United States Patent 11,078,247 (RNA ENCODING A THERAPEUTIC PROTEIN) - sequence listing, part 8

SEQ ID NO: 16330 - RNA, 6342 nt, Artificial Sequence
  DSCAML1__Homo_sapiens__NP_065744
augaccggcgccggcgagcccagaagagaggagccccccccccagcccagcgccggccugagaagcagagagagcggcgcccccagcgccggcggcugggagagagccgagagaggcagaggcgccgccgccagacccgccaccggccccccccccagaagaaucggcccccuguacggcauguggcuggugaccuuccugcugcugcuggacagccugcacaaggccagacccgaggacgugggcaccagccuguacuucgugaacgacagccugcagcaggugaccuucagcagcagcgugggcgugguggugcccugccccgccgccggcagccccagcgccgcccugagaugguaccuggccaccggcgacgacaucuacgacgugccccacaucagacacgugcacgccaacggcacccugcagcuguaccccuucagccccagcgccuucaacagcuucauccacgacaacgacuacuucugcaccgccgagaacgccgccggcaagaucagaagccccaacaucagagugaaggccguguucagagagcccuacaccgugagaguggaggaccagagaagcaugagaggcaacguggccguguucaagugccugauccccagcagcgugcaggaguacgugagcguggugagcugggagaaggacaccgugagcaucauccccgagcacagauucuucaucaccuaccacggcggccuguacaucagcgacgugcagaaggaggacgcccugagcaccuacagaugcaucaccaagcacaaguacagcggcgagaccagacagagcaacggcgccagacugagcgugaccgaccccgccgagagcauccccaccauccuggacggcuuccacagccaggaggugugggccggccacaccguggagcugcccugcaccgccagcggcuaccccauccccgccaucagauggcugaaggacggcagaccccugcccgccgacagcagauggaccaagagaaucaccggccugaccaucagcgaccugagaaccgaggacagcggcaccuacaucugcgaggugaccaacaccuucggcagcgccgaggccaccggcauccugauggugaucgacccccugcacgugacccugacccccaagaagcugaagaccggcaucggcagcaccgugauccugagcugcgcccugaccggcagccccgaguucaccaucagaugguacagaaacaccgagcuggugcugcccgacgaggccaucagcaucagaggccugagcaacgagacccugcugaucaccagcgcccagaagagccacagcggcgccuaccagugcuucgccaccagaaaggcccagaccgcccaggacuucgccaucaucgcccuggaggacggcacccccagaaucgugagcagcuucagcgagaagguggugaaccccggcgagcaguucagccugaugugcgccgccaagggcgcccccccccccaccgugaccugggcccuggacgacgagcccaucgugagagacggcagccacagaaccaaccaguacaccaugagcgacggcaccaccaucagccacaugaacgugaccggcccccagaucagagacggcggcguguacagaugcaccgccagaaaccuggugggcagcgccgaguaccaggccagaaucaacgugagaggcccccccagcaucagagccaugagaaacaucaccgccguggccggcagagacacccugaucaacugcagagugaucggcuaccccuacuacagcaucaagugguacaaggacgcccugcugcugcccgacaaccacagacaggugguguucgagaacggcacccugaagcugaccgacgugcagaagggcauggacgagggcgaguaccugugcagcgugcugauccagccccagcugagcaucagccagagcgugcacguggccgugaaggugcccccccugauccagcccuucgaguucccccccgccagcaucggccagcugcuguacauccccugcguggugagcagcggcgacaugcccaucagaaucaccuggagaaaggacggccaggugaucaucagcggcagcggcgugaccaucgagagcaaggaguucaugagcagccugcagaucagcagcgugagccugaagcacaacggcaacuacaccugcaucgccagcaacgccgccgccaccgugagcagagagagacagcugaucgugagagugccccccagauucguggugcagcccaacaaccaggacggcaucuacggcaaggccggcgugcugaacugcagcguggacggcuaccccccccccaaggugauguggaagcacgccaagggcagcggcaacccccagcaguaccaccccgugccccugaccggcagaauccagauccugcccaacagcagccugcugaucagacacgugcuggaggaggacaucggcuacuaccugugccaggccagcaacggcgugggcaccgacaucagcaagagcauguuccugaccgugaagauccccgccaugaucaccagccaccccaacaccaccaucgccaucaagggccacgccaaggagcugaacugcaccgccagaggcgagagacccaucaucaucagaugggagaagggcgacaccgugaucgaccccgacagagugaugagauacgccaucgccaccaaggacaacggcgacgagguggugagcacccugaagcugaagcccgccgacagaggcgacagcguguucuucagcugccacgccaucaacagcuacggcgaggacagaggccugauccagcugaccgugcaggagccccccgacccccccgagcuggagaucagagaggugaaggccagaagcaugaaccugagauggacccagagauucgacggcaacagcaucaucaccggcuucgacaucgaguacaagaacaagagcgacagcugggacuucaagcagagcaccagaaacaucagccccaccaucaaccaggccaacaucguggaccugcaccccgccagcguguacagcaucagaauguacagcuucaacaagaucggcagaagcgagcccagcaaggagcugaccaucagcaccgaggaggccgcccccgacggcccccccauggacgugacccugcagcccgugaccagccagagcauccaggugaccuggaaggcccccaagaaggagcugcagaacggcgugaucagaggcuaccagaucggcuacagagagaacagccccggcagcaacggccaguacagcaucguggagaugaaggccaccggcgacagcgagguguacacccuggacaaccugaagaaguucgcccaguacggcgugguggugcaggccuucaacagagccggcaccggccccagcagcagcgagaucaacgccaccacccuggaggacgugcccagccagccccccgagaacgugagagcccugagcaucaccagcgacguggccgugaucagcuggagcgagccccccagaagcacccugaacggcgugcugaagggcuacagagugaucuucuggagccuguacguggacggcgaguggggcgagaugcagaacaucaccaccaccagagagagaguggagcugagaggcauggagaaguucaccaacuacagcgugcaggugcuggccuacacccaggccggcgacggcgugagaagcagcgugcuguacauccagaccaaggaggacgugcccggcccccccgccggcaucaaggccgugcccagcagcgccagcagcgugguggugagcuggcugccccccaccaagcccaacggcgugaucagaaaguacaccaucuucugcagcagccccggcagcggccagcccgcccccagcgaguacgagaccagccccgagcagcuguucuacagaaucgcccaccugaacagaggccagcaguaccugcuguggguggccgccgugaccagcgccggcagaggcaacagcagcgagaaggugaccaucgagcccgccggcaaggcccccgccaagaucaucagcuucggcggcaccgugaccacccccuggaugaaggacgugagacugcccugcaacagcgugggcgaccccgcccccgccgugaaguggaccaaggacagcgaggacagcgccauccccgugagcauggacggccacagacugauccacaccaacggcacccugcugcugagagccgugaaggccgaggacagcggcuacuacaccugcaccgccaccaacaccggcggcuucgacaccaucaucgugaaccugcuggugcaggugccccccgaccagcccagacugaccgugagcaagaccagcgccagcagcaucacccugaccuggauccccggcgacaacggcggcagcagcaucagaggcuucgugcugcaguacagcguggacaacagcgaggaguggaaggacguguucaucagcagcagcgagagaagcuucaagcuggacagccugaagugcggcaccugguacaaggugaagcuggccgccaagaacagcgugggcagcggcagaaucagcgagaucaucgaggccaagacccacggcagagagcccagcuucagcaaggaccagcaccuguucacccacaucaacagcacccacgccagacugaaccugcagggcuggaacaacggcggcugccccaucaccgccaucgugcuggaguacagacccaagggcaccugggccuggcagggccugagagccaacagcagcggcgagguguuccugaccgagcugagagaggccaccugguacgagcugagaaugagagccugcaacagcgccggcugcggcaacgagaccgcccaguucgccacccuggacuacgacggcagcaccaucccccccaucaagagcgcccagggcgagggcgacgacgugaagaagcuguucaccaucggcugccccgugauccuggccacccugggcguggcccugcuguucaucgugagaaagaagagaaaggagaagagacugaagagacugagagacgccaagagccuggccgagaugcugaucagcaagaacaacagaagcuucgacacccccgugaagggccccccccagggccccagacugcacaucgacauccccagagugcagcugcugaucgaggacaaggagggcaucaagcagcugggcgacgacaaggccaccauccccgugaccgacgccgaguucagccaggccgugaacccccagagcuucugcaccggcgugagccugcaccaccccacccugauccagagcaccggcccccugaucgacaugagcgacaucagacccggcaccaaccccgugagcagaaagaacgugaagagcgcccacagcaccagaaacagauacagcagccaguggacccugaccaagugccaggccagcacccccgccagaacccugaccagcgacuggagaaccgugggcagccagcacggcgugaccgugaccgagagcgacagcuacagcgccagccugagccaggacaccgacaagggcagaaacagcauggugagcaccgagagcgccagcagcaccuacgaggagcuggccagagccuacgagcacgccaagcuggaggagcagcugcagcacgccaaguucgagaucaccgagugcuucaucagcgacagcagcagcgaccagaugaccaccggcaccaacgagaacgccgacagcaugaccagcaugagcacccccagcgagcccggcaucugcagauucaccgccagcccccccaagccccaggacgccgacagaggcaagaacguggccgugcccaucccccacagagccaacaagagcgacuacugcaaccugccccuguacgccaagagcgaggccuucuucagaaaggccgacggcagagagcccugccccguggugccccccagagaggccagcaucagaaaccuggccagaaccuaccacacccaggccagacaccugacccuggaccccgccagcaagagccugggccugccccaccccggcgcccccgccgccgccagcaccgccacccugccccagagaacccuggccaugcccgccccccccgccggcaccgccccccccgcccccggccccacccccgccgagccccccaccgcccccagcgccgccccccccgcccccagcaccgagccccccagagccggcggcccccacaccaagaugggcggcagcagagacagccugcuggagaugagcaccagcggcgugggcagaagccagaagcagggcgccggcgccuacagcaagagcuacacccugguguaa

SEQ ID NO: 16331 - RNA, 1182 nt, Artificial Sequence
  DSCC1__Homo_sapiens__NP_076999
augaagagaaccagagacgagguggacgccacccugcagaucgccaagcugaacgccgccgagcugcugcccgccgugcacugccugggcuucggccccggcgccagcggcgccgccgccggcgacuucugccugcuggagcuggagcccacccugugccagcagcuggaggacggccacagccuggugaucagaggcgacaaggacgagcaggccgugcugugcagcaaggacaagaccuacgaccugaagaucgccgacaccagcaacaugcugcuguucauccccggcugcaagacccccgaccagcugaagaaggaggacagccacugcaacaucauccacaccgagaucuucggcuucagcaacaacuacugggagcugagaagaagaagacccaagcugaagaagcugaagaagcugcugauggagaaccccuacgagggccccgacagccagaaggagaaggacagcaacagcagcaaguacaccaccgaggaccugcuggaccagauccaggccagcgaggaggagaucaugacccagcugcaggugcugaacgccugcaagaucggcggcuacuggagaauccuggaguucgacuacgagaugaagcugcugaaccacgugacccagcugguggacagcgagagcuggagcuucggcaaggugccccugaacaccugccugcaggagcugggcccccuggagcccgaggagaugaucgagcacugccugaagugcuacggcaagaaguacguggacgagggcgagguguacuucgagcuggacgccgacaagaucugcagagccgccgccagaaugcugcugcagaacgccgugaaguucaaccuggccgaguuccaggagguguggcagcagagcgugcccgagggcauggugaccagccuggaccagcugaagggccuggcccugguggacagacacagcagacccgagaucaucuuccugcugaagguggacgaccugcccgaggacaaccaggagagauucaacagccuguucagccugagagagaaguggaccgaggaggacaucgcccccuacauccaggaccugugcggcgagaagcagaccaucggcgcccugcugaccaaguacagccacagcagcaugcagaacggcgugaagguguacaacagcagaagacccaucagcuaa

SEQ ID NO: 16332 - RNA, 357 nt, Artificial Sequence
  DSCR4__Homo_sapiens__NP_005858
augagccugaucauccugaccagagacgacgagcccagaaucuucacccccgacagcgacgccgccagccccgcccugcacagcaccagcccccugcccgaccccgccagcgccagcccccugcacagagaggagaagauccugcccaaggugugcaacaucgugagcugccugagcuucagccugcccgccagccccaccgacagcggccuggccagccccaccaucaucaccagagagggccagcaguucugggccaagugccugaucuggaaguaccagcuguaccugcacggccugcacaagaagagcgacggcagaagagacaagcagaucagcgccagccccagcaccuaa

SEQ ID NO: 16333 - RNA, 2877 nt, Artificial Sequence
  DSE__Homo_sapiens__NP_037484
augagaacccacaccagaggcgcccccagcguguucuucaucuaccugcugugcuucgugagcgccuacaucaccgacgagaaccccgaggugaugauccccuucaccaacgccaacuacgacagccaccccaugcuguacuucagcagagccgagguggccgagcugcagcugagagccgccagcagccacgagcacaucgccgccagacugaccgaggccgugcacaccaugcugagcagcccccuggaguaccugccccccugggaccccaaggacuacagcgccagauggaacgagaucuucggcaacaaccugggcgcccuggccauguucugcgugcuguaccccgagaacaucgaggccagagacauggccaaggacuacauggagagaauggccgcccagcccagcuggcuggugaaggacgcccccugggacgaggugccccuggcccacagccuggugggcuucgccaccgccuacgacuuccuguacaacuaccugagcaagacccagcaggagaaguuccuggaggugaucgccaacgccagcggcuacauguacgagaccagcuacagaagaggcuggggcuuccaguaccugcacaaccaccagcccaccaacugcauggcccugcugaccggcagccuggugcugaugaaccagggcuaccugcaggaggccuaccuguggaccaagcaggugcugaccaucauggagaagagccuggugcugcugagagaggugaccgacggcagccuguacgagggcguggccuacggcagcuacaccaccagaagccuguuccaguacauguuccuggugcagagacacuucaacaucaaccacuucggccaccccuggcugaagcagcacuucgccuucauguacagaaccauccugcccggcuuccagagaaccguggccaucgccgacagcaacuacaacugguucuacggccccgagagccagcugguguuccuggacaaguucgugaugagaaacggcagcggcaacuggcuggccgaccagaucagaagaaacagagugguggagggccccggcacccccagcaagggccagagauggugcacccugcacaccgaguuccugugguacgacggcagccugaagagcgugcccccccccgacuucggcacccccacccugcacuacuucgaggacuggggcguggugaccuacggcagcgcccugcccgccgagaucaacagaagcuuccugagcuucaagagcggcaagcugggcggcagagccaucuacgacaucgugcacagaaacaaguacaaggacuggaucaagggcuggagaaacuucaacgccggccacgagcaccccgaccagaacagcuucaccuucgcccccaacggcgugcccuucaucaccgaggcccuguacggccccaaguacaccuucuucaacaacgugcugauguucagccccgccgugagcaagagcugcuucagccccugggugggccaggugaccgaggacugcagcagcaaguggagcaaguacaagcacgaccuggccgccagcugccagggcagagugguggccgccgaggagaagaacggcgugguguucaucagaggcgagggcgugggcgccuacaacccccagcugaaccugaagaacgugcagagaaaccugauccugcugcacccccagcugcugcugcugguggaccagauccaccugggcgaggagagcccccuggagaccgccgccagcuucuuccacaacguggacgugcccuucgaggagaccgugguggacggcgugcacggcgccuucaucagacagagagacggccuguacaagauguacuggauggacgacaccggcuacagcgagaaggccaccuucgccagcgugaccuaccccagaggcuaccccuacaacggcaccaacuacgugaacgugaccaugcaccugagaagccccaucaccagagccgccuaccuguucaucggccccagcaucgacgugcagagcuucaccgugcacggcgacagccagcagcuggacguguucaucgccaccagcaagcacgccuacgccaccuaccuguggaccggcgaggccaccggccagagcgccuucgcccaggugaucgccgacagacacaagauccuguucgacagaaacagcgccaucaagagcagcaucgugcccgaggugaaggacuacgccgccaucguggagcagaaccugcagcacuucaagcccguguuccagcugcuggagaagcagauccugagcagagugagaaacaccgccagcuucagaaagaccgccgagagacugcugagauucagcgacaagagacagaccgaggaggccaucgacagaaucuucgccaucagccagcagcagcagcagcagagcaagagcaagaagaacagaagagccggcaagagauacaaguucguggacgccgugcccgacaucuucgcccagaucgaggugaacgagaagaagaucagacagaaggcccagauccuggcccagaaggagcugcccaucgacgaggacgaggagaugaaggaccugcuggacuucgccgacgugaccuacgagaagcacaagaacggcggccugaucaagggcagauucggccaggccagaauggugaccaccacccacagcagagcccccagccugagcgccagcuacaccagacuguuccugauccugaacaucgccaucuucuucgugaugcuggccaugcagcugaccuacuuccagagagcccagagccugcacggccagagaugccuguacgccgugcugcugaucgacagcugcauccugcuguggcuguacagcagcugcagccagagccagugcuaa

SEQ ID NO: 16334 - RNA, 3669 nt, Artificial Sequence
  DSEL__Homo_sapiens__NP_115536
augcccaagggcggcgccccccccuggaucauggcccugauguucaccggccaccugcuguuccuggcccugcugauguucgccuucagcaccuucgaggagagcgugagcaacuacagcgagugggccguguucaccgacgacaucgaccaguucaagacccagaaggugcaggacuucagacccaaccagaagcugaagaagagcaugcugcaccccagccuguacuucgacgccggcgagauccaggccaugagacagaagagcagagccagccaccugcaccuguucagagccaucagaagcgccgugaccgugaugcugagcaaccccaccuacuaccugcccccccccaagcacgccgacuucgccgccaaguggaacgagaucuacggcaacaaccugcccccccuggcccuguacugccugcugugccccgaggacaagguggccuucgaguucgugcuggaguacauggacagaauggugggcuacaaggacuggcugguggagaacgcccccggcgacgaggugcccaucggccacagccugaccggcuucgccaccgccuucgacuuccuguacaaccugcuggacaaccacagaagacagaaguaccuggagaagaucugggugaucaccgaggagauguacgaguacagcaaggugagaagcuggggcaagcagcugcugcacaaccaccaggccaccaacaugaucgcccugcugaccggcgcccuggugaccggcguggacaagggcagcaaggccaacaucuggaagcaggccgugguggacgugauggagaagaccauguuccugcugaaccacaucguggacggcagccuggacgagggcguggccuacggcagcuacaccgccaagagcgugacccaguacguguuccuggcccagagacacuucaacaucaacaaccuggacaacaacuggcugaagaugcacuucugguucuacuacgccacccugcugcccggcuuccagagaaccgugggcaucgccgacagcaacuacaacugguucuacggccccgagagccagcugguguuccuggacaaguucauccugaagaacggcgccggcaacuggcuggcccagcagaucagaaagcacagacccaaggacggccccauggugcccagcaccgcccagagauggagcacccugcacaccgaguacaucugguacgacccccagcugaccccccagccccccgccgacuacggcaccgccaagauccacaccuuccccaacuggggcguggugaccuacggcgccggccugcccaacacccagaccaacaccuucgugagcuucaagagcggcaagcugggcggcagagccguguacgacaucgugcacuuccagcccuacagcuggaucgacggcuggagaagcuucaaccccggccacgagcaccccgaccagaacagcuucaccuucgcccccaacggccagguguucgugagcgaggcccuguacggccccaagcugagccaccugaacaacgugcugguguucgcccccagccccagcagccagugcaacaagcccugggagggccagcugggcgagugcgcccaguggcugaaguggaccggcgaggaggugggcgacgccgccggcgagaucaucaccgccagccagcacggcgagaugguguucgugagcggcgaggccgugagcgccuacagcagcgccaugagacugaagagcguguacagagcccugcugcugcugaacagccagacccugcuggugguggaccacaucgagagacaggaggacagccccaucaacagcgugagcgccuucuuccacaaccuggacaucgacuucaaguacauccccuacaaguucaugaacagauacaacggcgccaugauggacgugugggacgcccacuacaagauguucugguucgaccaccacggcaacagccccauggccagcauccaggaggccgagcaggccgccgaguucaagaagagauggacccaguucgugaacgugaccuuccagauggagcccaccaucaccagaaucgccuacguguucuacggccccuacaucaacgugagcagcugcagauucaucgacagcagcaaccccggccugcagaucagccugaacgugaacaacaccgagcacguggugagcaucgugaccgacuaccacaaccugaagaccagauucaacuaccugggcuucggcggcuucgccagcguggccgaccagggccagaucaccagauucggccugggcacccaggccaucgugaagcccgugagacacgacagaaucaucuuccccuucggcuucaaguucaacaucgccgugggccugauccugugcaucagccuggugauccugaccuuccaguggagauucuaccugagcuucagaaagcugaugagauggauccugauccuggugaucgcccugugguucaucgagcugcuggacguguggagcaccugcagccagcccaucugcgccaaguggaccagaaccgaggccgagggcagcaagaagagccugagcagcgagggccaccacauggaccugcccgacguggugaucaccagccugcccggcagcggcgccgagauccugaagcagcuguucuucaacagcagcgacuuccuguacaucagagugcccaccgccuacaucgacauccccgagaccgagcuggagaucgacagcuucguggacgccugcgaguggaaggugagcgacaucagaagcggccacuucagacugcugagaggcuggcugcagagccuggugcaggacaccaagcugcaccugcagaacauccaccugcacgagcccaacagaggcaagcuggcccaguacuucgccaugaacaaggacaagaagagaaaguucaagagaagagagagccugcccgagcagagaagccagaugaagggcgccuucgacagagacgccgaguacaucagagcccugagaagacaccugguguacuaccccagcgccagacccgugcugagccugagcagcggcagcuggacccugaagcugcacuucuuccaggaggugcugggcgccagcaugagagcccuguacaucgugagagaccccagagccuggaucuacagcaugcuguacaacagcaagcccagccuguacagccugaagaacgugcccgagcaccuggccaagcuguucaagaucgagggcggcaagggcaagugcaaccugaacagcggcuacgccuucgaguacgagccccugagaaaggagcugagcaagagcaagagcaacgccgugagccugcugagccaccuguggcuggccaacaccgccgccgcccugagaaucaacaccgaccugcugcccaccagcuaccagcuggugaaguucgaggacaucgugcacuucccccagaagaccaccgagagaaucuucgccuuccugggcaucccccugagccccgccagccugaaccagauccuguucgccaccagcaccaaccuguucuaccugcccuacgagggcgagaucagccccaccaacaccaacguguggaagcagaaccugcccagagacgagaucaagcugaucgagaacaucugcuggacccugauggacagacugggcuaccccaaguucauggacuaa

SEQ ID NO: 16335 - RNA, 3150 nt, Artificial Sequence
  DSG1__Homo_sapiens__NP_001933
auggacuggagcuucuucagagugguggccaugcuguucaucuuccugguggugguggaggugaacagcgaguucagaauccaggugagagacuacaacaccaagaacggcaccaucaaguggcacagcaucagaagacagaagagagaguggaucaaguucgccgccgccugcagagagggcgaggacaacagcaagagaaaccccaucgccaagauccacagcgacugcgccgccaaccagcaggugaccuacagaaucagcggcgugggcaucgaccagccccccuacggcaucuucgugaucaaccagaagaccggcgagaucaacaucaccagcaucguggacagagaggugacccccuucuucaucaucuacugcagagcccugaacagcaugggccaggaccuggagagaccccuggagcugagagugagagugcuggacaucaacgacaacccccccguguucagcauggccaccuucgccggccagaucgaggagaacagcaacgccaacacccuggugaugauccugaacgccaccgacgccgacgagcccaacaaccugaacagcaagaucgccuucaagaucaucagacaggagcccagcgacagccccauguucaucaucaacagaaacaccggcgagaucagaaccaugaacaacuuccuggacagagagcaguacggccaguacgcccuggccgugagaggcagcgacagagacggcggcgccgacggcaugagcgccgagugcgagugcaacaucaagauccuggacgugaacgacaacauccccuacauggagcagagcagcuacaccaucgagauccaggagaacacccugaacagcaaccugcuggagaucagagugaucgaccuggacgaggaguucagcgccaacuggauggccgugaucuucuucaucagcggcaacgagggcaacugguucgagaucgagaugaacgagagaaccaacgugggcauccugaagguggugaagccccuggacuacgaggccaugcagagccugcagcugagcaucggcgugagaaacaaggccgaguuccaccacagcaucaugagccaguacaagcugaaggccagcgccaucagcgugaccgugcugaacgugaucgagggccccguguucagacccggcagcaagaccuacguggugaccggcaacaugggcagcaacgacaaggugggcgacuucguggccaccgaccuggacaccggcagacccagcaccaccgugagauacgugaugggcaacaaccccgccgaccugcuggccguggacagcagaaccggcaagcugacccugaagaacaaggugaccaaggagcaguacaacaugcugggcggcaaguaccagggcaccauccugagcaucgacgacaaccugcagagaaccugcaccggcaccaucaacaucaacauccagagcuucggcaacgacgacagaaccaacaccgagcccaacaccaagaucaccaccaacaccggcagacaggagagcaccagcagcaccaacuacgacaccagcaccaccagcaccgacagcagccagguguacagcagcgagcccggcaacggcgccaaggaccugcugagcgacaacgugcacuucggccccgccggcaucggccugcugaucaugggcuuccuggugcugggccuggugcccuuccugaugaucugcugcgacugcggcggcgcccccagaagcgccgccggcuucgagcccgugcccgagugcagcgacggcgccauccacagcugggccguggagggcccccagcccgagcccagagacaucaccaccgugaucccccagaucccccccgacaacgccaacaucaucgagugcaucgacaacagcggcguguacaccaacgaguacggcggcagagagaugcaggaccugggcggcggcgagagaaugaccggcuucgagcugaccgagggcgugaagaccagcggcaugcccgagaucugccaggaguacagcggcacccugagaagaaacagcaugagagagugcagagagggcggccugaacaugaacuucauggagagcuacuucugccagaaggccuacgccuacgccgacgaggacgagggcagacccagcaacgacugccugcugaucuacgacaucgagggcgugggcagccccgccggcagcgugggcugcugcagcuucaucggcgaggaccuggacgacagcuuccuggacacccugggccccaaguucaagaagcuggccgacaucagccugggcaaggagagcuaccccgaccuggaccccagcuggcccccccagagcaccgagcccgugugccugccccaggagaccgagcccguggugagcggccacccccccaucagcccccacuucggcaccaccaccgugaucagcgagagcaccuaccccagcggccccggcgugcugcaccccaagcccauccuggacccccugggcuacggcaacgugaccgugaccgagagcuacaccaccagcgacacccugaagcccagcgugcacgugcacgacaacagacccgccagcaacgugguggugaccgagagaguggugggccccaucagcggcgccgaccugcacggcaugcuggagaugcccgaccugagagacggcagcaacgugaucgugaccgagagagugaucgcccccagcagcagccugcccaccagccugaccauccaccaccccagagagagcagcaacgugguggugaccgagagagugauccagcccaccagcggcaugaucggcagccugagcaugcaccccgagcuggccaacgcccacaacgugaucgugaccgagagaguggugagcggcgccggcgugaccggcaucagcggcaccaccggcaucagcggcggcaucggcagcagcggccuggugggcaccagcaugggcgccggcagcggcgcccugagcggcgccggcaucagcggcggcggcaucggccugagcagccugggcggcaccgccagcaucggccacaugagaagcagcagcgaccaccacuucaaccagaccaucggcagcgccagccccagcaccgccagaagcagaaucaccaaguacagcaccgugcaguacagcaaguaa

SEQ ID NO: 16336 - RNA, 3357 nt, Artificial Sequence
  DSG2__Homo_sapiens__NP_001934
auggccagaagccccggcagagccuacgcccugcugcugcugcugaucugcuucaacgugggcagcggccugcaccugcaggugcugagcaccagaaacgagaacaagcugcugcccaagcacccccaccuggugagacagaagagagccuggaucaccgcccccguggcccugagagagggcgaggaccugagcaagaagaaccccaucgccaagauccacagcgaccuggccgaggagagaggccugaagaucaccuacaaguacaccggcaagggcaucaccgagccccccuucggcaucuucguguucaacaaggacaccggcgagcugaacgugaccagcauccuggacagagaggagacccccuucuuccugcugaccggcuacgcccuggacgccagaggcaacaacguggagaagccccuggagcugagaaucaaggugcuggacaucaacgacaacgagcccguguucacccaggacguguucgugggcagcguggaggagcugagcgccgcccacacccuggugaugaagaucaacgccaccgacgccgacgagcccaacacccugaacagcaagaucagcuacagaaucgugagccuggagcccgccuacccccccguguucuaccugaacaaggacaccggcgagaucuacaccaccagcgugacccuggacagagaggagcacagcagcuacacccugaccguggaggccagagacggcaacggcgaggugaccgacaagcccgugaagcaggcccaggugcagaucagaauccuggacgugaacgacaacauccccgugguggagaacaaggugcuggagggcaugguggaggagaaccaggugaacguggaggugaccagaaucaagguguucgacgccgacgagaucggcagcgacaacuggcuggccaacuucaccuucgccagcggcaacgagggcggcuacuuccacaucgagaccgacgcccagaccaacgagggcaucgugacccugaucaaggagguggacuacgaggagaugaagaaccuggacuucagcgugaucguggccaacaaggccgccuuccacaagagcaucagaagcaaguacaagcccacccccauccccaucaaggugaaggugaagaacgugaaggagggcauccacuucaagagcagcgugaucagcaucuacgugagcgagagcauggacagaagcagcaagggccagaucaucggcaacuuccaggccuucgacgaggacaccggccugcccgcccacgccagauacgugaagcuggaggacagagacaacuggaucagcguggacagcgugaccagcgagaucaagcuggccaagcugcccgacuucgagagcagauacgugcagaacggcaccuacaccgugaagaucguggccaucagcgaggacuaccccagaaagaccaucaccggcaccgugcugaucaacguggaggacaucaacgacaacugccccacccugaucgagcccgugcagaccaucugccacgacgccgaguacgugaacgugaccgccgaggaccuggacggccaccccaacagcggccccuucagcuucagcgugaucgacaagccccccggcauggccgagaaguggaagaucgccagacaggagagcaccagcgugcugcugcagcagagcgagaagaagcugggcagaagcgagauccaguuccugaucagcgacaaccagggcuucagcugccccgagaagcaggugcugacccugaccgugugcgagugccugcacggcagcggcugcagagaggcccagcacgacagcuacgugggccugggccccgccgccaucgcccugaugauccuggccuuccugcugcugcugcuggugccccugcugcugcugaugugccacugcggcaagggcgccaagggcuucacccccauccccggcaccaucgagaugcugcaccccuggaacaacgagggcgccccccccgaggacaagguggugcccagcuuccugcccguggaccagggcggcagccuggugggcagaaacggcgugggcggcauggccaaggaggccaccaugaagggcagcagcagcgccagcaucgugaagggccagcacgagaugagcgagauggacggcagaugggaggagcacagaagccugcugagcggcagagccacccaguucaccggcgccaccggcgccaucaugaccaccgagaccaccaagaccgccagagccaccggcgccagcagagacauggccggcgcccaggccgccgccguggcccugaacgaggaguuccugagaaacuacuucaccgacaaggccgccagcuacaccgaggaggacgagaaccacaccgccaaggacugccugcugguguacagccaggaggagaccgagagccugaacgccagcaucggcugcugcagcuucaucgagggcgagcuggacgacagauuccuggacgaccugggccugaaguucaagacccuggccgaggugugccugggccagaagaucgacaucaacaaggagaucgagcagagacagaagcccgccaccgagaccagcaugaacaccgccagccacagccugugcgagcagaccauggugaacagcgagaacaccuacagcagcggcagcagcuuccccgugcccaagagccugcaggaggccaacgccgagaaggugacccaggagaucgugaccgagagaagcgugagcagcagacaggcccagaagguggccaccccccugcccgaccccauggccagcagaaacgugaucgccaccgagaccagcuacgugaccggcagcaccaugccccccaccaccgugauccugggccccagccagccccagagccugaucgugaccgagagaguguacgcccccgccagcacccugguggaccagcccuacgccaacgagggcaccgugguggugaccgagagagugauccagccccacggcggcggcagcaacccccuggagggcacccagcaccugcaggacgugcccuacgugauggugagagagagagagagcuuccuggcccccagcagcggcgugcagcccacccuggccaugcccaacaucgccgugggccagaacgugaccgugaccgagagagugcuggcccccgccagcacccugcagagcagcuaccagauccccaccgagaacagcaugaccgccagaaacaccaccgugagcggcgccggcgugcccggcccccugcccgacuucggccuggaggagagcggccacagcaacagcaccaucaccaccagcagcaccagagugaccaagcacagcaccgugcagcacagcuacagcuaa

SEQ ID NO: 16337 - RNA, 3000 nt, Artificial Sequence
  DSG3__Homo_sapiens__NP_001935
augaugggccuguuccccagaaccaccggcgcccuggccaucuucgugguggugauccuggugcacggcgagcugagaaucgagaccaagggccaguacgacgaggaggagaugaccaugcagcaggccaagagaagacagaagagagagugggugaaguucgccaagcccugcagagagggcgaggacaacagcaagagaaaccccaucgccaagaucaccagcgacuaccaggccacccagaagaucaccuacagaaucagcggcgugggcaucgaccagccccccuucggcaucuucgugguggacaagaacaccggcgacaucaacaucaccgccaucguggacagagaggagacccccagcuuccugaucaccugcagagcccugaacgcccagggccuggacguggagaagccccugauccugaccgugaagauccuggacaucaacgacaacccccccguguucagccagcagaucuucaugggcgagaucgaggagaacagcgccagcaacagccuggugaugauccugaacgccaccgacgccgacgagcccaaccaccugaacagcaagaucgccuucaagaucgugagccaggagcccgccggcacccccauguuccugcugagcagaaacaccggcgaggugagaacccugaccaacagccuggacagagagcaggccagcagcuacagacugguggugagcggcgccgacaaggacggcgagggccugagcacccagugcgagugcaacaucaaggugaaggacgugaacgacaacuuccccauguucagagacagccaguacagcgccagaaucgaggagaacauccugagcagcgagcugcugagauuccaggugaccgaccuggacgaggaguacaccgacaacuggcuggccguguacuucuucaccagcggcaacgagggcaacugguucgagauccagaccgaccccagaaccaacgagggcauccugaagguggugaaggcccuggacuacgagcagcugcagagcgugaagcugagcaucgccgugaagaacaaggccgaguuccaccagagcgugaucagcagauacagagugcagagcacccccgugaccauccaggugaucaacgugagagagggcaucgccuucagacccgccagcaagaccuucaccgugcagaagggcaucagcagcaagaagcugguggacuacauccugggcaccuaccaggccaucgacgaggacaccaacaaggccgccagcaacgugaaguacgugaugggcagaaacgacggcggcuaccugaugaucgacagcaagaccgccgagaucaaguucgugaagaacaugaacagagacagcaccuucaucgugaacaagaccaucaccgccgaggugcuggccaucgacgaguacaccggcaagaccagcaccggcaccguguacgugagagugcccgacuucaacgacaacugccccaccgccgugcuggagaaggacgccgugugcagcagcagccccagcgugguggugagcgccagaacccugaacaacagauacaccggccccuacaccuucgcccuggaggaccagcccgugaagcugcccgccguguggagcaucaccacccugaacgccaccagcgcccugcugagagcccaggagcagaucccccccggcguguaccacaucagccuggugcugaccgacagccagaacaacagaugcgagaugcccagaagccugacccuggaggugugccagugcgacaacagaggcaucugcggcaccagcuaccccaccaccagccccggcaccagauacggcagaccccacagcggcagacugggccccgccgccaucggccugcugcugcugggccugcugcugcugcugcuggccccccugcugcugcugaccugcgacugcggcgccggcagcaccggcggcgugaccggcggcuucauccccgugcccgacggcagcgagggcaccauccaccaguggggcaucgagggcgcccaccccgaggacaaggagaucaccaacaucugcgugccccccgugaccgccaacggcgccgacuucauggagagcagcgaggugugcaccaacaccuacgccagaggcaccgccguggagggcaccagcggcauggagaugaccaccaagcugggcgccgccaccgagagcggcggcgccgccggcuucgccaccggcaccgugagcggcgccgccagcggcuucggcgccgccaccggcgugggcaucugcagcagcggccagagcggcaccaugagaaccagacacagcaccggcggcaccaacaaggacuacgccgacggcgccaucagcaugaacuuccuggacagcuacuucagccagaaggccuucgccugcgccgaggaggacgacggccaggaggccaacgacugccugcugaucuacgacaacgagggcgccgacgccaccggcagccccgugggcagcgugggcugcugcagcuucaucgccgacgaccuggacgacagcuuccuggacagccugggccccaaguucaagaagcuggccgagaucagccugggcguggacggcgagggcaaggaggugcagccccccagcaaggacagcggcuacggcaucgagagcugcggccaccccaucgaggugcagcagaccggcuucgugaagugccagacccugagcggcagccagggcgccagcgcccugagcaccagcggcagcgugcagcccgccgugagcauccccgacccccugcagcacggcaacuaccuggugaccgagaccuacagcgccagcggcagccuggugcagcccagcaccgccggcuucgacccccugcugacccagaacgugaucgugaccgagagagugaucugccccaucagcagcgugcccggcaaccuggccggccccacccagcugagaggcagccacaccaugcugugcaccgaggaccccugcagcagacugaucuaa

SEQ ID NO: 16338 - RNA, 3180 nt, Artificial Sequence
  DSG4__Homo_sapiens__NP_001127925
auggacuggcuguucuucagaaacaucugccugcugaucauccugaugguggugauggaggugaacagcgaguucaucguggaggugaaggaguucgacaucgagaacggcaccaccaaguggcagaccgugagaagacagaagagagaguggaucaaguucgccgccgccugcagagagggcgaggacaacagcaagagaaaccccaucgccaagaucagaagcgacugcgagagcaaccagaagaucaccuacagaaucagcggcgugggcaucgacagaccccccuacggcguguucaccaucaaccccagaaccggcgagaucaacaucaccagcgugguggacagagagaucaccccccuguuccugaucuacugcagagcccugaacagcagaggcgaggaccuggagagaccccuggagcugagagugaaggugauggacaucaacgacaacgcccccguguucagccagagcguguacaccgccagcaucgaggagaacagcgacgccaacacccugguggugaagcugugcgccaccgacgccgacgaggagaaccaccugaacagcaagaucgccuacaagaucgugagccaggagcccagcggcgcccccauguucauccugaacagauacaccggcgaggugugcaccaugagcagcuuccuggacagagagcagcacagcauguacaaccugguggugagaggcagcgacagagacggcgccgccgacggccugagcagcgagugcgacugcagaaucaaggugcuggacgugaacgacaacuuccccacccuggagaagaccagcuacagcgccagcaucgaggagaacugccugagcagcgagcugaucagacugcaggccaucgaccuggacgaggagggcaccgacaacuggcuggcccaguaccugauccugagcggcaacgacggcaacugguucgacauccagaccgacccccagaccaacgagggcauccugaagguggugaagaugcuggacuacgagcaggcccccaacauccagcugagcaucggcgugaagaaccaggccgacuuccacuacagcguggccagccaguuccagaugcaccccacccccgugagaauccaggugguggacgugagagagggccccgccuuccaccccagcaccauggccuucagcgugagagagggcaucaagggcagcagccugcugaacuacgugcugggcaccuacaccgccaucgaccuggacaccggcaaccccgccaccgacgugagauacaucaucggccacgacgccggcagcuggcugaagaucgacagcagaaccggcgagauccaguucagcagagaguucgacaagaagagcaaguacaucaucaacggcaucuacaccgccgagauccuggccaucgacgacggcagcggcaagaccgccaccggcaccaucugcaucgaggugcccgacaucaacgacuacugccccaacaucuuccccgagagaagaaccaucugcaucgacagccccagcgugcugaucagcgugaacgagcacagcuacggcagccccuucaccuucugcgugguggacgagccccccggcaucgccgacaugugggacgugagaagcaccaacgccaccagcgccauccugaccgccaagcaggugcugagccccggcuucuacgagauccccauccuggugaaggacagcuacaacagagccugcgagcuggcccagauggugcagcuguacgccugcgacugcgacgacaaccacaugugccuggacagcggcgccgccggcaucuacaccgaggacaucaccggcgacaccuacggccccgugaccgaggaccaggccggcgugagcaacgugggccugggccccgccggcaucggcaugauggugcugggcauccugcugcugauccuggccccccugcugcugcugcugugcugcugcaagcagagacagcccgagggccugggcaccagauucgcccccgugcccgagggcggcgagggcgugaugcagagcuggagaaucgagggcgcccaccccgaggacagacuguucagcgccuacgcccugcccggcggcggcggcaccgccgacggcggcggcagcgugcugggcagaugcgcccugcaggccacccccgcccugcugaaccagcacccccccuucagcgagaucuacaccaacaccuacgccgccggcggcaccguggagggcggcgugagcggcguggagcugaacaccggcaugggcaccgccgugggccugauggccgccggcgccgccggcgccagcggcgccgccagaaagagaagcagcaccaugggcacccugagagacuacgccgacgccgacaucaacauggccuuccuggacagcuacuucagcgagaaggccuacgccuacgccgacgaggacgagggcagacccgccaacgacugccugcugaucuacgaccacgagggcgugggcagccccgugggcagcaucggcugcugcagcuggaucguggacgaccuggacgagagcugcauggagacccuggaccccaaguucagaacccuggccgagaucugccugaacaccgagaucgagcccuuccccagccaccaggccugcauccccaucagcaccgaccugccccugcugggccccaacuacuucgugaacgagagcagcggccugacccccagcgagguggaguuccaggaggagauggccgccagcgagcccguggugcacggcgacaucaucgugaccgagaccuacggcaacgccgaccccugcgugcagcccaccaccaucaucuucgacccccagcuggcccccaacgugguggugaccgaggccgugauggcccccguguacgacauccagggcaacaucugcgugcccgccgagcuggccgacuacaacaacgugaucuacgccgagagagugcuggccagccccggcgugcccgacaugagcaacagcagcaccaccgagggcugcaugggccccgugaugagcggcaacauccuggugggccccgagauccaggugaugcagaugaugagccccgaccugcccaucggccagaccgugggcagcaccagccccaugaccagcagacacagagugaccagauacagcaacauccacuacacccagcaguaa

SEQ ID NO: 16339 - RNA, 6819 nt, Artificial Sequence
  DSP__Homo_sapiens__NP_001008844
augagcugcaacggcggcagccaccccagaaucaacacccugggcagaaugaucagagccgagagcggccccgaccugagauacgaggugaccagcggcggcggcggcaccagcagaauguacuacagcagaagaggcgugaucaccgaccagaacagcgacggcuacugccagaccggcaccaugagcagacaccagaaccagaacaccauccaggagcugcugcagaacugcagcgacugccugaugagagccgagcugaucgugcagcccgagcugaaguacggcgacggcauccagcugaccagaagcagagagcuggacgagugcuucgcccaggccaacgaccagauggagauccuggacagccugaucagagagaugagacagaugggccagcccugcgacgccuaccagaagagacugcugcagcugcaggagcagaugagagcccuguacaaggccaucagcgugcccagagugagaagagccagcagcaagggcggcggcggcuacaccugccagagcggcagcggcugggacgaguucaccaagcacgugaccagcgagugccugggcuggaugagacagcagagagccgagauggacaugguggccuggggcguggaccuggccagcguggagcagcacaucaacagccacagaggcauccacaacagcaucggcgacuacagauggcagcuggacaagaucaaggccgaccugagagagaagagcgccaucuaccagcuggaggaggaguacgagaaccugcugaaggccagcuucgagagaauggaccaccugagacagcugcagaacaucauccaggccaccagcagagagaucauguggaucaacgacugcgaggaggaggagcugcuguacgacuggagcgacaagaacaccaacaucgcccagaagcaggaggccuucagcaucagaaugagccagcuggaggugaaggagaaggagcugaacaagcugaagcaggagagcgaccagcuggugcugaaccagcaccccgccagcgacaagaucgaggccuacauggacacccugcagacccaguggagcuggauccugcagaucaccaagugcaucgacgugcaccugaaggagaacgccgccuacuuccaguucuucgaggaggcccagagcaccgaggccuaccugaagggccugcaggacagcaucagaaagaaguaccccugcgacaagaacaugccccugcagcaccugcuggagcagaucaaggagcuggagaaggagagagagaagauccuggaguacaagagacaggugcagaaccuggugaacaagagcaagaagaucgugcagcugaagcccagaaaccccgacuacagaagcaacaagcccaucauccugagagcccugugcgacuacaagcaggaccagaagaucgugcacaagggcgacgagugcauccugaaggacaacaacgagagaagcaagugguacgugaccggccccggcggcguggacaugcuggugcccagcgugggccugaucauccccccccccaacccccuggccguggaccugagcugcaagaucgagcaguacuacgaggccauccuggcccuguggaaccagcuguacaucaacaugaagagccuggugagcuggcacuacugcaugaucgacaucgagaagaucagagccaugaccaucgccaagcugaagaccaugagacaggaggacuacaugaagaccaucgccgaccuggagcugcacuaccaggaguucaucagaaacagccagggcagcgagauguucggcgacgacgacaagagaaagauccagagccaguucaccgacgcccagaagcacuaccagacccuggugauccagcugcccggcuacccccagcaccagaccgugaccaccaccgagaucacccaccacggcaccugccaggacgugaaccacaacaaggugaucgagaccaacagagagaacgacaagcaggagaccuggaugcugauggagcugcagaagaucagaagacagaucgagcacugcgagggcagaaugacccugaagaaccugccccuggccgaccagggcagcagccaccacaucaccgugaagaucaacgagcugaagagcgugcagaacgacagccaggccaucgccgaggugcugaaccagcugaaggacaugcuggccaacuucagaggcagcgagaaguacugcuaccugcagaacgagguguucggccuguuccagaagcuggagaacaucaacggcgugaccgacggcuaccugaacagccugugcaccgugagagcccugcugcaggccauccugcagaccgaggacaugcugaagguguacgaggccagacugaccgaggaggagaccgugugccuggaccuggacaagguggaggccuacagaugcggccugaagaagaucaagaacgaccugaaccugaagaagagccugcuggccaccaugaagaccgagcugcagaaggcccagcagauccacagccagaccagccagcaguacccccuguacgaccuggaccugggcaaguucggcgagaaggugacccagcugaccgacagauggcagagaaucgacaagcagaucgacuucagacugugggaccuggagaagcagaucaagcagcugagaaacuacagagacaacuaccaggccuucugcaaguggcuguacgacgccaagagaagacaggacagccuggagagcaugaaguucggcgacagcaacaccgugaugagauuccugaacgagcagaagaaccugcacagcgagaucagcggcaagagagacaagagcgaggaggugcagaagaucgccgagcugugcgccaacagcaucaaggacuacgagcugcagcuggccagcuacaccagcggccuggagacccugcugaacauccccaucaagagaaccaugauccagagccccagcggcgugauccugcaggaggccgccgacgugcacgccagauacaucgagcugcugaccagaagcggcgacuacuacagauuccugagcgagaugcugaagagccuggaggaccugaagcugaagaacaccaagaucgaggugcuggaggaggagcugagacuggccagagacgccaacagcgagaacugcaacaagaacaaguuccuggaccagaaccugcagaaguaccaggccgagugcagccaguucaaggccaagcuggccagccuggaggagcugaagagacaggccgagcuggacggcaagagcgccaagcagaaccuggacaagugcuacggccagaucaaggagcugaacgagaagaucaccagacugaccuacgagaucgaggacgagaagagaagaagaaagagcguggaggacagauucgaccagcagaagaacgacuacgaccagcugcagaaggccagacagugcgagaaggagaaccugggcuggcagaagcuggagagcgagaaggccaucaaggagaaggaguacgagaucgagagacugagagugcugcugcaggaggagggcaccagaaagagagaguacgagaacgagcuggccaaggccagcaacagaauccaggagagcaagaaccagugcacccagguggugcaggagagagagagccugcuggugaagaucaaggugcuggagcaggacaaggccagacugcagagacuggaggacgagcugaacagagccaagagcacccuggaggccgagaccagagugaagcagagacuggagugcgagaagcagcagauccagaacgaccugaaccaguggaagacccaguacagcagaaaggaggaggccaucagaaagaucgagagcgagagagagaagagcgagagagagaagaacagccugagaagcgagaucgagagacugcaggccgagaucaagagaaucgaggagagaugcagaagaaagcuggaggacagcaccagagagacccagagccagcuggagaccgagagaagcagauaccagagagagaucgacaagcugagacagagacccuacggcagccacagagagacccagaccgagugcgaguggaccguggacaccagcaagcugguguucgacggccugagaaagaaggugaccgccaugcagcuguacgagugccagcugaucgacaagaccacccuggacaagcugcugaagggcaagaagagcguggaggagguggccagcgagauccagcccuuccugagaggcgccggcagcaucgccggcgccagcgccagccccaaggagaaguacagccugguggaggccaagagaaagaagcugaucagccccgagagcaccgugaugcugcuggaggcccaggccgccaccggcggcaucaucgacccccacagaaacgagaagcugaccguggacagcgccaucgccagagaccugaucgacuucgacgacagacagcagaucuacgccgccgagaaggccaucaccggcuucgacgaccccuucagcggcaagaccgugagcgugagcgaggccaucaagaagaaccugaucgacagagagaccggcaugagacugcuggaggcccagaucgccagcggcggcgugguggaccccgugaacagcguguuccugcccaaggacguggcccuggccagaggccugaucgacagagaccuguacagaagccugaacgaccccagagacagccagaagaacuucguggaccccgugaccaagaagaaggugagcuacgugcagcugaaggagagaugcagaaucgagccccacaccggccugcugcugcugagcgugcagaagagaagcaugagcuuccagggcaucagacagcccgugaccgugaccgagcugguggacagcggcauccugagacccagcaccgugaacgagcuggagagcggccagaucagcuacgacgaggugggcgagagaaucaaggacuuccugcagggcagcagcugcaucgccggcaucuacaacgagaccaccaagcagaagcugggcaucuacgaggccaugaagaucggccuggugagacccggcaccgcccuggagcugcuggaggcccaggccgccaccggcuucaucguggaccccgugagcaaccugagacugcccguggaggaggccuacaagagaggccuggugggcaucgaguucaaggagaagcugcugagcgccgagagagccgugaccggcuacaacgaccccgagaccggcaacaucaucagccuguuccaggccaugaacaaggagcugaucgagaagggccacggcaucagacugcuggaggcccagaucgccaccggcggcaucaucgaccccaaggagagccacagacugcccguggacaucgccuacaagagaggcuacuucaacgaggagcugagcgagauccugagcgaccccagcgacgacaccaagggcuucuucgaccccaacaccgaggagaaccugaccuaccugcagcugaaggagagaugcaucaaggacgaggagaccggccugugccugcugccccugaaggagaagaagaagcaggugcagaccagccagaagaacacccugagaaagagaagaguggugaucguggaccccgagaccaacaaggagaugagcgugcaggaggccuacaagaagggccugaucgacuacgagaccuucaaggagcugugcgagcaggagugcgagugggaggagaucaccaucaccggcagcgacggcagcaccagaguggugcugguggacagaaagaccggcagccaguacgacauccaggacgccaucgacaagggccugguggacagaaaguucuucgaccaguacagaagcggcagccugagccugacccaguucgccgacaugaucagccugaagaacggcgugggcaccagcagcagcaugggcagcggcgugagcgacgacguguucagcagcagcagacacgagagcgugagcaagaucagcaccaucagcagcgugagaaaccugaccaucagaagcagcagcuucagcgacacccuggaggagagcagccccaucgccgccaucuucgacaccgagaaccuggagaagaucagcaucaccgagggcaucgagagaggcaucguggacagcaucaccggccagagacugcuggaggcccaggccugcaccggcggcaucauccaccccaccaccggccagaagcugagccugcaggacgccgugagccagggcgugaucgaccaggacauggccaccagacugaagcccgcccagaaggccuucaucggcuucgagggcgugaagggcaagaagaagaugagcgccgccgaggccgugaaggagaaguggcugcccuacgaggccggccagagauuccuggaguuccaguaccugaccggcggccugguggaccccgaggugcacggcagaaucagcaccgaggaggccaucagaaagggcuucaucgacggcagagccgcccagagacugcaggacaccagcagcuacgccaagauccugaccugccccaagaccaagcugaagaucagcuacaaggacgccaucaacagaagcaugguggaggacaucaccggccugagacugcuggaggccgccagcgugagcagcaagggccugcccagccccuacaacaugagcagcgcccccggcagcagaagcggcagcagaagcggcagcagaagcggcagcagaagcggcagcagaagcggcagcagaagaggcagcuucgacgccaccggcaacagcagcuacagcuacagcuacagcuucagcagcagcagcaucggccacuaa

SEQ ID NO: 16340 - RNA, 3906 nt, Artificial Sequence
  DSPP__Homo_sapiens__NP_055023
augaagaucaucaccuacuucugcaucugggccguggccugggccauccccgugccccagagcaagccccuggagagacacguggagaagagcaugaaccugcaccugcuggccagaagcaacgugagcgugcaggacgagcugaacgccagcggcaccaucaaggagagcggcgugcuggugcacgagggcgacagaggcagacaggagaacacccaggacggccacaagggcgagggcaacggcagcaagugggccgaggugggcggcaagagcuucagcaccuacagcacccuggccaacgaggagggcaacaucgagggcuggaacggcgacaccggcaaggccgagaccuacggccacgacggcauccacggcaaggaggagaacaucaccgccaacggcauccagggccaggugagcaucaucgacaacgccggcgccaccaacagaagcaacaccaacggcaacaccgacaagaacacccagaacggcgacgugggcgacgccggccacaacgaggacguggccguggugcaggaggacggcccccagguggccggcagcaacaacagcaccgacaacgaggacgagaucaucgagaacagcugcagaaacgagggcaacaccagcgagaucaccccccagaucaacagcaagagaaacggcaccaaggaggccgaggugacccccggcaccggcgaggacgccggccuggacaacagcgacggcagccccagcggcaacggcgccgacgaggacgaggacgagggcagcggcgacgacgaggacgaggaggccggcaacggcaaggacagcagcaacaacagcaagggccaggagggccaggaccacggcaaggaggacgaccacgacagcagcaucggccagaacagcgacagcaaggaguacuacgaccccgagggcaaggaggacccccacaacgagguggacggcgacaagaccagcaagagcgaggagaacagcgccggcauccccgaggacaacggcagccagagaaucgaggacacccagaagcugaaccacagagagagcaagagaguggagaacagaaucaccaaggagagcgagacccacgccgugggcaagagccaggacaagggcaucgagaucaagggccccagcagcggcaacagaaacaucaccaaggaggugggcaagggcaacgagggcaaggaggacaagggccagcacggcaugauccugggcaagggcaacgugaagacccagggcgagguggugaacaucgagggccccggccagaagagcgagcccggcaacaaggugggccacagcaacaccggcagcgacagcaacagcgacggcuacgacagcuacgacuucgacgacaagagcaugcagggcgacgaccccaacagcagcgacgagagcaacggcaacgacgacgccaacagcgagagcgacaacaacagcagcagcagaggcgacgccagcuacaacagcgacgagagcaaggacaacggcaacggcagcgacagcaagggcgccgaggacgacgacagcgacagcaccagcgacaccaacaacagcgacagcaacggcaacggcaacaacggcaacgacgacaacgacaagagcgacagcggcaagggcaagagcgacagcagcgacagcgacagcagcgacagcagcaacagcagcgacagcagcgacagcagcgacagcgacagcagcgacagcaacagcagcagcgacagcgacagcagcgacagcgacagcagcgacagcagcgacagcgacagcagcgacagcagcaacagcagcgacagcagcgacagcagcgacagcagcgacagcagcgacagcagcgacagcagcgacagcaagagcgacagcagcaagagcgagagcgacagcagcgacagcgacagcaagagcgacagcagcgacagcaacagcagcgacagcagcgacaacagcgacagcagcgacagcagcaacagcagcaacagcagcgacagcagcgacagcagcgacagcagcgacagcagcagcagcagcgacagcagcaacagcagcgacagcagcgacagcagcgacagcagcaacagcagcgagagcagcgacagcagcgacagcagcgacagcgacagcagcgacagcagcgacagcagcaacagcaacagcagcgacagcgacagcagcaacagcagcgacagcagcgacagcagcaacagcagcgacagcagcgacagcagcgacagcagcaacagcagcgacagcagcgacagcagcgacagcagcaacagcagcgacagcagcgacagcagcgacagcagcgacagcagcgacagcagcaacagcagcgacagcaacgacagcagcaacagcagcgacagcagcgacagcagcaacagcagcgacagcagcaacagcagcgacagcagcgacagcagcgacagcagcgacagcgacagcagcaacagcagcgacagcagcaacagcagcgacagcagcgacagcagcaacagcagcgacagcagcgacagcagcgacagcagcgacggcagcgacagcgacagcagcaacagaagcgacagcagcaacagcagcgacagcagcgacagcagcgacagcagcaacagcagcgacagcagcgacagcagcgacagcaacgagagcagcaacagcagcgacagcagcgacagcagcaacagcagcgacagcgacagcagcgacagcagcaacagcagcgacagcagcgacagcagcaacagcagcgacagcagcgagagcagcaacagcagcgacaacagcaacagcagcgacagcagcaacagcagcgacagcagcgacagcagcgacagcagcaacagcagcgacagcagcaacagcagcgacagcagcaacagcagcgacagcagcgacagcaacagcagcgacagcagcgacagcagcaacagcagcgacagcagcgacagcagcgacagcagcgacagcagcgacagcagcgacagcagcaacagcagcgacagcagcgacagcagcgacagcagcgacagcagcaacagcagcgacagcagcaacagcagcgacagcagcaacagcagcgacagcagcgacagcagcgacagcagcgacagcagcgacagcagcgacagcagcgacagcagcgacagcagcaacagcagcgacagcagcgacagcagcgacagcagcgacagcagcgacagcagcgacagcagcgacagcagcgacagcagcgagagcagcgacagcagcgacagcagcaacagcagcgacagcagcgacagcagcgacagcagcgacagcagcgacagcagcgacagcagcgacagcagcgacagcagcgacagcagcaacagcagcgacagcagcgacagcagcgacagcagcgacagcagcgacagcagcaacagcagcgacagcagcgacagcagcgagagcagcgacagcagcgacagcagcgacagcagcgacagcagcgacagcagcgacagcagcgacagcagcgacagcagcgacagcagcaacagcagcgacagcagcgacagcagcgacagcagcgacagcagcgacagcagcgacagcagcgacagcagcgacagcagcgacagcagcgacagcagcgacagcagcgacagcagcgacagcagcgacagcagcgacagcagcgacagcagcgacagcaacgagagcagcgacagcagcgacagcagcgacagcagcgacagcagcaacagcagcgacagcagcgacagcagcgacagcagcgacagcaccagcgacagcaacgacgagagcgacagccagagcaagagcggcaacggcaacaacaacggcagcgacagcgacagcgacagcgagggcagcgacagcaaccacagcaccagcgacgacuaa

SEQ ID NO: 16341 - RNA, 7950 nt, Artificial Sequence
  DST__Homo_sapiens__NP_001714
augcacagcagcagcuacagcuacagaagcagcgacagcguguucagcaacaccaccagcaccagaaccagccuggacagcaacgagaaccugcugcuggugcacugcggccccacccugaucaacagcugcaucagcuucggcagcgagagcuucgacggccacagacuggagaugcugcagcagaucgccaacagagugcagagagacagcgugaucugcgaggacaagcugauccuggccggcaacgcccugcagagcgacagcaagagacuggagagcggcgugcaguuccagaacgaggccgagaucgccggcuacauccuggagugcgagaaccugcugagacagcacgugaucgacgugcagauccugaucgacggcaaguacuaccaggccgaccagcuggugcagagaguggccaagcugagagacgagaucauggcccugagaaacgagugcagcagcguguacagcaagggcagaauccugaccaccgagcagaccaagcugaugaucagcggcaucacccagagccugaacagcggcuucgcccagacccugcaccccagccugaccagcggccugacccagagccugacccccagccugaccagcagcagcaugaccagcggccugagcagcggcaugaccagcagacugacccccagcgugacccccgccuacacccccggcuuccccagcggccuggugcccaacuucagcagcggcguggagcccaacagccugcagacccugaagcugaugcagaucagaaagccccugcugaagagcagccugcuggaccagaaccugaccgaggaggagaucaacaugaaguucgugcaggaccugcugaacuggguggacgagaugcaggugcagcuggacagaaccgaguggggcagcgaccugcccagcguggagagccaccuggagaaccacaagaacgugcacagagccaucgaggaguucgagagcagccugaaggaggccaagaucagcgagauccagaugaccgccccccugaagcugaccuacgccgagaagcugcacagacuggagagccaguacgccaagcugcugaacaccagcagaaaccaggagagacaccuggacacccugcacaacuucgugagcagagccaccaacgagcugaucuggcugaacgagaaggaggaggaggagguggccuacgacuggagcgagagaaacaccaacaucgccagaaagaaggacuaccacgccgagcugaugagagagcuggaccagaaggaggagaacaucaagagcgugcaggagaucgccgagcagcugcugcuggagaaccaccccgccagacugaccaucgaggccuacagagccgccaugcagacccaguggagcuggauccugcagcugugccagugcguggagcagcacaucaaggagaacaccgccuacuucgaguucuucaacgacgccaaggaggccaccgacuaccugagaaaccugaaggacgccauccagagaaaguacagcugcgacagaagcagcagcauccacaagcuggaggaccuggugcaggagagcauggaggagaaggaggagcugcugcaguacaagagcaccaucgccaaccugaugggcaaggccaagaccaucauccagcugaagcccagaaacagcgacugcccccugaagaccagcauccccaucaaggccaucugcgacuacagacagaucgagaucaccaucuacaaggacgacgagugcgugcuggccaacaacagccacagagccaaguggaaggugaucagccccaccggcaacgaggccauggugcccagcgugugcuucaccgugcccccccccaacaaggaggccguggaccuggccaacagaaucgagcagcaguaccagaacgugcugacccuguggcacgagagccacaucaacaugaagagcguggugagcuggcacuaccugaucaacgagaucgacagaaucagagccagcaacguggccagcaucaagaccaugcugcccggcgagcaccagcaggugcugagcaaccugcagagcagauucgaggacuuccuggaggacagccaggagagccagguguucagcggcagcgacaucacccagcuggagaaggaggugaacgugugcaagcaguacuaccaggagcugcugaagagcgccgagagagaggagcaggaggagagcguguacaaccuguacaucagcgaggugagaaacaucagacugagacuggagaacugcgaggacagacugaucagacagaucagaaccccccuggagagagacgaccugcacgagagcguguucagaaucaccgagcaggagaagcugaagaaggagcuggagagacugaaggacgaccugggcaccaucaccaacaagugcgaggaguucuucagccaggccgccgccagcagcagcgugcccacccugagaagcgagcugaacguggugcugcagaacaugaaccagguguacagcaugagcagcaccuacaucgacaagcugaagaccgugaaccuggugcugaagaacacccaggccgccgaggcccuggugaagcuguacgagaccaagcugugcgaggaggaggccgugaucgccgacaagaacaacaucgagaaccugaucagcacccugaagcaguggagaagcgagguggacgagaagagacagguguuccacgcccuggaggacgagcugcagaaggccaaggccaucagcgacgagauguucaagaccuacaaggagagagaccuggacuucgacuggcacaaggagaaggccgaccagcugguggagagauggcagaacgugcacgugcagaucgacaacagacugagagaccuggagggcaucggcaagagccugaaguacuacagagacaccuaccacccccuggacgacuggauccagcagguggagaccacccagagaaagauccaggagaaccagcccgagaacagcaagacccuggccacccagcugaaccagcagaagaugcuggugagcgagaucgagaugaagcagagcaagauggacgagugccagaaguacgccgagcaguacagcgccaccgugaaggacuacgagcugcagaccaugaccuacagagccaugguggacagccagcagaagagccccgugaagagaagaagaaugcagagcagcgccgaccugaucauccaggaguucauggaccugagaaccagauacaccgcccuggugacccugaugacccaguacaucaaguucgccggcgacagccugaagagacuggaggaggaggagaucaagagaugcaaggagaccagcgagcacggcgccuacagcgaccugcugcagagacagaaggccaccgugcuggagaacagcaagcugaccggcaagaucagcgagcuggagagaaugguggccgagcugaagaagcagaagagcagaguggaggaggagcugcccaaggugagagaggccgccgagaacgagcugagaaagcagcagagaaacguggaggacaucagccugcagaagaucagagccgagagcgaggccaagcaguacagaagagagcuggagaccaucgugagagagaaggaggccgccgagagagagcuggagagagugagacagcugaccaucgaggccgaggccaagagagccgccguggaggagaaccugcugaacuucagaaaccagcuggaggagaacaccuucaccagaagaacccuggaggaccaccugaagagaaaggaccugagccugaacgaccuggagcagcagaagaacaagcugauggaggagcugagaagaaagagagacaacgaggaggagcugcugaagcugaucaagcagauggagaaggaccuggccuuccagaagcagguggccgagaagcagcugaaggagaagcagaagaucgagcuggaggccagaagaaagaucaccgagauccaguacaccugcagagagaacgcccugcccgugugccccaucacccaggccaccagcugcagagccgugaccggccugcagcaggagcacgacaagcagaaggccgaggagcugaagcagcagguggacgagcugaccgccgccaacagaaaggccgagcaggacaugagagagcugaccuacgagcugaacgcccugcagcuggagaagaccagcagcgaggagaaggccagacugcugaaggacaagcuggacgagaccaacaacacccugagaugccugaagcuggagcuggagagaaaggaccaggccgagaagggcuacagccagcagcugagagagcugggcagacagcugaaccagaccaccggcaaggccgaggaggccaugcaggaggccagcgaccugaagaagaucaagagaaacuaccagcuggagcuggagagccugaaccacgagaagggcaagcugcagagagagguggacagaaucaccagagcccacgccguggccgagaagaacauccagcaccugaacagccagauccacagcuucagagacgagaaggagcuggagagacugcagaucugccagagaaagagcgaccaccugaaggagcaguucgagaagagccacgagcagcugcugcagaacaucaaggccgagaaggagaacaacgacaagauccagagacugaacgaggagcuggagaagagcaacgagugcgccgagaugcugaagcagaagguggaggagcugaccagacagaacaacgagaccaagcugaugaugcagagaauccaggccgagagcgagaacaucgugcuggagaagcagaccauccagcagagaugcgaggcccugaagauccaggccgacggcuucaaggaccagcugagaagcaccaacgagcaccugcacaagcagaccaagaccgagcaggacuuccagagaaagaucaagugccuggaggaggaccuggccaagagccagaaccuggugagcgaguucaagcagaagugcgaccagcagaacaucaucauccagaacaccaagaaggaggugagaaaccugaacgccgagcugaacgccagcaaggaggagaagagaagaggcgagcagaaggugcagcugcagcaggcccaggugcaggagcugaacaacagacugaagaaggugcaggacgagcugcaccugaagaccaucgaggagcagaugacccacagaaagauggugcuguuccaggaggagagcggcaaguucaagcagagcgccgaggaguucagaaagaagauggagaagcugauggagagcaaggugaucaccgagaacgacaucagcggcaucagacuggacuucgugagccugcagcaggagaacagcagagcccaggagaacgccaagcugugcgagaccaacaucaaggagcuggagagacagcugcagcaguacagagagcagaugcagcagggccagcacauggaggccaaccacuaccagaagugccagaagcuggaggacgagcugaucgcccagaagagagagguggagaaccugaagcagaagauggaccagcagaucaaggagcacgagcaccagcuggugcugcugcagugcgagauccagaagaagagcaccgccaaggacugcaccuucaagcccgacuucgagaugaccgugaaggagugccagcacagcggcgagcugagcagcagaaacaccggccaccugcaccccacccccagaagcccccugcugagauggacccaggagccccagccccuggaggagaaguggcagcacagagugguggagcagauccccaaggaggugcaguuccagccccccggcgccccccuggagaaggagaagagccagcagugcuacagcgaguacuucagccagaccagcaccgagcugcagaucaccuucgacgagaccaaccccaucaccagacugagcgagaucgagaagaucagagaccaggcccugaacaacagcagaccccccgugagauaccaggacaacgccugcgagauggagcuggugaaggugcugaccccccuggagaucgccaagaacaagcaguacgacaugcacaccgaggugaccacccugaagcaggagaagaaccccgugcccagcgccgaggaguggaugcuggagggcugcagagccagcggcggccugaagaagggcgacuuccugaagaagggccuggagcccgagaccuuccagaacuucgacggcgaccacgccugcagcgugagagacgacgaguucaaguuccagggccugagacacaccgugaccgccagacagcugguggaggccaagcugcuggacaugagaaccaucgagcagcugagacugggccugaagaccguggaggaggugcagaagacccugaacaaguuccugaccaaggccaccagcaucgccggccuguaccuggagagcaccaaggagaagaucagcuucgccagcgccgccgagagaaucaucaucgacaagaugguggcccuggccuuccuggaggcccaggccgccaccggcuucaucaucgaccccaucagcggccagaccuacagcguggaggacgccgugcugaagggcgugguggaccccgaguucagaaucagacugcuggaggccgagaaggccgccgugggcuacagcuacagcagcaagacccugagcguguuccaggccauggagaacagaaugcuggacagacagaagggcaagcacauccuggaggcccagaucgccagcggcggcgugaucgaccccgugagaggcaucagagugccccccgagaucgcccugcagcagggccugcugaacaacgccauccugcaguuccugcacgagcccagcagcaacaccagaguguuccccaaccccaacaacaagcaggcccuguacuacagcgagcugcugagaaugugcguguucgacguggagagccagugcuuccuguuccccuucggcgagagaaacaucagcaaccugaacgugaagaagacccacagaaucagcgugguggacaccaagaccggcagcgagcugaccguguacgaggccuuccagagaaaccugaucgagaagagcaucuaccuggagcugagcggccagcaguaccaguggaaggaggccauguucuucgagagcuacggccacagcagccacaugcugaccgacaccaagaccggccugcacuucaacaucaacgaggccaucgagcagggcaccaucgacaaggcccuggugaagaaguaccaggagggccugaucacccugaccgagcuggccgacagccugcugagcagacuggugcccaagaaggaccugcacagccccguggccggcuacuggcugaccgccagcggcgagagaaucagcgugcugaaggccagcagaagaaaccugguggacagaaucaccgcccugagaugccuggaggcccaggugagcaccggcggcaucaucgacccccugaccggcaagaaguacagaguggccgaggcccugcacagaggccugguggacgagggcuucgcccagcagcugagacagugcgagcuggugaucaccggcaucggccaccccaucaccaacaagaugaugagcgugguggaggccgugaacgccaacaucaucaacaaggagaugggcaucagaugccuggaguuccaguaccugaccggcggccugaucgagccccaggugcacagcagacugagcaucgaggaggcccugcaggugggcaucaucgacgugcugaucgccaccaagcugaaggaccagaagagcuacgugagaaacaucaucugcccccagaccaagagaaagcugaccuacaaggaggcccuggagaaggccgacuucgacuuccacaccggccugaagcugcuggaggugagcgagccccugaugaccggcaucagcagccuguacuacagcagcuaa

SEQ ID NO: 16342 - RNA, 498 nt, Artificial Sequence
  DSTN__Homo_sapiens__XP_011527445
auggccagcggcgugcagguggccgacgaggugugcagaaucuucuacgacaugaaggugagaaagugcagcacccccgaggagaucaagaagagaaagaaggccgugaucuucugccugagcgccgacaagaagugcaucaucguggaggagggcaaggagauccuggugggcgacgugggcgugaccaucaccgaccccuucaagcacuucgugggcaugcugcccgagaaggacugcagauacgcccuguacgacgccagcuucgagaccaaggagagcagaaaggaggagcugauguucuuccugugggcccccgagcuggccccccugaagagcaagaugaucuacgccagcagcaaggacgccaucaagaagaaguuccagggcaucaagcacgagugccaggccaacggccccgaggaccugaacagagccugcaucgccgagaagcugggcggcagccugaucguggccuucgagggcugccccguguaa

SEQ ID NO: 16343 - RNA, 2790 nt, Artificial Sequence
  DSTYK__Homo_sapiens__NP_056190
auggagggcgacggcgugcccuggggcagcgagcccgugagcggccccggccccggcggcggcggcaugaucagagagcugugcagaggcuucggcagauacagaagauaccugggcagacugagacagaaccugagagagacccagaaguucuucagagacaucaagugcagccacaaccacaccugccugagcagccugaccggcggcggcggcgccgagagaggccccgccggcgacguggccgagaccggccugcaggccggccagcugagcugcaucagcuucccccccaaggaggagaaguaccugcagcagaucguggacugccugcccugcauccugauccugggccaggacugcaacgugaagugccagcugcugaaccugcugcugggcgugcaggugcugcccaccaccaagcugggcagcgaggagagcugcaagcugagaagacugagauucaccuacggcacccagaccagagugagccuggcccugcccggccaguacgagcuggugcacacccugguggcccaccagggcaacugggagaccauccccgaggaggaccuggaggugcaggagaacaacgaggacgccgcccacgugcuggccgagcuggaggugaccaugcaccacgcccugcugcaggagguggacguggugguggcccccugccagggccugagacccaccguggacgugcugggcgaccuggugaacgacuuccugcccgugaucaccuacgcccugcacaaggacgagcugagcgagagagacgagcaggagcugcaggagaucagaaaguacuucagcuuccccguguucuucuucaaggugcccaagcugggcagcgagaucaucgacagcagcaccagaagaauggagagcgagagaagcccccuguacagacagcugaucgaccugggcuaccugagcagcagccacuggaacugcggcgcccccggccaggacaccaaggcccagagcaugcugguggagcagagcgagaagcugagacaccugagcaccuucagccaccaggugcugcagaccagacugguggacgccgccaaggcccugaaccuggugcacugccacugccuggacaucuucaucaaccaggccuucgacaugcagagagaccugcagaucacccccaagagacuggaguacaccagaaagaaggagaacgagcuguacgagagccugaugaacaucgccaacagaaagcaggaggagaugaaggacaugaucguggagacccugaacaccaugaaggaggagcugcuggacgacgccaccaacauggaguucaaggacgugaucgugcccgagaacggcgagcccgugggcaccagagagaucaagugcugcaucagacagauccaggagcugaucaucagcagacugaaccaggccguggccaacaagcugaucagcagcguggacuaccugagagagagcuucgugggcacccuggagagaugccugcagagccuggagaagagccaggacgugagcgugcacaucaccagcaacuaccugaagcagauccugaacgccgccuaccacguggaggugaccuuccacagcggcagcagcgugaccagaaugcugugggagcagaucaagcagaucauccagagaaucaccugggugagcccccccgccaucacccuggaguggaagagaaagguggcccaggaggccaucgagagccugagcgccagcaagcuggccaagagcaucugcagccaguucagaaccagacugaacagcagccacgaggccuucgccgccagccugagacagcuggaggccggccacagcggcagacuggagaagaccgaggaccuguggcugagagugagaaaggaccacgcccccagacuggccagacugagccuggagagcugcagccugcaggacgugcugcugcacagaaagcccaagcugggccaggagcugggcagaggccaguacggcgugguguaccugugcgacaacuggggcggccacuuccccugcgcccugaagagcguggugccccccgacgagaagcacuggaacgaccuggcccuggaguuccacuacaugagaagccugcccaagcacgagagacugguggaccugcacggcagcgugaucgacuacaacuacggcggcggcagcagcaucgccgugcugcugaucauggagagacugcacagagaccuguacaccggccugaaggccggccugacccuggagaccagacugcagaucgcccuggacgugguggagggcaucagauuccugcacagccagggccuggugcacagagacaucaagcugaagaacgugcugcuggacaagcagaacagagccaagaucaccgaccugggcuucugcaagcccgaggccaugaugagcggcagcaucgugggcacccccauccacauggcccccgagcuguucaccggcaaguacgacaacagcguggacguguacgccuucggcauccuguucugguacaucugcagcggcagcgugaagcugcccgaggccuucgagagaugcgccagcaaggaccaccuguggaacaacgugagaagaggcgccagacccgagagacugcccguguucgacgaggagugcuggcagcugauggaggccugcugggacggcgacccccugaagagaccccugcugggcaucgugcagcccaugcugcagggcaucaugaacagacugugcaagagcaacagcgagcagcccaacagaggccuggacgacagcaccuaa

SEQ ID NO: 16344 - RNA, 630 nt, Artificial Sequence
  DTD1__Homo_sapiens__NP_543010
augaaggccguggugcagagagugaccagagccagcgugaccgugggcggcgagcagaucagcgccaucggcagaggcaucugcgugcugcugggcaucagccuggaggacacccagaaggagcuggagcacauggugagaaagauccugaaccugagaguguucgaggacgagagcggcaagcacuggagcaagagcgugauggacaagcaguacgagauccugugcgugagccaguucacccugcagugcgugcugaagggcaacaagcccgacuuccaccuggccaugcccaccgagcaggccgagggcuucuacaacagcuuccuggagcagcugagaaagaccuacagacccgagcugaucaaggacggcaaguucggcgccuacaugcaggugcacauccagaacgacggccccgugaccaucgagcuggagagccccgcccccggcaccgccaccagcgaccccaagcagcugagcaagcuggagaagcagcagcagagaaaggagaagaccagagccaagggccccagcgagagcagcaaggagagaaacacccccagaaaggaggacagaagcgccagcagcggcgccgagggcgacgugagcagcgagagagagcccuaa

SEQ ID NO: 16345 - RNA, 1851 nt, Artificial Sequence
  DTHD1__Homo_sapiens__NP_001130008
augugccuggagaagagauaccuggacgugcugagcgacgugaccggcccccaggugagcugcuacaucaccgcccccagcuacgugcugcagcagcuggagugcagaaucaucaaccacaugagcagccugaucgugggcgacaacgaggagcuggugagcaacgugaucaccaucgagugcagcgacaaggagaagagagugcccuuccccaucggcaucgccauccccuucaccgccagauacagaggcaacuacagagacaucauggugaaggugugcgacaucaaccugcagagcagcuaccugaaccccaacagccuggagggcaugaagggcggcuacaagggcaccugcgccagcgugaagguguacaagcugggcaucuucagcguggugagcugccugaagaaggagagcuucaccgugaccaagaagggccuggcccugaagagcagcauggacagcagaaucagccugaacuacccccccggcguguucaccagccccgugcuggugcagcugaagauccagcccguggaccccgcccugguggcccaccugaaggcccagcaggacaccuucuacagcgugcagagcaccagcccccugauccacauccagcaccccagcaccuaccccuuccagaagcccgugacccuguuccugcccugcagccccuaccuggacaagaacaaccugggcagcgagaucgaccacaagagaagagccagcgccaccaucaacagaaucacccccagcuacuucaacagaaccaagaucgccagcaucagaaagcccagaaagaacgccagcgagugccugaagcugcugggcuucagaagccaggacagcggcuggugcggccuggacgacguggugaagaccauccagagcggccuggugagcguggagcuguacgagcaccuggagagauucaucgugcugcaccugagcagcaccauggacaacagccaccuggugaccuucgugaagagccuggaggaggccaugcugagcaccaccgccugcaucgugcugagccaccagaaggacaacccccacagaaucgccgugcugguggugcccagcaaggaccugagccaggugcugaaggaccugcaccuggagggcuucggcggcccccccgagcccagcagacacuuccaggugagagagggcgagcagcugcugcugagauucaccggcaacaucuucgccagcagcaacggcaaggacuacggcaaggacuacacccugaucuuccaccugcagagaaagcccagacuggagcugcagaucaaggagguggacgaguucggcaacuacagcugcccccacuacaagggcaccaucgugguguacaaggugcccaagggcaagaucgugcccaaccugaaccagagccuggugaucaacgagaaccacagccagcugcccaucugcaagcugccccugaagcugcccaagcacaagaagcugaucaacagaccccagagcaccaagagagugagcaaggaccccguggaggcccugugggacaaccugcugcacuggcuggccgaggagcugagcgaggagaacgccgagagccugagcagcacccugccccugagaagaagcaccauccagcugaucaagcugaagaaccccgacgaccugaccgagcagauccacgaguuccugugcuucuggaagaagagccugcccaccuucaccgacaagcugagacugcuggccagacaccugagaaagaucggcagaagcgaccuggccgaggagcugaaguucaagugggagaacaagguguucaccgagccccagcagugcuucgacguggcccccgaguaa

SEQ ID NO: 16346 - RNA, 1380 nt, Artificial Sequence
  DTL__Homo_sapiens__NP_001273158
augggcuacagcagccugauccuggacagcaccggcagcacccuguucgccaacugcaccgacgacaacaucuacauguucaacaugaccggccugaagaccagccccguggccaucuucaacggccaccagaacagcaccuucuacgugaagagcagccugagccccgacgaccaguuccuggugagcggcagcagcgacgaggccgccuacaucuggaaggugagcacccccuggcagccccccaccgugcugcugggccacagccaggaggugaccagcgugugcuggugccccagcgacuucaccaagaucgccaccugcagcgacgacaacacccugaagaucuggagacugaacagaggccuggaggagaagcccggcggcgacaagcugagcaccgugggcugggccagccagaagaagaaggagagcagacccggccuggugaccgugaccagcagccagagcacccccgccaaggcccccagagugaagugcaaccccagcaacagcagccccagcagcgccgccugcgcccccagcugcgccggcgaccugccccugcccagcaacacccccaccuucagcaucaagaccagccccgccaaggccagaagccccaucaacagaagaggcagcgugagcagcgugagccccaagccccccagcagcuucaagaugagcaucagaaacugggugaccagaacccccagcagcagcccccccaucaccccccccgccagcgagaccaagaucaugagccccagaaaggcccugauccccgugagccagaagagcagccaggccgaggccugcagcgagagcagaaacagagugaagagaagacuggacagcagcugccuggagagcgugaagcagaagugcgugaagagcugcaacugcgugaccgagcuggacggccagguggagaaccugcaccuggaccugugcugccuggccggcaaccaggaggaccugagcaaggacagccugggccccaccaagagcagcaagaucgagggcgccggcaccagcaucagcgagccccccagccccaucagccccuacgccagcgagagcugcggcacccugccccugccccugagacccugcggcgagggcagcgagauggugggcaaggagaacagcagccccgagaacaagaacuggcugcuggccauggccgccaagagaaaggccgagaaccccagccccagaagccccagcagccagacccccaacagcagaagacagagcggcaagacccugcccagccccgugaccaucacccccagcagcaugagaaagaucugcaccuacuuccacagaaagagccaggaggacuucugcggccccgagcacagcaccgagcuguaa

SEQ ID NO: 16347 - RNA, 1116 nt, Artificial Sequence
  DTNA__Homo_sapiens__NP_001121647
augaucgaggacagcggcaagagaggcaacaccauggccgagagaagacagcuguucgccgagaugagagcccaggaccuggacagaaucagacugagcaccuacagaaccgccugcaagcugagauucgugcagaagaagugcaaccugcaccugguggacaucuggaacgugaucgaggcccugagagagaacgcccugaacaaccuggaccccaacaccgagcugaacgugagcagacuggaggccgugcugagcaccaucuucuaccagcugaacaagagaaugcccaccacccaccagauccacguggagcagagcaucagccugcugcugaacuuccugcuggccgccuucgaccccgagggccacggcaagaucagcguguucgccgugaagauggcccuggccacccugugcggcggcaagaucauggacaagcugagauacaucuucagcaugaucagcgacagcagcggcgugaugguguacggcagauacgaccaguuccugagagaggugcugaagcugcccaccgccguguucgagggccccagcuucggcuacaccgagcagagcgccagaagcugcuucagccagcagaagaaggugacccugaacggcuuccuggacacccugaugagcgacccccccccccagugccugguguggcugccccugcugcacagacuggccaacguggagaacguguuccaccccguggagugcagcuacugccacagcgagagcaugaugggcuucagauacagaugccagcagugccacaacuaccagcugugccaggacugcuucuggagaggccacgccggcggcagccacagcaaccagcaccagaugaaggaguacaccagcuggaagagccccgccaagaagcugaccaacgcccugagcaagagccugagcugcgccagcagcagagagccccugcaccccauguuccccgaccagcccgagaagccccugaaccuggcccacaucgugccccccagacccgugaccagcaugaacgacacccuguucagccacagcgugcccagcagcggcagccccuucaucaccagaagcagcgacggcgccuucggcggcugcguguaa

SEQ ID NO: 16348 - RNA, 1863 nt, Artificial Sequence
  DTNB__Homo_sapiens__NP_001243232
augaucgaggagagcggcaacaagagaaagaccauggccgagaagagacagcuguucaucgagaugagagcccagaacuucgacgugaucagacugagcaccuacagaaccgccugcaagcugagauucgugcagaagagaugcaaccugcaccugguggacaucuggaacaugaucgaggccuucagagacaacggccugaacacccuggaccacaccaccgagaucagcgugagcagacuggagaccgugaucagcagcaucuacuaccagcugaacaagagacugcccagcacccaccagaucagcguggagcagagcaucagccugcugcugaacuucaugaucgccgccuacgacagcgagggcagaggcaagcugaccguguucagcgugaaggccaugcuggccaccaugugcggcggcaagaugcuggacaagcugagauacguguucagccagaugagcgacagcaacggccugaugaucuucagcaaguucgaccaguuccugaaggaggugcugaagcugcccaccgccguguucgagggccccagcuucggcuacaccgagcacagcgugagaaccugcuucccccagcagagaaagaucaugcugaacauguuccuggacaccaugauggccgacccccccccccagugccugguguggcugccccugaugcacagacuggcccacguggagaacguguuccaccccguggagugcagcuacugcagaugcgagagcaugaugggcuucagauacagaugccagcagugccacaacuaccagcugugccagaacugcuucuggagaggccacgccggcggcccccacagcaaccagcaccagaugaaggagcacagcagcuggaagagccccgccaagaagcugagccacgccaucagcaagagccugggcugcgugcccaccagagagcccccccaccccguguuccccgagcagcccgagaagccccuggaccuggcccacaucgugccccccagaccccugaccaacaugaacgacaccauggugagccacaugagcagcggcgugcccacccccaccaagagacugcaguacagccaggacauccccagccaccuggccgacgagcacgcccugaucgccagcuacguggccagacugcagcacugcgccagagugcuggacagccccagcagacuggacgaggagcacagacugaucgccagauacgccgccagacuggccgccgaggccggcaacgugaccagaccccccaccgaccugagcuucaacuucgacgccaacaagcagcagagacagcugaucgccgagcuggagaacaagaacagagagauccugcaggagauccagagacugagacuggagcacgagcaggccagccagcccacccccgagaaggcccagcagaaccccacccugcuggccgagcugagacugcugagacagagaaaggacgagcuggagcagagaaugagcgcccugcaggagagcagaagagagcugauggugcagcuggaggagcugaugaagcugcugaaggcccaggccaccggcagcccccacaccagccccacccacggcggcggcagacccaugcccaugcccgugagaagcaccagcgccggcagcacccccacccacugcccccaggacagccugagcggcgugggcggcgacgugcaggaggccuucgcccagggcaccagaagaaaccugagaaacgaccugcugguggccgccgacagcaucaccaacaccaugagcagccuggugaaggagcugcacagcgccgaggagggcgccgaggaggaggaggagaagaugcagaacggcaaggacagaggcuaa

SEQ ID NO: 16349 - RNA, 813 nt, Artificial Sequence
  DTNBP1__Homo_sapiens__NP_001258596
augcugagcgcccacugggagaagaagaagaccagccugguggagcugcaggagcagcugcagcagcugcccgcccugaucgccgaccuggagagcaugaccgccaaccugacccaccuggaggccagcuucgaggagguggagaacaaccugcugcaccuggaggaccugugcggccagugcgagcuggagagaugcaagcacaugcagagccagcagcuggagaacuacaagaagaacaagagaaaggagcuggagaccuucaaggccgagcuggacgccgagcacgcccagaaggugcuggagauggagcacacccagcagaugaagcugaaggagagacagaaguucuucgaggaggccuuccagcaggacauggagcaguaccugagcaccggcuaccugcagaucgccgagagaagagagcccaucggcagcaugagcagcauggaggugaacguggacaugcuggagcagauggaccugauggacaucagcgaccaggaggcccuggacguguuccugaacagcggcggcgaggagaacaccgugcugagccccgcccugggccccgagagcagcaccugccagaacgagaucacccugcaggugcccaaccccagcgagcugagagccaagccccccagcagcagcagcaccugcaccgacagcgccaccagagacaucagcgagggcggcgagagccccguggugcagagcgacgaggaggaggugcagguggacaccgcccuggccaccagccacaccgacagagaggccacccccgacggcggcgaggacagcgacagcuaa

SEQ ID NO: 16350 - RNA, 1863 nt, Artificial Sequence
  DTX1__Homo_sapiens__XP_011536311
augagcagacccggccacggcggccugaugcccgugaacggccugggcuuccccccccagaacguggccagagugguggugugggaguggcugaacgagcacagcagauggagacccuacaccgccaccgugugccaccacaucgagaacgugcugaaggaggacgccagaggcagcguggugcugggccagguggacgcccagcuggugcccuacaucaucgaccugcagagcaugcaccaguucagacaggacaccggcaccaugagacccgugagaagaaacuucuacgaccccagcagcgcccccggcaagggcaucgugugggagugggagaacgacggcggcgccuggaccgccuacgacauggacaucugcaucaccauccagaacgccuacgagaagcagcaccccuggcuggaccugagcagccugggcuucugcuaccugaucuacuucaacagcaugagccagaugaacagacagaccagaagaagaagaagacugagaagaagacuggaccuggccuacccccugaccgugggcagcauccccaagagccagagcuggcccgugggcgccagcagcggccagcccugcagcugccagcagugccugcuggugaacagcaccagagccgccagcaacgccauccuggccagccagagaagaaaggccccccccgcccccccccugccccccccccccccccccggcggcccccccggcgcccuggccgugagacccagcgccaccuucaccggcgccgcccugugggccgcccccgccgccggccccgccgagcccgcccccccccccggcgccccccccagaagccccggcgcccccggcggcgccagaacccccggccagaacaaccugaacagacccggcccccagagaaccaccagcgugagcgccagagccagcaucccccccggcgugcccgcccugcccgugaagaaccugaacggcaccggccccgugcaccccgcccuggccggcaugaccggcauccugcugugcgccgccggccugcccgugugccugaccagagcccccaagcccauccugcaccccccccccgugagcaagagcgacgugaagcccgugcccggcgugcccggcgugugcagaaagaccaagaagaagcaccugaagaagagcaagaaccccgaggacguggugagaagauacaugcagaaggugaagaacccccccgacgaggacugcaccaucugcauggagagacuggugaccgccagcggcuacgagggcgugcugagacacaagggcgugagacccgagcuggugggcagacugggcagaugcggccacauguaccaccugcugugccugguggccauguacagcaacggcaacaaggacggcagccugcagugccccaccugcaaggccaucuacggcgagaagaccggcacccagccccccggcaagauggaguuccaccugaucccccacagccugcccggcuuccccgacacccagaccaucagaaucguguacgacauccccaccggcauccagggccccgagcaccccaaccccggcaagaaguucaccgccagaggcuuccccagacacugcuaccugcccaacaacgagaagggcagaaaggugcugagacugcugaucaccgccugggagagaagacugaucuucaccaucggcaccagcaacaccaccggcgagagcgacaccgugguguggaacgagauccaccacaagaccgaguucggcagcaaccugaccggccacggcuaccccgacgccagcuaccuggacaacgugcuggccgagcugaccgcccagggcgugagcgaggccgccgccaaggccuaa

SEQ ID NO: 16351 - RNA, 1869 nt, Artificial Sequence
  DTX2__Homo_sapiens__NP_001096064
auggccauggcccccagccccagccuggugcagguguacaccagccccgccgccguggccgugugggaguggcaggacggccugggcaccuggcaccccuacagcgccaccgugugcagcuucaucgagcagcaguucgugcagcagaagggccagagauucggccugggcagccuggcccacagcaucccccugggccaggccgaccccagccuggcccccuacaucaucgaccugcccagcuggacccaguucagacaggacaccggcaccaugagagccgugagaagacaccuguucccccagcacagcgcccccggcagaggcguggugugggaguggcugagcgacgacggcagcuggaccgccuacgaggccagcgugugcgacuaccuggagcagcagguggccagaggcaaccagcugguggaccuggccccccugggcuacaacuacaccgugaacuacaccacccacacccagaccaacaagaccagcagcuucugcagaagcgugagaagacaggccggcccccccuaccccgugaccaccaucaucgccccccccggccacaccggcguggccugcagcugccaccagugccugagcggcagcagaaccggccccgugagcggcagauacagacacagcaugaccaaccugcccgccuaccccgugccccagcaccccccccacagaaccgccagcguguucggcacccaccaggccuucgcccccuacaacaagcccagccugagcggcgccagaagcgcccccagacugaacaccaccaacgccuggggcgccgccccccccagccugggcagccagccccuguacagaagcagccugagccaccugggcccccagcaccugccccccggcagcagcaccagcggcgccgugagcgccagccugcccagcggccccagcagcagccccggcagcgugcccgccaccgugcccaugcagaugcccaagcccagcagagugcagcaggcccuggccggcaugaccagcgugcugaugagcgccaucggccugcccgugugccugagcagagccccccagcccaccagcccccccgccagcagacuggccagcaagagccacggcagcgugaagagacugagaaagaugagcgugaagggcgccacccccaagcccgagcccgagcccgagcaggugaucaagaacuacaccgaggagcugaaggugccccccgacgaggacugcaucaucugcauggagaagcugagcaccgccagcggcuacagcgacgugaccgacagcaaggccaucggcagccuggccgugggccaccugaccaagugcagccacgccuuccaccugcugugccugcuggccauguacugcaacggcaacaaggacggcagccugcagugccccagcugcaagaccaucuacggcgagaagaccggcacccagccccagggcaagauggaggugcugagauuccagaugagccugcccggccacgaggacugcggcaccauccugaucguguacagcaucccccacggcauccagggccccgagcaccccaaccccggcaagcccuucaccgccagaggcuuccccagacagugcuaccugcccgacaacgcccagggcagaaaggugcuggagcugcugaagguggccuggaagagaagacugaucuucaccgugggcaccagcagcaccaccggcgagaccgacaccgugguguggaacgagauccaccacaagaccgagauggacagaaacaucaccggccacggcuaccccgaccccaacuaccugcagaacgugcuggccgagcuggccgcccagggcgugaccgaggacugccuggagcagcaguaa

SEQ ID NO: 16352 - RNA, 1053 nt, Artificial Sequence
  DTX3__Homo_sapiens__NP_001273174
augcccauccugagcagcagcggcagcaagauggccgccugcggcggcaccugcaagaacaaggugaccgugagcaagcccgugugggacuuccugagcaaggagacccccgccagacuggccagacugagagaggagcacagagugagcauccugaucgacggcgagaccagcgacaucuacgugcugcagcugagcccccagggccccccccccgccccccccaacggccuguaccuggccagaaaggcccugaagggccugcugaaggaggccgagaaggagcugaagaaggcccagagacagggcgagcugaugggcugccuggcccugggcggcggcggcgagcaccccgagaugcacagagccggcccccccccccugagagccgccccccugcugccccccggcgccagaggccugcccccccccccccccccccugccccccccccugccccccagacugagagaggaggccgaggagcaggagagcaccugccccaucugccugggcgagauccagaacgccaagacccuggagaagugcagacacagcuucugcgagggcugcaucaccagagcccugcaggugaagaaggccugccccaugugcggcagauucuacggccagcuggugggcaaccagccccagaacggcagaaugcuggugagcaaggacgccacccugcugcugcccagcuacgagaaguacggcaccaucgugauccaguacguguucccccccggcgugcagggcgccgagcaccccaaccccggcgugagauaccccggcaccaccagaguggccuaccugcccgacugccccgagggcaacaaggugcugacccuguucagaaaggccuucgaccagagacugaccuucaccaucggcaccagcaugaccaccggcagacccaacgugaucaccuggaacgacauccaccacaagaccagcugcaccggcggcccccagcuguucggcuaccccgaccccaccuaccugaccagagugcaggaggagcugagagccaagggcaucaccgacgacuaa

SEQ ID NO: 16353 - RNA, 1542 nt, Artificial Sequence
  DTX4__Homo_sapiens__NP_001287656
auggaggugggcaucaccauccagcacgccuacgagaagcagcaccccuggaucgaccugaccagcaucggcuucagcuacgugaucgacuucaacaccaugggccagaucaacagacagacccagagacagagaagagugagaagaagacuggaccugaucuaccccauggugaccggcacccugcccaaggcccagagcuggcccgugagccccggccccgccaccagcccccccaugagccccugcagcugcccccagugcgugcuggugaugagcgugaaggccgccguggugaacggcagcaccggcccccugcagcugcccgugaccagaaagaacaugcccccccccggcguggugaagcugcccccccugcccggcagcggcgccaagccccuggacagcaccggcaccaucagaggcccccugaagaccgcccccagccaggugaucagaagacaggccagcagcaugcccaccggcaccaccaugggcagccccgccagcccccccggccccaacagcaagaccggcagaguggcccuggccacccugaacagaaccaaccugcagagacuggccaucgcccagagcagagugcugaucgccagcggcgugcccaccgugcccgugaagaaccugaacggcagcagccccgugaaccccgcccuggccggcaucaccggcauccugaugagcgccgccggccugcccgugugccugaccagaccccccaagcuggugcugcaccccccccccgugagcaagagcgagaucaagagcauccccggcgugagcaacaccagcagaaagaccaccaagaagcaggccaagaagggcaagacccccgaggaggugcugaagaaguaccugcagaaggugagacacccccccgacgaggacugcaccaucugcauggagagacugaccgcccccagcggcuacaagggcccccagcccaccgugaagcccgaccuggugggcaagcugagcagaugcggccacguguaccacaucuacugccugguggccauguacaacaacggcaacaaggacggcagccugcagugccccaccugcaagaccaucuacggcgugaagaccggcacccagccccccggcaagauggaguaccaccugaucccccacagccugcccggccaccccgacugcaagaccaucagaaucaucuacagcaucccccccggcauccagggccccgagcaccccaaccccggcaagagcuucagcgccagaggcuuccccagacacugcuaccugcccgacagcgagaagggcagaaaggugcugaagcugcugcugguggccugggacagaagacugaucuucgccaucggcaccagcagcaccaccggcgagagcgacaccgugaucuggaacgaggugcaccacaagaccgaguucggcagcaaccugaccggccacggcuaccccgacgccaacuaccuggacaacgugcuggccgagcuggccgcccagggcaucagcgaggacagcaccgcccaggagaaggacuaa

SEQ ID NO: 16354 - RNA, 639 nt, Artificial Sequence
  DTYMK__Homo_sapiens__NP_036277
auggccgccagaagaggcgcccugaucgugcuggagggcguggacagagccggcaagagcacccagagcagaaagcugguggaggcccugugcgccgccggccacagagccgagcugcugagauuccccgagagaagcaccgagaucggcaagcugcugagcagcuaccugcagaagaagagcgacguggaggaccacagcgugcaccugcuguucagcgccaacagaugggagcaggugccccugaucaaggagaagcugagccagggcgugacccuggugguggacagauacgccuucagcggcguggccuucaccggcgccaaggagaacuucagccuggacuggugcaagcagcccgacgugggccugcccaagcccgaccuggugcuguuccugcagcugcagcuggccgacgccgccaagagaggcgccuucggccacgagagauacgagaacggcgccuuccaggagagagcccugagaugcuuccaccagcugaugaaggacaccacccugaacuggaagaugguggacgccagcaagagcaucgaggccgugcacgaggacaucagagugcugagcgaggacgccaucagaaccgccaccgagaagccccugggcgagcuguggaaguaa

SEQ ID NO: 16355 - RNA, 4656 nt, Artificial Sequence
  DUOX1__Homo_sapiens__NP_787954
augggcuucugccuggcccuggccuggacccugcuggugggcgccuggaccccccugggcgcccagaaccccaucagcugggaggugcagagauucgacggcugguacaacaaccugauggagcacagauggggcagcaagggcagcagacugcagagacuggugcccgccagcuacgccgacggcguguaccagccccugggcgagccccaccugcccaaccccagagaccugagcaacaccaucagcagaggccccgccggccuggccagccugagaaacagaaccgugcugggcguguucuucggcuaccacgugcugagcgaccuggugagcguggagacccccggcugccccgccgaguuccugaacaucagaaucccccccggcgaccccauguucgaccccgaccagagaggcgacguggugcugcccuuccagagaagcagaugggaccccgagaccggcagaagccccagcaaccccagagaccccgccaaccaggugaccggcuggcuggacggcagcgccaucuacggcagcagccacagcuggagcgacgcccugagaagcuucagcagaggccagcuggccagcggccccgaccccgccuuccccagagacagccagaacccccugcugaugugggccgcccccgaccccgccaccggccagaacggccccagaggccuguacgccuucggcgccgagagaggcaacagagagcccuuccugcaggcccugggccugcugugguucagauaccacaaccugugggcccagagacuggccagacagcaccccgacugggaggacgaggagcuguuccagcacgccagaaagagagugaucgccaccuaccagaacaucgccguguacgaguggcugcccagcuuccugcagaagacccugcccgaguacaccggcuacagacccuuccuggaccccagcaucagcagcgaguucguggccgccagcgagcaguuccugagcaccauggugccccccggcguguacaugagaaacgccagcugccacuuccagggcgugaucaacagaaacagcagcgugagcagagcccugagagugugcaacagcuacuggagcagagagcaccccagccugcagagcgccgaggacguggacgcccugcugcugggcauggccagccagaucgccgagagagaggaccacgugcugguggaggacgugagagacuucuggcccggcccccugaaguucagcagaaccgaccaccuggccagcugccugcagagaggcagagaccugggccugcccagcuacaccaaggccagagccgcccugggccugagccccaucaccagauggcaggacaucaaccccgcccugagcagaagcaacgacaccgugcuggaggccaccgccgcccuguacaaccaggaccugagcuggcuggagcugcugcccggcggccugcuggagagccacagagaccccggcccccuguucagcaccaucgugcuggagcaguucgugagacugagagacggcgacagauacugguucgagaacaccagaaacggccuguucagcaagaaggagaucgaggagaucagaaacaccacccugcaggacgugcugguggccgugaucaacaucgaccccagcgcccugcagcccaacguguucguguggcacaagggcgaccccugcccccagcccagacagcugagcaccgagggccugcccgccugcgcccccagcguggugagagacuacuucgagggcagcggcuucggcuucggcgugaccaucggcacccugugcugcuucccccuggugagccugcugagcgccuggaucguggccagacugagaaugagaaacuucaagagacugcagggccaggacagacagagcaucgugagcgagaagcuggugggcggcauggaggcccuggaguggcagggccacaaggagcccugcagacccgugcugguguaccugcagcccggccagaucagagugguggacggcagacugaccgugcugagaaccauccagcugcagcccccccagaaggugaacuucgugcugagcagcaacagaggcagaagaacccugcugcugaagauccccaaggaguacgaccuggugcugcuguucaaccuggaggaggagagacaggcccugguggagaaccugagaggcgcccugaaggagagcggccugagcauccaggagugggagcugagagagcaggagcugaugagagccgccgugaccagagagcagagaagacaccugcuggagaccuucuucagacaccuguucagccaggugcuggacaucaaccaggccgacgccggcacccugccccuggacagcagccagaaggugagagaggcccugaccugcgagcugagcagagccgaguucgccgagagccugggccugaagccccaggacauguucguggagagcauguucagccuggccgacaaggacggcaacggcuaccugagcuucagagaguuccuggacauccuggugguguucaugaagggcagccccgaggagaagagcagacugauguucagaauguacgacuucgacggcaacggccugaucagcaaggacgaguucaucagaaugcugagaagcuucaucgagaucagcaacaacugccugagcaaggcccagcuggccgaggugguggagagcauguucagagagagcggcuuccaggacaaggaggagcugaccugggaggacuuccacuucaugcugagagaccacaacagcgagcugagauucacccagcugugcgugaagggcguggaggugcccgaggugaucaaggaccugugcagaagagccagcuacaucagccaggacaugaucugccccagccccagagugagcgccagaugcagcagaagcgacaucgagaccgagcugaccccccagagacugcagugccccauggacaccgaccccccccaggagaucagaagaagauucggcaagaaggugaccagcuuccagccccugcuguucaccgaggcccacagagagaaguuccagagaagcugccugcaccagaccgugcagcaguucaagagauucaucgagaacuacagaagacacaucggcugcguggccguguucuacgccaucgccggcggccuguuccuggagagagccuacuacuacgccuucgccgcccaccacaccggcaucaccgacaccaccagagugggcaucauccugagcagaggcaccgccgccagcaucagcuucauguucagcuacauccugcugaccaugugcagaaaccugaucaccuuccugagagagaccuuccugaacagauacgugcccuucgacgccgccguggacuuccacagacugaucgccagcaccgccaucgugcugaccgugcugcacagcgugggccacguggugaacguguaccuguucagcaucagcccccugagcgugcugagcugccuguuccccggccuguuccacgacgacggcagcgagcugccccagaaguacuacuggugguucuuccagaccgugcccggccugaccggcguggugcugcugcugauccuggccaucauguacguguucgccagccaccacuucagaagaagaagcuucagaggcuucuggcugacccaccaccuguacauccugcuguacgugcugcugaucauccacggcagcuucgcccugauccagcugcccagauuccacaucuucuuccuggugcccgccaucaucuacggcggcgacaagcuggugagccugagcagaaagaagguggagaucagcguggugaaggccgagcugcugcccagcggcgugacccaccugagauuccagagaccccagggcuucgaguacaagagcggccagugggugagaaucgccugccuggcccugggcaccaccgaguaccaccccuucacccugaccagcgccccccacgaggacacccugagccugcacaucagagccgccggccccuggaccaccagacugagagagaucuacagcgcccccaccggcgacagaugcgccagauaccccaagcuguaccuggacggccccuucggcgagggccaccaggaguggcacaaguucgaggugagcgugcuggugggcggcggcaucggcgugacccccuucgccagcauccugaaggaccugguguucaagagcagcgugagcugccagguguucugcaagaagaucuacuucaucugggugaccagaacccagagacaguucgaguggcuggccgacaucaucagagagguggaggagaacgaccaccaggaccuggugagcgugcacaucuacaucacccagcuggccgagaaguucgaccugagaaccaccaugcuguacaucugcgagagacacuuccagaaggugcugaacagaagccuguucaccggccugagaagcaucacccacuucggcagaccccccuucgagcccuucuucaacagccugcaggaggugcacccccaggugagaaagaucggcguguucagcugcggcccccccggcaugaccaagaacguggagaaggccugccagcugaucaacagacaggacagaacccacuucagccaccacuacgagaacuucuaa

SEQ ID NO: 16356 - RNA, 4647 nt, Artificial Sequence
  DUOX2__Homo_sapiens__NP_054799
augcugagagccagacccgaggcccugaugcugcugggcgcccugcugaccggcagccugggccccagcggcaaccaggacgcccugagccugcccugggaggugcagagauacgacggcugguucaacaaccugagacaccacgagagaggcgccgugggcugcagacugcagagaagagugcccgccaacuacgccgacggcguguaccaggcccuggaggagccccagcugcccaaccccagaagacugagcaacgccgccaccagaggcaucgccggccugcccagccugcacaacagaaccgugcugggcguguucuucggcuaccacgugcugagcgacguggugagcguggagacccccggcugccccgccgaguuccugaacaucagaaucccccccggcgaccccguguucgaccccgaccagagaggcgacguggugcugcccuuccagagaagcagaugggaccccgagaccggcagaagccccagcaaccccagagaccuggccaaccaggugaccggcuggcuggacggcagcgccaucuacggcagcagccacagcuggagcgacgcccugagaagcuucagcggcggccagcuggccagcggccccgaccccgccuuccccagagacagccagaacccccugcugaugugggccgcccccgaccccgccaccggccagaacggccccagaggccuguacgccuucggcgccgagagaggcaacagagagcccuuccugcaggcccugggccugcugugguucagauaccacaaccugugggcccagagacuggccagacagcaccccgacugggaggacgaggagcuguuccagcacgccagaaagagagugaucgccaccuaccagaacaucgccguguacgaguggcugcccagcuuccugcagaagacccugcccgaguacaccggcuacagacccuuccuggaccccagcaucagccccgaguucgugguggccagcgagcaguucuucagcaccauggugccccccggcguguacaugagaaacgccagcugccacuucagaaaggugcugaacaagggcuuccagagcagccaggcccugagagugugcaacaacuacuggaucagagagaaccccaaccugaacagcacccaggaggugaacgagcugcugcugggcauggccagccagaucagcgagcuggaggacaacaucgugguggaggaccugagagacuacuggcccggccccggcaaguucagcagaaccgacuacguggccagcagcauccagagaggcagagacaugggccugcccagcuacagccaggcccugcuggccuucggccuggacauccccagaaacuggagcgaccugaaccccaacguggacccccaggugcuggaggccaccgccgcccuguacaaccaggaccugagccagcuggagcugcugcugggcggccugcuggagagccacggcgaccccggcccccuguucagcgccaucgugcuggaccaguucgugagacugagagacggcgacagauacugguucgagaacaccagaaacggccuguucagcaagaaggagaucgaggacaucagaaacaccacccugagagacgugcugguggccgugaucaacaucgaccccagcgcccugcagcccaacguguucguguggcacaagggcgcccccugcccccagcccaagcagcugaccaccgacggccugccccagugcgccccccugaccgugcuggacuucuucgagggcagcagccccggcuucgccaucaccaucaucgcccugugcugccugccccuggugagccugcugcugagcggcgugguggccuacuucagaggcagagagcacaagaagcugcagaagaagcugaaggagagcgugaagaaggaggccgccaaggacggcgugcccgccauggaguggcccggccccaaggagagaagcagccccaucaucauccagcugcugagcgacagaugccugcaggugcugaacagacaccugaccgugcugagaguggugcagcugcagccccugcagcaggugaaccugauccugagcaacaacagaggcugcagaacccugcugcugaagauccccaaggaguacgaccuggugcugcuguucagcagcgaggaggagagaggcgccuucgugcagcagcugugggacuucugcgugagaugggcccugggccugcacguggccgagaugagcgagaaggagcuguucagaaaggccgugaccaagcagcagagagagagaauccuggagaucuucuucagacaccuguucgcccaggugcuggacaucaaccaggccgacgccggcacccugccccuggacagcagccagaaggugagagaggcccugaccugcgagcugagcagagccgaguucgccgagagccugggccugaagccccaggacauguucguggagagcauguucagccuggccgacaaggacggcaacggcuaccugagcuucagagaguuccuggacauccuggugguguucaugaagggcagccccgaggacaagagcagacugauguucaccauguacgaccuggacgagaacggcuuccugagcaaggacgaguucuucaccaugaugagaagcuucaucgagaucagcaacaacugccugagcaaggcccagcuggccgaggugguggagagcauguucagagagagcggcuuccaggacaaggaggagcugaccugggaggacuuccacuucaugcugagagaccacgacagcgagcugagauucacccagcugugcgugaagggcggcggcggcggcggcaacggcaucagagacaucuucaagcagaacaucagcugcagagugagcuucaucaccagaacccccggcgagagaagccacccccagggccugggcccccccgcccccgaggcccccgagcugggcggccccggccugaagaagagauucggcaagaaggccgccgugcccacccccagacuguacaccgaggcccugcaggagaagaugcagagaggcuuccuggcccagaagcugcagcaguacaagagauucguggagaacuacagaagacacaucgugugcguggccaucuucagcgccaucugcgugggcguguucgccgacagagccuacuacuacggcuucgccagcccccccagcgacaucgcccagaccacccuggugggcaucauccugagcagaggcaccgccgccagcgugagcuucauguucagcuacauccugcugaccaugugcagaaaccugaucaccuuccugagagagaccuuccugaacagauacgugcccuucgacgccgccguggacuuccacagauggaucgccauggccgccguggugcuggccauccugcacagcgccggccacgccgugaacguguacaucuucagcgugagcccccugagccugcuggccugcaucuuccccaacguguucgugaacgacggcagcaagcugccccagaaguucuacuggugguucuuccagaccgugcccggcaugaccggcgugcugcugcugcuggugcuggccaucauguacguguucgccagccaccacuucagaagaagaagcuucagaggcuucuggcugacccaccaccuguacauccugcuguacgcccugcugaucauccacggcagcuacgcccugauccagcugcccaccuuccacaucuacuuccuggugcccgccaucaucuacggcggcgacaagcuggugagccugagcagaaagaagguggagaucagcguggugaaggccgagcugcugcccagcggcgugaccuaccugcaguuccagagaccccagggcuucgaguacaagagcggccagugggugagaaucgccugccuggcccugggcaccaccgaguaccaccccuucacccugaccagcgccccccacgaggacacccugagccugcacaucagagccgugggccccuggaccaccagacugagagagaucuacagcagccccaagggcaacggcugcgccggcuaccccaagcuguaccuggacggccccuucggcgagggccaccaggaguggcacaaguucgaggugagcgugcuggugggcggcggcaucggcgugacccccuucgccagcauccugaaggaccugguguucaagagcagccugggcagccagaugcugugcaagaagaucuacuucaucugggugaccagaacccagagacaguucgaguggcuggccgacaucauccaggagguggaggagaacgaccaccaggaccuggugagcgugcacaucuacgugacccagcuggccgagaaguucgaccugagaaccaccaugcuguacaucugcgagagacacuuccagaaggugcugaacagaagccuguucaccggccugagaagcaucacccacuucggcagaccccccuucgagcccuucuucaacagccugcaggaggugcacccccaggugagaaagaucggcguguucagcugcggcccccccggcaugaccaagaacguggagaaggccugccagcuggugaacagacaggacagagcccacuucaugcaccacuacgagaacuucuaa

SEQ ID NO: 16357 - RNA, 1452 nt, Artificial Sequence
  DUOXA1__Homo_sapiens__NP_001263193
auggccacccugggccacaccuuccccuucuacgccggccccaagcccaccuuccccauggacaccacccuggccagcaucaucaugaucuuccugaccgcccuggccaccuucaucgugauccugcccggcaucagaggcaagaccagacuguucuggcugcugagaguggugaccagccuguucaucggcgccgccauccuggccgugaacuucagcagcgaguggagcgugggccaggugagcaccaacaccagcuacaaggccuucagcagcgaguggaucagcgccgacaucggccugcaggugggccugggcggcgugaacaucacccugaccggcacccccgugcagcagcugaacgagaccaucaacuacaacgaggaguucaccuggagacugggcgagaacuacgccgaggaguacgccaaggcccuggagaagggccugcccgaccccgugcuguaccuggccgagaaguucacccccagaagccccugcggccuguacagacaguacagacuggccggccacuacaccagcgccaugcuguggguggccuuccugugcuggcugcuggccaacgugaugcugagcaugcccgugcugguguacggcggcuacaugcugcuggccaccggcaucuuccagcugcuggcccugcuguucuucagcauggccaccagccugaccagccccugcccccugcaccugggcgccagcgugcugcacacccaccacggccccgccuucuggaucacccugaccaccggccugcugugcgugcugcugggccuggccauggccguggcccacagaaugcagccccacagacugaaggccuucuucaaccagagcguggacgaggaccccaugcuggaguggagccccgaggagggcggccugcugagccccagauacagaagcauggccgacagccccaagagccaggacaucccccugagcgaggccagcagcaccaaggccuacuacagacccagaagacugagccuggugcccgccgacgugagaggccuggcccccgccgcccugagcgcccugcccggcgcccugcuggcccaggccuggagagcccugcugcccggccugagaugccccaaggccggcaaggagagcagacugggccccccccacagccccuggagauucggccccgagggcugcgaggagagaugggccgagcacaccggcgacagccccagaccccugagaggcagaggcaccggcagacuguggagauggggcagcaaggagagaagagccugcggcgugagagccaugcugcccagacuggugagcaacagcggccugaagagacccagcugccuggaccugcccaagugcugggacuacagaagagacgccagagccuucuuccaccugcuggagcccacccccugcgugaccagcagacacaccccccugaucuaa

SEQ ID NO: 16358 - RNA, 963 nt, Artificial Sequence
  DUOXA2__Homo_sapiens__NP_997464
augacccuguggaacggcgugcugcccuucuacccccagcccagacacgccgccggcuucagcgugccccugcugaucgugauccugguguuccuggcccuggccgccagcuuccugcugauccugcccggcaucagaggccacagcagaugguucuggcuggugagagugcugcugagccuguucaucggcgccgagaucguggccgugcacuucagcgccgagugguucgugggcaccgugaacaccaacaccagcuacaaggccuucagcgccgccagagugaccgccagagugagacugcuggugggccuggagggcaucaacaucacccugaccggcacccccgugcaccagcugaacgagaccaucgacuacaacgagcaguucaccuggagacugaaggagaacuacgccgccgaguacgccaacgcccuggagaagggccugcccgaccccgugcuguaccuggccgagaaguucacccccagcagccccugcggccuguaccaccaguaccaccuggccggccacuacgccagcgccacccuguggguggccuucugcuucuggcugcugagcaacgugcugcugagcacccccgccccccuguacggcggccuggcccugcugaccaccggcgccuucgcccuguucggcguguucgcccuggccagcaucagcagcgugccccugugcccccugagacugggcagcagcgcccugaccacccaguacggcgccgccuucugggugacccuggccaccggcgugcugugccuguuccugggcggcgccguggugagccugcaguacgugagacccagcgcccugagaacccugcuggaccagagcgccaaggacugcagccaggagagaggcggcagcccccugauccugggcgacccccugcacaagcaggccgcccugcccgaccugaagugcaucaccaccaaccuguaa

SEQ ID NO: 16359 - RNA, 663 nt, Artificial Sequence
  DUPD1__Homo_sapiens__NP_001003892
augaccagcggcgaggugaagaccagccugaagaacgccuacagcagcgccaagagacugagccccaagauggaggaggagggcgaggaggaggacuacugcacccccggcgccuucgagcuggagagacuguucuggaagggcagcccccaguacacccacgugaacgagguguggcccaagcuguacaucggcgacgaggccaccgcccuggacagauacagacugcagaaggccggcuucacccacgugcugaacgccgcccacggcagauggaacguggacaccggccccgacuacuacagagacauggacauccaguaccacggcguggaggccgacgaccugcccaccuucgaccugagcguguucuucuaccccgccgccgccuucaucgacagagcccugagcgacgaccacagcaagauccuggugcacugcgugaugggcagaagcagaagcgccacccuggugcuggccuaccugaugauccacaaggacaugacccugguggacgccauccagcagguggccaagaacagaugcgugcugcccaacagaggcuuccugaagcagcugagagagcuggacaagcagcuggugcagcagagaagaagaagccagagacaggacggcgaggaggaggacggcagagagcuguaa

SEQ ID NO: 16360 - RNA, 1482 nt, Artificial Sequence
  DUS2__Homo_sapiens__NP_001258691
augauccugaacagccugagccugugcuaccacaacaagcugauccuggcccccauggugagagugggcacccugcccaugagacugcuggcccuggacuacggcgccgacaucguguacugcgaggagcugaucgaccugaagaugauccagugcaagagaguggugaacgaggugcugagcaccguggacuucguggcccccgacgacagagugguguucagaaccugcgagagagagcagaacagagugguguuccagaugggcaccagcgacgccgagagagcccuggccguggccagacugguggagaacgacguggccggcaucgacgugaacaugggcugccccaagcaguacagcaccaagggcggcaugggcgccgcccugcugagcgaccccgacaagaucgagaagauccugagcacccuggugaagggcaccagaagacccgugaccugcaagaucagaauccugcccagccuggaggacacccugagccuggugaagagaaucgagagaaccggcaucgccgccaucgccgugcacggcagaaagagagaggagagaccccagcaccccgugagcugcgaggugaucaaggccaucgccgacacccugagcauccccgugaucgccaacggcggcagccacgaccacauccagcaguacagcgacaucgaggacuucagacaggccaccgccgccagcagcgugaugguggccagagccgccauguggaaccccagcaucuuccugaaggagggccugagaccccuggaggaggugaugcagaaguacaucagauacgccgugcaguacgacaaccacuacaccaacaccaaguacugccugugccagaugcugagagagcagcuggagagcccccagggcagacugcugcacgccgcccagagcagcagagagaucugcgaggccuucggccugggcgccuucuacgaggagaccacccaggagcuggacgcccagcaggccagacugagcgccaagaccagcgagcagaccggcgagcccgccgaggacaccagcggcgugaucaagauggccgugaaguucgacagaagagccuaccccgcccagaucacccccaagaugugccugcuggaguggugcagaagagagaagcuggcccagcccguguacgagaccgugcagagaccccuggacagacuguucagcagcaucgugaccguggccgagcagaaguaccagagcacccugugggacaagagcaagaagcuggccgagcaggccgccgccaucgugugccugagaagccagggccugcccgagggcagacugggcgaggagagccccagccugcacaagagaaagagagaggcccccgaccaggaccccggcggccccagagcccaggagcuggcccagcccggcgaccugugcaagaagcccuucguggcccugggcagcggcgaggagagcccccuggagggcugguaa

SEQ ID NO: 16361 - RNA, 1449 nt, Artificial Sequence
  DUSP10__Homo_sapiens__NP_009138
augccccccagcccccuggacgacagaguggugguggcccugagcagacccgugagaccccaggaccugaaccugugccuggacagcagcuaccugggcagcgccaaccccggcagcaacagccacccccccgugaucgccaccaccguggugagccugaaggccgccaaccugaccuacaugcccagcagcagcggcagcgccagaagccugaacugcggcugcagcagcgccagcugcugcaccguggccaccuacgacaaggacaaccaggcccagacccaggccaucgccgccggcaccaccaccaccgccaucggcaccagcaccaccugccccgccaaccagauggugaacaacaacgagaacaccggcagccugagccccagcagcggcgugggcagccccgugagcggcacccccaagcagcuggccagcaucaagaucaucuaccccaacgaccuggccaagaagaugaccaagugcagcaagagccaccugcccagccagggccccgugaucaucgacugcagacccuucauggaguacaacaagagccacauccagggcgccgugcacaucaacugcgccgacaagaucagcagaagaagacugcagcagggcaagaucaccgugcuggaccugaucagcugcagagagggcaaggacagcuucaagagaaucuucagcaaggagaucaucguguacgacgagaacaccaacgagcccagcagagugaugcccagccagccccugcacaucgugcuggagagccugaagagagagggcaaggagccccuggugcugaagggcggccugagcagcuucaagcagaaccacgagaaccugugcgacaacagccugcagcugcaggagugcagagaggugggcggcggcgccagcgccgccagcagccugcugccccagcccauccccaccacccccgacaucgagaacgccgagcugacccccauccugcccuuccuguuccugggcaacgagcaggacgcccaggaccuggacaccaugcagagacugaacaucggcuacgugaucaacgugaccacccaccugccccuguaccacuacgagaagggccuguucaacuacaagagacugcccgccaccgacagcaacaagcagaaccugagacaguacuucgaggaggccuucgaguucaucgaggaggcccaccagugcggcaagggccugcugauccacugccaggccggcgugagcagaagcgccaccaucgugaucgccuaccugaugaagcacaccagaaugaccaugaccgacgccuacaaguucgugaagggcaagagacccaucaucagccccaaccugaacuucaugggccagcugcuggaguucgaggaggaccugaacaacggcgugacccccagaauccugacccccaagcugaugggcguggagaccgugguguaa

SEQ ID NO: 16362 - RNA, 1134 nt, Artificial Sequence
  DUSP11__Homo_sapiens__NP_003575
augagaaacagcgagacccuggagagaggcgugggcggcugcagaguguucagcugccugggcagcuaccccggcaucgagggcgccggccuggcccugcuggccgaccuggcccugggcggcagacugcugggcacccacaugagccaguggcaccaccccagaagcggcuggggcagaagaagagacuucagcggcagaagcagcgccaagaagaagggcggcaaccacauccccgagagauggaaggacuaccugcccgugggccagagaaugcccggcaccagauucaucgccuucaaggugccccugcagaagagcuucgagaagaagcuggcccccgaggagugcuucagcccccuggaccuguucaacaagaucagagagcagaacgaggagcugggccugaucaucgaccugaccuacacccagagauacuacaagcccgaggaccugcccgagaccgugcccuaccugaagaucuucaccgugggccaccaggugcccgacgacgagaccaucuucaaguucaagcacgccgugaacggcuuccugaaggagaacaaggacaacgacaagcugaucggcgugcacugcacccacggccugaacagaaccggcuaccugaucugcagauaccugaucgacguggagggcgugagacccgacgacgccaucgagcuguucaacagaugcagaggccacugccuggagagacagaacuacaucgaggaccugcagaacggccccaucagaaagaacuggaacagcagcgugcccagaagcagcgacuucgaggacagcgcccaccugaugcagcccgugcacaacaagcccgugaagcagggccccagauacaaccugcaccagauccagggccacagcgcccccagacacuuccacacccagacccagagccugcagcagagcgugagaaaguucagcgagaacccccacguguaccagagacaccaccugcccccccccggcccccccggcgaggacuacagccacagaagauacagcuggaacgugaagcccaacgccagcagagccgcccaggacagaagaagaugguaccccuacaacuacagcagacugagcuaccccgccugcugggaguggacccaguaa

SEQ ID NO: 16363 - RNA, 1023 nt, Artificial Sequence
  DUSP12__Homo_sapiens__NP_009171
augcuggaggcccccggccccagcgacggcugcgagcugagcaaccccagcgccagcagagugagcugcgccggccagaugcuggaggugcagcccggccuguacuucggcggcgccgccgccguggccgagcccgaccaccugagagaggccggcaucaccgccgugcugaccguggacagcgaggagcccagcuucaaggccggccccggcguggaggaccuguggagacuguucgugcccgcccuggacaagcccgagaccgaccugcugagccaccuggacagaugcguggccuucaucggccaggccagagccgagggcagagccgugcuggugcacugccacgccggcgugagcagaagcguggccaucaucaccgccuuccugaugaagaccgaccagcugcccuucgagaaggccuacgagaagcugcagauccugaagcccgaggccaagaugaacgagggcuucgaguggcagcugaagcuguaccaggccaugggcuacgagguggacaccagcagcgccaucuacaagcaguacagacugcagaaggugaccgagaaguaccccgagcugcagaaccugccccaggagcuguucgccguggaccccaccaccgugagccagggccugaaggacgaggugcuguacaagugcagaaagugcagaagaagccuguucagaagcagcagcauccuggaccacagagagggcagcggccccaucgccuucgcccacaagagaaugacccccagcagcaugcugaccaccggcagacaggcccagugcaccagcuacuucaucgagcccgugcaguggauggagagcgcccugcugggcgugauggacggccagcugcugugccccaagugcagcgccaagcugggcagcuucaacugguacggcgagcagugcagcugcggcagauggaucacccccgccuuccagauccacaagaacagaguggacgagaugaagauccugcccgugcugggcagccagaccggcaagaucuaa

SEQ ID NO: 16364 - RNA, 567 nt, Artificial Sequence
  DUSP13__Homo_sapiens__NP_001007272
auggccgagaccagccugcccgagcugggcggcgaggacaaggccacccccugccccagcauccuggagcuggaggagcugcugagagccggcaagagcagcugcagcagaguggacgagguguggcccaaccuguucaucggcgacgccgccaccgccaacaacagauucgagcuguggaagcugggcaucacccacgugcugaacgccgcccacaagggccuguacugccagggcggccccgacuucuacggcagcagcgugagcuaccugggcgugcccgcccacgaccugcccgacuucgacaucagcgccuacuucagcagcgccgccgacuucauccacagagcccugaacacccccggcgccaaggugcuggugcacugcguggugggcgugagcagaagcgccacccuggugcuggccuaccugaugcugcaccagagacugagccugagacaggccgugaucaccgugagacagcacagauggguguuccccaacagaggcuuccugcaccagcugugcagacuggaccagcagcugagaggcgccggccagagcuaa

SEQ ID NO: 16365 - RNA, 597 nt, Artificial Sequence
  DUSP14__Homo_sapiens__NP_008957
augagcagcagaggccacagcacccugcccagaacccugauggcccccagaaugaucagcgagggcgacaucggcggcaucgcccagaucaccagcagccuguuccugggcagaggcagcguggccagcaacagacaccugcugcaggccagaggcaucaccugcaucgugaacgccaccaucgagauccccaacuucaacuggccccaguucgaguacgugaaggugccccuggccgacaugccccacgcccccaucggccuguacuucgacaccguggccgacaagauccacagcgugagcagaaagcacggcgccacccuggugcacugcgccgccggcgugagcagaagcgccacccugugcaucgccuaccugaugaaguuccacaacgugugccugcuggaggccuacaacugggugaaggccagaagacccgugaucagacccaacgugggcuucuggagacagcugaucgacuacgagagacagcuguucggcaagagcaccgugaagauggugcagacccccuacggcaucgugcccgacguguacgagaaggagagcagacaccugaugcccuacuggggcaucuaa

SEQ ID NO: 16366 - RNA, 708 nt, Artificial Sequence
  DUSP15__Homo_sapiens__NP_542178
augggcaacggcaugaccaaggugcugcccggccuguaccugggcaacuucaucgacgccaaggaccuggaccagcugggcagaaacaagaucacccacaucaucagcauccacgagagcccccagccccugcugcaggacaucaccuaccugagaauccccguggccgacacccccgaggugcccaucaagaagcacuucaaggagugcaucaacuucauccacugcugcagacugaacggcggcaacugccuggugcacugcuucgccggcaucagcagaagcaccaccaucgugaccgccuacgugaugaccgugaccggccugggcuggagagacgugcuggaggccaucaaggccaccagacccaucgccaaccccaaccccggcuucagacagcagcuggaggaguucggcugggccagcagccagaagcugagaagacagcuggaggagagauucggcgagagccccuucagagacgaggaggagcugagagcccugcugccccugugcaagagaugcagacagggcagcgccaccagcgccagcagcgccggcccccacagcgccgccagcgagggcaccgugcagagacuggugcccagaacccccagagaggcccacagaccccugccccugcuggccagagugaagcagaccuucagcugccugcccagaugccugagcagaaagggcggcaaguaa

SEQ ID NO: 16367 - RNA, 1554 nt, Artificial Sequence
  DUSP16__Homo_sapiens__XP_005253545
augcugccccugagccugcagaccguguucagccuguacuucugggugaacuggagaagagccagcacccuguucaccugccugcaggagcugaugcagcagaacggcaucggcuacgugcugaacgccagcaacaccugccccaagcccgacuucauccccgagagccacuuccugagagugcccgugaacgacagcuucugcgagaagauccugcccuggcuggacaagagcguggacuucaucgagaaggccaaggccagcaacggcugcgugcuggugcacugccuggccggcaucagcagaagcgccaccaucgccaucgccuacaucaugaagagaauggacaugagccuggacgaggccuacagauucgugaaggagaagagacccaccaucagccccaacuucaacuuccugggccagcugcuggacuacgagaagaagaucaagaaccagaccggcgccagcggccccaagagcaagcugaagcugcugcaccuggagaagcccaacgagcccgugcccgccgugagcgagggcggccagaagagcgagaccccccugagcccccccugcgccgacagcgccaccagcgaggccgccggccagagacccgugcaccccgccagcgugcccagcgugcccagcgugcagcccagccugcuggaggacagcccccuggugcaggcccugagcggccugcaccugagcgccgacagacuggaggacagcaacaagcugaagagaagcuucagccuggacaucaagagcgugagcuacagcgccagcauggccgccagccugcacggcuucagcagcagcgaggacgcccuggaguacuacaagcccagcaccacccuggacggcaccaacaagcugugccaguucagccccgugcaggagcugagcgagcagacccccgagaccagccccgacaaggaggaggccagcauccccaagaagcugcagaccgccagacccagcgacagccagagcaagagacugcacagcgugagaaccagcagcagcggcaccgcccagagaagccugcugagcccccugcacagaagcggcagcguggaggacaacuaccacaccagcuuccuguucggccugagcaccagccagcagcaccugaccaagagcgccggccugggccugaagggcuggcacagcgacauccuggccccccagaccagcacccccagccugaccagcagcugguacuucgccaccgagagcagccacuucuacagcgccagcgccaucuacggcggcagcgccagcuacagcgccuacagcugcagccagcugcccaccugcggcgaccagguguacagcgugagaagaagacagaagcccagcgacagagccgacagcagaagaagcuggcacgaggagagccccuucgagaagcaguucaagagaagaagcugccagauggaguucggcgagagcaucaugagcgagaacagaagcagagaggagcugggcaaggugggcagccagagcagcuucagcggcagcauggagaucaucgaggugagcuaa

SEQ ID NO: 16368 - RNA, 567 nt, Artificial Sequence
  DUSP18__Homo_sapiens__NP_001291723
augaccgcccccagcugcgccuuccccgugcaguucagacagcccagcgugagcggccugagccagaucaccaagagccuguacaucagcaacggcguggccgccaacaacaagcugaugcugagcagcaaccagaucaccauggugaucaacgugagcguggagguggugaacacccuguacgaggacauccaguacaugcaggugcccguggccgacagccccaacagcagacugugcgacuucuucgaccccaucgccgaccacauccacagcguggagaugaagcagggcagaacccugcugcacugcgccgccggcgugagcagaagcgccgcccugugccuggccuaccugaugaaguaccacgccaugagccugcuggacgcccacaccuggaccaagagcugcagacccaucaucagacccaacagcggcuucugggagcagcugauccacuacgaguuccagcuguucggcaagaacaccgugcacauggugagcagccccgugggcaugauccccgacaucuacgagaaggaggugagacugaugaucccccuguaa

SEQ ID NO: 16369 - RNA, 1104 nt, Artificial Sequence
  DUSP1__Homo_sapiens__NP_004408
auggugauggaggugggcacccuggacgccggcggccugagagcccugcugggcgagagagccgcccagugccugcugcuggacugcagaagcuucuucgccuucaacgccggccacaucgccggcagcgugaacgugagauucagcaccaucgugagaagaagagccaagggcgccaugggccuggagcacaucgugcccaacgccgagcugagaggcagacugcuggccggcgccuaccacgccguggugcugcuggacgagagaagcgccgcccuggacggcgccaagagagacggcacccuggcccuggccgccggcgcccugugcagagaggccagagccgcccagguguucuuccugaagggcggcuacgaggccuucagcgccagcugccccgagcugugcagcaagcagagcacccccaugggccugagccugccccugagcaccagcgugcccgacagcgccgagagcggcugcagcagcugcagcaccccccuguacgaccagggcggccccguggagauccugcccuuccuguaccugggcagcgccuaccacgccagcagaaaggacaugcuggacgcccugggcaucaccgcccugaucaacgugagcgccaacugccccaaccacuucgagggccacuaccaguacaagagcauccccguggaggacaaccacaaggccgacaucagcagcugguucaacgaggccaucgacuucaucgacagcaucaagaacgccggcggcagaguguucgugcacugccaggccggcaucagcagaagcgccaccaucugccuggccuaccugaugagaaccaacagagugaagcuggacgaggccuucgaguucgugaagcagagaagaagcaucaucagccccaacuucagcuucaugggccagcugcugcaguucgagagccaggugcuggccccccacugcagcgccgaggccggcagccccgccauggccgugcuggacagaggcaccagcaccaccaccguguucaacuuccccgugagcauccccgugcacagcaccaacagcgcccugagcuaccugcagagccccaucaccaccagccccagcugcuaa

SEQ ID NO: 16370 - RNA, 573 nt, Artificial Sequence
  DUSP21__Homo_sapiens__NP_071359
augaccgccagcgccagcagcuucagcagcagccagggcgugcagcagcccagcaucuacagcuucagccagaucaccagaagccuguuccugagcaacggcguggccgccaacgacaagcugcugcugagcagcaacagaaucaccgccaucgugaacgccagcguggagguggugaacguguucuucgagggcauccaguacaucaaggugcccgugaccgacgccagagacagcagacuguacgacuucuucgaccccaucgccgaccugauccacaccaucgacaugagacagggcagaacccugcugcacugcauggccggcgugagcagaagcgccagccugugccuggccuaccugaugaaguaccacagcaugagccugcuggacgcccacaccuggaccaagagcagaagacccaucaucagacccaacaacggcuucugggagcagcugaucaacuacgaguucaagcuguucaacaacaacaccgugagaaugaucaacagccccgugggcaacauccccgacaucuacgagaaggaccugagaaugaugaucagcauguaa

SEQ ID NO: 16371 - RNA, 618 nt, Artificial Sequence
  DUSP22__Homo_sapiens__NP_001273484
augggcaacggcaugaacaagauccugcccggccuguacaucggcaacuucaaggacgccagagacgccgagcagcugagcaagaacaaggugacccacauccugagcgugcacgacagcgccagacccaugcuggagggcgugaaguaccugugcauccccgccgccgacagccccagccagaaccugaccagacacuucaaggagagcaucaaguucauccacgagugcagacugagaggcgagagcugccuggugcacugccuggccggcgugagcagaagcgugacccuggugaucgccuacaucaugaccgugaccgacuucggcugggaggacgcccugcacaccgugagagccggcagaagcugcgccaaccccaacgugggcuuccagagacagcugcaggaguucgagaagcacgaggugcaccaguacagacaguggcugaaggaggaguacggcgagagcccccugcaggacgccgaggaggccaagaacauccugggcaaguacaaggagcagggcagaaccgagccccagcccggcgccagaagauggagcagcuuccccgcccuggccccccugaccuacgacaacuacaccaccgagaccuaa

SEQ ID NO: 16372 - RNA, 453 nt, Artificial Sequence
  DUSP23__Homo_sapiens__NP_060293
augggcgugcagccccccaacuucagcugggugcugcccggcagacuggccggccuggcccugcccagacugcccgcccacuaccaguuccugcuggaccugggcgugagacaccuggugagccugaccgagagaggccccccccacagcgacagcugccccggccugacccugcacagacugagaauccccgacuucugcccccccgcccccgaccagaucgacagauucgugcagaucguggacgaggccaacgccagaggcgaggccgugggcgugcacugcgcccugggcuucggcagaaccggcaccaugcuggccugcuaccuggugaaggagagaggccuggccgccggcgacgccaucgccgagaucagaagacugagacccggcagcaucgagaccuacgagcaggagaaggccguguuccaguucuaccagagaaccaaguaa

SEQ ID NO: 16373 - RNA, 3477 nt, Artificial Sequence
  DUSP27__Homo_sapiens__XP_005245660
auggccaccagaaaggacaccgaggaggagcagguggugcccagcgaggaggacgaggccaacgugagagccgugcaggcccacuaccugagaagccccagccccagccaguacagcauggugagcgacgccgagaccgagagcaucuucauggagcccauccaccugagcagcgccaucgccgccaagcagaucaucaacgaggagcugaagccccccggcgugagagccgacgccgagugccccggcaugcuggagagcgccgagcagcugcugguggaggaccuguacaacagagugagagagaagauggacgacaccagccuguacaacacccccugcgugcuggaccugcagagagcccuggugcaggacagacaggaggcccccuggaacgagguggacgagguguggcccaacguguucaucgccgagaagagcguggccgugaacaagggcagacugaagagacugggcaucacccacauccugaacgccgcccacggcaccggcguguacaccggccccgaguucuacaccggccuggagauccaguaccugggcguggagguggacgacuuccccgagguggacaucagccagcacuucagaaaggccagcgaguuccuggacgaggcccugcugaccuacagaggcaaggugcuggugagcagcgagaugggcaucagcagaagcgccgugcuggugguggccuaccugaugaucuuccacaacauggccauccuggaggcccugaugaccgugagaaagaagagagccaucuaccccaacgagggcuuccugaagcagcugagagagcugaacgagaagcugauggaggagagagaggaggacuacggcagagagggcggcagcgccgaggccgaggagggcgagggcaccggcagcaugcugggcgccagagugcacgcccugaccguggaggaggaggacgacagcgccagccaccugagcggcagcagccugggcaaggccacccaggccagcaagccccugacccugaucgacgaggaggaggaggagaagcuguacgagcaguggaagaagggccagggccugcugagcgacaaggugccccaggacggcggcggcuggagaagcgccagcagcggccagggcggcgaggagcuggaggacgaggacguggagagaaucauccaggaguggcagagcagaaacgagagauaccaggccgagggcuacagaagauggggcagagaggaggagaaggaggaggagagcgacgccggcagcagcgugggcagaagaagaagaacccugagcgagagcagcgccugggagagcgugagcagccacgacaucugggugcugaagcagcagcuggagcugaacagacccgaccacggcagaagaagaagagccgacagcaugagcagcgagagcaccugggacgccuggaacgagagacugcuggagaucgagaaggaggccagcagaagauaccacgccaagagcaagagagaggaggccgccgacagaagcagcgaggccggcagcagagugagagaggacgacgaggacagcgugggcagcgaggccagcagcuucuacaacuucugcagcagaaacaaggacaagcugaccgcccuggagagauggaagaucaagagaauccaguucggcuuccacaagaaggaccugggcgccggcgacagcagcggcgagcccggcgccgaggaggccgugggcgagaagaaccccagcgacgugagccugaccgccuaccaggccuggaagcugaagcaccagaagaaggugggcagcgagaacaaggaggaggugguggagcugagcaagggcgaggacagcgcccuggccaagaagagacagagaagacuggagcugcuggagagaagcagacagacccuggaggagagccagagcauggccagcugggaggccgacagcagcaccgccagcggcagcaucccccugagcgccuucuggagcgccgaccccagcgugagcgccgacggcgacaccaccagcgugcugagcacccagagccacagaagccaccugagccaggccgccagcaacaucgccggcugcagcaccagcaaccccaccaccccccugcccaaccugcccgugggccccggcgacaccaucagcaucgccagcauccagaacuggaucgccaacguggugagcgagacccuggcccagaagcagaacgagaugcugcugcugagcagaagccccagcguggccagcaugaaggccgugcccgccgccagcugccugggcgacgaccaggugagcaugcugagcggccacagcagcagcagccugggcggcugccugcugccccagagccaggccagacccagcagcgacaugcagagcgugcugagcugcaacaccacccugagcagccccgccgagagcugcagaagcaaggugagaggcaccagcaagcccaucuucagccuguucgccgacaacguggaccugaaggagcugggcagaaaggagaaggagaugcagauggagcugagagagaagaugagcgaguacaagauggagaagcuggccagcgacaacaagagaagcagccuguucaagaagaagaaggugaaggaggacgaggacgacggcgugggcgacggcgacgaggacaccgacagcgccaucggcagcuucagauacagcagcagaagcaacagccagaagcccgagaccgacaccugcagcagccuggccgugugcgaccacuacgccagcggcagcagagugggcaaggagauggacagcagcaucaacaaguggcugagcggccugagaaccgaggagaagccccccuuccagagcgacuggagcggcagcagcagaggcaaguacaccagaagcagccugcugagagagaccgagagcaagagcagcagcuacaaguucagcaagagccagagcgaggagcaggacaccagcagcuaccacgaggccaacggcaacagcgugagaagcaccagcagauucagcagcagcagcaccagagagggcagagagaugcacaaguucagcagaagcaccuacaacgagaccagcagcagcagagaggagagccccgagcccuacuucuucagaagaacccccgagagcagcgagagagaggagagccccgagccccagagacccaacugggccagaagcagagacugggaggacguggaggagagcagcaagagcgacuucagcgaguucggcgccaagagaaaguucacccagagcuucaugagaagcgaggaggagggcgagaaggagagaaccgagaacagagaggagggcagauucgccagcggcagaagaagccaguacagaagaagcaccgacagagaggaggaggaggagauggacgacgaggccaucaucgccgccuggagaagaagacaggaggagaccagaaccaagcugcagaagagaagagaggacuaa

SEQ ID NO: 16374 - RNA, 531 nt, Artificial Sequence
  DUSP28__Homo_sapiens__NP_001028747
augggccccgccgaggccggcagaagaggcgccgccagccccgugccccccccccuggugagaguggcccccagccuguuccugggcagcgccagagccgccggcgccgaggagcagcuggccagagccggcgugacccugugcgugaacgugagcagacagcagcccggccccagagcccccggcguggccgagcugagagugcccguguucgacgaccccgccgaggaccugcuggcccaccuggagcccaccugcgccgccauggaggccgccgugagagccggcggcgccugccugguguacugcaagaacggcagaagcagaagcgccgccgugugcaccgccuaccugaugagacacagaggccugagccuggccaaggccuuccagauggugaagagcgccagacccguggccgagcccaaccccggcuucuggagccagcugcagaaguacgaggaggcccugcaggcccagagcugccugcagggcgagccccccgcccugggccugggccccgaggccuaa

SEQ ID NO: 16375 - RNA, 945 nt, Artificial Sequence
  DUSP2__Homo_sapiens__NP_004409
augggccuggaggccgccagagagcuggagugcgccgcccugggcacccugcugagagaccccagagaggccgagagaacccugcugcuggacugcagacccuuccuggccuucugcagaagacacgugagagccgccagacccgugcccuggaacgcccugcugagaagaagagccagaggcccccccgccgccgugcuggccugccugcugcccgacagagcccugagaaccagacuggugagaggcgagcuggccagagccguggugcuggacgagggcagcgccagcguggccgagcugagacccgacagccccgcccacgugcugcuggccgcccugcugcacgagaccagagccggccccaccgccguguacuuccugagaggcggcuucgacggcuuccagggcugcugccccgaccugugcagcgaggcccccgcccccgcccugccccccaccggcgacaagaccagcagaagcgacagcagagcccccguguacgaccagggcggccccguggagauccugcccuaccuguuccugggcagcugcagccacagcagcgaccugcagggccugcaggccugcggcaucaccgccgugcugaacgugagcgccagcugccccaaccacuucgagggccuguucagauacaagagcauccccguggaggacaaccagaugguggagaucagcgccugguuccaggaggccaucggcuucaucgacugggugaagaacagcggcggcagagugcuggugcacugccaggccggcaucagcagaagcgccaccaucugccuggccuaccugaugcagagcagaagagugagacuggacgaggccuucgacuucgugaagcagagaagaggcgugaucagccccaacuucagcuucaugggccagcugcugcaguucgagacccaggugcugugccacuaa

SEQ ID NO: 16376 - RNA, 558 nt, Artificial Sequence
  DUSP3__Homo_sapiens__NP_004081
augagcggcagcuucgagcugagcgugcaggaccugaacgaccugcugagcgacggcagcggcugcuacagccugcccagccagcccugcaacgaggugacccccagaaucuacgugggcaacgccagcguggcccaggacauccccaagcugcagaagcugggcaucacccacgugcugaacgccgccgagggcagaagcuucaugcacgugaacaccaacgccaacuucuacaaggacagcggcaucaccuaccugggcaucaaggccaacgacacccaggaguucaaccugagcgccuacuucgagagagccgccgacuucaucgaccaggcccuggcccagaagaacggcagagugcuggugcacugcagagagggcuacagcagaagccccacccuggugaucgccuaccugaugaugagacagaagauggacgugaagagcgcccugagcaucgugagacagaacagagagaucggccccaacgacggcuuccuggcccagcugugccagcugaacgacagacuggccaaggagggcaagcugaagcccuaa

SEQ ID NO: 16377 - RNA, 1185 nt, Artificial Sequence
  DUSP4__Homo_sapiens__NP_001385
auggugaccauggaggagcugagagagauggacugcagcgugcugaagagacugaugaacagagacgagaacggcggcggcgccggcggcagcggcagccacggcacccugggccugcccagcggcggcaagugccugcugcuggacugcagacccuuccuggcccacagcgccggcuacauccugggcagcgugaacgugagaugcaacaccaucgugagaagaagagccaagggcagcgugagccuggagcagauccugcccgccgaggaggaggugagagccagacugagaagcggccuguacagcgccgugaucguguacgacgagagaagccccagagccgagagccugagagaggacagcaccgugagccugguggugcaggcccugagaagaaacgccgagagaaccgacaucugccugcugaagggcggcuacgagagauucagcagcgaguaccccgaguucugcagcaagaccaaggcccuggccgccauccccccccccgugccccccagcgccaccgagccccuggaccugggcugcagcagcugcggcaccccccugcacgaccagggcggccccguggagauccugcccuuccuguaccugggcagcgccuaccacgccgccagaagagacaugcuggacgcccugggcaucaccgcccugcugaacgugagcagcgacugccccaaccacuucgagggccacuaccaguacaagugcauccccguggaggacaaccacaaggccgacaucagcagcugguucauggaggccaucgaguacaucgacgccgugaaggacugcagaggcagagugcuggugcacugccaggccggcaucagcagaagcgccaccaucugccuggccuaccugaugaugaagaagagagugagacuggaggaggccuucgaguucgugaagcagagaagaagcaucaucagccccaacuucagcuucaugggccagcugcugcaguucgagagccaggugcuggccaccagcugcgccgccgaggccgccagccccagcggcccccugagagagagaggcaagacccccgccacccccaccagccaguucguguucagcuuccccgugagcgugggcgugcacagcgcccccagcagccugcccuaccugcacagccccaucaccaccagccccagcugcuaa

SEQ ID NO: 16378 - RNA, 1155 nt, Artificial Sequence
  DUSP5__Homo_sapiens__NP_004410
augaaggugaccagccuggacggcagacagcugagaaagaugcugagaaaggaggccgccgccagaugcguggugcuggacugcagacccuaccuggccuucgccgccagcaacgugagaggcagccugaacgugaaccugaacagcguggugcugagaagagccagaggcggcgccgugagcgccagauacgugcugcccgacgaggccgccagagccagacugcugcaggagggcggcggcggcguggccgccgugguggugcuggaccagggcagcagacacuggcagaagcugagagaggagagcgccgccagaguggugcugaccagccugcuggccugccugcccgccggccccagaguguacuuccugaagggcggcuacgagaccuucuacagcgaguaccccgagugcugcguggacgugaagcccaucagccaggagaagaucgagagcgagagagcccugaucagccagugcggcaagcccguggugaacgugagcuacagacccgccuacgaccagggcggccccguggagauccugcccuuccuguaccugggcagcgccuaccacgccagcaagugcgaguuccuggccaaccugcacaucaccgcccugcugaacgugagcagaagaaccagcgaggccugcgccacccaccugcacuacaaguggauccccguggaggacagccacaccgccgacaucagcagccacuuccaggaggccaucgacuucaucgacugcgugagagagaagggcggcaaggugcuggugcacugcgaggccggcaucagcagaagccccaccaucugcauggccuaccugaugaagaccaagcaguucagacugaaggaggccuucgacuacaucaagcagagaagaagcauggugagccccaacuucggcuucaugggccagcugcugcaguacgagagcgagauccugcccagcacccccaacccccagccccccagcugccagggcgaggccgccggcagcagccugaucggccaccugcagacccugagccccgacaugcagggcgccuacugcaccuuccccgccagcgugcuggcccccgugcccacccacagcaccgugagcgagcugagcagaagccccguggccaccgccaccagcugcuaa

SEQ ID NO: 16379 - RNA, 1146 nt, Artificial Sequence
  DUSP6__Homo_sapiens__NP_001937
augaucgacacccugagacccgugcccuucgccagcgagauggccaucagcaagaccguggccuggcugaacgagcagcuggagcugggcaacgagagacugcugcugauggacugcagaccccaggagcuguacgagagcagccacaucgagagcgccaucaacguggccauccccggcaucaugcugagaagacugcagaagggcaaccugcccgugagagcccuguucaccagaggcgaggacagagacagauucaccagaagaugcggcaccgacaccguggugcuguacgacgagagcagcagcgacuggaacgagaacaccggcggcgagagcgugcugggccugcugcugaagaagcugaaggacgagggcugcagagccuucuaccuggagggcggcuucagcaaguuccaggccgaguucagccugcacugcgagaccaaccuggacggcagcugcagcagcagcagccccccccugcccgugcugggccugggcggccugagaaucagcagcgacagcagcagcgacaucgagagcgaccuggacagagaccccaacagcgccaccgacagcgacggcagcccccugagcaacagccagcccagcuuccccguggagauccugcccuuccuguaccugggcugcgccaaggacagcaccaaccuggacgugcuggaggaguucggcaucaaguacauccugaacgugacccccaaccugcccaaccuguucgagaacgccggcgaguucaaguacaagcagauccccaucagcgaccacuggagccagaaccugagccaguucuuccccgaggccaucagcuucaucgacgaggccagaggcaagaacugcggcgugcuggugcacugccuggccggcaucagcagaagcgugaccgugaccguggccuaccugaugcagaagcugaaccugagcaugaacgacgccuacgacaucgugaagaugaagaagagcaacaucagccccaacuucaacuucaugggccagcugcuggacuucgagagaacccugggccugagcagccccugcgacaacagagugcccgcccagcagcuguacuucaccacccccagcaaccagaacguguaccagguggacagccugcagagcaccuaa

SEQ ID NO: 16380 - RNA, 1260 nt, Artificial Sequence
  DUSP7__Homo_sapiens__NP_001938
augaagaaccagcugagaggcccccccgccagagcccacaugagcaccagcggcgccgccgccgccggcggcaccagagccggcagcgagcccggcgccggcagcggcagcggcgccggcaccggcgccggcgccgccaccggcgccggcgccaugcccugcaagagcgccgaguggcugcaggaggagcuggaggccagaggcggcgccagccugcugcugcuggacugcagaccccacgagcuguucgagagcagccacaucgagaccgccaucaaccuggccauccccggccugaugcugagaagacugagaaagggcaaccugcccaucagaagcaucauccccaaccacgccgacaaggagagauucgccaccagaugcaaggccgccaccgugcugcuguacgacgaggccaccgccgaguggcagcccgagcccggcgcccccgccagcgugcugggccugcugcugcagaagcugagagacgacggcugccaggccuacuaccugcagggcggcuucaacaaguuccagaccgaguacagcgagcacugcgagaccaacguggacagcagcagcagccccagcagcagcccccccaccagcgugcugggccugggcggccugagaaucagcagcgacugcagcgacggcgagagcgacagagagcugcccagcagcgccaccgagagcgacggcagccccgugcccagcagccagcccgccuuccccgugcagauccugcccuaccuguaccugggcugcgccaaggacagcaccaaccuggacgugcugggcaaguacggcaucaaguacauccugaacgugacccccaaccugcccaacgccuucgagcacggcggcgaguucaccuacaagcagauccccaucagcgaccacuggagccagaaccugagccaguucuuccccgaggccaucagcuucaucgacgaggccagaagcaagaagugcggcgugcuggugcacugccuggccggcaucagcagaagcgugaccgugaccguggccuaccugaugcagaagaugaaccugagccugaacgacgccuacgacuucgugaagagaaagaagagcaacaucagccccaacuucaacuucaugggccagcugcuggacuucgagagaacccugggccugagcagccccugcgacaaccacgccagcagcgagcagcuguacuucagcacccccaccaaccacaaccuguucccccugaacacccuggagagcaccuaa

SEQ ID NO: 16381 - RNA, 1878 nt, Artificial Sequence
  DUSP8__Homo_sapiens__XP_011518235
auggccggcgacagacugcccagaaaggugauggacgccaagaagcuggccagccugcugagaggcggccccggcggcccccuggugaucgacagcagaagcuucguggaguacaacagcuggcacgugcugagcagcgugaacaucugcugcagcaagcuggugaagagaagacugcagcagggcaaggugaccaucgccgagcugauccagcccgccgccagaagccagguggaggccaccgagccccaggacguggugguguacgaccagagcaccagagacgccagcgugcuggccgccgacagcuuccugagcauccugcugagcaagcuggacggcugcuucgacagcguggccauccugaccggcggcuucgccaccuucagcagcugcuuccccggccugugcgagggcaagcccgccgcccugcugcccaugagccugagccagcccugccugcccgugcccagcgugggccugaccagaauccugccccaccuguaccugggcagccagaaggacgugcugaacaaggaccugaugacccagaacggcaucagcuacgugcugaacgccagcaacagcugccccaagcccgacuucaucugcgagagcagauucaugagagugcccaucaacgacaacuacugcgagaagcugcugcccuggcuggacaagagcaucgaguucaucgacaaggccaagcugagcagcugccaggugaucgugcacugccuggccggcaucagcagaagcgccaccaucgccaucgccuacaucaugaagaccaugggcaugagcagcgacgacgccuacagauucgugaaggacagaagacccagcaucagccccaacuucaacuuccugggccagcugcuggaguacgagagaagccugaagcugcuggccgcccugcagggcgaccccggcacccccagcggcacccccgagcccccccccagccccgccgccggcgccccccugcccagacugcccccccccaccagcgagagcgccgccaccggcaacgccgccgccagagagggcggccugagcgccggcggcgagccccccgccccccccaccccccccgccaccagcgcccugcagcagggccugagaggccugcaccugagcagcgacagacugcaggacaccaacagacugaagagaagcuucagccuggacaucaagagcgccuacgcccccagcagaagacccgacggccccggcccccccgaccccggcgaggcccccaagcugugcaagcuggacagccccagcggcgccgcccugggccugagcagccccagccccgacagccccgacgccgcccccgaggccagacccagacccagaagaagacccagaccccccgccggcagccccgccagaagccccgcccacagccugggccugaacuucggcgacgccgccagacagacccccagacacggccugagcgcccugagcgcccccggccugcccggccccggccagcccgccggccccggcgccugggcccccccccuggacagccccggcacccccagccccgacggccccuggugcuucagccccgagggcgcccagggcgccggcggcgugcuguucgcccccuucggcagagccggcgcccccggccccggcggcggcagcgaccugagaagaagagaggccgccagagccgagcccagagacgccagaaccggcuggcccgaggagcccgcccccgagacccaguucaagagaagaagcugccagauggaguucgaggagggcaugguggagggcagagccagaggcgaggagcuggccgcccugggcaagcaggccagcuucagcggcagcguggaggugaucgaggugagcuaa

SEQ ID NO: 16382 - RNA, 1248 nt, Artificial Sequence
  DUSP9__Homo_sapiens__XP_011529425
auggaggccgcccaggugggccccaagggcagacagcugcccggcaagcacgugguggcccccguggugcagagagugggcagcagaagccccauggagggccugggcagaagcugccuguggcugagaagagagcugagcccccccagacccagacugcugcugcuggacugcagaagcagagagcuguacgagagcgccagaaucggcggcgcccugagcguggcccugcccgcccugcugcugagaagacugagaagaggcagccugagcgugagagcccugcugcccggccccccccugcagccccccccccccgcccccgugcugcuguacgaccagggcggcggcagaagaagaagaggcgaggccgaggccgaggccgaggagugggaggccgagagcgugcugggcacccugcugcagaagcugagagaggagggcuaccuggccuacuaccugcagggcggcuucagcagauuccaggccgagugcccccaccugugcgagaccagccuggccggcagagccggcagcagcauggcccccgugcccggccccgugcccguggugggccugggcagccugugccugggcagcgacugcagcgacgccgagagcgaggccgacagagacagcaugagcugcggccuggacagcgagggcgccacccccccccccgugggccugagagccagcuuccccgugcagauccugcccaaccuguaccugggcagcgccagagacagcgccaaccuggagagccuggccaagcugggcaucagauacauccugaacgugacccccaaccugcccaacuucuucgagaagaacggcgacuuccacuacaagcagauccccaucagcgaccacuggagccagaaccugagcagauucuuccccgaggccaucgaguucaucgacgaggcccugagccagaacugcggcgugcuggugcacugccuggccggcgugagcagaagcgugaccgugaccguggccuaccugaugcagaagcugcaccugagccugaacgacgccuacgaccuggugaagagaaagaagagcaacaucagccccaacuucaacuucaugggccagcugcuggacuucgagagaagccugagacuggaggagagacacagccaggagcagggcagcggcggccaggccagcgccgccagcaacccccccagcuucuucaccacccccaccagcgacggcgccuucgagcuggcccccaccuaa

SEQ ID NO: 16383 - RNA, 759 nt, Artificial Sequence
  DUT__Homo_sapiens__NP_001020419
augaccccccugugccccagacccgcccugugcuaccacuuccugaccagccugcugagaagcgccaugcagaacgccagaggcgccagacagagagccgaggccgccgugcugagcggccccggccccccccugggcagagccgcccagcacggcauccccagaccccugagcagcgccggcagacugagccagggcugcagaggcgccagcaccgugggcgccgccggcuggaagggcgagcugcccaaggccggcggcagccccgcccccggccccgagacccccgccaucagccccagcaagagagccagacccgccgaggugggcggcaugcagcugagauucgccagacugagcgagcacgccaccgcccccaccagaggcagcgccagagccgccggcuacgaccuguacagcgccuacgacuacaccaucccccccauggagaaggccguggugaagaccgacauccagaucgcccugcccagcggcugcuacggcagaguggcccccagaagcggccuggccgccaagcacuucaucgacgugggcgccggcgugaucgacgaggacuacagaggcaacgugggcguggugcuguucaacuucggcaaggagaaguucgaggugaagaagggcgacagaaucgcccagcugaucugcgagagaaucuucuaccccgagaucgaggaggugcaggcccuggacgacaccgagagaggcagcggcggcuucggcagcaccggcaagaacuaa

SEQ ID NO: 16384 - RNA, 483 nt, Artificial Sequence
  DUX4__Homo_sapiens__XP_011529816
auggcccugcccacccccagcgacagcacccugcccgccgaggccagaggcagaggcagaagaagaagacugguguggacccccagccagagcgaggcccugagagccugcuucgagagaaaccccuaccccggcaucgccaccagagagagacuggcccaggccaucggcauccccgagcccagagugcagaucugguuccagaacgagagaagcagacagcugagacagcacagaagagagagcagacccuggcccggcagaagaggcccccccgagggcagaagaaagagaaccgccgugaccggcagccagaccgcccugcugcugagagccuucgagaaggacagauuccccggcaucgccgccagagaggagcuggccagagagaccggccugcccgagagcagaauccagaucugguuccagaacagaagagccagacaccccggccagggcggcagagcccccgcccagguguaa

SEQ ID NO: 16385 - RNA, 2211 nt, Artificial Sequence
  DVL2__Homo_sapiens__NP_004413
auggccggcagcagcaccggcggcggcggcgugggcgagaccaaggugaucuaccaccuggacgaggaggagacccccuaccuggugaagauccccgugcccgccgagagaaucacccugggcgacuucaagagcgugcugcagagacccgccggcgccaaguacuucuucaagagcauggaccaggacuucggcguggugaaggaggagaucagcgacgacaacgccagacugcccugcuucaacggcagaguggugagcuggcuggugagcagcgacaacccccagcccgagauggccccccccgugcacgagcccagagccgagcuggccccccccgcccccccccugcccccccugccccccgagagaaccagcggcaucggcgacagcagaccccccagcuuccaccccaacgugagcagcagccacgagaaccuggagcccgagaccgagaccgagagcguggugagccugagaagagagagacccagaagaagagacagcagcgagcacggcgccggcggccacagaaccggcggccccagcagacuggagagacaccuggccggcuacgagagcagcagcacccugaugaccagcgagcuggagagcaccagccugggcgacagcgacgaggaggacaccaugagcagauucagcagcagcaccgagcagagcagcgccagcagacugcugaagagacacagaagaagaagaaagcagagaccccccagacuggagagaaccagcagcuucagcagcgugaccgacagcaccaugagccugaacaucaucaccgugacccugaacauggagaaguacaacuuccugggcaucagcaucgugggccagagcaacgagagaggcgacggcggcaucuacaucggcagcaucaugaagggcggcgccguggccgccgacggcagaaucgagcccggcgacaugcugcugcaggugaacgacaugaacuucgagaacaugagcaacgacgacgccgugagagugcugagagacaucgugcacaagcccggccccaucgugcugaccguggccaagugcugggaccccagcccccaggccuacuucacccugcccagaaacgagcccauccagcccaucgaccccgccgccugggugagccacagcgccgcccugaccggcaccuuccccgccuaccccggcagcagcagcaugagcaccaucaccagcggcagcagccugcccgacggcugcgagggcagaggccugagcgugcacaccgacauggccagcgugaccaaggccauggccgcccccgagagcggccuggaggugagagacagaauguggcugaagaucaccauccccaacgccuuccugggcagcgacgugguggacuggcuguaccaccacguggagggcuuccccgagagaagagaggccagaaaguacgccagcggccugcugaaggccggccugaucagacacaccgugaacaagaucaccuucagcgagcagugcuacuacguguucggcgaccugagcggcggcugcgagagcuaccuggugaaccugagccugaacgacaacgacggcagcagcggcgccagcgaccaggacacccuggccccccugcccggcgccacccccuggccccugcugcccaccuucagcuaccaguaccccgccccccaccccuacagcccccagcccccccccuaccacgagcugagcagcuacaccuacggcggcggcagcgccagcagccagcacagcgagggcagcagaagcagcggcagcaccagaagcgacggcggcgccggcagaaccggcagacccgaggagagagcccccgagagcaagagcggcagcggcagcgagagcgagcccagcagcagaggcggcagccugagaagaggcggcgaggccagcggcaccagcgacggcggccccccccccagcagaggcagcaccggcggcgcccccaaccugagagcccaccccggccugcaccccuacggccccccccccggcauggcccugcccuacaaccccaugaugguggugaugaugccccccccccccccccccgugccccccgccgugcagccccccggcgccccccccgugagagaccugggcagcgugccccccgagcugaccgccagcagacagagcuuccacauggccaugggcaaccccagcgaguucuucguggacgugauguaa

SEQ ID NO: 16386 - RNA, 2151 nt, Artificial Sequence
  DVL3__Homo_sapiens__NP_004414
augggcgagaccaagaucaucuaccaccuggacggccaggagacccccuaccuggugaagcugccccugcccgccgagagagugacccuggccgacuucaagggcgugcugcagagacccagcuacaaguucuucuucaagagcauggacgacgacuucggcguggugaaggaggagaucagcgacgacaacgccaagcugcccugcuucaacggcagaguggugagcuggcuggugagcgccgagggcagccaccccgaccccgcccccuucugcgccgacaaccccagcgagcugcccccccccauggagagaaccggcggcaucggcgacagcagaccccccagcuuccacccccacgccggcggcggcagccaggagaaccuggacaacgacaccgagaccgacagccuggugagcgcccagagagagagacccagaagaagagacggccccgagcacgccaccagacugaacggcaccgccaagggcgagagaagaagagagcccggcggcuacgacagcagcagcacccugaugagcagcgagcuggagaccaccagcuucuucgacagcgacgaggacgacagcaccagcagauucagcagcagcaccgagcagagcagcgccagcagacugaugagaagacacaagagaagaagaagaaagcagaaggugagcagaaucgagagaagcagcagcuucagcagcaucaccgacagcaccaugagccugaacaucaucaccgugacccugaacauggagaaguacaacuuccugggcaucagcaucgugggccagagcaacgagagaggcgacggcggcaucuacaucggcagcaucaugaagggcggcgccguggccgccgacggcagaaucgagcccggcgacaugcugcugcaggugaacgagaucaacuucgagaacaugagcaacgacgacgccgugagagugcugagagagaucgugcacaagcccggccccaucacccugaccguggccaagugcugggaccccagccccagaggcugcuucacccugcccagaagcgagcccaucagacccaucgaccccgccgccugggugagccacaccgccgccaugaccggcaccuuccccgccuacggcaugagccccagccugagcaccaucaccagcaccagcagcagcaucaccagcagcauccccgacaccgagagacuggacgacuuccaccugagcauccacagcgacauggccgccaucgugaaggccauggccagccccgagagcggccuggaggugagagacagaauguggcugaagaucaccauccccaacgccuucaucggcagcgacgugguggacuggcuguaccacaacguggagggcuucaccgacagaagagaggccagaaaguacgccagcaaccugcugaaggccggcuucaucagacacaccgugaacaagaucaccuucagcgagcagugcuacuacaucuucggcgaccugugcggcaacauggccaaccugagccugcacgaccacgacggcagcagcggcgccagcgaccaggacacccuggccccccugccccaccccggcgccgcccccuggcccauggccuuccccuaccaguaccccccccccccccaccccuacaacccccaccccggcuuccccgagcugggcuacagcuacggcggcggcagcgccagcagccagcacagcgagggcagcagaagcagcggcagcaacagaagcggcagcgacagaagaaaggagaaggaccccaaggccggcgacagcaagagcggcggcagcggcagcgagagcgaccacaccaccagaagcagccugagaggccccagagagagagcccccagcgagagaagcggccccgccgccagcgagcacagccacagaagccaccacagccuggccagcagccugagaagccaccacacccaccccagcuacggcccccccggcgugcccccccuguacggcccccccaugcugaugaugccccccccccccgccgccaugggcccccccggcgccccccccggcagagaccuggccagcgugccccccgagcugaccgccagcagacagagcuucagaauggccaugggcaaccccagcgaguucuucguggacgugauguaa

SEQ ID NO: 16387 - RNA, 1191 nt, Artificial Sequence
  DXO__Homo_sapiens__XP_006715068
auggaccccagaggcaccaagagaggcgccgagaagaccgagguggccgagcccagaaacaagcugcccagacccgcccccagccugcccaccgaccccgcccuguacagcggccccuuccccuucuacagaagacccagcgagcugggcugcuucagccuggacgcccagagacaguaccacggcgacgccagagcccugagauacuacagccccccccccaccaacggccccggccccaacuucgaccugagagacggcuaccccgacagauaccagcccagagacgaggaggugcaggagagacuggaccaccugcugugcuggcugcuggagcacagaggcagacuggagggcggccccggcuggcuggccgaggccaucgugaccuggagaggccaccugaccaagcugcugaccacccccuacgagagacaggagggcuggcagcuggccgccagcagauuccagggcacccuguaccugagcgagguggagacccccaacgccagagcccagagacuggccagacccccccugcugagagagcugauguacaugggcuacaaguucgagcaguacaugugcgccgacaagcccggcagcagccccgaccccagcggcgaggugaacaccaacguggccuucugcagcgugcugagaagcagacugggcagccacccccugcuguucagcggcgagguggacugcaccgacccccaggcccccagcacccagccccccaccugcuacguggagcugaagaccagcaaggagaugcacagccccggccaguggagaagcuucuacagacacaagcugcugaaguggugggcccagagcuuccugcccggcgugcccaacgugguggccggcuucagaaaccccgacggcuucgugagcagccugaagaccuuccccaccaugaagauguucgaguacgugagaaacgacagagacggcuggaaccccagcgugugcaugaacuucugcgccgccuuccugagcuucgcccagagcaccguggugcaggacgaccccagacuggugcaccuguucagcugggagcccggcggccccgugaccgugagcgugcaccaggacgcccccuacgccuuccugcccaucugguacguggaggccaugacccaggaccugcccagcccccccaagacccccagccccaaguaa

SEQ ID NO: 16388 - RNA, 2010 nt, Artificial Sequence
  DYM__Homo_sapiens__NP_060123
augggcagcaacagcagcagaaucggcgaccugcccaagaacgaguaccugaagaagcugagcggcaccgagagcaucagcgagaacgaccccuucuggaaccagcugcugagcuucagcuuccccgcccccaccagcagcagcgagcugaagcugcuggaggaggccaccaucagcgugugcagaagccugguggagaacaaccccagaaccggcaaccugggcgcccugaucaagguguuccugagcagaaccaaggagcugaagcugagcgccgagugccagaaccacaucuucaucuggcagacccacaacgcccuguucaucaucugcugccugcugaagguguucaucugccagaugagcgaggaggagcugcagcugcacuucaccuacgaggagaagagccccggcaacuacagcagcgacagcgaggaccugcuggaggagcugcugugcugccugaugcagcugaucaccgacaucccccugcuggacaucaccuacgagaucagcguggaggccaucagcaccauggugguguuccugagcugccagcuguuccacaaggaggugcugagacagagcaucagccacaaguaccugaugagaggccccugccugcccuacaccagcaagcuggugaagacccugcuguacaacuucaucagacaggagaagccccccccccccggcgcccacguguucccccagcagagcgacggcggcggccugcuguacggccuggccagcggcguggccaccggccuguggaccguguucacccugggcggcgugggcagcaaggccgccgccagccccgagcugagcagcccccuggccaaccagagccugcugcugcugcuggugcuggccaaccugaccgacgccagcgacgcccccaaccccuacagacaggccaucaugagcuucaagaacacccaggacagcagccccuuccccagcagcaucccccacgccuuccagaucaacuucaacagccuguacaccgcccugugcgagcagcagaccagcgaccaggccacccugcugcuguacacccugcugcaccagaacagcaacaucagaaccuacaugcuggccagaaccgacauggagaaccuggugcugcccauccuggagauccuguaccacguggaggagagaaacagccaccacguguacauggcccugaucauccugcugauccugaccgaggacgacggcuucaacagaagcauccacgaggugauccugaagaacaucaccugguacagcgagagagugcugaccgagaucagccugggcagccugcugauccugguggugaucagaaccauccaguacaacaugaccagaaccagagacaaguaccugcacaccaacugccuggccgcccuggccaacaugagcgcccaguucagaagccugcaccaguacgccgcccagagaaucaucagccuguucagccugcugagcaagaagcacaacaaggugcuggagcaggccacccagagccugagaggcagccugagcagcaacgacgugccccugcccgacuacgcccaggaccugaacgugaucgaggaggugaucagaaugaugcuggagaucaucaacagcugccugaccaacagccugcaccacaaccccaaccugguguacgcccugcuguacaagagagaccuguucgagcaguucagaacccaccccagcuuccaggacaucaugcagaacaucgaccuggugaucagcuucuucagcagcagacugcugcaggccggcgccgagcugagcguggagagagugcuggagaucaucaagcagggcgugguggcccugcccaaggacagacugaagaaguuccccgagcugaaguucaaguacguggaggaggagcagcccgaggaguucuucauccccuacguguggagccugguguacaacagcgccgugggccuguacuggaacccccaggacauccagcuguucaccauggacagcgacuaa

SEQ ID NO: 16389 - RNA, 633 nt, Artificial Sequence
  DYNAP__Homo_sapiens__NP_775900
augguggccgacaucaagggcaacgagcagaucgagaaguacagcuggagagaggccugcgacaccggcagcagcagaauggacagaaagcacggcaaguacauccugaacguggagcacagcgagaaccagccccccaucacccaccccaacgaccaggaggcccacagcagcaucugcuggugccugcccagcaacgacaucaccagcgacgugagccccaaccugaccggcgugugcgugaaccccggcauccuggcccacagcagaugccugcagagcgagagcugcaacacccaggugaaggaguacugcagaaacgacuggagcauguggaagguguuccuggccugccugcuggccugcgugaucaugaccgccaucggcgugcugaucaucugccuggugaacaacaagggcagcgccaacagcagcaucgugauccagcugagcaccaacgacggcgagugcgugaccgugaagcccggcacccccagccccgccugcccccccaccaugaccaccaccagcaccgugcccgccagcaccgccaccgagagcaccaccagcaccgccaccgccgccaccaccagcaccgagcccaucaccguggcccccaccgaccaccuguaa

SEQ ID NO: 16390 - RNA, 13941 nt, Artificial Sequence
  DYNC1H1__Homo_sapiens__NP_001367
augagcgagcccggcggcggcggcggcgaggacggcagcgccggccuggaggugagcgccgugcagaacguggccgacgugagcgugcugcagaagcaccugagaaagcuggugccccugcugcuggaggacggcggcgaggcccccgccgcccuggaggccgcccuggaggagaagagcgcccuggagcagaugagaaaguuccugagcgacccccaggugcacaccgugcugguggagagaagcacccugaaggaggacgugggcgacgagggcgaggaggagaaggaguucaucagcuacaacaucaacaucgacauccacuacggcgugaagagcaacagccuggccuucaucaagagaacccccgugaucgacgccgacaagcccgugagcagccagcugagagugcugacccugagcgaggacagccccuacgagacccugcacagcuucaucagcaacgccguggcccccuucuucaagagcuacaucagagagagcggcaaggccgacagagacggcgacaagauggcccccagcguggagaagaagaucgccgagcuggagaugggccugcugcaccugcagcagaacaucgagauccccgagaucagccugcccauccaccccaugaucaccaacguggccaagcagugcuacgagagaggcgagaagcccaaggugaccgacuucggcgacaagguggaggaccccaccuuccugaaccagcugcagagcggcgugaacagauggaucagagagauccagaaggugaccaagcuggacagagaccccgccagcggcaccgcccugcaggagaucagcuucuggcugaaccuggagagagcccuguacagaauccaggagaagagagagagccccgaggugcugcugacccuggacauccugaagcacggcaagagauuccacgccaccgugagcuucgacaccgacaccggccugaagcaggcccuggagaccgugaacgacuacaacccccugaugaaggacuucccccugaacgaccugcugagcgccaccgagcuggacaagaucagacaggcccugguggccaucuucacccaccugagaaagaucagaaacaccaaguaccccauccagagagcccugagacugguggaggccaucagcagagaccugagcagccagcugcugaaggugcugggcaccagaaagcugaugcacguggccuacgaggaguucgagaaggugaugguggccugcuucgagguguuccagaccugggacgacgaguacgagaagcugcaggugcugcugagagacaucgugaagagaaagagagaggagaaccugaagaugguguggagaaucaaccccgcccacagaaagcugcaggccagacuggaccagaugagaaaguucagaagacagcacgagcagcugagagccgugaucgugagagugcugagaccccaggugaccgccguggcccagcagaaccagggcgaggugcccgagccccaggacaugaagguggccgaggugcuguucgacgccgccgacgccaacgccaucgaggaggugaaccuggccuacgagaacgugaaggagguggacggccuggacgugagcaaggagggcaccgaggccugggaggccgccaugaagagauacgacgagagaaucgacagaguggagaccagaaucaccgccagacugagagaccagcugggcaccgccaagaacgccaacgagauguucagaaucuucagcagauucaacgcccuguucgugagaccccacaucagaggcgccaucagagaguaccagacccagcugauccagagagugaaggacgacaucgagagccugcacgacaaguucaaggugcaguacccccagagccaggccugcaagaugagccacgugagagaccugccccccgugagcggcagcaucaucugggccaagcagaucgacagacagcugaccgccuacaugaagagaguggaggacgugcugggcaagggcugggagaaccacguggagggccagaagcugaagcaggacggcgacagcuucagaaugaagcugaacacccaggagaucuucgacgacugggccagaaaggugcagcagagaaaccugggcgugagcggcagaaucuucaccaucgagagcaccagagugagaggcagaaccggcaacgugcugaagcugaaggugaacuuccugcccgagaucaucacccugagcaaggaggugagaaaccugaaguggcugggcuucagagugccccuggccaucgugaacaaggcccaccaggccaaccagcuguaccccuucgccaucagccugaucgagagcgugagaaccuacgagagaaccugcgagaagguggaggagagaaacaccaucagccugcugguggccggccugaagaaggaggugcaggcccugaucgccgagggcaucgcccuggugugggagagcuacaagcuggaccccuacgugcagagacuggccgagaccguguucaacuuccaggagaagguggacgaccugcugaucaucgaggagaagaucgaccuggaggugagaagccuggagaccugcauguacgaccacaagaccuucagcgagauccugaacagagugcagaaggccguggacgaccugaaccugcacagcuacagcaaccugcccaucugggugaacaagcuggacauggagaucgagagaauccugggcgugagacugcaggccggccugagagccuggacccaggugcugcugggccaggccgaggacaaggccgagguggacauggacaccgacgccccccaggugagccacaagcccggcggcgagcccaagaucaagaacguggugcacgagcugagaaucaccaaccaggugaucuaccugaacccccccaucgaggagugcagauacaagcuguaccaggagauguucgccuggaagaugguggugcugagccugcccagaauccagagccagagauaccaggugggcgugcacuacgagcugaccgaggaggagaaguucuacagaaacgcccugaccagaaugcccgacggccccguggcccuggaggagagcuacagcgccgugaugggcaucgugagcgagguggagcaguacgugaagguguggcugcaguaccagugccugugggacaugcaggccgagaacaucuacaacagacugggcgaggaccugaacaaguggcaggcccugcuggugcagaucagaaaggccagaggcaccuucgacaacgccgagaccaagaaggaguucggccccguggugaucgacuacggcaaggugcagagcaaggugaaccugaaguacgacagcuggcacaaggaggugcugagcaaguucggccagaugcugggcagcaacaugaccgaguuccacagccagaucagcaagagcagacaggagcuggagcagcacagcguggacaccgccagcaccagcgacgccgugaccuucaucaccuacgugcagagccugaagagaaagaucaagcaguucgagaagcagguggagcuguacagaaacggccagagacugcuggagaagcagagauuccaguucccccccagcuggcuguacaucgacaacaucgagggcgaguggggcgccuucaacgacaucaugagaagaaaggacagcgccauccagcagcagguggccaaccugcagaugaagaucgugcaggaggacagagccguggagagcagaaccaccgaccugcugaccgacugggagaagaccaagcccgugaccggcaaccugagacccgaggaggcccugcaggcccugaccaucuacgagggcaaguucggcagacugaaggacgacagagagaagugcgccaaggccaaggaggcccuggagcugaccgacaccggccugcugagcggcagcgaggagagagugcagguggcccuggaggagcugcaggaccugaagggcguguggagcgagcugagcaaggugugggagcagaucgaccagaugaaggagcagcccugggugagcgugcagcccagaaagcugagacagaaccuggacgcccugcugaaccagcugaagagcuuccccgccagacugagacaguacgccagcuacgaguucgugcagagacugcugaagggcuacaugaagaucaacaugcuggugaucgagcugaagagcgaggcccugaaggacagacacuggaagcagcugaugaagagacugcacgugaacuggguggugagcgagcugacccugggccagaucugggacguggaccugcagaagaacgaggccaucgugaaggacgugcugcugguggcccagggcgagauggcccuggaggaguuccugaagcagaucagagagguguggaacaccuacgagcuggaccuggugaacuaccagaacaagugcagacugaucagaggcugggacgaccuguucaacaaggugaaggagcacaucaacagcgugagcgccaugaagcugagccccuacuacaagguguucgaggaggacgcccugagcugggaggacaagcugaacagaaucauggcccuguucgacguguggaucgacgugcagagaagauggguguaccuggagggcaucuucaccggcagcgccgacaucaagcaccugcugcccguggagacccagagauuccagagcaucagcaccgaguuccuggcccugaugaagaaggugagcaagagcccccuggugauggacgugcugaacauccagggcgugcagagaagccuggagagacuggccgaccugcugggcaagauccagaaggcccugggcgaguaccuggagagagagagaagcagcuuccccagauucuacuucgugggcgacgaggaccugcuggagaucaucggcaacagcaagaacguggccaagcugcagaagcacuucaagaagauguucgccggcgugagcagcaucauccugaacgaggacaacagcguggugcugggcaucagcagcagagagggcgaggaggugauguucaagacccccgugagcaucaccgagcaccccaagaucaacgaguggcugacccugguggagaaggagaugagagugacccuggccaagcugcuggccgagagcgugaccgagguggagaucuucggcaaggccaccagcaucgaccccaacaccuacaucaccuggaucgacaaguaccaggcccagcugguggugcugagcgcccagaucgccuggagcgagaacguggagaccgcccugagcagcaugggcggcggcggcgacgccgccccccugcacagcgugcugagcaacguggaggugacccugaacgugcuggccgacagcgugcugauggagcagcccccccugagaagaagaaagcuggagcaccugaucaccgagcuggugcaccagagagacgugaccagaagccugaucaagagcaagaucgacaacgccaagagcuucgaguggcugagccagaugagauucuacuucgaccccaagcagaccgacgugcugcagcagcugagcauccagauggccaacgccaaguucaacuacggcuucgaguaccugggcgugcaggacaagcuggugcagaccccccugaccgacagaugcuaccugaccaugacccaggcccuggaggccagacugggcggcagccccuucggccccgccggcaccggcaagaccgagagcgugaaggcccugggccaccagcugggcagauucgugcugguguucaacugcgacgagaccuucgacuuccaggccaugggcagaaucuucgugggccugugccaggugggcgccuggggcugcuucgacgaguucaacagacuggaggagagaaugcugagcgccgugagccagcaggugcagugcauccaggaggcccugagagagcacagcaaccccaacuacgacaagaccagcgcccccaucaccugcgagcugcugaacaagcaggugaaggugagccccgacauggccaucuucaucaccaugaaccccggcuacgccggcagaagcaaccugcccgacaaccugaagaagcuguucagaagccuggccaugaccaagcccgacagacagcugaucgcccaggugaugcuguacagccagggcuucagaaccgccgaggugcuggccaacaagaucgugcccuucuucaagcugugcgacgagcagcugagcagccagagccacuacgacuucggccugagagcccugaagagcgugcuggugagcgccggcaacgugaagagagagagaauccagaagaucaagagagagaaggaggagagaggcgaggccguggacgagggcgagaucgccgagaaccugcccgagcaggagauccugauccagagcgugugcgagaccauggugcccaagcugguggccgaggacaucccccugcuguucagccugcugagcgacguguuccccggcgugcaguaccacagaggcgagaugaccgcccugagagaggagcugaagaaggugugccaggagauguaccugaccuacggcgacggcgaggaggugggcggcauguggguggagaaggugcugcagcuguaccagaucacccagaucaaccacggccugaugauggugggccccagcggcagcggcaagagcauggccuggagagugcugcugaaggcccuggagagacuggagggcguggagggcguggcccacaucaucgaccccaaggccaucagcaaggaccaccuguacggcacccuggaccccaacaccagagaguggaccgacggccuguucacccacgugcugagaaagaucaucgacagcgugagaggcgagcugcagaagagacaguggaucguguucgacggcgacguggaccccgaguggguggagaaccugaacagcgugcuggacgacaacaagcugcugacccugcccaacggcgagagacugagccugccccccaacgugagaaucauguucgaggugcaggaccugaaguacgccacccuggccaccgugagcagaugcggcauggugugguucagcgaggacgugcugagcaccgacaugaucuucaacaacuuccuggccagacugagaagcaucccccuggacgagggcgaggacgaggcccagagaagaagaaagggcaaggaggacgagggcgaggaggccgccagccccaugcugcagauccagagagacgccgccaccaucaugcagcccuacuucaccagcaacggccuggugaccaaggcccuggagcacgccuuccagcuggagcacaucauggaccugaccagacugagaugccugggcagccuguucagcaugcugcaccaggccugcagaaacguggcccaguacaacgccaaccaccccgacuuccccaugcagaucgagcagcuggagagauacauccagagauaccugguguacgccauccuguggagccugagcggcgacagcagacugaagaugagagccgagcugggcgaguacaucagaagaaucaccaccgugccccugcccaccgcccccaacauccccaucaucgacuacgaggugagcaucagcggcgaguggagccccuggcaggccaaggugccccagaucgagguggagacccacaagguggccgcccccgacgugguggugcccacccuggacaccgugagacacgaggcccugcuguacaccuggcuggccgagcacaagccccuggugcugugcggcccccccggcagcggcaagaccaugacccuguucagcgcccugagagcccugcccgacauggagguggugggccugaacuucagcagcgccaccacccccgagcugcugcugaagaccuucgaccacuacugcgaguacagaagaacccccaacggcguggugcuggcccccgugcagcugggcaaguggcuggugcuguucugcgacgagaucaaccugcccgacauggacaaguacggcacccagagagugaucagcuucaucagacagaugguggagcacggcggcuucuacagaaccagcgaccagaccugggugaagcuggagagaauccaguucgugggcgccugcaacccccccaccgaccccggcagaaagccccugagccacagauuccugagacacgugcccgugguguacguggacuaccccggccccgccagccugacccagaucuacggcaccuucaacagagccaugcugagacugauccccagccugagaaccuacgccgagccccugaccgccgccaugguggaguucuacaccaugagccaggagagauucacccaggacacccagccccacuacaucuacagccccagagagaugaccagaugggugagaggcaucuucgaggcccugagaccccuggagacccugcccguggagggccugaucagaaucugggcccacgaggcccugagacuguuccaggacagacugguggaggacgaggagagaagauggaccgacgagaacaucgacaccguggcccugaagcacuuccccaacaucgacagagagaaggccaugagcagacccauccuguacagcaacuggcugagcaaggacuacauccccguggaccaggaggagcugagagacuacgugaaggccagacugaagguguucuacgaggaggagcuggacgugccccuggugcuguucaacgaggugcuggaccacgugcugagaaucgacagaaucuucagacagccccagggccaccugcugcugaucggcgugagcggcgccggcaagaccacccugagcagauucguggccuggaugaacggccugagcguguaccagaucaaggugcacagaaaguacaccggcgaggacuucgacgaggaccugagaaccgugcugagaagaagcggcugcaagaacgagaagaucgccuucaucauggacgagagcaacgugcuggacagcggcuuccuggagagaaugaacacccugcuggccaacggcgaggugcccggccuguucgagggcgacgaguacgccacccugaugacccagugcaaggagggcgcccagaaggagggccugaugcuggacagccacgaggagcuguacaagugguucaccagccaggugaucagaaaccugcacgugguguucaccaugaaccccagcagcgagggccugaaggacagagccgccaccagccccgcccuguucaacagaugcgugcugaacugguucggcgacuggagcaccgaggcccuguaccaggugggcaaggaguucaccagcaagauggaccuggagaagcccaacuacaucgugcccgacuacaugcccgugguguacgacaagcugccccagccccccagccacagagaggccaucgugaacagcugcguguucgugcaccagacccugcaccaggccaacgccagacuggccaagagaggcggcagaaccauggccaucacccccagacacuaccuggacuucaucaaccacuacgccaaccuguuccacgagaagagaagcgagcuggaggagcagcagaugcaccugaacgugggccugagaaagaucaaggagaccguggaccagguggaggagcugagaagagaccugagaaucaagagccaggagcuggaggugaagaacgccgccgccaacgacaagcugaagaagauggugaaggaccagcaggaggccgagaagaagaaggugaugagccaggagauccaggagcagcugcacaagcagcaggaggugaucgccgacaagcagaugagcgugaaggaggaccuggacaagguggagcccgccgugaucgaggcccagaacgccgugaagagcaucaagaagcagcaccugguggaggugagaagcauggccaacccccccgccgccgugaagcuggcccuggagagcaucugccugcugcugggcgagagcaccaccgacuggaagcagaucagaagcaucaucaugagagagaacuucauccccaccaucgugaacuucagcgccgaggagaucagcgacgccaucagagagaagaugaagaagaacuacaugagcaaccccagcuacaacuacgagaucgugaacagagccagccuggccugcggccccauggugaagugggccaucgcccagcugaacuacgccgacaugcugaagagaguggagccccugagaaacgagcugcagaagcuggaggacgacgccaaggacaaccagcagaaggccaacgagguggagcagaugaucagagaccuggaggccagcaucgccagauacaaggaggaguacgccgugcugaucagcgaggcccaggccaucaaggccgaccuggccgccguggaggccaaggugaacagaagcaccgcccugcugaagagccugagcgccgagagagagagaugggagaagaccagcgagaccuucaagaaccagaugagcaccaucgccggcgacugccugcugagcgccgccuucaucgccuacgccggcuacuucgaccagcagaugagacagaaccuguucaccaccuggagccaccaccugcagcaggccaacauccaguucagaaccgacaucgccagaaccgaguaccugagcaacgccgacgagagacugagauggcaggccagcagccugcccgccgacgaccugugcaccgagaacgccaucaugcugaagagauucaacagauacccccugaucaucgaccccagcggccaggccaccgaguucaucaugaacgaguacaaggacagaaagaucaccagaaccagcuuccuggacgacgccuucagaaagaaccuggagagcgcccugagauucggcaacccccugcuggugcaggacguggagagcuacgaccccgugcugaaccccgugcugaacagagaggugagaagaaccggcggcagagugcugaucacccugggcgaccaggacaucgaccugagccccagcuucgugaucuuccugagcaccagagaccccaccguggaguucccccccgaccugugcagcagagugaccuucgugaacuucaccgugaccagaagcagccugcagagccagugccugaacgaggugcugaaggccgagagacccgacguggacgagaagagaagcgaccugcugaagcugcagggcgaguuccagcugagacugagacagcuggagaagagccugcugcaggcccugaacgaggugaagggcagaauccuggacgacgacaccaucaucaccacccuggagaaccugaagagagaggccgccgaggugaccagaaagguggaggagaccgacaucgugaugcaggagguggagaccgugagccagcaguaccugccccugagcaccgccugcagcagcaucuacuucaccauggagagccugaagcagauccacuuccuguaccaguacagccugcaguucuuccuggacaucuaccacaacgugcuguacgagaaccccaaccugaagggcgugaccgaccacacccagagacugagcaucaucaccaaggaccuguuccagguggccuucaacagaguggccagaggcaugcugcaccaggaccacaucaccuucgccaugcugcuggccagaaucaagcugaagggcaccgugggcgagcccaccuacgacgccgaguuccagcacuuccugagaggcaacgagaucgugcugagcgccggcagcacccccagaauccagggccugaccguggagcaggccgaggccguggugagacugagcugccugcccgccuucaaggaccugaucgccaaggugcaggccgacgagcaguucggcaucuggcuggacagcagcagccccgagcagaccgugcccuaccuguggagcgaggagacccccgccacccccaucggccaggccauccacagacugcugcugauccaggccuucagacccgacagacugcuggccauggcccacauguucgugagcaccaaccugggcgagagcuucaugagcaucauggagcagccccuggaccugacccacaucgugggcaccgaggugaagcccaacacccccgugcugaugugcagcgugcccggcuacgacgccagcggccacguggaggaccuggccgccgagcagaacacccagaucaccagcaucgccaucggcagcgccgagggcuucaaccaggccgacaaggccaucaacaccgccgugaagagcggcagaugggugaugcugaagaacgugcaccuggcccccggcuggcugaugcagcuggagaagaagcugcacagccugcagccccacgccugcuucagacuguuccugaccauggagaucaaccccaaggugcccgugaaccugcugagagccggcagaaucuucguguucgagcccccccccggcgugaaggccaacaugcugagaaccuucagcagcauccccgugagcagaaucugcaagagccccaacgagagagccagacuguacuuccugcuggccugguuccacgccaucauccaggagagacugagauacgccccccugggcuggagcaagaaguacgaguucggcgagagcgaccugagaagcgccugcgacaccguggacaccuggcuggacgacaccgccaagggcagacagaacaucagccccgacaagauccccuggagcgcccugaagacccugauggcccagagcaucuacggcggcagaguggacaacgaguucgaccagagacugcugaacaccuuccuggagagacuguucaccaccagaagcuucgacagcgaguucaagcuggccugcaagguggacggccacaaggacauccagaugcccgacggcaucagaagagaggaguucgugcaguggguggagcugcugcccgacacccagacccccagcuggcugggccugcccaacaacgccgagagagugcugcugaccacccagggcguggacaugaucagcaagaugcugaagaugcagaugcuggaggacgaggacgaccuggccuacgccgagaccgagaagaagaccagaaccgacagcaccagcgacggcagacccgccuggaugagaacccugcacaccaccgccagcaacuggcugcaccugaucccccagacccugagccaccugaagagaaccguggagaacaucaaggacccccuguucagauucuucgagagagaggugaagaugggcgccaagcugcugcaggacgugagacaggaccuggccgacguggugcaggugugcgagggcaagaagaagcagaccaacuaccugagaacccugaucaacgagcuggugaagggcauccugcccagaagcuggagccacuacaccgugcccgccggcaugaccgugauccagugggugagcgacuucagcgagagaaucaagcagcugcagaacaucagccuggccgccgccagcggcggcgccaaggagcugaagaacauccacgugugccugggcggccuguucgugcccgaggccuacaucaccgccaccagacaguacguggcccaggccaacagcuggagccuggaggagcugugccuggaggugaacgugaccaccagccagggcgccacccuggacgccugcagcuucggcgugaccggccugaagcugcagggcgccaccugcaacaacaacaagcugagccugagcaacgccaucagcaccgcccugccccugacccagcugagaugggugaagcagaccaacaccgagaagaaggccagcguggugacccugcccguguaccugaacuucaccagagccgaccugaucuucaccguggacuucgagaucgccaccaaggaggaccccagaagcuucuacgagagaggcguggccgugcugugcaccgaguaa

SEQ ID NO: 16391 - RNA, 1827 nt, Artificial Sequence
  DYNC1I1__Homo_sapiens__NP_001129029
augagcgacaagagcgaccugaaggccgagcuggagagaaagaagcagagacuggcccagaucagagaggagaagaagagaaaggaggaggagagaaagaagaaggaggccgacaugcagcagaagaaggagcccgugcaggacgacagcgaccuggacagaaagagaagagagaccgaggcccugcugcagagcaucggcaucagccccgagcccccccuggugcccacccccaugagccccagcagcaagagcgugagcacccccagcgaggccggcagccaggacagcggcgaccugggcccccugaccagaagaagacugcacaagcugggcgugagcaaggugacccagguggacuuccugcccagagagguggugagcuacagcaaggagacccagaccccccuggccacccaccagagcgaggaggacgaggaggacgaggagaugguggagagcaaggugggccaggacagcgagcuggagaaccaggacaagaagcaggaggugaaggaggccccccccagagagcugaccgaggaggagaagcagcagauccugcacagcgaggaguuccugaucuucuucgacagaaccaucagagugaucgagagagcccuggccgaggacagcgacaucuucuucgacuacagcggcagagagcuggaggagaaggacggcgacgugcaggccggcgccaaccugagcuucaacagacaguucuacgacgagcacuggagcaagcacagaguggugaccugcauggacuggagccugcaguaccccgagcugaugguggccagcuacaacaacaacgaggacgccccccacgagcccgacggcguggcccugguguggaacaugaaguucaagaagaccacccccgaguacguguuccacugccagagcagcgugaugagcgugugcuucgccagauuccaccccaaccugguggugggcggcaccuacagcggccagaucgugcugugggacaacagaagccacagaagaacccccgugcagagaaccccccugagcgccgccgcccacacccaccccguguacugcgugaacguggugggcacccagaacgcccacaaccugaucaccgugagcaccgacggcaagaugugcagcuggagccuggacaugcugagcaccccccaggagagcauggagcugguguacaacaagagcaagcccguggccgugaccggcauggccuuccccaccggcgacgugaacaacuucguggugggcagcgaggagggcaccguguacaccgccugcagacacggcagcaaggccggcaucggcgagguguucgagggccaccagggccccgugaccggcaucaacugccacauggccgugggccccaucgacuucagccaccuguucgugaccagcagcuucgacuggaccgugaagcuguggaccaccaagcacaacaagccccuguacagcuucgaggacaacgccgacuacguguacgacgugauguggagccccgugcaccccgcccuguucgccugcguggacggcaugggcagacuggaccuguggaaccugaacaacgacaccgaggugcccaccgccagcguggccaucgagggcgccagcgcccugaacagagugagaugggcccaggccggcaaggagguggccgugggcgacagcgagggcagaaucuggguguacgacgugggcgagcuggccgugccccacaacgacgaguggaccagauucgccagaacccugguggagaucagagccaacagagccgacagcgaggaggagggcaccguggagcugagcgccuaa

SEQ ID NO: 16392 - RNA, 1893 nt, Artificial Sequence
  DYNC1I2__Homo_sapiens__NP_001258715
augagcgacaagagcgagcugaaggccgagcuggagagaaagaagcagagacuggcccagaucagagaggagaagaagagaaaggaggaggagagaaagaagaaggagaccgaccagaagaaggaggccguggcccccgugcaggaggagagcgaccuggagaagaagagaagagaggccgaggcccugcugcagagcaugggccugacccccgagagccccaucgccgagcagccccugagaguggugaccgccgacaccugccuguuccacuaccuggugcccccccccaugagccccagcagcaagagcgugagcacccccagcgaggccggcagccaggacagcggcgacggcgccgugggcagcagaagaggccccaucaagcugggcauggccaagaucacccagguggacuucccccccagagagaucgugaccuacaccaaggagacccagacccccgugauggcccagcccaaggaggacgaggaggaggacgacgacgugguggcccccaagccccccaucgagcccgaggaggagaagacccugaagaaggacgaggagaacgacagcaaggcccccccccacgagcugaccgaggaggagaagcagcagauccugcacagcgaggaguuccugagcuucuucgaccacagcaccagaaucguggagagagcccugagcgagcagaucaacaucuucuucgacuacagcggcagagaccuggaggacaaggagggcgagauccaggccggcgccaagcugagccugaacagacaguucuucgacgagagauggagcaagcacagaguggugagcugccuggacuggagcagccaguaccccgagcugcugguggccagcuacaacaacaacgaggacgccccccacgagcccgacggcguggcccugguguggaacaugaaguacaagaagaccacccccgaguacguguuccacugccagagcgccgugaugagcgccaccuucgccaaguuccaccccaaccugguggugggcggcaccuacagcggccagaucgugcugugggacaacagaagcaacaagagaacccccgugcagagaaccccccugagcgccgccgcccacacccaccccguguacugcgugaacguggugggcacccagaacgcccacaaccugaucagcaucagcaccgacggcaagaucugcagcuggagccuggacaugcugagccacccccaggacagcauggagcuggugcacaagcagagcaaggccguggccgugaccagcaugagcuuccccgugggcgacgugaacaacuucguggugggcagcgaggagggcagcguguacaccgccugcagacacggcagcaaggccggcaucagcgagauguucgagggccaccagggccccaucaccggcauccacugccacgccgccgugggcgccguggacuucagccaccuguucgugaccagcagcuucgacuggaccgugaagcuguggaccaccaagaacaacaagccccuguacagcuucgaggacaacgccgacuacguguacgacgugauguggagccccacccaccccgcccuguucgccugcguggacggcaugggcagacuggaccuguggaaccugaacaacgacaccgaggugcccaccgccagcaucagcguggagggcaaccccgcccugaacagagugagauggacccacagcggcagagagaucgccgugggcgacagcgagggccagaucgugaucuacgacgugggcgagcagaucgccgugcccagaaacgacgagugggccagauucggcagaacccuggccgagaucaacgccaacagagccgacgccgaggaggaggccgccaccagaauccccgccuaa

SEQ ID NO: 16393 - RNA, 1572 nt, Artificial Sequence
  DYNC1LI1__Homo_sapiens__NP_057225
auggccgccgugggcagagugggcagcuucggcagcagcccccccggccugagcagcaccuacaccggcggcccccugggcaacgagaucgccagcggcaacggcggcgccgccgccggcgacgacgaggacggccagaaccuguggagcugcauccugagcgaggugagcaccagaagcagaagcaagcugcccgccggcaagaacgugcugcugcugggcgaggacggcgccggcaagaccagccugaucagaaagauccagggcaucgaggaguacaagaagggcagaggccuggaguaccuguaccugaacgugcacgacgaggacagagacgaccagaccagaugcaacguguggauccuggacggcgaccuguaccacaagggccugcugaaguucagccuggacgccgugagccugaaggacacccuggugaugcuggugguggacaugagcaagcccuggaccgcccuggacagccugcagaagugggccagcguggugagagagcacguggacaagcugaagaucccccccgaggagaugaagcagauggagcagaagcugaucagagacuuccaggaguacguggagcccggcgaggacuuccccgccagcccccagagaagaaacaccgccagccaggaggacaaggacgacagcguggugcugccccugggcgccgacacccugacccacaaccugggcauccccgugcugguggugugcaccaagugcgacgccaucagcgugcuggagaaggagcacgacuacagagacgagcacuucgacuucauccagagccacaucagaaaguucugccugcaguacggcgccgcccugaucuacaccagcgugaaggagaacaagaacaucgaccugguguacaaguacaucgugcagaagcuguacggcuuccccuacaagauccccgccguggugguggagaaggacgccguguucauccccgccggcugggacaacgacaagaagaucggcauccugcacgagaacuuccagacccugaaggccgaggacaacuucgaggacaucaucaccaagccccccgugagaaaguucgugcacgagaaggagaucauggccgaggacgaccagguguuccugaugaagcugcagagccugcuggccaagcagccccccaccgccgccggcagacccguggacgccagccccagagugcccggcggcagccccagaacccccaacagaagcgugagcagcaacguggccagcgugagccccauccccgccggcagcaagaagaucgaccccaacaugaaggccggcgccaccagcgagggcgugcuggccaacuucuucaacagccugcugagcaagaagaccggcagccccggcggccccggcgugagcggcggcagccccgccggcggcgccggcggcggcagcagcggccugccccccagcaccaagaagagcggccagaagcccgugcuggacgugcacgccgagcuggacagaaucaccagaaagcccgugaccgugagccccaccacccccaccagccccaccgagggcgaggccagcuaa

SEQ ID NO: 16394 - RNA, 12945 nt, Artificial Sequence
  DYNC2H1__Homo_sapiens__NP_001073932
auggccaacggcaccgccgacgugagaaagcuguucaucuucaccaccacccagaacuacuucggccugaugagcgagcugugggaccagccccugcugugcaacugccuggagaucaacaacuuccuggacgacggcaaccagaugcugcugagagugcagagaagcgacgccggcaucagcuucagcaacaccaucgaguucggcgacaccaaggacaaggugcugguguucuucaagcugagacccgaggugaucaccgacgagaaccugcacgacaacauccuggugagcagcaugcuggagagccccaucagcagccuguaccaggccgugagacagguguucgcccccaugcugcugaaggaccaggaguggagcagaaacuucgaccccaagcugcagaaccugcugagcgagcuggaggccggccugggcaucgugcugagaagaagcgacaccaaccugaccaagcugaaguucaaggaggacgacaccagaggcauccugacccccagcgacgaguuccaguucuggaucgagcaggcccacagaggcaacaagcagaucagcaaggagagagccaacuacuucaaggagcuguucgagaccaucgccagagaguucuacaaccuggacagccugagccugcuggaggugguggaccugguggagaccacccaggacgugguggacgacguguggagacagaccgagcacgaccacuaccccgagagcagaaugcugcaccugcuggacaucaucggcggcagcuucggcagauucgugcagaagaagcugggcacccugaaccugugggaggaccccuacuaccuggugaaggagagccugaaggccggcaucagcaucugcgagcagugggugaucgugugcaaccaccugaccggccagguguggcagagauacgugccccaccccuggaagaacgagaaguacuuccccgagacccuggacaagcugggcaagagacuggaggaggugcuggccaucagaaccauccacgagaaguuccuguacuuccugcccgccagcgaggagaagaucaucugccugaccagaguguucgagcccuucaccggccugaaccccgugcaguacaaccccuacaccgagccccuguggaaggccgccgugagccaguacgagaagaucaucgcccccgccgagcagaagaucgccggcaagcugaagaacuacaucagcgagauccaggacagcccccagcagcugcugcaggccuuccugaaguacaaggagcuggugaagagacccaccaucagcaaggagcugaugcuggagagagagacccugcuggccagacugguggacagcaucaaggacuucagacuggacuucgagaacagaugcagaggcauccccggcgacgccagcggcccccugagcggcaagaaccugagcgagguggugaacagcaucgugugggugagacagcuggagcugaagguggacgacaccaucaagaucgccgaggcccugcugagcgaccugcccggcuucagaugcuuccaccagagcgccaaggaccugcuggaccagcugaagcuguacgagcaggagcaguucgacgacuggagcagagacauccagagcggccugagcgacagcagaagcggccugugcaucgaggccagcagcagaaucauggagcuggacagcaacgacggccugcugaaggugcacuacagcgacagacuggugauccugcugagagaggugagacagcugagcgcccugggcuucgugauccccgccaagauccagcagguggccaacaucgcccagaaguucugcaagcaggccaucauccugaagcagguggcccacuucuacaacagcaucgaccagcagaugauccagagccagagacccaugaugcugcagagcgcccuggccuucgagcagaucaucaagaacagcaaggccggcagcggcggcaagagccagaucaccugggacaaccccaaggagcuggagggcuacauccagaagcugcagaacgccgccgagagacuggccaccgagaacagaaagcugagaaaguggcacaccaccuucugcgagaaggugguggugcugaugaacaucgaccugcugagacagcagcagagauggaaggacggccugcaggagcugagaaccggccuggccaccguggaggcccagggcuuccaggccagcgacaugcacgccuggaagcagcacuggaaccaccagcuguacaaggcccuggagcaccaguaccagaugggccuggaggcccugaacgagaaccugcccgagaucaacaucgaccugaccuacaagcagggcagacugcaguucagaccccccuucgaggagaucagagccaaguacuacagagagaugaagagauucaucggcauccccaaccaguucaagggcgugggcgaggccggcgacgagagcaucuucagcaucaugaucgacagaaacgccagcggcuuccugaccaucuucagcaaggccgaggaccuguucagaagacugagcgccgugcugcaccagcacaaggaguggaucgugaucggccagguggacauggaggcccugguggagaagcaccuguucaccgugcacgacugggagaagaacuucaaggcccugaagaucaagggcaaggagguggagagacugcccagcgccgugaagguggacugccugaacaucaacugcaaccccgugaagaccgugaucgacgaccugauccagaagcuguucgaccugcuggugcugagccugaagaagagcauccaggcccaccugcacgagaucgacaccuucgugaccgaggccauggaggugcugaccaucaugccccagagcguggaggagaucggcgacgccaaccugcaguacagcaagcugcaggagagaaagcccgagauccugccccuguuccaggaggccgaggacaagaacagacugcugagaaccguggccggcggcggccuggagaccaucagcaaccugaaggccaagugggacaaguucgagcugaugauggagagccaccagcugaugaucaaggaccagaucgaggugaugaagggcaacgugaagagcagacugcagaucuacuaccaggagcuggagaaguucaaggccagaugggaccagcugaagcccggcgacgacgugaucgagaccggccagcacaacacccuggacaagagcgccaagcugaucaaggagaagaagaucgaguucgacgaccuggaggugaccagaaagaagcugguggacgacugccaccacuucagacuggaggagcccaacuucagccuggccagcagcaucagcaaggacaucgagagcugcgcccagaucugggccuucuacgaggaguuccagcagggcuuccaggagauggccaacgaggacuggaucaccuucagaaccaagaccuaccuguucgaggaguuccugaugaacuggcacgacagacugagaaagguggaggagcacagcgugaugaccgugaagcugcagagcgagguggacaaguacaagaucgugauccccauccugaaguacgugagaggcgagcaccugagccccgaccacuggcuggaccuguucagacugcugggccugcccagaggcaccagccuggagaagcugcuguucggcgaccugcugagaguggccgacaccaucguggccaaggccgccgaccugaaggaccugaacagcagagcccagggcgaggugaccaucagagaggcccugagagagcuggaccuguggggcgugggcgccguguucacccugaucgacuacgaggacagccagagcagaaccaugaagcugaucaaggacuggaaggacaucgugaaccaggugggcgacaacagaugccugcugcagagccugaaggacagccccuacuacaagggcuucgaggacaaggugagcaucugggagagaaagcuggccgagcuggacgaguaccugcagaaccugaaccacauccagagaaaguggguguaccuggagcccaucuucggcagaggcgcccugcccaaggagcagaccagauucaacagaguggacgaggacuucagaagcaucaugaccgacaucaagaaggacaacagagugaccacccugaccacccacgccggcaucagaaacagccugcugaccauccuggaccagcugcagagaugccagaagagccugaacgaguuccuggaggagaagagaagcgccuuccccagauucuacuucaucggcgacgacgaccugcuggagauccugggccagagcaccaaccccagcgugauccagagccaccugaagaagcuguucgccggcaucaacagcgugugcuucgacgagaagagcaagcacaucaccgccaugaagagccuggagggcgagguggugcccuucaagaacaaggugccccugagcaacaacguggagaccuggcugaacgaccuggcccuggagaugaagaagacccuggagcagcugcugaaggagugcgugaccaccggcagaagcagccagggcgccguggaccccagccuguuccccagccagauccugugccuggccgagcagaucaaguucaccgaggacguggagaacgccaucaaggaccacagccugcaccagaucgagacccagcuggugaacaagcuggagcaguacaccaacaucgacaccagcagcgaggaccccggcaacaccgagagcggcauccuggagcugaagcugaaggcccugauccuggacaucauccacaacaucgacguggugaagcagcugaaccagauccaggugcacaccaccgaggacugggccuggaagaagcagcugagauucuacaugaagagcgaccacaccugcugcgugcagaugguggacagcgaguuccaguacaccuacgaguaccagggcaacgccagcaagcugguguacaccccccugaccgacaagugcuaccugacccugacccaggccaugaagaugggccugggcggcaaccccuacggccccgccggcaccggcaagaccgagagcgugaaggcccugggcggccugcugggcagacaggugcugguguucaacugcgacgagggcaucgacgugaagagcaugggcagaaucuucgugggccuggugaagugcggcgccuggggcugcuucgacgaguucaacagacuggaggagagcgugcugagcgccgugagcaugcagauccagaccauccaggacgcccugaagaaccacagaaccgugugcgagcugcugggcaaggagguggaggugaacagcaacagcggcaucuucaucaccaugaaccccgccggcaagggcuacggcggcagacagaagcugcccgacaaccugaagcagcuguucagacccguggccaugagccaccccgacaacgagcugaucgccgaggugauccuguacagcgagggcuucaaggacgccaaggugcugagcagaaagcugguggccaucuucaaccugagcagagagcugcugaccccccagcagcacuacgacuggggccugagagcccugaagaccgugcugagaggcagcggcaaccugcugagacagcugaacaagagcggcaccacccagaacgccaacgagagccacaucguggugcaggcccugagacugaacaccaugagcaaguucaccuucaccgacugcaccagauucgacgcccugaucaaggacguguuccccggcaucgagcugaaggagguggaguacgacgagcugagcgccgcccugaagcagguguucgaggaggccaacuacgagaucauccccaaccagaucaagaaggcccuggagcuguacgagcagcugugccagagaaugggcguggugaucgugggccccagcggcgccggcaagagcacccuguggagaaugcugagagccgcccugugcaagaccggcaagguggugaagcaguacaccaugaaccccaaggccaugcccagauaccagcugcugggccacaucgacauggacaccagagaguggagcgacggcgugcugaccaacagcgccagacagguggugagagagccccaggacgugagcagcuggaucaucugcgacggcgacaucgaccccgaguggaucgagagccugaacagcgugcuggacgacaacagacugcugaccaugcccagcggcgagagaauccaguucggccccaacgugaacuucguguucgagacccacgaccugagcugcgccagccccgccaccaucagcagaaugggcaugaucuuccugagcgacgaggagaccgaccugaacagccugaucaagagcuggcugagaaaccagcccgccgaguacagaaacaaccuggagaacuggaucggcgacuacuucgagaaggcccugcagugggugcugaagcagaacgacuacgugguggagaccagccuggugggcaccgugaugaacggccugagccaccugcacggcugcagagaccacgacgaguucaucaucaaccugaucagaggccugggcggcaaccugaacaugaagagcagacuggaguucaccaaggagguguuccacugggccagagagagcccccccgacuuccacaagcccauggacaccuacuacgacagcaccagaggcagacuggccaccuacgugcugaagaagcccgaggaccugaccgccgacgacuucagcaacggccugacccugcccgugauccagacccccgacaugcagagaggccuggacuacuucaagcccuggcugagcagcgacaccaagcagcccuucauccuggugggccccgagggcugcggcaagggcaugcugcugagauacgccuucagccagcugagaagcacccagaucgccaccgugcacugcagcgcccagaccaccagcagacaccugcugcagaagcugagccagaccugcauggugaucagcaccaacaccggcagaguguacagacccaaggacugcgagagacuggugcuguaccugaaggacaucaaccugcccaagcuggacaaguggggcaccagcacccugguggccuuccugcagcaggugcugaccuaccagggcuucuacgacgagaaccuggagugggugggccuggagaacauccagaucguggccagcaugagcgccggcggcagacugggcagacacaagcugaccaccagauucaccagcaucgugagacugugcagcaucgacuaccccgagagagagcagcugcagaccaucuacggcgccuaccuggagcccgugcugcacaagaaccugaagaaccacagcaucuggggcagcagcagcaagaucuaccugcuggccggcagcauggugcagguguacgagcaggugagagccaaguucaccguggacgacuacagccacuacuucuucacccccugcauccugacccagugggugcugggccuguucagauacgaccuggagggcggcagcagcaaccacccccuggacuacgugcuggagaucguggccuacgaggccagaagacuguucagagacaagaucgugggcgccaaggagcugcaccuguucgacaucauccugaccagcguguuccagggcgacuggggcagcgacauccuggacaacaugagcgacagcuucuacgugaccuggggcgccagacacaacagcggcgccagagccgcccccggccagccccugcccccccacggcaagccccugggcaagcugaacagcaccgaccugaaggacgugaucaagaagggccugauccacuacggcagagacaaccagaaccuggacauccugcuguuccacgaggugcuggaguacaugagcagaaucgacagagugcugagcuuccccggcggcagccugcugcuggccggcagaagcggcgugggcagaagaaccaucaccagccuggugagccacaugcacggcgccgugcuguucagccccaagaucagcagaggcuacgagcugaagcaguucaagaacgaccugaagcacgugcugcagcuggccggcaucgaggcccagcagguggugcugcugcuggaggacuaccaguucgugcaccccaccuuccuggagaugaucaacagccugcugagcagcggcgaggugcccggccuguacacccuggaggagcuggagccccugcugcugccccugaaggaccaggccagccaggacggcuucuucggccccguguucaacuacuucaccuacagaauccagcagaaccugcacaucgugcugaucauggacagcgccaacagcaacuucaugaucaacugcgagagcaaccccgcccugcacaagaagugccaggugcuguggauggagggcuggagcaacagcagcaugaagaagauccccgagaugcuguucagcgagaccggcggcggcgagaaguacaacgacaagaagagaaaggaggagaagaagaagaacagcguggaccccgacuuccugaagagcuuccugcugauccacgagagcugcaaggccuacggcgccacccccagcagauacaugaccuuccugcacguguacagcgccaucagcagcagcaagaagaaggagcugcugaagagacagagccaccugcaggccggcgugagcaagcugaacgaggccaaggcccugguggacgagcugaacagaaaggccggcgagcagagcgugcugcugaagaccaagcaggacgaggccgacgccgcccugcagaugaucaccgugagcaugcaggacgccagcgagcagaagaccgagcuggagagacugaagcacagaaucgccgaggagguggugaagaucgaggagagaaagaacaagaucgacgacgagcugaaggaggugcagccccuggugaacgaggccaagcuggccgugggcaacaucaagcccgagagccugagcgagaucagaagccugagaaugccccccgacgugaucagagacauccuggagggcgugcugagacugaugggcaucuucgacaccagcugggugagcaugaagagcuuccuggccaagagaggcgugagagaggacaucgccaccuucgacgccagaaacaucagcaaggagaucagagagagcguggaggagcugcuguucaagaacaagggcagcuucgaccccaagaacgccaagagagccagcaccgccgccgccccccuggccgccugggugaaggccaacauccaguacagccacgugcuggagagaauccacccccuggagaccgagcaggccggccuggagagcaaccugaagaagaccgaggacagaaagagaaagcuggaggagcugcugaacagcgugggccagaaggugagcgagcugaaggagaaguuccagagcagaaccagcgaggccgccaagcuggaggccgaggugagcaaggcccaggagaccaucaaggccgccgaggugcugaucaaccagcuggacagagagcacaagagauggaacgcccaggugguggagaucaccgaggagcuggccacccugcccaagagagcccagcuggccgccgccuucaucaccuaccugagcgccgcccccgagagccugagaaagaccugccuggaggaguggaccaagagcgccggccuggagaaguucgaccugagaagauuccugugcaccgagagcgagcagcugaucuggaagagcgagggccugcccagcgacgaccugagcaucgagaacgcccuggugauccugcagaucaucggccugaagagcuggagcagagugugccccuuccugaucgaccccagcagccaggccaccgaguggcugaagacccaccugaaggacagcagacuggaggugaucaaccagcaggacagcaacuucaucaccgcccuggagcuggccgugagauucggcaagacccugaucauccaggagauggacggcguggagcccgugcuguacccccugcugagaagagaccugguggcccagggccccagauacguggugcagaucggcgacaagaucaucgacuacaacgaggaguucagacuguuccugagcaccagaaaccccaaccccuucaucccccccgacgccgccagcaucgugaccgaggugaacuucaccaccaccagaagcggccugagaggccagcugcuggcccugaccauccagcacgagaagcccgaccuggaggagcagaagaccaagcugcugcagcaggaggaggacaagaagauccagcuggccaagcuggaggagagccugcuggagacccuggccaccagccagggcaacauccuggagaacaaggaccugaucgagagccugaaccagaccaaggccagcagcgcccugauccaggagagccugaaggagagcuacaagcugcagaucagccuggaccaggagagagacgccuaccugccccuggccgagagcgccagcaagauguacuucaucaucagcgaccugagcaagaucaacaacauguacagauucagccuggccgccuuccugagacuguuccagagagcccugcagaacaagcaggacagcgagaacaccgagcagagaauccagagccugaucagcagccugcagcacaugguguacgaguacaucugcagaugccuguucaaggccgaccagcugauguucgcccugcacuucgugagaggcaugcaccccgagcuguuccaggagaacgagugggacaccuucaccggcgugguggugggcgacaugcugagaaaggccgacagccagcagaagaucagagaccagcugcccagcuggaucgaccaggagagaagcugggccguggccacccugaagaucgcccugcccagccuguaccagacccugugcuucgaggacgccgcccuguggagaaccuacuacaacaacagcaugugcgagcaggaguuccccagcauccuggccaagaaggugagccuguuccagcagauccugguggugcaggcccugagacccgacagacugcagagcgccauggcccuguucgccugcaagacccugggccugaaggaggugagcccccugccccugaaccugaagagacuguacaaggagacccuggagaucgagcccauccugaucaucaucagccccggcgccgaccccagccaggagcugcaggagcuggccaacgccgagagaagcggcgagugcuaccaccagguggccaugggccagggccaggccgaccuggccauccagaugcugaaggagugcgccagaaacggcgacuggcugugccugaagaaccugcaccugguggugagcuggcugcccgugcuggagaaggagcugaacacccugcagcccaaggacaccuucagacuguggcugaccgccgaggugcaccccaacuucacccccauccugcugcagagcagccugaagaucaccuacgagagcccccccggccugaagaagaaccugaugagaaccuacgagagcuggacccccgagcagaucagcaagaaggacaacacccacagagcccacgcccuguucagccuggccugguuccacgccgccugccaggagagaagaaacuacaucccccagggcuggaccaaguucuacgaguucagccugagcgaccugagagccggcuacaacaucaucgacagacuguucgacggcgccaaggacgugcagugggaguucgugcacggccugcuggagaacgccaucuacggcggcagaaucgacaacuacuucgaccugagagugcugcagagcuaccugaagcaguucuucaacagcagcgugaucgacguguucaaccagagaaacaagaagagcaucuuccccuacagcgugagccugccccagagcugcagcauccuggacuacagagccgugaucgagaagauccccgaggacgacaagcccagcuucuucggccugcccgccaacaucgccagaagcagccagagaaugaucagcagccaggugaucagccagcugagaauccugggcagaagcaucaccgccggcagcaaguucgacagagagaucuggagcaacgagcugagccccgugcugaaccuguggaagaagcugaaccagaacagcaaccugauccaccagaaggugcccccccccaacgacagacagggcagccccauccugagcuucaucauccuggagcaguucaacgccaucagacuggugcagagcgugcaccagagccuggccgcccugagcaaggugaucagaggcaccacccugcugagcagcgaggugcagaagcuggccagcgcccugcugaaccagaagugcccccuggccuggcagagcaagugggagggccccgaggacccccugcaguaccugagaggccugguggccagagcccuggccauccagaacuggguggacaaggccgagaagcaggcccugcugagcgagacccuggaccugagcgagcuguuccaccccgacaccuuccugaacgcccugagacaggagaccgccagagccgugggcagaagcguggacagccugaaguucguggccagcuggaagggcagacugcaggaggccaagcugcagaucaagaucagcggccugcugcuggagggcugcagcuucgacggcaaccagcugagcgagaaccagcuggacagccccagcgugagcagcgugcugcccugcuucaugggcuggaucccccaggacgccugcggccccuacagccccgacgagugcaucagccugcccguguacaccagcgccgagagagacagaguggugaccaacaucgacgugcccugcggcggcaaccaggaccaguggauccagugcggcgccgcccuguuccugaagaaccaguaa

SEQ ID NO: 16395 - RNA, 270 nt, Artificial Sequence
  DYNLL1__Homo_sapiens__NP_001032584
augugcgacagaaaggccgugaucaagaacgccgacaugagcgaggagaugcagcaggacagcguggagugcgccacccaggcccuggagaaguacaacaucgagaaggacaucgccgcccacaucaagaaggaguucgacaagaaguacaaccccaccuggcacugcaucgugggcagaaacuucggcagcuacgugacccacgagaccaagcacuucaucuacuucuaccugggccagguggccauccugcuguucaagagcggcuaa

SEQ ID NO: 16396 - RNA, 270 nt, Artificial Sequence
  DYNLL2__Homo_sapiens__NP_542408
augagcgacagaaaggccgugaucaagaacgccgacaugagcgaggacaugcagcaggacgccguggacugcgccacccaggccauggagaaguacaacaucgagaaggacaucgccgccuacaucaagaaggaguucgacaagaaguacaaccccaccuggcacugcaucgugggcagaaacuucggcagcuacgugacccacgagaccaagcacuucaucuacuucuaccugggccagguggccauccugcuguucaagagcggcuaa

SEQ ID NO: 16397 - RNA, 312 nt, Artificial Sequence
  DYNLRB1__Homo_sapiens__NP_001268658
augaacagccagagaagaggcccccacagcugccugaagaccgcccccaaggccaagcccuuccacugggaggcccuggccgccuaccugcuggacaccagcauccccaucaagagcaccauggacaaccccaccaccacccaguacgccagccugaugcacagcuucauccugaaggccagaagcaccgugagagacaucgacccccagaacgaccugaccuuccugagaaucagaagcaagaagaacgagaucaugguggcccccgacaaggacuacuuccugaucgugauccagaaccccaccgaguaa

SEQ ID NO: 16398 - RNA, 300 nt, Artificial Sequence
  DYNLT1__Homo_sapiens__NP_001278531
auggaggacuaccaggccgccgaggaggccaucgagagcgccaucggcggcaacgccuaccagcacagcaaggugaaccaguggaccaccaacgugguggagcagacccugagccagcugaccaagcugggcaagcccuucaaguacaucgugaccugcgugaucaugcagaagaacggcgccggccugcacaccgccagcagcugcuucugggacagcagcaccgacggcagcugcaccgugagaugggagaacaagaccauguacugcaucgugagcgccuucggccugagcaucuaa

SEQ ID NO: 16399 - RNA, 351 nt, Artificial Sequence
  DYNLT3__Homo_sapiens__NP_006511
auggaggaguaccacagacacugcgacgaggugggcuucaacgccgaggaggcccacaacaucgugaaggagugcguggacggcgugcugggcggcgaggacuacaaccacaacaacaucaaccaguggaccgccagcaucguggagcagagccugacccaccuggugaagcugggcaaggccuacaaguacaucgugaccugcgccguggugcagaagagcgccuacggcuuccacaccgccagcagcugcuucugggacaccaccagcgacggcaccugcaccgugagaugggagaacagaaccaugaacugcaucgugaacguguucgccaucgccaucgugcuguaa

SEQ ID NO: 16400 - RNA, 2292 nt, Artificial Sequence
  DYRK1A__Homo_sapiens__NP_001387
augcacaccggcggcgagaccagcgccugcaagcccagcagcgugagacuggcccccagcuucagcuuccacgccgccggccugcagauggccggccagaugccccacagccaccaguacagcgacagaagacagcccaacaucagcgaccagcaggugagcgcccugagcuacagcgaccagauccagcagccccugaccaaccaggugaugcccgacaucgugaugcugcagagaagaaugccccagaccuucagagaccccgccaccgccccccugagaaagcugagcguggaccugaucaagaccuacaagcacaucaacgagguguacuacgccaagaagaagagaagacaccagcagggccagggcgacgacagcagccacaagaaggagagaaagguguacaacgacggcuacgacgacgacaacuacgacuacaucgugaagaacggcgagaaguggauggacagauacgagaucgacagccugaucggcaagggcagcuucggccagguggugaaggccuacgacagaguggagcaggaguggguggccaucaagaucaucaagaacaagaaggccuuccugaaccaggcccagaucgaggugagacugcuggagcugaugaacaagcacgacaccgagaugaaguacuacaucgugcaccugaagagacacuucauguucagaaaccaccugugccugguguucgagaugcugagcuacaaccuguacgaccugcugagaaacaccaacuucagaggcgugagccugaaccugaccagaaaguucgcccagcagaugugcaccgcccugcuguuccuggccacccccgagcugagcaucauccacugcgaccugaagcccgagaacauccugcugugcaaccccaagagaagcgccaucaagaucguggacuucggcagcagcugccagcugggccagagaaucuaccaguacauccagagcagauucuacagaagccccgaggugcugcugggcaugcccuacgaccuggccaucgacauguggagccugggcugcauccugguggagaugcacaccggcgagccccuguucagcggcgccaacgagguggaccagaugaacaagaucguggaggugcugggcaucccccccgcccacauccuggaccaggcccccaaggccagaaaguucuucgagaagcugcccgacggcaccuggaaccugaagaagaccaaggacggcaagagagaguacaagccccccggcaccagaaagcugcacaacauccugggcguggagaccggcggccccggcggcagaagagccggcgagagcggccacaccguggccgacuaccugaaguucaaggaccugauccugagaaugcuggacuacgaccccaagaccagaauccagcccuacuacgcccugcagcacagcuucuucaagaagaccgccgacgagggcaccaacaccagcaacagcgugagcaccagccccgccauggagcagagccagagcagcggcaccaccagcagcaccagcagcagcagcggcggcagcagcggcaccagcaacagcggcagagccagaagcgaccccacccaccagcacagacacagcggcggccacuucaccgccgccgugcaggccauggacugcgagacccacagcccccaggugagacagcaguuccccgccccccugggcuggagcggcaccgaggcccccacccaggugaccguggagacccaccccgugcaggagaccaccuuccacguggccccccagcagaacgcccugcaccaccaccacggcaacagcagccaccaccaccaccaccaccaccaccaccaccaccaccacggccagcaggcccugggcaacagaaccagacccagaguguacaacagccccaccaacagcagcagcacccaggacagcauggaggugggccacagccaccacagcaugaccagccugagcagcagcaccaccagcagcagcaccagcagcagcagcaccggcaaccagggcaaccaggccuaccagaacagacccguggccgccaacacccuggacuucggccagaacggcgccauggacgugaaccugaccguguacagcaaccccagacaggagaccggcaucgccggccaccccaccuaccaguucagcgccaacaccggccccgcccacuacaugaccgagggccaccugaccaugagacagggcgccgacagagaggagagccccaugaccggcgugugcgugcagcagagccccguggccagcagcuaa

SEQ ID NO: 16401 - RNA, 1890 nt, Artificial Sequence
  DYRK1B__Homo_sapiens__NP_004705
auggccgugccccccggccacggccccuucagcggcuuccccggcccccaggagcacacccaggugcugcccgacgugagacugcugcccagaagacugccccuggccuucagagacgccaccagcgccccccugagaaagcugagcguggaccugaucaagaccuacaagcacaucaacgagguguacuacgccaagaagaagagaagagcccagcaggcccccccccaggacagcagcaacaagaaggagaagaaggugcugaaccacggcuacgacgacgacaaccacgacuacaucgugagaagcggcgagagauggcuggagagauacgagaucgacagccugaucggcaagggcagcuucggccagguggugaaggccuacgaccaccagacccaggagcugguggccaucaagaucaucaagaacaagaaggccuuccugaaccaggcccagaucgagcugagacugcuggagcugaugaaccagcacgacaccgagaugaaguacuacaucgugcaccugaagagacacuucauguucagaaaccaccugugccugguguucgagcugcugagcuacaaccuguacgaccugcugagaaacacccacuucagaggcgugagccugaaccugaccagaaagcuggcccagcagcugugcaccgcccugcuguuccuggccacccccgagcugagcaucauccacugcgaccugaagcccgagaacauccugcugugcaaccccaagagaagcgccaucaagaucguggacuucggcagcagcugccagcugggccagagaaucuaccaguacauccagagcagauucuacagaagccccgaggugcugcugggcacccccuacgaccuggccaucgacauguggagccugggcugcauccugguggagaugcacaccggcgagccccuguucagcggcagcaacgagguggaccagaugaacagaaucguggaggugcugggcaucccccccgccgccaugcuggaccaggcccccaaggccagaaaguacuucgagagacugcccggcggcggcuggacccugagaagaaccaaggagcugagaaaggacuaccagggccccggcaccagaagacugcaggaggugcugggcgugcagaccggcggccccggcggcagaagagccggcgagcccggccacagccccgccgacuaccugagauuccaggaccuggugcugagaaugcuggaguacgagcccgccgccagaaucagcccccugggcgcccugcagcacggcuucuucagaagaaccgccgacgaggccaccaacaccggccccgccggcagcagcgccagcaccagccccgccccccuggacaccugccccagcagcagcaccgccagcagcaucagcagcagcggcggcagcagcggcagcagcagcgacaacagaaccuacagauacagcaacagauacugcggcggccccggcccccccaucaccgacugcgagaugaacagcccccaggugccccccagccagccccugagacccugggccggcggcgacgugccccacaagacccaccaggcccccgccagcgccagcagccugcccggcaccggcgcccagcugcccccccagcccagauaccugggcagaccccccagccccaccagcccccccccccccgagcugauggacgugagccuggugggcggccccgccgacugcagccccccccaccccgcccccgccccccagcaccccgccgccagcgcccugagaaccagaaugaccggcggcagacccccccugcccccccccgacgaccccgccacccugggcccccaccugggccugagaggcgugccccagagcaccgccgccagcagcuaa

SEQ ID NO: 16402 - RNA, 1587 nt, Artificial Sequence
  DYRK2__Homo_sapiens__NP_003574
augaacgaccaccugcacgugggcagccacgcccacggccagauccaggugcagcagcuguucgaggacaacagcaacaagagaaccgugcugaccacccagcccaacggccugaccaccgugggcaagaccggccugcccguggugcccgagagacagcuggacagcauccacagaagacagggcagcagcaccagccugaagagcauggagggcaugggcaaggugaaggccacccccaugacccccgagcaggccaugaagcaguacaugcagaagcugaccgccuucgagcaccacgagaucuucagcuaccccgagaucuacuuccugggccugaacgccaagaagagacagggcaugaccggcggccccaacaacggcggcuacgacgacgaccagggcagcuacgugcaggugccccacgaccacguggccuacagauacgaggugcugaaggugaucggcaagggcagcuucggccagguggugaaggccuacgaccacaaggugcaccagcacguggcccugaagauggugagaaacgagaagagauuccacagacaggccgccgaggagaucagaauccuggagcaccugagaaagcaggacaaggacaacaccaugaacgugauccacaugcuggagaacuucaccuucagaaaccacaucugcaugaccuucgagcugcugagcaugaaccuguacgagcugaucaagaagaacaaguuccagggcuucagccugccccuggugagaaaguucgcccacagcauccugcagugccuggacgcccugcacaagaacagaaucauccacugcgaccugaagcccgagaacauccugcugaagcagcagggcagaagcggcaucaaggugaucgacuucggcagcagcugcuacgagcaccagagaguguacaccuacauccagagcagauucuacagagcccccgaggugauccugggcgccagauacggcaugcccaucgacauguggagccugggcugcauccuggccgagcugcugaccggcuacccccugcugcccggcgaggacgagggcgaccagcuggccugcaugaucgagcugcugggcaugcccagccagaagcugcuggacgccagcaagagagccaagaacuucgugagcagcaagggcuaccccagauacugcaccgugaccacccugagcgacggcagcguggugcugaacggcggcagaagcagaagaggcaagcugagaggcccccccgagagcagagaguggggcaacgcccugaagggcugcgacgacccccuguuccuggacuuccugaagcagugccuggagugggaccccgccgugagaaugacccccggccaggcccugagacaccccuggcugagaagaagacugcccaagccccccaccggcgagaagaccagcgugaagagaaucaccgagagcaccggcgccaucaccagcaucagcaagcugcccccccccagcagcagcgccagcaagcugagaaccaaccuggcccagaugaccgacgccaacggcaacauccagcagagaaccgugcugcccaagcuggugagcuaa

SEQ ID NO: 16403 - RNA, 1707 nt, Artificial Sequence
  DYRK3__Homo_sapiens__NP_001004023
augaaguggaaggagaagcugggcgacggcguguacgacaccuucaugaugaucgacgagaccaagugcccccccugcagcaacgugcugugcaaccccagcgagccccccccccccagaagacugaacaugaccaccgagcaguucaccggcgaccacacccagcacuuccuggacggcggcgagaugaagguggagcagcuguuccaggaguucggcaacagaaagagcaacaccauccagagcgacggcaucagcgacagcgagaagugcagccccaccgugagccagggcaagagcagcgacugccugaacaccgugaagagcaacagcagcagcaaggcccccaagguggugccccugacccccgagcaggcccugaagcaguacaagcaccaccugaccgccuacgagaagcuggagaucaucaacuaccccgagaucuacuucgugggccccaacgccaagaagagacacggcgugaucggcggccccaacaacggcggcuacgacgacgccgacggcgccuacauccacgugcccagagaccaccuggccuacagauacgaggugcugaagaucaucggcaagggcagcuucggccagguggccagaguguacgaccacaagcugagacaguacguggcccugaagauggugagaaacgagaagagauuccacagacaggccgccgaggagaucagaauccuggagcaccugaagaagcaggacaagaccggcagcaugaacgugauccacaugcuggagagcuucaccuucagaaaccacgugugcauggccuucgagcugcugagcaucgaccuguacgagcugaucaagaagaacaaguuccagggcuucagcgugcagcuggugagaaaguucgcccagagcauccugcagagccuggacgcccugcacaagaacaagaucauccacugcgaccugaagcccgagaacauccugcugaagcaccacggcagaagcagcaccaaggugaucgacuucggcagcagcugcuucgaguaccagaagcuguacaccuacauccagagcagauucuacagagcccccgagaucauccugggcagcagauacagcacccccaucgacaucuggagcuucggcugcauccuggccgagcugcugaccggccagccccuguuccccggcgaggacgagggcgaccagcuggccugcaugauggagcugcugggcaugcccccccccaagcugcuggagcagagcaagagagccaaguacuucaucaacagcaagggcauccccagauacugcagcgugaccacccaggccgacggcagaguggugcuggugggcggcagaagcagaagaggcaagaagagaggcccccccggcagcaaggacuggggcaccgcccugaagggcugcgacgacuaccuguucaucgaguuccugaagagaugccugcacugggaccccagcgccagacugacccccgcccaggcccugagacaccccuggaucagcaagagcgugcccagaccccugaccaccaucgacaaggugagcggcaagagaguggugaaccccgccagcgccuuccagggccugggcagcaagcugccccccguggugggcaucgccaacaagcugaaggccaaccugaugagcgagaccaacggcagcaucccccugugcagcgugcugcccaagcugaucagcuaa

SEQ ID NO: 16404 - RNA, 6246 nt, Artificial Sequence
  DYSF__Homo_sapiens__NP_001123927
augcugugcugccugcuggugagagccagcaaccugcccagcgccaagaaggacagaagaagcgaccccguggccagccugaccuucagaggcgugaagaagagaaccaaggugaucaagaacagcgugaaccccguguggaacgagggcuucgagugggaccugaagggcaucccccuggaccagggcagcgagcugcacgugguggugaaggaccacgagaccaugggcagaaacagauuccugggcgaggccaaggugccccugagagaggugcuggccacccccagccugagcgccagcuucaacgccccccugcuggacaccaagaagcagcccaccggcgccagccuggugcugcaggugagcuacaccccccugcccggcgccgugccccuguuccccccccccaccccccuggagcccagccccacccugcccgaccuggacgugguggccgacaccggcggcgaggaggacaccgaggaccagggccugaccggcgacgaggccgagcccuuccuggaccagagcggcggccccggcgcccccaccacccccagaaagcugcccagcagaccccccccccacuaccccggcaucaagagaaagagaagcgcccccaccagcagaaagcugcugagcgacaagccccaggacuuccagaucagagugcaggugaucgagggcagacagcugcccggcgugaacaucaagcccguggugaaggugaccgccgccggccagaccaagagaaccagaauccacaagggcaacagcccccuguucaacgagacccuguucuucaaccuguucgacagccccggcgagcuguucgacgagcccaucuucaucaccgugguggacagcagaagccugagaaccgacgcccugcugggcgaguucagaauggacgugggcaccaucuacagagagcccagacacgccuaccugagaaaguggcugcugcugagcgaccccgacgacuucagcgccggcgccagaggcuaccugaagaccagccugugcgugcugggccccggcgacgaggccccccuggagagaaaggaccccagcgaggacaaggaggacaucgagagcaaccugcugagacccaccggcguggcccugagaggcgcccacuucugccugaagguguucagagccgaggaccugccccagauggacgacgccgugauggacaacgugaagcagaucuucggcuucgagagcaacaagaagaaccugguggaccccuucguggaggugagcuucgccggcaagaugcugugcagcaagauccuggagaagaccgccaacccccaguggaaccagaacaucacccugcccgccauguuccccagcaugugcgagaagaugagaaucagaaucaucgacugggacagacugacccacaacgacaucguggccaccaccuaccugagcaugagcaagaucagcgcccccggcggcgagaucgaggaggagcccgccggcgccgugaagcccagcaaggccagcgaccuggacgacuaccugggcuuccugcccaccuucggccccugcuacaucaaccuguacggcagccccagagaguucaccggcuuccccgaccccuacaccgagcugaacaccggcaagggcgagggcguggccuacagaggcagacugcugcugagccuggagaccaagcugguggagcacagcgagcagaagguggaggaccugcccgccgacgacauccugagaguggagaaguaccugagaagaagaaaguacagccuguucgccgccuucuacagcgccaccaugcugcaggacguggacgacgccauccaguucgaggugagcaucggcaacuacggcaacaaguucgacaugaccugccugccccuggccagcaccacccaguacagcagagccguguucgacggcugccacuacuacuaccugcccuggggcaacgugaagcccgugguggugcugagcagcuacugggaggacaucagccacagaaucgagacccagaaccagcugcugggcaucgccgacagacuggaggccggccuggagcaggugcaccuggcccugaaggcccagugcagcaccgaggacguggacagccugguggcccagcugaccgacgagcugaucgccggcugcagccagccccugggcgacauccacgagacccccagcgccacccaccuggaccaguaccuguaccagcugagaacccaccaccugagccagaucaccgaggccgcccuggcccugaagcugggccacagcgagcugcccgccgcccuggagcaggccgaggacuggcugcugagacugagagcccuggccgaggagccccagaacagccugcccgacaucgugaucuggaugcugcagggcgacaagagaguggccuaccagagagugcccgcccaccaggugcuguucagcagaagaggcgccaacuacugcggcaagaacugcggcaagcugcagaccaucuuccugaaguaccccauggagaaggugcccggcgccagaaugcccgugcagaucagagugaagcugugguucggccugagcguggacgagaaggaguucaaccaguucgccgagggcaagcugagcguguucgccgagaccuacgagaacgagaccaagcuggcccuggugggcaacuggggcaccaccggccugaccuaccccaaguucagcgacgugaccggcaagaucaagcugcccaaggacagcuucagacccagcgccggcuggaccugggccggcgacugguucgugugccccgagaagacccugcugcacgacauggacgccggccaccugagcuucguggaggagguguucgagaaccagaccagacugcccggcggccaguggaucuacaugagcgacaacuacaccgacgugaacggcgagaaggugcugcccaaggacgacaucgagugcccccugggcuggaagugggaggacgaggaguggagcaccgaccugaacagagccguggacgagcagggcugggaguacagcaucaccaucccccccgagagaaagcccaagcacugggugcccgccgagaagauguacuacacccacagaagaagaagaugggugagacugagaagaagagaccugagccagauggaggcccugaagagacacagacaggccgaggccgagggcgagggcugggaguacgccagccuguucggcuggaaguuccaccuggaguacagaaagaccgacgccuucagaagaagaagauggagaagaagaauggagccccuggagaagaccggccccgccgccguguucgcccuggagggcgcccugggcggcgugauggacgacaagagcgaggacagcaugagcgugagcacccugagcuucggcgugaacagacccaccaucagcugcaucuucgacuacggcaacagauaccaccugagaugcuacauguaccaggccagagaccuggccgccauggacaaggacagcuucagcgaccccuacgccaucgugagcuuccugcaccagagccagaagaccgugguggugaagaacacccugaaccccaccugggaccagacccugaucuucuacgagaucgagaucuucggcgagcccgccaccguggccgagcagccccccagcaucgugguggagcuguacgaccacgacaccuacggcgccgacgaguucaugggcagaugcaucugccagcccagccuggagagaaugcccagacuggccugguucccccugaccagaggcagccagcccagcggcgagcugcuggccagcuucgagcugauccagagagagaagcccgccauccaccacauccccggcuucgaggugcaggagaccagcagaauccuggacgagagcgaggacaccgaccugcccuacccccccccccagagagaggccaacaucuacauggugccccagaacaucaagcccgcccugcagagaaccgccaucgagauccuggccuggggccugagaaacaugaagagcuaccagcuggccaacaucagcagccccagccuggugguggagugcggcggccagaccgugcagagcugcgugaucagaaaccugagaaagaaccccaacuucgacaucugcacccuguucauggaggugaugcugcccagagaggagcuguacugcccccccaucaccgugaaggugaucgacaacagacaguucggcagaagacccguggugggccagugcaccaucagaagccuggagagcuuccugugcgaccccuacagcgccgagagccccagcccccagggcggccccgacgacgugagccugcugagccccggcgaggacgugcugaucgacaucgacgacaaggagccccugauccccauccaggaggaggaguucaucgacugguggagcaaguucuucgccagcaucggcgagagagagaagugcggcagcuaccuggagaaggacuucgacacccugaagguguacgacacccagcuggagaacguggaggccuucgagggccugagcgacuucugcaacaccuucaagcuguacagaggcaagacccaggaggagaccgaggaccccagcgugaucggcgaguucaagggccuguucaagaucuacccccugcccgaggaccccgccauccccaugccccccagacaguuccaccagcuggccgcccagggcccccaggagugccuggugagaaucuacaucgugagagccuucggccugcagcccaaggaccccaacggcaagugcgaccccuacaucaagaucagcaucggcaagaagagcgugagcgaccaggacaacuacauccccugcacccuggagcccguguucggcaagauguucgagcugaccugcacccugccccuggagaaggaccugaagaucacccuguacgacuacgaccugcugagcaaggacgagaagaucggcgagaccgugguggaccuggagaacagacugcugagcaaguucggcgccagaugcggccugccccagaccuacugcgugagcggccccaaccaguggagagaccagcugagacccagccagcugcugcaccuguucugccagcagcacagagugaaggcccccguguacagaaccgacagagugauguuccaggacaaggaguacagcaucgaggagaucgaggccggcagaauccccaacccccaccugggccccguggaggagagacuggcccugcacgugcugcagcagcagggccuggugcccgagcacguggagagcagaccccuguacagcccccugcagcccgacaucgagcagggcaagcugcagauguggguggaccuguuccccaaggcccugggcagacccggcccccccuucaacaucacccccagaagagccagaagauucuuccugagaugcaucaucuggaacaccagagacgugauccuggacgaccugagccugaccggcgagaagaugagcgacaucuacgugaagggcuggaugaucggcuucgaggagcacaagcagaagaccgacgugcacuacagaagccugggcggcgagggcaacuucaacuggagauucaucuuccccuucgacuaccugcccgccgagcaggugugcaccaucgccaagaaggacgccuucuggagacuggacaagaccgagagcaagauccccgccagagugguguuccagaucugggacaacgacaaguucagcuucgacgacuuccugggcagccugcagcuggaccugaacagaaugcccaagcccgccaagaccgccaagaagugcagccuggaccagcuggacgacgccuuccaccccgagugguucgugagccuguucgagcagaagaccgugaagggcugguggcccugcguggccgaggagggcgagaagaagauccuggccggcaagcuggagaugacccuggagaucguggccgagagcgagcacgaggagagacccgccggccagggcagagacgagcccaacaugaaccccaagcuggaggaccccagaagacccgacaccagcuuccugugguucaccagccccuacaagaccaugaaguucauccuguggagaagauucagaugggccaucauccuguucaucauccuguucauccugcugcuguuccuggccaucuucaucuacgccuuccccaacuacgccgccaugaagcuggugaagcccuucagcuaa

SEQ ID NO: 16405 - RNA, 1131 nt, Artificial Sequence
  DYX1C1__Homo_sapiens__NP_001028731
augccccugcaggugagcgacuacagcuggcagcagaccaagaccgccguguuccugagccugccccugaagggcgugugcgugagagacaccgacguguucugcaccgagaacuaccugaaggugaacuucccccccuuccuguucgaggccuuccuguacgcccccaucgacgacgagagcagcaaggccaagaucggcaacgacaccaucguguucacccuguacaagaaggaggccgccaugugggagacccugagcgugaccggcguggacaaggagaugaugcagagaaucagagagaagagcauccugcaggcccaggagagagccaaggaggccaccgaggccaaggccgccgccaagagagaggaccagaaguacgcccugagcgugaugaugaagaucgaggaggaggagagaaagaagaucgaggacaugaaggagaacgagagaaucaaggccaccaaggcccuggaggccuggaaggaguaccagagaaaggccgaggagcagaagaagauccagagagaggagaagcugugccagaaggagaagcagaucaaggaggagagaaagaagaucaaguacaagagccugaccagaaaccuggccagcagaaaccuggcccccaagggcagaaacagcgagaacaucuucaccgagaagcugaaggaggacagcauccccgcccccagaagcgugggcagcaucaagaucaacuucacccccagaguguuccccaccgcccugagagagagccagguggccgaggaggaggaguggcugcacaagcaggccgaggccagaagagccaugaacaccgacaucgccgagcugugcgaccugaaggaggaggagaagaaccccgaguggcugaaggacaagggcaacaagcuguucgccaccgagaacuaccuggccgccaucaacgccuacaaccuggccaucagacugaacaacaagaugccccugcuguaccugaacagagccgccugccaccugaagcugaagaaccugcacaaggccaucgaggacagcagcaaggccuacagaaucaugaagagacaccugagacugauccaccccaccaagcuguacaagcugaugcugagaagauucggcauguaa

SEQ ID NO: 16406 - RNA, 2547 nt, Artificial Sequence
  DZIP1__Homo_sapiens__NP_055749
augcaggccgaggccgccgacugguucagcagcaugcccuuccagaagcacguguacuacccccuggccagcggccccgagggccccgacguggccguggccgccgccgccgccggcgccgccagcauggccugcgccccccccagcgccgccagcggcccccugcccuucuuccaguucagacccagacuggagagcguggacuggagaagacugagcgccaucgacguggacaagguggccggcgccguggacgugcugacccugcaggagaacaucaugaacaucaccuucugcaagcuggaggacgagaagugcccccacugccagagcggcguggaccccgugcugcugaagcugaucagacuggcccaguucaccaucgaguaccugcugcacagccaggaguuccugaccagccagcugcacacccuggaggagagacugagacugagccacugcgacggcgagcagagcaagaagcugcugaccaagcaggccggcgagaucaagacccugaaggaggagugcaagagaagaaagaagaugaucagcacccagcagcugaugaucgaggccaaggccaacuacuaccagugccacuucugcgacaaggccuucaugaaccaggccuuccugcagagccacauccagagaagacacaccgaggagaacagccacuucgaguaccagaagaacgcccagaucgagaagcugagaagcgagaucguggugcugaaggaggagcugcagcugaccagaagcgagcuggaggccgcccaccacgccagcgccgugagauucagcaaggaguacgagaugcagaagaccaaggaggaggacuuccugaagcuguucgacagauggaaggaggaggagaaggagaagcugguggacgagauggagaaggugaaggagauguucaugaaggaguucaaggagcugaccagcaagaacagcgcccuggaguaccagcugagcgagauccagaagagcaacaugcagaucaagagcaacaucggcacccugaaggacgcccacgaguucaaggaggacagaagccccuacccccaggacuuccacaacgugaugcagcugcuggacagccaggagagcaaguggaccgccagagugcaggccauccaccaggagcacaagaaggagaagggcagacugcugagccacaucgagaagcugagaaccagcaugaucgacgaccugaacgccagcaacguguucuacaagaagagaaucgaggagcugggccagagacugcaggagcagaacgagcugaucaucacccagagacagcagaucaaggacuucaccugcaacccccugaacagcaucagcgagcccaaggugaacgcccccgcccugcacacccuggagaccaagagcagccugcccauggugcacgagcaggccuucagcagccacauccuggagcccaucgaggagcugagcgaggaggagaagggcagagagaacgagcagaagcugaacaacaacaagaugcaccugagaaaggcccugaagagcaacagcagccugaccaagggccugagaaccaugguggagcagaaccugauggagaagcuggagacccugggcaucaacgccgacaucagaggcaucagcagcgaccagcugcacagagugcugaagagcguggagagcgagagacacaagcaggagagagagauccccaacuuccaccagaucagagaguuccuggagcaccaggugagcugcaagaucgaggagaaggcccugcugagcagcgaccagugcagcgugagccagauggacacccugagcaccggcgaggugcccaagaugauccagcugcccagcaagaacagacagcugaucagacagaaggccgugagcaccgacagaaccagcgugcccaagaucaagaagaacgugauggaggaccccuuccccagaaagagcagcaccaucaccaccccccccuucagcagcgaggaggagcaggaggacgacgaccugaucagagccuacgccagccccggcccccugcccgugccccccccccagaacaagggcagcuucggcaagaacaccgugaagagcgacgccgacggcaccgagggcagcgagaucgaggacaccgacgacagccccaagcccgccggcguggccgugaagacccccaccgagaagguggagaagauguucccccacagaaagaacgugaacaagcccgugggcggcaccaacgugcccgagauguucaucaagaaggaggagcugcaggagcugaagugcgccgacguggaggacgaggacugggacaucagcagccuggaggaggagaucagccugggcaagaagagcggcaaggagcagaaggagcccccccccgccaagaacgagccccacuucgcccacgugcugaacgccuggggcgccuucaaccccaagggccccaagggcgagggccugcaggagaacgagagcagcacccugaagagcagccuggugaccgugaccgacuggagcgacaccagcgacguguaa

SEQ ID NO: 16407 - RNA, 1314 nt, Artificial Sequence
  E2F1__Homo_sapiens__NP_005216
auggcccuggccggcgcccccgccggcggccccugcgcccccgcccuggaggcccugcugggcgccggcgcccugagacugcuggacagcagccagaucgugaucaucagcgccgcccaggacgccagcgccccccccgcccccaccggccccgccgcccccgccgccggccccugcgaccccgaccugcugcuguucgccaccccccaggcccccagacccacccccagcgcccccagacccgcccugggcagaccccccgugaagagaagacuggaccuggagaccgaccaccaguaccuggccgagagcagcggccccgccagaggcagaggcagacaccccggcaagggcgugaagagccccggcgagaagagcagauacgagaccagccugaaccugaccaccaagagauuccuggagcugcugagccacagcgccgacggcgugguggaccugaacugggccgccgaggugcugaaggugcagaagagaagaaucuacgacaucaccaacgugcuggagggcauccagcugaucgccaagaagagcaagaaccacauccaguggcugggcagccacaccaccgugggcgugggcggcagacuggagggccugacccaggaccugagacagcugcaggagagcgagcagcagcuggaccaccugaugaacaucugcaccacccagcugagacugcugagcgaggacaccgacagccagagacuggccuacgugaccugccaggaccugagaagcaucgccgaccccgccgagcagauggugauggugaucaaggccccccccgagacccagcugcaggccguggacagcagcgagaacuuccagaucagccugaagagcaagcagggccccaucgacguguuccugugccccgaggagaccgugggcggcaucagccccggcaagacccccagccaggaggugaccagcgaggaggagaacagagccaccgacagcgccaccaucgugagccccccccccagcagcccccccagcagccugaccaccgaccccagccagagccugcugagccuggagcaggagccccugcugagcagaaugggcagccugagagcccccguggacgaggacagacugagcccccugguggccgccgacagccugcuggagcacgugagagaggacuucagcggccugcugcccgaggaguucaucagccugagccccccccacgaggcccuggacuaccacuucggccuggaggagggcgagggcaucagagaccuguucgacugcgacuucggcgaccugaccccccuggacuucuaa

SEQ ID NO: 16408 - RNA, 1005 nt, Artificial Sequence
  E2F3__Homo_sapiens__NP_001230005
augccccugcagcagcaggccaagagaagacuggagcugggcgagagcggccaccaguaccugagcgacggccugaagacccccaagggcaagggcagagccgcccugagaagccccgacagccccaagaagaagaccagauacgacaccagccugggccugcugaccaagaaguucauccagcugcugagccagagccccgacggcgugcuggaccugaacaaggccgccgaggugcugaaggugcagaagagaagaaucuacgacaucaccaacgugcuggagggcauccaccugaucaagaagaagagcaagaacaacgugcaguggaugggcugcagccugagcgaggacggcggcaugcuggcccagugccagggccugagcaaggaggugaccgagcugagccaggaggagaagaagcuggacgagcugauccagagcugcacccuggaccugaagcugcugaccgaggacagcgagaaccagagacuggccuacgugaccuaccaggacaucagaaagaucagcggccugaaggaccagaccgugaucguggugaaggccccccccgagaccagacuggaggugcccgacagcaucgagagccugcagauccaccuggccagcacccagggccccaucgagguguaccugugccccgaggagaccgagacccacagccccaugaagaccaacaaccaggaccacaacggcaacauccccaagcccgccagcaaggaccuggccagcaccaacagcggccacagcgacugcagcgugagcaugggcaaccugagcccccuggccagccccgccaaccugcugcagcagaccgaggaccagauccccagcaaccuggagggccccuucgugaaccugcugcccccccugcugcaggaggacuaccugcugagccugggcgaggaggagggcaucagcgaccuguucgacgccuacgaccuggagaagcugccccugguggaggacuucaugugcagcuaa

SEQ ID NO: 16409 - RNA, 1242 nt, Artificial Sequence
  E2F4__Homo_sapiens__NP_001941
auggccgaggccggcccccaggccccccccccccccggcacccccagcagacacgagaagagccugggccugcugaccaccaaguucgugagccugcugcaggaggccaaggacggcgugcuggaccugaagcuggccgccgacacccuggccgugagacagaagagaagaaucuacgacaucaccaacgugcuggagggcaucggccugaucgagaagaagagcaagaacagcauccaguggaagggcgugggccccggcugcaacaccagagagaucgccgacaagcugaucgagcugaaggccgagaucgaggagcugcagcagagagagcaggagcuggaccagcacaaggugugggugcagcagagcaucagaaacgugaccgaggacgugcagaacagcugccuggccuacgugacccacgaggacaucugcagaugcuucgccggcgacacccugcuggccaucagagcccccagcggcaccagccuggaggugcccauccccgagggccugaacggccagaagaaguaccagauccaccugaagagcgugagcggccccaucgaggugcugcuggugaacaaggaggccuggagcagcccccccguggccgugcccgugcccccccccgaggaccugcugcagagccccagcgccgugagcaccccccccccccugcccaagcccgcccuggcccagagccaggaggccagcagacccaacagcccccagcugacccccaccgccgugcccggcagcgccgaggugcagggcauggccggccccgccgccgagaucaccgugagcggcggccccggcaccgacagcaaggacagcggcgagcugagcagccugccccugggccccaccacccuggacaccagaccccugcagagcagcgcccugcuggacagcagcagcagcagcagcagcagcagcagcagcagcagcaacagcaacagcagcagcagcagcggccccaaccccagcaccagcuucgagcccaucaaggccgaccccaccggcgugcuggagcugcccaaggagcugagcgagaucuucgaccccaccagagagugcaugagcagcgagcugcuggaggagcugaugagcagcgagguguucgccccccugcugagacugagccccccccccggcgaccacgacuacaucuacaaccuggacgagagcgagggcgugugcgaccuguucgacgugcccgugcugaaccuguaa

SEQ ID NO: 16410 - RNA, 1038 nt, Artificial Sequence
  E2F5__Homo_sapiens__NP_001077057
auggccgccgccgagcccgccagcagcggccagcaggcccccgccggccagggccagggccagagaccccccccccagcccccccaggcccaggccccccagccccccccccccccccagcugggcggcgccggcggcggcagcagcagacacgagaagagccugggccugcugaccaccaaguucgugagccugcugcaggaggccaaggacggcgugcuggaccugaaggccgccgccgacacccuggccgugagacagaagagaagaaucuacgacaucaccaacgugcuggagggcaucgaccugaucgagaagaagagcaagaacagcauccaguggaagggcgugggcgccggcugcaacaccaaggaggugaucgacagacugagauaccugaaggccgagaucgaggaccuggagcugaaggagagagagcuggaccagcagaagcuguggcugcagcagagcaucaagaacgugauggacgacagcaucaacaacagauucagcuacgugacccacgaggacaucugcaacugcuucaacggcgacacccugcuggccauccaggcccccagcggcacccagcuggaggugcccauccccgagaugggccagaacggccagaagaaguaccagaucaaccugaagagccacagcggccccauccacgugcugcugaucaacaaggagagcagcagcagcaagcccgugguguuccccgugcccccccccgacgaccugacccagcccagcagccagagccugacccccgugaccccccagaagagcagcauggccacccagaaccugcccgagcagcacgugagcgagagaagccaggcccugcagcagaccagcgccaccgacaucagcagcggcagcaucagcggcgacaucaucgacgagcugaugagcagcgacguguucccccugcugagacugagccccacccccgccgacgacuacaacuucaaccuggacgacaacgagggcgugugcgaccuguucgacgugcagauccugaacuacuaa

SEQ ID NO: 16411 - RNA, 750 nt, Artificial Sequence
  E2F6__Homo_sapiens__NP_001265204
augaaccccagccccagcaagaucagaaucaaccuggaggacaacgugcaguacgugagcaugagaaaggcccugaaggugaagagacccagauucgacgugagccugguguaccugaccagaaaguucauggaccuggugagaagcgcccccggcggcauccuggaccugaacaagguggccaccaagcugggcgugagaaagagaagaguguacgacaucaccaacgugcuggacggcaucgaccugguggagaagaagagcaagaaccacaucagauggaucggcagcgaccugagcaacuucggcgccgugccccagcagaagaagcugcaggaggagcugagcgaccugagcgccauggaggacgcccuggacgagcugaucaaggacugcgcccagcagcuguucgagcugaccgacgacaaggagaacgagagacuggccuacgugaccuaccaggacauccacagcauccaggccuuccacgagcagaucgugaucgccgugaaggcccccgccgagaccagacuggacgugcccgcccccagagaggacagcaucaccgugcacaucagaagcaccaacggccccaucgacguguaccugugcgagguggagcagggccagaccagcaacaagagaagcgagggcgugggcaccagcagcagcgagagcacccaccccgagggccccgaggaggaggagaacccccagcagagcgaggagcugcuggaggugagcaacuaa

SEQ ID NO: 16412 - RNA, 2736 nt, Artificial Sequence
  E2F7__Homo_sapiens__NP_976328
auggaggugaacugccugacccugaaggaccugaucagccccagacagcccagacuggacuucgccguggaggacggcgagaacgcccagaaggagaacaucuucguggacagaagcagaauggcccccaagacccccaucaagaacgagcccaucgaccugagcaagcagaagaaguucacccccgagagaaaccccaucacccccgugaaguucguggacagacagcaggccgagcccuggacccccaccgccaaccugaagaugcugaucagcgccgccagccccgacaucagagacagagagaagaagaagggccuguucagacccaucgagaacaaggacgacgccuucaccgacagccugcagcuggacguggugggcgacagcgccguggacgaguucgagaagcagagacccagcagaaagcagaagagccugggccugcugugccagaaguuccuggccagauaccccagcuacccccugagcaccgagaagaccaccaucagccuggacgagguggccgugagccugggcguggagagaagaagaaucuacgacaucgugaacgugcuggagagccugcaccuggugagcagaguggccaagaaccaguacggcuggcacggcagacacagccugcccaagacccugagaaaccugcagagacugggcgaggagcagaaguacgaggagcagauggccuaccugcagcagaaggagcuggaccugaucgacuacaaguucggcgagagaaagaaggacggcgaccccgacagccaggagcagcagcugcuggacuucagcgagcccgacugccccagcagcagcgccaacagcagaaaggacaagagccugagaaucaugagccagaaguucgugaugcuguuccuggugagcaagaccaagaucgugacccuggacguggccgccaagauccugaucgaggagagccaggacgcccccgaccacagcaaguucaagaccaaggugagaagacuguacgacaucgccaacgugcugaccagccuggcccugaucaagaaggugcacgugaccgaggagagaggcagaaagcccgccuucaaguggaucggccccguggacuucagcagcagcgacgaggagcugguggacgugagcgccagcgugcugcccgagcugaagagagagaccuacggccagauccaggugugcgccaagcagaagcuggccagacacggcagcuucaacaccgugcaggccagcgagagaauccagagaaaggugaacagcgagcccagcagccccuacagagaggagcagggcagcggcggcuacagccuggagaucggcagccuggccgccguguacagacagaagaucgaggacaacagccagggcaaggccuucgccagcaagagaguggugccccccagcagcagccuggaccccguggcccccuuccccgugcugagcguggaccccgaguacugcgugaacccccuggcccaccccguguucagcguggcccagaccgaccugcaggccuucagcaugcagaacggccugaacggccagguggacgugagccuggccagcgccgccagcgccguggagagccugaagcccgcccugcuggccggccagccccugguguacgugcccagcgccagccuguucaugcuguacggcagccugcaggagggccccgccagcggcagcggcagcgagagagacgacagaagcagcgaggcccccgccaccguggagcugagcagcgcccccagcgcccagaagagacugugcgaggagagaaagccccaggaggaggacgagcccgccaccaagagacagagcagagaguacgaggacggcccccugagccuggugaugcccaagaagcccagcgacagcaccgaccuggccagccccaagaccaugggcaacagagccagcaucccccugaaggacauccacgugaacggccagcugcccgccgccgaggagaucagcggcaaggccaccgccaacagccuggugagcagcgaguggggcaaccccagcagaaacaccgacguggagaagcccagcaaggagaacgagagcaccaaggagcccagccugcugcaguaccugugcgugcagagccccgccggccugaacggcuucaacgugcugcugagcggcagccagaccccccccaccgugggccccagcagcggccagcugcccagcuucagcgugcccugcauggugcugcccagccccccccugggccccuuccccgugcuguacagccccgccaugcccggccccgugagcagcacccugggcgcccugcccaacaccggccccgugaacuucagccugcccggccugggcagcaucgcccagcugcuggugggccccaccgccguggugaaccccaagagcagcacccugcccagcgccgacccccagcugcagagccagcccagccugaaccugagccccgugaugagcagaagccacagcguggugcagcagcccgagagccccguguacgugggccaccccgugagcguggugaagcugcaccagagccccgugcccgugacccccaagagcauccagagaacccacagagagaccuucuucaagacccccggcagccugggcgaccccgugcugaagagaagagagagaaaccagagcagaaacaccagcagcgcccagagaagacuggagauccccagcggcggcgccgacuaa

SEQ ID NO: 16413 - RNA, 2604 nt, Artificial Sequence
  E2F8__Homo_sapiens__NP_078956
auggagaacgagaaggagaaccuguucugcgagccccacaagagaggccugaugaagaccccccugaaggagagcaccaccgccaacaucgugcuggccgagauccagcccgacuucggcccccugaccacccccaccaagcccaaggagggcagccagggcgagcccuggacccccaccgccaaccugaagaugcugaucagcgccgugagccccgagaucagaaacagagaccagaagagaggccuguucgacaacagaagcggccugcccgaggccaaggacugcauccacgagcaccugagcggcgacgaguucgagaagagccagcccagcagaaaggagaagagccugggccugcugugccacaaguuccuggccagauaccccaacuaccccaaccccgccgugaacaacgacaucugccuggacgagguggccgaggagcugaacguggagagaagaagaaucuacgacaucgugaacgugcuggagagccugcacauggugagcagacuggccaagaacagauacaccuggcacggcagacacaaccugaacaagacccugggcacccugaagagcaucggcgaggagaacaaguacgccgagcagaucaugaugaucaagaagaaggaguacgagcaggaguucgacuucaucaagagcuacagcaucgaggaccacaucaucaagagcaacaccggccccaacggccaccccgacaugugcuucguggagcugcccggcguggaguucagagccgccagcgugaacagcagaaaggacaagagccugagagugaugagccagaaguucgugaugcuguuccuggugagcaccccccagaucgugagccuggagguggccgccaagauccugaucggcgaggaccacguggaggaccuggacaagagcaaguucaagaccaagaucagaagacuguacgacaucgccaacgugcugagcagccuggaccugaucaagaaggugcacgugaccgaggagagaggcagaaagcccgccuucaaguggaccggccccgagaucagccccaacaccagcggcagcagccccgugauccacuucacccccagcgaccuggaggugagaagaagcagcaaggagaacugcgccaagaaccuguucagcaccagaggcaagcccaacuucaccagacaccccagccugaucaagcuggugaagagcaucgagagcgacagaagaaagaucaacagcgcccccagcagccccaucaagaccaacaaggccgagagcagccagaacagcgcccccuuccccagcaagauggcccagcuggccgccaucugcaagaugcagcuggaggagcagagcagcgagagcagacagaaggugaaggugcagcuggccagaagcggccccugcaagcccguggccccccuggacccccccgugaacgccgagauggagcugaccgcccccagccugauccagccccugggcauggugccccugauccccagcccccugagcagcgccgugccccugauccugccccaggcccccagcggccccagcuacgccaucuaccugcagcccacccaggcccaccagagcgugacccccccccagggccugagccccaccgugugcaccacccacagcagcaaggccaccggcagcaaggacagcaccgacgccaccaccgagaaggccgccaacgacaccagcaaggccagcgccagcaccagacccggcagccugcugcccgcccccgagagacagggcgccaagagcagaaccagagagcccgccggcgagagaggcagcaagagagccagcaugcuggaggacagcggcagcaagaagaaguucaaggaggaccugaagggccuggagaacgugagcgccacccuguuccccagcggcuaccugaucccccugacccagugcagcagccugggcgccgagagcauccugagcggcaaggagaacagcagcgcccugagccccaaccacagaaucuacagcagccccaucgccggcgugauccccgugaccagcagcgagcugaccgccgugaacuuccccagcuuccacgugaccccccugaagcugauggugagccccaccagcguggccgccgugcccgugggcaacagccccgcccuggccagcagccaccccgugcccauccagaaccccagcagcgccaucgugaacuucacccugcagcaccugggccugaucagccccaacgugcagcugagcgccagccccggcagcggcaucgugcccgugagccccagaaucgagagcgugaacguggcccccgagaacgccggcacccagcagggcagagccaccaacuacgacagccccgugcccggccagagccagcccaacggccagagcguggccgugaccggcgcccagcagcccgugcccgugacccccaagggcagccagcugguggccgagagcuucuucagaacccccggcggccccaccaagcccaccagcagcagcugcauggacuucgagggcgccaacaagaccagccugggcacccuguucgugccccagagaaagcuggaggugagcaccgaggacgugcacuaa

SEQ ID NO: 16414 - RNA, 2355 nt, Artificial Sequence
  E4F1__Homo_sapiens__NP_004415
auggagggcgccauggccgugagagugaccgccgcccacaccgccgaggcccaggccgaggccggcagagaggccggcgagggcgccguggccgccguggccgccgcccuggcccccagcggcuuccugggccugcccgcccccuucagcgaggaggacgaggacgacgugcacagaugcggcagaugccaggccgaguucaccgcccuggaggacuucgugcagcacaagauccagaaggccugccagagagccccccccgaggcccugcccgccacccccgccaccaccgcccugcugggccaggagguggugcccgccgcccccggccccgaggagcccaucaccguggcccacaucgugguggaggccgccagccuggccgccgacaucagccacgccagcgaccuggugggcggcggccacaucaaggaggugaucguggccgccgaggccgagcugggcgacggcgagauggccgaggcccccggcagcccccaccagcagggccugggccuggccggcgagggcgagcaggcccaggugaagcugcuggugaacaaggacggcagauacgugugcgcccugugccacaagaccuucaagaccggcagcauccugaaggcccacauggugacccacagcagcagaaaggaccacgagugcaagcugugcggcgccagcuucagaaccaagggcagccugaucagacaccacagaagacacaccgacgagagacccuacaagugcagcaagugcggcaagagcuucagagagagcggcgcccugaccagacaccugaagagccugacccccugcaccgagaagaucagauucagcgugagcaaggacgugguggugagcaaggaggacgccagagccggcagcggcgccggcgccgccggccugggcaccgccaccagcagcgugaccggcgagcccaucgagaccagccccgugauccaccuggugaccgacgccaagggcaccgugauccacgaggugcacgugcagaugcaggagcugagccugggcaugaaggcccuggcccccgagccccccgugagccaggagcugcccugcagcagcgagggcagcagagagaaccugcugcaccaggccaugcagaacagcggcaucgugcuggagagagccgccggcgaggagggcgcccuggagcccgcccccgccgccggcagcagcccccagccccuggccguggccgccccccagcugcccgugcuggaggugcagccccuggagacccagguggccagcgaggccagcgccgugcccagaacccaccccugcccccagugcagcgagaccuuccccaccgccgccacccuggaggcccacaagagaggccacaccggccccagacccuucgccugcgcccagugcggcaaggccuuccccaaggccuaccugcugaagaagcaccaggaggugcacgugagagagagaagauucagaugcggcgacugcggcaagcuguacaagaccaucgcccacgugagaggccacagaagagugcacagcgacgagagacccuaccccugccccaagugcggcaagagauacaagaccaagaacgcccagcaggugcacuucagaacccaccuggaggagaagccccacgugugccaguucugcagcagaggcuucagagagaagggcagccuggugagacacgugagacaccacaccggcgagaagcccuucaagugcuacaagugcggcagaggcuucgccgagcacggcacccugaacagacaccugagaaccaagggcggcugccugcuggagguggaggagcugcuggugagcgaggacagccccgccgccgccaccaccgugcugaccgaggacccccacaccgugcugguggaguucagcagcgugguggccgacacccaggaguacaucaucgaggccaccgccgacgacgccgagaccagcgaggccaccgagaucaucgagggcacccagaccgagguggacagccacaucaugaagguggugcagcagaucgugcaccaggccagcgccggccaccagaucaucgugcagaacgugaccauggacgaggagaccgcccugggccccgaggccgccgccgccgacaccaucaccaucgccacccccgagagccugaccgagcagguggccaugacccuggccagcgccaucagcgagggcaccgugcuggccgccagagccggcaccagcggcaccgagcaggccaccgugaccauggugagcagcgaggacaucgagauccuggagcacgccggcgagcuggugaucgccagccccgagggccagcuggaggugcagaccgugaucguguaa

SEQ ID NO: 16415 - RNA, 807 nt, Artificial Sequence
  EAF1__Homo_sapiens__NP_149074
augaacggcaccgccaacccccugcuggacagagaggagcacugccugagacugggcgagagcuucgagaagagacccagagccagcuuccacaccaucagauacgacuucaagcccgccagcaucgacaccagcugcgagggcgagcugcaggugggcaagggcgacgaggugaccaucacccugccccacauccccggcagcaccccccccaugaccguguucaagggcaacaagagacccuaccagaaggacugcgugcugaucaucaaccacgacaccggcgaguacgugcuggagaagcugagcagcagcauccaggugaagaagaccagagccgagggcagcagcaagauccaggccagaauggagcagcagcccaccagacccccccagaccagccagcccccccccccccccccccccaugcccuucagagcccccaccaagccccccgugggccccaagaccagcccccugaaggacaaccccagccccgagccccagcuggacgacaucaagagagagcugagagccgagguggacaucaucgagcagaugagcagcagcagcggcagcagcagcagcgacagcgagagcagcagcggcagcgacgacgacagcagcagcagcggcggcgaggacaacggccccgccagccccccccagcccagccaccagcagcccuacaacagcagacccgccguggccaacggcaccagcagaccccagggcagcaaccagcugaugaacacccugagaaacgaccugcagcugagcgagagcggcagcgacagcgacgacuaa

SEQ ID NO: 16416 - RNA, 783 nt, Artificial Sequence
  EAF2__Homo_sapiens__NP_060926
augaacagcgccgccggcuucagccaccuggacagaagagagagagugcugaagcugggcgagagcuucgagaagcagcccagaugcgccuuccacaccgugagauacgacuucaagcccgccagcaucgacaccagcagcgagggcuaccuggaggugggcgagggcgagcaggugaccaucacccugcccaacaucgagggcagcaccccccccgugaccguguucaagggcagcaagaagcccuaccugaaggagugcauccugaucaucaaccacgacaccggcgagugcagacuggagaagcugagcagcaacaucaccgugaagaagaccagaguggagggcagcagcaagauccaguacagaaaggagcagcagcagcagcagauguggaacagcgccagaacccccaaccuggugaagcacagccccagcgaggacaagaugagccccgccagccccaucgacgacaucgagagagagcugaaggccgaggccagccugauggaccagaugagcagcugcgacagcagcagcgacagcaagagcagcagcagcagcagcagcgaggacagcagcagcgacagcgaggacgaggacugcaagagcagcaccagcgacaccggcaacugcgugagcggccaccccaccaugacccaguacagaauccccgacaucgacgccagccacaacagauucagagacaacagcggccugcugaugaacacccugagaaacgaccugcagcugagcgagagcggcagcgacagcgacgacuaa

SEQ ID NO: 16417 - RNA, 1572 nt, Artificial Sequence
  EARS2__Homo_sapiens__NP_001077083
auggccgcccugcugagaagacugcugcagagagagagacccagcgccgccagcggcagacccgugggcagaagagaggccaaccugggcaccgacgccggcguggccgugagagugagauucgcccccagccccaccggcuuccugcaccugggcggccugagaaccgcccuguacaacuacaucuucgccaagaaguaccagggcagcuucauccugagacuggaggacaccgaccagaccagaguggugcccggcgccgccgagaacaucgaggacaugcuggagugggccggcaucccccccgacgagagccccagaagaggcggccccgccggccccuaccagcagagccagagacuggagcuguacgcccaggccaccgaggcccugcugaagaccggcgccgccuaccccugcuucugcagcccccagagacuggagcugcugaagaaggaggcccugagaaaccaccagacccccagauacgacaacagaugcagaaacaugagccaggagcagguggcccagaagcuggccaaggaccccaagcccgccaucagauucagacuggagcagguggugcccgccuuccaggaccugguguacggcuggaacagacacgagguggccagcguggagggcgaccccgugaucaugaagagcgacggcuuccccaccuaccaccuggccugcgugguggacgaccaccacaugggcaucagccacgugcugagaggcagcgaguggcuggugagcaccgccaagcaccugcugcuguaccaggcccugggcuggcagcccccccacuucgcccaccugccccugcugcugaacagagacggcagcaagcugagcaagagacagggcgacguguuccuggagcacuucgccgccgacggcuuccugcccgacagccugcuggacaucaucaccaacugcggcagcggcuucgccgagaaccagaugggcagaacccugcccgagcugaucacccaguucaaccugacccaggugaccugccacagcgcccugcuggaccuggagaagcugcccgaguucaacagacugcaccugcagagacuggugagcaacgagagccagagaagacagcuggugggcaagcugcaggugcugguggaggaggccuucggcugccagcugcagaacagagacgugcugaaccccguguacguggagagaauccugcugcugagacagggccacaucugcagacugcaggaccuggugagccccguguacagcuaccuguggaccagacccgccgugggcagagcccagcuggacgccaucagcgagaagguggacgugaucgccaagagagugcugggccugcuggagagaagcagcaugagccugacccaggacaugcugaacggcgagcugaagaagcugagcgagggccuggagggcaccaaguacagcaacgugaugaagcugcugagaauggcccugagcggccagcagcagggcccccccguggccgagaugaugcuggcccugggccccaaggaggugagagagagaauccagaagguggugagcagcuaa

SEQ ID NO: 16418 - RNA, 642 nt, Artificial Sequence
  EBAG9__Homo_sapiens__NP_001265867
auggccaucacccaguucagacuguucaaguucugcaccugccuggccaccguguucagcuuccugaagagacugaucugcagaagcggcagaggcagaaagcugagcggcgaccagaucacccugcccaccaccguggacuacagcagcgugcccaagcagaccgacguggaggaguggaccagcugggacgaggacgcccccaccagcgugaagaucgagggcggcaacggcaacguggccacccagcagaacagccuggagcagcuggagcccgacuacuucaaggacaugacccccaccaucagaaagacccagaagaucgugaucaagaagagagagccccugaacuucggcauccccgacggcagcaccggcuucagcagcagacuggccgccacccaggaccugcccuucauccaccagagcagcgagcugggcgaccuggacaccuggcaggagaacaccaacgccugggaggaggaggaggacgccgccuggcaggccgaggaggugcugagacagcagaagcuggccgacagagagaagagagccgccgagcagcagagaaagaagauggagaaggaggcccagagacugaugaagaaggagcagaacaagaucggcgugaagcugagcuaa

SEQ ID NO: 16419 - RNA, 1776 nt, Artificial Sequence
  EBF1__Homo_sapiens__NP_076870
auguucggcauccaggagagcauccagagaagcggcagcagcaugaaggaggagccccugggcagcggcaugaacgccgugagaaccuggaugcagggcgccggcgugcuggacgccaacaccgccgcccagagcggcgugggccuggccagagcccacuucgagaagcagccccccagcaaccugagaaagagcaacuucuuccacuucgugcuggcccuguacgacagacagggccagcccguggagaucgagagaaccgccuucgugggcuucguggagaaggagaaggaggccaacagcgagaagaccaacaacggcauccacuacagacugcagcugcuguacagcaacggcaucagaaccgagcaggacuucuacgugagacugaucgacagcaugaccaagcaggccaucguguacgagggccaggacaagaaccccgagaugugcagagugcugcugacccacgagaucaugugcagcagaugcugcgacaagaagagcugcggcaacagaaacgagacccccagcgaccccgugaucaucgacagauucuuccugaaguucuuccugaagugcaaccagaacugccugaagaacgccggcaaccccagagacaugagaagauuccaggugguggugagcaccaccgugaacguggacggccacgugcuggccgugagcgacaacauguucgugcacaacaacagcaagcacggcagaagagccagaagacuggaccccagcgagggcacccccagcuaccuggagcacgccacccccugcaucaaggccaucagccccagcgagggcuggaccaccggcggcgccaccgugaucaucaucggcgacaacuucuucgacggccugcaggugaucuucggcaccaugcugguguggagcgagcugaucaccccccacgccaucagagugcagaccccccccagacacauccccggcgugguggaggugacccugagcuacaagagcaagcaguucugcaagggcacccccggcagauucaucuacaccgcccugaacgagcccaccaucgacuacggcuuccagagacugcagaaggugauccccagacaccccggcgaccccgagagacugcccaaggaggugauccugaagagagccgccgaccugguggaggcccuguacggcaugccccacaacaaccaggagaucauccugaagagagccgccgacaucgccgaggcccuguacagcgugcccagaaaccacaaccagcugcccgcccuggccaacaccagcgugcacgccggcaugaugggcgugaacagcuucagcggccagcuggccgugaacgugagcgaggccagccaggccaccaaccagggcuucaccagaaacagcagcagcgugagcccccacggcuacgugcccagcaccaccccccagcagaccaacuacaacagcgugaccaccagcaugaacggcuacggcagcgccgccaugagcaaccugggcggcagccccaccuuccugaacggcagcgccgccaacagccccuacgccaucgugcccagcagccccaccauggccagcagcaccagccugcccagcaacugcagcagcagcagcggcaucuucagcuucagccccgccaacauggugagcgccgugaagcagaagagcgccuucgcccccguggugagaccccagaccagccccccccccaccugcaccagcaccaacggcaacagccugcaggccaucagcggcaugaucgugccccccauguaa

SEQ ID NO: 16420 - RNA, 1728 nt, Artificial Sequence
  EBF2__Homo_sapiens__NP_073150
auguucggcauccaggacacccugggcagaggccccacccugaaggagaagagccugggcgccgagauggacagcgugagaagcugggugagaaacgugggcgugguggacgccaacguggccgcccagagcggcguggcccugagcagagcccacuucgagaagcagccccccagcaaccugagaaagagcaacuucuuccacuucgugcuggcccuguacgacagacagggccagcccguggagaucgagagaaccgccuucguggacuucguggagaacgacaaggagcagggcaacgagaagaccaacaacggcacccacuacaagcugcagcugcuguacagcaacggcgugagaaccgagcaggaccuguacgugagacugaucgacagcgugaccaagcagcccaucgccuacgagggccagaacaagaaccccgagaugugcagagugcugcugacccacgaggugaugugcagcagaugcugcgagaagaagagcugcggcaacagaaacgagacccccagcgaccccgugaucaucgacagauucuuccugaaguucuuccugaagugcaaccagaacugccugaagaccgccggcaaccccagagacaugagaagauuccagguggugcugagcaccaccgugaacguggacggccacgugcuggccgugagcgacaacauguucgugcacaacaacagcaagcacggcagaagagccagaagacuggaccccagcgaggccacccccugcaucaaggccaucagccccagcgagggcuggaccaccggcggcgccauggugaucaucaucggcgacaacuucuucgacggccugcaggugguguucggcaccaugcugguguggagcgagcugaucaccccccacgccaucagagugcagaccccccccagacacauccccggcgugguggaggugacccugagcuacaagagcaagcaguucugcaagggcgcccccggcagauucaucuacaccgcccugaacgagcccaccaucgacuacggcuuccagagacugcagaaggugauccccagacaccccggcgaccccgagagacuggccaaggagaugcugcugaagagagccgccgaccugguggaggcccuguacggcaccccccacaacaaccaggacaucauccugaagagagccgccgacaucgccgaggcccuguacagcgugcccagaaaccccagccagcugcccgcccugagcagcagccccgcccacagcggcaugaugggcaucaacagcuacggcagccagcugggcgugagcaucagcgagagcacccagggcaacaaccagggcuacaucagaaacaccagcagcaucagccccagaggcuacagcagcagcagcaccccccagcagagcaacuacagcaccagcagcaacagcaugaacggcuacagcaacgugcccauggccaaccugggcgugcccggcagccccggcuuccugaacggcagccccaccggcagccccuacggcaucaugagcagcagccccaccgugggcagcagcagcaccagcagcauccugcccuucagcagcagcguguuccccgccgugaagcagaagagcgccuucgcccccgugaucagaccccagggcagccccagccccgccugcagcagcggcaacggcaacggcuucagagccaugaccggccugguggugccccccauguaa

SEQ ID NO: 16421 - RNA, 1656 nt, Artificial Sequence
  EBF3__Homo_sapiens__NP_001005463
auguucggcauccaggagaacauccccagaggcggcaccaccaugaaggaggagccccugggcagcggcaugaaccccgugagaagcuggaugcacaccgccggcgugguggacgccaacaccgccgcccagagcggcgugggccuggccagagcccacuucgagaagcagccccccagcaaccugagaaagagcaacuucuuccacuucgugcuggcccuguacgacagacagggccagcccguggagaucgagagaaccgccuucguggacuucguggagaaggagaaggagcccaacaacgagaagaccaacaacggcauccacuacaagcugcagcugcuguacagcaacggcgugagaaccgagcaggaccuguacgugagacugaucgacagcaugaccaagcaggccaucguguacgagggccaggacaagaaccccgagaugugcagagugcugcugacccacgagaucaugugcagcagaugcugcgacaagaagagcugcggcaacagaaacgagacccccagcgaccccgugaucaucgacagauucuuccugaaguucuuccugaagugcaaccagaacugccugaagaacgccggcaaccccagagacaugagaagauuccaggugguggugagcaccaccgugaacguggacggccacgugcuggccgugagcgacaacauguucgugcacaacaacagcaagcacggcagaagagccagaagacuggaccccagcgaggccacccccugcaucaaggccaucagccccagcgagggcuggaccaccggcggcgccaccgugaucaucaucggcgacaacuucuucgacggccugcaggugguguucggcaccaugcugguguggagcgagcugaucaccccccacgccaucagagugcagaccccccccagacacauccccggcgugguggaggugacccugagcuacaagagcaagcaguucugcaagggcgcccccggcagauucguguacaccgcccugaacgagcccaccaucgacuacggcuuccagagacugcagaaggugauccccagacaccccggcgaccccgagagacugcccaaggaggugcugcugaagagagccgccgaccugguggaggcccuguacggcaugccccacaacaaccaggagaucauccugaagagagccgccgacaucgccgaggcccuguacagcgugcccagaaaccacaaccagauccccacccugggcaacaaccccgcccacaccggcaugaugggcgugaacagcuucagcagccagcuggccgugaacgugagcgagaccagccaggccaacgaccaggugggcuacagcagaaacaccagcagcgugagccccagaggcuacgugcccagcagcaccccccagcagagcaacuacaacaccgugagcaccagcaugaacggcuacggcagcggcgccauggccagccugggcgugcccggcagccccggcuuccugaacggcagcagcgccaacagccccuacggcaugaagcagaagagcgccuucgcccccguggugagaccccaggccagccccccccccagcugcaccagcgccaacggcaacggccugcaggccaugagcggccugguggugccccccauguaa

SEQ ID NO: 16422 - RNA, 1797 nt, Artificial Sequence
  EBF4__Homo_sapiens__NP_001103984
auggacgcccugcccagaagcggccugaaccugaaggaggagccccugcugcccgccggccugggcagcgugagaagcuggaugcagggcgccggcauccuggacgccagcaccgccgcccagagcggcgugggccuggccagagcccacuucgagaagcagccccccagcaaccugagaaagagcaacuucuuccacuucgugcuggccauguacgacagacagggccagcccguggagguggagagaaccgccuucaucgacuucguggagaaggacagagagcccggcgccgagaagaccaacaacggcauccacuacagacugagacugguguacaacaacggccugagaaccgagcaggaccuguacgugagacugaucgacagcaugagcaagcaggccaucaucuacgagggccaggacaagaaccccgagaugugcagagugcugcugacccacgagaucaugugcagcagaugcugcgacagaaagagcugcggcaacagaaacgagacccccagcgaccccgugaucaucgacagauucuuccugaaguucuuccugaagugcaaccagaacugccugaagaacgccggcaaccccagagacaugagaagauuccaggugguggugagcaccaccgugagcguggacggccacgugcuggccgugagcgacaacauguucgugcacaacaacagcaagcacggcagaagagccagaagacuggaccccagcgaggccgccacccccugcaucaaggccaucagccccggcgagggcuggaccaccggcggcgccaccgugaucgugaucggcgacaacuucuucgacggccugcaggugguguucggcaacgugcugguguggagcgagcugaucaccccccacgccaucagagugcagaccccccccagacacauccccggcgugguggaggugacccugagcuacaagagcaagcaguucugcaagggcugccccggcagauucguguacaccgcccugaacgagcccaccaucgacuacggcuuccagagacugcagaaggugauccccagacaccccggcgaccccgagagacugcccaaggaggugcugcugaagagagccgccgaccuggccgaggcccuguacggcgugcccggcagcaaccaggagcugcugcugaagagagccgccgacguggccgaggcccuguacagcacccccagagcccccggcccccuggccccccuggcccccagccacccccaccccgccguggugggcaucaacgccuucagcagcccccuggccaucgccgugggcgacgccacccccggccccgagcccggcuacgccagaagcugcagcagcgccagccccagaggcuucgcccccagccccggcagccagcagagcggcuacggcggcggccugggcgccggccugggcggcuacggcgcccccggcguggccggccugggcgugcccggcagccccagcuuccugaacggcagcaccgccaccagccccuucgccaucaugcccagcagccccccccuggccgccgccagcagcaugagccugcccgccgccgcccccaccaccagcguguucagcuucagccccgugaacaugaucagcgccgugaagcagagaagcgccuucgcccccgugcugagaccccccagcagccccccccaggccugccccagagcccacggcgagggccugcccgaccagagcuucgaggacagcgacaaguuccacagccccgccagaggccugcagggccuggccuacagcuaa

SEQ ID NO: 16423 - RNA, 690 nt, Artificial Sequence
  EBI3__Homo_sapiens__NP_005746
augaccccccagcugcugcuggcccuggugcugugggccagcugcccccccugcagcggcagaaagggcccccccgccgcccugacccugcccagagugcagugcagagccagcagauaccccaucgccguggacugcagcuggacccugccccccgcccccaacagcaccagccccgugagcuucaucgccaccuacagacugggcauggccgccagaggccacagcuggcccugccugcagcagacccccaccagcaccagcugcaccaucaccgacgugcagcuguucagcauggcccccuacgugcugaacgugaccgccgugcaccccuggggcagcagcagcagcuucgugcccuucaucaccgagcacaucaucaagcccgacccccccgagggcgugagacugagcccccuggccgagagacagcugcaggugcagugggagccccccggcagcuggcccuuccccgagaucuucagccugaaguacuggaucagauacaagagacagggcgccgccagauuccacagagugggccccaucgaggccaccagcuucauccugagagccgugagacccagagccagauacuacgugcagguggccgcccaggaccugaccgacuacggcgagcugagcgacuggagccugcccgccaccgccaccaugagccugggcaaguaa

SEQ ID NO: 16424 - RNA, 693 nt, Artificial Sequence
  EBP__Homo_sapiens__NP_006570
augaccaccaacgccggcccccugcaccccuacuggccccagcaccugagacuggacaacuucgugcccaacgacagacccaccuggcacauccuggccggccuguucagcgugaccggcgugcugguggugaccaccuggcugcugagcggcagagccgccguggugccccugggcaccuggagaagacugagccugugcugguucgccgugugcggcuucauccaccuggugaucgagggcugguucgugcuguacuacgaggaccugcugggcgaccaggccuuccugagccagcuguggaaggaguacgccaagggcgacagcagauacauccugggcgacaacuucaccgugugcauggagaccaucaccgccugccuguggggcccccugagccuguggguggugaucgccuuccugagacagcacccccugagauucauccugcagcugguggugagcgugggccagaucuacggcgacgugcuguacuuccugaccgagcacagagacggcuuccagcacggcgagcugggccacccccuguacuucugguucuacuucguguucaugaacgcccuguggcuggugcugcccggcgugcuggugcuggacgccgugaagcaccugacccacgcccagagcacccuggacgccaaggccaccaaggccaagagcaagaagaacuaa

SEQ ID NO: 16425 - RNA, 405 nt, Artificial Sequence
  EBPL__Homo_sapiens__NP_001265565
augggcgccgagugggagcugggcgccgaggccggcggcagccugcugcugugcgccgcccugcuggccgccggcugcgcccugggccugagacugggcagaggccagggcgccgccgacagaggcgcccugaucuggcugugcuacgacgcccuggugcacuucgcccuggagggccccuucguguaccugagccuggugggcaacguggccaacagcgacggccugaucgccagccuguggaaggaguacggcaaggccgacgccagauggguguacuucgaccccaccaucgugagcguggagauccugaccguggcccuggacggcagccuggcccuguuccugaucuacgccaucgugaaggagaaguacuacagagacagaguggccuggggcgaguaa

SEQ ID NO: 16426 - RNA, 2034 nt, Artificial Sequence
  ECD__Homo_sapiens__NP_001129224
auggaggagaccaugaagcuggccaccauggaggacaccguggaguacugccuguuccugauccccgacgagagcagagacagcgacaagcacaaggagauccugcagaaguacaucgagagaaucaucaccagauucgcccccaugcuggugcccuacaucuggcagaaccagcccuucaaccugaaguacaagcccggcaagggcggcgugcccgcccacauguucggcgugaccaaguucggcgacaacaucgaggacgagugguucaucguguacgugaucaagcagaucaccaaggaguuccccgagcugguggccagaaucgaggacaacgacggcgaguuccugcugaucgaggccgccgacuuccugcccaaguggcuggaccccgagaacagcaccaacagaguguucuucugccacggcgagcugugcaucauccccgcccccagaaagagcggcgccgagagcuggcugcccaccaccccccccaccaucccccaggcccugaacaucaucaccgcccacagcgagaagauccuggccagcgagagcaucagagccgccgugaacagaagaaucagaggcuaccccgagaagauccaggccagccugcacagagcccacugcuuccugcccgccggcaucguggccgugcugaagcagagacccagacugguggccgccgccgugcaggccuucuaccugagagaccccaucgaccugagagccugcagaguguucaagaccuuccugcccgagaccagaaucaugaccagcgugaccuucaccaagugccuguacgcccagcuggugcagcagagauucgugcccgacagaagaagcggcuacagacugcccccccccagcgacccccaguacagagcccacgagcugggcaugaagcuggcccacggcuucgagauccugugcagcaagugcagcccccacuucagcgacugcaagaagagccuggugaccgccagcccccugugggccagcuuccuggagagccugaagaagaacgacuacuucaagggccugaucgagggcagcgcccaguacagagagagacuggagauggccgagaacuacuuccagcugagcguggacuggcccgagagacuggaggugcaguggagagaccccggccugcugcaggcccccccccccggcuucacccccuucaucugccugagccugcugagcaccugggacaacagcagccuggccaugagccccggcgaggagauccugacccugcugcagaccauccccuucgacaucgaggaccugaagaaggaggccgccaaccugccccccgaggacgacgaccaguggcuggaccugagccccgaccagcuggaccagcugcugcaggaggccgugggcaagaaggagagcgagagcgugagcaaggaggagaaggagcagaacuacgaccugaccgaggugagcgagagcaugaaggccuucaucagcaaggugagcacccacaagggcgccgagcugcccagagagcccagcgaggcccccaucaccuucgacgccgacagcuuccugaacuacuucgacaagauccugggccccagacccaacgagagcgacagcgacgaccuggacgacgaggacuucgagugccuggacagcgacgacgaccuggacuucgagacccacgagcccggcgaggaggccagccugaagggcacccuggacaaccugaagagcuacauggcccagauggaccaggagcuggcccacaccugcaucagcaagagcuucaccaccagaaaccagguggagcccgugagccagaccaccgacaacaacagcgacgaggaggacagcggcaccggcgagagcgugauggcccccguggacguggaccugaaccuggugagcaacauccuggagagcuacagcagccaggccggccuggccggccccgccagcaaccugcugcagagcaugggcgugcagcugcccgacaacaccgaccacagacccaccagcaagcccaccaagaacuaa

SEQ ID NO: 16427 - RNA, 2211 nt, Artificial Sequence
  ECE2__Homo_sapiens__NP_001032401
augaacguggcccugcaggagcugggcgccggcagcaacgugggcuuccagaagggcaccagacagcugcugggcagcagaacccagcuggagcuggugcuggccggcgccagccugcugcuggccgcccugcugcugggcugccugguggcccugggcgugcaguaccacagagaccccagccacagcaccugccugaccgaggccugcaucagaguggccggcaagauccuggagagccuggacagaggcgugagccccugcgaggacuucuaccaguucagcugcggcggcuggaucagaagaaacccccugcccgacggcagaagcagauggaacaccuucaacagccugugggaccagaaccaggccauccugaagcaccugcuggagaacaccaccuucaacagcagcagcgaggccgagcagaagacccagagauucuaccugagcugccugcagguggagagaaucgaggagcugggcgcccagccccugagagaccugaucgagaagaucggcggcuggaacaucaccggccccugggaccaggacaacuucauggaggugcugaaggccguggccggcaccuacagagccacccccuucuucaccguguacaucagcgccgacagcaagagcagcaacagcaacgugauccagguggaccagagcggccuguuccugcccagcagagacuacuaccugaacagaaccgccaacgagaaggugcugaccgccuaccuggacuacauggaggagcugggcaugcugcugggcggcagacccaccagcaccagagagcagaugcagcaggugcuggagcuggagauccagcuggccaacaucaccgugccccaggaccagagaagagacgaggagaagaucuaccacaagaugagcaucagcgagcugcaggcccuggcccccagcauggacuggcuggaguuccugagcuuccugcugagcccccuggagcugagcgacagcgagcccguggugguguacggcauggacuaccugcagcaggugagcgagcugaucaacagaaccgagcccagcauccugaacaacuaccugaucuggaaccuggugcagaagaccaccagcagccuggacagaagauucgagagcgcccaggagaagcugcuggagacccuguacggcaccaagaagagcugcgugcccagauggcagaccugcaucagcaacaccgacgacgcccugggcuucgcccugggcagccuguucgugaaggccaccuucgacagacagagcaaggagaucgccgagggcaugaucagcgagaucagaaccgccuucgaggaggcccugggccagcugguguggauggacgagaagaccagacaggccgccaaggagaaggccgacgccaucuacgacaugaucggcuuccccgacuucauccuggagcccaaggagcuggacgacguguacgacggcuacgagaucagcgaggacagcuucuuccagaacaugcugaaccuguacaacuucagcgccaaggugauggccgaccagcugagaaagccccccagcagagaccaguggagcaugaccccccagaccgugaacgccuacuaccugcccaccaagaacgagaucguguuccccgccggcauccugcaggcccccuucuacgccagaaaccaccccaaggcccugaacuucggcggcaucggcguggugaugggccacgagcugacccacgccuucgacgaccagggcagagaguacgacaaggagggcaaccugagacccugguggcagaacgagagccuggccgccuucagaaaccacaccgccugcauggaggagcaguacaaccaguaccaggugaacggcgagagacugaacggcagacagacccugggcgagaacaucgccgacaacggcggccugaaggccgccuacaacgccuacaaggccuggcugagaaagcacggcgaggagcagcagcugcccgccgugggccugaccaaccaccagcuguucuucgugggcuucgcccagguguggugcagcgugagaacccccgagagcagccacgagggccuggugaccgacccccacagccccgccagauucagagugcugggcacccugagcaacagcagagacuuccugagacacuucggcugccccgugggcagccccaugaaccccggccagcugugcgaggugugguaa

SEQ ID NO: 16428 - RNA, 2322 nt, Artificial Sequence
  ECEL1__Homo_sapiens__NP_001277716
auggagccccccuacagccugaccgcccacuacgacgaguuccaggaggugaaguacgugagcagaugcggcgccggcggcgccagaggcgccagccugccccccggcuucccccugggcgccgccagaagcgccaccggcgccagaagcggccugcccagauggaacagaagagaggugugccugcugagcggccugguguucgccgccggccugugcgccauccuggccgccaugcuggcccugaaguaccugggccccguggccgccggcggcggcgccugccccgagggcugccccgagagaaaggccuucgccagagccgccagauuccuggccgccaaccuggacgccagcaucgaccccugccaggacuucuacagcuucgccugcggcggcuggcugagaagacacgccauccccgacgacaagcugaccuacggcaccaucgccgccaucggcgagcagaacgaggagagacugagaagacugcuggccagacccggcggcggccccggcggcgccgcccagagaaaggugagagccuucuucagaagcugccuggacaugagagagaucgagagacugggccccagacccaugcuggaggugaucgaggacugcggcggcugggaccugggcggcgccgaggagagacccggcguggccgccagaugggaccugaacagacugcuguacaaggcccagggcguguacagcgccgccgcccuguucagccugaccgugagccuggacgacagaaacagcagcagauacgugaucagaaucgaccaggacggccugacccugcccgagagaacccuguaccuggcccaggacgaggacagcgagaagauccuggccgccuacagaguguucauggagagagugcugagccugcugggcgccgacgccguggagcagaaggcccaggagauccugcagguggagcagcagcuggccaacaucaccgugagcgagcacgacgaccugagaagagacgugagcagcauguacaacaaggugacccugggccagcugcagaagaucaccccccaccugagauggaaguggcugcuggaccagaucuuccaggaggacuucagcgaggaggaggagguggugcugcuggccaccgacuacaugcagcaggugagccagcugaucagaagcaccccccacagagugcugcacaacuaccugguguggagaguggugguggugcugagcgagcaccugagcccccccuucagagaggcccugcacgagcuggcccaggagauggagggcagcgacaagccccaggagcuggccagagugugccugggccaggccaacagacacuucggcauggcccugggcgcccuguucgugcacgagcacuucagcgccgccagcaaggccaaggugcagcagcugguggaggacaucaaguacauccugggccagagacuggaggagcuggacuggauggacgccgagaccagagccgccgccagagccaagcugcaguacaugauggugauggugggcuaccccgacuuccugcugaagcccgacgccguggacaaggaguacgaguucgaggugcacgagaagaccuacuucaagaacauccugaacagcaucagauucagcauccagcugagcgugaagaagaucagacaggagguggacaaguggcugcugcccccccaggcccugaacgccuacuaccugcccaacaagaaccagaugguguuccccgccggcauccugcagcccacccuguacgaccccgacuucccccagagccugaacuacggcggcaucggcaccaucaucggccacgagcugacccacggcuacgacgacuggggcggccaguacgacagaagcggcaaccugcugcacugguggaccgaggccagcuacagcagauuccugagaaaggccgagugcaucgugagacuguacgacaacuucaccguguacaaccagagagugaacggcaagcacacccugggcgagaacaucgccgacaugggcggccugaagcuggccuaccacgccuaccagaagugggugagagagcacggccccgagcacccccugcccagacugaaguacacccacgaccagcuguucuucaucgccuucgcccagaacuggugcaucaagagaagaagccagagcaucuaccugcaggugcugaccgacaagcacgcccccgagcacuacagagugcugggcagcgugagccaguucgaggaguucggcagagccuuccacugccccaaggacagccccaugaaccccgcccacaagugcagcgugugguaa

SEQ ID NO: 16429 - RNA, 681 nt, Artificial Sequence
  ECHDC1__Homo_sapiens__NP_001099014
augaugcugcagcugcuggagaaggugaucgagcuggagaacuggaccgagggcaagggccugaucgugagaggcgccaagaacaccuucagcagcggcagcgaccugaacgccgugaagagccugggcacccccgaggacggcauggccgugugcauguucaugcagaacacccugaccagauucaugagacugccccugaucagcguggcccuggugcagggcugggcccugggcggcggcgccgaguucaccaccgccugcgacuucagacugaugacccccgagagcaagaucagauucgugcacaaggagaugggcaucauccccagcuggggcggcaccaccagacugguggagaucaucggcagcagacaggcccugaaggugcugagcggcgcccugaagcuggacagcaagaacgcccugaacaucggcaugguggaggaggugcugcagagcagcgacgagaccaagagccuggaggaggcccaggaguggcugaagcaguucauccagggcccccccgaggugaucagagcccugaagaagagcgugugcagcggcagagagcuguaccuggaggaggcccugcagaacgagagagaccugcugggcaccguguggggcggccccgccaaccuggaggccaucgccaagaagggcaaguucaacaaguaa

SEQ ID NO: 16430 - RNA, 912 nt, Artificial Sequence
  ECHDC3__Homo_sapiens__NP_078969
auggccgccguggccgugcugagagccuucggcgccagcggccccaugugccugagaagaggccccugggcccagcugcccgccagauucugcagcagagaccccgccggcgccggcagaagagagagcgagcccagacccaccagcgccagacagcuggacggcaucagaaacaucgugcugagcaaccccaagaagagaaacacccugagccuggccaugcugaagagccugcagagcgacauccugcacgacgccgacagcaacgaccugaaggugaucaucaucagcgccgagggccccguguucagcagcggccacgaccugaaggagcugaccgaggagcagggcagagacuaccacgccgagguguuccagaccugcagcaaggugaugaugcacaucagaaaccaccccgugcccgugaucgccauggugaacggccuggccaccgccgccggcugccagcugguggccagcugcgacaucgccguggccagcgacaagagcagcuucgccacccccggcgugaacgugggccuguucugcagcacccccggcguggcccuggccagagccgugcccagaaagguggcccuggagaugcuguucaccggcgagcccaucagcgcccaggaggcccugcugcacggccugcugagcaagguggugcccgaggccgagcugcaggaggagaccaugagaaucgccagaaagaucgccagccugagcagacccguggugagccugggcaaggccaccuucuacaagcagcugccccaggaccugggcaccgccuacuaccugaccagccaggccaugguggacaaccuggcccugagagacggccaggagggcaucaccgccuuccugcagaagagaaagcccguguggagccacgagcccguguaa

SEQ ID NO: 16431 - RNA, 873 nt, Artificial Sequence
  ECHS1__Homo_sapiens__NP_004083
auggccgcccugagagugcugcugagcugcgugagaggcccccugagaccccccgugagaugccccgccuggagacccuucgccagcggcgccaacuucgaguacaucaucgccgagaagagaggcaagaacaacaccgugggccugauccagcugaacagacccaaggcccugaacgcccugugcgacggccugaucgacgagcugaaccaggcccugaagaccuucgaggaggaccccgccgugggcgccaucgugcugaccggcggcgacaaggccuucgccgccggcgccgacaucaaggagaugcagaaccugagcuuccaggacugcuacagcagcaaguuccugaagcacugggaccaccugacccaggugaagaagcccgugaucgccgccgugaacggcuacgccuucggcggcggcugcgagcuggccaugaugugcgacaucaucuacgccggcgagaaggcccaguucgcccagcccgagauccugaucggcaccauccccggcgccggcggcacccagagacugaccagagccgugggcaagagccuggccauggagauggugcugaccggcgacagaaucagcgcccaggacgccaagcaggccggccuggugagcaagaucugccccguggagacccugguggaggaggccauccagugcgccgagaagaucgccagcaacagcaagaucgugguggccauggccaaggagagcgugaacgccgccuucgagaugacccugaccgagggcagcaagcuggagaagaagcuguucuacagcaccuucgccaccgacgacagaaaggagggcaugaccgccuucguggagaagagaaaggccaacuucaaggaccaguaa

SEQ ID NO: 16432 - RNA, 858 nt, Artificial Sequence
  ECI1__Homo_sapiens__NP_001171500
auggcccugguggccagcgugagagugcccgccagagugcugcugagagccggcgccagacugcccggcgccgcccugggcagaaccgagagagccgccggcggcggcgacggcgccagaagauucggcagccagagagugcugguggagcccgacgccggcgccggcguggccgugaugaaguucaagaacccccccgugaacagccugagccuggaguuccugaccgagcuggugaucagccuggagaagcuggagaacgacaagagcuucagaggcgugauccugaccagcgacagacccggcguguucagcgccggccuggaccugaccgagaugugcggcagaagccccgcccacuacgccggcuacuggaaggccgugcaggagcuguggcugagacuguaccagagcaaccuggugcuggugagcgccaucaacggcgccugccccgccggcggcugccugguggcccugaccugcgacuacagaauccuggccgacaaccccagacugaaggacacccuggagaacaccaucggccacagagccgccgagagagcccugcagcugggccugcuguucccccccgccgaggcccugcaggugggcaucguggaccagguggugcccgaggagcaggugcagagcaccgcccugagcgccaucgcccaguggauggccauccccgaccacgccagacagcugaccaaggccaugaugagaaaggccaccgccagcagacuggugacccagagagacgccgacgugcagaacuucgugagcuucaucagcaaggacagcauccagaagagccugcagauguaccuggagagacugaaggaggagaagggcuaa

SEQ ID NO: 16433 - RNA, 1095 nt, Artificial Sequence
  ECI2__Homo_sapiens__NP_006108
augaacagaaccgccaugagagccagccagaaggacuucgagaacagcaugaaccaggugaagcugcugaagaaggaccccggcaacgaggugaagcugaagcuguacgcccuguacaagcaggccaccgagggccccugcaacaugcccaagcccggcguguucgaccugaucaacaaggccaagugggacgccuggaacgcccugggcagccugcccaaggaggccgccagacagaacuacguggaccuggugagcagccugagccccagccuggagagcagcagccagguggagcccggcaccgacagaaagagcaccggcuucgagacccugguggugaccagcgaggacggcaucaccaagaucauguucaacagacccaagaagaagaacgccaucaacaccgagauguaccacgagaucaugagagcccugaaggccgccagcaaggacgacagcaucaucaccgugcugaccggcaacggcgacuacuacagcagcggcaacgaccugaccaacuucaccgacaucccccccggcggcguggaggagaaggccaagaacaacgccgugcugcugagagaguucgugggcugcuucaucgacuuccccaagccccugaucgccguggugaacggccccgccgugggcaucagcgugacccugcugggccuguucgacgccguguacgccagcgacagagccaccuuccacacccccuucagccaccugggccagagccccgagggcugcagcagcuacaccuuccccaagaucaugagccccgccaaggccaccgagaugcugaucuucggcaagaagcugaccgccggcgaggccugcgcccagggccuggugaccgagguguuccccgacagcaccuuccagaaggagguguggaccagacugaaggccuucgccaagcugccccccaacgcccugagaaucagcaaggaggugaucagaaagagagagagagagaagcugcacgccgugaacgccgaggagugcaacgugcugcagggcagauggcugagcgacgagugcaccaacgccguggugaacuuccugagcagaaagagcaagcuguaa

SEQ ID NO: 16434 - RNA, 618 nt, Artificial Sequence
  ECSCR__Homo_sapiens__NP_001071161
augggcaccgccggcgccaugcagcugugcugggugauccugggcuuccugcuguucagaggccacaacagccagcccaccaugacccagaccagcagcagccagggcggccugggcggccugagccugaccaccgagcccgugagcagcaaccccggcuacauccccagcagcgaggccaacagacccagccaccugagcagcaccggcacccccggcgccggcgugcccagcagcggcagagacggcggcaccagcagagacaccuuccagaccgugccccccaacagcaccaccaugagccugagcaugagagaggacgccaccauccugcccagccccaccagcgagaccgugcugaccguggccgccuucggcgugaucagcuucaucgugauccugguggugguggugaucauccuggugggcguggugagccugagauucaagugcagaaagagcaaggagagcgaggacccccagaagcccggcagcagcggccugagcgagagcugcagcaccgccaacggcgagaaggacagcaucacccugaucagcaugaagaacaucaacaugaacaacggcaagcagagccugagcgccgagaaggugcuguaa

SEQ ID NO: 16435 - RNA, 891 nt, Artificial Sequence
  ECSIT__Homo_sapiens__NP_001135936
augagcugggugcaggccacccugcuggccagaggccugugcagagccuggggcggcaccugcggcgccgcccugaccggcaccagcaucagccaggugcccagaagacugcccagaggccugcacugcagcgccgccgcccacagcagcgagcagagccuggugcccagcccccccgagcccagacagagacccaccaaggcccuggugcccuucgaggaccuguucggccaggcccccggcggcgagagagacaaggccagcuuccugcagaccgugcagaaguucgccgagcacagcgugagaaagagaggccacaucgacuucaucuaccuggcccugagaaagaugagagaguacggcguggagagagaccuggccguguacaaccagcugcugaacaucuuccccaaggagguguucagacccagaaacaucauccagagaaucuucgugcacuaccccagacagcaggagugcggcaucgccgugcuggagcagauggagaaccacggcgugaugcccaacaaggagaccgaguuccugcugauccagaucuucggcagaaagagcuaccccaugcugaagcuggugagacugaagcugugguuccccagauucaugaacgugaaccccuuccccgugcccagagaccugccccaggaccccguggagcuggccauguucggccugagacacauggagcccgaccugagcgccagagugaccaucuaccaggugccccugcccaaggacagcaccggcgccgccgaccccccccagccccacaucgugggcagcggcagagacgccggcggcguggagccccugcugcccgacgccgccggccccggcgugugcgaggaguggcugggccagcugagaguguaa

SEQ ID NO: 16436 - RNA, 2745 nt, Artificial Sequence
  ECT2__Homo_sapiens__NP_001245244
auggccgagaacagcgugcugaccagcaccaccggcagaaccagccuggccgacagcagcaucuucgacagcaaggugaccgagaucagcaaggagaaccugcugaucggcagcaccagcuacguggaggaggagaugccccagaucgagaccagagugauccuggugcaggaggccggcaagcaggaggagcugaucaaggcccugaagaccaucaagaucauggaggugcccgugaucaagaucaaggagagcugccccggcaagagcgacgagaagcugaucaagagcgugaucaacauggacaucaaggugggcuucgugaagauggagagcguggaggaguucgagggccuggacagccccgaguucgagaacguguucguggugaccgacuuccaggacagcguguucaacgaccuguacaaggccgacugcagagugaucggcccccccguggugcugaacugcagccagaagggcgagccccugcccuucagcugcagaccccuguacugcaccagcaugaugaaccuggugcugugcuucaccggcuucagaaagaaggaggagcuggugagacuggugacccuggugcaccacaugggcggcgugaucagaaaggacuucaacagcaaggugacccaccugguggccaacugcacccagggcgagaaguucagaguggccgugagccugggcacccccaucaugaagcccgaguggaucuacaaggccugggagagaagaaacgagcaggacuucuacgccgccguggacgacuucagaaacgaguucaaggugccccccuuccaggacugcauccugagcuuccugggcuucagcgacgaggagaagaccaacauggaggagaugaccgagaugcagggcggcaaguaccugccccugggcgacgagagaugcacccaccuggugguggaggagaacaucgugaaggaccugcccuucgagcccagcaagaagcuguacguggugaagcaggagugguucuggggcagcauccagauggacgccagagccggcgagaccauguaccuguacgagaaggccaacacccccgagcugaagaagagcgugagcaugcugagccugaacacccccaacagcaacagaaagagaagaagacugaaggagacccuggcccagcugagcagagagaccgacgugagccccuucccccccagaaagagacccagcgccgagcacagccugagcaucggcagccugcuggacaucagcaacacccccgagagcagcaucaacuacggcgacacccccaagagcugcaccaagagcagcaagagcagcacccccgugcccagcaagcagagcgccagauggcagguggccaaggagcuguaccagaccgagagcaacuacgugaacauccuggccaccaucauccagcuguuccaggugccccuggaggaggagggccagagaggcggccccauccuggcccccgaggagaucaagaccaucuucggcagcauccccgacaucuucgacgugcacaccaagaucaaggacgaccuggaggaccugaucgugaacugggacgagagcaagagcaucggcgacaucuuccugaaguacagcaaggaccuggugaagaccuacccccccuucgugaacuucuucgagaugagcaaggagaccaucaucaagugcgagaagcagaagcccagauuccacgccuuccugaagaucaaccaggccaagcccgagugcggcagacagagccugguggagcugcugaucagacccgugcagagacugcccagcguggcccugcugcugaacgaccugaagaagcacaccgccgacgagaaccccgacaagagcacccuggagaaggccaucggcagccugaaggaggugaugacccacaucaacgaggacaagagaaagaccgaggcccagaagcagaucuucgacgugguguacgagguggacggcugccccgccaaccugcugagcagccacagaagccuggugcagagaguggagaccaucagccugggcgagcaccccugcgacagaggcgagcaggugacccuguuccuguucaacgacugccuggagaucgccagaaagagacacaaggugaucggcaccuucagaagcccccacggccagaccagaccccccgccagccugaagcacauccaccugaugccccugagccagaucaagaaggugcuggacaucagagagaccgaggacugccacaacgccuucgcccugcuggugagaccccccaccgagcaggccaacgugcugcugagcuuccagaugaccagcgacgagcugcccaaggagaacuggcugaagaugcugugcagacacguggccaacaccaucugcaaggccgacgccgagaaccugaucuacaccgccgaccccgagagcuucgaggugaacaccaaggacauggacagcacccugagcagagccagcagagccaucaagaagaccagcaagaaggugaccagagccuucagcuucagcaagacccccaagagagcccugagaagagcccugaugaccagccacggcagcguggagggcagaagccccagcagcaacgacaagcacgugaugagcagacugagcagcaccagcagccuggccggcauccccagccccagccuggugagccugcccagcuucuucgagagaagaagccacacccugagcagaagcaccacccaccugaucuaa

SEQ ID NO: 16437 - RNA, 894 nt, Artificial Sequence
  EDA2R__Homo_sapiens__NP_001186616
auggacugccaggagaacgaguacugggaccaguggggcagaugcgugaccugccagagaugcggccccggccaggagcugagcaaggacugcggcuacggcgagggcggcgacgccuacugcaccgccugcccccccagaagauacaagagcagcuggggccaccacagaugccagagcugcaucaccugcgccgugaucaacagagugcagaaggugaacugcaccgccaccagcaacgccgugugcggcgacugccugcccagauucuacagaaagaccagaaucggcggccugcaggaccaggagugcauccccugcaccaagcagacccccaccagcgaggugcagugcgccuuccagcugagccugguggaggccgacgcccccaccgugcccccccaggaggccacccugguggcccuggugagcagccugcuggugguguucacccuggccuuccugggccuguucuuccuguacugcaagcaguucuucaacagacacugccagagaggcggccugcugcaguucgaggccgacaagaccgccaaggaggagagccuguuccccgugccccccagcaaggagaccagcgccgagagccaggugagcgagaacaucuuccagacccagccccugaaccccauccuggaggacgacugcagcagcaccagcggcuuccccacccaggagagcuucaccauggccagcugcaccagcgagagccacagccacugggugcacagccccaucgagugcaccgagcuggaccugcagaaguucagcagcagcgccagcuacaccggcgccgagacccugggcggcaacaccguggagagcaccggcgacagacuggagcugaacgugcccuucgaggugcccagccccuaa

SEQ ID NO: 16438 - RNA, 1170 nt, Artificial Sequence
  EDA__Homo_sapiens__NP_001005609
augggcuaccccgagguggagagaagagagcugcugcccgccgccgcccccagagagagaggcagccagggcugcggcugcggcggcgcccccgccagagccggcgagggcaacagcugccugcuguuccugggcuucuucggccugagccuggcccugcaccugcugacccugugcugcuaccuggagcugagaagcgagcugagaagagagagaggcgccgagagcagacugggcggcagcggcacccccggcaccagcggcacccugagcagccugggcggccuggaccccgacagccccaucaccagccaccugggccagcccagccccaagcagcagccccuggagcccggcgaggccgcccugcacagcgacagccaggacggccaccagauggcccugcugaacuucuucuuccccgacgagaagcccuacagcgaggaggagagcagaagagugagaagaaacaagagaagcaagagcaacgagggcgccgacggccccgugaagaacaagaagaagggcaagaaggccggcccccccggccccaacggcccccccggcccccccggcccccccggcccccagggcccccccggcauccccggcauccccggcauccccggcaccaccgugaugggcccccccggcccccccggcccccccggcccccagggcccccccggccugcagggccccagcggcgccgccgacaaggccggcaccagagagaaccagcccgccguggugcaccugcagggccagggcagcgccauccaggugaagaacgaccugagcggcggcgugcugaacgacuggagcagaaucaccaugaaccccaagguguucaagcugcaccccagaagcggcgagcuggaggugcugguggacggcaccuacuucaucuacagccagguguacuacaucaacuucaccgacuucgccagcuacgagguggugguggacgagaagcccuuccugcagugcaccagaagcaucgagaccggcaagaccaacuacaacaccugcuacaccgccggcgugugccugcugaaggccagacagaagaucgccgugaagauggugcacgccgacaucagcaucaacaugagcaagcacaccaccuucuucggcgccaucagacugggcgaggcccccgccagcuaa

SEQ ID NO: 16439 - RNA, 618 nt, Artificial Sequence
  EDARADD__Homo_sapiens__NP_542776
auggccagccccgacgacccccugagagccgaccacauggugaaggagcccguggaggacaccgaccccagcacccugagcuucaacaugagcgacaaguaccccauccaggacaccgagcugcccaaggccgaggagugcgacaccaucacccugaacugccccagaaacagcgacaugaagaaccagggcgaggagaacggcuuccccgacagcaccggcgacccccugcccgagaucagcaaggacaacagcugcaaggagaacugcaccugcagcagcugccugcugagagcccccaccaucagcgaccugcugaacgaccaggaccugcuggacgugaucagaaucaagcuggaccccugccaccccaccgugaagaacuggagaaacuucgccagcaaguggggcaugagcuacgacgagcugugcuuccuggagcagagaccccagagccccacccuggaguuccugcugagaaacagccagagaaccgugggccagcugauggagcugugcagacuguaccacagagccgacguggagaaggugcugagaagauggguggacgaggaguggcccaagagagagagaggcgaccccagcagacacuucuaa

SEQ ID NO: 16440 - RNA, 1347 nt, Artificial Sequence
  EDAR__Homo_sapiens__NP_071731
auggcccacgugggcgacugcacccagacccccuggcugcccgugcugguggugagccugaugugcagcgccagagccgaguacagcaacugcggcgagaacgaguacuacaaccagaccaccggccugugccaggagugcccccccugcggccccggcgaggagcccuaccugagcugcggcuacggcaccaaggacgaggacuacggcugcgugcccugccccgccgagaaguucagcaagggcggcuaccagaucugcagaagacacaaggacugcgagggcuucuucagagccaccgugcugacccccggcgacauggagaacgacgccgagugcggccccugccugcccggcuacuacaugcuggagaacagacccagaaacaucuacggcauggugugcuacagcugccugcuggccccccccaacaccaaggagugcgugggcgccaccagcggcgccagcgccaacuuccccggcaccagcggcagcagcacccugagccccuuccagcacgcccacaaggagcugagcggccagggccaccuggccaccgcccugaucaucgccaugagcaccaucuucaucauggccaucgccaucgugcugaucaucauguucuacauccugaagaccaagcccagcgcccccgccugcugcaccagccaccccggcaagagcguggaggcccaggugagcaaggacgaggagaagaaggaggcccccgacaacguggugauguucagcgagaaggacgaguucgagaagcugaccgccacccccgccaagcccaccaagagcgagaacgacgccagcagcgagaacgagcagcugcugagcagaagcguggacagcgacgaggagcccgcccccgacaagcagggcagccccgagcugugccugcugagccuggugcaccuggccagagagaagagcgccaccagcaacaagagcgccggcauccagagcagaagaaagaagauccuggacguguacgccaacgugugcggcgugguggagggccugagccccaccgagcugcccuucgacugccuggagaagaccagcagaaugcugagcagcaccuacaacagcgagaaggccguggugaagaccuggagacaccuggccgagagcuucggccugaagagagacgagaucggcggcaugaccgacggcaugcagcuguucgacagaaucagcaccgccggcuacagcauccccgagcugcugaccaagcuggugcagaucgagagacuggacgccguggagagccugugcgccgacauccuggagugggccggcguggugccccccgccagccagccccacgccgccagcuaa

SEQ ID NO: 16441 - RNA, 4206 nt, Artificial Sequence
  EDC4__Homo_sapiens__NP_055144
auggccagcugcgccagcaucgacaucgaggacgccacccagcaccugagagacauccugaagcuggacagacccgccggcggccccagcgccgagagccccagacccagcagcgccuacaacggcgaccugaacggccugcuggugcccgacccccugugcagcggcgacagcaccagcgccaacaagaccggccugagaaccaugccccccaucaaccugcaggagaagcaggugaucugccugagcggcgacgacagcagcaccugcaucggcauccuggccaaggagguggagaucguggccagcagcgacagcagcaucagcagcaaggccagaggcagcaacaaggugaagauccagcccguggccaaguacgacugggagcagaaguacuacuacggcaaccugaucgccgugagcaacagcuuccuggccuacgccaucagagccgccaacaacggcagcgccauggugagagugaucagcgugagcaccagcgagagaacccugcugaagggcuucaccggcagcguggccgaccuggccuucgcccaccugaacagcccccagcuggccugccuggacgaggccggcaaccuguucguguggagacuggcccuggugaacggcaagauccaggaggagauccuggugcacaucagacagcccgagggcaccccccugaaccacuucagaagaaucaucuggugccccuucauccccgaggagagcgaggacugcugcgaggagagcagccccaccguggcccugcugcacgaggacagagccgaggugugggaccuggacaugcugagaagcagccacagcaccuggcccguggacgugagccagaucaagcagggcuucaucguggugaagggccacagcaccugccugagcgagggcgcccugagccccgacggcaccgugcuggccaccgccagccacgacggcuacgugaaguucuggcagaucuacaucgagggccaggacgagcccagaugccugcacgaguggaagccccacgacggcagaccccugagcugccugcuguucugcgacaaccacaagaagcaggaccccgacgugcccuucuggagauuccugaucaccggcgccgaccagaacagagagcugaagauguggugcaccgugagcuggaccugccugcagaccaucagauucagccccgacaucuucagcagcgugagcgugccccccagccugaaggugugccuggaccugagcgccgaguaccugauccugagcgacgugcagagaaaggugcuguacgugauggagcugcugcagaaccaggaggagggccacgccugcuucagcagcaucagcgaguuccugcugacccaccccgugcugagcuucggcauccagguggugagcagaugcagacugagacacaccgaggugcugcccgccgaggaggagaacgacagccugggcgccgacggcacccacggcgccggcgccauggagagcgccgccggcgugcugaucaagcuguucugcgugcacaccaaggcccugcaggacgugcagaucagauuccagccccagcugaaccccgacgugguggccccccugcccacccacaccgcccacgaggacuucaccuucggcgagagcagacccgagcugggcagcgagggccugggcagcgccgcccacggcagccagcccgaccugagaagaaucguggagcugcccgcccccgccgacuuccugagccugagcagcgagaccaagcccaagcugaugacccccgacgccuucaugacccccagcgccagccugcagcagaucaccgccagccccagcagcagcagcagcggcagcagcagcagcagcagcagcagcagcagcagccugaccgccgugagcgccaugagcagcaccagcgccguggaccccagccugaccagaccccccgaggagcugacccugagccccaagcugcagcuggacggcagccugaccaugagcagcagcggcagccugcaggccagccccagaggccugcugcccggccugcugcccgcccccgccgacaagcugacccccaagggccccggccaggugcccaccgccaccagcgcccugagccuggagcugcaggagguggagccccugggccugccccaggccagccccagcagaaccagaagccccgacgugaucagcagcgccagcaccgcccugagccaggacauccccgagaucgccagcgaggcccugagcagaggcuucggcagcagcgcccccgagggccuggagcccgacagcauggccagcgccgccagcgcccugcaccugcugagccccagacccagacccggccccgagcugggcccccagcugggccuggacggcggccccggcgacggcgacagacacaacacccccagccugcuggaggccgcccugacccaggaggccagcacccccgacagccagguguggcccaccgcccccgacaucaccagagagaccugcagcacccuggccgagagccccagaaacggccugcaggagaagcacaagagccuggccuuccacagaccccccuaccaccugcugcagcagagagacagccaggacgccagcgccgagcagagcgaccacgacgacgagguggccagccuggccagcgccagcggcggcuucggcaccaaggugcccgcccccagacugcccgccaaggacuggaagaccaagggcagccccagaaccagccccaagcugaagagaaagagcaagaaggacgacggcgacgccgccaugggcagcagacugaccgagcaccagguggccgagccccccgaggacuggcccgcccugaucuggcagcagcagagagagcuggccgagcugagacacagccaggaggagcugcugcagagacugugcacccagcuggagggccugcagagcaccgugaccggccacguggagagagcccuggagaccagacacgagcaggagcagagaagacuggagagagcccuggccgagggccagcagagaggcggccagcugcaggagcagcugacccagcagcugagccaggcccugagcagcgccguggccggcagacuggagagaagcaucagagacgagaucaagaagaccgugccccccugcgugagcagaagccuggagcccauggccggccagcugagcaacagcguggccaccaagcugaccgccguggagggcagcaugaaggagaacaucagcaagcugcugaagagcaagaaccugaccgacgccaucgccagagccgccgccgacacccugcagggccccaugcaggccgccuacagagaggccuuccagagcguggugcugcccgccuucgagaagagcugccaggccauguuccagcagaucaacgacagcuucagacugggcacccaggaguaccugcagcagcuggagagccacaugaagagcagaaaggccagagagcaggaggccagagagcccgugcuggcccagcugagaggccuggugagcacccugcagagcgccaccgagcagauggccgccaccguggccggcagcgugagagccgaggugcagcaccagcugcacguggccgugggcagccugcaggagagcauccuggcccaggugcagagaaucgugaagggcgaggugagcguggcccugaaggagcagcaggccgccgugaccagcagcaucaugcaggccaugagaagcgccgccggcacccccgugcccagcgcccaccuggacugccaggcccagcaggcccacauccugcagcugcugcagcagggccaccugaaccaggccuuccagcaggcccugaccgccgccgaccugaaccuggugcuguacgugugcgagaccguggaccccgcccagguguucggccagccccccugcccccugagccagcccgugcugcugagccugauccagcagcuggccagcgaccugggcaccagaaccgaccugaagcugagcuaccuggaggaggccgugaugcaccuggaccacagcgaccccaucaccagagaccacaugggcagcgugauggcccaggugagacagaagcuguuccaguuccugcaggccgagccccacaacagccugggcaaggccgccagaagacugagccugaugcugcacggccuggugacccccagccugcccuaa

SEQ ID NO: 16442 - RNA, 1974 nt, Artificial Sequence
  EDEM1__Homo_sapiens__NP_055489
augcaguggagagcccuggugcugggccuggugcugcugagacugggccugcacggcgugcuguggcugguguucggccugggccccagcaugggcuucuaccagagauucccccugagcuucggcuuccagagacugagaagccccgacggccccgccagccccaccagcggccccgugggcagacccggcggcgugagcggccccagcuggcugcagccccccggcaccggcgccgcccagagccccagaaaggcccccagaagacccggccccggcaugugcggccccgccaacuggggcuacgugcugggcggcagaggcagaggccccgacgaguacgagaagagauacagcggcgccuuccccccccagcugagagcccagaugagagaccuggccagaggcauguucguguucggcuacgacaacuacauggcccacgccuucccccaggacgagcugaaccccauccacugcagaggcagaggccccgacagaggcgaccccagcaaccugaacaucaacgacgugcugggcaacuacagccugacccugguggacgcccuggacacccuggccaucaugggcaacagcagcgaguuccagaaggccgugaagcuggugaucaacaccgugagcuucgacaaggacagcaccgugcagguguucgaggccaccaucagagugcugggcagccugcugagcgcccacagaaucaucaccgacagcaagcagcccuucggcgacaugaccaucaaggacuacgacaacgagcugcuguacauggcccacgaccuggccgugagacugcugcccgccuucgagaacaccaagaccggcauccccuaccccagagugaaccugaagaccggcgugccccccgacaccaacaacgagaccugcaccgccggcgccggcagccugcugguggaguucggcauccugagcagacugcugggcgacagcaccuucgaguggguggccagaagagccgugaaggcccuguggaaccugagaagcaacgacaccggccugcugggcaacguggugaacauccagaccggccacugggugggcaagcagagcggccugggcgccggccuggacagcuucuacgaguaccugcugaagagcuacauccuguucggcgagaaggaggaccuggagauguucaacgccgccuaccagagcauccagaacuaccugagaagaggcagagaggccugcaacgagggcgagggcgaccccccccuguacgugaacgugaacauguucagcggccagcugaugaacaccuggaucgacagccugcaggccuucuuccccggccugcaggugcugaucggcgacguggaggacgccaucugccugcacgccuucuacuacgccaucuggaagagauacggcgcccugcccgagagauacaacuggcagcugcaggcccccgacgugcuguucuacccccugagacccgagcugguggagagcaccuaccugcuguaccaggccaccaagaaccccuucuaccugcacgugggcauggacauccugcagagccuggagaaguacaccaaggugaagugcggcuacgccacccugcaccacgugaucgacaagagcaccgaggacagaauggagagcuucuuccugagcgagaccugcaaguaccuguaccugcuguucgacgaggacaaccccgugcacaagagcggcaccagauacauguucaccaccgagggccacaucgugagcguggacgagcaccugagagagcugcccuggaaggaguucuucagcgaggagggcggccaggaccagggcggcaagagcgugcacagacccaagccccacgagcugaaggugaucaacagcagcagcaacugcaacagagugcccgacgagagaagauacagccugccccugaagagcaucuacaugagacagaucgaccagauggugggccugaucuaa

SEQ ID NO: 16443 - RNA, 1413 nt, Artificial Sequence
  EDIL3__Homo_sapiens__NP_001265571
augaagagaagcguggccguguggcugcuggugggccugagccugggcgugccccaguucggcaagggcgacaucugcgaccccaaccccugcgagaacggcggcaucugccugcccggccuggccgacggcagcuucagcugcgagugccccgacggcuucaccgaccccaacugcagcagcgugguggaggugggccccugcacccccaaccccugccacaacggcggcaccugcgagaucagcgaggccuacagaggcgacaccuucaucggcuacgugugcaagugccccagaggcuucaacggcauccacugccagcacaacaucaacgagugcgagguggagcccugcaagaacggcggcaucugcaccgaccugguggccaacuacagcugcgagugccccggcgaguucaugggcagaaacugccaguacaagugcagcggcccccugggcaucgagggcggcaucaucagcaaccagcagaucaccgccagcagcacccacagagcccuguucggccugcagaagugguaccccuacuacgccagacugaacaagaagggccugaucaacgccuggaccgccgccgagaacgacagauggcccuggauccagaucaaccugcagagaaagaugagagugaccggcgugaucacccagggcgccaagagaaucggcagccccgaguacaucaagagcuacaagaucgccuacagcaacgacggcaagaccugggccauguacaaggugaagggcaccaacgaggacaugguguucagaggcaacaucgacaacaacacccccuacgccaacagcuucaccccccccaucaaggcccaguacgugagacuguacccccaggugugcagaagacacugcacccugagaauggagcugcugggcugcgagcugagcggcugcagcgagccccugggcaugaagagcggccacauccaggacuaccagaucaccgccagcagcaucuucagaacccugaacauggacauguucaccugggagcccagaaaggccagacuggacaagcagggcaaggugaacgccuggaccagcggccacaacgaccagagccaguggcugcagguggaccugcuggugcccaccaaggugaccggcaucaucacccagggcgccaaggacuucggccacgugcaguucgugggcagcuacaagcuggccuacagcaacgacggcgagcacuggaccguguaccaggacgagaagcagagaaaggacaagguguuccagggcaacuucgacaacgacacccacagaaagaacgugaucgacccccccaucuacgccagacacaucagaauccugcccuggagcugguacggcagaaucacccugagaagcgagcugcugggcugcaccgaggaggaguaa

SEQ ID NO: 16444 - RNA, 639 nt, Artificial Sequence
  EDN1__Homo_sapiens__NP_001946
auggacuaccugcugaugaucuucagccugcuguucguggccugccagggcgcccccgagaccgccgugcugggcgccgagcugagcgccgugggcgagaacggcggcgagaagcccacccccagcccccccuggagacugagaagaagcaagagaugcagcugcagcagccugauggacaaggagugcguguacuucugccaccuggacaucaucugggugaacacccccgagcacguggugcccuacggccugggcagccccagaagcaagagagcccuggagaaccugcugcccaccaaggccaccgacagagagaacagaugccagugcgccagccagaaggacaagaagugcuggaacuucugccaggccggcaaggagcugagagccgaggacaucauggagaaggacuggaacaaccacaagaagggcaaggacugcagcaagcugggcaagaagugcaucuaccagcagcuggugagaggcagaaagaucagaagaagcagcgaggagcaccugagacagaccagaagcgagaccaugagaaacagcgugaagagcagcuuccacgaccccaagcugaagggcaagcccagcagagagagauacgugacccacaacagagcccacugguaa

SEQ ID NO: 16445 - RNA, 579 nt, Artificial Sequence
  EDN3__Homo_sapiens__NP_001289385
auggagcccggccuguggcugcuguucggccugaccgugaccagcgccgccggcuucgugcccugcagccagagcggcgacgccggcagaagaggcgugagccaggcccccaccgccgccagaagcgagggcgacugcgaggagaccguggccggccccggcgaggagaccguggccggccccggcgagggcaccguggcccccaccgcccugcagggccccagccccggcagccccggccaggagcaggccgccgagggcgcccccgagcaccacagaagcagaagaugcaccugcuucaccuacaaggacaaggagugcguguacuacugccaccuggacaucaucuggaucaacacccccgagcagaccgugcccuacggccugagcaacuacagaggcagcuucagaggcaagagaagcgccggcccccugcccggcaaccugcagcugagccacagaccccaccugagaugcgccugcgugggcagauacgacaaggccugccugcacuucugcacccagacccuggacgugagcagacugaagagcagaaccaacaaggccagcagacuguaa

SEQ ID NO: 16446 - RNA, 957 nt, Artificial Sequence
  EDNRA__Homo_sapiens__NP_001159527
auggagacccugugccugagagccagcuucuggcuggcccuggugggcugcgugaucagcgacaaccccgagagauacagcaccaaccugagcaaccacguggacgacuucaccaccuucagaggcaccgagcugagcuuccuggugaccacccaccagcccaccaaccuggugcugcccagcaacggcagcaugcacaacuacugcccccagcagaccaagaucaccagcgccuucaaguacaucaacaccgugaucagcugcaccaucuucaucgugggcauggugggcaacgccacccugcugagaaucaucuaccagaacaagugcaugagaaacggccccaacgcccugaucgccagccuggcccugggcgaccugaucuacguggugaucgaccugcccaucaacguguucaaguucuaccaggacgugaaggacugguggcuguucggcuucuacuucugcaugccccuggugugcaccgccaucuucuacacccugaugaccugcgagaugcugaacagaagaaacggcagccugagaaucgcccugagcgagcaccugaagcagagaagagagguggccaagaccguguucugccugguggugaucuucgcccugugcugguucccccugcaccugagcagaauccugaagaagaccguguacaacgagauggacaagaacagaugcgagcugcugagcuuccugcugcugauggacuacaucggcaucaaccuggccaccaugaacagcugcaucaaccccaucgcccuguacuucgugagcaagaaguucaagaacugcuuccagagcugccugugcugcugcugcuaccagagcaagagccugaugaccagcgugcccaugaacggcaccagcauccaguggaagaaccacgaccagaacaaccacaacaccgacagaagcagccacaaggacagcaugaacuaa

SEQ ID NO: 16447 - RNA, 1329 nt, Artificial Sequence
  EDNRB__Homo_sapiens__NP_000106
augcagcccccccccagccugugcggcagagcccugguggcccuggugcuggccugcggccugagcagaaucuggggcgaggagagaggcuucccccccgacagagccaccccccugcugcagaccgccgagaucaugaccccccccaccaagacccuguggcccaagggcagcaacgccagccuggccagaagccuggcccccgccgaggugcccaagggcgacagaaccgccggcagcccccccagaaccaucagccccccccccugccagggccccaucgagaucaaggagaccuucaaguacaucaacaccguggugagcugccugguguucgugcugggcaucaucggcaacagcacccugcugagaaucaucuacaagaacaagugcaugagaaacggccccaacauccugaucgccagccuggcccugggcgaccugcugcacaucgugaucgacauccccaucaacguguacaagcugcuggccgaggacuggcccuucggcgccgagaugugcaagcuggugcccuucauccagaaggccagcgugggcaucaccgugcugagccugugcgcccugagcaucgacagauacagagccguggccagcuggagcagaaucaagggcaucggcgugcccaaguggaccgccguggagaucgugcugaucuggguggugagcguggugcuggccgugcccgaggccaucggcuucgacaucaucaccauggacuacaagggcagcuaccugagaaucugccugcugcaccccgugcagaagaccgccuucaugcaguucuacaagaccgccaaggacugguggcuguucagcuucuacuucugccugccccuggccaucaccgccuucuucuacacccugaugaccugcgagaugcugagaaagaagagcggcaugcagaucgcccugaacgaccaccugaagcagagaagagagguggccaagaccguguucugccuggugcugguguucgcccugugcuggcugccccugcaccugagcagaauccugaagcugacccuguacaaccagaacgaccccaacagaugcgagcugcugagcuuccugcuggugcuggacuacaucggcaucaacauggccagccugaacagcugcaucaaccccaucgcccuguaccuggugagcaagagauucaagaacugcuucaagagcugccugugcugcuggugccagagcuucgaggagaagcagagccuggaggagaagcagagcugccugaaguucaaggccaacgaccacggcuacgacaacuucagaagcagcaacaaguacagcagcagcuaa

SEQ ID NO: 16448 - RNA, 4236 nt, Artificial Sequence
  EEA1__Homo_sapiens__NP_003557
augcugagaagaauccugcagagaacccccggcagagugggcagccagggcagcgaccuggacagcagcgccacccccaucaacaccguggacgugaacaacgagagcagcagcgagggcuucaucugcccccagugcaugaagagccugggcagcgccgacgagcuguucaagcacuacgaggccgugcacgacgccggcaacgacagcggccacggcggcgagagcaaccuggcccugaagagagacgacgugacccugcugagacaggaggugcaggaccugcaggccagccugaaggaggagaagugguacagcgaggagcugaagaaggagcuggagaaguaccagggccugcagcagcaggaggccaagcccgacggccuggugaccgacagcagcgccgagcugcagagccuggagcagcagcuggaggaggcccagaccgagaacuucaacaucaagcagaugaaggaccuguucgagcagaaggccgcccagcuggccaccgagaucgccgacaucaagagcaaguacgacgaggagagaagccugagagaggccgccgagcagaaggugaccagacugaccgaggagcugaacaaggaggccaccgugauccaggaccugaagaccgagcugcugcagagacccggcaucgaggacguggccgugcugaagaaggagcuggugcaggugcagacccugauggacaacaugacccuggagagagagagagagagcgagaagcugaaggacgagugcaagaagcugcagagccaguacgccagcagcgaggccaccaucagccagcugagaagcgagcuggccaagggcccccaggagguggccguguacgugcaggagcugcagaagcugaagagcagcgugaacgagcugacccagaagaaccagacccugaccgagaaccugcugaagaaggagcaggacuacaccaagcuggaggagaagcacaacgaggagagcgugagcaagaagaacauccaggccacccugcaccagaaggaccuggacugccagcagcugcagagcagacugagcgccagcgagaccagccugcacagaauccacguggagcugagcgagaagggcgaggccacccagaagcugaaggaggagcugagcgagguggagaccaaguaccagcaccugaaggccgaguucaagcagcugcagcagcagagagaggagaaggagcagcacggccugcagcugcagagcgagaucaaccagcugcacagcaagcugcuggagaccgagagacagcugggcgaggcccacggcagacugaaggagcagagacagcugagcagcgagaagcugauggacaaggagcagcagguggccgaccugcagcugaagcugagcagacuggaggagcagcugaaggagaaggugaccaacagcaccgagcugcagcaccagcuggacaagaccaagcagcagcaccaggagcagcaggcccugcagcagagcaccaccgccaagcugagagaggcccagaacgaccuggagcaggugcugagacagaucggcgacaaggaccagaagauccagaaccuggaggcccugcugcagaagagcaaggagaacaucagccugcuggagaaggagagagaggaccuguacgccaagauccaggccggcgagggcgagaccgccgugcugaaccagcugcaggagaagaaccacacccugcaggagcaggugacccagcugaccgagaagcugaagaaccagagcgagagccacaagcaggcccaggagaaccugcacgaccaggugcaggagcagaaggcccaccugagagccgcccaggacagagugcugagccuggagaccagcgugaacgagcugaacagccagcugaacgagagcaaggagaaggugagccagcuggacauccagaucaaggccaagaccgagcugcugcugagcgccgaggccgccaagaccgcccagagagccgaccugcagaaccaccuggacaccgcccagaacgcccugcaggacaagcagcaggagcugaacaagaucaccacccagcuggaccaggugaccgccaagcugcaggacaagcaggagcacugcagccagcuggagagccaccugaaggaguacaaggagaaguaccugagccuggagcagaagaccgaggagcuggagggccagaucaagaagcuggaggccgacagccuggaggugaaggccagcaaggagcaggcccugcaggaccugcagcagcagagacagcugaacaccgaccuggagcugagagccaccgagcugagcaagcagcuggagauggagaaggagaucgugagcagcaccagacuggaccugcagaagaagagcgaggcccuggagagcaucaagcagaagcugaccaagcaggaggaggagaagcagauccugaagcaggacuucgagacccugagccaggagaccaagauccagcacgaggagcugaacaacagaauccagaccaccgugaccgagcugcagaaggugaagauggagaaggaggcccugaugaccgagcugagcaccgugaaggacaagcugagcaaggugagcgacagccugaagaacagcaagagcgaguucgagaaggagaaccagaagggcaaggccgccauccuggaccuggagaagaccugcaaggagcugaagcaccagcugcaggugcagauggagaacacccugaaggagcagaaggagcugaagaagagccuggagaaggagaaggaggccagccaccagcugaagcuggagcugaacagcaugcaggagcagcugauccaggcccagaacacccugaagcagaacgagaaggaggagcagcagcugcagggcaacaucaacgagcugaagcagagcagcgagcagaagaagaagcagaucgaggcccugcagggcgagcugaagaucgccgugcugcagaagaccgagcuggagaacaagcugcagcagcagcugacccaggccgcccaggagcuggccgccgagaaggagaagaucagcgugcugcagaacaacuacgagaagagccaggagaccuucaagcagcugcagagcgacuucuacggcagagagagcgagcugcuggccaccagacaggaccugaagagcguggaggagaagcugagccuggcccaggaggaccugaucagcaacagaaaccagaucggcaaccagaacaagcugauccaggagcugaagaccgccaaggccacccuggagcaggacagcgccaagaaggagcagcagcugcaggagagaugcaaggcccugcaggacauccagaaggagaagagccugaaggagaaggagcuggugaacgagaagagcaagcuggccgagaucgaggagaucaagugcagacaggagaaggagaucaccaagcugaacgaggagcugaagagccacaagcuggagagcaucaaggagaucaccaaccugaaggacgccaagcagcugcugauccagcagaagcuggagcugcagggcaaggccgacagccugaaggccgccguggagcaggagaagagaaaccagcagauccugaaggaccaggugaagaaggaggaggaggagcugaagaaggaguucaucgagaaggaggccaagcugcacagcgagaucaaggagaaggaggugggcaugaagaagcacgaggagaacgaggccaagcugaccaugcagaucaccgcccugaacgagaaccugggcaccgugaagaaggaguggcagagcagccagagaagagugagcgagcuggagaagcagaccgacgaccugagaggcgagaucgccgugcuggaggccaccgugcagaacaaccaggacgagagaagagcccugcuggagagaugccugaagggcgagggcgagaucgagaagcugcagaccaaggugcuggagcugcagagaaagcuggacaacaccaccgccgccgugcaggagcugggcagagagaaccagagccugcagaucaagcacacccaggcccugaacagaaagugggccgaggacaacgaggugcagaacugcauggccugcggcaagggcuucagcgugaccgugagaagacaccacugcagacagugcggcaacaucuucugcgccgagugcagcgccaagaacgcccugacccccagcagcaagaagcccgugagagugugcgacgccugcuucaacgaccugcagggcuaa

SEQ ID NO: 16449 - RNA, 1326 nt, Artificial Sequence
  EED__Homo_sapiens__NP_003788
augagcgagagagaggugagcaccgcccccgccggcaccgacaugcccgccgccaagaagcagaagcugagcagcgacgagaacagcaaccccgaccugagcggcgacgagaacgacgacgccgugagcaucgagagcggcaccaacaccgagagacccgacacccccaccaacacccccaacgcccccggcagaaagagcuggggcaagggcaaguggaagagcaagaagugcaaguacagcuucaagugcgugaacagccugaaggaggaccacaaccagccccuguucggcgugcaguucaacuggcacagcaaggagggcgacccccugguguucgccaccgugggcagcaacagagugacccuguacgagugccacagccagggcgagaucagacugcugcagagcuacguggacgccgacgccgacgagaacuucuacaccugcgccuggaccuacgacagcaacaccagccacccccugcuggccguggccggcagcagaggcaucaucagaaucaucaaccccaucaccaugcagugcaucaagcacuacgugggccacggcaacgccaucaacgagcugaaguuccaccccagagaccccaaccugcugcugagcgugagcaaggaccacgcccugagacuguggaacauccagaccgacacccugguggccaucuucggcggcguggagggccacagagacgaggugcugagcgccgacuacgaccugcugggcgagaagaucaugagcugcggcauggaccacagccugaagcuguggagaaucaacagcaagagaaugaugaacgccaucaaggagagcuacgacuacaaccccaacaagaccaacagacccuucaucagccagaagauccacuuccccgacuucagcaccagagacauccacagaaacuacguggacugcgugagauggcugggcgaccugauccugagcaagagcugcgagaacgccaucgugugcuggaagcccggcaagauggaggacgacaucgacaagaucaagcccagcgagagcaacgugaccauccugggcagauucgacuacagccagugcgacaucugguacaugagauucagcauggacuucuggcagaagaugcuggcccugggcaaccaggugggcaagcuguacgugugggaccuggagguggaggacccccacaaggccaagugcaccacccugacccaccacaagugcggcgccgccaucagacagaccagcuucagcagagacagcagcauccugaucgccgugugcgacgacgccagcaucuggagaugggacagacugagauaa

SEQ ID NO: 16450 - RNA, 1389 nt, Artificial Sequence
  EEF1A1__Homo_sapiens__XP_011533816
augggcaaggagaagacccacaucaacaucguggugaucggccacguggacagcggcaagagcaccaccaccggccaccugaucuacaagugcggcggcaucgacaagagaaccaucgagaaguucgagaaggaggccgccgagaugggcaagggcagcuucaaguacgccugggugcuggacaagcugaaggccgagagagagagaggcaucaccaucgacaucagccuguggaaguucgagaccagcaaguacuacgugaccaucaucgacgcccccggccacagagacuucaucaagaacaugaucaccggcaccagccaggccgacugcgccgugcugaucguggccgccggcgugggcgaguucgaggccggcaucagcaagaacggccagaccagagagcacgcccugcuggccuacacccugggcgugaagcagcugaucgugggcgugaacaagauggacagcaccgagccccccuacagccagaagagauacgaggagaucgugaaggaggugagcaccuacaucaagaagaucggcuacaaccccgacaccguggccuucgugcccaucagcggcuggaacggcgacaacaugcuggagcccagcgccaacaugcccugguucaagggcuggaaggugaccagaaaggacggcaacgccagcggcaccacccugcuggaggcccuggacugcauccugccccccaccagacccaccgacaagccccugagacugccccugcaggacguguacaagaucggcggcaucggcaccgugcccgugggcagaguggagaccggcgugcugaagcccggcaugguggugaccuucgcccccgugaacgugaccaccgaggugaagagcguggagaugcaccacgaggcccugagcgaggcccugcccggcgacaacgugggcuucaacgugaagaacgugagcgugaaggacgugagaagaggcaacguggccggcgacagcaagaacgacccccccauggaggccgccggcuucaccgcccaggugaucauccugaaccaccccggccagaucagcgccggcuacgcccccgugcuggacugccacaccgcccacaucgccugcaaguucgccgagcugaaggagaagaucgacagaagaagcggcaagaagcuggaggacggccccaaguuccugaagagcggcgacgccgccaucguggacauggugcccggcaagcccaugugcguggagagcuucagcgacuaccccccccugggcagauucgccgugagagacaugagacagaccguggccgugggcgugaucaaggccguggacaagaaggccgccggcgccggcaaggugaccaagagcgcccagaaggcccagaaggccaaguaa

SEQ ID NO: 16451 - RNA, 1392 nt, Artificial Sequence
  EEF1A2__Homo_sapiens__NP_001949
augggcaaggagaagacccacaucaacaucguggugaucggccacguggacagcggcaagagcaccaccaccggccaccugaucuacaagugcggcggcaucgacaagagaaccaucgagaaguucgagaaggaggccgccgagaugggcaagggcagcuucaaguacgccugggugcuggacaagcugaaggccgagagagagagaggcaucaccaucgacaucagccuguggaaguucgagaccaccaaguacuacaucaccaucaucgacgcccccggccacagagacuucaucaagaacaugaucaccggcaccagccaggccgacugcgccgugcugaucguggccgccggcgugggcgaguucgaggccggcaucagcaagaacggccagaccagagagcacgcccugcuggccuacacccugggcgugaagcagcugaucgugggcgugaacaagauggacagcaccgagcccgccuacagcgagaagagauacgacgagaucgugaaggaggugagcgccuacaucaagaagaucggcuacaaccccgccaccgugcccuucgugcccaucagcggcuggcacggcgacaacaugcuggagcccagccccaacaugcccugguucaagggcuggaagguggagagaaaggagggcaacgccagcggcgugagccugcuggaggcccuggacaccauccugccccccaccagacccaccgacaagccccugagacugccccugcaggacguguacaagaucggcggcaucggcaccgugcccgugggcagaguggagaccggcauccugagacccggcaugguggugaccuucgcccccgugaacaucaccaccgaggugaagagcguggagaugcaccacgaggcccugagcgaggcccugcccggcgacaacgugggcuucaacgugaagaacgugagcgugaaggacaucagaagaggcaacgugugcggcgacagcaagagcgaccccccccaggaggccgcccaguucaccagccaggugaucauccugaaccaccccggccagaucagcgccggcuacagccccgugaucgacugccacaccgcccacaucgccugcaaguucgccgagcugaaggagaagaucgacagaagaagcggcaagaagcuggaggacaaccccaagagccugaagagcggcgacgccgccaucguggagauggugcccggcaagcccaugugcguggagagcuucagccaguaccccccccugggcagauucgccgugagagacaugagacagaccguggccgugggcgugaucaagaacguggagaagaagagcggcggcgccggcaaggugaccaagagcgcccagaaggcccagaaggccggcaaguaa

SEQ ID NO: 16452 - RNA, 678 nt, Artificial Sequence
  EEF1B2__Homo_sapiens__NP_001032752
augggcuucggcgaccugaagagccccgccggccugcaggugcugaacgacuaccuggccgacaagagcuacaucgagggcuacgugcccagccaggccgacguggccguguucgaggccgugagcagccccccccccgccgaccugugccacgcccugagaugguacaaccacaucaagagcuacgagaaggagaaggccagccugcccggcgugaagaaggcccugggcaaguacggccccgccgacguggaggacaccaccggcagcggcgccaccgacagcaaggacgacgacgacaucgaccuguucggcagcgacgacgaggaggagagcgaggaggccaagagacugagagaggagagacuggcccaguacgagagcaagaaggccaagaagcccgcccugguggccaagagcagcauccugcuggacgugaagcccugggacgacgagaccgacauggccaagcuggaggagugcgugagaagcauccaggccgacggccugguguggggcagcagcaagcuggugcccgugggcuacggcaucaagaagcugcagauccagugcgugguggaggacgacaaggugggcaccgacaugcuggaggagcagaucaccgccuucgaggacuacgugcagagcauggacguggccgccuucaacaagaucuaa

SEQ ID NO: 16453 - RNA, 1944 nt, Artificial Sequence
  EEF1D__Homo_sapiens__NP_001123525
augagaagcggcaaggccagcugcacccuggagaccgugugggaggacaagcacaaguacgaggaggccgagagaagauucuacgagcacgaggccacccaggccgccgccagcgcccagcagcugcccgccgagggccccgccaugaacggccccggccaggacgaccccgaggacgccgacgaggccgaggcccccgacggcggcagcagaagagaccccagaaagagccaggacagcagaaagccccugcagaagaagagaaagagaagccccaagagcggccugggccccgccgaccuggcccugcugggccugagcgccgagagaguguggcuggacaagagccuguucgaccaggccgagagcagcuacagacagaagcuggccgacguggccgcccaggccgccuggccccccgcccuggcccccuggggccugugcacccacggcaaccagguggccugccaccacgugaccuggggcaucugggugaacaagagcagcuucgaccaggccgagagagccuucguggaguggagccaggcccugcugcuggcccccgagggcagcagaagacagggcacccccaacaccggccagcagguggccgugcccgaccuggcccaccagcccagcccccccgugaacggccagcccccccugggcagccugcaggcccuggugagagagguguggcuggagaagcccagauacgacgccgccgagagaggcuucuacgaggcccuguucgacggccacccccccggcaaggugagacugcaggagagagccggccuggccgagggcgccagaagaggcagaagagacagaagaggcagaaacauccugggcaacaagagagccggccugagaagagccgacggcgaggcccccagcgcccugcccuacugcuacuuccugcagaaggacgccgaggcccccuggcugagcaagcccgccuacgacagcgccgagugcagacaccacgccgccgaggcccugagaguggccuggugccuggaggccgccagccugagccacagacccggccccagaagcggccugagcgugagcagccugagacccaacagaaagauggccaccaacuuccuggcccacgagaagaucugguucgacaaguucaaguacgacgacgccgagagaagauucuacgagcagaugaacggccccguggccggcgccagcagacaggagaacggcgccagcgugauccugagagacaucgccagagccagagagaacauccagaagagccuggccggcagcagcggccccggcgccagcagcggcaccagcggcgaccacggcgagcugguggugagaaucgccagccuggagguggagaaccagagccugagaggcguggugcaggagcugcagcaggccaucagcaagcuggaggccagacugaacgugcuggagaagagcagccccggccacagagccaccgccccccagacccagcacgugagccccaugagacagguggagccccccgccaagaagcccgccacccccgccgaggacgacgaggacgacgacaucgaccuguucggcagcgacaacgaggaggaggacaaggaggccgcccagcugagagaggagagacugagacaguacgccgagaagaaggccaagaagcccgcccugguggccaagagcagcauccugcuggacgugaagcccugggacgacgagaccgacauggcccagcuggaggccugcgugagaagcauccagcuggacggccugguguggggcgccagcaagcuggugcccgugggcuacggcaucagaaagcugcagauccagugcgugguggaggacgacaaggugggcaccgaccugcuggaggaggagaucaccaaguucgaggagcacgugcagagcguggacaucgccgccuucaacaagaucuaa

SEQ ID NO: 16454 - RNA, 420 nt, Artificial Sequence
  EEF1E1__Homo_sapiens__NP_001129122
auggccgccgccgccgagcugagccugcuggagaagagccugggccugagcaagggcaacaaguacagcgcccagggcgagagacagauccccgugcugcagaccaacaacggccccagccugaccggccugaccaccaucgccgcccaccuggugaagcaggccaacaaggaguaccugcugggcagcaccgccgaggagaaggccaucgugcagcaguggcuggaguacagagugacccagguggacggccacagcagcaagaacgacauccacacccugcugaaggaccugaacagcuaccuggaggacaagguguaccugaccggcuacaacuucacccuggccgacauccugcuguacuacggccugcacagauucaucaucagaaagcugagacacaccgaggugggcaacuaa

SEQ ID NO: 16455 - RNA, 1314 nt, Artificial Sequence
  EEF1G__Homo_sapiens__NP_001395
auggccgccggcacccuguacaccuaccccgagaacuggagagccuucaaggcccugaucgccgcccaguacagcggcgcccaggugagagugcugagcgcccccccccacuuccacuucggccagaccaacagaacccccgaguuccugagaaaguuccccgccggcaaggugcccgccuucgagggcgacgacggcuucugcguguucgagagcaacgccaucgccuacuacgugagcaacgaggagcugagaggcagcacccccgaggccgccgcccagguggugcagugggugagcuucgccgacagcgacaucgugccccccgccagcaccuggguguuccccacccugggcaucaugcaccacaacaagcaggccaccgagaacgccaaggaggaggugagaagaauccugggccugcuggacgccuaccugaagaccagaaccuuccuggugggcgagagagugacccuggccgacaucaccguggugugcacccugcuguggcuguacaagcaggugcuggagcccagcuucagacaggccuuccccaacaccaacagaugguuccugaccugcaucaaccagccccaguucagagccgugcugggcgaggugaagcugugcgagaagauggcccaguucgacgccaagaaguucgccgagacccagcccaagaaggacacccccagaaaggagaagggcagcagagaggagaagcagaagccccaggccgagagaaaggaggagaagaaggccgccgcccccgcccccgaggaggagauggacgagugcgagcaggcccuggccgccgagcccaaggccaaggaccccuucgcccaccugcccaagagcaccuucgugcuggacgaguucaagagaaaguacagcaacgaggacacccugagcguggcccugcccuacuucugggagcacuucgacaaggacggcuggagccugugguacagcgaguacagauuccccgaggagcugacccagaccuucaugagcugcaaccugaucaccggcauguuccagagacuggacaagcugagaaagaacgccuucgccagcgugauccuguucggcaccaacaacagcagcagcaucagcggcguguggguguucagaggccaggagcuggccuucccccugagccccgacuggcagguggacuacgagagcuacaccuggagaaagcuggaccccggcagcgaggagacccagacccuggugagagaguacuucagcugggagggcgccuuccagcacgugggcaaggccuucaaccagggcaagaucuucaaguaa

SEQ ID NO: 16456 - RNA, 2577 nt, Artificial Sequence
  EEF2__Homo_sapiens__NP_001952
auggugaacuucaccguggaccagaucagagccaucauggacaagaaggccaacaucagaaacaugagcgugaucgcccacguggaccacggcaagagcacccugaccgacagccuggugugcaaggccggcaucaucgccagcgccagagccggcgagaccagauucaccgacaccagaaaggacgagcaggagagaugcaucaccaucaagagcaccgccaucagccuguucuacgagcugagcgagaacgaccugaacuucaucaagcagagcaaggacggcgccggcuuccugaucaaccugaucgacagccccggccacguggacuucagcagcgaggugaccgccgcccugagagugaccgacggcgcccugguggugguggacugcgugagcggcgugugcgugcagaccgagaccgugcugagacaggccaucgccgagagaaucaagcccgugcugaugaugaacaagauggacagagcccugcuggagcugcagcuggagcccgaggagcuguaccagaccuuccagagaaucguggagaacgugaacgugaucaucagcaccuacggcgagggcgagagcggccccaugggcaacaucaugaucgaccccgugcugggcaccgugggcuucggcagcggccugcacggcugggccuucacccugaagcaguucgccgagauguacguggccaaguucgccgccaagggcgagggccagcugggccccgccgagagagccaagaagguggaggacaugaugaagaagcuguggggcgacagauacuucgaccccgccaacggcaaguucagcaagagcgccaccagccccgagggcaagaagcugcccagaaccuucugccagcugauccuggaccccaucuucaagguguucgacgccaucaugaacuucaagaaggaggagaccgccaagcugaucgagaagcuggacaucaagcuggacagcgaggacaaggacaaggagggcaagccccugcugaaggccgugaugagaagauggcugcccgccggcgacgcccugcugcagaugaucaccauccaccugcccagccccgugaccgcccagaaguacagaugcgagcugcuguacgagggcccccccgacgacgaggccgccaugggcaucaagagcugcgaccccaagggcccccugaugauguacaucagcaagauggugcccaccagcgacaagggcagauucuacgccuucggcagaguguucagcggccuggugagcaccggccugaaggugagaaucaugggccccaacuacacccccggcaagaaggaggaccuguaccugaagcccauccagagaaccauccugaugaugggcagauacguggagcccaucgaggacgugcccugcggcaacaucgugggccuggugggcguggaccaguuccuggugaagaccggcaccaucaccaccuucgagcacgcccacaacaugagagugaugaaguucagcgugagccccguggugagaguggccguggaggccaagaaccccgccgaccugcccaagcugguggagggccugaagagacuggccaagagcgaccccauggugcagugcaucaucgaggagagcggcgagcacaucaucgccggcgccggcgagcugcaccuggagaucugccugaaggaccuggaggaggaccacgccugcauccccaucaagaagagcgaccccguggugagcuacagagagaccgugagcgaggagagcaacgugcugugccugagcaagagccccaacaagcacaacagacuguacaugaaggccagacccuuccccgacggccuggccgaggacaucgacaagggcgaggugagcgccagacaggagcugaagcagagagccagauaccuggccgagaaguacgagugggacguggccgaggccagaaagaucuggugcuucggccccgacggcaccggccccaacauccugaccgacaucaccaagggcgugcaguaccugaacgagaucaaggacagcgugguggccggcuuccagugggccaccaaggagggcgcccugugcgaggagaacaugagaggcgugagauucgacgugcacgacgugacccugcacgccgacgccauccacagaggcggcggccagaucauccccaccgccagaagaugccuguacgccagcgugcugaccgcccagcccagacugauggagcccaucuaccugguggagauccagugccccgagcagguggugggcggcaucuacggcgugcugaacagaaagagaggccacguguucgaggagagccagguggccggcacccccauguucguggugaaggccuaccugcccgugaacgagagcuucggcuucaccgccgaccugagaagcaacaccggcggccaggccuucccccagugcguguucgaccacuggcagauccugcccggcgaccccuucgacaacagcagcagacccagccaggugguggccgagaccagaaagagaaagggccugaaggagggcauccccgcccuggacaacuuccuggacaagcuguaa

SEQ ID NO: 16457 - RNA, 1791 nt, Artificial Sequence
  EEFSEC__Homo_sapiens__NP_068756
auggccggcagaagagugaacgugaacgugggcgugcugggccacaucgacagcggcaagaccgcccuggccagagcccugagcaccaccgccagcaccgccgccuucgacaagcagccccagagcagagagagaggcaucacccuggaccugggcuucagcugcuucagcgugccccugcccgccagacugagaagcagccugcccgaguuccaggccgcccccgaggccgagcccgagcccggcgagccccugcugcaggugacccugguggacugccccggccacgccagccugaucagaaccaucaucggcggcgcccagaucaucgaccugaugaugcuggugaucgacgugaccaagggcaugcagacccagagcgccgagugccuggugaucggccagaucgccugccagaagcuggugguggugcugaacaagaucgaccugcugcccgagggcaagagacaggccgccaucgacaagaugaccaagaagaugcagaagacccuggagaacaccaaguucagaggcgcccccaucauccccguggccgccaagcccggcggccccgaggcccccgagaccgaggccccccagggcauccccgagcugaucgagcugcugaccagccagaucagcauccccaccagagaccccagcggccccuuccugaugagcguggaccacugcuucagcaucaagggccagggcaccgugaugaccggcaccauccugagcggcagcaucagccugggcgacagcguggagauccccgcccugaagguggugaagaaggugaagagcaugcagauguuccacaugcccaucaccagcgccaugcagggcgacagacugggcaucugcgugacccaguucgaccccaagcugcuggagagaggccuggugugcgcccccgagagccugcacaccgugcacgccgcccugaucagcguggagaagauccccuacuucagaggcccccugcagaccaaggccaaguuccacaucaccgugggccacgagaccgugaugggcagacugauguucuucagccccgcccccgacaacuucgaccaggagcccauccuggacagcuucaacuucagccaggaguaccuguuccaggagcaguaccugagcaaggaccugacccccgccgugaccgacaacgacgaggccgacaagaaggccggccaggccaccgagggccacugccccagacagcagugggcccugguggaguucgagaagcccgugaccugccccagacugugccuggugaucggcagcagacuggacgccgacauccacaccaacaccugcagacuggccuuccacggcauccugcugcacggccuggaggacagaaacuacgccgacagcuuccugcccagacugaagguguacaagcugaagcacaagcacggccugguggagagagccauggacgacuacagcgugaucggcagaagccuguucaagaaggagaccaacauccagcuguucgugggccugaaggugcaccugagcaccggcgagcugggcaucaucgacagcgccuucggccagagcggcaaguucaagauccacauccccggcggccugagccccgagagcaagaagauccugacccccgcccugaagaagagagccagagccggcagaggcgaggccaccagacaggaggagagcgccgagagaagcgagcccagccagcacguggugcugagccugaccuucaagagauacguguucgacacccacaagagaauggugcagagccccuaa

SEQ ID NO: 16458 - RNA, 429 nt, Artificial Sequence
  EFCAB11__Homo_sapiens__NP_001271195
auguucuucagcgaggccagagccagaagcagaaccugggaggccagccccagcgagcacagaaaguggguggagguguucaaggccugcgacgaggaccacaagggcuaccugagcagagaggacuucaagaccgccguggugaugcuguucggcuacaagcccagcaagaucgagguggacagcgugaugagcagcaucaaccccaacaccagcggcauccugcuggagggcuuccugaacaucgugagaaagaagaaggaggcccagagauacagaaacgaggugagacacaucuucaccgccuucgacaccuacuacagaggcuuccugacccuggaggacuucaagaaggccuucagacagguggcccccaagcugcccgagagaaccgugcuggagguguucagaggcaucuucagcgccuaa

SEQ ID NO: 16459 - RNA, 480 nt, Artificial Sequence
  EFCAB1__Homo_sapiens__XP_005251361
augaacagaaagaagcugcagaagcugaccgacacccugaccaagaacugcaagcaccuguucagaggcuucgacaaggacaacgacggcugcgugaacgugcuggaguggauccacggccugagccuguuccugagaggcagccuggaggagaagaugaaguacugcuucgagguguucgaccugaacggcgacggcuucaucagcaaggaggagauguuccacaugcugaagaacagccugcugaagcagcccagcgaggaggaccccgacgagggcaucaaggaccugguggagaucacccugaagaagauggaccacgaccacgacggcaagcugagcuucgccgacuacgagcuggccgugagagaggagacccugcugcuggaggccuucggccccugccugcccgaccccaagagccagauggaguucgaggcccagguguucaaggaccccaacgaguucaacgacauguaa

SEQ ID NO: 16460 - RNA, 1482 nt, Artificial Sequence
  EFEMP1__Homo_sapiens__NP_001034438
augcugaaggcccuguuccugaccaugcugacccuggcccuggugaagagccaggacaccgaggagaccaucaccuacacccagugcaccgacggcuacgagugggaccccgugagacagcagugcaaggacaucgacgagugcgacaucgugcccgacgccugcaagggcggcaugaagugcgugaaccacuacggcggcuaccugugccugcccaagaccgcccagaucaucgugaacaacgagcagccccagcaggagacccagcccgccgagggcaccagcggcgccaccaccggcgugguggccgccagcagcauggccaccagcggcgugcugcccggcggcggcuucguggccagcgccgccgccguggccggccccgagaugcagaccggcagaaacaacuucgugaucagaagaaaccccgccgacccccagagaauccccagcaaccccagccacagaauccagugcgccgccggcuacgagcagagcgagcacaacgugugccaggacaucgacgagugcaccgccggcacccacaacugcagagccgaccaggugugcaucaaccugagaggcagcuucgccugccagugcccccccggcuaccagaagagaggcgagcagugcguggacaucgacgagugcaccaucccccccuacugccaccagagaugcgugaacacccccggcagcuucuacugccagugcagccccggcuuccagcuggccgccaacaacuacaccugcguggacaucaacgagugcgacgccagcaaccagugcgcccagcagugcuacaacauccugggcagcuucaucugccagugcaaccagggcuacgagcugagcagcgacagacugaacugcgaggacaucgacgagugcagaaccagcagcuaccugugccaguaccagugcgugaacgagcccggcaaguucagcugcaugugcccccagggcuaccagguggugagaagcagaaccugccaggacaucaacgagugcgagaccaccaacgagugcagagaggacgagaugugcuggaacuaccacggcggcuucagaugcuaccccagaaaccccugccaggaccccuacauccugacccccgagaacagaugcgugugccccgugagcaacgccaugugcagagagcugccccagagcaucguguacaaguacaugagcaucagaagcgacagaagcgugcccagcgacaucuuccagauccaggccaccaccaucuacgccaacaccaucaacaccuucagaaucaagagcggcaacgagaacggcgaguucuaccugagacagaccagccccgugagcgccaugcuggugcuggugaagagccugagcggccccagagagcacaucguggaccuggagaugcugaccgugagcagcaucggcaccuucagaaccagcagcgugcugagacugaccaucaucgugggccccuucagcuucuaa

SEQ ID NO: 16461 - RNA, 1332 nt, Artificial Sequence
  EFEMP2__Homo_sapiens__NP_058634
augcugcccugcgccagcugccugcccggcagccugcugcugugggcccugcugcugcugcugcugggcagcgccagcccccaggacagcgaggagcccgacagcuacaccgagugcaccgacggcuacgagugggaccccgacagccagcacugcagagacgugaacgagugccugaccauccccgaggccugcaagggcgagaugaagugcaucaaccacuacggcggcuaccugugccugcccagaagcgccgccgugaucaacgaccugcacggcgagggcccccccccccccgugccccccgcccagcaccccaaccccugcccccccggcuacgagcccgacgaccaggacagcugcguggacguggacgagugcgcccaggcccugcacgacugcagacccagccaggacugccacaaccugcccggcagcuaccagugcaccugccccgacggcuacagaaagaucggccccgagugcguggacaucgacgagugcagauacagauacugccagcacagaugcgugaaccugcccggcagcuucagaugccagugcgagcccggcuuccagcugggccccaacaacagaagcugcguggacgugaacgagugcgacaugggcgcccccugcgagcagagaugcuucaacagcuacggcaccuuccugugcagaugccaccagggcuacgagcugcacagagacggcuucagcugcagcgacaucgacgagugcagcuacagcagcuaccugugccaguacagaugcaucaacgagcccggcagauucagcugccacugcccccagggcuaccagcugcuggccaccagacugugccaggacaucgacgagugcgagagcggcgcccaccagugcagcgaggcccagaccugcgugaacuuccacggcggcuacagaugcguggacaccaacagaugcguggagcccuacauccaggugagcgagaacagaugccugugccccgccagcaacccccugugcagagagcagcccagcagcaucgugcacagauacaugaccaucaccagcgagagaagcgugcccgccgacguguuccagauccaggccaccagcguguaccccggcgccuacaacgccuuccagaucagagccggcaacagccagggcgacuucuacaucagacagaucaacaacgugagcgccaugcuggugcuggccagacccgugaccggccccagagaguacgugcuggaccuggagauggugaccaugaacagccugaugagcuacagagccagcagcgugcugagacugaccguguucgugggcgccuacaccuucuaa

SEQ ID NO: 16462 - RNA, 2502 nt, Artificial Sequence
  EFHB__Homo_sapiens__NP_653316
augaacauggagaucggccacccccacgagggcaaggacgaccugggcgacaagagagugaucaugggcaccaaguuccccauggagcugggcaucagagugggccugggcaaggaggacagcagaugcggcgagagccccguggugagcaacaagugcgagggcagaauggccccccccgagaccaaguucccccugagcaagggccuggagaugggccuggagagacagaacaucagcagaaccgugaugcagagaggcagccugggcguggacagcgugagcgccagccagggcaccaagcccagccugcugcccggcagaaugggccuggagaacgagagccugcuggccggcuacacccacgagagaaucauccagcccccccugggcagagugugcggcagcagccaggccgccggcagcagaagagccccccuggccagcggccccgagggcguggaggagcuggugggcaagcccgccuucgugauggagcccagacaggagauggagaaggagagcaccugcgugcugaugaagcccaacaccgagaucaagcugcccguggagguggacaucggccugacccaggccgagggccccgacgagaccaagaacaccgagccccagaugggccuggugaucgagcccccccagugccaguucgcccagcagcacgagcagagaaaggaggccggcaacaucgagagcggcguggagccccccgacagaaucagacccaucuacagcggcaaguucuucgacagaacccccugcuggcccagcgccggcaaggugauccccgugggcuacagaguggccaccugccugaccgagaagcugcccagacugaucaccccccccgaggccaagaaguacuucaacuucagauacccccccgccggcguggagagaguguucuacggcagagccaacgacccccagaucgcccccuaccugacccacggcaucagaagcaagaucagcgugcuggccaacacccugaucaacccccagcccaucaccaccuuccagcagaagaucaaggacaagaaggagagcaucuaccugagcaacagaagagccccccugggcaagagccacgaccaggcccccggccugcccaagggcauggacaccaccaacaccaccuucggcaccgccgugaucaaggaguacagcgccaaggacguggugaacccccccaagagcuacgaggagguguucaaggagggcaacgagggccacgaccuguacguggugagccacaacgacuacuacgccggcgaggccaagaacagaaaguacaaccccagcagcuuccacagaugcagcguguacggcgugcccaccccccacuucaacgacggcagagccauggccaagagccuguacuggcugcacgagcugcagaugaagagaggcgccaaguucgugagcaagagagccgacgacuucaaggagaaguuccagcacaagcugggcagagugcuggaccccaucgccgagaccaugaacgugccccccgacugcaccuucggcgccugccugagacccgaggaguacggcgugggcgaccugauccacaacagacugcccgacgaguaccugagaggcaaggacagacagagagcccugaucgccgccgugagacaccaccugaagaaggugaacuaccagaaguucgacacccugcuggccgccuucagacacuacgacaagaagggcgacggcaugaucgacaaggacgagcugcaggaggccugcgaccaggccaaccugagccuggacgacaagcugcuggaccagcuguucgacuacugcgacguggacaacgacggcuucaucaacuaccuggaguucgccaacuuccugaacuggaaggacaagaugcugcugaaggaguacgaggagagagugaucaucaagggcagaaagcccgacugcgugaaccccaccgaggccaacguggaggagcccgagcagacccugcugaucaagcccgaggacaucgugcugaaggaggccggcagcaccgagaagacccugagaacccugcugagacccagcgacaaggugagcaacuacuacaagaccaccagcagcgagaucaacgccaucgugggcgccauccccagcaccugcuaccccaucugcggcgugcccaccaucagaagcgacauccccgcccccagaaucagaagaaucagcgacagaaccaacuacggcgaggagggcagcgccuacagccugcuguaccccaccaucuucgccagaaagggcguguucgagagagacuucuucaagaccagaagcaaggaggagaucgccgagauccugugcaacaucggcgugaagcugagcgacgaggaguucgagaacguguggaaccuggccagcaagaagcaccacagaggcgaggugugcguggagaacaucagaaacgugcuggacgagcugagacacgccgacagaaucaagugcaagacccugauguaa

SEQ ID NO: 16463 - RNA, 1866 nt, Artificial Sequence
  EFHC1__Homo_sapiens__NP_001165891
augcugaagaccgccuuccacagaagccagacccugagcuacagaaacggcuacgccaucgugagaagacccaccgugggcaucggcggcgacagacugcaguucaaccagcugagccaggccgagcuggacgagcuggccagcaaggcccccgugcugaccuacggccagcccaagcaggccccccccgccgacuucauccccgcccacguggccuucgacaagaaggugcugaaguucgacgccuacuuccaggaggacgugcccaugagcaccgaggagcaguacagaaucagacaggugaacaucuacuacuaccuggaggacgacagcaugagcgugaucgagcccgugguggagaacagcggcauccugcagggcaagcugaucaagagacagagacuggccaagaacgacagaggcgaccacuaccacuggaaggaccugaacagaggcaucaacaucaccaucuacggcaagaccuucagagugguggacugcgaccaguucacccagguguuccuggagagccagggcaucgagcugaacccccccgagaagauggcccuggaccccuacaccgagcugagaaagcagccccugagaaaguacgugacccccagcgacuucgaccagcugaagcaguuccugaccuucgacaagcaggugcugagauucuacgccaucugggacgacaccgacagcauguacggcgagugcagaaccuacaucauccacuacuaccugauggacgacaccguggagaucagagaggugcacgagagaaacgacggcagagaccccuucccccugcugaugaacagacagagagugcccaaggugcugguggagaacgccaagaacuucccccagugcgugcuggagaucagcgaccaggaggugcuggagugguacaccgccaaggacuucaucgugggcaagagccugaccauccugggcagaaccuucuucaucuacgacugcgaccccuucaccagaagauacuacaaggagaaguucggcaucaccgaccugcccagaaucgacgugagcaagagagagcccccccccgugaagcaggagcugccccccuacaacggcuucggccugguggaggacagcgcccagaacugcuucgcccugauccccaaggcccccaagaaggacgugaucaagaugcuggugaacgacaacaaggugcugagauaccuggccgugcuggagagccccauccccgaggacaaggacagaagauucguguucagcuacuuccuggccaccgacaugaucagcaucuucgagccccccgugagaaacagcggcaucaucggcggcaaguaccugggcagaaccaagguggugaagcccuacagcaccguggacaaccccguguacuacggccccagcgacuucuucaucggcgccgugaucgagguguucggccacagauucaucauccuggacaccgacgaguacgugcugaaguacauggagagcaacgccgcccaguacagccccgaggcccuggccagcauccagaaccacgugagaaagagagaggcccccgcccccgaggccgagagcaagcagaccgagaaggaccccggcgugcaggagcuggaggcccugaucgacaccauccagaagcagcugaaggaccacagcugcaaggacaacaucagagaggccuuccagaucuacgacaaggaggccagcggcuacguggacagagacauguucuucaagaucugcgagagccugaacgugcccguggacgacagccuggugaaggagcugaucagaaugugcagccacggcgagggcaagaucaacuacuacaacuucgugagagccuucagcaacuaa

SEQ ID NO: 16464 - RNA, 2250 nt, Artificial Sequence
  EFHC2__Homo_sapiens__NP_079460
auggcccugccccugcugcccggcaacagcuucaacagaaacgugggcaaggagaaguuccacaagagccagcacuggggcuucugcaacaacgugaugaugcuggugagcgacgagaagcccggcaucggcggcgagccccugcugggccagaagaucaagcccaagugcagcaucuaccccaagggcgacggcagcgacgugcccagcuggguggccuucgacaagcaggugcugagcuucgacgccuaccuggaggaggaggugcuggacaagagccagaccaacuacagaaucagauacuacaagaucuacuucuaccccgaggacgacaccauccaggugaacgagcccgaggugaagaacagcggccugcugcagggcaccagcaucagaagacacagaaucacccugcccccccccgacgaggaccaguucuacaccguguaccacuucaacgugggcaccgaggugguguucuacggcagaaccuucaagaucuacgacugcgacgccuucaccagaaacuuccugagaaagaucggcgugaaggugaacccccccgugcagugccccgaggaccccuacaugaagaucagaagagaggugguggagcacguggagccccugagacccuacgagagccuggacacccugaagcaguuccugcaguaccacggcaagauccugugcuucuucugccugugggacgacagcgugagcauguucggcgacagaagagagcugauccugcacuacuuccugugcgacgacaccaucgagaucaaggagcugcugccccacagcagcggcagagacgcccugaagauguuccugagaagaagcaagcugcccaagaacugcccccccagaguguaccagcccggccagaucaccgacagagccgugcugaacagcuacggcgacuucaucaagaaccaggccgacggcuaccuguucgacagauacaagcugggcaagguggaccaggaguucuacaaggacagcgaccugagccugggcgugaccaucaacguguggggcagaaaggugcugcuguacgacugcgacgaguucaccaagagcuacuacaagagcaaguacggcaucgagaacuucaccagcgugagcugcaagccccccagccccccccccaagaucgagagaaaguucccccccuacaacggcuucggcagcgaggaggacagccugagaaacugcaucgaccugaagcccaccccccacagaagaaacuucaagaaguucauggagaaggacagcuacggcagcaagagcaacauccugagauucuucgccaagcuggugaccgacaagugcguggaccuggacagaauguucgugaucagcuacuaccugggcgacgacaccaucagcguguucgagcccaucgagagaaacagcggcaucgccggcggcauguuccugaagagaagcagagugaagaagcccggccaggagguguucaagagcgagcugagcgaguacaucaaggccgaggagcuguacaucggcgugaccgugaacgugaacggcuaccuguucagacugcugaacgccgacgaguacacccugaacuacauggagcagaacaccgacaaguaccccuucagcaaccugaagcuggcccugcagaagcugaagcaggaggagggcaagagcagagagcugaagcagguguucaaggccgccgacagcaagcacaccaacaugguggacuacaacaccuucagagacauccugaugagccugaccgugggcaaccuggccgagcaggaguucgugaccaucgccagacacuacagagugcccgagggcaccugcagcgacauggacuuccugaucgcccuggcccacgagaaguucaagaagaacauguucgagaacuucgacaccuucaucuacagcugcguguacgaggacagagagaagaagaacgugcugcccaccaaggacaucaagagacugugcaagagcagcagacugccccugagcgacgaccugcuggagagccugcugagcagauucgaggacagcgagaagcagaucgacuacaagagcuucuucagcgcccugaacuggagaaagaaccccgugcccgagcugcagcccgccagcuaccugaaggagagaugcgaggacguguggcugggcaugcccagccccauccccgccaaguacaucgacuacuggaccuuccugaaggacgccuucggccuggaggaggaguaa

SEQ ID NO: 16465 - RNA, 432 nt, Artificial Sequence
  EFHD1__Homo_sapiens__NP_001230181
augggcgagcugcaguacgacgccggcagagacggcuucaucgaccugauggagcugaagcugaugauggagaagcugggcgccccccagacccaccugggccugaagagcaugaucaaggagguggacgaggacuucgacggcaagcugagcuucagagaguuccugcugaucuuccacaaggccgccgccggcgagcugcaggaggacagcggccugauggcccuggccaagcugagcgagaucgacguggcccuggagggcgugaagggcgccaagaacuucuucgaggccaaggugcaggcccugagcagcgccagcaaguucgaggccgagcugaaggccgagcaggacgagagaaagagagaggaggaggagagaagacugagacaggccgccuuccagaagcugaaggccaacuucaacaccuaa

SEQ ID NO: 16466 - RNA, 618 nt, Artificial Sequence
  EFNA1__Homo_sapiens__NP_004419
auggaguuccugugggccccccugcugggccugugcugcagccuggccgccgccgacagacacaccguguucuggaacagcagcaaccccaaguucagaaacgaggacuacaccauccacgugcagcugaacgacuacguggacaucaucugcccccacuacgaggaccacagcguggccgacgccgccauggagcaguacauccuguaccugguggagcacgaggaguaccagcugugccagccccagagcaaggaccaggugagauggcagugcaacagacccagcgccaagcacggccccgagaagcugagcgagaaguuccagagauucacccccuucacccugggcaaggaguucaaggagggccacagcuacuacuacaucagcaagcccauccaccagcacgaggacagaugccugagacugaaggugaccgugagcggcaagaucacccacagcccccaggcccacgacaacccccaggagaagagacuggccgccgacgaccccgaggugagagugcugcacagcaucggccacagcgccgcccccagacuguucccccuggccuggaccgugcugcugcugccccugcugcugcugcagacccccuaa

SEQ ID NO: 16467 - RNA, 642 nt, Artificial Sequence
  EFNA2__Homo_sapiens__NP_001396
auggcccccgcccagagaccccugcugccccugcugcugcugcugcugccccugccccccccccccuucgccagagccgaggacgccgccagagccaacagcgacagauacgccguguacuggaacagaagcaaccccagauuccacgccggcgccggcgacgacggcggcggcuacaccguggaggugagcaucaacgacuaccuggacaucuacugcccccacuacggcgccccccugccccccgccgagagaauggagcacuacgugcuguacauggugaacggcgagggccacgccagcugcgaccacagacagagaggcuucaagagaugggagugcaacagacccgccgcccccggcggcccccugaaguucagcgagaaguuccagcuguucacccccuucagccugggcuucgaguucagacccggccacgaguacuacuacaucagcgccaccccccccaacgccguggacagacccugccugagacugaagguguacgugagacccaccaacgagacccuguacgaggcccccgagcccaucuucaccagcaacaacagcugcagcagccccggcggcugcagacuguuccugagcaccauccccgugcuguggacccugcugggcagcuaa

SEQ ID NO: 16468 - RNA, 717 nt, Artificial Sequence
  EFNA3__Homo_sapiens__NP_004943
auggccgccgccccccugcugcugcugcugcugcuggugcccgugccccugcugccccugcuggcccagggccccggcggcgcccugggcaacagacacgccguguacuggaacagcagcaaccagcaccugagaagagagggcuacaccgugcaggugaacgugaacgacuaccuggacaucuacugcccccacuacaacagcagcggcgugggccccggcgccggccccggccccggcggcggcgccgagcaguacgugcuguacauggugagcagaaacggcuacagaaccugcaacgccagccagggcuucaagagaugggagugcaacagaccccacgccccccacagccccaucaaguucagcgagaaguuccagagauacagcgccuucagccugggcuacgaguuccacgccggccacgaguacuacuacaucagcacccccacccacaaccugcacuggaagugccugagaaugaagguguucgugugcugcgccagcaccagccacagcggcgagaagcccgugcccacccugccccaguucaccaugggccccaacgugaagaucaacgugcuggaggacuucgagggcgagaacccccaggugcccaagcuggagaagagcaucagcggcaccagccccaagagagagcaccugccccuggccgugggcaucgccuucuuccugaugaccuuccuggccagcuaa

SEQ ID NO: 16469 - RNA, 606 nt, Artificial Sequence
  EFNA4__Homo_sapiens__NP_005218
augagacugcugccccugcugagaaccgugcugugggccgccuuccugggcagcccccugagaggcggcagcagccugagacacgugguguacuggaacagcagcaaccccagacugcugagaggcgacgccgugguggagcugggccugaacgacuaccuggacaucgugugcccccacuacgagggccccggcccccccgagggccccgagaccuucgcccuguacaugguggacuggcccggcuacgagagcugccaggccgagggccccagagccuacaagagaugggugugcagccugcccuucggccacgugcaguucagcgagaagauccagagauucacccccuucagccugggcuucgaguuccugcccggcgagaccuacuacuacaucagcgugcccacccccgagagcagcggccagugccugagacugcaggugagcgugugcugcaaggagagaaagagcgagagcgcccaccccgugggcagccccggcgagagcggcaccagcggcuggagaggcggcgacacccccagcccccugugccugcugcugcugcugcugcugcugauccugagacugcugagaauccuguaa

SEQ ID NO: 16470 - RNA, 687 nt, Artificial Sequence
  EFNA5__Homo_sapiens__NP_001953
augcugcacguggagaugcugacccugguguuccuggugcuguggaugugcguguucagccaggaccccggcagcaaggccguggccgacagauacgccguguacuggaacagcagcaaccccagauuccagagaggcgacuaccacaucgacgugugcaucaacgacuaccuggacguguucugcccccacuacgaggacagcgugcccgaggacaagaccgagagauacgugcuguacauggugaacuucgacggcuacagcgccugcgaccacaccagcaagggcuucaagagaugggagugcaacagaccccacagccccaacggcccccugaaguucagcgagaaguuccagcuguucacccccuucagccugggcuucgaguucagacccggcagagaguacuucuacaucagcagcgccauccccgacaacggcagaagaagcugccugaagcugaagguguucgugagacccaccaacagcugcaugaagaccaucggcgugcacgacagaguguucgacgugaacgacaagguggagaacagccuggagcccgccgacgacaccgugcacgagagcgccgagcccagcagaggcgagaacgccgcccagacccccagaauccccagcagacugcuggccauccugcuguuccugcuggccaugcugcugacccuguaa

SEQ ID NO: 16471 - RNA, 1041 nt, Artificial Sequence
  EFNB1__Homo_sapiens__NP_004420
auggccagacccggccagagauggcugggcaaguggcugguggccaugguggugugggcccugugcagacuggccaccccccuggccaagaaccuggagcccgugagcuggagcagccugaaccccaaguuccugagcggcaagggccuggugaucuaccccaagaucggcgacaagcuggacaucaucugccccagagccgaggccggcagacccuacgaguacuacaagcuguaccuggugagacccgagcaggccgccgccugcagcaccgugcuggaccccaacgugcuggugaccugcaacagacccgagcaggagaucagauucaccaucaaguuccaggaguucagccccaacuacaugggccuggaguucaagaagcaccacgacuacuacaucaccagcaccagcaacggcagccuggagggccuggagaacagagagggcggcgugugcagaaccagaaccaugaagaucaucaugaaggugggccaggaccccaacgccgugacccccgagcagcugaccaccagcagacccagcaaggaggccgacaacaccgugaagauggccacccaggcccccggcagcagaggcagccugggcgacagcgacggcaagcacgagaccgugaaccaggaggagaagagcggccccggcgccagcggcggcagcagcggcgaccccgacggcuucuucaacagcaagguggcccuguucgccgccgugggcgccggcugcgugaucuuccugcugaucaucaucuuccugaccgugcugcugcugaagcugagaaagagacacagaaagcacacccagcagagagccgccgcccugagccugagcacccuggccagccccaagggcggcagcggcaccgccggcaccgagcccagcgacaucaucaucccccugagaaccaccgagaacaacuacugcccccacuacgagaaggugagcggcgacuacggccaccccguguacaucgugcaggagaugcccccccagagccccgccaacaucuacuacaagguguaa

SEQ ID NO: 16472 - RNA, 1002 nt, Artificial Sequence
  EFNB2__Homo_sapiens__NP_004084
auggccgugagaagagacagcguguggaaguacugcuggggcgugcugauggugcugugcagaaccgccaucagcaagagcaucgugcuggagcccaucuacuggaacagcagcaacagcaaguuccugcccggccagggccuggugcuguacccccagaucggcgacaagcuggacaucaucugccccaagguggacagcaagaccgugggccaguacgaguacuacaagguguacaugguggacaaggaccaggccgacagaugcaccaucaagaaggagaacaccccccugcugaacugcgccaagcccgaccaggacaucaaguucaccaucaaguuccaggaguucagccccaaccuguggggccuggaguuccagaagaacaaggacuacuacaucaucagcaccagcaacggcagccuggagggccuggacaaccaggagggcggcgugugccagaccagagccaugaagauccugaugaaggugggccaggacgccagcagcgccggcagcaccagaaacaaggaccccaccagaagacccgagcuggaggccggcaccaacggcagaagcagcaccaccagccccuucgugaagcccaaccccggcagcagcaccgacggcaacagcgccggccacagcggcaacaacauccugggcagcgagguggcccuguucgccggcaucgccagcggcugcaucaucuucaucgugaucaucaucacccugguggugcugcugcugaaguacagaagaagacacagaaagcacagcccccagcacaccaccacccugagccugagcacccuggccacccccaagagaagcggcaacaacaacggcagcgagcccagcgacaucaucaucccccugagaaccgccgacagcguguucugcccccacuacgagaaggugagcggcgacuacggccaccccguguacaucgugcaggagaugcccccccagagccccgccaacaucuacuacaagguguaa

SEQ ID NO: 16473 - RNA, 1023 nt, Artificial Sequence
  EFNB3__Homo_sapiens__NP_001397
augggccccccccacagcggccccggcggcgugagagugggcgcccugcugcugcugggcgugcugggccuggugagcggccugagccuggagcccguguacuggaacagcgccaacaagagauuccaggccgagggcggcuacgugcuguacccccagaucggcgacagacuggaccugcugugccccagagccagaccccccggcccccacagcagccccaacuacgaguucuacaagcuguaccuggugggcggcgcccagggcagaagaugcgaggccccccccgcccccaaccugcugcugaccugcgacagacccgaccuggaccugagauucaccaucaaguuccaggaguacagccccaaccuguggggccacgaguucagaagccaccacgacuacuacaucaucgccaccagcgacggcaccagagagggccuggagagccugcagggcggcgugugccugaccagaggcaugaaggugcugcugagagugggccagagccccagaggcggcgccgugcccagaaagcccgugagcgagaugcccauggagagagacagaggcgccgcccacagccuggagcccggcaaggagaaccugcccggcgaccccaccagcaacgccaccagcagaggcgccgagggcccccugcccccccccagcaugcccgccguggccggcgccgccggcggccuggcccugcugcugcugggcguggccggcgccggcggcgccaugugcuggagaagaagaagagccaagcccagcgagagcagacaccccggccccggcagcuucggcagaggcggcagccugggccugggcggcggcggcggcaugggccccagagaggccgagcccggcgagcugggcaucgcccugagaggcggcggcgccgccgacccccccuucugcccccacuacgagaaggugagcggcgacuacggccaccccguguacaucgugcaggacggccccccccagagcccccccaacaucuacuacaagguguaa

SEQ ID NO: 16474 - RNA, 2466 nt, Artificial Sequence
  EFR3A__Homo_sapiens__NP_055952
augcccaccagagugugcugcugcugcagcgcccugagacccagauacaagagacugguggacaacaucuuccccgaggaccccaaggacggccuggugaagaccgacauggagaagcugaccuucuacgccgugagcgcccccgagaagcuggacagaaucggcagcuaccuggccgagagacugagcagagacguggugagacacagaagcggcuacgugcugaucgccauggaggcccuggaccagcugcugauggccugccacagccagagcaucaagcccuucguggagagcuuccugcacaugguggccaagcugcuggagagcggcgagcccaagcugcaggugcugggcaccaacagcuucgugaaguucgccaacaucgaggaggacacccccagcuaccacagaagauacgacuucuucgugagcagauucagcgccaugugccacagcugccacagcgaccccgagaucagaaccgagaucagaaucgccggcaucagaggcauccagggcguggugagaaagaccgugaacgacgagcugagagccaccaucugggagccccagcacauggacaagaucgugcccagccugcuguucaacaugcagaagaucgaggagguggacagcagaaucggcccccccagcagccccagcgccaccgacaaggaggagaaccccgccgugcuggccgagaacugcuucagagagcugcugggcagagccaccuucggcaacaugaacaacgccgugagacccguguucgcccaccuggaccaccacaagcugugggaccccaacgaguucgccgugcacugcuucaagaucaucauguacagcauccaggcccaguacagccaccacgugauccaggagauccugggccaccuggacgccagaaagaaggacgcccccagagugagagccggcaucauccaggugcugcuggaggccguggccaucgccgccaagggcagcaucggccccaccgugcuggagguguucaacacccugcugaagcaccugagacugagcguggaguucgaggccaacgaccugcagggcggcagcgugggcagcgugaaccugaacaccagcagcaaggacaacgacgagaagaucgugcagaacgccaucauccagaccaucggcuucuucggcagcaaccugcccgacuaccagagaagcgagaucaugauguucaucaugggcaaggugcccguguucggcaccagcacccacacccuggacaucagccagcugggcgaccugggcaccagaagaauccagaucaugcugcugagaagccugcugauggugaccagcggcuacaaggccaagaccaucgugaccgcccugcccggcagcuuccuggacccccugcugagccccagccugauggaggacuacgagcugagacagcuggugcuggaggugaugcacaaccugauggacagacacgacaacagagccaagcugagaggcaucagaaucauccccgacguggccgaccugaagaucaagagagagaagaucugcagacaggacaccagcuucaugaagaagaacggccagcagcuguacagacacaucuaccugggcugcaaggaggaggacaacgugcagaagaacuacgagcugcuguacaccagccuggcccugaucaccaucgagcuggccaacgaggagguggugaucgaccugaucagacuggccaucgcccugcaggacagcgccaucaucaacgaggacaaccugcccauguuccacagaugcggcaucauggcccugguggccgccuaccugaacuucgugagccagaugaucgccgugcccgccuucugccagcacgugagcaaggugaucgagaucagaaccauggaggcccccuacuuccugcccgagcacaucuucagagacaagugcaugcugcccaagagccuggagaagcacgagaaggaccuguacuuccugaccaacaagaucgccgagagccugggcggcagcggcuacagcguggagagacugagcgugcccuacgugccccaggugaccgacgaggacagacugagcagaagaaagagcaucguggacaccgugagcauccagguggacauccugagcaacaacgugcccagcgacgacguggugagcaacaccgaggagaucaccuucgaggcccugaagaaggccaucgacaccagcggcauggaggagcaggagaaggagaagagaagacuggugaucgagaaguuccagaaggcccccuucgaggagaucgccgcccagugcgagagcaaggccaaccugcugcacgacagacuggcccagauccuggagcugaccaucagacccccccccagccccagcggcacccugaccaucaccagcggccacgcccaguaccagagcgugcccguguacgagaugaaguuccccgaccugugcguguacuaa

SEQ ID NO: 16475 - RNA, 2454 nt, Artificial Sequence
  EFR3B__Homo_sapiens__NP_055786
auguacggcgugugcggcugcugcggcgcccugagacccagauacaagagacugguggacaacaucuuccccgaggaccccgaggacggccuggugaagaccaacauggagaagcugaccuucuacgcccugagcgcccccgagaagcuggacagaaucggcgccuaccugagcgagagacugaucagagacgugggcagacacagauacggcuacgugugcaucgccauggaggcccuggaccagcugcugauggccugccacugccagagcaucaaccuguucguggagagcuuccugaagaugguggccaagcugcuggagagcgagaagcccaaccugcagauccugggcaccaacagcuucgugaaguucgccaacaucgaggaggacacccccagcuaccacagaagcuacgacuucuucgugagcagauucagcgagaugugccacagcagccacgacgaccuggagaucaagaccaagaucagaaugagcggcaucaagggccugcagggcguggugagaaagaccgugaacgacgagcugcaggccaacaucugggacccccagcacauggacaagaucgugcccagccugcuguucaaccugcagcacguggaggaggccgagagcagaagccccagcccccugcaggcccccgagaaggagaaggagagccccgccgagcuggccgagagaugccugagagagcugcugggcagagccgccuucggcaacaucaagaacgccaucaagcccgugcugauccaccuggacaaccacagccugugggagcccaagguguucgccaucagaugcuucaagaucaucauguacagcauccagccccagcacagccaccuggugauccagcagcugcugggccaccuggacgccaacagcagaagcgccgccaccgugagagccggcaucguggaggugcugagcgaggccgccgugaucgccgccaccggcagcgugggccccaccgugcuggagauguucaacacccugcugagacagcugagacugagcaucgacuacgcccugaccggcagcuacgacggcgccgugagccugggcaccaagaucaucaaggagcacgaggagagaauguuccaggaggccgugaucaagaccgugggcagcuucgccagcacccugcccaccuaccagagaagcgaggugauccuguucaucaugagcaaggugcccagacccagccugcaccaggccguggacaccggcagaaccggcgagaacagaaacagacugacccagaucaugcugcugaagagccugcugcaggugagcaccggcuuccagugcaacaacaugaugagcgcccugcccagcaacuuccuggacagacugcugagcaccgcccugauggaggacgccgagaucagacuguucgugcuggagauccugaucagcuucaucgacagacacggcaacagacacaaguucagcaccaucagcacccugagcgacaucagcgugcugaagcugaagguggacaagugcagcagacaggacaccguguucaugaagaagcacagccagcagcuguacagacacaucuaccugagcugcaaggaggagaccaacgugcagaagcacuacgaggcccuguacggccugcuggcccugaucagcaucgagcuggccaacgaggagguggugguggaccugaucagacuggugcuggccgugcaggacguggcccaggugaacgaggagaaccugcccguguacaacagaugcgcccuguacgcccugggcgccgccuaccugaaccugaucagccagcugaccaccgugcccgccuucugccagcacauccacgaggugaucgagaccagaaagaaggaggcccccuacaugcugcccgaggacguguucguggagagacccagacugagccagaaccuggacggcguggugaucgagcugcuguucagacagagcaagaucagcgaggugcugggcggcagcggcuacaacagcgacagacugugccugcccuacaucccccagcugaccgacgaggacagacugagcaagagaagaagcaucggcgagaccaucagccugcagguggagguggagagcagaaacagccccgagaaggaggagagagugcccgccgaggagaucaccuacgagacccugaagaaggccaucguggacagcguggccguggaggagcaggagagagagagaagaagacaggugguggagaaguuccagaaggcccccuucgaggagaucgccgcccacugcggcgccagagccagccugcugcagagcaagcugaaccagaucuucgagaucaccaucagacccccccccagccccagcggcaccaucaccgccgccuacggccagccccagaaccacagcauccccguguacgagaugaaguuccccgaccugugcguguacuaa

SEQ ID NO: 16476 - RNA, 1179 nt, Artificial Sequence
  EFS__Homo_sapiens__NP_001264103
auggccaucgccaccagcguguacguggugcccccccccgccagacccugccccaccagcggcccccccgccggccccugcccccccagccccgaccugaucuacaagauccccagagccagcggcacccagcuggccgcccccagagacgcccuggagguguacgacgugccccccaccgcccugagagugcccagcagcggccccuacgacugccccgccagcuucagccacccccugaccagaguggccccccagccccccggcgaggacgacgccccccccagccccgagccccccggcgcccuggccagccacgaccaggacacccuggcccagcugcuggccagaagccccccccccccccacagacccagacugcccagcgccgagagccugagcagaagaccccugcccgcccugcccgugcccgaggcccccagccccagccccgugcccagccccgcccccggcagaaagggcagcauccaggacagaccccugcccccccccccccccagacugcccggcuacggcggccccaagguggagggcgaccccgagggcagagagauggaggacgaccccgccggccaccacaacgaguacgagggcauccccauggccgaggaguacgacuacgugcaccugaagggcauggacaaggcccagggcagcagaccccccgaccaggccugcaccggcgaccccgagcugcccgagagaggcaugcccgccccccaggaggcccugagccccggcgagccccugguggugagcaccggcgaccugcagcugcuguacuucuacgccggccagugccagagccacuacagcgcccugcaggccgccguggccgcccugaugagcagcacccaggccaaccagccccccagacuguucgugccccacagcaagagaguggugguggccgcccacagacugguguucgugggcgacacccugggcagacuggccgccagcgccccccugagagcccaggugagagccgccggcaccgcccugggccaggcccugagagccaccgugcuggccgugaagggcgccgcccugggcuaccccagcagccccgccauccaggagauggugcagugcgugaccgagcuggccggccaggcccugcaguucaccacccugcugaccagccuggcccccuaa

SEQ ID NO: 16477 - RNA, 3210 nt, Artificial Sequence
  EFTUD1__Homo_sapiens__NP_001035700
auggugcugaacagccuggacaagaugauccagcugcagaagaacaccgccaacaucagaaacaucugcgugcuggcccacguggaccacggcaacgaggaguaccugaucaaccugaucgacagccccggccacguggacuucagcagcgaggugagcaccgccgugagaaucugcgacggcugcaucaucgugguggacgccguggagggcgugugcccccagacccaggccgugcugagacaggccuggcuggagaacaucagacccgugcuggugaucaacaagaucgacagacugaucguggagcugaaguucaccccccaggaggccuacagccaccugaagaacauccuggagcagaucaacgcccugaccggcacccuguucaccagcaaggugcuggaggagagagccgagagagagaccgagagccaggugaaccccaacagcgagcagggcgagcagguguacgacuggagcaccggccuggaggacaccgacgacagccaccuguacuucagccccgagcagggcaacgugguguucaccagcgccaucgacggcuggggcuucggcaucgagcacuucgccagaaucuacagccagaagaucggcaucaagaaggaggugcugaugaagacccuguggggcgacuacuacaucaacaugaaggccaagaagaucaugaagggcgaccaggccaagggcaagaagccccuguucgugcagcugauccuggagaacaucuggagccuguacgacgccgugcugaagaaggacaaggacaagaucgacaagaucgugaccagccugggccugaagaucggcgccagagaggccagacacagcgaccccaaggugcagaucaacgccaucugcagccaguggcugcccaucagccacgccgugcuggccauggugugccagaagcugcccagcccccuggacaucaccgccgagagaguggagagacugaugugcaccggcagccagaccuucgacagcuucccccccgagacccaggcccugaaggccgccuucaugaagugcggcagcgaggacaccgcccccgugaucaucuucgugagcaagauguucgccguggacgccaaggcccugccccagaacaagcccagaccccugacccaggaggagaucgcccagagaagagagagagccagacagagacacgccgagaagcuggccgccgcccagggccaggccccccuggagcccacccaggacggcagcgccaucgagaccugccccaagggcgaggagcccagaggcgacgagcagcagguggagagcaugacccccaagcccgugcugcaggaggagaacaaccaggagagcuucaucgccuucgccagaguguucagcggcguggccagaagaggcaagaagaucuucgugcugggccccaaguacagcccccuggaguuccugagaagagugccccugggcuucagcgccccccccgacggccugccccaggugccccacauggccuacugcgcccuggagaaccuguaccugcugaugggcagagagcuggaguaccuggaggaggugccccccggcaacgugcugggcaucggcggccugcaggacuucgugcugaagagcgccacccugugcagccugcccagcugcccccccuucaucccccugaacuucgaggccacccccaucgugagaguggccguggagcccaagcaccccagcgagaugccccagcuggugaagggcaugaagcugcugaaccaggccgaccccugcgugcagauccugauccaggagaccggcgagcacgugcuggugaccgccggcgaggugcaccugcagagaugccuggacgaccugaaggagagauucgccaagauccacaucagcgugagcgagcccaucauccccuucagagagaccaucaccaagccccccaagguggacauggugaacgaggagaucggcaagcagcagaagguggccgugauccaccagaugaaggaggaccagagcaagauccccgagggcauccagguggacagcgacggccugaucaccaucaccacccccaacaagcuggccacccugagcgugagagccaugccccugcccgaggaggugacccagauccuggaggagaacagcgaccugaucagaagcauggagcagcugaccagcagccugaacgagggcgagaacacccacaugauccaccagaagacccaggagaagaucugggaguucaagggcaagcuggagcagcaccugaccggcagaagauggagaaacaucguggaccagaucuggagcuucggccccagaaagugcggccccaacauccuggugaacaagagcgaggacuuccagaacagcguguggaccggccccgccgacaaggccagcaaggaggccagcagauacagagaccugggcaacagcaucgugagcggcuuccagcuggccacccugagcggccccaugugcgaggagccccugaugggcgugugcuucgugcuggagaagugggaccugagcaaguucgaggagcagggcgccagcgaccuggccaaggagggccaggaggagaacgagaccugcagcggcggcaacgagaaccaggagcugcaggacggcugcagcgaggccuucgagaagagaaccagccagaagggcgagagcccccugaccgacugcuacggccccuucagcggccagcugaucgccaccaugaaggaggccugcagauacgcccugcaggugaagccccagagacugauggccgccauguacaccugcgacaucauggccaccggcgacgugcugggcagaguguacgccgugcugagcaagagagagggcagagugcugcaggaggagaugaaggagggcaccgacauguucaucaucaaggccgugcugcccguggccgagagcuucggcuucgccgacgagaucagaaagagaaccagcggccuggccagcccccagcugguguucagccacugggagaucauccccagcgaccccuucugggugcccaccaccgaggaggaguaccugcacuucggcgagaaggccgacagcgagaaccaggccagaaaguacaugaacgccgugagaaagagaaagggccuguacguggaggagaagaucguggagcacgccgagaagcagagaacccugagcaagaacaaguaa

SEQ ID NO: 16478 - RNA, 2814 nt, Artificial Sequence
  EFTUD2__Homo_sapiens__NP_001136077
auggacgacgacgacgacgacgacgacgugggcgaccacgacgacgaccaccccggcauggagguggugcugcacgaggacaagaaguacuaccccaccgccgaggagguguacggccccgagguggagaccaucgugcaggaggaggacacccagccccugaccgagcccaucaucaagcccgugaagaccaagaaguucacccugauggagcagacccugcccgugaccguguacgagauggacuuccuggccgaccugauggacaacagcgagcugaucagaaacgugacccugugcggccaccugcaccacggcaagaccugcuucguggacugccugaucgagcagacccaccccgagaucagaaagagauacgaccaggaccugugcuacaccgacauccuguucaccgagcaggagagaggcgugggcaucaagagcacccccgugaccguggugcugcccgacaccaagggcaagagcuaccuguucaacaucauggacacccccggccacgugaacuucagcgacgaggugaccgccggccugagaaucagcgacggcguggugcuguucaucgacgccgccgagggcgugaugcugaacaccgagagacugaucaagcacgccgugcaggagagacuggccgugaccgugugcaucaacaagaucgacagacugauccuggagcugaagcugccccccaccgacgccuacuacaagcugagacacaucguggacgaggugaacggccugaucagcauguacagcaccgacgagaaccugauccugagcccccugcugggcaacgugugcuucagcagcagccaguacagcaucugcuucacccugggcagcuucgccaagaucuacgccgacaccuucggcgacaucaacuaccaggaguucgccaagagacuguggggcgacaucuacuucaaccccaagaccagaaaguucaccaagaaggcccccaccagcagcagccagagaagcuucguggaguucauccuggagccccuguacaagauccuggcccagguggugggcgacguggacaccagccugcccagaacccuggacgagcugggcauccaccugaccaaggaggagcugaagcugaacaucagaccccugcugagacuggugugcaagaaguucuucggcgaguucaccggcuucguggacaugugcgugcagcacauccccagccccaaggugggcgccaagcccaagaucgagcacaccuacaccggcggcguggacagcgaccugggcgaggccaugagcgacugcgaccccgacggcccccugaugugccacaccaccaagauguacagcaccgacgacggcgugcaguuccacgccuucggcagagugcugagcggcaccauccacgccggccagcccgugaaggugcugggcgagaacuacacccuggaggacgaggaggacagccagaucugcaccgugggcagacuguggaucagcguggccagauaccacaucgaggugaacagagugcccgccggcaacugggugcugaucgagggcguggaccagcccaucgugaagaccgccaccaucaccgagcccagaggcaacgaggaggcccagaucuucagaccccugaaguucaacaccaccagcgugaucaagaucgccguggagcccgugaaccccagcgagcugcccaagaugcuggacggccugagaaaggugaacaagagcuaccccagccugaccaccaagguggaggagagcggcgagcacgugauccugggcaccggcgagcuguaccuggacugcgugaugcacgaccugagaaagauguacagcgagaucgacaucaagguggccgaccccguggugaccuucugcgagaccgugguggagaccagcagccugaagugcuucgccgagacccccaacaagaagaacaagaucaccaugaucgccgagccccuggagaagggccuggccgaggacaucgagaacgagguggugcagaucaccuggaacagaaagaagcugggcgaguucuuccagaccaaguacgacugggaccugcuggccgccagaagcaucugggccuucggccccgacgccaccggccccaacauccugguggacgacacccugcccagcgagguggacaaggcccugcugggcagcgugaaggacagcaucgugcagggcuuccaguggggcaccagagagggcccccugugcgacgagcugaucagaaacgugaaguucaagauccuggacgccgugguggcccaggagccccugcacagaggcggcggccagaucauccccaccgccagaagagugguguacagcgccuuccugauggccacccccagacugauggagcccuacuacuucguggaggugcaggcccccgccgacugcgugagcgccguguacaccgugcuggccagaagaagaggccacgugacccaggacgcccccauccccggcagcccccuguacaccaucaaggccuucauccccgccaucgacagcuucggcuucgagaccgaccugagaacccacacccagggccaggccuucagccugagcguguuccaccacuggcagaucgugcccggcgacccccuggacaagagcaucgugaucagaccccuggagccccagcccgccccccaccuggccagagaguucaugaucaagaccagaagaagaaagggccugagcgaggacgugagcaucagcaaguucuucgacgaccccaugcugcuggagcuggccaagcaggacguggugcugaacuaccccauguaa

SEQ ID NO: 16479 - RNA, 3501 nt, Artificial Sequence
  EGF__Homo_sapiens__NP_001171601
augcugcugacccugaucauccugcugcccguggugagcaaguucagcuucgugagccugagcgccccccagcacuggagcugccccgagggcacccuggccggcaacggcaacagcaccugcgugggccccgcccccuuccugaucuucagccacggcaacagcaucuucagaaucgacaccgagggcaccaacuacgagcagcuggugguggacgccggcgugagcgugaucauggacuuccacuacaacgagaagagaaucuacuggguggaccuggagagacagcugcugcagagaguguuccugaacggcagcagacaggagagagugugcaacaucgagaagaacgugagcggcauggccaucaacuggaucaacgaggaggugaucuggagcaaccagcaggagggcaucaucaccgugaccgacaugaagggcaacaacagccacauccugcugagcgcccugaaguaccccgccaacguggccguggaccccguggagagauucaucuucuggagcagcgagguggccggcagccuguacagagccgaccuggacggcgugggcgugaaggcccugcuggagaccagcgagaagaucaccgccgugagccuggacgugcuggacaagagacuguucuggauccaguacaacagagagggcagcaacagccugaucugcagcugcgacuacgacggcggcagcgugcacaucagcaagcaccccacccagcacaaccuguucgccaugagccuguucggcgacagaaucuucuacagcaccuggaagaugaagaccaucuggaucgccaacaagcacaccggcaaggacauggugagaaucaaccugcacagcagcuucgugccccugggcgagcugaagguggugcacccccuggcccagcccaaggccgaggacgacaccugggagcccgagcagaagcugugcaagcugagaaagggcaacugcagcagcaccgugugcggccaggaccugcagagccaccugugcaugugcgccgagggcuacgcccugagcagagacagaaaguacugcgaggacgugaacgagugcgccuucuggaaccacggcugcacccugggcugcaagaacacccccggcagcuacuacugcaccugccccgugggcuucgugcugcugcccgacggcaagagaugccaccagcuggugagcugccccagaaacgugagcgagugcagccacgacugcgugcugaccagcgagggcccccugugcuucugccccgagggcagcgugcuggagagagacggcaagaccugcagcggcugcagcagccccgacaacggcggcugcagccagcugugcgugccccugagccccgugagcugggagugcgacugcuuccccggcuacgaccugcagcuggacgagaagagcugcgccgccagcggcccccagcccuuccugcuguucgccaacagccaggacaucagacacaugcacuucgacggcaccgacuacggcacccugcugagccagcagaugggcaugguguacgcccuggaccacgaccccguggagaacaagaucuacuucgcccacaccgcccugaaguggaucgagagagccaacauggacggcagccagagagagagacugaucgaggagggcguggacgugcccgagggccuggccguggacuggaucggcagaagauucuacuggaccgacagaggcaagagccugaucggcagaagcgaccugaacggcaagagaagcaagaucaucaccaaggagaacaucagccagcccagaggcaucgccgugcaccccauggccaagagacuguucuggaccgacaccggcaucaaccccagaaucgagagcagcagccugcagggccugggcagacuggugaucgccagcagcgaccugaucuggcccagcggcaucaccaucgacuuccugaccgacaagcuguacuggugcgacgccaagcagagcgugaucgagauggccaaccuggacggcagcaagagaagaagacugacccagaacgacgugggccaccccuucgccguggccguguucgaggacuacgugugguucagcgacugggccaugcccagcgugaugagagugaacaagagaaccggcaaggacagagugagacugcagggcagcaugcugaagcccagcagccuggugguggugcacccccuggccaagcccggcgccgaccccugccuguaccagaacggcggcugcgagcacaucugcaagaagagacugggcaccgccuggugcagcugcagagagggcuucaugaaggccagcgacggcaagaccugccuggcccuggacggccaccagcugcuggccggcggcgagguggaccugaagaaccaggugaccccccuggacauccugagcaagaccagagugagcgaggacaacaucaccgagagccagcacaugcugguggccgagaucauggugagcgaccaggacgacugcgcccccgugggcugcagcauguacgccagaugcaucagcgagggcgaggacgccaccugccagugccugaagggcuucgccggcgacggcaagcugugcagcgacaucgacgagugcgagaugggcgugcccgugugcccccccgccagcagcaagugcaucaacaccgagggcggcuacgugugcagaugcagcgagggcuaccagggcgacggcauccacugccuggacagcaccccccccccccaccugagagaggacgaccaccacuacagcgugagaaacagcgacagcgagugcccccugagccacgacggcuacugccugcacgacggcgugugcauguacaucgaggcccuggacaaguacgccugcaacugcguggugggcuacaucggcgagagaugccaguacagagaccugaaguggugggagcugagacacgccggccacggccagcagcagaaggugaucgugguggccgugugcgugguggugcuggugaugcugcugcugcugagccuguggggcgcccacuacuacagaacccagaagcugcugagcaagaaccccaagaaccccuacgaggagagcagcagagacgugagaagcagaagacccgccgacaccgaggacggcaugagcagcugcccccagcccugguucguggugaucaaggagcaccaggaccugaagaacggcggccagcccguggccggcgaggacggccaggccgccgacggcagcaugcagcccaccagcuggagacaggagccccagcugugcggcaugggcaccgagcagggcugcuggauccccgugagcagcgacaagggcagcugcccccaggugauggagagaagcuuccacaugcccagcuacggcacccagacccuggagggcggcguggagaagccccacagccugcugagcgccaacccccuguggcagcagagagcccuggaccccccccaccagauggagcugacccaguaa

SEQ ID NO: 16480 - RNA, 1665 nt, Artificial Sequence
  EGFL6__Homo_sapiens__NP_001161362
augccccugcccuggagccuggcccugccccugcugcugagcuggguggccggcggcuucggcaacgccgccagcgccagacaccacggccugcuggccagcgccagacagcccggcgugugccacuacggcaccaagcuggccugcugcuacggcuggagaagaaacagcaagggcgugugcgaggccaccugcgagcccggcugcaaguucggcgagugcgugggccccaacaagugcagaugcuuccccggcuacaccggcaagaccugcagccaggacgugaacgagugcggcaugaagcccagacccugccagcacagaugcgugaacacccacggcagcuacaagugcuucugccugagcggccacaugcugaugcccgacgccaccugcgugaacagcagaaccugcgccaugaucaacugccaguacagcugcgaggacaccgaggagggcccccagugccugugccccagcagcggccugagacuggcccccaacggcagagacugccuggacaucgacgagugcgccagcggcaaggugaucugccccuacaacagaagaugcgugaacaccuucggcagcuacuacugcaagugccacaucggcuucgagcugcaguacaucagcggcagauacgacugcaucgacaucaacgagugcaccauggacagccacaccugcagccaccacgccaacugcuucaacacccagggcagcuucaagugcaagugcaagcagggcuacaagggcaacggccugagaugcagcgccauccccgagaacagcgugaaggaggugcugagagcccccggcaccaucaaggacagaaucaagaagcugcuggcccacaagaacagcaugaagaagaaggccaagaucaagaacgugacccccgagcccaccagaacccccacccccaaggugaaccugcagcccuucaacuacgaggagaucgugagcagaggcggcaacagccacggcggcaagaagggcaacgaggagaagaugaaggagggccuggaggacgagaagagagaggagaaggcccugaagaacgacaucgaggagagaagccugagaggcgacguguucuuccccaaggugaacgaggccggcgaguucggccugauccuggugcagagaaaggcccugaccagcaagcuggagcacaaggccgaccugaacaucagcguggacugcagcuucaaccacggcaucugcgacuggaagcaggacagagaggacgacuucgacuggaaccccgccgacagagacaacgccaucggcuucuacauggccgugcccgcccuggccggccacaagaaggacaucggcagacugaagcugcugcugcccgaccugcagccccagagcaacuucugccugcuguucgacuacagacuggccggcgacaaggugggcaagcugagaguguucgugaagaacagcaacaacgcccuggccugggagaagaccaccagcgaggacgagaaguggaagaccggcaagauccagcuguaccagggcaccgacgccaccaagagcaucaucuucgaggccgagagaggcaagggcaagaccggcgagaucgccguggacggcgugcugcuggugagcggccugugccccgacagccugcugagcguggacgacuaa

SEQ ID NO: 16481 - RNA, 822 nt, Artificial Sequence
  EGFL7__Homo_sapiens__XP_011517068
augagaggcagccaggaggugcugcugauguggcugcuggugcuggccgugggcggcaccgagcacgccuacagacccggcagaagagugugcgccgugagagcccacggcgaccccgugagcgagagcuucgugcagagaguguaccagcccuuccugaccaccugcgacggccacagagccugcagcaccuacagaaccaucuacagaaccgccuacagaagaagccccggccuggcccccgccagacccagauacgccugcugccccggcuggaagagaaccagcggccugcccggcgccugcggcgccgccaucugccagccccccugcagaaacggcggcagcugcgugcagcccggcagaugcagaugccccgccggcuggagaggcgacaccugccagagcgacguggacgagugcagcgccagaagaggcggcugcccccagagaugcgugaacaccgccggcagcuacuggugccagugcugggagggccacagccugagcgccgacggcacccugugcgugcccaagggcggcccccccagaguggcccccaaccccaccggcguggacagcgccaugaaggaggaggugcagagacugcagagcagaguggaccugcuggaggagaagcugcagcuggugcuggccccccugcacagccuggccagccaggcccuggagcacggccugcccgaccccggcagccugcuggugcacagcuuccagcagcugggcagaaucgacagccugagcgagcagaucagcuuccuggaggagcagcugggcagcugcagcugcaagaaggacagcuaa

SEQ ID NO: 16482 - RNA, 882 nt, Artificial Sequence
  EGFL8__Homo_sapiens__NP_085155
augggcagcagagccgagcugugcacccugcugggcggcuucagcuuccugcugcugcugauccccggcgagggcgccaagggcggcagccugagagagagccagggcgugugcagcaagcagacccugguggugccccugcacuacaacgagagcuacagccagcccguguacaagcccuaccugacccugugcgccggcagaagaaucugcagcaccuacagaaccauguacagagugauguggagagaggugagaagagaggugcagcagacccacgccgugugcugccagggcuggaagaagagacaccccggcgcccugaccugcgaggccaucugcgccaagcccugccugaacggcggcgugugcgugagacccgaccagugcgagugcgcccccggcuggggcggcaagcacugccacguggacguggacgagugcagaaccagcaucacccugugcagccaccacugcuucaacaccgccggcagcuucaccugcggcugcccccacgaccuggugcugggcguggacggcagaaccugcauggagggcagccccgagccccccaccagcgccagcauccugagcguggccgugagagaggccgagaaggacgagagagcccugaagcaggagauccacgagcugagaggcagacuggagagacuggagcagugggccggccaggccggcgccugggugagagccgugcugcccgugccccccgaggagcugcagcccgagcagguggccgagcuguggggcagaggcgacagaaucgagagccugagcgaccaggugcugcugcuggaggagagacugggcgccugcagcugcgaggacaacagccugggccugggcgugaaccacagauaa

SEQ ID NO: 16483 - RNA, 3054 nt, Artificial Sequence
  EGFLAM__Homo_sapiens__NP_001192230
auggaccugaucagaggcgugcugcugagacugcugcugcuggccagcagccugggccccggcgccgugagccugagagccgccaucagaaagcccggcaaggugggccccccccuggacaucaagcugggcgcccugaacugcaccgccuucagcauccaguggaagaugcccagacaccccggcagccccauccugggcuacaccguguucuacagcgaggugggcgccgacaagagccugcaggagcagcugcacagcgugccccugagcagagacauccccaccaccgaggaggugaucggcgaccugaagcccggcaccgaguacagagugagcaucgccgccuacagccaggccggcaagggcagacugagcagccccagacacgugaccacccugagccaggacagcugccugccccccgccgccccccagcagccccacgugaucguggugagcgacagcgagguggcccugagcuggaagcccggcgccagcgagggcagcgcccccauccaguacuacagcguggaguucaucagacccgacuucgacaagaaguggaccagcauccacgagagaauccagauggacagcauggugaucaagggccuggaccccgacaccaacuaccaguucgccgugagagccaugaacagccacggccccagccccagaagcuggcccagcgacaucaucagaacccugugccccgaggaggccggcagcggcagauacggccccagauacaucaccgacaugggcgccggcgaggacgacgagggcuucgaggacgaccuggaccuggacaucagcuucgaggaggugaagccccugcccgccaccaagggcggcaacaagaaguuccugguggagagcaagaagaugagcaucagcaaccccaagaccaucagcagacugaucccccccaccagcgccagccugcccgugaccaccguggccccccagcccauccccauccagagaaagggcaagaacggcguggccaucaugagcagacuguucgacaugcccugcgacgagacccugugcagcgccgacagcuucugcgugaacgacuacaccuggggcggcagcagaugccagugcacccugggcaagggcggcgagagcugcagcgaggacaucgugauccaguacccccaguucuucggccacagcuacgugaccuucgagccccugaagaacagcuaccaggccuuccagaucacccuggaguucagagccgaggccgaggacggccugcugcuguacugcggcgagaacgagcacggcagaggcgacuucaugagccuggccaucaucagaagaagccugcaguucagauucaacugcggcaccggcguggccaucaucgugagcgagaccaagaucaagcugggcggcuggcacaccgugaugcuguacagagacggccugaacggccugcugcagcugaacaacggcacccccgugaccggccagagccagggccaguacagcaagaucaccuucagaaccccccuguaccugggcggcgcccccagcgccuacuggcuggugagagccaccggcaccaacagaggcuuccagggcugcgugcagagccuggccgugaacggcagaagaaucgacaugagacccuggccccugggcaaggcccugagcggcgccgacgugggcgagugcagcagcggcaucugcgacgaggccagcugcauccacggcggcaccugcaccgccaucaaggccgacagcuacaucugccugugcccccugggcuucaagggcagacacugcgaggacgccuucacccugaccaucccccaguucagagagagccugagaagcuacgccgccacccccuggccccuggagccccagcacuaccugagcuucauggaguucgagaucaccuucagacccgacagcggcgacggcgugcugcuguacagcuacgacaccggcagcaaggacuuccugagcaucaaccuggccggcggccacguggaguucagauucgacugcggcagcggcaccggcgugcugagaagcgaggacccccugacccugggcaacuggcacgagcugagagugagcagaaccgccaagaacggcauccugcagguggacaagcagaagaucguggagggcauggccgagggcggcuucacccagaucaagugcaacaccgacaucuucaucggcggcgugcccaacuacgacgacgugaagaagaacagcggcgugcugaagcccuucagcggcagcauccagaagaucauccugaacgacagaaccauccacgugaagcacgacuucaccagcggcgugaacguggagaacgccgcccaccccugcgugagagcccccugcgcccacggcggcagcugcagacccagaaaggagggcuacgacugcgacugcccccugggcuucgagggccugcacugccagaaggagugcggcaacuacugccugaacaccaucaucgaggccaucgagaucccccaguucaucggcagaagcuaccugaccuacgacaaccccgacauccugaagagagugagcggcagcagaagcaacguguucaugagauucaagaccaccgccaaggacggccugcugcuguggagaggcgacagccccaugagacccaacagcgacuucaucagccugggccugagagacggcgcccugguguucagcuacaaccugggcagcggcguggccagcaucauggugaacggcagcuucaacgacggcagauggcacagagugaaggccgugagagacggccagagcggcaagaucaccguggacgacuacggcgccagaaccggcaagagccccggcaugaugagacagcugaacaucaacggcgcccuguacgugggcggcaugaaggagaucgcccugcacaccaacagacaguacaugagaggccuggugggcugcaucagccacuucacccugagcaccgacuaccacaucagccugguggaggacgccguggacggcaagaacaucaacaccugcggcgccaaguaa

SEQ ID NO: 16484 - RNA, 3633 nt, Artificial Sequence
  EGFR__Homo_sapiens__NP_005219
augagacccagcggcaccgccggcgccgcccugcuggcccugcuggccgcccugugccccgccagcagagcccuggaggagaagaaggugugccagggcaccagcaacaagcugacccagcugggcaccuucgaggaccacuuccugagccugcagagaauguucaacaacugcgagguggugcugggcaaccuggagaucaccuacgugcagagaaacuacgaccugagcuuccugaagaccauccaggagguggccggcuacgugcugaucgcccugaacaccguggagagaaucccccuggagaaccugcagaucaucagaggcaacauguacuacgagaacagcuacgcccuggccgugcugagcaacuacgacgccaacaagaccggccugaaggagcugcccaugagaaaccugcaggagauccugcacggcgccgugagauucagcaacaaccccgcccugugcaacguggagagcauccaguggagagacaucgugagcagcgacuuccugagcaacaugagcauggacuuccagaaccaccugggcagcugccagaagugcgaccccagcugccccaacggcagcugcuggggcgccggcgaggagaacugccagaagcugaccaagaucaucugcgcccagcagugcagcggcagaugcagaggcaagagccccagcgacugcugccacaaccagugcgccgccggcugcaccggccccagagagagcgacugccuggugugcagaaaguucagagacgaggccaccugcaaggacaccugccccccccugaugcuguacaaccccaccaccuaccagauggacgugaaccccgagggcaaguacagcuucggcgccaccugcgugaagaagugccccagaaacuacguggugaccgaccacggcagcugcgugagagccugcggcgccgacagcuacgagauggaggaggacggcgugagaaagugcaagaagugcgagggccccugcagaaaggugugcaacggcaucggcaucggcgaguucaaggacagccugagcaucaacgccaccaacaucaagcacuucaagaacugcaccagcaucagcggcgaccugcacauccugcccguggccuucagaggcgacagcuucacccacacccccccccuggacccccaggagcuggacauccugaagaccgugaaggagaucaccggcuuccugcugauccaggccuggcccgagaacagaaccgaccugcacgccuucgagaaccuggagaucaucagaggcagaaccaagcagcacggccaguucagccuggccguggugagccugaacaucaccagccugggccugagaagccugaaggagaucagcgacggcgacgugaucaucagcggcaacaagaaccugugcuacgccaacaccaucaacuggaagaagcuguucggcaccagcggccagaagaccaagaucaucagcaacagaggcgagaacagcugcaaggccaccggccaggugugccacgcccugugcagccccgagggcugcuggggccccgagcccagagacugcgugagcugcagaaacgugagcagaggcagagagugcguggacaagugcaaccugcuggagggcgagcccagagaguucguggagaacagcgagugcauccagugccaccccgagugccugccccaggccaugaacaucaccugcaccggcagaggccccgacaacugcauccagugcgcccacuacaucgacggcccccacugcgugaagaccugccccgccggcgugaugggcgagaacaacacccugguguggaaguacgccgacgccggccacgugugccaccugugccaccccaacugcaccuacggcugcaccggccccggccuggagggcugccccaccaacggccccaagauccccagcaucgccaccggcauggugggcgcccugcugcugcugcuggugguggcccugggcaucggccuguucaugagaagaagacacaucgugagaaagagaacccugagaagacugcugcaggagagagagcugguggagccccugacccccagcggcgaggcccccaaccaggcccugcugagaauccugaaggagaccgaguucaagaagaucaaggugcugggcagcggcgccuucggcaccguguacaagggccuguggauccccgagggcgagaaggugaagauccccguggccaucaaggagcugagagaggccaccagccccaaggccaacaaggagauccuggacgaggccuacgugauggccagcguggacaacccccacgugugcagacugcugggcaucugccugaccagcaccgugcagcugaucacccagcugaugcccuucggcugccugcuggacuacgugagagagcacaaggacaacaucggcagccaguaccugcugaacuggugcgugcagaucgccaagggcaugaacuaccuggaggacagaagacuggugcacagagaccuggccgccagaaacgugcuggugaagaccccccagcacgugaagaucaccgacuucggccuggccaagcugcugggcgccgaggagaaggaguaccacgccgagggcggcaaggugcccaucaaguggauggcccuggagagcauccugcacagaaucuacacccaccagagcgacguguggagcuacggcgugaccgugugggagcugaugaccuucggcagcaagcccuacgacggcauccccgccagcgagaucagcagcauccuggagaagggcgagagacugccccagccccccaucugcaccaucgacguguacaugaucauggugaagugcuggaugaucgacgccgacagcagacccaaguucagagagcugaucaucgaguucagcaagauggccagagacccccagagauaccuggugauccagggcgacgagagaaugcaccugcccagccccaccgacagcaacuucuacagagcccugauggacgaggaggacauggacgacgugguggacgccgacgaguaccugaucccccagcagggcuucuucagcagccccagcaccagcagaaccccccugcugagcagccugagcgccaccagcaacaacagcaccguggccugcaucgacagaaacggccugcagagcugccccaucaaggaggacagcuuccugcagagauacagcagcgaccccaccggcgcccugaccgaggacagcaucgacgacaccuuccugcccgugcccgaguacaucaaccagagcgugcccaagagacccgccggcagcgugcagaaccccguguaccacaaccagccccugaaccccgcccccagcagagacccccacuaccaggacccccacagcaccgccgugggcaaccccgaguaccugaacaccgugcagcccaccugcgugaacagcaccuucgacagccccgcccacugggcccagaagggcagccaccagaucagccuggacaaccccgacuaccagcaggacuucuuccccaaggaggccaagcccaacggcaucuucaagggcagcaccgccgagaacgccgaguaccugagaguggccccccagagcagcgaguucaucggcgccuaa

SEQ ID NO: 16485 - RNA, 1281 nt, Artificial Sequence
  EGLN1__Homo_sapiens__NP_071334
auggccaacgacagcggcggccccggcggccccagccccagcgagagagacagacaguacugcgagcugugcggcaagauggagaaccugcugagaugcagcagaugcagaagcagcuucuacugcugcaaggagcaccagagacaggacuggaagaagcacaagcuggugugccagggcagcgagggcgcccugggccacggcgugggcccccaccagcacagcggccccgccccccccgccgccgugcccccccccagagccggcgccagagagcccagaaaggccgccgccagaagagacaacgccagcggcgacgccgccaagggcaaggugaaggccaagccccccgccgaccccgccgccgccgccagccccugcagagccgccgccggcggccagggcagcgccguggccgccgaggccgagcccggcaaggaggagccccccgccagaagcagccuguuccaggagaaggccaaccuguacccccccagcaacacccccggcgacgcccugagccccggcggcggccugagacccaacggccagaccaagccccugcccgcccugaagcuggcccuggaguacaucgugcccugcaugaacaagcacggcaucugcgugguggacgacuuccugggcaaggagaccggccagcagaucggcgacgaggugagagcccugcacgacaccggcaaguucaccgacggccagcuggugagccagaagagcgacagcagcaaggacaucagaggcgacaagaucaccuggaucgagggcaaggagcccggcugcgagaccaucggccugcugaugagcagcauggacgaccugaucagacacugcaacggcaagcugggcagcuacaagaucaacggcagaaccaaggccaugguggccugcuaccccggcaacggcaccggcuacgugagacacguggacaaccccaacggcgacggcagaugcgugaccugcaucuacuaccugaacaaggacugggacgccaaggugagcggcggcauccugagaaucuuccccgagggcaaggcccaguucgccgacaucgagcccaaguucgacagacugcuguucuucuggagcgacagaagaaacccccacgaggugcagcccgccuacgccaccagauacgccaucaccgugugguacuucgacgccgacgagagagccagagccaaggugaaguaccugaccggcgagaagggcgugagaguggagcugaacaagcccagcgacagcgugggcaaggacguguucuaa

SEQ ID NO: 16486 - RNA, 1224 nt, Artificial Sequence
  EGLN2__Homo_sapiens__NP_444274
auggacagccccugccagccccagccccugagccaggcccugccccagcugcccggcagcagcagcgagccccuggagcccgagcccggcagagccagaaugggcguggagagcuaccugcccugcccccugcugcccagcuaccacugccccggcgugcccagcgaggccagcgccggcagcggcacccccagagccaccgccaccagcaccaccgccagcccccugagagacggcuucggcggccaggacggcggcgagcugagaccccugcagagcgagggcgccgccgcccuggugaccaagggcugccagagacuggccgcccagggcgccagacccgaggcccccaagagaaagugggccgaggacggcggcgacgcccccagccccagcaagagacccugggccagacaggagaaccaggaggccgagagagagggcggcaugagcugcagcugcagcagcggcagcggcgaggccagcgccggccugauggaggaggcccugcccagcgcccccgagagacuggcccuggacuacaucgugcccugcaugagauacuacggcaucugcgugaaggacagcuuccugggcgccgcccugggcggcagagugcuggccgagguggaggcccugaagagaggcggcagacugagagacggccagcuggugagccagagagccaucccccccagaagcaucagaggcgaccagaucgccuggguggagggccacgagcccggcugcagaagcaucggcgcccugauggcccacguggacgccgugaucagacacugcgccggcagacugggcagcuacgugaucaacggcagaaccaaggccaugguggccugcuaccccggcaacggccugggcuacgugagacacguggacaacccccacggcgacggcagaugcaucaccugcaucuacuaccugaaccagaacugggacgugaaggugcacggcggccugcugcagaucuuccccgagggcagacccgugguggccaacaucgagccccuguucgacagacugcugaucuucuggagcgacagaagaaacccccacgaggugaagcccgccuacgccaccagauacgccaucaccgugugguacuucgacgccaaggagagagccgccgccaaggacaaguaccagcuggccagcggccagaagggcgugcaggugcccgugagccagccccccacccccaccuaa

SEQ ID NO: 16487 - RNA, 720 nt, Artificial Sequence
  EGLN3__Homo_sapiens__NP_071356
augccccugggccacaucaugagacuggaccuggagaagaucgcccuggaguacaucgugcccugccugcacgaggugggcuucugcuaccuggacaacuuccugggcgagguggugggcgacugcgugcuggagagagugaagcagcugcacugcaccggcgcccugagagacggccagcuggccggccccagagccggcgugagcaagagacaccugagaggcgaccagaucaccuggaucggcggcaacgaggagggcugcgaggccaucagcuuccugcugagccugaucgacagacuggugcuguacugcggcagcagacugggcaaguacuacgugaaggagagaagcaaggccaugguggccugcuaccccggcaacggcaccggcuacgugagacacguggacaaccccaacggcgacggcagaugcaucaccugcaucuacuaccugaacaagaacugggacgccaagcugcacggcggcauccugagaaucuuccccgagggcaagagcuucaucgccgacguggagcccaucuucgacagacugcuguucuucuggagcgacagaagaaacccccacgaggugcagcccagcuacgccaccagauacgccaugaccgugugguacuucgacgccgaggagagagccgaggccaagaagaaguucagaaaccugaccagaaagaccgagagcgcccugaccgaggacuaa

SEQ ID NO: 16488 - RNA, 1632 nt, Artificial Sequence
  EGR1__Homo_sapiens__NP_001955
auggccgccgccaaggccgagaugcagcugaugagcccccugcagaucagcgaccccuucggcagcuucccccacagccccaccauggacaacuaccccaagcuggaggagaugaugcugcugagcaacggcgccccccaguuccugggcgccgccggcgcccccgagggcagcggcagcaacagcagcagcagcagcagcggcggcggcggcggcggcggcggcggcagcaacagcagcagcagcagcagcaccuucaacccccaggccgacaccggcgagcagcccuacgagcaccugaccgccgagagcuuccccgacaucagccugaacaacgagaaggugcugguggagaccagcuaccccagccagaccaccagacugccccccaucaccuacaccggcagauucagccuggagcccgcccccaacagcggcaacacccuguggcccgagccccuguucagccuggugagcggccuggugagcaugaccaacccccccgccagcagcagcagcgcccccagccccgccgccagcagcgccagcgccagccagagccccccccugagcugcgccgugcccagcaacgacagcagccccaucuacagcgccgcccccaccuuccccacccccaacaccgacaucuuccccgagccccagagccaggccuuccccggcagcgccggcaccgcccugcaguaccccccccccgccuaccccgccgccaagggcggcuuccaggugcccaugauccccgacuaccuguucccccagcagcagggcgaccugggccugggcacccccgaccagaagcccuuccagggccuggagagcagaacccagcagcccagccugaccccccugagcaccaucaaggccuucgccacccagagcggcagccaggaccugaaggcccugaacaccagcuaccagagccagcugaucaagcccagcagaaugagaaaguaccccaacagacccagcaagacccccccccacgagagacccuacgccugccccguggagagcugcgacagaagauucagcagaagcgacgagcugaccagacacaucagaauccacaccggccagaagcccuuccagugcagaaucugcaugagaaacuucagcagaagcgaccaccugaccacccacaucagaacccacaccggcgagaagcccuucgccugcgacaucugcggcagaaaguucgccagaagcgacgagagaaagagacacaccaagauccaccugagacagaaggacaagaaggccgacaagagcgugguggccagcagcgccaccagcagccugagcagcuaccccagccccguggccaccagcuaccccagccccgugaccaccagcuaccccagccccgccaccaccagcuaccccagccccgugcccaccagcuucagcagccccggcagcagcaccuaccccagccccgugcacagcggcuuccccagccccagcguggccaccaccuacagcagcgugccccccgccuuccccgcccaggugagcagcuuccccagcagcgccgugaccaacagcuucagcgccagcaccggccugagcgacaugaccgccaccuucagccccagaaccaucgagaucugcuaa

SEQ ID NO: 16489 - RNA, 1431 nt, Artificial Sequence
  EGR2__Homo_sapiens__NP_001129650
augaugaccgccaaggccguggacaagauccccgugacccugagcggcuucgugcaccagcugagcgacaacaucuaccccguggaggaccuggccgccaccagcgugaccaucuuccccaacgccgagcugggcggccccuucgaccagaugaacggcguggccggcgacggcaugaucaacaucgacaugaccggcgagaagagaagccuggaccugcccuaccccagcagcuucgcccccgugagcgcccccagaaaccagaccuucaccuacaugggcaaguucagcaucgacccccaguaccccggcgccagcugcuaccccgagggcaucaucaacaucgugagcgccggcauccugcagggcgugaccagccccgccagcaccaccgccagcagcagcgugaccagcgccagccccaacccccuggccaccggcccccugggcgugugcaccaugagccagacccagcccgaccuggaccaccuguacagccccccccccccccccccccccuacagcggcugcgccggcgaccuguaccaggaccccagcgccuuccugagcgccgccaccaccagcaccagcagcagccuggccuacccccccccccccagcuaccccagccccaagcccgccaccgaccccggccuguuccccaugauccccgacuaccccggcuucuuccccagccagugccagagagaccugcacggcaccgccggccccgacagaaagcccuuccccugcccccuggacacccugagagugccccccccccugaccccccugagcaccaucagaaacuucacccugggcggccccagcgccggcgugaccggccccggcgccagcggcggcagcgagggccccagacugcccggcagcagcagcgccgccgccgccgccgccgccgccgccgccuacaacccccaccaccugccccugagacccauccugagacccagaaaguaccccaacagacccagcaagacccccgugcacgagagacccuaccccugccccgccgagggcugcgacagaagauucagcagaagcgacgagcugaccagacacaucagaauccacaccggccacaagcccuuccagugcagaaucugcaugagaaacuucagcagaagcgaccaccugaccacccacaucagaacccacaccggcgagaagcccuucgccugcgacuacugcggcagaaaguucgccagaagcgacgagagaaagagacacaccaagauccaccugagacagaaggagagaaagagcagcgcccccagcgccagcgugcccgcccccagcaccgccagcugcagcggcggcgugcagcccggcggcacccugugcagcagcaacagcagcagccugggcggcggcccccuggcccccugcagcagcagaaccagaacccccuaa

SEQ ID NO: 16490 - RNA, 1002 nt, Artificial Sequence
  EGR3__Homo_sapiens__NP_001186810
auggacaucggccugaccaacgagaagcccaaccccgagcugagcuacagcggcagcuuccagcccgcccccggcaacaagaccgugaccuaccugggcaaguucgccuucgacagccccagcaacuggugccaggacaacaucaucagccugaugagcgccggcauccugggcgugccccccgccagcggcgcccugagcacccagaccagcaccgccagcauggugcagcccccccagggcgacguggaggccauguaccccgcccugccccccuacagcaacugcggcgaccuguacagcgagcccgugagcuuccacgacccccagggcaaccccggccuggccuacagcccccaggacuaccagagcgccaagcccgcccuggacagcaaccuguuccccaugauccccgacuacaaccuguaccaccaccccaacgacaugggcagcauccccgagcacaagcccuuccagggcauggaccccaucagagugaaccccccccccaucaccccccuggagaccaucaaggccuucaaggacaagcagauccaccccggcuucggcagccugccccagcccccccugacccugaagcccaucagacccagaaaguaccccaacagacccagcaagaccccccugcacgagagaccccacgccugccccgccgagggcugcgacagaagauucagcagaagcgacgagcugaccagacaccugagaauccacaccggccacaagcccuuccagugcagaaucugcaugagaagcuucagcagaagcgaccaccugaccacccacaucagaacccacaccggcgagaagcccuucgccugcgaguucugcggcagaaaguucgccagaagcgacgagagaaagagacacgccaagauccaccugaagcagaaggagaagaaggccgagaagggcggcgcccccagcgccagcagcgccccccccgugagccuggcccccguggugaccaccugcgccuaa

SEQ ID NO: 16491 - RNA, 1770 nt, Artificial Sequence
  EGR4__Homo_sapiens__NP_001956
auggccguggccagaggcgugggcagccccgagcccgcccccccccagcuguacaaguggggcggcugcggccugggcgagcccggcagcgcccuggagagaagaggcgccgccgccagaggcagaugcggcagagccagagcccccagacugcccgacagcuuccccagaggcgagugccccaagcccggcgccagagcccccagaagcgugagaugcggcgagccccugccccccgccagccccccccccgccagaccccaggcccagagagccagacccagagccccccacagcagaagaagagccaugcugcaccugagcgaguucagcgagcccgacgcccugcuggugaagagcaccgagggcugcugcgccgagcccagcgccgagcugcccagacugcccgccagagacgcccccgccgccaccggcuaccccggcgccggcgacuuccugagcugggcccugaacagcugcggcgccagcggcgaccuggccgacagcugcuuccuggagggccccgcccccacccccccccccggccugagcuacagcggcagcuucuucauccaggccgugcccgagcacccccacgaccccgaggcccuguucaaccugaugagcggcauccugggccuggcccccuuccccggccccgaggccgccgccagcagaagcccccuggacgcccccuuccccgccggcagcgacgcccugcugcccggcccccccgaccuguacagccccgaccugggcgccgcccccuuccccgaggccuucugggaggccagccccugcgccggcgcccccagccagugccuguacgagccccagcugagcccccccgacgugaagcccggccugagagccccccccgccagccccgcccuggacgccgugagcgccuucaagggccccuacgcccccugggagcugcugagcgugggcgcccccggcaacugcggcagccagggcgacuaccaggccgcccccgaggccagauuccccgugaucggcaccaagaucgaggaccugcugagcaucagcugccccgccgagcugcccgccgugcccgccaacagacuguaccccagcggcgccuacgacgccuucccccuggcccccggcgaccugggcgagggcgccgagggccugcccggccugcugaccccccccagcggcgagggcggcagcagcggcgacggcggcgaguuccuggccagcacccagccccagcugagcccccugggccugagaagcgccgccgccgccgacuuccccaagccccugguggccgacauccccggcagcagcggcguggccgccccccccgugcccccccccccccccacccccuucccccaggccaaggccagaagaaagggcagaagaggcggcaagugcagcaccagaugcuucugccccagaccccacgccaaggccuucgccugccccguggagagcugcgugagaagcuucgccagaagcgacgagcugaacagacaccugagaauccacaccggccacaagcccuuccagugcagaaucugccugagaaacuucagcagaagcgaccaccugaccacccacgugagaacccacaccggcgagaagcccuucgccugcgacgugugcggcagaagauucgccagaagcgacgagaagaagagacacagcaaggugcaccugaagcagaaggccagagccgaggagagacugaagggccugggcuucuacagccugggccugagcuucgccagccuguaa

SEQ ID NO: 16492 - RNA, 3483 nt, Artificial Sequence
  EHBP1__Homo_sapiens__NP_001136087
auggccagcguguggaagagacugcagagagugggcaagcacgccagcaaguuccaguucguggccagcuaccaggagcugaugguggagugcaccaagaaguggcagcccgacaagcugguggugguguggaccagaagaagcagaagaaagagcagcaaggcccacagcuggcagcccggcaucaagaaccccuacagaggcguggugguguggcccgugcccgagaacaucgagaucaccgugacccuguucaaggacccccacgccgaggaguucgaggacaaggaguggaccuucgugaucgagaacgagagccccagcggcagaagaaaggcccuggccaccagcagcaucaacaugaagcaguacgccagccccaugcccacccagaccgacgugaagcugaaguucaagccccugagcaagaagguggugagcgccgcccugcaguucagccugagcugcaucuuccugagagagggcaaggccaccgacgaggacaugcagagccuggccagccugaugagcaugaagcaggccgacaucggcaaccuggacgacuucgaggaggacaacgaggacgacgacgagaacagagugaaccaggaggagaaggccgccaagaucaccgagcugaucaacaagcugaacuuccuggacgaggccgagaaggaccuggccaccgugaacagcaaccccuucgacgaccccgacgccgccgagcugaaccccuucggcgaccccgacagcgaggagcccaucaccgagaccgccagccccagaaagaccgaggacagcuucuacaacaacagcuacaaccccuucaaggaggugcagaccccccaguaccugaaccccuucgacgagcccgaggccuucgugaccaucaaggacagccccccccagagcaccaagagaaagaacaucagacccguggacaugagcaaguaccuguacgccgacagcagcaagaccgaggaggaggagcuggacgagagcaaccccuucuacgagcccaagagcacccccccccccaacaaccuggugaaccccgugcaggagcuggagaccgagagaagagugaagagaaaggcccccgccccccccgugcugagccccaagaccggcgugcugaacgagaacaccgugagcgccggcaaggaccugagcaccagccccaagcccagccccauccccagccccgugcugggcagaaagcccaacgccagccagagccugcugguguggugcaaggaggugaccaagaacuacagaggcgugaagaucaccaacuucaccaccagcuggagaaacggccugagcuucugcgccauccugcaccacuucagacccgaccugaucgacuacaagagccugaacccccaggacaucaaggagaacaacaagaaggccuacgacggcuucgccagcaucggcaucagcagacugcuggagcccagcgacauggugcugcuggccauccccgacaagcugaccgugaugaccuaccuguaccagaucagagcccacuucagcggccaggagcugaacguggugcagaucgaggagaacagcagcaagagcaccuacaaggugggcaacuacgagaccgacaccaacagcagcguggaccaggagaaguucuacgccgagcugagcgaccugaagagagagcccgagcugcagcagcccaucagcggcgccguggacuuccugagccaggacgacagcguguucgugaacgacagcggcgugggcgagagcgagagcgagcaccagacccccgacgaccaccugagccccagcaccgccagccccuacugcagaagaaccaagagcgacaccgagccccagaagagccagcagagcagcggcagaaccagcggcagcgacgaccccggcaucugcagcaacaccgacagcacccaggcccaggugcugcugggcaagaagagacugcugaaggccgagacccuggagcugagcgaccuguacgugagcgacaagaagaaggacaugagcccccccuucaucugcgaggagaccgacgagcagaagcugcagacccuggacaucggcagcaaccuggagaaggagaagcuggagaacagcagaagccuggagugcagaagcgaccccgagagccccaucaagaagaccagccugagccccaccagcaagcugggcuacagcuacagcagagaccuggaccuggccaagaagaagcacgccagccugagacagaccgagagcgaccccgacgccgacagaaccacccugaaccacgccgaccacagcagcaagaucgugcagcacagacugcugagcagacaggaggagcugaaggagagagccagagugcugcuggagcaggccagaagagacgccgcccugaaggccggcaacaagcacaacaccaacaccgccacccccuucugcaacagacagcugagcgaccagcaggacgaggagagaagaagacagcugagagagagagccagacagcugaucgccgaggccagaagcggcgugaagaugagcgagcugcccagcuacggcgagauggccgccgagaagcugaaggagagaagcaaggccagcggcgagcagaacagcaagcugguggaccugaagcugaagaagcugcuggaggugcagccccagguggccaacagccccagcagcgccgcccagaaggccgugaccgagagcagcgagcaggacaugaagagcggcaccgaggaccugagaaccgagagacugcagaagaccaccgagagauucagaaaccccgugguguucagcaaggacagcaccgugagaaagacccagcugcagagcuucagccaguacaucgagaacagacccgagaugaagagacagagaagcauccaggaggacaccaagaagggcaacgaggagaaggccgccaucaccgagacccagagaaagcccagcgaggacgaggugcugaacaagggcuucaaggacaccagccaguacguggugggcgagcuggccgcccuggagaacgagcagaagcagaucgacaccagagccgcccugguggagaagagacugagauaccugauggacaccggcagaaacaccgaggaggaggaggccaugaugcaggagugguucaugcuggugaacaagaagaacgcccugaucagaagaaugaaccagcugagccugcuggagaaggagcacgaccuggagagaagauacgagcugcugaacagagagcugagagccaugcuggccaucgaggacuggcagaagaccgaggcccagaagagaagagagcagcugcugcuggacgagcugguggcccuggugaacaagagagacgcccuggugagagaccuggacgcccaggagaagcaggccgaggaggaggacgagcaccuggagagaacccuggagcagaacaagggcaagauggccaagaaggaggagaagugcgugcugcaguaa

SEQ ID NO: 16493 - RNA, 1647 nt, Artificial Sequence
  EHD1__Homo_sapiens__NP_001269374
auggagcagcccggcaccgccgccagccccgugagcggcagcauguucagcugggugagcaaggacgccagaagaaagaaggagcccgagcuguuccagaccguggccgagggccugagacagcuguacgcccagaagcugcugccccuggaggagcacuacagauuccacgaguuccacagccccgcccuggaggacgccgacuucgacaacaagcccauggugcugcuggugggccaguacagcaccggcaagaccaccuucaucagacaccugaucgagcaggacuuccccggcaugagaaucggccccgagcccaccaccgacagcuucaucgccgugaugcacggccccaccgagggcguggugcccggcaacgcccuggugguggaccccagaagacccuucagaaagcugaacgccuucggcaacgccuuccugaacagauucaugugcgcccagcugcccaaccccgugcuggacagcaucagcaucaucgacacccccggcauccugagcggcgagaagcagagaaucagcagaggcuacgacuucgccgccgugcuggagugguucgccgagagaguggacagaaucauccugcuguucgacgcccacaagcuggacaucagcgacgaguucagcgaggugaucaaggcccugaagaaccacgaggacaagaucagaguggugcugaacaaggccgaccagaucgagacccagcagcugaugagaguguacggcgcccugauguggagccugggcaagaucaucaacacccccgagguggugagaguguacaucggcagcuucuggagccacccccugcugauccccgacaacagaaagcuguucgaggccgaggagcaggaccuguucaaggacauccagagccugcccagaaacgccgcccugagaaagcugaacgaccugaucaagagagccagacuggccaaggugcacgccuacaucaucagcagccugaagaaggagaugcccaacguguucggcaaggagagcaagaagaaggagcuggugaacaaccugggcgagaucuaccagaagaucgagagagagcaccagaucagccccggcgacuuccccagccugagaaagaugcaggagcugcugcagacccaggacuucagcaaguuccaggcccugaagcccaagcugcuggacaccguggacgacaugcuggccaacgacaucgccagacugauggugauggugagacaggaggagagccugaugcccagccagguggugaagggcggcgccuucgacggcaccaugaacggccccuucggccacggcuacggcgagggcgccggcgagggcaucgacgacguggaguggguggugggcaaggacaagcccaccuacgacgagaucuucuacacccugagccccgugaacggcaagaucaccggcgccaacgccaagaaggagauggugaagagcaagcugcccaacaccgugcugggcaagaucuggaagcuggccgacguggacaaggacggccugcuggacgacgaggaguucgcccuggccaaccaccugaucaaggugaagcuggagggccacgagcugcccgccgaccugcccccccaccuggugccccccagcaagagaagacacgaguaa

SEQ ID NO: 16494 - RNA, 1632 nt, Artificial Sequence
  EHD2__Homo_sapiens__NP_055416
auguucagcuggcugaagagaggcggcgccagaggccagcagcccgaggccaucagaaccgugaccagcgcccugaaggagcuguacagaaccaagcugcugccccuggaggagcacuacagauucggcgccuuccacagccccgcccuggaggacgccgacuucgacggcaagcccauggugcugguggccggccaguacagcaccggcaagaccagcuucauccaguaccugcuggagcaggaggugcccggcagcagagugggccccgagcccaccaccgacugcuucguggccgugaugcacggcgacaccgagggcaccgugcccggcaacgcccuggugguggaccccgacaagcccuucagaaagcugaaccccuucggcaacaccuuccugaacagauucaugugcgcccagcugcccaaccaggugcuggagagcaucagcaucaucgacacccccggcauccugagcggcgccaagcagagagugagcagaggcuacgacuuccccgccgugcugagaugguucgccgagagaguggaccugaucauccugcuguucgacgcccacaagcuggagaucagcgacgaguucagcgaggccaucggcgcccugagaggccacgaggacaagaucagaguggugcugaacaaggccgacaugguggagacccagcagcugaugagaguguacggcgcccugaugugggcccugggcaagguggugggcacccccgaggugcugagaguguacaucggcagcuucuggagccagccccugcuggugcccgacaacagaagacuguucgagcuggaggagcaggaccuguucagagacauccagggccugcccagacacgccgcccugagaaagcugaacgaccuggugaagagagccagacuggugagagugcacgccuacaucaucagcuaccugaagaaggagaugcccagcguguucggcaaggagaacaagaagaagcagcugauccugaagcugcccgugaucuucgccaagauccagcuggagcaccacaucagccccggcgacuuccccgacugccagaagaugcaggagcugcugauggcccacgacuucaccaaguuccacagccugaagcccaagcugcuggaggcccuggacgagaugcugacccacgacaucgccaagcugaugccccugcugagacaggaggagcuggagagcaccgaggugggcgugcagggcggcgccuucgagggcacccacaugggccccuucguggagagaggccccgacgaggccauggaggacggcgaggagggcagcgacgacgaggccgaguggguggugaccaaggacaagagcaaguacgacgagaucuucuacaaccuggcccccgccgacggcaagcugagcggcagcaaggccaagaccuggauggugggcaccaagcugcccaacagcgugcugggcagaaucuggaagcugagcgacguggacagagacggcaugcuggacgacgaggaguucgcccuggccagccaccugaucgaggccaagcuggagggccacggccugcccgccaaccugcccagaagacuggugccccccagcaagagaagacacaagggcagcgccgaguaa

SEQ ID NO: 16495 - RNA, 1608 nt, Artificial Sequence
  EHD3__Homo_sapiens__NP_055415
auguucagcuggcugggcaccgacgacagaagaagaaaggaccccgagguguuccagaccgugagcgagggccugaagaagcuguacaagagcaagcugcugccccuggaggagcacuacagauuccacgaguuccacagccccgcccuggaggacgccgacuucgacaacaagcccauggugcugcuggugggccaguacagcaccggcaagaccaccuucaucagauaccugcuggagcaggacuuccccggcaugagaaucggccccgagcccaccaccgacagcuucaucgccgugaugcagggcgacauggagggcaucauccccggcaacgcccuggugguggaccccaagaagcccuucagaaagcugaacgccuucggcaacgccuuccugaacagauucgugugcgcccagcugcccaaccccgugcuggagagcaucagcgugaucgacacccccggcauccugagcggcgagaagcagagaaucagcagaggcuacgacuucgccgccgugcuggagugguucgccgagagaguggacagaaucauccugcuguucgacgcccacaagcuggacaucagcgacgaguucagcgaggugaucaaggcccugaagaaccacgaggacaagaugagaguggugcugaacaaggccgaccagaucgagacccagcagcugaugagaguguacggcgcccugauguggagccugggcaagaucgugaacacccccgaggugaucagaguguacaucggcagcuucuggagccacccccugcugauccccgacaacagaaagcuguucgaggccgaggagcaggaccuguucagagacauccagagccugcccagaaacgccgcccugagaaagcugaacgaccugaucaagagagccagacuggccaaggugcacgccuacaucaucagcagccugaagaaggagaugcccagcguguucggcaaggacaacaagaagaaggagcuggugaacaaccuggccgagaucuacggcagaaucgagagagagcaccagaucagccccggcgacuuccccaaccugaagagaaugcaggaccagcugcaggcccaggacuucagcaaguuccagccccugaagagcaagcugcuggaggugguggacgacaugcuggcccacgacaucgcccagcugauggugcuggugagacaggaggagagccagagacccauccagauggugaagggcggcgccuucgagggcacccugcacggccccuucggccacggcuacggcgagggcgccggcgagggcaucgacgacgccgagugggugguggccagagacaagcccauguacgacgagaucuucuacacccugagccccguggacggcaagaucaccggcgccaacgccaagaaggagauggugagaagcaagcugcccaacagcgugcugggcaagaucuggaagcuggccgacaucgacaaggacggcaugcuggacgacgacgaguucgcccuggccaaccaccugaucaaggugaagcuggagggccacgagcugcccaacgagcugcccgcccaccugcugccccccagcaagagaaagguggccgaguaa

SEQ ID NO: 16496 - RNA, 1626 nt, Artificial Sequence
  EHD4__Homo_sapiens__NP_644670
auguucagcuggaugggcagacaggccggcggcagagagagagccggcggcgccgacgccgugcagaccgugaccggcggccugagaagccuguaccugagaaaggugcugccccuggaggaggccuacagauuccacgaguuccacagccccgcccuggaggacgccgacuucgagaacaagcccaugauccugcuggugggccaguacagcaccggcaagaccaccuucaucagauaccugcuggagcaggacuuccccggcaugagaaucggccccgagcccaccaccgacagcuucaucgccgugauguacggcgagaccgagggcagcacccccggcaacgcccuggugguggaccccaagaagcccuucagaaagcugagcagauucggcaacgccuuccugaacagauucaugugcagccagcugcccaaccaggugcugaagagcaucagcgugaucgacagccccggcauccugagcggcgagaagcagagaaucagcagaggcuacgacuucugccaggugcugcagugguucgccgagagaguggacagaaucauccugcuguucgacgcccacaagcuggacaucagcgacgaguucagcgaggccaucaaggccuucagaggccaggacgacaagaucagaguggugcugaacaaggccgaccagguggacacccagcagcugaugagaguguacggcgcccugauguggagccugggcaaggugaucaacacccccgaggugcugagaguguacaucggcagcuucugggcccagccccugcagaacaccgacaacagaagacuguucgaggccgaggcccaggaccuguucagagacauccagagccugccccagaaggccgccgugagaaagcugaacgaccugaucaagagagccagacuggccaaggugcacgccuacaucaucagcuaccugaagaaggagaugcccagcguguucggcaaggagaacaagaagagagagcugaucagcagacugcccgagaucuacauccagcugcagagagaguaccagaucagcgccggcgacuuccccgaggugaaggccaugcaggagcagcuggagaacuacgacuucaccaaguuccacagccugaagcccaagcugaucgaggccguggacaacaugcugagcaacaagaucagcccccugaugaaccugaucagccaggaggagaccagcacccccacccagcuggugcagggcggcgccuucgacggcaccaccgagggccccuucaaccagggcuacggcgagggcgccaaggagggcgccgacgaggaggagugggugguggccaaggacaagcccguguacgacgagcuguucuacacccugagccccaucaacggcaagaucagcggcgugaacgccaagaaggagauggugaccagcaagcugcccaacagcgugcugggcaagaucuggaagcuggccgacugcgacugcgacggcaugcuggacgaggaggaguucgcccuggccaagcaccugaucaagaucaagcuggacggcuacgagcugcccagcagccugcccccccaccuggugccccccagccacagaaagagccugcccaaggccgacuaa

SEQ ID NO: 16497 - RNA, 969 nt, Artificial Sequence
  EHF__Homo_sapiens__NP_001193545
augggccugcccgagagaagaggccuggugcugcugcugagccuggccgagauccuguucaagaucaugauccuggagggcggcggcgugaugaaccugaaccccggcaacaaccugcugcaccagccccccgccuggaccgacagcuacagcaccugcaacgugagcagcggcuucuucggcggccaguggcacgagauccacccccaguacuggaccaaguaccaggugugggaguggcugcagcaccugcuggacaccaaccagcuggacgccaacugcauccccuuccaggaguucgacaucaacggcgagcaccugugcagcaugagccugcaggaguucaccagagccgccggcaccgccggccagcugcuguacagcaaccugcagcaccugaaguggaacggccagugcagcagcgaccuguuccagagcacccacaacgugaucgugaagaccgagcagaccgagcccagcaucaugaacaccuggaaggacgagaacuaccuguacgacaccaacuacggcagcaccguggaccugcuggacagcaagaccuucugcagagcccagaucagcaugaccaccaccagccaccugcccguggccgagagccccgacaugaagaaggagcaggacccccccgccaagugccacaccaagaagcacaaccccagaggcacccaccugugggaguucaucagagacauccugcugaaccccgacaagaaccccggccugaucaagugggaggacagaagcgagggcguguucagauuccugaagagcgaggccguggcccagcuguggggcaagaagaagaacaacagcagcaugaccuacgagaagcugagcagagccaugagauacuacuacaagagagagauccuggagagaguggacggcagaagacugguguacaaguucggcaagaacgccagaggcuggagagagaacgagaacuaa

SEQ ID NO: 16498 - RNA, 1884 nt, Artificial Sequence
  EHHADH__Homo_sapiens__NP_001159887
auggccuucggcggcggccuggagcuggcccugggcugccacuacagaaucgcccacgccgaggcccaggugggccugcccgaggugacccugggccugcugcccggcgccagaggcacccagcugcugcccagacugaccggcgugcccgccgcccuggaccugaucaccagcggcagaagaauccuggccgacgaggcccugaagcugggcauccuggacaagguggugaacagcgaccccguggaggaggccaucagauucgcccagagagugagcgaccagccccuggagagcagaagacugugcaacaagcccauccagagccugcccaacauggacagcaucuucagcgaggcccugcugaagaugagaagacagcaccccggcugccuggcccaggaggccugcgugagagccgugcaggccgccgugcaguaccccuacgaggugggcaucaagaaggaggaggagcuguuccuguaccugcugcagagcggccaggccagagcccugcaguacgccuucuucgccgagagaaaggccaacaaguggagcacccccagcggcgccagcuggaagaccgccagcgccagacccgugagcagcgugggcguggugggccugggcaccaugggcagaggcaucgugaucagcuucgccagagccagaauccccgugaucgccguggacagcgacaagaaccagcuggccaccgccaacaagaugaucaccagcgugcuggagaaggaggccagcaagaugcagcagagcggccaccccuggagcggccccaagcccagacugaccagcagcgugaaggagcugggcggcguggaccuggugaucgaggccguguucgaggagaugagccugaagaagcagguguucgccgagcugagcgccgugugcaagcccgaggccuuccugugcaccaacaccagcgcccuggacguggacgagaucgccagcagcaccgacagaccccaccuggugaucggcacccacuucuucagccccgcccacgugaugaagcugcuggaggugauccccagccaguacagcagccccaccaccaucgccaccgugaugaaccugagcaagaagaucaagaagaucggcgugguggugggcaacugcuucggcuucgugggcaacagaaugcugaaccccuacuacaaccaggccuacuuccugcuggaggagggcagcaagcccgaggagguggaccaggugcuggaggaguucggcuucaagaugggccccuucagagugagcgaccuggccggccuggacgugggcuggaagagcagaaagggccagggccugaccggccccacccugcugcccggcacccccgccagaaagagaggcaacagaagauacugccccauccccgacgugcugugcgagcugggcagauucggccagaagaccggcaagggcugguaccaguacgacaagccccugggcagaauccacaagcccgaccccuggcugagcaaguuccugagcagauacagaaagacccaccacaucgagcccagaaccaucagccaggacgagauccuggagagaugccuguacagccugaucaacgaggccuucagaauccugggcgagggcaucgccgccagccccgagcacaucgacgugguguaccugcacggcuacggcuggcccagacacaagggcggccccauguucuacgccagcaccgugggccugcccaccgugcuggagaagcugcagaaguacuacagacagaaccccgacaucccccagcuggagcccagcgacuaccugaagaagcuggccagccagggcaaccccccccugaaggaguggcagagccuggccggcagccccagcagcaagcuguaa

SEQ ID NO: 16499 - RNA, 2427 nt, Artificial Sequence
  EHMT1__Homo_sapiens__NP_001138999
auggccgccgccgacgccgaggccgugcccgccagaggcgagccccagcaggacugcugcgugaagaccgagcugcugggcgaggagacccccauggccgccgacgagggcagcgccgagaagcaggccggcgaggcccacauggccgccgacggcgagaccaacggcagcugcgagaacagcgacgccagcagccacgccaacgccgccaagcacacccaggacagcgccagagugaacccccaggacggcaccaacacccugaccagaaucgccgagaacggcgugagcgagagagacagcgaggccgccaagcagaaccacgugaccgccgacgacuucgugcagaccagcgugaucggcagcaacggcuacauccugaacaagcccgcccugcaggcccagccccugagaaccaccagcacccuggccagcagccugcccggccacgccgccaagacccugcccggcggcgccggcaagggcagaacccccagcgccuucccccagacccccgccgccccccccgccacccugggcgagggcagcgccgacaccgaggacagaaagcugcccgcccccggcgccgacgugaaggugcacagagccagaaagaccaugcccaagagcguggugggccugcacgccgccagcaaggaccccagagaggugagagaggccagagaccacaaggagcccaaggaggagaucaacaagaacaucagcgacuucggcagacagcagcugcugccccccuuccccagccugcaccagagccugccccagaaccagugcuacauggccaccaccaagagccagaccgccugccugcccuucgugcuggccgccgccgugagcagaaagaagaagagaagaaugggcaccuacagccuggugcccaagaagaagaccaaggugcugaagcagagaaccgugaucgagauguucaagagcaucacccacagcaccgugggcagcaagggcgagaaggaccugggcgccagcagccugcacgugaacggcgagagccuggagauggacagcgacgaggacgacagcgaggagcuggaggaggacgacggccacggcgccgagcaggccgccgccuuccccaccgaggacagcagaaccagcaaggagagcaugagcgaggccgacagagcccagaagauggacggcgagagcgaggaggagcaggagagcguggacaccggcgaggaggaggagggcggcgacgagagcgaccugagcagcgagagcagcaucaagaagaaguuccugaagagaaagggcaagaccgacagccccuggaucaagcccgccagaaagagaagaagaagaagcagaaagaagcccagcggcgcccugggcagcgagagcuacaagagcagcgccggcagcgccgagcagaccgcccccggcgacagcaccggcuacauggaggugagccuggacagccuggaccugagagugaagggcauccugagcagccaggccgagggccuggccaacggccccgacgugcuggagaccgacggccugcaggaggugccccugugcagcugcagaauggagacccccaagagcagagagaucaccacccuggccaacaaccagugcauggccaccgagagcguggaccacgagcugggcagaugcaccaacagcguggugaaguacgagcugaugagacccagcaacaaggccccccugcuggugcugugcgaggaccacagaggcagaauggugaagcaccagugcugccccggcugcggcuacuucugcaccgccggcaacuucauggagugccagcccgagagcagcaucagccacagauuccacaaggacugcgccagcagagugaacaacgccagcuacugcccccacugcggcgaggagagcagcaaggccaaggaggugaccaucgccaaggccgacaccaccagcaccgugacccccgugcccggccaggagaagggcagcgcccuggagggcagagccgacaccaccaccggcagcgccgccggccccccccugagcgaggacgacaagcugcagggcgccgccagccacgugcccgagggcuucgaccccaccggccccgccggccugggcagacccacccccggccugagccagggccccggcaaggagacccuggagagcgcccugaucgcccuggacagcgagaagcccaagaagcugagauuccaccccaagcagcuguacuucagcgccagacagggcgagcugcagaaggugcugcugaugcugguggacggcaucgaccccaacuucaagauggagcaccagaacaagagaagcccccugcacgccgccgccgaggccggccacguggacaucugccacaugcuggugcaguucugcagacugggcagccccagaagcagaggcugccugugguaa

SEQ ID NO: 16500 - RNA, 3702 nt, Artificial Sequence
  EHMT2__Homo_sapiens__NP_001276342
augagaggccugcccagaggcagaggccugaugagagccagaggcagaggcagagccgccccccccggcagcagaggcagaggcagaggcggcccccacagaggcagaggcagacccagaagccugcugagccugcccagagcccaggccagcuggaccccccagcugagcaccggccugaccagcccccccgugcccugccugcccagccagggcgaggcccccgccgagaugggcgcccugcugcuggagaaggagaccagaggcgccaccgagagagugcacggcagccugggcgacacccccagaagcgaggagacccugcccaaggccacccccgacagccuggagcccgccggccccagcagccccgccagcgugaccgugaccgugggcgacgagggcgccgacacccccgugggcgccaccccccugaucggcgacgagagcgagaaccuggagggcgacggcgaccugagaggcggcagaauccugcugggccacgccaccaagagcuuccccagcagccccagcaagggcggcagcugccccagcagagccaagaugagcaugaccggcgccggcaagagcccccccagcgugcagagccuggccaugagacugcugagcaugcccggcgcccagggcgccgccgccgccggcagcgagcccccccccgccaccaccagccccgagggccagcccaaggugcacagagccagaaagaccaugagcaagcccggcaacggccagccccccgugcccgagaagagaccccccgagauccagcacuucagaaugagcgacgacgugcacagccugggcaaggugaccagcgaccuggccaagagaagaaagcugaacagcggcggcggccugagcgaggagcugggcagcgccagaagaagcggcgaggugacccugaccaagggcgaccccggcagccuggaggagugggagaccguggugggcgacgacuucagccuguacuacgacagcuacagcguggacgagagaguggacagcgacagcaagagcgagguggaggcccugaccgagcagcugagcgaggaggaggaggaggaggaggaggaggaggaggaggaggaggaggaggaggaggaggaggaggaggaggaggacgaggagagcggcaaccagagcgacagaagcggcagcagcggcagaagaaaggccaagaagaaguggagaaaggacagccccugggugaagcccagcagaaagagaagaaagagagagccccccagagccaaggagcccagaggcgugagcaacgacaccagcagccuggagaccgagagaggcuucgaggagcugccccugugcagcugcagaauggaggcccccaagaucgacagaaucagcgagagagccggccacaagugcauggccaccgagagcguggacggcgagcugagcggcugcaacgccgccauccugaagagagagaccaugagacccagcagcagaguggcccugauggugcugugcgagacccacagagccagaauggugaagcaccacugcugccccggcugcggcuacuucugcaccgccggcaccuuccuggagugccaccccgacuucagaguggcccacagauuccacaaggccugcgugagccagcugaacggcaugguguucugcccccacugcggcgaggacgccagcgaggcccaggaggugaccauccccagaggcgacggcgugaccccccccgccggcaccgccgcccccgccccccccccccugagccaggacgugcccggcagagccgacaccagccagcccagcgccagaaugagaggccacggcgagcccagaagaccccccugcgacccccuggccgacaccaucgacagcagcggccccagccugacccugcccaacggcggcugccugagcgccgugggccugccccugggccccggcagagaggcccuggagaaggcccuggugauccaggagagcgagagaagaaagaagcugagauuccaccccagacagcuguaccugagcgugaagcagggcgagcugcagaaggugauccugaugcugcuggacaaccuggaccccaacuuccagagcgaccagcagagcaagagaaccccccugcacgccgccgcccagaagggcagcguggagaucugccacgugcugcugcaggccggcgccaacaucaacgccguggacaagcagcagagaaccccccugauggaggccguggugaacaaccaccuggagguggccagauacauggugcagagaggcggcugcguguacagcaaggaggaggacggcagcaccugccugcaccacgccgccaagaucggcaaccuggagauggugagccugcugcugagcaccggccagguggacgugaacgcccaggacagcggcggcuggacccccaucaucugggccgccgagcacaagcacaucgaggugaucagaaugcugcugaccagaggcgccgacgugacccugaccgacaacgaggagaacaucugccugcacugggccagcuucaccggcagcgccgccaucgccgaggugcugcugaacgccagaugcgaccugcacgccgugaacuaccacggcgacaccccccugcacaucgccgccagagagagcuaccacgacugcgugcugcuguuccugagcagaggcgccaaccccgagcugagaaacaaggagggcgacaccgccugggaccugacccccgagagaagcgacgugugguucgcccugcagcugaacagaaagcugagacugggcgugggcaacagagccaucagaaccgagaagaucaucugcagagacguggccagaggcuacgagaacgugcccauccccugcgugaacggcguggacggcgagcccugccccgaggacuacaaguacaucagcgagaacugcgagaccagcaccaugaacaucgacagaaacaucacccaccugcagcacugcaccugcguggacgacugcagcagcagcaacugccugugcggccagcugagcaucagaugcugguacgacaaggacggcagacugcugcaggaguucaacaagaucgagcccccccugaucuucgagugcaaccaggccugcagcugcuggagaaacugcaagaacagaguggugcagagcggcaucaaggugagacugcagcuguacagaaccgccaagaugggcuggggcgugagagcccugcagaccaucccccagggcaccuucaucugcgaguacgugggcgagcugaucagcgacgccgaggccgacgugagagaggacgacagcuaccuguucgaccuggacaacaaggacggcgagguguacugcaucgacgccagauacuacggcaacaucagcagauucaucaaccaccugugcgaccccaacaucauccccgugagaguguucaugcugcaccaggaccugagauuccccagaaucgccuucuucagcagcagagacaucagaaccggcgaggagcugggcuucgacuacggcgacagauucugggacaucaagagcaaguacuucaccugccagugcggcagcgagaagugcaagcacagcgccgaggccaucgcccuggagcagagcagacuggccagacuggacccccaccccgagcugcugcccgagcugggcagccugccccccgugaacaccuaa

SEQ ID NO: 16501 - RNA, 1023 nt, Artificial Sequence
  EI24__Homo_sapiens__XP_011541371
auggccgacagcgugaagaccuuccugcaggaccuggccagaggcaucaaggacagcaucuggggcaucugcaccaucagcaagcuggacgccagaauccagcagaagagagaggagcagagaagaagaagagccagcagcgugcuggcccagagaagagcccagagcaucgagagaaagcaggagagcgagcccagaaucgugagcagaaucuuccagugcugcgccuggaacggcggcguguucugguucagccugcugcuguucuacagaguguucauccccgugcugcagagcgugaccgccagaaucaucggcgaccccagccugcacggcgacguguggagcuggcuggaguucuuccugaccagcaucuucagcgcccugugggugcugccccuguucgugcugagcaagguggugaacgccaucugguuccaggacaucgccgaccuggccuucgaggugagcggcagaaagccccaccccuuccccagcgugagcaagaucaucgccgacaugcuguucaaccugcugcugcaggcccuguuccugauccagggcauguucgugagccuguuccccauccaccuggugggccagcuggugagccugcugcacaugagccugcuguacagccuguacugcuucgaguacagaugguucaacaagggcaucgagaugcaccagagacugagcaacaucgagagaaacuggcccuacuacuucggcuucggccugccccuggccuuccugaccgccaugcagagcagcuacaucaucagcggcugccuguucagcauccuguucccccuguucaucaucagcgccaacgaggccaagacccccggcaaggccuaccuguuccagcugagacuguucagccuggugguguuccugagcaacagacuguuccacaagaccguguaccugcagagcgcccugagcagcagcaccagcgccgagaaguuccccagcccccaccccagccccgccaagcugaaggccaccgccggccacuaa

SEQ ID NO: 16502 - RNA, 564 nt, Artificial Sequence
  EID1__Homo_sapiens__NP_055150
augagcgagauggccgagcugagcgagcuguacgaggagagcagcgaccugcagauggacgugaugcccggcgagggcgaccugccccagauggaggugggcagcggcagcagagagcugagccugagacccagcagaagcggcgcccagcagcuggaggaggagggccccauggaggaggaggaggcccagcccauggccgcccccgagggcaagagaagccuggccaacggccccaacgccggcgagcagcccggccagguggccggcgccgacuucgagagcgaggacgagggcgaggaguucgacgacugggaggacgacuacgacuaccccgaggaggagcagcugagcggcgccggcuacagagugagcgccgcccuggaggaggccgacaagauguuccugagaaccagagagcccgcccuggacggcggcuuccagaugcacuacgagaagacccccuucgaccagcuggccuucaucgaggagcuguucagccugaugguggugaacagacugaccgaggagcugggcugcgacgagaucaucgacagagaguaa

SEQ ID NO: 16503 - RNA, 498 nt, Artificial Sequence
  EIF1AD__Homo_sapiens__NP_001229411
augagccaggccaccaagagaaagcacguggugaaggaggugcugggcgagcacaucgugcccagcgaccagcagcagaucgugagagugcugagaacccccggcaacaaccugcacgagguggagaccgcccagggccagagauuccuggugagcaugcccagcaaguacagaaagaacaucuggaucaagagaggcgacuuccugaucguggaccccaucgaggagggcgagaaggugaaggccgagaucagcuucgugcugugcaaggaccacgugagaagccugcagaaggagggcuucuggcccgaggccuucagcgagguggccgagaagcacaacaacagaaacagacagacccagcccgagcugcccgccgagccccagcugagcggcgaggagagcagcagcgaggacgacagcgaccuguucgugaacaccaacagaagacaguaccacgagagcgaggaggagagcgaggaggaggaggccgccuaa

SEQ ID NO: 16504 - RNA, 435 nt, Artificial Sequence
  EIF1AX__Homo_sapiens__NP_001403
augcccaagaacaagggcaagggcggcaagaacagaagaagaggcaagaacgagaacgagagcgagaagagagagcugguguucaaggaggacggccaggaguacgcccaggugaucaagaugcugggcaacggcagacuggaggccaugugcuucgacggcgugaagagacugugccacaucagaggcaagcugagaaagaagguguggaucaacaccagcgacaucauccuggugggccugagagacuaccaggacaacaaggccgacgugauccugaaguacaacgccgacgaggccagaagccugaaggccuacggcgagcugcccgagcacgccaagaucaacgagaccgacaccuucggccccggcgacgacgacgagauccaguucgacgacaucggcgacgacgacgaggacaucgacgacaucuaa

SEQ ID NO: 16505 - RNA, 384 nt, Artificial Sequence
  EIF1AY__Homo_sapiens__NP_001265541
augcccaagaacaagggcaagggcggcaagaacagaagaagaggcaagaacgagaacgagagcgagaagagagagcugguguucaaggaggacggccaggaguacgcccaggugaucaagaugcugggcaacggcagacuggaggcccugugcuucgacggcgugaagagacugugccacaucagaggcaagcugagaaagaaggacaacaaggccgacgugauccugaaguacaacgccgacgaggccagaagccugaaggccuacggcgagcugcccgagcacgccaagaucaacgagaccgacaccuucggccccggcgacgacgacgagauccaguucgacgacaucggcgacgacgacgaggacaucgacgacaucuaa

SEQ ID NO: 16506 - RNA, 342 nt, Artificial Sequence
  EIF1__Homo_sapiens__NP_005792
augagcgccauccagaaccugcacagcuucgaccccuucgccgacgccagcaagggcgacgaccugcugcccgccggcaccgaggacuacauccacaucagaauccagcagagaaacggcagaaagacccugaccaccgugcagggcaucgccgacgacuacgacaagaagaagcuggugaaggccuucaagaagaaguucgccugcaacggcaccgugaucgagcaccccgaguacggcgaggugauccagcugcagggcgaccagagaaagaacaucugccaguuccugguggagaucggccuggccaaggacgaccagcugaaggugcacggcuucuaa

SEQ ID NO: 16507 - RNA, 1758 nt, Artificial Sequence
  EIF2A__Homo_sapiens__NP_114414
auggcccccagcaccccccugcugaccgugagaggcagcgagggccuguacauggugaacggccccccccacuucaccgagagcaccguguuccccagagagagcggcaagaacugcaaggugugcaucuucagcaaggacggcacccuguucgccuggggcaacggcgagaaggugaacaucaucagcgugaccaacaagggccugcugcacagcuucgaccugcugaaggccgugugccuggaguucagccccaagaacaccgugcuggccaccuggcagcccuacaccaccagcaaggacggcaccgccggcauccccaaccugcagcuguacgacgugaagaccggcaccugccugaagagcuucauccagaagaagaugcagaacuggugccccagcuggagcgaggacgagacccugugcgccagaaacgugaacaacgaggugcacuucuucgagaacaacaacuucaacaccaucgccaacaagcugcaccugcagaagaucaacgacuucgugcugagccccggcccccagcccuacaagguggccguguacgugcccggcagcaagggcgcccccagcuucgugagacuguaccaguaccccaacuucgccggcccccacgccgcccuggccaacaagagcuucuucaaggccgacaaggugaccaugcuguggaacaagaaggccaccgccgugcuggugaucgccagcaccgacguggacaagaccggcgccagcuacuacggcgagcagacccugcacuacaucgccaccaacggcgagagcgccguggugcagcugcccaagaacggccccaucuacgacgugguguggaacagcagcagcaccgaguucugcgccguguacggcuucaugcccgccaaggccaccaucuucaaccugaagugcgaccccguguucgacuucggcaccggccccagaaacgccgccuacuacagcccccacggccacauccuggugcuggccggcuucggcaaccugagaggccagauggaggugugggacgugaagaacuacaagcugaucagcaagcccguggccagcgacagcaccuacuucgccuggugccccgacggcgagcacauccugaccgccaccugcgcccccagacugagagugaacaacggcuacaagaucuggcacuacaccggcagcauccugcacaaguacgacgugcccagcaacgccgagcuguggcaggugagcuggcagcccuuccuggacggcaucuuccccgccaagaccaucaccuaccaggccgugcccagcgaggugcccaacgaggagcccaagguggccaccgccuacagaccccccgcccugagaaacaagcccaucaccaacagcaagcugcacgaggaggagcccccccagaacaugaagccccagagcggcaacgacaagccccugagcaagaccgcccugaagaaccagagaaagcacgaggccaagaaggccgccaagcaggaggccagaagcgacaagagccccgaccuggcccccacccccgccccccagagcacccccagaaacaccgugagccagagcaucagcggcgaccccgagaucgacaagaagaucaagaaccugaagaagaagcugaaggccaucgagcagcugaaggagcaggccgccaccggcaagcagcuggagaagaaccagcuggagaagauccagaaggagaccgcccugcugcaggagcuggaggaccuggagcugggcaucuaa

SEQ ID NO: 16508 - RNA, 1893 nt, Artificial Sequence
  EIF2AK1__Homo_sapiens__NP_055228
augcagggcggcaacagcggcgugagaaagagagaggaggagggcgacggcgccggcgccguggccgccccccccgccaucgacuuccccgccgagggccccgaccccgaguacgacgagagcgacgugcccgccgagauccaggugcugaaggagccccugcagcagcccaccuuccccuucgccguggccaaccagcugcugcuggugagccugcuggagcaccugagccacgugcacgagcccaacccccugagaagcagacagguguucaagcugcugugccagaccuucaucaagaugggccugcugagcagcuucaccugcagcgacgaguucagcagccugagacugcaccacaacagagccaucacccaccugaugagaagcgccaaggagagagugagacaggaccccugcgaggacaucagcagaauccagaagaucagaagcagagagguggcccuggaggcccagaccagcagauaccugaacgaguucgaggagcuggccauccugggcaagggcggcuacggcagaguguacaaggugagaaacaagcuggacggccaguacuacgccaucaagaagauccugaucaagggcgccaccaagaccgugugcaugaaggugcugagagaggugaaggugcuggccggccugcagcaccccaacaucgugggcuaccacaccgccuggaucgagcacgugcacgugauccagcccagagccgacagagccgccaucgagcugcccagccuggaggugcugagcgaccaggaggaggacagagagcagugcggcgugaagaacgacgagagcagcagcagcagcaucaucuucgccgagcccacccccgagaaggagaagagauucggcgagagcgacaccgagaaccagaacaacaagagcgugaaguacaccaccaaccuggugaucagagagagcggcgagcuggagagcacccuggagcugcaggagaacggccuggccggccugagcgccagcagcaucguggagcagcagcugccccugagaagaaacagccaccuggaggagagcuucaccagcaccgaggagagcagcgaggagaacgugaacuuccugggccagaccgaggcccaguaccaccugaugcugcacauccagaugcagcugugcgagcugagccugugggacuggaucguggagagaaacaagagaggcagagaguacguggacgagagcgccugccccuacgugauggccaacguggccaccaagaucuuccaggagcugguggagggcguguucuacauccacaacaugggcaucgugcacagagaccugaagcccagaaacaucuuccugcacggccccgaccagcaggugaagaucggcgacuucggccuggccugcaccgacauccugcagaagaacaccgacuggaccaacagaaacggcaagagaacccccacccacaccagcagagugggcaccugccuguacgccagccccgagcagcuggagggcagcgaguacgacgccaagagcgacauguacagccugggcguggugcugcuggagcuguuccagcccuucggcaccgagauggagagagccgaggugcugaccggccugagaaccggccagcugcccgagagccugagaaagagaugccccgugcaggccaaguacauccagcaccugaccagaagaaacagcagccagagacccagcgccauccagcugcugcagagcgagcuguuccagaacagcggcaacgugaaccugacccugcagaugaagaucaucgagcaggagaaggagaucgccgagcugaagaagcagcugaaccugcugagccaggacaagggcgugagagacgacggcaaggacggcggcgugggcuaa

SEQ ID NO: 16509 - RNA, 1533 nt, Artificial Sequence
  EIF2AK2__Homo_sapiens__NP_001129124
auggccggcgaccugagcgccggcuucuucauggaggagcugaacaccuacagacagaagcagggcguggugcugaaguaccaggagcugcccaacagcggccccccccacgacagaagauucaccuuccaggugaucaucgacggcagagaguuccccgagggcgagggcagaagcaagaaggaggccaagaacgccgccgccaagcuggccguggagauccugaacaaggagaagaaggccgugagcccccugcugcugaccaccaccaacagcagcgagggccugagcaugggcaacuacaucggccugaucaacagaaucgcccagaagaagagacugaccgugaacuacgagcagugcgccagcggcgugcacggccccgagggcuuccacuacaagugcaagaugggccagaaggaguacagcaucggcaccggcagcaccaagcaggaggccaagcagcuggccgccaagcuggccuaccugcagauccugagcgaggagaccagcgugaagagcgacuaccugagcagcggcagcuucgccaccaccugcgagagccagagcaacagccuggugaccagcacccuggccagcgagagcagcagcgagggcgacuucagcgccgacaccagcgagaucaacagcaacagcgacagccugaacagcagcagccugcugaugaacggccugagaaacaaccagagaaaggccaagagaagccuggcccccagauucgaccugcccgacaugaaggagaccaaguacaccguggacaagagaaaggccgagagagaggugaaggcccuggccaagcuggaccacgugaacaucgugcacuacaacggcugcugggacggcuucgacuacgaccccgagaccagcgacgacagccuggagagcagcgacuacgaccccgagaacagcaagaacagcagcagaagcaagaccaagugccuguucauccagauggaguucugcgacaagggcacccuggagcaguggaucgagaagagaagaggcgagaagcuggacaaggugcuggcccuggagcuguucgagcagaucaccaagggcguggacuacauccacagcaagaagcugauccacagagaccugaagcccagcaacaucuuccugguggacaccaagcaggugaagaucggcgacuucggccuggugaccagccugaagaacgacggcaagagaaccagaagcaagggcacccugagauacaugagccccgagcagaucagcagccaggacuacggcaaggagguggaccuguacgcccugggccugauccuggccgagcugcugcacgugugcgacaccgccuucgagaccagcaaguucuucaccgaccugagagacggcaucaucagcgacaucuucgacaagaaggagaagacccugcugcagaagcugcugagcaagaagcccgaggacagacccaacaccagcgagauccugagaacccugaccguguggaagaagagccccgagaagaacgagagacacaccugcuaa

SEQ ID NO: 16510 - RNA, 3351 nt, Artificial Sequence
  EIF2AK3__Homo_sapiens__NP_004827
auggagagagccaucagccccggccugcuggugagagcccugcugcugcugcugcugcugcugggccuggccgccagaaccguggccgccggcagagccagaggccugcccgcccccaccgccgaggccgccuucggccugggcgccgccgccgcccccaccagcgccaccagagugcccgccgccggcgccguggccgccgccgaggugaccguggaggacgccgaggcccugcccgccgccgccggcgagcaggagcccagaggccccgagcccgacgacgagaccgagcugagacccagaggcagaagccuggugaucaucagcacccuggacggcagaaucgccgcccuggaccccgagaaccacggcaagaagcagugggaccuggacgugggcagcggcagccuggugagcagcagccugagcaagcccgagguguucggcaacaagaugaucauccccagccuggacggcgcccuguuccagugggaccaggacagagagagcauggagaccgugcccuucaccguggagagccugcuggagagcagcuacaaguucggcgacgacguggugcuggugggcggcaagagccugaccaccuacggccugagcgccuacagcggcaaggugagauacaucugcagcgcccugggcugcagacagugggacagcgacgagauggagcaggaggaggacauccugcugcugcagagaacccagaagaccgugagagccgugggccccagaagcggcaacgagaaguggaacuucagcgugggccacuucgagcugagauacauccccgacauggagaccagagccggcuucaucgagagcaccuucaagcccaacgagaacaccgaggagagcaagaucaucagcgacguggaggagcaggaggccgccaucauggacaucgugaucaaggugagcguggccgacuggaaggugauggccuucagcaagaagggcggccaccuggagugggaguaccaguucugcacccccaucgccagcgccuggcugcugaaggacggcaaggugauccccaucagccuguucgacgacaccagcuacaccagcaacgacgacgugcuggaggacgaggaggacaucguggaggccgccagaggcgccaccgagaacagcguguaccugggcauguacagaggccagcuguaccugcagagcagcgugagaaucagcgagaaguuccccagcagccccaaggcccuggagagcgugaccaacgagaacgccaucaucccccugcccaccaucaaguggaagccccugauccacagccccagcagaacccccgugcuggugggcagcgacgaguucgacaagugccugagcaacgacaaguucagccacgaggaguacagcaacggcgcccugagcauccugcaguaccccuacgacaacggcuacuaccugcccuacuacaagagagagagaaacaagagaagcacccagaucaccgugagauuccuggacaacccccacuacaacaagaacaucagaaagaaggaccccgugcugcugcugcacugguggaaggagaucguggccaccauccuguucugcaucaucgccaccaccuucaucgugagaagacuguuccacccccacccccacagacagagaaaggagagcgagacccagugccagaccgagaacaaguacgacagcgugagcggcgaggccaacgacagcagcuggaacgacaucaagaacagcggcuacaucagcagauaccugaccgacuucgagcccauccagugccugggcagaggcggcuucggcgugguguucgaggccaagaacaagguggacgacugcaacuacgccaucaagagaaucagacugcccaacagagagcuggccagagagaaggugaugagagaggugaaggcccuggccaagcuggagcaccccggcaucgugagauacuucaacgccuggcuggaggccccccccgagaaguggcaggagaagauggacgagaucuggcugaaggacgagagcaccgacuggccccugagcagccccagccccauggacgcccccagcgugaagaucagaagaauggaccccuucgccaccaaggagcacaucgagaucaucgcccccagcccccagagaagcagaagcuucagcgugggcaucagcugcgaccagaccagcagcagcgagagccaguucagcccccuggaguucagcggcauggaccacgaggacaucagcgagagcguggacgccgccuacaaccugcaggacagcugccugaccgacugcgacguggaggacggcaccauggacggcaacgacgagggccacagcuucgagcugugccccagcgaggccagccccuacgugagaagcagagagagaaccagcagcagcaucguguucgaggacagcggcugcgacaacgccagcagcaaggaggagcccaagaccaacagacugcacaucggcaaccacugcgccaacaagcugaccgccuucaagcccaccagcagcaagagcagcagcgaggccacccugagcaucagcccccccagacccaccacccugagccuggaccugaccaagaacaccaccgagaagcugcagcccagcagccccaagguguaccuguacauccagaugcagcugugcagaaaggagaaccugaaggacuggaugaacggcagaugcaccaucgaggagagagagagaagcgugugccugcacaucuuccugcagaucgccgaggccguggaguuccugcacagcaagggccugaugcacagagaccugaagcccagcaacaucuucuucaccauggacgacguggugaaggugggcgacuucggccuggugaccgccauggaccaggacgaggaggagcagaccgugcugacccccaugcccgccuacgccagacacaccggccaggugggcaccaagcuguacaugagccccgagcagauccacggcaacagcuacagccacaagguggacaucuucagccugggccugauccuguucgagcugcuguaccccuucagcacccagauggagagagugagaacccugaccgacgugagaaaccugaaguuccccccccuguucacccagaaguaccccugcgaguacgugauggugcaggacaugcugagccccagccccauggagagacccgaggccaucaacaucaucgagaacgccguguucgaggaccuggacuuccccggcaagaccgugcugagacagagaagcagaagccugagcagcagcggcaccaagcacagcagacagagcaacaacagccacagcccccugcccagcaacuaa

SEQ ID NO: 16511 - RNA, 4950 nt, Artificial Sequence
  EIF2AK4__Homo_sapiens__NP_001013725
auggccggcggcagaggcgcccccggcagaggcagagacgagccccccgagagcuacccccagagacaggaccacgagcugcaggcccuggaggccaucuacggcgccgacuuccaggaccugagacccgacgccugcggccccgugaaggagccccccgagaucaaccuggugcuguacccccagggccugaccggcgaggagguguacgugaagguggaccugagagugaagugcccccccaccuaccccgacguggugcccgagaucgagcugaagaacgccaagggccugagcaacgagagcgugaaccugcugaagagcagacuggaggagcuggccaagaagcacugcggcgaggugaugaucuucgagcuggccuaccacgugcagagcuuccugagcgagcacaacaagcccccccccaagagcuuccacgaggagaugcuggagagaagagcccaggaggagcagcagagacugcuggaggccaagagaaaggaggagcaggagcagagagagauccugcacgagauccagagaagaaaggaggagaucaaggaggagaagaagagaaaggagauggccaagcaggagagacuggagaucgccagccugagcaaccaggaccacaccagcaagaaggaccccggcggccacagaaccgccgccauccugcacggcggcagccccgacuucgugggcaacggcaagcacagagccaacagcagcggcagaagcagaagagagagacaguacagcgugugcaacagcgaggacagccccggcagcugcgagauccuguacuucaacaugggcagccccgaccagcugauggugcacaagggcaagugcaucggcagcgacgagcagcugggcaagcugguguacaacgcccuggagaccgccaccggcggcuucgugcugcuguacgagugggugcugcaguggcagaagaagaugggccccuuccugaccagccaggagaaggagaagaucgacaagugcaagaagcagauccagggcaccgagaccgaguucaacagccuggugaagcugagccaccccaacguggugagauaccuggccaugaaccugaaggagcaggacgacagcaucgugguggacauccugguggagcacaucagcggcgugagccuggccgcccaccugagccacagcggccccauccccgugcaccagcugagaagauacaccgcccagcugcugagcggccuggacuaccugcacagcaacagcguggugcacaaggugcugagcgccagcaacgugcugguggacgccgagggcaccgugaagaucaccgacuacagcaucagcaagagacuggccgacaucugcaaggaggacguguucgagcagaccagagugagauucagcgacaacgcccugcccuacaagaccggcaagaagggcgacguguggagacugggccugcugcugcugagccugagccagggccaggagugcggcgaguaccccgugaccauccccagcgaccugcccgccgacuuccaggacuuccugaagaagugcgugugccuggacgacaaggagagauggagcccccagcagcugcugaagcacagcuucaucaacccccagcccaagaugccccugguggagcagagccccgaggacagcgagggccaggacuacguggagaccgugauccccagcaacagacugcccagcgccgccuucuucagcgagacccagagacaguucagcagauacuucaucgaguucgaggagcugcagcugcugggcaagggcgccuucggcgccgugaucaaggugcagaacaagcuggacggcugcugcuacgccgugaagagaauccccaucaaccccgccagcagacaguucagaagaaucaagggcgaggugacccugcugagcagacugcaccacgagaacaucgugagauacuacaacgccuggaucgagagacacgagagacccgccggccccggcacccccccccccgacagcggcccccuggccaaggacgacagagccgccagaggccagcccgccagcgacaccgacggccuggacagcguggaggccgccgcccccccccccauccugagcagcagcguggaguggagcaccagcggcgagagaagcgccagcgccagauuccccgccaccggccccggcagcagcgacgacgaggacgacgacgaggacgagcacggcggcguguucagccagagcuuccugcccgccagcgacagcgagagcgacaucaucuucgacaacgaggacgagaacagcaagagccagaaccaggacgaggacugcaacgagaagaacggcugccacgagagcgagcccagcgugaccaccgaggccgugcacuaccuguacauccagauggaguacugcgagaagagcacccugagagacaccaucgaccagggccuguacagagacaccgugagacuguggagacuguucagagagauccuggacggccuggccuacauccacgagaagggcaugauccacagagaccugaagcccgugaacaucuuccuggacagcgacgaccacgugaagaucggcgacuucggccuggccaccgaccaccuggccuucagcgccgacagcaagcaggacgaccagaccggcgaccugaucaagagcgaccccagcggccaccugaccggcauggugggcaccgcccuguacgugagccccgaggugcagggcagcaccaagagcgccuacaaccagaagguggaccuguucagccugggcaucaucuucuucgagaugagcuaccaccccauggugaccgccagcgagagaaucuucgugcugaaccagcugagagaccccaccagccccaaguuccccgaggacuucgacgacggcgagcacgccaagcagaagagcgugaucagcuggcugcugaaccacgaccccgccaagagacccaccgccaccgagcugcugaagagcgagcugcugccccccccccagauggaggagagcgagcugcacgaggugcugcaccacacccugaccaacguggacggcaaggccuacagaaccaugauggcccagaucuucagccagagaaucagccccgccaucgacuacaccuacgacagcgacauccugaagggcaacuucagcaucagaaccgccaagaugcagcagcacgugugcgagaccaucaucagaaucuucaagagacacggcgccgugcagcugugcaccccccugcugcugcccagaaacagacagaucuacgagcacaacgaggccgcccuguucauggaccacagcggcaugcuggugaugcugcccuucgaccugagaauccccuucgccagauacguggccagaaacaacauccugaaccugaagagauacugcaucgagagaguguucagacccagaaagcuggacagauuccaccccaaggagcugcuggagugcgccuucgacaucgugaccagcaccaccaacagcuuccugcccaccgccgagaucaucuacaccaucuacgagaucauccaggaguuccccgcccugcaggagagaaacuacagcaucuaccugaaccacaccaugcugcugaaggccauccugcugcacugcggcauccccgaggacaagcugagccagguguacaucauccuguacgacgccgugaccgagaagcugaccagaagagagguggaggccaaguucugcaaccugagccugagcagcaacagccugugcagacuguacaaguucaucgagcagaagggcgaccugcaggaccugaugcccaccaucaacagccugaucaagcagaagaccggcaucgcccagcuggugaaguacggccugaaggaccuggaggagguggugggccugcugaagaagcugggcaucaagcugcaggugcugaucaaccugggccugguguacaaggugcagcagcacaacggcaucaucuuccaguucguggccuucaucaagagaagacagagagccgugcccgagauccuggccgccggcggcagauacgaccugcugaucccccaguucagaggcccccaggcccugggccccgugcccaccgccaucggcgugagcaucgccaucgacaagaucagcgccgccgugcugaacauggaggagagcgugaccaucagcagcugcgaccugcugguggugagcgugggccagaugagcaugagcagagccaucaaccugacccagaagcuguggaccgccggcaucaccgccgagaucauguacgacuggagccagagccaggaggagcugcaggaguacugcagacaccacgagaucaccuacguggcccuggugagcgacaaggagggcagccacgugaaggugaagagcuucgagaaggagagacagaccgagaagagagugcuggagaccgagcugguggaccacgugcugcagaagcugagaaccaaggugaccgacgagagaaacggcagagaggccagcgacaaccuggccgugcagaaccugaagggcagcuucagcaacgccagcggccuguucgagauccacggcgccaccguggugcccaucgugagcgugcuggcccccgagaagcugagcgccagcaccagaagaagauacgagacccaggugcagaccagacugcagaccagccuggccaaccugcaccagaagagcagcgagaucgagauccuggccguggaccugcccaaggagaccauccugcaguuccugagccuggagugggacgccgacgagcaggccuucaacaccaccgugaagcagcugcugagcagacugcccaagcagagauaccugaagcuggugugcgacgagaucuacaacaucaagguggagaagaaggugagcgugcuguuccuguacagcuacagagacgacuacuacagaauccuguucuaa

SEQ ID NO: 16512 - RNA, 918 nt, Artificial Sequence
  EIF2B1__Homo_sapiens__NP_001405
auggacgacaaggagcugaucgaguacuucaagagccagaugaaggaggaccccgacauggccagcgccguggccgccaucagaacccugcuggaguuccugaagagagacaagggcgagaccauccagggccugagagccaaccugaccagcgccaucgagacccugugcggcguggacagcagcguggccgugagcagcggcggcgagcuguuccugagauucaucagccuggccagccuggaguacagcgacuacagcaagugcaagaagaucaugaucgagagaggcgagcuguuccugagaagaaucagccugagcagaaacaagaucgccgaccugugccacaccuucaucaaggacggcgccaccauccugacccacgccuacagcagaguggugcugagagugcuggaggccgccguggccgccaagaagagauucagcguguacgugaccgagagccagcccgaccugagcggcaagaagauggccaaggcccugugccaccugaacgugcccgugaccguggugcuggacgccgccgugggcuacaucauggagaaggccgaccuggugaucgugggcgccgagggcgugguggagaacggcggcaucaucaacaagaucggcaccaaccagauggccgugugcgccaaggcccagaacaagcccuucuacgugguggccgagagcuucaaguucgugagacuguucccccugaaccagcaggacgugcccgacaaguucaaguacaaggccgacacccugaagguggcccagaccggccaggaccugaaggaggagcaccccuggguggacuacaccgcccccagccugaucacccugcuguucaccgaccugggcgugcugacccccagcgccgugagcgacgagcugaucaagcuguaccuguaa

SEQ ID NO: 16513 - RNA, 1056 nt, Artificial Sequence
  EIF2B2__Homo_sapiens__NP_055054
augcccggcagcgccgccaagggcagcgagcugagcgagagaaucgagagcuucguggagacccugaagagaggcggcggccccagaagcagcgaggagauggccagagagacccugggccugcugagacagaucaucaccgaccacagauggagcaacgccggcgagcugauggagcugaucagaagagagggcagaagaaugaccgccgcccagcccagcgagaccaccgugggcaacauggugagaagagugcugaagaucaucagagaggaguacggcagacugcacggcagaagcgacgagagcgaccagcaggagagccugcacaagcugcugaccagcggcggccugaacgaggacuucagcuuccacuacgcccagcugcagagcaacaucaucgaggccaucaacgagcugcugguggagcuggagggcaccauggagaacaucgccgcccaggcccuggagcacauccacagcaacgaggugaucaugaccaucggcuucagcagaaccguggaggccuuccugaaggaggccgccagaaagagaaaguuccacgugaucguggccgagugcgcccccuucugccagggccacgagauggccgugaaccugagcaaggccggcaucgagaccaccgugaugaccgacgccgccaucuucgccgugaugagcagagugaacaaggugaucaucggcaccaagaccauccuggccaacggcgcccugagagccgugaccggcacccacacccuggcccuggccgccaagcaccacagcaccccccugaucgugugcgcccccauguucaagcugagcccccaguuccccaacgaggaggacagcuuccacaaguucguggcccccgaggaggugcugcccuucaccgagggcgacauccuggagaaggugagcgugcacugccccguguucgacuacgugccccccgagcugaucacccuguucaucagcaacaucggcggcaacgcccccagcuacaucuacagacugaugagcgagcuguaccaccccgacgaccacgugcuguaa

SEQ ID NO: 16514 - RNA, 1269 nt, Artificial Sequence
  EIF2B3__Homo_sapiens__XP_011540698
auggaguuccaggccguggugauggccgugggcggcggcagcagaaugaccgaccugaccagcagcauccccaagccccugcugcccgugggcaacaagccccugaucugguacccccugaaccugcuggagagagugggcuucgaggaggugaucguggugaccaccagagacgugcagaaggcccugugcgccgaguucaagaugaagaugaagcccgacaucgugugcauccccgacgacgccgacaugggcaccgccgacagccugagauacaucuaccccaagcugaagaccgacgugcuggugcugagcugcgaccugaucaccgacguggcccugcacgaggugguggaccuguucagagccuacgacgccagccuggccaugcugaugagaaagggccaggacagcaucgagcccgugcccggccagaagggcaagaagaaggccguggagcagagagacuucaucggcguggacagcaccggcaagagacugcuguucauggccaacgaggccgaccuggacgaggagcuggugaucaagggcagcauccugcagaagagcaucaccagcaucagaagcgagcugauccccuaccuggugagaaagcaguucagcagcgccagcagccagcagggccaggaggagaaggaggaggaccugaagaagaaggagcugaagagccuggacaucuacagcuucaucaaggaggccaacacccugaaccuggcccccuacgacgccugcuggaacgccugcagaggcgacagaugggaggaccugagcagaagccaggugagaugcuacgugcacaucaugaaggagggccugugcagcagagugagcacccugggccuguacauggaggccaacagacaggugcccaagcugcugagcgcccugugccccgaggagccccccgugcacagcagcgcccagaucgugagcaagcaccuggugggcguggacagccugaucggccccgagacccagaucggcgagaagagcagcaucaagagaagcgugaucggcagcagcugccugaucaaggacagagugaccaucaccaacugccugcugaugaacagcgugaccguggaggagggcagcaacauccagggcagcgugaucugcaacaacgccgugaucgagaagggcgccgacaucaaggacugccugaucggcagcggccagagaaucgaggccaaggccaagagagugaacgaggugaucgugggcaacgaccagcugauggagaucuaa

SEQ ID NO: 16515 - RNA, 1572 nt, Artificial Sequence
  EIF2B4__Homo_sapiens__NP_001029288
auggccgccguggccguggccgugagagaggacagcggcagcggcaugaaggccgagcugccccccggccccggcgccgugggcagagagaugaccaaggaggagaagcugcagcugagaaaggagaagaagcagcagaagaagaagagaaaggaggagaagggcgccgagcccgagaccggcagcgccgugagcgccgcccagugccaggugggccccaccagagagcugcccgagagcggcauccagcugggcacccccagagagaaggugcccgccggcagaagcaaggccgagcugagagccgagagaagagccaagcaggaggccgagagagcccugaagcaggccagaaagggcgagcagggcggccccccccccaaggccagccccagcaccgccggcgagacccccagcggcgugaagagacugcccgaguacccccagguggacgaccugcugcugagaagacuggugaagaagcccgagagacagcaggugcccaccagaaaggacuacggcagcaaggugagccuguucagccaccugccccaguacagcagacagaacagccugacccaguucaugagcauccccagcagcgugauccaccccgccauggugagacugggccugcaguacagccagggccuggugagcggcagcaacgccagaugcaucgcccugcugagagcccugcagcaggugauccaggacuacaccaccccccccaacgaggagcugagcagagaccuggugaacaagcugaagcccuacaugagcuuccugacccagugcagaccccugagcgccagcaugcacaacgccaucaaguuccugaacaaggagaucaccagcgugggcagcagcaagagagaggaggaggccaagagcgagcugagagccgccaucgacagauacgugcaggagaagaucgugcuggccgcccaggccaucagcagauucgccuaccagaagaucagcaacggcgacgugauccugguguacggcugcagcagccuggugagcagaauccugcaggaggccuggaccgagggcagaagauucagagugguggugguggacagcagacccuggcuggagggcagacacacccugagaagccuggugcacgccggcgugcccgccagcuaccugcugauccccgccgccagcuacgugcugcccgaggugagcaaggugcugcugggcgcccacgcccugcuggccaacggcagcgugaugagcagagugggcaccgcccagcuggcccugguggccagagcccacaacgugcccgugcuggugugcugcgagaccuacaaguucugcgagagagugcagaccgacgccuucgugagcaacgagcuggacgaccccgacgaccugcagugcaagagaggcgagcacguggcccuggccaacuggcagaaccacgccagccugagacugcugaaccugguguacgacgugaccccccccgagcugguggaccuggugaucaccgagcugggcaugauccccugcagcagcgugcccguggugcugagagugaagagcagcgaccaguaa

SEQ ID NO: 16516 - RNA, 2166 nt, Artificial Sequence
  EIF2B5__Homo_sapiens__NP_003898
auggccgcccccgugguggccccccccggcgugguggugagcagagccaacaagagaagcggcgccggccccggcggcagcggcggcggcggcgccagaggcgccgaggaggagcccccccccccccugcaggccgugcugguggccgacagcuucgacagaagauucuuccccaucagcaaggaccagcccagagugcugcugccccuggccaacguggcccugaucgacuacacccuggaguuccugaccgccaccggcgugcaggagaccuucguguucugcugcuggaaggccgcccagaucaaggagcaccugcugaagagcaaguggugcagacccaccagccugaacguggugagaaucaucaccagcgagcuguacagaagccugggcgacgugcugagagacguggacgccaaggcccuggugagaagcgacuuccugcugguguacggcgacgugaucagcaacaucaacaucaccagagcccuggaggagcacagacugagaagaaagcuggagaagaacgugagcgugaugaccaugaucuucaaggagagcagccccagccaccccaccagaugccacgaggacaacguggugguggccguggacagcaccaccaacagagugcugcacuuccagaagacccagggccugagaagauucgccuucccccugagccuguuccagggcagcagcgacggcguggaggugagauacgaccugcuggacugccacaucagcaucugcagcccccagguggcccagcuguucaccgacaacuucgacuaccagaccagagacgacuucgugagaggccugcuggugaacgaggagauccugggcaaccagauccacaugcacgugaccgccaaggaguacggcgccagagugagcaaccugcacauguacagcgccgugugcgccgacgugaucagaagauggguguacccccugacccccgaggccaacuucaccgacagcaccacccagagcugcacccacagcagacacaacaucuacagaggccccgaggugagccugggccacggcagcauccuggaggagaacgugcugcugggcagcggcaccgugaucggcagcaacugcuucaucaccaacagcgugaucggccccggcugccacaucggcgacaacguggugcuggaccagaccuaccuguggcagggcgugagaguggccgccggcgcccagauccaccagagccugcugugcgacaacgccgaggugaaggagagagugacccugaagcccagaagcgugcugaccagccaggugguggugggccccaacaucacccugcccgagggcagcgugaucagccugcacccccccgacgccgaggaggacgaggacgacggcgaguucagcgacgacagcggcgccgaccaggagaaggacaaggugaagaugaagggcuacaaccccgccgaggugggcgccgccggcaagggcuaccuguggaaggccgccggcaugaacauggaggaggaggaggagcugcagcagaaccuguggggccugaagaucaacauggaggaggagagcgagagcgagagcgagcagagcauggacagcgaggagcccgacagcagaggcggcagcccccagauggacgacaucaagguguuccagaacgaggugcugggcacccugcagagaggcaaggaggagaacaucagcugcgacaaccuggugcuggagaucaacagccugaaguacgccuacaacaucagccugaaggaggugaugcaggugcugagccacguggugcuggaguucccccugcagcagauggacagcccccuggacagcagcagauacugcgcccugcugcugccccugcugaaggccuggagccccguguucagaaacuacaucaagagagccgccgaccaccuggaggcccuggccgccaucgaggacuucuuccuggagcacgaggcccugggcaucagcauggccaaggugcugauggccuucuaccagcuggagauccuggccgaggagaccauccugagcugguucagccagagagacaccaccgacaagggccagcagcugagaaagaaccagcagcugcagagauucauccaguggcugaaggaggccgaggaggagagcagcgaggacgacuaa

SEQ ID NO: 16517 - RNA, 948 nt, Artificial Sequence
  EIF2S1__Homo_sapiens__NP_004085
augcccggccugagcugcagauucuaccagcacaaguuccccgagguggaggacguggugauggugaacgugagaagcaucgccgagaugggcgccuacgugagccugcuggaguacaacaacaucgagggcaugauccugcugagcgagcugagcagaagaagaaucagaagcaucaacaagcugaucagaaucggcagaaacgagugcgugguggugaucagaguggacaaggagaagggcuacaucgaccugagcaagagaagagugagccccgaggaggccaucaagugcgaggacaaguucaccaagagcaagaccguguacagcauccugagacacguggccgaggugcuggaguacaccaaggacgagcagcuggagagccuguuccagagaaccgccuggguguucgacgacaaguacaagagacccggcuacggcgccuacgacgccuucaagcacgccgugagcgaccccagcauccuggacagccuggaccugaacgaggacgagagagaggugcugaucaacaacaucaacagaagacugaccccccaggccgugaagaucagagccgacaucgagguggccugcuacggcuacgagggcaucgacgccgugaaggaggcccugagagccggccugaacugcagcaccgagaacaugcccaucaagaucaaccugaucgccccccccagauacgugaugaccaccaccacccuggagagaaccgagggccugagcgugcugagccaggccauggccgugaucaaggagaagaucgaggagaagagaggcguguucaacgugcagauggagcccaagguggugaccgacaccgacgagaccgagcuggccagacagauggagagacuggagagagagaacgccgagguggacggcgacgacgacgccgaggagauggaggccaaggccgaggacuaa

SEQ ID NO: 16518 - RNA, 1002 nt, Artificial Sequence
  EIF2S2__Homo_sapiens__NP_003899
augagcggcgacgagaugaucuucgaccccaccaugagcaagaagaagaagaagaagaagaagcccuucaugcuggacgaggagggcgacacccagaccgaggagacccagcccagcgagaccaaggagguggagcccgagcccaccgaggacaaggaccuggaggccgacgaggaggacaccagaaagaaggacgccagcgacgaccuggacgaccugaacuucuucaaccagaagaagaagaagaagaagaccaagaagaucuucgacaucgacgaggccgaggagggcgugaaggaccugaagaucgagagcgacgugcaggagcccaccgagcccgaggacgaccuggacaucaugcugggcaacaagaagaagaagaagaagaacgugaaguuccccgacgaggacgagauccuggagaaggacgaggcccuggaggacgaggacaacaagaaggacgacggcaucagcuucagcaaccagaccggccccgccugggccggcagcgagagagacuacaccuacgaggagcugcugaacagaguguucaacaucaugagagagaagaaccccgacaugguggccggcgagaagagaaaguucgugaugaagcccccccagguggugagagugggcaccaagaagaccagcuucgugaacuucaccgacaucugcaagcugcugcacagacagcccaagcaccugcuggccuuccugcuggccgagcugggcaccagcggcagcaucgacggcaacaaccagcuggugaucaagggcagauuccagcagaagcagaucgagaacgugcugagaagauacaucaaggaguacgugaccugccacaccugcagaagccccgacaccauccugcagaaggacaccagacuguacuuccugcagugcgagaccugccacagcagaugcagcguggccagcaucaagaccggcuuccaggccgugaccggcaagagagcccagcugagagccaaggccaacuaa

SEQ ID NO: 16519 - RNA, 1419 nt, Artificial Sequence
  EIF2S3__Homo_sapiens__NP_001406
auggccggcggcgaggccggcgugacccugggccagccccaccugagcagacaggaccugaccacccuggacgugaccaagcugaccccccugagccacgaggugaucagcagacaggccaccaucaacaucggcaccaucggccacguggcccacggcaagagcaccguggugaaggccaucagcggcgugcacaccgugagauucaagaacgagcuggagagaaacaucaccaucaagcugggcuacgccaacgccaagaucuacaagcuggacgaccccagcugccccagacccgagugcuacagaagcugcggcagcagcacccccgacgaguuccccaccgacauccccggcaccaagggcaacuucaagcuggugagacacgugagcuucguggacugccccggccacgacauccugauggccaccaugcugaacggcgccgccgugauggacgccgcccugcugcugaucgccggcaacgagagcugcccccagccccagaccagcgagcaccuggccgccaucgagaucaugaagcugaagcacauccugauccugcagaacaagaucgaccuggugaaggagagccaggccaaggagcaguacgagcagauccuggccuucgugcagggcaccguggccgagggcgcccccaucauccccaucagcgcccagcugaaguacaacaucgagguggugugcgaguacaucgugaagaagauccccgugccccccagagacuucaccagcgagcccagacugaucgugaucagaagcuucgacgugaacaagcccggcugcgagguggacgaccugaagggcggcguggccggcggcagcauccugaagggcgugcugaaggugggccaggagaucgaggugagacccggcaucgugagcaaggacagcgagggcaagcugaugugcaagcccaucuucagcaagaucgugagccuguucgccgagcacaacgaccugcaguacgccgcccccggcggccugaucggcgugggcaccaagaucgaccccacccugugcagagccgacagaauggugggccaggugcugggcgccgugggcgcccugcccgagaucuucaccgagcuggagaucagcuacuuccugcugagaagacugcugggcgugagaaccgagggcgacaagaaggccgccaaggugcagaagcugagcaagaacgaggugcugauggugaacaucggcagccugagcaccggcggcagagugagcgccgugaaggccgaccugggcaagaucgugcugaccaaccccgugugcaccgaggugggcgagaagaucgcccugagcagaagaguggagaagcacuggagacugaucggcuggggccagaucagaagaggcgugaccaucaagcccaccguggacgacgacuaa

SEQ ID NO: 16520 - RNA, 4149 nt, Artificial Sequence
  EIF3A__Homo_sapiens__NP_003741
augcccgccuacuuccagagacccgagaacgcccugaagagagccaacgaguuccuggaggugggcaagaagcagcccgcccuggacgugcuguacgacgugaugaagagcaagaagcacagaaccuggcagaagauccacgagcccaucaugcugaaguaccuggagcugugcguggaccugagaaagagccaccuggccaaggagggccuguaccaguacaagaacaucugccagcaggugaacaucaagagccuggaggacguggugagagccuaccugaagauggccgaggagaagaccgaggccgccaaggaggagagccagcagauggugcuggacaucgaggaccuggacaacauccagacccccgagagcgugcugcugagcgccgugagcggcgaggacacccaggacagaaccgacagacugcugcugacccccugggugaaguuccugugggagagcuacagacagugccuggaccugcugagaaacaacagcagaguggagagacuguaccacgacaucgcccagcaggccuucaaguucugccugcaguacaccagaaaggccgaguucagaaagcugugcgacaaccugagaaugcaccugagccagauccagagacaccacaaccagagcaccgccaucaaccugaacaaccccgagagccagagcaugcaccuggagaccagacuggugcagcuggacagcgccaucagcauggagcuguggcaggaggccuucaaggccguggaggacauccacggccuguucagccugagcaagaagccccccaagccccagcugauggccaacuacuacaacaaggugagcaccguguucuggaagagcggcaacgcccuguuccacgccagcacccugcacagacuguaccaccugagcagagagaugagaaagaaccugacccaggacgagaugcagagaaugagcaccagagugcugcuggccacccugagcauccccaucacccccgagagaaccgacaucgccagacugcuggacauggacggcaucaucguggagaagcagagaagacuggccacccugcugggccugcaggccccccccaccagaaucggccugaucaacgacauggugagauucaacgugcugcaguacguggugcccgaggugaaggaccuguacaacuggcuggagguggaguucaacccccugaagcugugcgagagagugaccaaggugcugaacugggugagagagcagcccgagaaggagcccgagcugcagcaguacgugccccagcugcagaacaacaccauccugagacugcugcagcaggugagccagaucuaccagagcaucgaguucagcagacugaccagccuggugcccuucguggacgccuuccagcuggagagagccaucguggacgccgccagacacugcgaccugcaggugagaaucgaccacaccagcagaacccugagcuucggcagcgaccugaacuacgccaccagagaggacgcccccaucggcccccaccugcagagcaugcccagcgagcagaucagaaaccagcugaccgccaugagcagcgugcuggccaaggcccuggaggugaucaagcccgcccacauccugcaggagaaggaggagcagcaccagcuggccgugaccgccuaccugaagaacagcagaaaggagcaccagagaauccuggccagaagacagaccaucgaggagagaaaggagagacuggagagccugaacauccagagagagaaggaggagcuggagcagagagaggccgagcugcagaaggugagaaaggccgaggaggagagacugagacaggaggccaaggagagagagaaggagagaauccugcaggagcacgagcagaucaagaagaagaccgugagagagagacuggagcagaucaagaagaccgagcugggcgccaaggccuucaaggacaucgacaucgaggaccuggaggagcuggaccccgacuucaucauggccaagcagguggagcagcuggagaaggagaagaaggagcugcaggagagacugaagaaccaggagaagaagaucgacuacuucgagagagccaagagacuggaggagaucccccugaucaagagcgccuacgaggagcagagaaucaaggacauggaccugugggagcagcaggaggaggagagaaucaccaccaugcagcuggagagagagaaggcccuggagcacaagaacagaaugagcagaaugcuggaggacagagaccuguucgugaugagacugaaggccgccagacagagcguguacgaggagaagcugaagcaguucgaggagagacuggccgaggagagacacaacagacuggaggagagaaagagacagagaaaggaggagagaagaaucaccuacuacagagagaaggaggaggaggagcagagaagagccgaggagcagaugcugaaggagagagaggagagagagagagccgagagagccaagagagaggaggagcugagagaguaccaggagagagugaagaagcuggaggagguggagagaaagaagagacagagagagcuggagaucgaggagagagagagaagaagagaggaggagagaagacugggcgacagcagccugagcagaaaggacagcagauggggcgacagagacagcgagggcaccuggagaaagggccccgaggccgacagcgaguggagaagaggcccccccgagaaggaguggagaagaggcgagggcagagacgaggacagaagccacagaagagacgaggagagacccagaagacugggcgacgacgaggacagagagcccagccugagacccgacgacgacagagugcccagaagaggcauggacgacgacagaggccccagaagaggccccgaggaggacagauucagcagaagaggcgccgacgacgacagacccagcuggagaaacaccgacgacgacagaccccccagaagaaucgccgacgaggacagaggcaacuggagacacgccgacgacgacagaccccccagaagaggccuggacgaggacagaggcagcuggagaaccgccgacgaggacagaggccccagaagaggcauggacgacgacagaggccccagaagaggcggcgccgacgacgagagaagcagcuggagaaacgccgacgacgacagaggccccagaagaggccuggacgacgacagaggccccagaagaggcauggacgacgacagaggccccagaagaggcauggacgacgacagaggccccagaagaggcauggacgacgacagaggccccagaagaggccuggacgacgacagaggccccuggagaaacgccgacgacgacagaauccccagaagaggcgccgaggacgacagaggccccuggagaaacauggacgacgacagacugagcagaagagccgacgacgacagauuccccagaagaggcgacgacagcagacccggccccuggagaccccuggugaagcccggcggcuggagagagaaggagaaggccagagaggagagcuggggcccccccagagagagcagacccagcgaggagagagagugggacagagagaaggagagagacagagacaaccaggacagagaggagaacgacaaggaccccgagagagagagagacagagagagagacguggacagagaggacagauucagaagacccagagacgagggcggcuggagaagaggccccgccgaggagagcagcagcuggagagacagcagcagaagagacgacagagacagagacgacagaagaagagagagagacgacagaagagaccugagagagagaagagaccugagagacgacagagacagaagaggccccccccugagaagcgagagagaggaggugagcagcuggagaagagccgacgacagaaaggacgacagaguggaggagagagacccccccagaagagugcccccccccgcccugagcagagacagagagagagacagagacagagagagagagggcgagaaggagaaggccagcuggagagccgagaaggacagagagagccugagaagaaccaagaacgagaccgacgaggacggcuggaccaccgugagaagauaa

SEQ ID NO: 16521 - RNA, 2445 nt, Artificial Sequence
  EIF3B__Homo_sapiens__NP_001032360
augcaggacgccgagaacguggccgugcccgaggccgccgaggagagagccgagcccggccagcagcagcccgccgccgagcccccccccgccgagggccugcugagacccgccggccccggcgcccccgaggccgccggcaccgaggccagcagcgaggaggugggcaucgccgaggccggccccgagagcgaggugagaaccgagcccgccgccgaggccgaggccgccagcggccccagcgagagccccagcccccccgccgccgaggagcugcccggcagccacgccgagccccccgugcccgcccagggcgaggcccccggcgagcaggccagagacgagagaagcgacagcagagcccaggccgugagcgaggacgccggcggcaacgagggcagagccgccgaggccgagcccagagcccuggagaacggcgacgccgacgagcccagcuucagcgaccccgaggacuucguggacgacgugagcgaggaggagcugcugggcgacgugcugaaggacagaccccaggaggccgacggcaucgacagcgugaucgugguggacaacgugccccaggugggccccgacagacuggagaagcugaagaacgugauccacaagaucuucagcaaguucggcaagaucaccaacgacuucuaccccgaggaggacggcaagaccaagggcuacaucuuccuggaguacgccagccccgcccacgccguggacgccgugaagaacgccgacggcuacaagcuggacaagcagcacaccuucagagugaaccuguucaccgacuucgacaaguacaugaccaucagcgacgagugggacauccccgagaagcagcccuucaaggaccugggcaaccugagauacuggcuggaggaggccgagugcagagaccaguacagcgugaucuucgagagcggcgacagaaccagcaucuucuggaacgacgugaaggaccccgugagcaucgaggagagagccagauggaccgagaccuacgugagauggagccccaagggcaccuaccuggccaccuuccaccagagaggcaucgcccuguggggcggcgagaaguucaagcagauccagagauucagccaccagggcgugcagcugaucgacuucagccccugcgagagauaccuggugaccuucagcccccugauggacacccaggacgacccccaggccaucaucaucugggacauccugaccggccacaagaagagaggcuuccacugcgagagcagcgcccacuggcccaucuucaaguggagccacgacggcaaguucuucgccagaaugacccuggacacccugagcaucuacgagacccccagcaugggccugcuggacaagaagagccugaagaucagcggcaucaaggacuucagcuggagccccggcggcaacaucaucgccuucugggugcccgaggacaaggacauccccgccagagugacccugaugcagcugcccaccagacaggagaucagagugagaaaccuguucaacgugguggacugcaagcugcacuggcagaagaacggcgacuaccugugcgugaagguggacagaacccccaagggcacccagggcguggugaccaacuucgagaucuucagaaugagagagaagcaggugcccguggacgugguggagaugaaggagaccaucaucgccuucgccugggagcccaacggcagcaaguucgccgugcugcacggcgaggcccccagaaucagcgugagcuucuaccacgugaagaacaacggcaagaucgagcugaucaagauguucgacaagcagcaggccaacaccaucuucuggagcccccagggccaguucguggugcuggccggccugagaagcaugaacggcgcccuggccuucguggacaccagcgacugcaccgugaugaacaucgccgagcacuacauggccagcgacguggagugggaccccaccggcagauacguggugaccagcgugagcugguggagccacaagguggacaacgccuacuggcuguggaccuuccagggcagacugcugcagaagaacaacaaggacagauucugccagcugcuguggagacccagaccccccacccugcugagccaggagcagaucaagcagaucaagaaggaccugaagaaguacagcaagaucuucgagcagaaggacagacugagccagagcaaggccagcaaggagcugguggagagaagaagaaccaugauggaggacuucagaaaguacagaaagauggcccaggagcuguacauggagcagaagaacgagagacuggagcugagaggcggcguggacaccgacgagcuggacagcaacguggacgacugggaggaggagaccaucgaguucuucgugaccgaggagaucaucccccugggcaaccaggaguaa

SEQ ID NO: 16522 - RNA, 2742 nt, Artificial Sequence
  EIF3C__Homo_sapiens__NP_001254503
augagcagauucuucaccaccggcagcgacagcgagagcgagagcagccugagcggcgaggagcuggugaccaagcccgugggcggcaacuacggcaagcagccccugcugcugagcgaggacgaggaggacaccaagagaguggugagaagcgccaaggacaagagauucgaggagcugaccaaccugaucagaaccaucagaaacgccaugaagaucagagacgugaccaagugccuggaggaguucgagcugcugggcaaggccuacggcaaggccaagagcaucguggacaaggagggcgugcccagauucuacaucagaauccuggccgaccuggaggacuaccugaacgagcugugggaggacaaggagggcaagaagaagaugaacaagaacaacgccaaggcccugagcacccugagacagaagaucagaaaguacaacagagacuucgagagccacaucaccagcuacaagcagaaccccgagcagagcgccgacgaggacgccgagaagaacgaggaggacagcgagggcagcagcgacgaggacgaggacgaggacggcgugagcgccgccaccuuccugaagaagaagagcgaggcccccagcggcgagagcagaaaguuccugaagaagauggacgacgaggacgaggacagcgaggacagcgaggacgacgaggacugggacaccggcagcaccagcagcgacagcgacagcgaggaggaggagggcaagcagaccgcccuggccagcagauuccugaagaaggcccccaccaccgacgaggacaagaaggccgccgagaagaagagagaggacaaggccaagaagaagcacgacagaaagagcaagagacuggacgaggaggaggaggacaacgagggcggcgagugggagagagugagaggcggcgugccccuggugaaggagaagcccaagauguucgccaagggcaccgagaucacccacgccguggugaucaagaagcugaacgagauccugcaggccagaggcaagaagggcaccgacagagccgcccagaucgagcugcugcagcugcuggugcagaucgccgccgagaacaaccugggcgagggcgugaucgugaagaucaaguucaacaucaucgccagccuguacgacuacaaccccaaccuggccaccuacaugaagcccgagauguggggcaagugccuggacugcaucaacgagcugauggacauccuguucgccaaccccaacaucuucgugggcgagaacauccuggaggagagcgagaaccugcacaacgccgaccagccccugagagugagaggcugcauccugacccugguggagagaauggacgaggaguucaccaagaucaugcagaacaccgacccccacagccaggaguacguggagcaccugaaggacgaggcccaggugugcgccaucaucgagagagugcagagauaccuggaggagaagggcaccaccgaggaggugugcagaaucuaccugcugagaauccugcacaccuacuacaaguucgacuacaaggcccaccagagacagcugaccccccccgagggcagcagcaagagcgagcaggaccaggccgagaacgagggcgaggacagcgccgugcugauggagagacugugcaaguacaucuacgccaaggacagaaccgacagaaucagaaccugcgccauccugugccacaucuaccaccacgcccugcacagcagaugguaccaggccagagaccugaugcugaugagccaccugcaggacaacauccagcacgccgacccccccgugcagauccuguacaacagaaccauggugcagcugggcaucugcgccuucagacagggccugaccaaggacgcccacaacgcccugcuggacauccagagcagcggcagagccaaggagcugcugggccagggccugcugcugagaagccugcaggagagaaaccaggagcaggagaagguggagagaagaagacaggugcccuuccaccugcacaucaaccuggagcugcuggagugcguguaccuggugagcgccaugcugcuggagauccccuacauggccgcccacgagagcgacgccagaagaagaaugaucagcaagcaguuccaccaccagcugagagugggcgagagacagccccugcugggcccccccgagagcaugagagagcacgugguggccgccagcaaggccaugaagaugggcgacuggaagaccugccacagcuucaucaucaacgagaagaugaacggcaaggugugggaccuguuccccgaggccgacaaggugagaaccaugcuggugagaaagauccaggaggagagccugagaaccuaccuguucaccuacagcagcguguacgacagcaucagcauggagacccugagcgacauguucgagcuggaccugcccaccgugcacagcaucaucagcaagaugaucaucaacgaggagcugauggccagccuggaccagcccacccagaccguggugaugcacagaaccgagcccaccgcccagcagaaccuggcccugcagcuggccgagaagcugggcagccugguggagaacaacgagagaguguucgaccacaagcagggcaccuacggcggcuacuucagagaccagaaggacggcuacagaaagaacgagggcuacaugagaagaggcggcuacagacagcagcagagccagaccgccuacuaa

SEQ ID NO: 16523 - RNA, 1338 nt, Artificial Sequence
  EIF3E__Homo_sapiens__NP_001559
auggccgaguacgaccugaccaccagaaucgcccacuuccuggacagacaccugguguucccccugcuggaguuccugagcgugaaggagaucuacaacgagaaggagcugcugcagggcaagcuggaccugcugagcgacaccaacaugguggacuucgccauggacguguacaagaaccuguacagcgacgacaucccccacgcccugagagagaagagaaccaccgugguggcccagcugaagcagcugcaggccgagaccgagcccaucgugaagauguucgaggaccccgagaccaccagacagaugcagagcaccagagacggcagaaugcuguucgacuaccuggccgacaagcacggcuucagacaggaguaccuggacacccuguacagauacgccaaguuccaguacgagugcggcaacuacagcggcgccgccgaguaccuguacuucuucagagugcuggugcccgccaccgacagaaacgcccugagcagccuguggggcaagcuggccagcgagauccugaugcagaacugggacgccgccauggaggaccugaccagacugaaggagaccaucgacaacaacagcgugagcagcccccugcagagccugcagcagagaaccuggcugauccacuggagccuguucguguucuucaaccaccccaagggcagagacaacaucaucgaccuguuccuguaccagccccaguaccugaacgccauccagaccaugugcccccacauccugagauaccugaccaccgccgugaucaccaacaaggacgugagaaagagaagacaggugcugaaggaccuggugaaggugauccagcaggagagcuacaccuacaaggaccccaucaccgaguucguggagugccuguacgugaacuucgacuucgacggcgcccagaagaagcugagagagugcgagagcgugcuggugaacgacuucuuccugguggccugccuggaggacuucaucgagaacgccagacuguucaucuucgagaccuucugcagaauccaccagugcaucagcaucaacaugcuggccgacaagcugaacaugacccccgaggaggccgagagauggaucgugaaccugaucagaaacgccagacuggacgccaagaucgacagcaagcugggccacguggugaugggcaacaacgccgugagccccuaccagcaggugaucgagaagaccaagagccugagcuucagaagccagaugcuggccaugaacaucgagaagaagcugaaccagaacagcagaagcgaggcccccaacugggccacccaggacagcggcuucuacuaa

SEQ ID NO: 16524 - RNA, 1074 nt, Artificial Sequence
  EIF3F__Homo_sapiens__NP_003745
auggccacccccgccgugcccgugagcgccccccccgccacccccacccccgugcccgccgccgcccccgccagcgugcccgcccccacccccgcccccgccgccgcccccgugcccgccgccgcccccgccagcagcagcgaccccgccgccgccgccgccgccaccgccgcccccggccagacccccgccagcgcccaggcccccgcccagacccccgcccccgcccugcccggccccgcccugcccggccccuuccccggcggcagaguggugagacugcaccccgugauccuggccagcaucguggacagcuacgagagaagaaacgagggcgccgccagagugaucggcacccugcugggcaccguggacaagcacagcguggaggugaccaacugcuucagcgugccccacaacgagagcgaggacgagguggccguggacauggaguucgccaagaacauguacgagcugcacaagaaggugagccccaacgagcugauccugggcugguacgccaccggccacgacaucaccgagcacagcgugcugauccacgaguacuacagcagagaggcccccaaccccauccaccugaccguggacaccagccugcagaacggcagaaugagcaucaaggccuacgugagcacccugaugggcgugcccggcagaaccaugggcgugauguucaccccccugaccgugaaguacgccuacuacgacaccgagagaaucggcguggaccugaucaugaagaccugcuucagccccaacagagugaucggccugagcagcgaccugcagcaggugggcggcgccagcgccagaauccaggacgcccugagcaccgugcugcaguacgccgaggacgugcugagcggcaaggugagcgccgacaacaccgugggcagauuccugaugagccuggugaaccaggugcccaagaucgugcccgacgacuucgagaccaugcugaacagcaacaucaacgaccugcugauggugaccuaccuggccaaccugacccagagccagaucgcccugaacgagaagcuggugaaccuguaa

SEQ ID NO: 16525 - RNA, 1059 nt, Artificial Sequence
  EIF3H__Homo_sapiens__NP_003747
auggccagcagaaaggagggcaccggcagcaccgccaccagcagcagcagcaccgccggcgccgccggcaagggcaagggcaagggcggcagcggcgacagcgccgugaagcaggugcagaucgacggccugguggugcugaagaucaucaagcacuaccaggaggagggccagggcaccgagguggugcagggcgugcugcugggccuggugguggaggacagacuggagaucaccaacugcuuccccuucccccagcacaccgaggacgacgccgacuucgacgaggugcaguaccagauggagaugaugagaagccugagacacgugaacaucgaccaccugcacgugggcugguaccagagcaccuacuacggcagcuucgugaccagagcccugcuggacagccaguucagcuaccagcacgccaucgaggagagcguggugcugaucuacgaccccaucaagaccgcccagggcagccugagccugaaggccuacagacugacccccaagcugauggaggugugcaaggagaaggacuucagccccgaggcccugaagaaggccaacaucaccuucgaguacauguucgaggaggugcccaucgugaucaagaacagccaccugaucaacgugcugaugugggagcuggagaagaagagcgccguggccgacaagcacgagcugcugagccuggccagcagcaaccaccugggcaagaaccugcagcugcugauggacagaguggacgagaugagccaggacaucgugaaguacaacaccuacaugagaaacaccagcaagcagcagcagcagaagcaccaguaccagcagagaagacagcaggagaacaugcagagacagagcagaggcgagcccccccugcccgaggaggaccugagcaagcuguucaagcccccccagccccccgccagaauggacagccugcugaucgccggccagaucaacaccuacugccagaacaucaaggaguucaccgcccagaaccugggcaagcuguucauggcccaggcccugcaggaguacaacaacuaa

SEQ ID NO: 16526 - RNA, 630 nt, Artificial Sequence
  EIF3J__Homo_sapiens__NP_001271265
auggccgccgccgccgccgccgccggcgacagcgacagcugggacgccgacgccuucagcguggaggaccccgugagaaaggugggcggcggcggcaccgccggcggcgacagaugggagggcgaggacgaggacgaggacgugaagcuggaggagcccgaggagcccaaggugcugacccccgaggagcagcuggccgacaagcugagacugaagaagcugcaggaggagagcgaccuggagcuggccaaggagaccuucggcgugaacaacgccguguacggcaucgacgccaugaaccccagcagcagagacgacuucaccgaguucggcaagcugcugaaggacaagaucacccaguacgagaagagccuguacuacgccagcuuccuggaggugcuggugagagacgugugcaucagccuggagaucgacgaccugaagaagaucaccaacagccugaccgugcugugcagcgagaagcagaagcaggagaagcagagcaaggccaagaagaagaagaagggcguggugcccggcggcggccugaaggccaccaugaaggacgaccuggccgacuacggcggcuacgacggcggcuacgugcaggacuacgaggacuucauguaa

SEQ ID NO: 16527 - RNA, 657 nt, Artificial Sequence
  EIF3K__Homo_sapiens__NP_037366
auggccauguucgagcagaugagagccaacgugggcaagcugcugaagggcaucgacagauacaaccccgagaaccuggccacccuggagagauacguggagacccaggccaaggagaacgccuacgaccuggaggccaaccuggccgugcugaagcuguaccaguucaaccccgccuucuuccagaccaccgugaccgcccagauccugcugaaggcccugaccaaccugccccacaccgacuucacccugugcaagugcaugaucgaccaggcccaccaggaggagagacccaucagacagauccuguaccugggcgaccugcuggagaccugccacuuccaggccuucuggcaggcccuggacgagaacauggaccugcuggagggcaucaccggcuucgaggacagcgugagaaaguucaucugccacguggugggcaucaccuaccagcacaucgacagauggcugcuggccgagaugcugggcgaccugagcgacagccagcugaagguguggaugagcaaguacggcuggagcgccgacgagagcggccagaucuucaucugcagccaggaggagagcaucaagcccaagaacaucguggagaagaucgacuucgacagcgugagcagcaucauggccagcagccaguaa

SEQ ID NO: 16528 - RNA, 1125 nt, Artificial Sequence
  EIF3M__Homo_sapiens__NP_006351
augagcgugcccgccuucaucgacaucagcgaggaggaccaggccgccgagcugagagccuaccugaagagcaagggcgccgagaucagcgaggagaacagcgagggcggccugcacguggaccuggcccagaucaucgaggccugcgacgugugccugaaggaggacgacaaggacguggagagcgugaugaacagcguggugagccugcugcugauccuggagcccgacaagcaggaggcccugaucgagagccugugcgagaagcuggugaaguucagagagggcgagagacccagccugagacugcagcugcugagcaaccuguuccacggcauggacaagaacacccccgugagauacaccguguacugcagccugaucaagguggccgccagcugcggcgccauccaguacauccccaccgagcuggaccaggugagaaaguggaucagcgacuggaaccugaccaccgagaagaagcacacccugcugagacugcuguacgaggcccugguggacugcaagaagagcgacgccgccagcaaggugaugguggagcugcugggcagcuacaccgaggacaacgccagccaggccagaguggacgcccacagaugcaucgugagagcccugaaggaccccaacgccuuccuguucgaccaccugcugacccugaagcccgugaaguuccuggagggcgagcugauccacgaccugcugaccaucuucgugagcgccaagcuggccagcuacgugaaguucuaccagaacaacaaggacuucaucgacagccugggccugcugcacgagcagaacauggccaagaugagacugcugaccuucaugggcauggccguggagaacaaggagaucagcuucgacaccaugcagcaggagcugcagaucggcgccgacgacguggaggccuucgugaucgacgccgugagaaccaagaugguguacugcaagaucgaccagacccagagaaaggugguggugagccacagcacccacagaaccuucggcaagcagcaguggcagcagcuguacgacacccugaacgccuggaagcagaaccugaacaaggugaagaacagccugcugagccugagcgacaccuaa

SEQ ID NO: 16529 - RNA, 1044 nt, Artificial Sequence
  EIF4A1__Homo_sapiens__NP_001191439
augagcgccagccaggacagcagaagcagagacaacggccccgacggcauggagcccgagggcgugaucgagagcaacuggaacgagaucguggacagcuucgacgacaugaaccugagcgagagccugcugagaggcaucuacgccuacggcuucgagaagcccagcgccauccagcagagagccauccugcccugcaucaagggcuacgacgugaucgcccaggcccagagcggcaccggcaagaccgccaccuucgccaucagcauccugcagcagaucgagcuggaccugaaggccacccaggcccuggugcuggcccccaccagagagcuggcccagcagauccagaagguggugauggcccugggcgacuacaugggcgccagcugccacgccugcaucggcggcaccaacgugagagccgaggugcagaagcugcagauggaggccccccacaucaucgugggcacccccggcagaguguucgacaugcugaacagaagauaccugagccccaaguacaucaagauguucgugcuggacgaggccgacgagaugcugagcagaggcuucaaggaccagaucuacgacaucuuccagaagcugaacagcaacacccagguggugcugcugagcgccaccaugcccagcgacgugcuggaggugaccaagaaguucaugagagaccccaucagaauccuggugaagaaggaggagcugacccuggagggcaucagacaguucuacaucaacguggagagagaggaguggaagcuggacacccugugcgaccuguacgagacccugaccaucacccaggccgugaucuucaucaacaccagaagaaagguggacuggcugaccgagaagaugcacgccagagacuucaccgugagcgccaugcacggcgacauggaccagaaggagagagacgugaucaugagagaguucagaagcggcagcagcagagugcugaucaccaccgaccugcugggcaagcuguacccccagaacagaagcagauggaccguguggcccuaa

SEQ ID NO: 16530 - RNA, 1224 nt, Artificial Sequence
  EIF4A2__Homo_sapiens__NP_001958
augagcggcggcagcgccgacuacaacagagagcacggcggccccgagggcauggaccccgacggcgugaucgagagcaacuggaacgagaucguggacaacuucgacgacaugaaccugaaggagagccugcugagaggcaucuacgccuacggcuucgagaagcccagcgccauccagcagagagccaucauccccugcaucaagggcuacgacgugaucgcccaggcccagagcggcaccggcaagaccgccaccuucgccaucagcauccugcagcagcuggagaucgaguucaaggagacccaggcccuggugcuggcccccaccagagagcuggcccagcagauccagaaggugauccuggcccugggcgacuacaugggcgccaccugccacgccugcaucggcggcaccaacgugagaaacgagaugcagaagcugcaggccgaggccccccacaucguggugggcacccccggcagaguguucgacaugcugaacagaagauaccugagccccaaguggaucaagauguucgugcuggacgaggccgacgagaugcugagcagaggcuucaaggaccagaucuacgagaucuuccagaagcugaacaccagcauccagguggugcugcugagcgccaccaugcccaccgacgugcuggaggugaccaagaaguucaugagagaccccaucagaauccuggugaagaaggaggagcugacccuggagggcaucaagcaguucuacaucaacguggagagagaggaguggaagcuggacacccugugcgaccuguacgagacccugaccaucacccaggccgugaucuuccugaacaccagaagaaagguggacuggcugaccgagaagaugcacgccagagacuucaccgugagcgcccugcacggcgacauggaccagaaggagagagacgugaucaugagagaguucagaagcggcagcagcagagugcugaucaccaccgaccugcuggccagaggcaucgacgugcagcaggugagccuggugaucaacuacgaccugcccaccaacagagagaacuacauccacagaaucggcagaggcggcagauucggcagaaagggcguggccaucaacuucgugaccgaggaggacaagagaauccugagagacaucgagaccuucuacaacaccaccguggaggagaugcccaugaacguggccgaccugaucuaa

SEQ ID NO: 16531 - RNA, 1236 nt, Artificial Sequence
  EIF4A3__Homo_sapiens__NP_055555
auggccaccaccgccaccauggccaccagcggcagcgccagaaagagacugcugaaggaggaggacaugaccaagguggaguucgagaccagcgaggagguggacgugacccccaccuucgacaccaugggccugagagaggaccugcugagaggcaucuacgccuacggcuucgagaagcccagcgccauccagcagagagccaucaagcagaucaucaagggcagagacgugaucgcccagagccagagcggcaccggcaagaccgccaccuucagcaucagcgugcugcagugccuggacauccaggugagagagacccaggcccugauccuggcccccaccagagagcuggccgugcagauccagaagggccugcuggcccugggcgacuacaugaacgugcagugccacgccugcaucggcggcaccaacgugggcgaggacaucagaaagcuggacuacggccagcacgugguggccggcacccccggcagaguguucgacaugaucagaagaagaagccugagaaccagagccaucaagaugcuggugcuggacgaggccgacgagaugcugaacaagggcuucaaggagcagaucuacgacguguacagauaccugccccccgccacccagguggugcugaucagcgccacccugccccacgagauccuggagaugaccaacaaguucaugaccgaccccaucagaauccuggugaagagagacgagcugacccuggagggcaucaagcaguucuucguggccguggagagagaggaguggaaguucgacacccugugcgaccuguacgacacccugaccaucacccaggccgugaucuucugcaacaccaagagaaagguggacuggcugaccgagaagaugagagaggccaacuucaccgugagcagcaugcacggcgacaugccccagaaggagagagagagcaucaugaaggaguucagaagcggcgccagcagagugcugaucagcaccgacgugugggccagaggccuggacgugccccaggugagccugaucaucaacuacgaccugcccaacaacagagagcuguacauccacagaaucggcagaagcggcagauacggcagaaagggcguggccaucaacuucgugaagaacgacgacaucagaauccugagagacaucgagcaguacuacagcacccagaucgacgagaugcccaugaacguggccgaccugaucuaa

SEQ ID NO: 16532 - RNA, 1836 nt, Artificial Sequence
  EIF4B__Homo_sapiens__NP_001408
auggccgccagcgccaagaagaagaacaagaagggcaagaccaucagccugaccgacuuccuggccgaggacggcggcaccggcggcggcagcaccuacgugagcaagcccgugagcugggccgacgagaccgacgaccuggagggcgacgugagcaccaccuggcacagcaacgacgacgacguguacagagccccccccaucgacagaagcauccugcccaccgcccccagagccgccagagagcccaacaucgacagaagcagacugcccaagagcccccccuacaccgccuuccugggcaaccugcccuacgacgugaccgaggagagcaucaaggaguucuucagaggccugaacaucagcgccgugagacugcccagagagcccagcaaccccgagagacugaagggcuucggcuacgccgaguucgaggaccuggacagccugcugagcgcccugagccugaacgaggagagccugggcaacagaagaaucagaguggacguggccgaccaggcccaggacaaggacagagacgacagaagcuucggcagagacagaaacagagacagcgacaagaccgacaccgacuggagagccagacccgccaccgacagcuucgacgacuacccccccagaagaggcgacgacagcuucggcgacaaguacagagacagauacgacagcgacagauacagagacggcuacagagacggcuacagagacggccccagaagagacauggacagauacggcggcagagacagauacgacgacagaggcagcagagacuacgacagaggcuacgacagcagaaucggcagcggcagaagagccuucggcagcggcuacagaagagacgacgacuacagaggcggcggcgacagauacgaggacagauacgacagaagagacgacagaagcuggagcagcagagacgacuacagcagagacgacuacagaagagacgacagaggccccccccagagacccaagcugaaccugaagcccagaagcacccccaaggaggacgacagcagcgccagcaccagccagagcaccagagccgccagcaucuucggcggcgccaagcccguggacaccgccgccagagagagagagguggaggagagacugcagaaggagcaggagaagcugcagagacagcuggacgagcccaagcuggagagaagacccagagagagacaccccagcuggagaagcgaggagacccaggagagagagagaagcagaaccggcagcgagagcagccagaccggcaccagcaccaccagcagcagaaacgccagaagaagagagagcgagaagagccuggagaacgagacccugaacaaggaggaggacugccacagccccaccagcaagccccccaagcccgaccagccccugaaggugaugcccgcccccccccccaaggagaacgccugggugaagagaagcagcaacccccccgccagaagccagagcagcgacaccgagcagcagagccccaccagcggcggcggcaagguggcccccgcccagcccagcgaggagggccccggcagaaaggacgagaacaagguggacggcaugaacgcccccaagggccagaccggcaacagcagcagaggccccggcgacggcggcaacagagaccacuggaaggagagcgacagaaaggacggcaagaaggaccaggacagcagaagcgcccccgagcccaagaagcccgaggagaaccccgccagcaaguucagcagcgccagcaaguacgccgcccugagcguggacggcgaggacgagaacgagggcgaggacuacgccgaguaa

SEQ ID NO: 16533 - RNA, 705 nt, Artificial Sequence
  EIF4E2__Homo_sapiens__NP_001263265
augaacaacaaguucgacgcccugaaggacgacgacagcggcgaccacgaccagaacgaggagaacagcacccagaaggacggcgagaaggagaagaccgagagagacaagaaccagagcagcagcaagagaaaggccguggugcccggccccgccgagcacccccugcaguacaacuacaccuucugguacagcagaagaacccccggcagacccaccagcagccagagcuacgagcagaacaucaagcagaucggcaccuucgccagcguggagcaguucuggagauucuacagccacauggugagacccggcgaccugaccggccacagcgacuuccaccuguucaaggagggcaucaagcccaugugggaggacgacgccaacaagaacggcggcaaguggaucaucagacugagaaagggccuggccagcagaugcugggagaaccugauccuggccaugcugggcgagcaguucauggugggcgaggagaucugcggcgccguggugagcgugagauuccaggaggacaucaucagcaucuggaacaagaccgccagcgaccaggccaccaccgccagaaucagagacacccugagaagagugcugaaccugccccccaacaccaucauggaguacaagacccacaccgacagcaucaaggacaacagcagcuucagaaacaccaagaucacccuguaa

SEQ ID NO: 16534 - RNA, 357 nt, Artificial Sequence
  EIF4E3__Homo_sapiens__NP_001128121
augagaggcgagagaagaccccugugggaggaggagagcaacgccaagggcggcguguggaagaugaaggugcccaaggacagcaccagcaccguguggaaggagcugcugcuggccaccaucggcgagcaguucaccgacugcgccgccgccgacgacgaggugaucggcgugagcgugagcgugagagacagagaggacguggugcagguguggaacgugaacgccagccuggugggcgaggccaccgugcuggagaagaucuacgagcugcugccccacaucaccuucaaggccguguucuacaagccccacgaggagcaccacgccuucgagggcggcagaggcaagcacuaa

SEQ ID NO: 16535 - RNA, 357 nt, Artificial Sequence
  EIF4EBP1__Homo_sapiens__NP_004086
augagcggcggcagcagcugcagccagacccccagcagagccauccccgccaccagaagaguggugcugggcgacggcgugcagcugccccccggcgacuacagcaccacccccggcggcacccuguucagcaccacccccggcggcaccagaaucaucuacgacagaaaguuccugauggagugcagaaacagccccgugaccaagaccccccccagagaccugcccaccauccccggcgugaccagccccagcagcgacgagccccccauggaggccagccagagccaccugagaaacagccccgaggacaagagagccggcggcgaggagagccaguucgagauggacaucuaa

SEQ ID NO: 16536 - RNA, 363 nt, Artificial Sequence
  EIF4EBP2__Homo_sapiens__NP_004087
augagcagcagcgccggcagcggccaccagcccagccagagcagagccauccccaccagaaccguggccaucagcgacgccgcccagcugccccacgacuacugcaccacccccggcggcacccuguucagcaccacccccggcggcaccagaaucaucuacgacagaaaguuccugcuggacagaagaaacagccccauggcccagaccccccccugccaccugcccaacauccccggcgugaccagccccggcacccugaucgaggacagcaagguggaggugaacaaccugaacaaccugaacaaccacgacagaaagcacgccgugggcgacgacgcccaguucgagauggacaucuaa

SEQ ID NO: 16537 - RNA, 303 nt, Artificial Sequence
  EIF4EBP3__Homo_sapiens__NP_003723
augagcaccagcaccagcugccccauccccggcggcagagaccagcugcccgacugcuacagcaccacccccggcggcacccuguacgccaccacccccggcggcaccagaaucaucuacgacagaaaguuccugcuggagugcaagaacagccccaucgccagaaccccccccugcugccugccccagauccccggcgugaccaccccccccaccgccccccugagcaagcuggaggagcugaaggagcaggagaccgaggaggagauccccgacgacgcccaguucgagauggacaucuaa

SEQ ID NO: 16538 - RNA, 714 nt, Artificial Sequence
  EIF4E__Homo_sapiens__NP_001124150
augcuggaccugaccagcagaggccaggugggcaccagcagaagaauggccgaggccgccugcagcgcccacuuccuggagaccacccccacccccaacccccccaccaccgaggaggagaagaccgagagcaaccaggagguggccaaccccgagcacuacaucaagcacccccugcagaacagaugggcccugugguucuucaagaacgacaagagcaagaccuggcaggccaaccugagacugaucagcaaguucgacaccguggaggacuucugggcccuguacaaccacauccagcugagcagcaaccugaugcccggcugcgacuacagccuguucaaggacggcaucgagcccaugugggaggacgagaagaacaagagaggcggcagauggcugaucacccugaacaagcagcagagaagaagcgaccuggacagauucuggcuggagacccugcugugccugaucggcgagagcuucgacgacuacagcgacgacgugugcggcgccguggugaacgugagagccaagggcgacaagaucgccaucuggaccaccgagugcgagaacagagaggccgugacccacaucggcagaguguacaaggagagacugggccugccccccaagaucgugaucggcuaccagagccacgccgacaccgccaccaagagcggcagcaccaccaagaacagauucgugguguaa

SEQ ID NO: 16539 - RNA, 2436 nt, Artificial Sequence
  EIF4ENIF1__Homo_sapiens__NP_001157974
auggacagaagaagcaugggcgagaccgagagcggcgacgccuuccuggaccugaagaagccccccgccagcaagugcccccacagauacaccaaggaggagcugcuggacaucaaggagcugccccacagcaagcagagacccagcugccugagcgagaaguacgacagcgacggcgugugggaccccgagaaguggcacgccagccuguaccccgccagcggcagaagcagccccguggagagccugaagaaggagcuggacaccgacagacccagccuggugagaagaaucgugggcaucguggagugcaacggcggcguggccgaggaggacgagguggaggugauccuggcccaggagcccgccgccgaccaggaggugcccagagacgccgugcugcccgagcagagccccggcgacuucgacuucaacgaguucuucaaccuggacaaggugcccugccuggccagcaugaucgaggacgugcugggcgagggcagcgugagcgccagcagauucagcagaugguucagcaaccccagcagaagcggcagcagaagcagcagccugggcagcaccccccacgaggagcuggagagacuggccggccuggagcaggccauccugagccccggccagaacagcggcaacuacuucgcccccaucccccuggaggaccacgccgagaacaagguggacauccuggagaugcugcagaaggccaagguggaccugaagccccugcugagcagccugagcgccaacaaggagaagcugaaggagagcagccacagcggcguggugcugagcguggaggagguggaggccggccugaagggccugaagguggaccagcaggugaagaacagcacccccuucauggccgagcaccuggaggagacccugagcgccgugaccaacaacagacagcugaagaaggacggcgacaugaccgccuucaacaagcuggugagcaccaugaagagaaaccuggagagccaccugaugagccccgccgagauccccggccagcccgugcccaagaacauccugcaggagcugcugggccagcccgugcagagacccgccagcagcaaccugcugagcggccugaugggcagccuggagcccaccaccagccugcugggccagagagcccccagccccccccugagccagguguuccagaccagagccgccagcgccgacuaccugagacccagaauccccagccccaucggcuucacccccggcccccagcagcugcugggcgaccccuuccagggcaugagaaagcccaugagccccaucaccgcccagcagaugagccagcuggagcugcagcaggccgcccuggagggccuggcccugccccacgaccuggccgugcaggccgccaacuucuaccagcccggcuucggcaagccccagguggacagaaccagagacggcuucagaaacagacagcagagagugaccaagagccccgcccccgugcacagaggcaacagcagcagccccgcccccgccgccagcaucaccagcaugcugagccccagcuucacccccaccagcgugaucagaaagauguacgagagcaaggagaagagcaaggaggagcccgccagcggcaaggccgcccugggcgacagcaaggaggacacccagaaggccagcgaggagaaccugcugagcagcagcagcgugcccagcgccgacagagacagcagccccaccaccaacagcaagcugagcgcccugcagagaagcagcugcagcaccccccugagccaggccaacagauacaccaaggagcaggacuacagacccaaggccaccggcagaaagacccccacccuggccagccccgugcccaccacccccuuccugagacccgugcaccaggugccccuggugccccacgugcccauggugagacccgcccaccagcugcaccccggccuggugcagagaaugcuggcccagggcgugcacccccagcaccugcccagccugcugcagaccggcgugcugccccccggcauggaccugagccaccugcagggcaucagcggccccauccugggccagcccuucuacccccugcccgccgccagccacccccugcugaaccccagacccggcaccccccugcaccuggccauggugcagcagcagcugcagagaagcgugcugcacccccccggcagcggcagccacgccgccgccgugagcgugcagaccaccccccagaacgugcccagcagaagcggccugccccacaugcacagccagcuggagcacagacccagccagagaagcagcagccccgugggccuggccaagugguucggcagcgacgugcugcagcagccccugcccagcaugcccgccaaggugaucagcguggacgagcuggaguacagacaguaa

SEQ ID NO: 16540 - RNA, 4821 nt, Artificial Sequence
  EIF4G1__Homo_sapiens__NP_001181876
augaacaaggccccccagagcaccggccccccccccgcccccagccccggccugccccagcccgccuucccccccggccagaccgcccccgugguguucagcaccccccaggccacccagaugaacacccccagccagcccagacagggcggcuucagaagccugcagcacuucuaccccagcagagcccagccccccagcagcgccgccagcagagugcagagcgccgcccccgccagacccggccccgccgcccacguguaccccgccggcagccaggugaugaugauccccagccagaucagcuaccccgccagccagggcgccuacuacauccccggccagggcagaagcaccuacguggugcccacccagcaguaccccgugcagcccggcgcccccggcuucuaccccggcgccagccccaccgaguucggcaccuacgccggcgccuacuaccccgcccagggcgugcagcaguuccccaccggcguggcccccgcccccgugcugaugaaccagcccccccagaucgcccccaagagagagagaaagaccaucagaaucagagaccccaaccagggcggcaaggacaucaccgaggagaucaugagcggcgccagaaccgccagcacccccacccccccccagaccggcggcggccuggagccccaggccaacggcgagaccccccagguggccgugaucgugagacccgacgacagaagccagggcgccaucaucgccgacagacccggccugcccggccccgagcacagccccagcgagagccagcccagcagccccagccccacccccagccccagccccgugcuggagcccggcagcgagcccaaccuggccgugcugagcauccccggcgacaccaugaccaccauccagaugagcguggaggagagcacccccaucagcagagagaccggcgagcccuacagacugagccccgagcccaccccccuggccgagcccauccuggagguggaggugacccugagcaagcccgugcccgagagcgaguucagcagcagcccccugcaggcccccaccccccuggccagccacaccguggagauccacgagcccaacggcauggugcccagcgaggaccuggagcccgagguggagagcagccccgagcuggcccccccccccgccugccccagcgagagccccgugcccaucgcccccaccgcccagcccgaggagcugcugaacggcgcccccagcccccccgccguggaccugagccccgugagcgagcccgaggagcaggccaaggaggugaccgccagcauggccccccccaccauccccagcgccacccccgccaccgcccccagcgccaccagccccgcccaggaggaggagauggaggaggaggaggaggaggaggagggcgaggccggcgaggccggcgaggccgagagcgagaagggcggcgaggagcugcugccccccgagagcacccccauccccgccaaccugagccagaaccuggaggccgccgccgccacccagguggccgugagcgugcccaagagaagaagaaagaucaaggagcugaacaagaaggaggccgugggcgaccugcuggacgccuucaaggaggccaaccccgccgugcccgagguggagaaccagccccccgccggcagcaaccccggccccgagagcgagggcagcggcgugccccccagacccgaggaggccgacgagaccugggacagcaaggaggacaagauccacaacgccgagaacauccagcccggcgagcagaaguacgaguacaagagcgaccaguggaagccccugaaccuggaggagaagaagagauacgacagagaguuccugcugggcuuccaguucaucuucgccagcaugcagaagcccgagggccugccccacaucagcgacguggugcuggacaaggccaacaagaccccccugagaccccuggaccccaccagacugcagggcaucaacugcggccccgacuucacccccagcuucgccaaccugggcagaaccacccugagcaccagaggcccccccagaggcggccccggcggcgagcugcccagaggccccgccggccugggccccagaagaagccagcagggccccagaaaggagcccagaaagaucaucgccaccgugcugaugaccgaggacaucaagcugaacaaggccgagaaggccuggaagcccagcagcaagagaaccgccgccgacaaggacagaggcgaggaggacgccgacggcagcaagacccaggaccuguucagaagagugagaagcauccugaacaagcugaccccccagauguuccagcagcugaugaagcaggugacccagcuggccaucgacaccgaggagagacugaagggcgugaucgaccugaucuucgagaaggccaucagcgagcccaacuucagcguggccuacgccaacaugugcagaugccugauggcccugaaggugcccaccaccgagaagcccaccgugaccgugaacuucagaaagcugcugcugaacagaugccagaaggaguucgagaaggacaaggacgacgacgagguguucgagaagaagcagaaggagauggacgaggccgccaccgccgaggagagaggcagacugaaggaggagcuggaggaggccagagacaucgccagaagaagaagccugggcaacaucaaguucaucggcgagcuguucaagcugaagaugcugaccgaggccaucaugcacgacugcguggugaagcugcugaagaaccacgacgaggagagccuggagugccugugcagacugcugaccaccaucggcaaggaccuggacuucgagaaggccaagcccagaauggaccaguacuucaaccagauggagaagaucaucaaggagaagaagaccagcagcagaaucagauucaugcugcaggacgugcuggaccugagaggcagcaacugggugcccagaagaggcgaccagggccccaagaccaucgaccagauccacaaggaggccgagauggaggagcacagagagcacaucaaggugcagcagcugauggccaagggcagcgacaagagaagaggcggcccccccggcccccccaucagcagaggccugccccugguggacgacggcggcuggaacaccgugcccaucagcaagggcagcagacccaucgacaccagcagacugaccaagaucaccaagcccggcagcaucgacagcaacaaccagcuguucgcccccggcggcagacugagcuggggcaagggcagcagcggcggcagcggcgccaagcccagcgacgccgccagcgaggccgccagacccgccaccagcacccugaacagauucagcgcccugcagcaggccgugcccaccgagagcaccgacaacagaagaguggugcagagaagcagccugagcagagagagaggcgagaaggccggcgacagaggcgacagacuggagagaagcgagagaggcggcgacagaggcgacagacuggacagagccagaacccccgccaccaagagaagcuucagcaaggagguggaggagagaagcagagagagacccagccagcccgagggccugagaaaggccgccagccugaccgaggacagagacagaggcagagacgccgugaagagagaggccgcccugccccccgugagcccccugaaggccgcccugagcgaggaggagcuggagaagaagagcaaggccaucaucgaggaguaccugcaccugaacgacaugaaggaggccgugcagugcgugcaggagcuggccagccccagccugcuguucaucuucgugagacacggcguggagagcacccuggagagaagcgccaucgccagagagcacaugggccagcugcugcaccagcugcugugcgccggccaccugagcaccgcccaguacuaccagggccuguacgagauccuggagcuggccgaggacauggagaucgacaucccccacguguggcuguaccuggccgagcuggugacccccauccugcaggagggcggcgugcccaugggcgagcuguucagagagaucaccaagccccugagaccccugggcaaggccgccagccugcugcuggagauccugggccugcugugcaagagcaugggccccaagaaggugggcacccuguggagagaggccggccugagcuggaaggaguuccugcccgagggccaggacaucggcgccuucguggccgagcagaagguggaguacacccugggcgaggagagcgaggcccccggccagagagcccugcccagcgaggagcugaacagacagcuggagaagcugcugaaggagggcagcagcaaccagagaguguucgacuggaucgaggccaaccugagcgagcagcagaucgugagcaacacccuggugagagcccugaugaccgccgugugcuacagcgccaucaucuucgagaccccccugagaguggacguggccgugcugaaggccagagccaagcugcugcagaaguaccugugcgacgagcagaaggagcugcaggcccuguacgcccugcaggcccugguggugacccuggagcagccccccaaccugcugagaauguucuucgacgcccuguacgacgaggacguggugaaggaggacgccuucuacagcugggagagcagcaaggaccccgccgagcagcagggcaagggcguggcccugaagagcgugaccgccuucuucaaguggcugagagaggccgaggaggagagcgaccacaacuaa

SEQ ID NO: 16541 - RNA, 2610 nt, Artificial Sequence
  EIF4G2__Homo_sapiens__NP_001036024
auggagagcgccaucgccgagggcggcgccagcagauucagcgccagcagcggcggcggcggcagcagaggcgccccccagcacuaccccaagaccgccggcaacagcgaguuccugggcaagacccccggccagaacgcccagaaguggauccccgccagaagcaccagaagagacgacaacagcgccgccaacaacagcgccaacgagaaggagagacacgacgccaucuucagaaaggugagaggcauccugaacaagcugacccccgagaaguucgacaagcugugccuggagcugcugaacgugggcguggagagcaagcugauccugaagggcgugauccugcugaucguggacaaggcccuggaggagcccaaguacagcagccuguacgcccagcugugccugagacuggccgaggacgcccccaacuucgacggccccgccgccgagggccagcccggccagaagcagagcaccaccuucagaagacugcugaucagcaagcugcaggacgaguucgagaacagaaccagaaacguggacguguacgacaagagagagaacccccugcugcccgaggaggaggagcagagagccaucgccaagaucaagaugcugggcaacaucaaguucaucggcgagcugggcaagcuggaccugauccacgagagcauccugcacaagugcaucaagacccugcuggagaagaagaagagagugcagcugaaggacaugggcgaggaccuggagugccugugccagaucaugagaaccgugggccccagacuggaccacgagagagccaagagccugauggaccaguacuucgccagaaugugcagccugaugcugagcaaggagcugcccgccagaaucagauuccugcugcaggacaccguggagcugagagagcaccacugggugcccagaaaggccuuccuggacaacggccccaagaccaucaaccagaucagacaggacgccgugaaggaccugggcguguucauccccgcccccauggcccagggcaugagaagcgacuucuuccuggagggccccuucaugccccccagaaugaagauggacagagacccccugggcggccuggccgacauguucggccagaugcccggcagcggcaucggcaccggccccggcgugauccaggacagauucagccccaccaugggcagacacagaagcaaccagcuguucaacggccacggcggccacaucaugccccccacccagagccaguucggcgagaugggcggcaaguucaugaagagccagaucagccugagacccgcccagagcuuccugaugaacaagaaccaggugcccaagcugcagccccagaucaccaugaucccccccagcgcccagccccccagaacccagacccccccccugggccagaccccccagcugggccugaagaccaaccccccccugauccaggagaagcccgccaagaccagcaagaagcccccccccagcaaggaggagcugcugaagcugaccgagaccguggugaccgaguaccugaacagcggcaacgccaacgaggccgugaacggcgugagagagaugagagcccccaagcacuuccugcccgagaugcugagcaaggugaucauccugagccuggacagaagcgacgaggacaaggagaaggccagcagccugaucagccugcugaagcaggagggcaucgccaccagcgacaacuucaugcaggccuuccugaacgugcuggaccagugccccaagcuggagguggacaucccccuggugaagagcuaccuggcccaguucgccgccagagccaucaucagcgagcuggugagcaucagcgagcuggcccagccccuggagagcggcacccacuucccccuguuccugcugugccugcagcagcuggccaagcugcaggacagagaguggcugaccgagcuguuccagcagagcaaggugaacaugcagaagaugcugcccgagaucgaccagaacaaggacagaaugcuggagauccuggagggcaagggccugagcuuccuguucccccugcugaagcuggagaaggagcugcugaagcagaucaagcuggaccccagcccccagaccaucuacaaguggaucaaggacaacaucagccccaagcugcacguggacaagggcuucgugaacauccugaugaccagcuuccugcaguacaucagcagcgaggugaacccccccagcgacgagaccgacagcagcagcgcccccagcaaggagcagcuggagcaggagaagcagcugcugcugagcuucaagcccgugaugcagaaguuccugcacgaccacguggaccugcaggugagcgcccuguacgcccugcaggugcacugcuacaacagcaacuuccccaagggcaugcugcugagauucuucgugcacuucuacgacauggagaucaucgaggaggaggccuuccuggccuggaaggaggacaucacccaggaguuccccggcaagggcaaggcccuguuccaggugaaccaguggcugaccuggcuggagaccgccgaggaggaggagagcgaggaggaggccgacuaa

SEQ ID NO: 16542 - RNA, 747 nt, Artificial Sequence
  EIF4H__Homo_sapiens__NP_071496
auggccgacuucgacaccuacgacgacagagccuacagcagcuucggcggcggcagaggcagcagaggcagcgccggcggccacggcagcagaagccagaaggagcugcccaccgagccccccuacaccgccuacgugggcaaccugcccuucaacaccgugcagggcgacaucgacgccaucuucaaggaccugagcaucagaagcgugagacuggugagagacaaggacaccgacaaguucaagggcuucugcuacguggaguucgacgagguggacagccugaaggaggcccugaccuacgacggcgcccugcugggcgacagaagccugagaguggacaucgccgagggcagaaagcaggacaagggcggcuucggcuucagaaagggcggccccgacgacagaggcaugggcagcagcagagagagcagaggcggcugggacagcagagacgacuucaacagcggcuucagagacgacuuccugggcggcagaggcggcagcagacccggcgacagaagaaccggcccccccaugggcagcagauucagagacggccccccccugagaggcagcaacauggacuucagagagcccaccgaggaggagagagcccagagacccagacugcagcugaagcccagaaccguggccaccccccugaaccagguggccaaccccaacagcgccaucuucggcggcgccagacccagagaggagguggugcagaaggagcaggaguaa

SEQ ID NO: 16543 - RNA, 462 nt, Artificial Sequence
  EIF5A2__Homo_sapiens__NP_065123
auggccgacgagaucgacuucaccaccggcgacgccggcgccagcagcaccuaccccaugcagugcagcgcccugagaaagaacggcuucguggugcugaagggcagacccugcaagaucguggagaugagcaccagcaagaccggcaagcacggccacgccaaggugcaccuggugggcaucgacaucuucaccggcaagaaguacgaggacaucugccccagcacccacaacauggacgugcccaacaucaagagaaacgacuaccagcugaucugcauccaggacggcuaccugagccugcugaccgagaccggcgaggugagagaggaccugaagcugcccgagggcgagcugggcaaggagaucgagggcaaguacaacgccggcgaggacgugcaggugagcgugaugugcgccaugagcgaggaguacgccguggccaucaagcccugcaaguaa

SEQ ID NO: 16544 - RNA, 555 nt, Artificial Sequence
  EIF5A__Homo_sapiens__NP_001137232
augugcggcaccggcggcaccgacagcaagaccagaagacccccccacagagccagcuuccugaagagacuggagagcaagccccugaagauggccgacgaccuggacuucgagaccggcgacgccggcgccagcgccaccuuccccaugcagugcagcgcccugagaaagaacggcuucguggugcugaagggcagacccugcaagaucguggagaugagcaccagcaagaccggcaagcacggccacgccaaggugcaccuggugggcaucgacaucuucaccggcaagaaguacgaggacaucugccccagcacccacaacauggacgugcccaacaucaagagaaacgacuuccagcugaucggcauccaggacggcuaccugagccugcugcaggacagcggcgaggugagagaggaccugagacugcccgagggcgaccugggcaaggagaucgagcagaaguacgacugcggcgaggagauccugaucaccgugcugagcgccaugaccgaggaggccgccguggccaucaaggccauggccaaguaa

SEQ ID NO: 16545 - RNA, 1296 nt, Artificial Sequence
  EIF5__Homo_sapiens__NP_892116
augagcgugaacgugaacagaagcgugagcgaccaguucuacagauacaagaugcccagacugaucgccaagguggagggcaagggcaacggcaucaagaccgugaucgugaacaugguggacguggccaaggcccugaacagaccccccaccuaccccaccaaguacuucggcugcgagcugggcgcccagacccaguucgacgugaagaacgacagauacaucgugaacggcagccacgaggccaacaagcugcaggacaugcuggacggcuucaucaagaaguucgugcugugccccgagugcgagaaccccgagaccgaccugcacgugaaccccaagaagcagaccaucggcaacagcugcaaggccugcggcuacagaggcaugcuggacacccaccacaagcugugcaccuucauccugaagaacccccccgagaacagcgacagcggcaccggcaagaaggagaaggagaagaagaacagaaagggcaaggacaaggagaacggcagcgugagcagcagcgagacccccccccccccccccccccccaacgagaucaacccccccccccacaccauggaggaggaggaggacgacgacuggggcgaggacaccaccgaggaggcccagagaagaagaauggacgagaucagcgaccacgccaaggugcugacccugagcgacgaccuggagagaaccaucgaggagagagugaacauccuguucgacuucgugaagaagaagaaggaggagggcgugaucgacagcagcgacaaggagaucguggccgaggccgagagacuggacgugaaggccaugggcccccuggugcugaccgaggugcuguucaacgagaagaucagagagcagaucaagaaguacagaagacacuuccugagauucugccacaacaacaagaaggcccagagauaccugcugcacggccuggagugcgugguggccaugcaccaggcccagcugaucagcaagaucccccacauccugaaggagauguacgacgccgaccugcuggaggaggaggugaucaucagcuggagcgagaaggccagcaagaaguacgugagcaaggagcuggccaaggagaucagagugaaggccgagcccuucaucaaguggcugaaggaggccgaggaggagagcagcggcggcgaggaggaggacgaggacgagaacaucgaggugguguacagcaaggccgccagcgugcccaagguggagaccgugaagagcgacaacaaggacgacgacaucgacaucgacgccaucuaa

SEQ ID NO: 16546 - RNA, 738 nt, Artificial Sequence
  EIF6__Homo_sapiens__NP_001254739
auggccgugagagccagcuucgagaacaacugcgagaucggcugcuucgccaagcugaccaacaccuacugccugguggccaucggcggcagcgagaacuucuacagcguguucgagggcgagcugagcgacaccauccccguggugcacgccagcaucgccggcugcagaaucaucggcagaaugugcgugggcaacagacacggccugcuggugcccaacaacaccaccgaccaggagcugcagcacaucagaaacagccugcccgacaccgugcagaucagaagaguggaggagagacugagcgcccugggcaacgugaccaccugcaacgacuacguggcccuggugcaccccgaccuggacagagagaccgaggagauccuggccgacgugcugaagguggagguguucagacagaccguggccgaccaggugcuggugggcagcuacugcguguucagcaaccagggcggccuggugcaccccaagaccagcaucgaggaccaggacgagcugagcagccugcugcaggugccccugguggccggcaccgugaacagaggcagcgaggugaucgccgccggcaugguggugaacgacuggugcgccuucugcggccuggacaccaccagcaccgagcugagcgugguggagagcguguucaagcugaacgaggcccagcccagcaccaucgccaccagcaugagagacagccugaucgacagccugaccuaa

SEQ ID NO: 16547 - RNA, 1092 nt, Artificial Sequence
  ELAC1__Homo_sapiens__NP_061166
augagcauggacgugaccuuccugggcaccggcgccgccuaccccagccccaccagaggcgccagcgccguggugcugagaugcgagggcgagugcuggcuguucgacugcggcgagggcacccagacccagcugaugaagagccagcugaaggccggcagaaucaccaagaucuucaucacccaccugcacggcgaccacuucuucggccugcccggccugcugugcaccaucagccugcagagcggcagcauggugagcaagcagcccaucgagaucuacggccccgugggccugagagacuucaucuggagaaccauggagcugagccacaccgagcugguguuccacuacguggugcacgagcuggugcccaccgccgaccagugccccgccgaggagcugaaggaguucgcccacgugaacagagccgacagcccccccaaggaggagcagggcagaaccauccugcuggacagcgaggagaacagcuaccugcuguucgacgacgagcaguucguggugaaggccuucagacuguuccacagaauccccagcuucggcuucagcgugguggagaagaagagacccggcaagcugaacgcccagaagcugaaggaccugggcgugccccccggccccgccuacggcaagcugaagaacggcaucagcguggugcuggagaacggcgugaccaucagcccccaggacgugcugaagaagcccaucgugggcagaaagaucugcauccugggcgacugcagcggcguggugggcgacggcggcgugaagcugugcuucgaggccgaccugcugauccacgaggccacccuggacgacgcccagauggacaaggccaaggagcacggccacagcaccccccagauggccgccaccuucgccaagcugugcagagccaagagacuggugcugacccacuucagccagagauacaagcccguggcccuggccagagagggcgagaccgacggcaucgccgagcugaagaagcaggccgagagcgugcuggaccugcaggaggugacccuggccgaggacuucauggugaucagcauccccaucaagaaguaa

SEQ ID NO: 16548 - RNA, 2361 nt, Artificial Sequence
  ELAC2__Homo_sapiens__NP_001159434
augugggcccugugcagccugcugagaagcgccgccggcagaaccaugagccagggcagaaccaucagccaggcccccgccagaagagagagacccagaaaggacccccugagacaccugagaaccagagagaagagaggccccagcggcugcagcggcggccccaacaccguguaccugcaggugguggccgccggcagcagagacagcggcgccgcccuguacguguucagcgaguucaacagauaccuguucaacugcggcgagggcgugcagagacugaugcaggagcacaagcugaagguggccagacuggacaacaucuuccugaccagaaugcacuggagcaacgugggcggccugagcggcaugauccugacccugaaggagaccggccugcccaagugcgugcugagcggccccccccagcuggagaaguaccuggaggccaucaagaucuucagcggcccccugaagggcaucgagcuggccgugagaccccacagcgcccccgaguacgaggacgagaccaugaccguguaccagauccccauccacagcgugagccagagaagaggcgugagagacagcagccuggugguggccuucaucugcaagcugcaccugaagagaggcaacuuccuggugcugaaggccaaggagaugggccugcccgugggcaccgccgccaucgcccccaucaucgccgccgugaaggacggcaagagcaucacccacgagggcagagagauccuggccgaggagcugugcaccccccccgaccccggcgccgccuucguggugguggagugccccgacgagagcuucauccagcccaucugcgagaacgccaccuuccagagauaccagggcaaggccgacgcccccguggcccugguggugcacauggcccccgccagcgugcugguggacagcagauaccagcaguggauggagagauucggccccgacacccagcaccuggugcugaacgagaacugcgccagcgugcacaaccugagaagccacaagauccagacccagcugaaccugauccaccccgacaucuucccccugcugaccagcuucagaugcaagaaggagggccccacccugagcgugcccauggugcagggcgagugccugcugaaguaccagcugagacccagaagagaguggcagagagacgccaucaucaccugcaaccccgaggaguucaucguggaggcccugcagcugcccaacuuccagcagagcgugcaggaguacagaagaagcgcccaggacggccccgcccccgccgagaagagaagccaguaccccgagaucaucuuccugggcaccggcagcgccauccccaugaagaucagaaacgugagcgccacccuggugaacaucagccccgacaccagccugcugcuggacugcggcgagggcaccuucggccagcugugcagacacuacggcgaccagguggacagagugcugggcacccuggccgccguguucgugagccaccugcacgccgaccaccacaccggccugcccagcauccugcugcagagagagagagcccuggccagccugggcaagccccugcacccccugcuggugguggcccccaaccagcugaaggccuggcugcagcaguaccacaaccagugccaggaggugcugcaccacaucagcaugauccccgccaagugccugcaggagggcgccgagaucagcagccccgccguggagagacugaucagcagccugcugagaaccugcgaccuggaggaguuccagaccugccuggugagacacugcaagcacgccuucggcugcgcccuggugcacaccagcggcuggaaggugguguacagcggcgacaccaugcccugcgaggcccuggugagaaugggcaaggacgccacccugcugauccacgaggccacccuggaggacggccuggaggaggaggccguggagaagacccacagcaccaccagccaggccaucagcgugggcaugagaaugaacgccgaguucaucaugcugaaccacuucagccagagauacgccaaggugccccuguucagccccaacuucagcgagaaggugggcguggccuucgaccacaugaaggugugcuucggcgacuuccccaccaugcccaagcugauccccccccugaaggcccuguucgccggcgacaucgaggagauggaggagagaagagagaagagagagcugagacaggugagagccgcccugcugagcagagagcuggccggcggccuggaggacggcgagccccagcagaagagagcccacaccgaggagccccaggccaagaaggugagagcccaguaa

SEQ ID NO: 16549 - RNA, 804 nt, Artificial Sequence
  ELANE__Homo_sapiens__NP_001963
augacccugggcagaagacuggccugccuguuccuggccugcgugcugcccgcccugcugcugggcggcaccgcccuggccagcgagaucgugggcggcagaagagccagaccccacgccuggcccuucauggugagccugcagcugagaggcggccacuucugcggcgccacccugaucgcccccaacuucgugaugagcgccgcccacugcguggccaacgugaacgugagagccgugagaguggugcugggcgcccacaaccugagcagaagagagcccaccagacagguguucgccgugcagagaaucuucgagaacggcuacgaccccgugaaccugcugaacgacaucgugauccugcagcugaacggcagcgccaccaucaacgccaacgugcagguggcccagcugcccgcccagggcagaagacugggcaacggcgugcagugccuggccaugggcuggggccugcugggcagaaacagaggcaucgccagcgugcugcaggagcugaacgugaccguggugaccagccugugcagaagaagcaacgugugcacccuggugagaggcagacaggccggcgugugcuucggcgacagcggcagcccccuggugugcaacggccugauccacggcaucgccagcuucgugagaggcggcugcgccagcggccuguaccccgacgccuucgcccccguggcccaguucgugaacuggaucgacagcaucauccagagaagcgaggacaaccccugcccccaccccagagaccccgaccccgccagcagaacccacuaa

SEQ ID NO: 16550 - RNA, 981 nt, Artificial Sequence
  ELAVL1__Homo_sapiens__NP_001410
augagcaacggcuacgaggaccacauggccgaggacugcagaggcgacaucggcagaaccaaccugaucgugaacuaccugccccagaacaugacccaggacgagcugagaagccuguucagcagcaucggcgagguggagagcgccaagcugaucagagacaagguggccggccacagccugggcuacggcuucgugaacuacgugaccgccaaggacgccgagagagccaucaacacccugaacggccugagacugcagagcaagaccaucaaggugagcuacgccagacccagcagcgaggugaucaaggacgccaaccuguacaucagcggccugcccagaaccaugacccagaaggacguggaggacauguucagcagauucggcagaaucaucaacagcagagugcugguggaccagaccaccggccugagcagaggcguggccuucaucagauucgacaagagaagcgaggccgaggaggccaucaccagcuucaacggccacaagccccccggcagcagcgagcccaucaccgugaaguucgccgccaaccccaaccagaacaagaacguggcccugcugagccagcuguaccacagccccgccagaagauucggcggccccgugcaccaccaggcccagagauucagauucagccccaugggcguggaccacaugagcggccugagcggcgugaacgugcccggcaacgccagcagcggcuggugcaucuucaucuacaaccugggccaggacgccgacgagggcauccuguggcagauguucggccccuucggcgccgugaccaacgugaaggugaucagagacuucaacaccaacaagugcaagggcuucggcuucgugaccaugaccaacuacgaggaggccgccauggccaucgccagccugaacggcuacagacugggcgacaagauccugcaggugagcuucaagaccaacaagagccacaaguaa

SEQ ID NO: 16551 - RNA, 1041 nt, Artificial Sequence
  ELAVL2__Homo_sapiens__NP_001164668
auggagacccagcugagcaacggccccaccugcaacaacaccgccaacggccccaccaccaucaacaacaacugcagcagccccguggacagcggcaacaccgaggacagcaagaccaaccugaucgugaacuaccugccccagaacaugacccaggaggagcugaagagccuguucggcagcaucggcgagaucgagagcugcaagcuggugagagacaagaucaccggccagagccugggcuacggcuucgugaacuacaucgaccccaaggacgccgagaaggccaucaacacccugaacggccugagacugcagaccaagaccaucaaggugagcuacgccagacccagcagcgccagcaucagagacgccaaccuguacgugagcggccugcccaagaccaugacccagaaggagcuggagcagcuguucagccaguacggcagaaucaucaccagcagaauccugguggaccaggugaccggcaucagcagaggcgugggcuucaucagauucgacaagagaaucgaggccgaggaggccaucaagggccugaacggccagaagccccccggcgccaccgagcccaucaccgugaaguucgccaacaaccccagccagaagaccaaccaggccauccugagccagcuguaccagagccccaacagaagauaccccggcccccuggcccagcaggcccagagauucagauucagccccaugaccaucgacggcaugaccagccuggccggcaucaacauccccggccaccccggcaccggcuggugcaucuucguguacaaccuggcccccgacgccgacgagagcauccuguggcagauguucggccccuucggcgccgugaccaacgugaaggugaucagagacuucaacaccaacaagugcaagggcuucggcuucgugaccaugaccaacuacgacgaggccgccauggccaucgccagccugaacggcuacagacugggcgacagagugcugcaggugagcuucaagaccaacaagacccacaaggccuaa

SEQ ID NO: 16552 - RNA, 1104 nt, Artificial Sequence
  ELAVL3__Homo_sapiens__NP_001411
auggugacccagauccugggcgccauggagagccaggugggcggcggccccgccggccccgcccugcccaacggcccccugcugggcaccaacggcgccaccgacgacagcaagaccaaccugaucgugaacuaccugccccagaacaugacccaggacgaguucaagagccuguucggcagcaucggcgacaucgagagcugcaagcuggugagagacaagaucaccggccagagccugggcuacggcuucgugaacuacagcgaccccaacgacgccgacaaggccaucaacacccugaacggccugaagcugcagaccaagaccaucaaggugagcuacgccagacccagcagcgccagcaucagagacgccaaccuguacgugagcggccugcccaagaccaugagccagaaggagauggagcagcuguucagccaguacggcagaaucaucaccagcagaauccugguggaccaggugaccggcgugagcagaggcgugggcuucaucagauucgacaagagaaucgaggccgaggaggccaucaagggccugaacggccagaagccccugggcgccgccgagcccaucaccgugaaguucgccaacaaccccagccagaagaccggccaggcccugcugacccaccuguaccagagcagcgccagaagauacgccggcccccugcaccaccagacccagagauucagacuggacaaccugcugaacauggccuacggcgugaagagcccccugagccugaucgccagauucagccccaucgccaucgacggcaugagcggccuggccggcgugggccugagcggcggcgccgccggcgccggcuggugcaucuucguguacaaccugagccccgaggccgacgagagcgugcuguggcagcuguucggccccuucggcgccgugaccaacgugaaggugaucagagacuucaccaccaacaagugcaagggcuucggcuucgugaccaugaccaacuacgacgaggccgccauggccaucgccagccugaacggcuacagacugggcgagagagugcugcaggugagcuucaagaccagcaagcagcacaaggccuaa

SEQ ID NO: 16553 - RNA, 1116 nt, Artificial Sequence
  ELAVL4__Homo_sapiens__NP_001281277
auggaguggaacggccugaagaugaucaucagcaccauggagccccaggugagcaacggccccaccagcaacaccagcaacggccccagcagcaacaacagaaacugccccagccccaugcagaccggcgccaccaccgacgacagcaagaccaaccugaucgugaacuaccugccccagaacaugacccaggaggaguucagaagccuguucggcagcaucggcgagaucgagagcugcaagcuggugagagacaagaucaccggccagagccugggcuacggcuucgugaacuacaucgaccccaaggacgccgagaaggccaucaacacccugaacggccugagacugcagaccaagaccaucaaggugagcuacgccagacccagcagcgccagcaucagagacgccaaccuguacgugagcggccugcccaagaccaugacccagaaggagcuggagcagcuguucagccaguacggcagaaucaucaccagcagaauccugguggaccaggugaccggcgugagcagaggcgugggcuucaucagauucgacaagagaaucgaggccgaggaggccaucaagggccugaacggccagaagcccagcggcgccaccgagcccaucaccgugaaguucgccaacaaccccagccagaagagcagccaggcccugcugagccagcuguaccagagccccaacagaagauaccccggcccccugcaccaccaggcccagagauucagacuggacaaccugcugaacauggccuacggcgugaagagauucagccccaucaccaucgacggcaugaccagccuggugggcaugaacauccccggccacaccggcaccggcuggugcaucuucguguacaaccugagccccgacagcgacgagagcgugcuguggcagcuguucggccccuucggcgccgugaacaacgugaaggugaucagagacuucaacaccaacaagugcaagggcuucggcuucgugaccaugaccaacuacgacgaggccgccauggccaucgccagccugaacggcuacagacugggcgacagagugcugcaggugagcuucaagaccaacaaggcccacaagagcuaa

SEQ ID NO: 16554 - RNA, 1788 nt, Artificial Sequence
  ELF1__Homo_sapiens__NP_001138825
auggccgccguggugcagcagaacgaccugguguucgaguucgccagcaacgugauggaggacgagagacagcugggcgaccccgccaucuuccccgccgugaucguggagcacgugcccggcgccgacauccugaacagcuacgccggccuggccugcguggaggagcccaacgacaugaucaccgagagcagccuggacguggccgaggaggagaucaucgacgacgacgacgacgacaucacccugaccguggaggccagcugccacgacggcgacgagaccaucgagaccaucgaggccgccgaggcccugcugaacauggacagccccggccccaugcuggacgagaagagaaucaacggcauccccgaggugauggagacccagcaggugcaggagaaguacgccgacagccccggcgccagcagccccgagcagcccaagagaaagaagggcagaaagaccaagccccccagacccgacagccccgccaccacccccaacaucagcgugaagaagaagaacaaggacggcaagggcaacaccaucuaccugugggaguuccugcuggcccugcugcaggacaaggccaccugccccaaguacaucaaguggacccagagagagaagggcaucuucaagcugguggacagcaaggccgugagcagacuguggggcaagcacaagaacaagcccgacaugaacuacgagaccaugggcagagcccugagauacuacuaccagagaggcauccuggccaagguggagggccagagacugguguaccaguucaaggagaugcccaaggaccugaucuacaucaacgacgaggaccccagcagcagcaucgagagcagcgaccccagccugagcagcagcgccaccagcaacagaaaccagaccagcagaagcagagugagcagcagccccggcgugaagggcggcgccaccaccgugcugaagcccggcaacagcaaggccgccaagcccaaggaccccguggagguggcccagcccagcgaggugcugagaaccgugcagcccacccagagccccuaccccacccagcuguucagaaccgugcacguggugcagcccgugcaggccgugcccgagggcgaggccgccagaaccagcaccaugcaggacgagacccugaacagcagcgugcagagcaucagaaccauccaggcccccacccaggugcccgugguggugagccccagaaaccagcagcugcacaccgugacccugcagaccgugccccugaccaccgugaucgccagcaccgaccccagcgccggcaccggcagccagaaguucauccugcaggccauccccagcagccagcccaugaccgugcugaaggagaacgugaugcugcagagccagaaggccggcagcccccccagcaucgugcugggccccgcccaggugcagcaggugcugaccagcaacgugcagaccaucugcaacggcaccgugagcguggccagcagccccagcuucagcgccaccgcccccguggugaccuucagccccagaagcagccagcugguggcccacccccccggcaccgugaucaccagcgugaucaagacccaggagaccaagacccugacccaggagguggagaagaaggagagcgaggaccaccugaaggagaacaccgagaagaccgagcagcagccccagcccuacgugaugguggugagcagcagcaacggcuucaccagccagguggccaugaagcagaacgagcugcuggagcccaacagcuucuaa

SEQ ID NO: 16555 - RNA, 1515 nt, Artificial Sequence
  ELF2__Homo_sapiens__NP_001263386
auggccaccagccugcacgagggccccaccaaccagcuggaccugcugaucagagccguggaggccagcgugcacagcagcaacgcccacugcaccgacaagaccaucgaggccgccgaggcccugcugcacauggagagccccaccugccugagagacagcagaagccccguggagguguucgugccccccugcgugagcacccccgaguucauccacgccgccaugagacccgacgugaucaccgagaccgugguggaggugagcaccgaggagagcgagcccauggacaccagccccauccccaccagccccgacagccacgagcccaugaagaagaagaagggcaacaccaccuaccugugggaguuccugcuggaccugcugcaggacaagaacaccugccccagauacaucaaguggacccagagagagaagggcaucuucaagcugguggacagcaaggccgugagcaagcuguggggcaagcacaagaacaagcccgacaugaacuacgagaccaugggcagagcccugagauacuacuaccagagaggcauccuggccaagguggagggccagagacugguguaccaguucaaggacaugcccaagaacaucguggugaucgacgacgacaagagcgagaccugcaacgaggaccuggccggcaccaccgacgagaagagccuggagagagugagccugagcgccgagagccugcugaaggccgccagcagcgugagaagcggcaagaacagcagccccaucaacugcagcagagccgagaagggcguggccagaguggugaacaucaccagccccggccacgacgccagcagcagaagccccaccaccaccgccagcgugagcgccaccgccgcccccagaaccgugagaguggccaugcaggugcccguggugaugaccagccugggccagaagaucagcaccguggccgugcagagcgugaacgccggcgccccccugaucaccagcaccagccccaccaccgccaccagccccaagguggugauccagaccauccccaccgugaugcccgccagcaccgagaacggcgacaagaucaccaugcagcccgccaagaucaucaccauccccgccacccagcuggcccagugccagcugcagaccaagagcaaccugaccggcagcggcagcaucaacaucgugggcaccccccuggccgugagagcccugacccccgugagcaucgcccacggcacccccgugaugagacugagcaugcccacccagcaggccagcggccagaccccccccagagugaucagcgccgugaucaagggccccgaggugaagagcgaggccguggccaagaagcaggagcacgacgugaagacccugcagcugguggaggagaagcccgccgacggcaacaagaccgugacccacguggugguggugagcgcccccagcgccaucgcccugcccgugaccaugaagaccgagggccuggugaccugcgagaaguaa

SEQ ID NO: 16556 - RNA, 1116 nt, Artificial Sequence
  ELF3__Homo_sapiens__NP_001107781
auggccgccaccugcgagaucagcaacaucuucagcaacuacuucagcgccauguacagcagcgaggacagcacccuggccagcgugccccccgccgccaccuucggcgccgacgaccuggugcugacccugagcaacccccagaugagccuggagggcaccgagaaggccagcuggcugggcgagcagccccaguucuggagcaagacccaggugcuggacuggaucagcuaccagguggagaagaacaaguacgacgccagcgccaucgacuucagcagaugcgacauggacggcgccacccugugcaacugcgcccuggaggagcugagacugguguucggcccccugggcgaccagcugcacgcccagcugagagaccugaccagcagcagcagcgacgagcugagcuggaucaucgagcugcuggagaaggacggcauggccuuccaggaggcccuggaccccggccccuucgaccagggcagccccuucgcccaggagcugcuggacgacggccagcaggccagccccuaccaccccggcagcugcggcgccggcgcccccagccccggcagcagcgacgugagcaccgccggcaccggcgccagcagaagcagccacagcagcgacagcggcggcagcgacguggaccuggaccccaccgacggcaagcuguuccccagcgacggcuucagagacugcaagaagggcgaccccaagcacggcaagagaaagagaggcagacccagaaagcugagcaaggaguacugggacugccuggagggcaagaagagcaagcacgcccccagaggcacccaccugugggaguucaucagagacauccugauccaccccgagcugaacgagggccugaugaagugggagaacagacacgagggcguguucaaguuccugagaagcgaggccguggcccagcuguggggccagaagaagaagaacagcaacaugaccuacgagaagcugagcagagccaugagauacuacuacaagagagagauccuggagagaguggacggcagaagacugguguacaaguucggcaagaacagcagcggcuggaaggaggaggaggugcugcagagcagaaacuaa

SEQ ID NO: 16557 - RNA, 1992 nt, Artificial Sequence
  ELF4__Homo_sapiens__XP_005262446
auggccaucacccugcagcccagcgaccugaucuucgaguucgccagcaacggcauggacgacgacauccaccagcuggaggaccccagcguguuccccgccgugaucguggagcaggugcccuaccccgaccugcugcaccuguacagcggccuggagcuggacgacgugcacaacggcaucaucaccgacggcacccugugcaugacccaggaccagauccuggagggcagcuuccugcugaccgacgacaacgaggccaccagccacaccaugagcaccgccgaggugcugcugaacauggagagccccagcgacauccuggacgagaagcagaucuucagcaccagcgagaugcugcccgacagcgaccccgcccccgccgugacccugcccaacuaccuguuccccgccagcgagcccgacgcccugaacagagccggcgacaccagcgaccaggagggccacagccuggaggagaaggccagcagagaggagagcgccaagaagaccggcaagagcaagaagagaaucagaaagaccaagggcaacagaagcaccagccccgugaccgaccccagcauccccaucagaaagaagagcaaggacggcaagggcagcaccaucuaccugugggaguuccugcuggcccugcugcaggacagaaacaccugccccaaguacaucaaguggacccagagagagaagggcaucuucaagcugguggacagcaaggccgugagcaagcuguggggcaagcagaagaacaagcccgacaugaacuacgagaccaugggcagagcccugagauacuacuaccagagaggcauccuggccaagguggagggccagagacugguguaccaguucaaggagaugcccaaggaccugguggugaucgaggacgaggacgagagcagcgaggccaccgccgcccccccccaggccagcaccgccagcguggccagcgccagcaccaccagaagaaccagcagcagagugagcagcagaagcgccccccagggcaagggcagcagcagcugggagaagcccaagauccagcacgugggccugcagcccagcgccagccuggagcugggccccagccuggacgaggagauccccaccaccagcaccaugcuggugagccccgccgagggccaggugaagcugaccaaggccgugagcgccagcagcgugcccagcaacauccaccugggcguggcccccgugggcagcggcagcgcccugacccugcagaccaucccccugaccaccgugcugaccaacggcccccccgccagcaccaccgcccccacccagcuggugcugcagagcgugcccgccgccagcaccuucaaggacaccuucacccugcaggccagcuucccccugaacgccagcuuccaggacagccagguggccgcccccggcgccccccugauccugagcggccugccccagcugcuggccggcgccaacagacccaccaaccccgccccccccaccgugaccggcgccggccccgccggccccagcagccagccccccggcaccgugaucgccgccuucaucagaaccagcggcaccaccgccgcccccagagugaaggagggcccccugagaagcagcagcuacgugcagggcauggugaccggcgcccccauggagggccugcuggugcccgaggagacccugagagagcugcugagagaccaggcccaccugcagccccugcccacccagguggugagcagaggcagccacaaccccagccugcugggcaaccagacccugagcccccccagcagacccaccgugggccugacccccguggccgagcuggagcugagcagcggcagcggcagccugcugauggccgagcccagcgugaccaccagcggcagccugcugaccagaagccccacccccgcccccuucagccccuucaaccccaccagccugaucaagauggagccccacgacaucuaa

SEQ ID NO: 16558 - RNA, 483 nt, Artificial Sequence
  ELF5__Homo_sapiens__NP_001230009
augcuggacagcgugacccacagcaccuuccugcccaacgccagcuucugcgacccccugaugagcuggaccgaccuguucagcaacgaggaguacuaccccgccuucgagcaccagaccgacgccgacagcaacugccugaagaccagcggcaucaagagccaggacugccacagccacagcagaaccagccugcagagcagccaccugugggaguucgugagagaccugcugcugagccccgaggagaacugcggcauccuggagugggaggacagagagcagggcaucuucagaguggugaagagcgaggcccuggccaagauguggggccagagaaagaagaacgacagaaugaccuacgagaagcugagcagagcccugagauacuacuacaagaccggcauccuggagagaguggacagaagacugguguacaaguucggcaagaacgcccacggcuggcaggaggacaagcuguaa

SEQ ID NO: 16559 - RNA, 288 nt, Artificial Sequence
  ELK1__Homo_sapiens__NP_001244097
auggaccccagcgugacccuguggcaguuccugcugcagcugcugagagagcagggcaacggccacaucaucagcuggaccagcagagacggcggcgaguucaagcugguggacgccgaggagguggccagacuguggggccugagaaagaacaagaccaacaugaacuacgacaagcugagcagagcccugagauacuacuacgacaagaacaucaucagaaaggugagcggccagaaguucguguacaaguucgugagcuaccccgagagccacugcgcccccuaa

SEQ ID NO: 16560 - RNA, 1224 nt, Artificial Sequence
  ELK3__Homo_sapiens__XP_006719338
auggagagcgccaucacccuguggcaguuccugcugcagcugcugcuggaccagaagcacgagcaccugaucugcuggaccagcaacgacggcgaguucaagcugcugaaggccgaggagguggccaagcuguggggccugagaaagaacaagaccaacaugaacuacgacaagcugagcagagcccugagauacuacuacgacaagaacaucaucaagaaggugaucggccagaaguucguguacaaguucgugagcuuccccgagauccugaagauggacccccacgccguggagaucagcagagagagccugcugcugcaggacagcgacugcaaggccagccccgagggcagagaggcccacaagcacggccuggccgcccugagaagcaccagcagaaacgaguacauccacagcggccuguacagcagcuucaccaucaacagccugcagaacccccccgacgccuucaaggccaucaagaccgagaagcuggaggagccccccgaggacagcccccccguggaggaggugagaaccgugaucagauucgugaccaacaagaccgacaagcacgugaccagacccguggugagccugcccagcaccagcgaggccgccgccgccagcgccuuccuggccagcagcgugagcgccaagaucagcagccugaugcugcccaacgccgccagcaucagcagcgccagccccuucagcagcagaagccccagccugagccccaacagcccccugcccagcgagcacagaagccuguuccuggaggccgccugccacgacagcgacagccuggagccccugaaccugagcagcggcagcaagaccaagagccccagccugccccccaaggccaagaagcccaagggccuggagaucagcgcccccccccuggugcugagcggcaccgacaucggcagcaucgcccugaacagccccgcccugcccagcggcagccugacccccgccuucuucaccgcccagacccccaacggccugcugcugacccccagcccccugcugagcagcauccacuucuggagcagccugagccccguggccccccugagccccgccagacugcagggccccagcacccuguuccaguuccccacccugcugaacggccacaugcccgugcccauccccagccuggacagagccgccagccccgugcugcugagcagcaacagccagaagagcuaa

SEQ ID NO: 16561 - RNA, 1218 nt, Artificial Sequence
  ELK4__Homo_sapiens__NP_068567
auggacagcgccaucacccuguggcaguuccugcugcagcugcugcagaagccccagaacaagcacaugaucugcuggaccagcaacgacggccaguucaagcugcugcaggccgaggagguggccagacuguggggcaucagaaagaacaagcccaacaugaacuacgacaagcugagcagagcccugagauacuacuacgugaagaacaucaucaagaaggugaacggccagaaguucguguacaaguucgugagcuaccccgagauccugaacauggaccccaugaccgugggcagaaucgagggcgacugcgagagccugaacuucagcgaggugagcagcagcagcaaggacguggagaacggcggcaaggacaagcccccccagcccggcgccaagaccagcagcagaaacgacuacauccacagcggccuguacagcagcuucacccugaacagccugaacagcagcaacgugaagcuguucaagcugaucaagaccgagaaccccgccgagaagcuggccgagaagaagagcccccaggagcccacccccagcgugaucaaguucgugaccacccccagcaagaagccccccguggagcccguggccgccaccaucagcaucggccccagcaucagccccagcagcgaggagaccauccaggcccuggagacccuggugagccccaagcugcccagccuggaggcccccaccagcgccagcaacgugaugaccgccuucgccaccaccccccccaucagcagcauccccccccugcaggagccccccagaacccccagccccccccugagcagccaccccgacaucgacaccgacaucgacagcguggccagccagcccauggagcugcccgagaaccugagccuggagcccaaggaccaggacagcgugcugcuggagaaggacaaggugaacaacagcagcagaagcaagaagcccaagggccuggagcuggcccccacccuggugaucaccagcagcgaccccagcccccugggcauccugagccccagccugcccaccgccagccugacccccgccuucuucagccagguggccugcagccuguucauggugagcccccugcugagcuucaucugccccuucaagcagauccagaaccuguacacccaggugugcuuccugcugcugagauucgugcuggagagacugugcgugaccgugauguaa

SEQ ID NO: 16562 - RNA, 1923 nt, Artificial Sequence
  ELL2__Homo_sapiens__NP_036213
auggccgccggcggcaccggcggccugagagaggagcagagauacggccugagcugcggcagacugggccaggacaacaucaccgugcugcacgugaagcugaccgagaccgccaucagagcccuggagaccuaccagagccacaagaaccugauccccuucagacccagcauccaguuccagggccugcacggccuggugaagauccccaagaacgacccccugaacgaggugcacaacuucaacuucuaccugagcaacgugggcaaggacaacccccagggcagcuucgacugcauccagcagaccuucagcagcagcggcgccagccagcugaacugccugggcuucauccaggacaagaucaccgugugcgccaccaacgacagcuaccagaugaccagagagagaaugacccaggccgaggaggagagcagaaacagaagcaccaaggugaucaagcccggcggccccuacgugggcaagagagugcagaucagaaaggccccccaggccgugagcgacaccgugcccgagagaaagagaagcacccccaugaaccccgccaacaccaucagaaagacccacagcagcagcaccaucagccagagacccuacagagacagagugauccaccugcuggcccugaaggccuacaagaagcccgagcugcuggccagacugcagaaggacggcgugaaccagaaggacaagaacagccugggcgccauccugcagcagguggccaaccugaacagcaaggaccugagcuacacccugaaggacuacguguucaaggagcugcagagagacuggcccggcuacagcgagaucgacagaagaagccuggagagcgugcugagcagaaagcugaaccccagccagaacgccgccggcaccagcagaagcgagagccccgugugcagcagcagagacgccgugagcagcccccagaagagacugcuggacagcgaguucaucgacccccugaugaacaagaaggccagaaucagccaccugaccaacagagugccccccacccugaacggccaccugaaccccaccagcgagaagagcgccgccggccugccccugccccccgccgccgccgccauccccaccccccccccccugcccagcaccuaccugcccaucagccaccccccccagaucgugaacagcaacagcaacagccccagcacccccgagggcagaggcacccaggaccugcccguggacagcuucagccagaacgacagcaucuacgaggaccagcaggacaaguacaccagcagaaccagccuggagacccugccccccggcagcgugcugcugaagugccccaagcccauggaggagaaccacagcaugagccacaagaagagcaagaagaagagcaagaagcacaaggagaaggaccagaucaagaagcacgacaucgagaccaucgaggagaaggaggaggaccugaagagagaggaggagaucgccaagcugaacaacagcagccccaacagcagcggcggcgugaaggaggacugcaccgccagcauggagcccagcgccaucgagcugcccgacuaccugaucaaguacaucgccaucgugagcuacgagcagagacagaacuacaaggacgacuucaacgccgaguacgacgaguacagagcccugcacgccagaauggagaccguggccagaagauucaucaagcuggacgcccagagaaagagacugagccccggcagcaaggaguaccagaacgugcacgaggaggugcugcaggaguaccagaagaucaagcagagcagccccaacuaccacgaggagaaguacagaugcgaguaccugcacaacaagcuggcccacaucaagagacugaucggcgaguucgaccagcagcaggccgagagcuggagcuaa

SEQ ID NO: 16563 - RNA, 1866 nt, Artificial Sequence
  ELL__Homo_sapiens__NP_006523
auggccgcccugaaggaggacagaagcuacggccugagcugcggcagagugagcgacggcagcaaggugagcguguuccacgugaagcugaccgacagcgcccugagagccuucgagagcuacagagccagacaggacagcgugagccugagacccagcaucagauuccagggcagccagggccacaucagcaucccccagcccgacugccccgccgaggccagaaccuucagcuucuaccugagcaacaucggcagagacaacccccagggcagcuucgacugcauccagcaguacgugagcagccacggcgaggugcaccuggacugccugggcagcauccaggacaagaucaccgugugcgccaccgacgacagcuaccagaaggccagacagagcauggcccaggccgaggaggagaccagaagcagaagcgccaucgugaucaaggccggcggcagauaccugggcaagaaggugcaguucagaaagcccgcccccggcgccaccgacgccgugcccagcagaaagagagccacccccaucaaccuggccagcgccaucagaaagagcggcgccagcgccgugagcggcggcagcggcgugagccagagacccuucagagacagagugcugcaccugcuggcccugagacccuacagaaaggccgagcugcugcugagacugcagaaggacggccugacccaggccgacaaggacgcccuggacggccugcugcagcagguggccaacaugagcgccaaggacggcaccugcacccugcaggacugcauguacaaggacgugcagaaggacuggcccggcuacagcgagggcgaccagcagcugcugaagagagugcuggugagaaagcugugccagccccagagcaccggcagccugcugggcgaccccgccgccagcagcccccccggcgagagaggcagaagcgccagccccccccagaagagacugcagccccccgacuucaucgacccccuggccaacaagaagcccagaaucagccacuucacccagagagcccagcccgccgugaacggcaagcugggcgugcccaacggcagagaggcccugcugcccacccccggcccccccgccagcaccgacacccugagcagcagcacccaccugccccccagacuggagccccccagagcccacgacccccuggccgacgugagcaacgaccugggccacagcggcagagacugcgagcacggcgaggccgccgcccccgcccccaccgugagacugggccugccccugcugaccgacugcgcccagcccagcagaccccacggcagccccagcagaagcaagcccaagaagaagagcaagaagcacaaggacaaggagagagccgccgaggacaagcccagagcccagcugcccgacugcgcccccgccacccacgccacccccggcgcccccgccgacacccccggccugaacggcaccugcagcgugagcagcgugcccaccagcaccagcgagacccccgacuaccugcugaaguacgccgccaucagcagcagcgagcagagacagagcuacaagaacgacuucaacgccgaguacagcgaguacagagaccugcacgccagaaucgagagaaucaccagaagauucacccagcuggacgcccagcugagacagcugagccagggcagcgaggaguacgagaccaccagaggccagauccugcaggaguacagaaagaucaagaagaccaacaccaacuacagccaggagaagcacagaugcgaguaccugcacagcaagcuggcccacaucaagagacugaucgccgaguacgaccagagacagcugcaggccuggcccuaa

SEQ ID NO: 16564 - RNA, 744 nt, Artificial Sequence
  ELMO1__Homo_sapiens__NP_569709
augcagguggugaaggagcaggugaugagagcccugaccaccaagcccagcagccuggaccaguucaagagcaagcugcagaaccugagcuacaccgagauccugaagaucagacagagcgagagaaugaaccaggaggacuuccagagcagacccauccuggagcugaaggagaagauccagcccgagauccuggagcugaucaagcagcagagacugaacagacugguggagggcaccugcuucagaaagcugaacgccagaagaagacaggacaaguucugguacugcagacugagccccaaccacaaggugcugcacuacggcgaccuggaggagagcccccagggcgaggugccccacgacagccugcaggacaagcugcccguggccgacaucaaggccguggugaccggcaaggacugcccccacaugaaggagaagggcgcccugaagcagaacaaggaggugcuggagcuggccuucagcauccuguacgacagcaacugccagcugaacuucaucgcccccgacaagcacgaguacugcaucuggaccgacggccugaacgcccugcugggcaaggacaugaugagcgaccugaccagaaacgaccuggacacccugcugagcauggagaucaagcugagacugcuggaccuggagaacauccagauccccgacgcccccccccccauccccaaggagcccagcaacuacgacuucguguacgacugcaacuaa

SEQ ID NO: 16565 - RNA, 2163 nt, Artificial Sequence
  ELMO2__Homo_sapiens__NP_877496
augcccccccccagcgacaucgugaagguggccaucgaguggcccggcgccaacgcccagcugcuggagaucgaccagaagagaccccuggccagcaucaucaaggaggugugcgacggcuggagccugcccaaccccgaguacuacacccugagauacgccgacggcccccagcuguacaucaccgagcagaccagaagcgacaucaagaacggcaccauccugcagcuggccaucagccccagcagagccgccagacagcugauggagagaacccagagcagcaacauggagaccagacuggacgccaugaaggagcuggccaagcugagcgccgacgugaccuucgccaccgaguucaucaacauggacggcaucaucgugcugaccagacugguggagagcggcaccaagcugcugagccacuacagcgagaugcuggccuucacccugaccgccuuccuggagcugauggaccacggcaucgugagcugggacauggugagcaucaccuucaucaagcagaucgccggcuacgugagccagcccaugguggacgugagcauccugcagagaagccuggccauccuggagagcauggugcugaacagccagagccuguaccagaagaucgccgaggagaucaccgugggccagcugaucagccaccugcaggugagcaaccaggagauccagaccuacgccaucgcccugaucaacgcccuguuccugaaggcccccgaggacaagagacaggacauggccaacgccuucgcccagaagcaccugagaagcaucauccugaaccacgugaucagaggcaacagacccaucaagaccgagauggcccaccagcuguacgugcugcaggugcugaccuucaaccugcuggaggagagaaugaugaccaagauggaccccaacgaccaggcccagagagacaucaucuucgagcugagaagaaucgccuucgacgccgagagcgaccccagcaacgcccccggcagcggcaccgagaagagaaaggccauguacaccaaggacuacaagaugcugggcuucaccaaccacaucaaccccgccauggacuucacccagaccccccccggcaugcuggcccuggacaacaugcuguaccuggccaaggugcaccaggacaccuacaucagaaucgugcuggagaacagcagcagagaggacaagcacgagugccccuucggcagaagcgccaucgagcugaccaagaugcugugcgagauccugcaggugggcgagcugcccaacgagggcagaaacgacuaccaccccauguucuucacccacgacagagccuucgaggagcuguucggcaucugcauccagcugcugaacaagaccuggaaggagaugagagccaccgccgaggacuucaacaaggugaugcagguggugagagagcagaucaccagagcccugcccagcaagcccaacagccuggaccaguucaagagcaagcugagaagccugagcuacagcgagauccugagacugagacagagcgagagaaugagccaggacgacuuccagagcccccccaucguggagcugagagagaagauccagcccgagauccuggagcugaucaagcagcagagacugaacagacugugcgagggcagcagcuucagaaagaucggcaacagaagaagacaggagagauucugguacugcagacuggcccugaaccacaaggugcugcacuacggcgaccuggacgacaacccccagggcgaggugaccuucgagagccugcaggagaagauccccguggccgacaucaaggccaucgugaccggcaaggacugcccccacaugaaggagaagagcgcccugaagcagaacaaggaggugcuggagcuggccuucagcauccuguacgaccccgacgagacccugaacuucaucgcccccaacaaguacgaguacugcaucuggaucgacggccugagcgcccugcugggcaaggacaugagcagcgagcugaccaagagcgaccuggacacccugcugagcauggagaugaagcugagacugcuggaccuggagaacauccagauccccgaggcccccccccccauccccaaggagcccagcagcuacgacuucguguaccacuacggcuaa

SEQ ID NO: 16566 - RNA, 981 nt, Artificial Sequence
  ELMOD1__Homo_sapiens__NP_001123509
augaagcacuuccugagaaugcugauccaggugugccuguacuucuacugcaaguuccuguggagaugccugaaguucgugaugagaaagcugaccggcagaugcgagcugcagagaaucugcuacaacaccaagcccggcgccagcagaaccaugaagaucgagaccagccugagagacagcaagagcaagcugcugcagaccagcgugagcgugcaccccgacgccaucgagaagaccaucgaggacaucauggagcugaagaagaucaaccccgacgugaacccccagcugggcaucagccugcaggccugccugcugcagaucgugggcuacagaaaccugaucgccgacguggagaagcugagaagagaggccuacgacagcgacaacccccagcacgaggagaugcugcugaagcuguggaaguuccugaagcccaacaccccccuggagagcagaaucagcaagcaguggugcgagaucggcuuccagggcgacgaccccaagaccgacuucagaggcaugggccugcugggccuguacaaccugcaguacuucgccgagagagacgccaccgccgcccagcaggugcugagcgacagccugcaccccaagugcagcaaguucagcaaggccgagugggagaagaagagaauggacaaggccaucggcuacagcuucgccaucgugggcaucaacaucaccgaccuggccuacaaccugcuggugagcggcgcccugaagacccacuucuacaacaucgcccccgaggcccccacccugagccacuuccagcagaccuucugcuaccugaugcacgaguuccacaaguucuggaucgaggaggaccccauggacaucauggaguucaacagagugagagagaaguucagaaagagaaucaucaagcagcugcagaaccccgacauggcccugugcccccacuucgccgccagcgagggccugaucaacauguaa

SEQ ID NO: 16567 - RNA, 882 nt, Artificial Sequence
  ELMOD2__Homo_sapiens__NP_714913
auguucaucagccugugggaguucuucuacggccacuucuucagauucuggaugaaguggcugcugagacagaugaccggcaagugcgagcugcagagaaucuucgacaccuacgugggcgcccagagaacccacagaaucgagaacagccugaccuacagcaagaacaaggugcugcagaaggccacccacguggugcagagcgagguggacaaguacguggacgacaucaugaaggagaagaacaucaaccccgagaaggacgccagcuucaagaucugcaugaagaugugccugcugcagaucaccggcuacaagcagcuguaccuggacguggagagcgugagaaagagacccuacgacagcgacaaccugcagcacgaggagcugcugaugaagcuguggaaccugcugaugcccaccaagaagcugaacgccagaaucagcaagcagugggccgagaucggcuuccagggcgacgaccccaagaccgacuucagaggcaugggcauccugggccugaucaaccugguguacuucagcgagaacuacaccagcgaggcccaccagauccugagcagaagcaaccaccccaagcugggcuacagcuacgccaucgugggcaucaaccugaccgagauggccuacagccugcugaagagcgaggcccugaaguuccaccuguacaaccuggugcccggcauccccaccauggagcacuuccaccaguucuacugcuaccugguguacgaguucgacaaguucugguucgaggaggagcccgagagcaucauguacuucaaccuguacagagagaaguuccacgagaagaucaagggccugcugcuggacugcaacguggcccugacccugaagguguaa

SEQ ID NO: 16568 - RNA, 1146 nt, Artificial Sequence
  ELMOD3__Homo_sapiens__NP_001128494
augaacgagaagagcugcagcuuccacagcaaggaggagcugagagacggccagggcgagagacugagcgccggcuacagccccagcuacgacaaggacaagagcgugcuggccuucagaggcauccccaucagcgagcugaagaaccacggcauccugcaggcccugaccaccgaggccuacgagugggagcccagaguggugagcaccgagguggugagagcccaggaggagugggaggccguggacaccauccagcccgagaccggcagccaggccagcagcgagcagcccggccagcugaucagcuucagcgaggcccugcagcacuuccagaccguggaccugagccccuucaagaagagaauccagcccaccaucagaagaaccggccuggccgcccugagacacuaccuguucggcccccccaagcugcaccagagacugagagaggagagagaccuggugcugaccaucgcccagugcggccuggacagccaggaccccgugcacggcagagugcugcagaccaucuacaagaagcugaccggcagcaaguucgacugcgcccugcacggcaaccacugggaggaccugggcuuccagggcgccaaccccgccaccgaccugagaggcgccggcuuccuggcccugcugcaccugcuguaccuggugauggacagcaagacccugcccauggcccaggagaucuucagacugagcagacaccacauccagcaguuccccuucugccugaugagcgugaacaucacccacaucgccauccaggcccugagagaggagugccugagcagagagugcaacagacagcagaaggugauccccguggugaacagcuucuacgccgccaccuuccugcaccuggcccacguguggagaacccagagaaagaccaucagcgacagcggcuucgugcugaaggagcuggaggugcuggccaagaagagccccagaagacugcugaagacccuggagcuguaccuggccagagugagcaagggccaggccagccugcugggcgcccagaagugcuacggccccgaggccccccccuucaaggaccugaccuucaccggcgagagcgaccugcagagccacagcagcgagggcguguggcugaucuaa

SEQ ID NO: 16569 - RNA, 3138 nt, Artificial Sequence
  ELMSAN1__Homo_sapiens__NP_919254
augaaccugcaggcccagcccaaggcccagaacaagagaaagagaugccuguucggcggccaggagcccgcccccaaggagcagccccccccccugcagcccccccagcagagcaucagagugaaggaggagcaguaccugggccacgagggccccggcggcgccgugagcaccagccagcccguggagcugcccccccccagcagccuggcccugcugaacagcgugguguacggccccgagagaaccagcgccgccaugcugagccagcagguggccagcgugaaguggcccaacagcgugauggcccccggcagaggccccgagagaggcggcggcggcggcgugagcgacagcagcuggcagcagcagcccggccagccccccccccacagcaccuggaacugccacagccugagccuguacagcgccaccaagggcagcccccaccccggcgugggcgugcccaccuacuacaaccaccccgaggcccugaagagagagaaggccggcggcccccagcuggacagauacgugagacccaugaugccccagaaggugcagcuggaggugggcagaccccaggccccccugaacagcuuccacgccgccaagaagccccccaaccagagccugccccugcagcccuuccagcuggccuucggccaccaggugaacagacagguguucagacagggcccccccccccccaaccccguggccgccuuccccccccagaagcagcagcagcagcagcagccccagcagcagcagcagcagcagcaggccgcccugccccagaugccccuguucgagaacuucuacagcaugccccagcagcccagccagcagccccaggacuucggccugcagcccgccggcccccugggccagagccaccuggcccaccacagcauggcccccuaccccuucccccccaaccccgacaugaaccccgagcugagaaaggcccugcugcaggacagcgccccccagcccgcccugccccaggugcagauccccuuccccagaagaagcagaagacugagcaaggagggcauccugccccccagcgcccuggacggcgccggcacccagcccggccaggaggccaccggcaaccuguuccugcaccacuggccccugcagcagcccccccccggcagccugggccagccccaccccgaggcccugggcuucccccuggagcugagagagagccagcugcugcccgacggcgagagacuggcccccaacggcagagagagagaggcccccgccaugggcagcgaggagggcaugagagccgugagcaccggcgacugcggccaggugcugagaggcggcgugauccagagcaccagaagaagaagaagagccagccaggaggccaaccugcugacccuggcccagaaggccguggagcuggccagccugcagaacgccaaggacggcagcggcagcgaggagaagagaaagagcgugcuggccagcaccaccaagugcggcguggaguucagcgagcccagccuggccaccaagagagccagagaggacagcggcauggugccccugaucauccccgugagcgugcccgugagaaccguggaccccaccgaggccgcccaggccggcggccuggacgaggacggcaagggccccgagcagaaccccgccgagcacaagcccagcgugaucgugaccagaagaagaagcaccagaauccccggcaccgacgcccaggcccaggccgaggacaugaacgugaagcuggagggcgagcccagcgugagaaagcccaagcagagacccagacccgagccccugaucauccccaccaaggccggcaccuucaucgccccccccguguacagcaacaucacccccuaccagagccaccugagaagccccgugagacuggccgaccaccccagcgagagaagcuucgagcugccccccuacacccccccccccauccugagccccgugagagagggcagcggccuguacuucaacgccaucaucagcaccagcaccauccccgcccccccccccaucacccccaagagcgcccacagaacccugcugagaaccaacagcgccgaggugaccccccccgugcugagcgugaugggcgaggccacccccgugagcaucgagcccagaaucaacgugggcagcagauuccaggccgagaucccccugaugagagacagagcccuggccgccgccgacccccacaaggccgaccugguguggcagcccugggaggaccuggagagcagcagagagaagcagagacagguggaggaccugcugaccgccgccugcagcagcaucuuccccggcgccggcaccaaccaggagcuggcccugcacugccugcacgagagcagaggcgacauccuggagacccugaacaagcugcugcugaagaagccccugagaccccacaaccacccccuggccaccuaccacuacaccggcagcgaccaguggaagauggccgagagaaagcuguucaacaagggcaucgccaucuacaagaaggacuucuuccuggugcagaagcugauccagaccaagaccguggcccagugcguggaguucuacuacaccuacaagaagcaggugaagaucggcagaaacggcacccugaccuucggcgacguggacaccagcgacgagaagagcgcccaggaggagguggagguggacaucaagaccagccagaaguuccccagagugccccugcccagaagagagagccccagcgaggagagacuggagcccaagagagaggugaaggagcccagaaaggagggcgaggaggaggugcccgagauccaggagaaggaggagcaggaggagggcagagagagaagcagaagagccgccgccgugaaggccacccagacccugcaggccaacgagagcgccagcgacauccugauccugagaagccacgagagcaacgcccccggcagcgccggcggccaggccagcgagaagcccagagagggcaccggcaagagcagaagagcccugcccuucagcgagaagaagaagaagaccgagaccuucagcaagacccagaaccaggagaacaccuuccccugcaagaagugcggcagauaa

SEQ ID NO: 16570 - RNA, 2175 nt, Artificial Sequence
  ELN__Homo_sapiens__NP_000492
auggccggccugaccgccgccgcccccagacccggcgugcugcugcugcugcugagcauccugcaccccagcagacccggcggcgugcccggcgccauccccggcggcgugcccggcggcguguucuaccccggcgccggccugggcgcccugggcggcggcgcccugggccccggcggcaagccccugaagcccgugcccggcggccuggccggcgccggccugggcgccggccugggcgccuuccccgccgugaccuuccccggcgcccuggugcccggcggcguggccgacgccgccgccgccuacaaggccgccaaggccggcgccggccugggcggcgugcccggcgugggcggccugggcgugagcgccggcgccguggugccccagcccggcgccggcgugaagcccggcaaggugcccggcgugggccugcccggcguguaccccggcggcgugcugcccggcgccagauuccccggcgugggcgugcugcccggcgugcccaccggcgccggcgugaagcccaaggcccccggcgugggcggcgccuucgccggcauccccggcgugggccccuucggcggcccccagcccggcgugccccugggcuaccccaucaaggcccccaagcugcccggcggcuacggccugcccuacaccaccggcaagcugcccuacggcuacggccccggcggcguggccggcgccgccggcaaggccggcuaccccaccggcaccggcgugggcccccaggccgccgccgccgccgccgccaaggccgccgccaaguucggcgccggcgccgccggcgugcugcccggcgugggcggcgccggcgugcccggcgugcccggcgccauccccggcaucggcggcaucgccggcgugggcacccccgccgccgccgccgccgccgccgccgccgccaaggccgccaaguacggcgccgccgccggccuggugcccggcggccccggcuucggccccggcguggugggcgugcccggcgccggcgugcccggcgugggcgugcccggcgccggcauccccguggugcccggcgccggcauccccggcgccgccgugcccggcguggugagccccgaggccgccgccaaggccgccgccaaggccgccaaguacggcgccagacccggcgugggcgugggcggcauccccaccuacggcgugggcgccggcggcuuccccggcuucggcgugggcgugggcggcauccccggcguggccggcgugcccggcgugggcggcgugcccggcgugggcggcgugcccggcgugggcaucagccccgaggcccaggccgccgccgccgccaaggccgccaaguacggcgugggcacccccgccgccgccgccgccaaggccgccgccaaggccgcccaguucggccuggugcccggcgugggcguggcccccggcgugggcguggcccccggcgugggcguggcccccggcgugggccuggcccccggcgugggcguggcccccggcgugggcguggcccccggcgugggcguggcccccggcaucggccccggcggcguggccgccgccgccaagagcgccgccaagguggccgccaaggcccagcugagagccgccgccggccugggcgccggcauccccggccugggcgugggcgugggcgugcccggccugggcgugggcgccggcgugcccggccugggcgugggcgccggcgugcccggcuucggcgccgugcccggcgcccuggccgccgccaaggccgccaaguacggcgccgccgugcccggcgugcugggcggccugggcgcccugggcggcgugggcauccccggcggcguggugggcgccggccccgccgccgccgccgccgccgccaaggccgccgccaaggccgcccaguucggccuggugggcgccgccggccugggcggccugggcgugggcggccugggcgugcccggcgugggcggccugggcggcaucccccccgccgccgccgccaaggccgccaaguacggcgccgccggccugggcggcgugcugggcggcgccggccaguucccccugggcggcguggccgccagacccggcuucggccugagccccaucuuccccggcggcgccugccugggcaaggccugcggcagaaagagaaaguaa

SEQ ID NO: 16571 - RNA, 252 nt, Artificial Sequence
  ELOF1__Homo_sapiens__NP_115753
augggcagaagaaagagcaagagaaagcccccccccaagaagaagaugaccggcacccuggagacccaguucaccugccccuucugcaaccacgagaagagcugcgacgugaagauggacagagccagaaacaccggcgugaucagcugcaccgugugccuggaggaguuccagacccccaucaccuaccugagcgagcccguggacguguacagcgacuggaucgacgccugcgaggccgccaaccaguaa

SEQ ID NO: 16572 - RNA, 891 nt, Artificial Sequence
  ELOVL2__Homo_sapiens__NP_060240
auggagcaccugaaggccuucgacgacgagaucaacgccuuccuggacaacauguucggccccagagacagcagagugagaggcugguucaugcuggacagcuaccugcccaccuucuuccugaccgugauguaccugcugagcaucuggcugggcaacaaguacaugaagaacagacccgcccugagccugagaggcauccugacccuguacaaccugggcaucacccugcugagcgccuacaugcuggccgagcugauccugagcaccugggagggcggcuacaaccugcagugccaggaccugaccagcgccggcgaggccgacaucagaguggccaaggugcuguggugguacuacuucagcaagagcguggaguuccuggacaccaucuucuucgugcugagaaagaagaccagccagaucaccuuccugcacguguaccaccacgccagcauguucaacaucugguggugcgugcugaacuggauccccugcggccagagcuucuucggccccacccugaacagcuucauccacauccugauguacagcuacuacggccugagcguguuccccagcaugcacaaguaccugugguggaagaaguaccugacccaggcccagcuggugcaguucgugcugaccaucacccacaccaugagcgccguggugaagcccugcggcuuccccuucggcugccugaucuuccagagcagcuacaugcugacccuggugauccuguuccugaacuucuacgugcagaccuacagaaagaagcccaugaagaaggacaugcaggagccccccgccggcaaggaggugaagaacggcuucagcaaggccuacuucaccgccgccaacggcgugaugaacaagaaggcccaguaa

SEQ ID NO: 16573 - RNA, 945 nt, Artificial Sequence
  ELOVL4__Homo_sapiens__NP_073563
augggccugcuggacagcgagcccggcagcgugcugaacguggugagcaccgcccugaacgacaccguggaguucuacagauggaccuggagcaucgccgacaagagaguggagaacuggccccugaugcagagccccuggcccacccugagcaucagcacccuguaccugcuguucguguggcugggccccaaguggaugaaggacagagagcccuuccagaugagacuggugcugaucaucuacaacuucggcauggugcugcugaaccuguucaucuucagagagcuguucaugggcagcuacaacgccggcuacagcuacaucugccagagcguggacuacagcaacaacgugcacgaggugagaaucgccgccgcccuguggugguacuucgugagcaagggcguggaguaccuggacaccguguucuucauccugagaaagaagaacaaccaggugagcuuccugcacguguaccaccacugcaccauguucacccugugguggaucggcaucaaguggguggccggcggccaggccuucuucggcgcccagcugaacagcuucauccacgugaucauguacagcuacuacggccugaccgccuucggccccuggauccagaaguaccugugguggaagagauaccugaccaugcugcagcugauccaguuccacgugaccaucggccacaccgcccugagccuguacaccgacugccccuuccccaaguggaugcacugggcccugaucgccuacgccaucagcuucaucuuccuguuccugaacuucuacaucagaaccuacaaggagcccaagaagcccaaggccggcaagaccgccaugaacggcaucagcgccaacggcgugagcaagagcgagaagcagcugaugaucgagaacggcaagaagcagaagaacggcaaggccaagggcgacuaa

SEQ ID NO: 16574 - RNA, 981 nt, Artificial Sequence
  ELOVL5__Homo_sapiens__NP_001229757
auggagcacuucgacgccagccugagcaccuacuucaaggcccugcugggccccagagacaccagagugaagggcugguuccugcuggacaacuacauccccaccuucaucugcagcgugaucuaccugcugaucguguggcugggccccaaguacaugagaaacaagcagcccuucagcugcagaggcauccuggugguguacaaccugggccugacccugcugagccuguacauguucugcgagagcaagagagagcagcccagaagaagcgccugcgccagcagaaccgaccccagcacccagcagcagcugcccgagaacagacuggugaccggcgugugggagggcaaguacaacuucuucugccagggcaccagaaccgccggcgagagcgacaugaagaucaucagagugcuguggugguacuacuucagcaagcugaucgaguucauggacaccuucuucuucauccugagaaagaacaaccaccagaucaccgugcugcacguguaccaccacgccagcaugcugaacaucuggugguucgugaugaacugggugcccugcggccacagcuacuucggcgccacccugaacagcuucauccacgugcugauguacagcuacuacggccugagcagcgugcccagcaugagacccuaccugugguggaagaaguacaucacccagggccagcugcugcaguucgugcugaccaucauccagaccagcugcggcgugaucuggcccugcaccuucccccugggcuggcuguacuuccagaucggcuacaugaucagccugaucgcccuguucaccaacuucuacauccagaccuacaacaagaagggcgccagcagaagaaaggaccaccugaaggaccaccagaacggcagcauggccgccgugaacggccacaccaacagcuucagcccccuggagaacaacgugaagcccagaaagcugagaaaggacuaa

SEQ ID NO: 16575 - RNA, 798 nt, Artificial Sequence
  ELOVL6__Homo_sapiens__XP_011530536
augaacaugagcgugcugacccugcaggaguacgaguucgagaagcaguucaacgagaacgaggccauccaguggaugcaggagaacuggaagaagagcuuccuguucagcgcccuguacgccgccuucaucuucggcggcagacaccugaugaacaagagagccaaguucgagcugagaaagccccuggugcuguggagccugacccuggccguguucagcaucuucggcgcccugagaaccggcgccuacaugguguacauccugaugaccaagggccugaagcagagcgugugcgaccagggcuucuacaacggccccgugagcaaguucugggccuacgccuucgugcugagcaaggcccccgagcugggcgacaccaucuucaucauccugagaaagcagaagcugaucuuccugcacugguaccaccacaucaccgugcugcuguacagcugguacagcuacaaggacaugguggccggcggcggcugguucaugaccaugaacuacggcgugcacgccgugauguacagcuacuacgcccugagagccgccggcuucagagugagcagaaaguucgccauguucaucacccugagccagaucacccagaugcugaugggcugcguggugaacuaccugguguucugcuggaugcagcacgaccagugccacagccacuuccagaacaucuucuggagcagccugauguaccugagcuaccuggugcuguucugccacuucuucuucgaggccuacaucggcaagaugagaaagaccaccaaggccgaguaa

SEQ ID NO: 16576 - RNA, 846 nt, Artificial Sequence
  ELOVL7__Homo_sapiens__NP_001098028
auggccuucagcgaccugaccagcagaaccgugcaccuguacgacaacuggaucaaggacgccgaccccagaguggaggacuggcugcugaugagcagcccccugccccagaccauccugcugggcuucuacguguacuucgugaccagccugggccccaagcugauggagaacagaaagcccuucgagcugaagaaggccaugaucaccuacaacuucuucaucgugcuguucagcguguacaugugcuacgaguucgugaugagcggcuggggcaucggcuacagcuucagaugcgacaucguggacuacagcagaagccccaccgcccugagaauggccagaaccugcuggcuguacuacuucagcaaguucaucgagcugcuggacaccaucuucuucgugcugagaaagaagaacagccaggugaccuuccugcacguguuccaccacaccaucaugcccuggaccuggugguucggcgugaaguucgccgccggcggccugggcaccuuccacgcccugcugaacaccgccgugcacguggugauguacagcuacuacggccugagcgcccugggccccgccuaccagaaguaccugugguggaagaaguaccugaccagccugcagcuggugcaguucgugaucguggccauccacaucagccaguucuucuucauggaggacugcaaguaccaguuccccguguucgccugcaucaucaugagcuacagcuucauguuccugcugcuguuccugcacuucugguacagagccuacaccaagggccagagacugcccaagaccgugaagaacggcaccugcaagaacaaggacaacuaa

SEQ ID NO: 16577 - RNA, 2676 nt, Artificial Sequence
  ELP2__Homo_sapiens__NP_001229804
augguggcccccgugcuggagaccagccacguguucugcugccccaacagagugagaggcgugcugaacuggagcagcggccccagaggccugcuggccuucggcaccagcugcagcguggugcuguacgacccccugaagagagugguggugaccaaccugaacggccacaccgccagagugaacugcauccaguggaucugcaagcaggacggcagccccagcaccgagcuggugagcggcggcagcgacaaccaggugauccacugggagaucgaggacaaccagcugcugaaggccgugcaccugcagggccacgagggccccguguacgccgugcacgccguguaccagagaagaaccagcgaccccgcccugugcacccugaucgugagcgccgccgccgacagcgccgugagacuguggagcaagaagggccccgaggugaugugccugcagacccugaacuucggcaacggcuucgcccuggcccugugccugagcuuccugcccaacaccgacgugaccuggaagaccggccagguggagagaggcagagccuggaagccccccgccagccuggcccugugcagcagaagcugcgacagcauggugagcugcuacgccagcauccugugcaaggcccuguggaaggagaagcugcacaccuucuggcaccacaacagaaucagcuuccugcccagcgccuucagacccauccccauccuggccugcggcaacgacgacugcagaauccacaucuucgcccagcagaacgaccaguuccagaaggugcugagccugugcggccacgaggacuggaucagaggcguggagugggccgccuucggcagagaccuguuccuggccagcugcagccaggacugccugaucagaaucuggaagcuguacaucaagagcaccagccuggagacccaggacgacgacaacaucagacugaaggagaacaccuucaccaucgagaacgagagcgugaagaucgccuucgccgugacccuggagaccgugcuggccggccacgagaacugggugaacgccgugcacuggcagcccguguucuacaaggacggcgugcugcagcagcccgugagacugcugagcgccagcauggacaagaccaugauccugugggcccccgacgaggagagcggcguguggcuggagcaggugagagugggcgaggugggcggcaacacccugggcuucuacgacugccaguucaacgaggacggcagcaugaucaucgcccacgccuuccacggcgcccugcaccuguggaagcagaacaccgugaaccccagagaguggacccccgagaucgugaucagcggccacuucgacggcgugcaggaccuggugugggaccccgagggcgaguucaucaucaccgugggcaccgaccagaccaccagacuguucgcccccuggaagagaaaggaccagagccaggugaccuggcacgagaucgccagaccccagauccacggcuacgaccugaagugccuggccaugaucaacagauuccaguucgugagcggcgccgacgagaaggugcugagaguguucagcgcccccagaaacuucguggagaacuucugcgccaucaccggccagagccugaaccacgugcugugcaaccaggacagcgaccugcccgagggcgccaccgugcccgcccugggccugagcaacaaggccguguuccagggcgacaucgccagccagcccagcgacgaggaggagcugcugaccagcaccggcuucgaguaccagcagguggccuuccagcccagcauccugaccgagccccccaccgaggaccaccugcugcagaacacccuguggcccgaggugcagaagcuguacggccacggcuacgagaucuucugcgugaccugcaacagcagcaagacccugcuggccagcgccugcaaggccgccaagaaggagcacgccgccaucauccuguggaacaccaccagcuggaagcaggugcagaaccugguguuccacagccugaccgugacccagauggccuucagccccaacgagaaguuccugcuggccgugagcagagacagaaccuggagccuguggaagaagcaggacaccaucagccccgaguucgagcccguguucagccuguucgccuucaccaacaagaucaccagcgugcacagcagaaucaucuggagcugcgacuggagccccgacagcaaguacuucuucaccggcagcagagacaagaagguggugguguggggcgagugcgacagcaccgacgacugcaucgagcacaacaucggccccugcagcagcgugcuggacgugggcggcgccgugaccgccgugagcgugugccccgugcugcaccccagccagagauacgugguggccgugggccuggagugcggcaagaucugccuguacaccuggaagaagaccgaccaggugcccgagaucaacgacuggacccacugcguggagaccagccagagccagagccacacccuggccaucagaaagcugugcuggaagaacugcagcggcaagaccgagcagaaggaggccgagggcgccgaguggcugcacuucgccagcugcggcgaggaccacaccgugaagauccacagagugaacaagugcgcccuguaa

SEQ ID NO: 16578 - RNA, 1602 nt, Artificial Sequence
  ELP3__Homo_sapiens__NP_001271151
augaugcugaccaucggcgacgugaucaagcagcugaucgaggcccacgagcagggcaaggacaucgaccugaacaaggugaagaccaagaccgccgccaaguacggccugagcgcccagcccagacugguggacaucaucgccgccgugcccccccaguacagaaaggugcugaugcccaagcugaaggccaagcccaucagaaccgccagcggcaucgccgugguggccgugaugugcaagccccacagaugcccccacaucagcuucaccggcaacaucugcguguacugccccggcggccccgacagcgacuucgaguacagcacccagagcuacaccggcuacgagcccaccagcaugagagccaucagagccagauacgaccccuuccugcagaccagacacagaaucgagcagcugaagcagcugggccacagcguggacaagguggaguucaucgugaugggcggcaccuucauggcccugcccgaggaguacagagacuacuucaucagaaaccugcacgacgcccugagcggccacaccagcaacaacaucuacgaggccgugaaguacagcgagagaagccugaccaagugcaucggcaucaccaucgagaccagacccgacuacugcaugaagagacaccugagcgacaugcugaccuacggcugcaccagacuggagaucggcgugcagagcguguacgaggacguggccagagacaccaacagaggccacaccgugaaggccgugugcgagagcuuccaccuggccaaggacagcggcuucaaggugguggcccacaugaugcccgaccugcccaacgugggccuggagagagacaucgagcaguucaccgaguucuucgagaaccccgccuucagacccgacggccugaagcuguaccccacccuggugaucagaggcaccggccuguacgagcuguggaagagcggcagauacaagagcuacagccccagcgaccugguggagcugguggccagaauccuggcccuggugccccccuggaccagaguguacagagugcagagagacauccccaugccccuggugagcagcggcguggagcacggcaaccugagagagcuggcccuggccagaaugaaggaccugggcauccagugcagagacgugagaaccagagaggugggcauccaggagauccaccacaaggugagacccuaccagguggagcuggugagaagagacuacguggccaacggcggcugggagaccuuccugagcuacgaggaccccgaccaggacauccugaucggccugcugagacugagaaagugcagcgaggagaccuucagauucgagcugggcggcggcgugagcaucgugagagagcugcacguguacggcagcguggugcccgugagcagcagagaccccaccaaguuccagcaccagggcuucggcaugcugcugauggaggaggccgagagaaucgccagagaggagcacggcagcggcaagaucgccgugaucagcggcgugggcaccagaaacuacuacagaaagaucggcuacagacugcagggccccuacauggugaagaugcugaaguaa

SEQ ID NO: 16579 - RNA, 1431 nt, Artificial Sequence
  ELP4__Homo_sapiens__NP_001275654
auggccgccguggccaccugcggcagcguggccgccagcaccggcagcgccguggccaccgccagcaagagcaacgugaccagcuuccagagaagaggccccagagccagcgugaccaacgacagcggccccagacuggugagcaucgccggcaccagacccagcgugagaaacggccagcugcuggugagcaccggccugcccgcccuggaccagcugcugggcggcggccuggccgugggcaccgugcugcugaucgaggaggacaaguacaacaucuacagcccccugcuguucaaguacuuccuggccgagggcaucgugaacggccacacccugcugguggccagcgccaaggaggaccccgccaacauccugcaggagcugcccgccccccugcuggacgacaagugcaagaaggaguucgacgaggacguguacaaccacaagacccccgagagcaacaucaagaugaagaucgccuggagauaccagcugcugcccaagauggagcagaucggccccgugagcagcagcagauucggccacuacuacgacgccagcaagagaaugccccaggagcugaucgaggccagcaacuggcacggcuucuuccugcccgagaagaucagcagcacccugaagguggagcccugcagccugacccccggcuacaccaagcugcugcaguucauccagaacaucaucuacgaggagggcuucgacggcagcaacccccagaagaagcagagaaacauccugagaaucggcauccagaaccugggcagcccccuguggggcgacgacaucugcugcgccgagaacggcggcaacagccacagccugaccaaguuccuguacgugcugagaggccugcugagaaccagccugagcgccugcaucaucaccaugcccacccaccugauccagaacaaggccaucaucgccagagugaccacccugagcgacgugguggugggccuggagagcuucaucggcagcgagagagagaccaacccccuguacaaggacuaccacggccugauccacaucagacagauccccagacugaacaaccugaucugcgacgagagcgacgugaaggaccuggccuucaagcugaagagaaagcuguucaccaucgagugggugcaggacaacuaccugagacaggagagaaacaucuacccccccggcuucagcuaccugcugaagcagaaggacagcgccuggggcgagggcagccugcagcacagcaccuuccugaugagcuuccuggccaaggccaccgccuucgccagcagacuggugagacacagcgagccccugaagcagaacggcagcggcagaaucagacaggccgccggccccagacuguggcacgacggcagaagacaggaggcccccggccugcugggcaucccccccuaa

SEQ ID NO: 16580 - RNA, 801 nt, Artificial Sequence
  ELP6__Homo_sapiens__NP_001026873
auguucguggagcugaacaaccugcugaacaccacccccgacagagccgagcagggcaagcugacccugcugugcgacgccaagaccgacggcagcuuccuggugcaccacuuccugagcuucuaccugaaggccaacugcaaggugugcuucguggcccugauccagagcuucagccacuacagcaucgugggccagaagcugggcgugagccugaccauggccagagagagaggccagcugguguuccuggagggccugaagagcgccguggacgugguguuccaggcccagaaggagccccacccccugcaguuccugagagaggccaacgccggcaaccugaagccccuguucgaguucgugagagaggcccugaagcccguggacagcggcgaggccagauggaccuaccccgugcugcugguggacgaccugagcgugcugcugagccugggcaugggcgccguggccgugcuggacuucauccacuacugcagagccaccgugugcugggagcugaagggcaacaugguggugcuggugcacgacagcggcgacgccgaggacgaggagaacgacauccugcugaacggccugagccaccagagccaccugauccugagagccgagggccuggccaccggcuucugcagagacgugcacggccagcugagaauccuguggagaagacccagccagcccgccgugcacagagaccagagcuucaccuaccaguacaagauccaggacaagagcgugagcuucuucgccaagggcaugagccccgccgugcuguaa

SEQ ID NO: 16581 - RNA, 672 nt, Artificial Sequence
  ELSPBP1__Homo_sapiens__NP_071425
augaccagauggagcagcuaccugcugggcuggaccaccuuccugcuguacagcuacgagagcagcggcggcaugcacgaggagugcguguuccccuucaccuacaagggcagcguguacuucaccugcacccacauccacagccugagccccuggugcgccaccagagccguguacaacggccaguggaaguacugccagagcgaggacuaccccagaugcaucuuccccuucaucuacagaggcaaggccuacaacagcugcaucagccagggcagcuuccugggcagccuguggugcagcgugaccagcguguucgacgagaagcagcaguggaaguucugcgagaccaacgaguacggcggcaacagccugagaaagcccugcaucuuccccagcaucuacagaaacaacguggugagcgacugcauggaggacgagagcaacaagcuguggugccccaccaccgagaacauggacaaggacggcaaguggagcuucugcgccgacaccagaaucagcgcccuggugcccggcuuccccugccacuuccccuucaacuacaagaacaagaacuacuucaacugcaccaacgagggcagcaaggagaaccugguguggugcgccaccagcuacaacuacgaccaggaccacaccuggguguacugcuaa

SEQ ID NO: 16582 - RNA, 984 nt, Artificial Sequence
  EMB__Homo_sapiens__NP_940851
augagagcccugcccggccugcuggaggccagagccagaacccccagacugcugcugcugcagugccugcuggccgccgccagacccagcagcgccgacggcagcgcccccgacagccccuucaccagccccccccugagagaggagaucauggccaacaacuucagccuggagagccacaacaucagccugaccgagcacagcagcaugcccguggagaagaacaucacccuggagagacccagcaacgugaaccugaccugccaguucaccaccagcggcgaccugaacgccgugaacgugaccuggaagaaggacggcgagcagcuggagaacaacuaccuggugagcgccaccggcagcacccuguacacccaguacagauucaccaucaucaacagcaagcagaugggcagcuacagcugcuucuucagagaggagaaggagcagagaggcaccuucaacuucaaggugcccgagcugcacggcaagaacaagccccugaucagcuacgugggcgacagcaccgugcugaccugcaagugccagaacugcuucccccugaacuggaccugguacagcagcaacggcagcgugaaggugcccgugggcgugcagaugaacaaguacgugaucaacggcaccuacgccaacgagaccaagcugaagaucacccagcugcuggaggaggacggcgagagcuacuggugcagagcccuguuccagcugggcgagagcgaggagcacaucgagcugguggugcugagcuaccuggugccccugaagcccuuccuggugaucguggccgaggugauccugcugguggccaccauccugcugugcgagaaguacacccagaagaagaagaagcacagcgacgagggcaaggaguucgagcagaucgagcagcugaagagcgacgacagcaacggcaucgagaacaacgugcccagacacagaaagaacgagagccugggccaguaa

SEQ ID NO: 16583 - RNA, 765 nt, Artificial Sequence
  EMC10__Homo_sapiens__NP_778233
auggccgccgccagcgccggcgccaccagacugcugcugcugcugcugauggccguggccgcccccagcagagccagaggcagcggcugcagagccggcaccggcgccagaggcgccggcgccgagggcagagagggcgaggccugcggcaccgugggccugcugcuggagcacagcuucgagaucgacgacagcgccaacuucagaaagagaggcagccugcuguggaaccagcaggacggcacccugagccugagccagagacagcugagcgaggaggagagaggcagacugagagacguggccgcccugaacggccuguacagagugagaauccccagaagacccggcgcccuggacggccuggaggccggcggcuacgugagcagcuucgugcccgccugcagccugguggagagccaccugagcgaccagcugacccugcacguggacguggccggcaacguggugggcgugagcguggugacccaccccggcggcugcagaggccacgagguggaggacguggaccuggagcuguucaacaccagcgugcagcugcagccccccaccaccgcccccggccccgagaccgccgccuucaucgagagacuggagauggagcaggcccagaaggccaagaacccccaggagcagaagagcuucuucgccaaguacuggcacaucauccugggcggcgccgugcugcugaccgcccugagacccgccgcccccggccccgccccccccccccaggaggccuaa

SEQ ID NO: 16584 - RNA, 894 nt, Artificial Sequence
  EMC2__Homo_sapiens__NP_055488
auggccaaggugagcgagcuguacgacgugaccugggaggagaugagagacaagaugagaaaguggagagaggagaacagcagaaacagcgagcagaucguggaggugggcgaggagcugaucaacgaguacgccagcaagcugggcgacgacaucuggaucaucuacgagcaggugaugaucgccgcccuggacuacggcagagacgaccuggcccuguucugccugcaggagcugagaagacaguuccccggcagccacagagugaagagacugaccggcaugagauucgaggccauggagagauacgacgacgccauccagcuguacgacagaauccugcaggaggaccccaccaacaccgccgccagaaagagaaagaucgccaucagaaaggcccagggcaagaacguggaggccaucagagagcugaacgaguaccuggagcaguucgugggcgaccaggaggccuggcacgagcuggccgagcuguacaucaacgagcacgacuacgccaaggccgccuucugccuggaggagcugaugaugaccaacccccacaaccaccuguacugccagcaguacgccgaggugaaguacacccagggcggccuggagaaccuggagcugagcagaaaguacuucgcccaggcccugaagcugaacaacagaaacaugagagcccuguucggccuguacaugagcgccagccacaucgccagcaaccccaaggccagcgccaagaccaagaaggacaacaugaaguacgccagcugggccgccagccagaucaacagagccuaccaguucgccggcagaagcaagaaggagaccaaguacagccugaaggccguggaggacaugcuggagacccugcagaucacccagagcuaa

SEQ ID NO: 16585 - RNA, 786 nt, Artificial Sequence
  EMC3__Homo_sapiens__NP_060917
auggccggccccgagcugcugcuggacagcaacaucagacuguggguggugcugcccaucgugaucaucaccuucuucgugggcaugaucagacacuacgugagcauccugcugcagagcgacaagaagcugacccaggagcaggugagcgacagccaggugcugaucagaagcagagugcugagagagaacggcaaguacauccccaagcagagcuuccugaccagaaaguacuacuucaacaaccccgaggacggcuucuucaagaagaccaagagaaagguggugccccccagccccaugaccgaccccaccaugcugaccgacaugaugaagggcaacgugaccaacgugcugcccaugauccugaucggcggcuggaucaacaugaccuucagcggcuucgugaccaccaaggugcccuucccccugacccugagauucaagcccaugcugcagcagggcaucgagcugcugacccuggacgccagcugggugagcagcgccagcugguacuuccugaacguguucggccugagaagcaucuacagccugauccugggccaggacaacgccgccgaccagagcagaaugaugcaggagcagaugaccggcgccgccauggccaugcccgccgacaccaacaaggccuucaagaccgagugggaggcccuggagcugaccgaccaccagugggcccuggacgacguggaggaggagcugauggccaaggaccugcacuucgagggcauguucaagaaggagcugcagaccagcaucuucuaa

SEQ ID NO: 16586 - RNA, 729 nt, Artificial Sequence
  EMC7__Homo_sapiens__NP_064539
auggccgccgcccuguggggcuucuuccccgugcugcugcugcugcugcugagcggcgacgugcagagcagcgaggugcccggcgccgccgccgagggcagcggcggcagcggcgugggcaucggcgacagauucaagaucgagggcagagccguggugcccggcgugaagccccaggacuggaucagcgccgccagagugcugguggacggcgaggagcacgugggcuuccugaagaccgacggcagcuucguggugcacgacauccccagcggcagcuacgugguggagguggugagccccgccuacagauucgaccccgugagaguggacaucaccagcaagggcaagaugagagccagauacgugaacuacaucaagaccagcgagguggugagacugcccuacccccugcagaugaagagcagcggcccccccagcuacuucaucaagagagagagcuggggcuggaccgacuuccugaugaaccccauggugaugaugauggugcugccccugcugaucuucgugcugcugcccaagguggugaacaccagcgaccccgacaugagaagagagauggagcagagcaugaacaugcugaacagcaaccacgagcugcccgacgugagcgaguucaugaccagacuguucagcagcaagagcagcggcaagagcagcagcggcagcagcaagaccggcaagagcggcgccggcaagagaagauaa

SEQ ID NO: 16587 - RNA, 381 nt, Artificial Sequence
  EMC8__Homo_sapiens__NP_001135760
augcccggcgugaagcugaccacccaggccuacugcaagauggugcugcacggcgccaaguacccccacugcgccgugaacggccugcugguggccgagaagcagaagcccagaaaggagcaccugccccugggcggccccggcgcccaccacacccuguucguggacugcaucccccuguuccacggcacccuggcccuggcccccaugcuggagguggcccugacccugaucgacagcuggugcaaggaccacagcuacgugaucgccggcuacuaccaggccaacgagagagugaaggacgccagccccaaccagguggccgagaagguggccagcagaaucgccgagggcuucagcgacaccgcccugaucauguaa

SEQ ID NO: 16588 - RNA, 747 nt, Artificial Sequence
  EMCN__Homo_sapiens__NP_001153166
auggagcugcugcaggugaccauccuguuccugcugcccagcaucugcagcagcaacagcaccggcgugcuggaggccgccaacaacagccugguggugaccaccaccaagcccagcaucaccacccccaacaccgagagccugcagaagaacguggugacccccaccaccggcaccacccccaagggcaccaucaccaacgagcugcugaagaugagccugaugagcaccgccaccuuccugaccagcaaggacgagggccugaaggccaccaccaccgacgugagaaagaacgacagcaucaucagcaacgugaccgugaccagcgugacccugcccaacgccgugagcacccugcagagcagcaagcccaagagcagcgugcugcagcccgacgccagccccagcaagaccggcacccugaccagcauccccgugaccauccccgagaacaccagccagagccaggugaucggcaccgagggcggcaagaacgccagcaccagcgccaccagcagaagcuacagcagcaucauccugcccguggugaucgcccugaucgugaucacccugagcguguucgugcuggugggccuguacagaaugugcuggaaggccgaccccggcacccccgagaacggcaacgaccagccccagagcgacaaggagagcgugaagcugcugaccgugaagaccaucagccacgagagcggcgagcacagcgcccagggcaagaccaagaacuaa

SEQ ID NO: 16589 - RNA, 765 nt, Artificial Sequence
  EMD__Homo_sapiens__NP_000108
auggacaacuacgccgaccugagcgacaccgagcugaccacccugcugagaagauacaacaucccccacggccccguggugggcagcaccagaagacuguacgagaagaagaucuucgaguacgagacccagagaagaagacugagcccccccagcagcagcgccgccagcagcuacagcuucagcgaccugaacagcaccagaggcgacgccgacauguacgaccugcccaagaaggaggacgcccugcuguaccagagcaagggcuacaacgacgacuacuacgaggagagcuacuucaccaccagaaccuacggcgagcccgagagcgccggccccagcagagccgugagacagagcgugaccagcuuccccgacgccgacgccuuccaccaccaggugcacgacgacgaccugcugagcagcagcgaggaggagugcaaggacagagagagacccauguacggcagagacagcgccuaccagagcaucacccacuacagacccgugagcgccagcagaagcagccuggaccugagcuacuaccccaccagcagcagcaccagcuucaugagcagcagcagcagcagcagcagcuggcugaccagaagagccaucagacccgagaacagagcccccggcgccggccugggccaggacagacaggugccccuguggggccagcugcugcuguuccugguguucgugaucgugcuguucuucaucuaccacuucaugcaggccgaggagggcaaccccuucuaa

SEQ ID NO: 16590 - RNA, 1713 nt, Artificial Sequence
  EME1__Homo_sapiens__NP_689676
auggcccugaagaagagcagccccagccuggacagcggcgacagcgacagcgaggagcugcccaccuucgccuuccugaagaaggagcccagcagcaccaagagaagacagcccgagagagaggagaagaucguggugguggacaucagcgacugcgaggccagcugcccccccgcccccgagcuguucagcccccccgugcccgagaucgccgagaccgugacccagacccagcccgugagacugcugagcagcgagagcgaggacgaggaggaguucaucccccuggcccagagacugaccugcaaguuccugacccacaagcagcugagccccgaggacagcagcagccccgugaagagcgugcuggaccaccagaacaacgagggcgccagcugcgacuggaagaagcccuuccccaagauccccgaggugccccugcacgacacccccgagagaagcgccgccgacaacaaggaccugauccuggaccccugcugccagcugcccgccuaccugagcaccugccccggccagagcagcagccuggccgugaccaagaccaacagcgacauccugcccccccagaagaagaccaagcccagccagaaggugcagggcagaggcagccacggcugcagacagcagagacaggccagacagaaggagagcacccugagaagacaggagagaaagaacgccgcccuggugaccagaaugaaggcccagagacccgaggagugccugaagcacaucaucguggugcuggaccccgugcugcugcagauggagggcggcggccagcugcugggcgcccugcagaccauggagugcagaugcgugaucgaggcccaggccgugcccugcagcgugaccuggagaagaagagccggccccagcgaggacagagaggacuggguggaggagcccaccgugcuggugcugcugagagccgaggccuucgugagcaugaucgacaacggcaagcagggcagccuggacagcaccaugaagggcaaggagacccugcagggcuucgugaccgacaucaccgccaagaccgccggcaaggcccugagccuggugaucguggaccaggagaagugcuucagcgcccagaacccccccagaagaggcaagcagggcgccaacaagcagaccaagaagcagcagcagagacagcccgaggccagcaucggcagcauggugagcagaguggacgccgaggaggcccugguggaccugcagcugcacaccgaggcccaggcccagaucgugcagagcuggaaggagcuggccgacuucaccugcgccuucaccaaggccguggccgaggcccccuucaagaagcugagagacgagaccaccuucagcuucugccuggagagcgacugggccggcggcgugaagguggaccuggccggcagaggccuggcccugguguggagaagacagauccagcagcugaacagagugagccuggagauggccagcgccguggugaacgccuaccccagcccccagcugcuggugcaggccuaccagcagugcuucagcgacaaggagagacagaaccugcuggccgacauccaggugagaagaggcgagggcgugaccagcaccagcagaagaaucggccccgagcugagcagaagaaucuaccugcagaugaccacccugcagccccaccugagccuggacagcgccgacuaa

SEQ ID NO: 16591 - RNA, 735 nt, Artificial Sequence
  EMG1__Homo_sapiens__NP_006322
auggccgcccccagcgacggcuucaagcccagagagagaagcggcggcgagcaggcccaggacugggacgcccugccccccaagagacccagacugggcgccggcaacaagaucggcggcagaagacugaucguggugcuggagggcgccagccuggagaccgugaaggugggcaagaccuacgagcugcugaacugcgacaagcacaagagcauccugcugaagaacggcagagaccccggcgaggccagacccgacaucacccaccagagccugcugaugcugauggacagcccccugaacagagccggccugcugcagguguacauccacacccagaagaacgugcugaucgaggugaacccccagaccagaauccccagaaccuucgacagauucugcggccugauggugcagcugcugcacaagcugagcgugagagccgccgacggcccccagaagcugcugaaggugaucaagaaccccgugagcgaccacuuccccgugggcugcaugaaggugggcaccagcuucagcauccccguggugagcgacgugagagagcuggugcccagcagcgaccccaucguguucguggugggcgccuucgcccacggcaaggugagcguggaguacaccgagaagauggugagcaucagcaacuacccccugagcgccgcccugaccugcgccaagcugaccaccgccuucgaggagguguggggcgugaucuaa

SEQ ID NO: 16592 - RNA, 3051 nt, Artificial Sequence
  EMILIN1__Homo_sapiens__NP_008977
auggcccccagaacccuguggagcugcuaccugugcugccugcugaccgccgccgccggcgccgccagcuacccccccagaggcuucagccuguacaccggcagcagcggcgcccugagccccggcggcccccaggcccagaucgcccccagacccgccagcagacacagaaacuggugcgccuacguggugaccagaaccgugagcugcgugcuggaggacggcguggagaccuacgugaaguaccagcccugcgccuggggccagccccagugcccccagagcaucauguacagaagauuccugagacccagauacagaguggccuacaagaccgugaccgacauggaguggagaugcugccagggcuacggcggcgacgacugcgccgagagccccgcccccgcccugggccccgccagcagcacccccagaccccuggccagacccgccagacccaaccugagcggcagcagcgccggcagcccccugagcggccugggcggcgagggccccggcgagagcgagaaggugcagcagcuggaggagcaggugcagagccugaccaaggagcugcagggccugagaggcgugcugcagggccugagcggcagacuggccgaggacgugcagagagccguggagaccgccuucaacggcagacagcagcccgccgacgccgccgccagacccggcgugcacgagacccugaacgagauccagcaccagcugcagcugcuggacaccagagugagcacccacgaccaggagcugggccaccugaacaaccaccacggcggcagcagcagcagcggcggcagcagagcccccgcccccgccagcgccccccccggccccagcgaggagcugcugagacagcuggagcagagacugcaggagagcugcagcgugugccuggccggccuggacggcuucagaagacagcagcaggaggacagagagagacugagagccauggagaagcugcuggccagcguggaggagagacagagacaccuggccggccuggccgugggcagaagacccccccaggagugcugcagccccgagcugggcagaagacuggccgagcuggagagaagacuggacgugguggccggcagcgugaccgugcugagcggcagaagaggcaccgagcugggcggcgccgccggccagggcggccacccccccggcuacaccagccuggccagcagacugagcagacuggaggacagauucaacagcacccugggccccagcgaggagcaggaggagagcuggcccggcgcccccggcggccugagccacuggcugcccgccgccagaggcagacuggagcagcugggcggccugcuggccaacgugagcggcgagcugggcggcagacuggaccugcuggaggagcagguggccggcgccaugcaggccugcggccagcugugcagcggcgcccccggcgagcaggacagccaggugagcgagauccugagcgcccuggagagaagagugcuggacagcgagggccagcugagacuggugggcagcggccugcacaccguggaggccgccggcgaggccagacaggccacccuggagggccugcaggagguggugggcagacugcaggacagaguggacgcccaggacgagaccgccgccgaguucacccugagacugaaccugaccgccgccagacugggccagcuggagggccugcugcaggcccacggcgacgagggcugcggcgccugcggcggcgugcaggaggagcugggcagacugagagacggcguggagagaugcagcugcccccugcugccccccagaggccccggcgccggccccggcgugggcggccccagcagaggcccccuggacggcuucagcguguucggcggcagcagcggcagcgcccugcaggcccugcagggcgagcugagcgaggugauccugagcuucagcagccugaacgacagccugaacgagcugcagaccaccguggagggccagggcgccgaccuggccgaccugggcgccaccaaggacagaaucaucagcgagaucaacagacugcagcaggaggccaccgagcacgccaccgagagcgaggagagauucagaggccuggaggagggccaggcccaggccggccagugccccagccuggagggcagacugggcagacuggagggcgugugcgagagacuggacaccguggccggcggccugcagggccugagagagggccugagcagacacguggccggccugugggccggccugagagagaccaacaccaccagccagaugcaggccgcccugcuggagaagcuggugggcggccaggccggccugggcagaagacugggcgcccugaacagcagccugcagcugcuggaggacagacugcaccagcugagccugaaggaccugaccggccccgccggcgaggccggcccccccggcccccccggccugcagggcccccccggccccgccggcccccccggcagccccggcaaggacggccaggagggccccaucggcccccccggcccccagggcgagcagggcguggagggcgcccccgccgcccccgugccccagguggccuucagcgccgcccugagccugcccagaagcgagcccggcaccgugcccuucgacagagugcugcugaacgacggcggcuacuacgaccccgagaccggcguguucaccgccccccuggccggcagauaccugcugagcgccgugcugaccggccacagacacgagaagguggaggccgugcugagcagaagcaaccagggcguggccagaguggacagcggcggcuacgagcccgagggccuggagaacaagcccguggccgagagccagcccagccccggcacccugggcguguucagccugauccugccccugcaggccggcgacaccgugugcguggaccuggugaugggccagcuggcccacagcgaggagccccugaccaucuucagcggcgcccugcuguacggcgaccccgagcuggagcacgccuaa

SEQ ID NO: 16593 - RNA, 3162 nt, Artificial Sequence
  EMILIN2__Homo_sapiens__NP_114437
auguggcagcccagaagacccuggcccagagugcccuggagaugggcccuggcccugcuggcccuggugggcgccggccugugccacgccggcccccagcccggcuaccccgccagacccagcgccagaaacaagaacuggugcgccuacaucgugaacaagaacgugagcugcagcgugcuggagggcagcgagagcuucauccaggcccaguacaacugcgccuggaaccagaugcccugccccagcgcccugguguacagagugaacuucagacccagauacgugaccagauacaagaccgugacccagcuggaguggagaugcugccccggcuucagaggcggcgacugccaggagggccccaaggaccccgugaagacccugagacccacccccgccagacccagaaacagccugaagaaggccaccgacaacgagcccagccaguucagcgagcccagaaagacccugagccccaccggcaccgcccagcccagcuggggcguggaccccaaggagggcccccaggagcugcaggagaagaagauccaggugcuggaggagaaggugcugagacugaccagaaccgugcuggaccugcagagcagccuggccggcgugagcgagaaccugaagcacgccacccaggacgacgccagcagaaccagagcccccggccugagcagccagcaccccaagcccgacaccaccgugagcggcgacaccgagaccggccagagccccggcguguucaacaccaaggagagcggcaugaaggacaucaagagcgagcuggccgaggugaaggacacccugaagaacaagagcgacaagcuggaggagcuggacggcaaggugaagggcuacgagggccagcugagacagcugcaggaggccgcccagggccccaccgugaccaugaccaccaacgagcuguaccaggccuacguggacagcaagaucgacgcccugagagaggagcugauggagggcauggacagaaagcuggccgaccugaagaacagcugcgaguacaagcugaccggccugcagcagcagugcgacgacuacggcagcagcuaccugggcgugaucgagcugaucggcgagaaggagaccagccugagaaaggagaucaacaaccugagagccagacugcaggagcccagcgcccaggccaacugcugcgacagcgagaagaacggcgacaucggccagcagaucaagacccuggaccagaagaucgagagaguggccgaggccaccagaaugcugaacggcagacuggacaacgaguucgacagacugaucgugcccgagcccgacguggacuucgacgccaaguggaacgagcuggacgccagaaucaacgugaccgagaagaacgccgaggagcacugcuucuacaucgaggagacccugagaggcgccaucaacggcgaggugggcgaccugaagcagcugguggaccagaagauccagagccuggaggacagacugggcagcgugcugcugcagaugaccaacaacaccggcgccgagcugagcccccccggcgccgccgcccugcccggcgugagcggcagcggcgacgagagagugaugauggagcugaaccaccugaaggacaaggugcaggugguggaggacaucugccugcugaacauccagggcaagccccacggcauggagggcgcccugcccaacagagaggacagagccgugagagacagccugcaccugcugaagagccugaacgacaccaugcacagaaaguuccaggagaccgagcagaccauccagaagcugcagcaggacuucagcuuccuguacagccagcugaaccacaccgagaacgacgugacccaccugcagaaggagaugagcaacugcagagccggcgagaacgccggcaugggcagauucaccaaggugggcgagcaggagagaaccguggacacccugcccagcccccagcaccccguggcccacugcugcagccagcuggaggagagauggcagagacugcagagccaggugaucagcgagcuggacgccugcaaggagugcacccagggcgugcagagagaggugagcaugguggagggcagagugagccacauggagaagaccugcagcaagcuggacagcaucagcggcaaccugcagagaaucaaggagggccugaacaagcacgugagcagccuguggaacugcgugagacagaugaacggcacccugagaagccacagcagagacaucagcggccugaagaacagcgugcagcaguucuacagccacguguuccagaucagcaccgaccugcaggaccuggugaaguuccagcccagcgccaaggcccccagcccccccccccccgccgaggcccccaaggagccccugcagcccgagcccgccccccccagacccagcggccccgccaccgccgaggaccccggcagaagacccgugcugccccagagaccccccgaggagagacccccccagccccccggcagcaccggcgugaucgccgagaccggccaggccggcccccccgccggcgccggcgugagcggcagaggccugcccagaggcguggacggccagaccggcagcggcaccgugcccggcgccgagggcuucgccggcgcccccggcuaccccaagagcccccccguggccagccccggcgcccccgugcccagccuggugagcuucagcgccggccugacccagaagcccuuccccagcgacggcggcguggugcuguucaacaaggugcuggugaacgacggcgacguguacaaccccagcaccggcguguucaccgcccccuacgacggcagauaccugaucaccgccacccugacccccgagagagacgccuacguggaggccgugcugagcgugagcaacgccagcguggcccagcugcacaccgccggcuacagaagagaguuccuggaguaccacagaccccccggcgcccugcacaccugcggcggccccggcgccuuccaccugaucgugcaccugaaggccggcgacgccgugaacgugguggugaccggcggcaagcuggcccacaccgacuucgacgagauguacagcaccuucagcggcguguuccuguaccccuuccugagccaccuguaa

SEQ ID NO: 16594 - RNA, 2301 nt, Artificial Sequence
  EMILIN3__Homo_sapiens__NP_443078
augggcagaagaagacugcugguguggcugugcgccguggccgcccugcugagcggcgcccaggccagaggcaccccccugcuggccagacccgccccccccggcgccagcagauacagccuguacaccaccggcuggagacccagacugagacccggcccccacaaggcccugugcgccuacguggugcacagaaacgugaccugcauccugcaggagggcgccgagagcuacgugaaggccgaguacagacagugcagauggggccccaagugccccggcaccgugaccuacagaaccgugcugagacccaaguacaaggugggcuacaagaccgugaccgaccuggccuggagaugcugccccggcuucaccggcaagagaugccccgagcaccugaccgaccacggcgccgccagcccccagcuggagcccgagccccagauccccagcggccagcuggaccccggccccagaccccccagcuacagcagagccgcccccagcccccacggcagaaagggccccggccuguucggcgagagacuggagagacuggagggcgacgugcagagacuggcccagaccuacggcacccugagcggccugguggccagccacgaggaccccaacagaaugaccggcggccccagagcccccgccgugcccgugggcuucggcgugauccccgagggccuggugggccccggcgacagagccagaggcccccugacccccccccuggacgagauccugagcaaggugaccgaggugagcaacacccugcagaccaaggugcagcugcuggacaaggugcacggccuggcccugggccacgaggcccaccugcagagacugagagaggccccccccagcccccugaccagccuggcccugcuggaggaguacguggacagaagacugcacagacuguggggcagccugcuggacggcuucgagcagaagcugcagggcgugcagagcgagugcgaccugagagugcaggaggugagaagacagugcgaggagggccaggccgccagcagaagacugcaccagagccuggacggcagagagcuggcccugagacaggagcugagccagcugggcagccagcugcagggccugagcgugagcggcagaggcagcugcugcggccagcuggcccugaucaacgccagaauggacggccuggagagagcccugcaggccgugaccgagacccagagaggccccggcgcccccgccggcgacgagcugaccagacugagcgccgccaugcuggagggcggcguggacggccugcuggagggccuggagacccugaacggcaccgagggcggcgccagaggcugcugccugagacuggacaugggcggcuggggcgugggcggcuucggcaccaugcuggaggagagagugcagagccuggaggagagacuggccacccuggccggcgagcugagccacgacagcgccagccccggcagaagcgccagaccccuggugcagaccgagcuggccgugcuggagcagagacuggugagccuggagaccagcugcacccccagcaccaccagcgccauccuggacagccugguggccgaggugaaggccuggcagagcagaagcgaggcccugcugagacagguggccagccacgccgcccugcugcagcagcugaacggcaccguggccgaggugcagggccagcuggccgagggcaccggcagcagccugcagggcgagaucacccugcugaaggugaaccugaacagcgugagcaagagccugaccggccugagcgacagcgugagccaguacagcgacgccuuccuggccgccaacaccagccuggacgagagagagagaaagguggaggccgaggugcaggccauccaggagcaggugagcagccagggcagcagacugcaggccggccacagacaggugcugaaccugagaggcgagcuggagcagcugaaggccggcguggccaagguggccagcggccugagcagaugccaggacaccgcccagaagcugcagcacaccgugggccacuucgaccagagaguggcccagguggagggcgccugcagaagacugggccugcuggccgccggccuggacagccugcccaccgagccccugagacccagagagggccuguggagccacguggaccagcugaacagaacccuggcccagcacacccaggacaucgccagacugagagacgaccugcuggacugccaggcccagcuggccgagcaggugagacccggccaggccaacuaa

SEQ ID NO: 16595 - RNA, 2505 nt, Artificial Sequence
  EML1__Homo_sapiens__NP_001008707
auggaggacggcuucagcagcuacagcagccuguacgacaccagcagccugcugcaguucugcaacgacgacagcgccagcgccgccagcagcauggaggugaccgacagaaucgccagccuggagcagagagugcagaugcaggaggacgacauccagcugcugaagagcgcccuggccgacguggugagaagacugaacaucaccgaggagcagcaggccgugcugaacagaaagggccccaccaaggccagaccccugaugcagacccugccccugagaaccaccgugaacaacggcaccgugcugcccaagaagcccaccggcagccugcccagccccagcggcgugagaaaggagaccgccgugcccgccaccaagagacugaacagaagcgugagccugcugaacgccugcaagcugaacagaagcacccccagcaacaucaagagaaccagcagcagcgagagagugagccccggcggcagaagagagagcaacggcgacagcagaggcaacagaaacagaaccggcagcaccagcagcagcagcagcggcaagaagaacagcgagagcaagcccaaggagcccguguucagcgccgaggagggcuacgugaagauguuccugagaggcagacccgugaccauguacaugcccaaggaccagguggacagcuacagccuggaggccaagguggagcugcccaccaagagacugaagcuggaguggguguacggcuacagaggcagagacugcagaaacaaccuguaccugcugcccaccggcgagaccguguacuucaucgccagcgugguggugcuguacaacguggaggagcagcugcagagacacuacgccggccacaacgacgacgugaagugccuggccgugcaccccgacagaaucaccaucgccaccggccagguggccggcaccagcaaggacggcaagcagcugcccccccacgugagaaucugggacagcgugacccugaacacccugcacgugaucggcaucggcuucuucgacagagccgugaccugcaucgccuucagcaagagcaacggcggcaccaaccugugcgccguggacgacagcaacgaccacgugcugagcgugugggacuggcagaaggaggagaagcuggccgacgugaagugcagcaacgaggccguguucgccgccgacuuccaccccaccgacaccaacaucaucgugaccugcggcaagagccaccuguacuucuggacccuggagggcagcagccugaacaagaagcagggccuguucgagaagcaggagaagcccaaguucgugcugugcgugaccuucagcgagaacggcgacaccaucaccggcgacagcagcggcaacauccugguguggggcaagggcaccaacagaaucagcuacgccgugcagggcgcccacgagggcggcaucuucgcccugugcaugcugagagacggcacccuggugagcggcggcggcaaggacagaaagcugaucagcuggagcggcaacuaccagaagcugagaaagaccgagauccccgagcaguucggccccaucagaaccguggccgagggcaagggcgacgugauccugaucggcaccaccagaaacuucgugcugcagggcacccugagcggcgacuucacccccaucacccagggccacaccgacgagcuguggggccuggccauccacgccagcaagagccaguuccugaccugcggccacgacaagcacgccacccugugggacgccgugggccacagacccgugugggacaagaucaucgaggaccccgcccagagcagcggcuuccaccccagcggcagcgugguggccgugggcacccugaccggcagaugguucguguucgacaccgagaccaaggaccuggugaccgugcacaccgacggcaacgagcagcugagcgugaugagauacagccccgacggcaacuuccuggccaucggcagccacgacaacugcaucuacaucuacggcgugagcgacaacggcagaaaguacaccagagugggcaagugcagcggccacagcagcuucaucacccaccuggacuggagcgugaacagccaguuccuggugagcaacagcggcgacuacgagauccuguacugggugcccagcgccugcaagcagguggugagcguggagaccaccagagacaucgagugggccaccuacaccugcacccugggcuuccacguguucggcguguggcccgagggcagcgacggcaccgacaucaacgccgugugcagagcccacgagaagaagcugcugagcaccggcgacgacuucggcaaggugcaccuguucagcuaccccugcagccaguucagagcccccagccacaucuacggcggccacagcagccacgugaccaacguggacuuccugugcgaggacagccaccugaucagcaccggcggcaaggacaccagcaucaugcaguggagagugaucuaa

SEQ ID NO: 16596 - RNA, 2553 nt, Artificial Sequence
  EML2__Homo_sapiens__NP_001180197
augcuggagagaagagcccugcuguggcagagagaggccggccccggcuggggcgacagagccagagccggcaccggcggcgccggcggcggcugcggcggcgccauggccgagagaggccccgccuucugcggccuguacgacaccagcagccugcugagauacugcaacgacgacaaccugagcggcaccagcggcauggagguggacgacagagugagcgcccuggagcagagacugcagcugcaggaggacgagcuggccgugcugaaggccgcccuggccgacgcccugagaagacugagagccugcgaggagcagggcgccgcccugagagccagaggcacccccaagggcagagccccccccagacugggcaccaccgccagcgugugccagcugcugaagggccugcccaccagaaccccccugaacggcagcggcccccccagaagagugggcggcuacgccaccagccccagcagccccaagaaggaggccaccagcggcagaagcagcgugagaagauaccugagccccgagagacuggccagcgugagaagagaggaccccagaagcagaaccaccagcagcagcagcaacugcagcgccaagaaggagggcaagaccaaggaggugaucuucagcguggaggacggcagcgugaagauguuccugagaggcagacccgugcccaugaugauccccgacgagcuggcccccaccuacagccuggacaccagaagcgagcugcccagcugcagacugaagcuggaguggguguacggcuacagaggcagagacugcagagccaaccuguaccugcugcccaccggcgagaucguguacuucguggccagcguggccgugcuguacagcguggaggagcagagacagagacacuaccugggccacaacgacgacaucaagugccuggccauccaccccgacauggugaccaucgccaccggccagguggccggcaccaccaaggagggcaagccccugcccccccacgugagaaucugggacagcgugagccugagcacccugcacgugcugggccugggcguguucgacagagccgugugcugcgugggcuucagcaagagcaacggcggcaaccugcugugcgccguggacgagagcaacgaccacaugcugagcgugugggacugggccaaggagaccaaggugguggacgugaagugcagcaacgaggccgugcugguggccaccuuccaccccaccgaccccaccgugcugaucaccugcggcaagagccacaucuacuucuggacccuggagggcggcagccugagcaagagacagggccuguucgagaagcacgagaagcccaaguacgugcugugcgugaccuuccuggagggcggcgacguggugaccggcgacagcggcggcaaccuguacguguggggcaagggcggcaacagaaucacccaggccgugcugggcgcccacgacggcggcguguucggccugugcgcccugagagacggcacccuggugagcggcggcggcagagacagaagaguggugcuguggggcagcgacuacagcaagcugcaggagguggaggugcccgaggacuucggccccgugagaaccguggccgagggccacggcgacacccuguacgugggcaccaccagaaacagcauccugcagggcagcgugcacaccggcuucagccugcuggugcagggccacguggaggagcuguggggccuggccacccaccccagcagagcccaguucgugaccugcggccaggacaagcuggugcaccuguggagcagcgacagccaccagccccuguggagcagaaucaucgaggaccccgccagaagcgccggcuuccaccccagcggcagcgugcuggccgugggcaccgugaccggcagauggcugcugcuggacaccgagacccacgaccugguggccauccacaccgacggcaacgagcagaucagcguggugagcuucagccccgacggcgccuaccuggccgugggcagccacgacaaccugguguacguguacaccguggaccagggcggcagaaaggugagcagacugggcaagugcagcggccacagcagcuucaucacccaccuggacugggcccaggacagcagcugcuucgugaccaacagcggcgacuacgagauccuguacugggaccccgccaccugcaagcagaucaccagcgccgacgccgugagaaacauggagugggccaccgccaccugcgugcugggcuucggcguguucggcaucuggagcgagggcgccgacggcaccgacaucaacgccguggccagaagccacgacggcaagcugcuggccagcgccgacgacuucggcaaggugcaccuguucagcuaccccugcugccagcccagagcccugagccacaaguacggcggccacagcagccacgugaccaacguggccuuccugugggacgacagcauggcccugaccaccggcggcaaggacaccagcgugcugcaguggagagugguguaa

SEQ ID NO: 16597 - RNA, 2772 nt, Artificial Sequence
  EML4__Homo_sapiens__NP_001138548
auggacggcuucgccggcagccuggacgacagcaucagcgccgccagcaccagcgacgugcaggacagacugagcgcccuggagagcagagugcagcagcaggaggacgagaucaccgugcugaaggccgcccuggccgacgugcugagaagacuggccaucagcgaggaccacguggccagcgugaagaagagcgugagcagcaagggccagcccagccccagagccgugauccccaugagcugcaucaccaacggcagcggcgccaacagaaagcccagccacaccagcgccgugagcaucgccggcaaggagacccugagcagcgccgccaagagcaucaagagacccagccccgccgagaagagccacaacagcugggagaacagcgacgacagcagaaacaagcugagcaagauccccagcacccccaagcugauccccaaggugaccaagaccgccgacaagcacaaggacgugaucaucaaccaggagggcgaguacaucaagauguucaugagaggcagacccaucaccauguucauccccagcgacguggacaacuacgacgacaucagaaccgagcugccccccgagaagcugaagcuggagugggccuacggcuacagaggcaaggacugcagagccaacguguaccugcugcccaccggcgagaucguguacuucaucgccagcgugguggugcuguucaacuacgaggagagaacccagagacacuaccugggccacaccgacugcgugaagugccuggccauccaccccgacaagaucagaaucgccaccggccagaucgccggcguggacaaggacggcagaccccugcagccccacgugagagugugggacagcgugacccugagcacccugcagaucaucggccugggcaccuucgagagaggcgugggcugccuggacuucagcaaggccgacagcggcgugcaccugugcgugaucgacgacagcaacgagcacaugcugaccgugugggacuggcagaagaaggccaagggcgccgagaucaagaccaccaacgagguggugcuggccguggaguuccaccccaccgacgccaacaccaucaucaccugcggcaagagccacaucuucuucuggaccuggagcggcaacagccugaccagaaagcagggcaucuucggcaaguacgagaagcccaaguucgugcagugccuggccuuccugggcaacggcgacgugcugaccggcgacagcggcggcgugaugcugaucuggagcaagaccaccguggagcccacccccggcaagggccccaagggcguguaccagaucagcaagcagaucaaggcccacgacggcagcguguucacccugugccagaugagaaacggcaugcugcugaccggcggcggcaaggacagaaagaucauccugugggaccacgaccugaaccccgagagagagaucgaggugcccgaccaguacggcaccaucagagccguggccgagggcaaggccgaccaguuccuggugggcaccagcagaaacuucauccugagaggcaccuucaacgacggcuuccagaucgaggugcagggccacaccgacgagcuguggggccuggccacccaccccuucaaggaccugcugcugaccugcgcccaggacagacaggugugccuguggaacagcauggagcacagacuggaguggaccagacugguggacgagcccggccacugcgccgacuuccaccccagcggcaccgugguggccaucggcacccacagcggcagaugguucgugcuggacgccgagaccagagaccuggugagcauccacaccgacggcaacgagcagcugagcgugaugagauacagcaucgacggcaccuuccuggccgugggcagccacgacaacuucaucuaccuguacguggugagcgagaacggcagaaaguacagcagauacggcagaugcaccggccacagcagcuacaucacccaccuggacuggagccccgacaacaaguacaucaugagcaacagcggcgacuacgagauccuguacugggacauccccaacggcugcaagcugaucagaaacagaagcgacugcaaggacaucgacuggaccaccuacaccugcgugcugggcuuccagguguucggcguguggcccgagggcagcgacggcaccgacaucaacgcccuggugagaagccacaacagaaaggugaucgccguggccgacgacuucugcaaggugcaccuguuccaguaccccugcagcaaggccaaggcccccagccacaaguacagcgcccacagcagccacgugaccaacgugagcuucacccacaacgacagccaccugaucagcaccggcggcaaggacaugagcaucauccaguggaagcugguggagaagcugagccugccccagaacgagaccguggccgacaccacccugaccaaggcccccgugagcagcaccgagagcgugauccagagcaacacccccacccccccccccagccagccccugaacgagaccgccgaggaggagagcagaaucagcagcagccccacccugcuggagaacagccuggagcagaccguggagcccagcgaggaccacagcgaggaggagagcgaggagggcagcggcgaccugggcgagccccuguacgaggagcccugcaacgagaucagcaaggagcaggccaaggccacccugcuggaggaccagcaggaccccagccccagcagcuaa

SEQ ID NO: 16598 - RNA, 5934 nt, Artificial Sequence
  EML5__Homo_sapiens__NP_899243
auggccgccagaagcgcccccagcugccaccugagacuggaguggguguacggcuacagaggccaccagugcagaaacaaccuguacuacaccgccgccaaggagaucguguacuucguggccggcgugggcgugguguacagccccagagagcacagacagaaguucuacagaggccacagcgacgacaucaucagccuggcccugcaccccgagagagugcugguggccaccggccaggugggcaaggagcccuacaucugcaucugggacagcuacaccgugcagaccaucagcgugcugaaggacgugcacacccacggcaucgccugccuggccuucgaccuggacggccagagacuggugagcgugggccuggacagcaagaacgccgugugcgugugggacuggaagagaggcaagaugcugagcauggcccccggccacaccgacagaaucuucgacaucagcugggaccuguaccagcccaacaagcuggugagcugcggcgugaagcacaucaaguucuggagccugugcggcaacgcccugacccccaagagaggcguguucggcaagaccggcgaccugcagaccauccugugccuggccugcgccagagacgagcugaccuacagcggcgcccugaacggcgacaucuacguguggaagggcaucaaccugaucagaaccauccagggcgcccacgccgccggcaucuucagcaugaacgccugcgaggagggcuucgccaccggcggcagagacggcugcaucagacugugggaccugaccuucaagcccaucaccgugaucgaccugagagagaccgaccagggcuacaagggccugagcgugagaagcgugugcuggagaggcgaccacauccuggugggcacccaggacagcgagaucuucgagaucguggugcaggagagaaacaagcccuuccugaucaugcagggccacugcgagggcgagcugugggcccuggccgugcaccccaccaagccccuggccgugaccggcagcgacgacagaagcgugagaaucuggagccugguggaccacgcccugaucgccagaugcaacauggaggagcccaucagaugcgccgccgugaacgccgacggcauccaccuggcccugggcaugaaggacggcagcuucaccgugcugagagugagagacaugaccgagguggugcacaucaaggacagaaaggaggccauccacgagcugaaguacagccccgacggcaccuaccuggccgugggcugcaacgacagcagcguggacaucuacggcguggcccagagauacaagaaggugggcgagugccugggcagccugagcuucaucacccaccuggacuggagcagcgacagcagauaccugcagaccaacgacggcaacggcaagagacuguucuacagaaugcccggcggcaaggaggugaccagcaccgaggagaucaagggcgugcacugggccagcuggaccugcgugagcggccuggaggugaacggcaucuggcccaaguacagcgacaucaacgacaucaacagcguggacggcaacuacaucggccaggugcuggugaccgccgacgacuacggcaucaucaagcuguucagauaccccugccugagaaagggcgccaaguucagaaaguacaucggccacagcgcccacgugaccaacgugagauggagccacgacuaccagugggugaucagcaucggcggcgccgaccacagcguguuccaguggaaguucauccccgagagaaagcugaaggacgccgugcacaucgccccccaggagagccuggccgacagccacagcgacgagagcgacagcgaccugagcgacgugcccgagcuggacagcgagaucgagcaggagacccagcugaccuacagaagacagguguacaaggaggaccugccccagcugaaggagcagugcaaggagaagcagaagagcgccaccagcaagagaagagagagagcccccggcaacagcaucagacugcacuucgugcacggcuacagaggcuacgacugcagaagcaaccuguucuacacccagaucggcgagaucguguaccacguggccgccgugggcgugaucuacaacagacagcagaacacccagagauucuaccugggccacgacgacgacauccugugccugaccauccacccccugaaggacuacguggccaccggccaggugggcagagaccccagcauccacaucugggacaccgagaccaucaagccccugagcauccugaagggccaccaccaguacggcgugagcgccguggacuucagcgccgacggcaagagacuggccagcgugggcaucgacgacagccacaccguggugcugugggacuggaagaagggcgagaagcugagcaucgccagaggcagcaaggacaagaucuucguggugaagaugaaccccuacgugcccgacaagcugaucaccgccggcaucaagcacaugaaguucuggagaaaggccggcggcggccugaucggcagaaagggcuacaucggcacccugggcaagaacgacaccaugaugugcgccguguacggcuggaccgaggagauggccuucagcggcaccagcaccggcgacgugugcaucuggagagacaucuuccuggugaagaccgugaaggcccacgacggccccguguucagcaugcacgcccuggagaagggcuucgugaccggcggcaaggacggcaucguggcccugugggacgacagcuucgagagaugccugaagaccuacgccaucaagagagccgcccuggcccccggcagcaagggccugcugcuggaggacaaccccagcaucagagccaucagccugggccacggccacauccuggugggcaccaagaacggcgagauccuggagguggacaagagcggccccaucacccugcuggugcagggccacauggagggcgagguguggggccuggccacccaccccuaccugcccaucugcgccaccgugagcgacgacaagacccugagaaucugggaccugagccccagccacugcaugcuggccgugagaaagcugaagaagggcggcagaugcugcugcuucagccccgacggcaaggcccuggccgugggccugaacgacggcagcuuccugauggccaacgccgacacccuggaggaccuggugagcuuccaccacagaaaggacaugaucagcgacaucagauucagccccggcagcggcaaguaccuggccguggccagccacgacagcuucaucgacaucuacaacgugaugagcagcaagagagugggcaucugcaagggcgccaccagcuacaucacccacaucgacugggacaucagaggcaagcugcugcaggugaacaccggcgccaaggagcagcuguucuucgaggcccccagaggcaagaagcagaccauccccagcguggagguggagaagaucgccugggccagcuggaccagcgugcugggccugugcugcgagggcaucuggcccgugaucggcgaggugaccgacgugaccgccagcugccugaccagcgacaagauggugcuggccaccggcgacgaccugggcuucgugaagcuguucagauaccccaccaagggcaaguucggcaaguucaagagauacguggcccacagcacccacgugaccaacgugagauggaccuacgacgacagcaugcuggugacccugggcggcaccgacaugagccugaugguguggaccaacgagauggagggcuacagagagaagagacccugcgacagcgaggagagcgacaucgacagcgaggaggacggcggcuacgacagcgacgugaccagagagaacgagaucagcuacaccaucagagcccugagcaccaacaucagacccaugcugggcaucaagccccaccugcagcagaaggagcccagcaucgacgagagacagggcguggugagaggcagcagaccccccgugagcagagcccccccccagcccgagaagcugcagaccaacaacgugggcaagaagaagagacccaucgaggaccuggugcuggagcugaucuucggcuacagaggcagagacugcagaaacaacgugcacuaccugaacgacggcgacgacaucaucuaccacaccgccagcgugggcauccugcacaacguggccaccggcagccagagcuucuaccaggagcacaacgacgacauccugugccugaccgugaaccagcaccccaaguucaucaacaucguggccaccggccaggugggcgacagcgccgacaugagcgccaccgcccccagcauccacaucugggacgccaugaacaagcagacccugagcauccugagaugcuaccacagcaagggcgugugcagcgugagcuucagcgccaccggcaagcugcugcugagcgugggccuggaccccgagcacaccaucaccaucuggagauggcaggagggcgccaagaucgccagcagagccggccacaaccagagaaucuucguggccgaguucagacccgacagcgacacccaguucgugagcgugggcgugaagcacgugaaguucuggacccuggccggcagagcccugcugagcaagaagggccugcugagcacccuggaggacgccagaaugcagaccaugcuggccaucgccuucggcgccaacaaccugaccuucaccggcaccaucagcggcgacgugugcguguggaaggaccacauccugugcagaaucguggccagagcccacaacggccccguguucgccauguacaccacccugagagacggccugaucgugaccggcggcaaggagagacccagcaaggagggcggcgccgugaagcugugggaccaggagcugagaagaugcagagccuucagacuggagaccggccaggccaccgacugcgugagaagcgugugcagaggcaagggcaagauccuggugggcaccagaaacgccgagaucaucgaggugggcgagaagaacgccgccugcaacauccuggugaacggccacguggacggccccaucuggggccuggccacccaccccagcagagacuucuuccugagcgccgccgaggacggcaccgugagacugugggacaucgccgacaagaagaugcugaacaaggugaaccugggccacgccgccagaaccgugugcuacagccccgagggcgacaugguggccaucggcaugaagaacggcgaguucaucauccugcuggugagcagccugaagaucuggggcaagaagagagacagaagaugcgccauccacgacaucagauucagccccgacagcagauaccuggccgugggcagcagcgagaacagcguggacuucuacgaccugacccugggccccacccugaacagaaucagcuacugcaaggacauccccagcuucgugauccagauggacuucagcgccgacagcagcuaccugcaggugagcagcggcugcuacaagagacacguguacgaggugcccagcggcaagcaccugauggaccacgccgccaucgacagaaucaccugggccaccuggaccagcauccugggcgacgaggugcugggcaucuggagcagacacgccgagaaggccgacgugaacugcgccugcgugagccacagcggcaucagccuggugaccggcgacgacuucggcauggugaagcuguucgacuuccccugccccgagaaguucgccaagcacaagagauuccugggccacagcccccacgugaccaacaucagauucaccagcggcgacagacacguggugagcgccggcggcgacgacugcagccuguucguguggaagugcgugcacaccccccacuaa

SEQ ID NO: 16599 - RNA, 5877 nt, Artificial Sequence
  EML6__Homo_sapiens__NP_001034842
auggccgacagaaccgcccccagaugccagcugagacuggaguggguguacggcuacagaggccaccagugcagaaacaaccuguacuacaccgccggcaaggaggugguguacuucguggccggcgugggcgugguguacaacaccagagagcacagccagaaguucuuccugggccacaacgacgacaucaucagccuggcccugcaccccgacaagacccugguggccaccggccaggugggcaaggagcccuacaucugcaucugggacagcuacaacgugcagaccgugagccugcugaaggacgugcacacccacggcguggccugccuggccuucgacagcgacggccagagacuggccagcgugggccuggacgccaagaacaccgugugcaucugggacuggagaaagggcaagcugcuggccagcgccaccggccacagcgacagaaucuucgacaucagcugggaccccuaccagcccaacagaguggugagcugcggcgugaagcacaucaaguucuggacccugugcggcaacgcccugaccgccaagagaggcaucuucggcaagaccggcgaccugcagaccauccugugccuggccugcgccaaggaggacaucaccuacagcggcgcccugaacggcgacaucuacguguggaagggccugaaccuggugagaaccauccagggcgcccacagcgccggcaucuucagcauguacgccugcgaggagggcuucgccaccggcggcagagacggcugcaucagacugugggacaccgacuucaagcccaucaccaagaucgaccugagagagaccgagcagggcuacaagggccugagcaucagaagcgugugcuggaaggccgacagacugcuggccggcacccaggacagcgagaucuucgaggugaucgugagagagagagacaagcccaugcugauccugcagggccacugcgagggcgagcugugggcccuggcccugcaccccaagaagccccuggccgugaccggcagcgacgacagaagcgugagacuguggagccuggccgaccacgcccugaucgccagaugcaacauggaggaggccgugagaagcguggccuucagccccgacggcagccagcuggcccugggcaugaaggacggcagcuucaucgugcugagagugagagacaugaccgagguggugcacaucaaggacagaaaggaggugauccacgagaugaaguucagccccgacggcagcuaccuggccgugggcagcaacgacggccccguggacguguacgccguggcccagagauacaagaagaucggcgagugcagcaagagccugagcuucaucacccacaucgacuggagccuggacagcaaguaccugcagaccaacgacggcgccggcgagagacuguucuacagaaugcccagcggcaagccccugaccagcaaggaggagaucaagggcauccccugggccagcuggaccugcgugaagggccccgaggugagcggcaucuggcccaaguacaccgaggugaccgacaucaacagcguggacgccaacuacaacagcagcgugcuggugagcggcgacgacuucggccuggugaagcuguucaaguuccccugccugaagagaggcgccaaguucagaaaguacgugggccacagcgcccacgugaccaacgugagauggagccacgacuuccagugggugcugagcaccggcggcgccgaccacagcguguuccaguggagauucauccccgagggcgugagcaacggcaugcuggagaccgccccccaggagggcggcgccgacagcuacagcgaggagagcgacagcgaccugagcgacgugcccgagcuggacagcgacaucgagcaggaggcccagaucaacuacgacagacagguguacaaggaggaccugccccagcugaagcagcagagcaaggagaagaaccacgccgugcccuuccugaagagagagaaggcccccgaggacagccugaagcugcaguucauccacggcuacagaggcuacgacugcagaaacaaccuguucuacacccaggccggcgaggugguguaccacaucgccgccguggccgugguguacaacagacagcagcacagccagagacuguaccugggccacgacgacgacauccugagccugaccauccaccccgugaaggacuacguggccaccggccaggugggcagagacgccgccauccacgugugggacacccagacccugaagugccugagccugcugaagggccagcaccagagaggcgugugcgcccuggacuucagcgccgacggcaagugccuggugagcgugggccuggacgacuuccacagcaucguguucugggacuggaagaagggcgagaagaucgccaccaccagaggccacaaggacaagaucuucguggugaagugcaacccccaccacguggacaagcuggugaccgugggcaucaagcacaucaaguucuggcagcaggccggcggcggcuucaccagcaagagaggcaccuucggcagcgugggcaagcuggagaccaugaugugcgugagcuacggcagaauggaggaccugguguucagcggcgccgccaccggcgacaucuucaucuggaaggacauccugcugcugaagaccgugaaggcccacgacggccccguguucgccauguacgcccuggacaagggcuucgugaccggcggcaaggacggcaucguggagcugugggacgacauguucgagagaugccugaagaccuacgccaucaagagaagcgcccugagcaccagcagcaagggccugcugcuggaggacaaccccagcaucagagccaucacccugggccacggccacauccuggugggcaccaagaacggcgagauccuggagaucgacaagagcggccccaugacccugcuggugcagggccacauggagggcgagguguggggccuggccgcccacccccugcugcccaucugcgccaccgugagcgacgacaagacccugagaaucugggagcugagcgcccagcacagaaugcuggccgugagaaagcugaagaagggcggcagaugcugcgccuucagccccgacggcaaggcccuggccgugggccugaacgacggcagcuuccugguggugaacgccgacaccguggaggacauggugagcuuccaccacagaaaggagaugaucagcgacaucaaguucagcaaggacaccggcaaguaccuggccguggccagccacgacaacuucguggacaucuacaacgugcugaccagcaagagagugggcaucugcaagggcgccagcagcuacaucacccacaucgacugggacagcagaggcaagcugcugcaggugaacagcggcgccagagagcagcuguucuucgaggcccccagaggcaagagacacaucaucagacccagcgagaucgagaagaucgagugggacaccuggaccugcgugcugggccccaccugcgagggcaucuggcccgcccacagcgacaucaccgacgugaacgccgccagccugaccaaggacugcagccugcuggccaccggcgacgacuucggcuucgugaagcuguucagcuaccccgugaagggccagcacgccagauucaagaaguacgugggccacagcgcccacgugaccaacgugagauggcugcacaacgacagcgugcugcugaccgugggcggcgccgacaccgcccugaugaucuggaccagagaguucgugggcacccaggagagcaagcugguggacagcgaggagagcgacaccgacguggaggaggacggcggcuacgacagcgacguggccagagagaaggccaucgacuacaccaccaagaucuacgccgugagcaucagagagauggagggcaccaagccccaccagcagcugaaggaggugagcguggaggagagaccccccgugagcagagccgccccccagcccgagaagcugcagaagaacaacaucaccaagaagaagaagcugguggaggagcuggcccuggaccacguguucggcuacagaggcuucgacugcagaaacaaccugcacuaccugaacgacggcgccgacaucaucuuccacaccgccgccgccggcaucgugcagaaccugagcaccggcagccagagcuucuaccuggagcacaccgacgacauccugugccugaccgugaaccagcaccccaaguacagaaacgugguggccaccagccagaucggcaccacccccagcauccacaucugggacgccaugaccaagcacacccugagcaugcugagaugcuuccacagcaagggcgugaacuacaucaacuucagcgccaccggcaagcugcuggugagcgugggcguggaccccgagcacaccaucaccguguggagauggcaggagggcgccaagguggccagcagaggcggccaccuggagagaaucuucgugguggaguucagacccgacagcgacacccaguucgugagcgugggcgugaagcacaugaaguucuggacccuggccggcagcgcccugcuguacaagaagggcgugaucggcagccugggcgccgccaagaugcagaccaugcugagcguggccuucggcgccaacaaccugaccuucaccggcgccaucaacggcgacguguacguguggaaggaccacuuccugaucagacugguggccaaggcccacaccggccccguguucaccauguacaccacccugagagacggccugaucgugaccggcggcaaggagagacccaccaaggagggcggcgccgugaagcugugggaccaggagaugaagagaugcagagccuuccagcuggagaccggccagcugguggagugcgugagaagcgugugcagaggcaagggcaagauccuggugggcaccaaggacggcgagaucaucgaggugggcgagaagaacgccgccagcaacauccugaucgacggccacauggagggcgagaucuggggccuggccacccaccccagcaaggaccuguucaucagcgccagcaacgacggcaccgccagaaucugggaccuggccgacaagaagcugcugaacaaggugagccugggccacgccgccagaugcgccgccuacagccccgacggcgagaugguggccaucggcaugaagaacggcgaguucgugauccugcuggugaacagccugaagguguggggcaagaagagagacagaaagagcgccauccaggacaucagaaucagccccgacaacagauuccuggccgugggcagcagcgagcacaccguggacuucuacgaccugacccagggcaccaaccugaacagaaucggcuacugcaaggacauccccagcuucgugauccagauggacuucagcgccgacggcaaguacauccaggugagcaccggcgccuacaagagacaggugcacgaggugccccugggcaagcaggugaccgaggccguggugaucgagaagaucaccugggccagcuggaccagcgugcugggcgacgaggugaucggcaucuggcccagaaacgccgacaaggccgacgugaacugcgccugcgugacccacgccggccugaacaucgugaccggcgacgacuucggccuggugaagcuguucgacuuccccugcaccgagaaguucgccaagcacaagagauacuucggccacagcgcccacgugaccaacaucagauucagcuacgacgacaaguacguggugagcaccggcggcgacgacugcagcguguucguguggagaugccuguaa

SEQ ID NO: 16600 - RNA, 474 nt, Artificial Sequence
  EMP1__Homo_sapiens__NP_001414
augcuggugcugcuggccggcaucuucguggugcacaucgccaccgugaucaugcuguucgugagcaccaucgccaacguguggcuggugagcaacaccguggacgccagcgugggccuguggaagaacugcaccaacaucagcugcagcgacagccugagcuacgccagcgaggacgcccugaagaccgugcaggccuucaugauccugagcaucaucuucugcgugaucgcccugcugguguucguguuccagcuguucaccauggagaagggcaacagauucuuccugagcggcgccaccacccuggugugcuggcugugcauccuggugggcgugagcaucuacaccagccacuacgccaacagagacggcacccaguaccaccacggcuacagcuacauccugggcuggaucugcuucugcuucagcuucaucaucggcgugcuguaccuggugcugagaaagaaguaa

SEQ ID NO: 16601 - RNA, 504 nt, Artificial Sequence
  EMP2__Homo_sapiens__XP_006720927
augcuggugcugcuggccuucaucaucgccuuccacaucaccagcgccgcccugcuguucaucgccaccguggacaacgccuggugggugggcgacgaguucuucgccgacguguggagaaucugcaccaacaacaccaacugcaccgugaucaacgacagcuuccaggaguacagcacccugcaggccgugcaggccaccaugauccugagcaccauccugugcugcaucgccuucuucaucuucgugcugcagcuguucagacugaagcagggcgagagauucgugcugaccagcaucauccagcugaugagcugccugugcgugaugaucgccgccagcaucuacaccgacagaagagaggacauccacgacaagaacgccaaguucuaccccgugaccagagagggcagcuacggcuacagcuacauccuggccuggguggccuucgccugcaccuucaucagcggcaugauguaccugauccugagaaagagaaaguaa

SEQ ID NO: 16602 - RNA, 873 nt, Artificial Sequence
  EMX1__Homo_sapiens__NP_004088
augugccuggccggcugcacccccagaaaggccgccgcccccggcagaggcgcccugcccagagccagacugcccagaaccgcccccgccgccgccaccauguuccagcccgccgccaagagaggcuucaccaucgagagccugguggccaaggacggcggcaccggcggcggcaccggcggcggcggcgccggcagccaccugcuggccgccgccgccagcgaggagccccugagacccaccgcccugaacuacccccaccccagcgccgccgaggccgccuucgugagcggcuuccccgccgccgccgccgccggcgccggcagaagccuguacggcggccccgagcugguguuccccgaggccaugaaccaccccgcccugaccgugcaccccgcccaccagcugggcgccagcccccugcagcccccccacagcuucuucggcgcccagcacagagacccccugcacuucuaccccugggugcugagaaacagauucuucggccacagauuccaggccagcgacgugccccaggacggccugcugcugcacggccccuucgccagaaagcccaagagaaucagaaccgccuucagccccagccagcugcugagacuggagagagccuucgagaagaaccacuacguggugggcgccgagagaaagcagcuggccggcagccugagccugagcgagacccaggugaaggugugguuccagaacagaagaaccaaguacaagagacagaagcuggaggaggagggccccgagagcgagcagaagaagaagggcagccaccacaucaacagauggagaaucgccaccaagcaggccaacggcgaggacaucgacgugaccagcaacgacuaa

SEQ ID NO: 16603 - RNA, 510 nt, Artificial Sequence
  EMX2__Homo_sapiens__NP_001159396
auguuccagcccgcccccaagagaugcuucaccaucgagagccugguggccaaggacagcccccugcccgccagcagaagcgaggaccccaucagacccgccgcccugagcuacgccaacagcagccccaucaaccccuuccugaacggcuuccacagcgccgccgccgccgccgccggcagaggcguguacagcaaccccgaccugguguucgccgaggccgugagccacccccccaaccccgccgugcccgugcaccccgugccccccccccacgcccuggccgcccacccccugcccagcagccacagcccccacccccuguucgccagccagcagagagaccccagcaccuucuaccccuggcugauccacagauacagauaccugggccacagauuccagggcaagagcauggugagcgagcccaagaacaaggugcagaaggccgaggccggcggcagaagacugagauucgccaccaaggagaagagagacgcccccuacuaa

SEQ ID NO: 16604 - RNA, 1179 nt, Artificial Sequence
  EN1__Homo_sapiens__NP_001417
auggaggagcagcagcccgagcccaagagccagagagacagcgcccugggcgccgccgccgccgccacccccggcggccugagccugagccugagccccggcgccagcggcagcagcggcagcggcagcgacggcgacagcgugcccgugagcccccagcccgccccccccagcccccccgccgcccccugccugcccccccuggcccaccacccccaccugcccccccaccccccccccccccccccccagcaccuggccgcccccgcccaccagccccagcccgccgcccagcugcacagaaccaccaacuucuucaucgacaacauccugagacccgacuucggcugcaagaaggagcagccccccccccagcugcugguggccgccgccgccagaggcggcgccggcggcggcggcagaguggagagagacagaggccagaccgccgccggcagagaccccgugcacccccugggcaccagagcccccggcgccgccagccugcugugcgcccccgacgccaacugcggcccccccgacggcagccagcccgccgccgccggcgccggcgccagcaaggccggcaaccccgccgccgccgccgccgccgccgccgccgccguggccgccgccgccgccgccgccgccgccaagcccagcgacaccggcggcggcggcagcggcggcggcgccggcagccccggcgcccagggcaccaaguaccccgagcacggcaaccccgccauccugcugaugggcagcgccaacggcggccccguggugaagaccgacagccagcagccccugguguggcccgccuggguguacugcaccagauacagcgacagacccagcagcggccccagaaccagaaagcugaagaagaagaagaacgagaaggaggacaagagacccagaaccgccuucaccgccgagcagcugcagagacugaaggccgaguuccaggccaacagauacaucaccgagcagagaagacagacccuggcccaggagcugagccugaacgagagccagaucaagaucugguuccagaacaagagagccaagaucaagaaggccaccggcaucaagaacggccuggcccugcaccugauggcccagggccuguacaaccacagcaccaccaccgugcaggacaaggacgagagcgaguaa

SEQ ID NO: 16605 - RNA, 1002 nt, Artificial Sequence
  EN2__Homo_sapiens__NP_001418
auggaggagaacgaccccaagcccggcgaggccgccgccgccguggagggccagagacagcccgagagcagccccggcggcggcagcggcggcggcggcggcagcagccccggcgaggccgacaccggcagaagaagagcccugaugcugcccgccgugcugcaggcccccggcaaccaccagcacccccacagaaucaccaacuucuucaucgacaacauccugagacccgaguucggcagaagaaaggacgccggcaccugcugcgccggcgccggcggcggcagaggcggcggcgccggcggcgagggcggcgccagcggcgccgagggcggcggcggcgccggcggcagcgagcagcugcugggcagcggcagcagagagcccagacagaacccccccugcgcccccggcgccggcggcccccugcccgccgccggcagcgacagccccggcgacggcgagggcggcagcaagacccugagccugcacggcggcgccaagaagggcggcgaccccggcggcccccuggacggcagccugaaggccagaggccugggcggcggcgaccugagcgugagcagcgacagcgacagcagccaggccggcgccaaccugggcgcccagcccaugcuguggcccgccuggguguacugcaccagauacagcgacagacccagcagcggccccagaagcagaaagcccaagaagaagaaccccaacaaggaggacaagagacccagaaccgccuucaccgccgagcagcugcagagacugaaggccgaguuccagaccaacagauaccugaccgagcagagaagacagagccuggcccaggagcugagccugaacgagagccagaucaagaucugguuccagaacaagagagccaagaucaagaaggccaccggcaacaagaacacccuggccgugcaccugauggcccagggccuguacaaccacagcaccaccgccaaggagggcaagagcgacagcgaguaa

SEQ ID NO: 16606 - RNA, 1776 nt, Artificial Sequence
  ENAH__Homo_sapiens__NP_001008493
augagcgagcagagcaucugccaggccagagccgccgugaugguguacgacgacgccaacaagaagugggugcccgccggcggcagcaccggcuucagcagagugcacaucuaccaccacaccggcaacaacaccuucagaguggugggcagaaagauccaggaccaccagguggugaucaacugcgccauccccaagggccugaaguacaaccaggccacccagaccuuccaccaguggagagacgccagacagguguacggccugaacuucggcagcaaggaggacgccaacguguucgccagcgccaugaugcacgcccuggaggugcugaacagccaggagaccggccccacccugcccagacagaacagccagcugcccgcccaggugcagaacggccccagccaggaggagcuggagauccagagaagacagcugcaggagcagcagagacagaaggagcuggagagagagagacuggagagagagagaauggagagagagagacuggagagagagagacuggagagagagagacuggagagagagagacuggagcaggagcagcuggagagagagagacaggagagagagagacaggagagacuggagagacaggagagacuggagagacaggagagacuggagagacaggagagacuggacagagagagacaggagagacaggagagagagagacuggagagacuggagagagagagacaggagagagagagacaggagcagcuggagagagagcagcuggagugggagagagagagaagaaucagcagcgccgccgcccccgccagcguggagaccccccugaacagcgugcugggcgacagcagcgccagcgagcccggccugcaggccgccagccagcccgccgagacccccagccagcagggcaucgugcugggcccccuggcccccccccccccccccccccugccccccggccccgcccaggccagcguggcccugccccccccccccggccccccccccccccccccccugcccagcaccggcccccccccccccccccccccccccccccugcccaaccaggugccccccccccccccccccccccccgcccccccccugcccgccagcggcuucuuccuggccagcaugagcgaggacaacagaccccugaccggccuggccgccgccaucgccggcgccaagcugagaaaggugagcagaauggaggacaccagcuuccccagcggcggcaacgccaucggcgugaacagcgccagcagcaagaccgacaccggcagaggcaacggcccccugccccugggcggcagcggccugauggaggagaugagcgcccugcuggccagaagaagaagaaucgccgagaagggcagcaccaucgagaccgagcagaaggaggacaagggcgaggacagcgagcccgugaccagcaaggccagcagcaccagcacccccgagcccaccagaaagcccugggagagaaccaacaccaugaacggcagcaagagccccgugaucagcagaagagacagccccagaaagaaccagaucguguucgacaacagaagcuacgacagccugcacagacccaagagcaccccccugagccagcccagcgccaacggcgugcagaccgagggccuggacuacgacagacugaagcaggacauccuggacgagaugagaaaggagcugaccaagcugaaggaggagcugaucgacgccaucagacaggagcugagcaagagcaacaccgccuaa

SEQ ID NO: 16607 - RNA, 3429 nt, Artificial Sequence
  ENAM__Homo_sapiens__NP_114095
augcuggugcugagaugcagacugggcaccagcuuccccaagcuggacaaccuggugcccaagggcaagaugaagauccugcugguguuccugggccugcugggcaacagcguggccaugcccaugcacaugcccagaaugcccggcuucagcagcaagagcgaggagaugaugagauacaaccaguucaacuucaugaacggcccccacauggcccaccugggccccuucuucggcaacggccugccccagcaguucccccaguaccagaugcccauguggccccagcccccccccaacaccuggcaccccagaaagagcagcgcccccaagagacacaacaagaccgaccagacccaggagacccagaagcccaaccagacccagagcaagaagcccccccagaagagaccccugaagcagcccagccacaaccagccccagcccgaggaggaggcccagcccccccaggccuucccccccuucggcaacggccuguuccccuaccagcagccccccuggcagaucccccagagacugcccccccccggcuacggcagaccccccaucagcaacgaggagggcggcaaccccuacuucggcuacuucggcuaccacggcuucggcggcagaccccccuacuacagcgaggagauguucgagcaggacuucgagaagcccaaggaggaggacccccccaaggccgagagccccggcaccgagcccaccgccaacagcaccgugaccgagaccaacagcacccagcccaaccccaagggcagccagggcggcaacgacaccagccccaccggcaacagcacccccggccugaacaccggcaacaacccccccgcccagaacggcaucggcccccugcccgccgugaacgccagcggccagggcggccccggcagccagauccccuggagacccagccagcccaacaucagagagaaccaccccuaccccaacaucagaaacuuccccagcggcagacagugguacuucaccggcaccgugaugggccacagacagaacagacccuucuacagaaaccagcaggugcagagaggccccagauggaacuucuucgccugggagagaaagcagguggccagacccggcaaccccguguaccacaaggccuacccccccaccagcagaggcaacuaccccaacuacgccggcaaccccgccaaccugagaagaaagccccagggccccaacaagcaccccgugggcaccaccguggccccccugggccccaagcccggccccguggugagaaacgagaagauccagaaccccaaggagaagccccugggccccaaggagcagaucaucgugcccaccaagaaccccaccagccccuggagaaacagccagcaguacgaggugaacaagagcaacuacaagcugccccacagcgagggcuacaugcccgugcccaacuucaacagcguggaccagcacgagaacagcuacuaccccagaggcgacagcagaaaggugcccaacagcgacggccagacccagagccagaaccugcccaagggcaucgugcugggcagcagaagaaugcccuacgagagcgagaccaaccagagcgagcugaagcacagcagcuaccagcccgccguguaccccgaggagauccccagccccgccaaggagcacuuccccgccggcagaaacaccugggaccaccaggagaucagcccccccuucaaggaggaccccggcagacaggaggagcaccugccccaccccagccacggcagcagaggcagcguguucuaccccgaguacaaccccuacgaccccagagagaacagccccuaccugagaggcaacaccugggacgagagagacgacagccccaacaccaugggccagaaggagagcccccuguaccccaucaacacccccgaccagaaggagaucgugcccuacaacgaggaggaccccguggaccccaccggcgacgagguguuccccggccagaacagauggggcgaggagcugagcuucaagggcggccccaccgugagacacuacgagggcgagcaguacaccagcaaccagcccaaggaguaccugcccuacagccuggacaaccccagcaagcccagagaggacuucuacuacagcgaguucuaccccuggagccccgacgagaacuuccccagcuacaacaccgccagcaccaugcccccccccaucgagagcagaggcuacuacgugaacaacgccgccggccccgaggagagcacccuguuccccagcagaaacagcugggaccacagaauccaggcccagggccagagagagagaagacccuacuucaacagaaacaucugggaccaggccacccaccugcagaaggcccccgccagaccccccgaccagaagggcaaccagcccuacuacagcaacacccccgccggccugcagaagaaccccaucuggcacgagggcgagaaccugaacuacggcaugcagaucaccagaaugaacagccccgagagagagcacagcagcuuccccaacuucaucccccccagcuaccccagcggccagaaggaggcccaccuguuccaccugagccagagaggcagcugcugcgccggcagcagcaccggccccaaggacaacccccuggcccugcaggacuacacccccagcuacggccuggcccccggcgagaaccaggacaccagcccccuguacaccgacggcagccacaccaagcagaccagagacaucaucagccccaccagcauccugcccggccagagaaacagcagcgagaagagagagagccagaaccccuucagagacgacgugagcacccugagaagaaacacccccugcagcaucaagaaccagcugggccagaaggagaucaugcccuuccccgaggccagcagccugcagagcaagaacacccccugccugaagaacgaccugggcggcgacggcaacaacauccuggagcagguguucgaggacaaccagcugaacgagagaaccguggaccugacccccgagcagcuggugaucggcacccccgacgagggcagcaaccccgagggcauccagagccaggugcaggagaacgagagcgagagacagcagcagagacccagcaacauccugcaccugcccugcuucggcagcaagcuggccaagcaccacagcagcaccaccggcacccccagcagcgacggcagacagagccccuucgacggcgacagcaucacccccaccgagaaccccaacacccugguggagcuggccaccgaggagcaguucaagagcaucaacguggacccccuggacgccgacgagcacagccccuucgaguuccugcagagaggcaccaacgugcaggaccaggugcaggacugccugcugcugcaggccuaa

SEQ ID NO: 16608 - RNA, 1770 nt, Artificial Sequence
  ENC1__Homo_sapiens__XP_011541999
augagcgugagcgugcacgagaacagaaagagcagagccagcagcggcagcaucaacaucuaccuguuccacaagagcagcuacgccgacagcgugcugacccaccugaaccugcugagacagcagagacuguucaccgacgugcugcugcacgccggcaacagaaccuuccccugccacagagccgugcuggccgccugcagcagauacuucgaggccauguucagcggcggccugaaggagagccaggacagcgaggugaacuucgacaacagcauccaccccgaggugcuggagcugcugcuggacuacgccuacagcagcagagugaucaucaacgaggagaacgccgagagccugcuggaggccggcgacaugcuggaguuccaggacaucagagacgccugcgccgaguuccuggagaagaaccugcaccccaccaacugccugggcaugcugcugcugagcgacgcccaccagugcaccaagcuguacgagcugagcuggagaaugugccugagcaacuuccagaccaucagaaagaacgaggacuuccugcagcugccccaggacaugguggugcagcugcugagcagcgaggagcuggagaccgaggacgagagacugguguacgagagcgccaucaacuggaucagcuacgaccugaagaagagauacugcuaccugcccgagcugcugcagaccgugagacuggcccugcugcccgccaucuaccugauggagaacguggccauggaggagcugaucaccaagcagagaaagagcaaggagaucguggaggaggccaucagaugcaagcugaagauccugcagaacgacggcguggugaccagccugugcgccagacccagaaagaccggccacgcccuguuccugcugggcggccagaccuucaugugcgacaagcuguaccugguggaccagaaggccaaggagaucauccccaaggccgacauccccagccccagaaaggaguucagcgccugcgccaucggcugcaagguguacaucaccggcggcagaggcagcgagaacggcgugagcaaggacguguggguguacgacacccugcacgaggaguggagcaaggccgcccccaugcugguggccagauucggccacggcagcgccgagcugaagcacugccuguacguggugggcggccacaccgccgccaccggcugccugcccgccagccccagcgugagccugaagcagguggagcacuacgaccccaccaucaacaaguggaccaugguggccccccugagagagggcgugagcaacgccgccguggugagcgccaagcugaagcuguucgccuucggcggcaccagcgugagccacgacaagcugcccaaggugcagugcuacgaccagugcgagaacagauggaccgugcccgccaccugcccccagcccuggagauacaccgccgccgccgugcugggcaaccagaucuucaucaugggcggcgacaccgaguucagcgccugcagcgccuacaaguucaacagcgagaccuaccaguggaccaaggugggcgacgugaccgccaagagaaugagcugccacgccguggccagcggcaacaagcuguacguggugggcggcuacuucggcauccagagaugcaagacccuggacugcuacgaccccacccuggacguguggaacagcaucaccaccgugcccuacagccugauccccaccgccuucgugagcaccuggaagcaccugcccagcuaa

SEQ ID NO: 16609 - RNA, 894 nt, Artificial Sequence
  ENDOG__Homo_sapiens__NP_004426
augagagcccugagagccggccugacccuggccagcggcgccggccugggcgccgugguggagggcuggagaagaagaagagaggacgccagagccgcccccggccugcugggcagacugcccgugcugcccguggccgccgccgccgagcugccccccgugcccggcggccccagaggccccggcgagcuggccaaguacggccugcccggccuggcccagcugaagagcagagagagcuacgugcugugcuacgaccccagaaccagaggcgcccugugggugguggagcagcugagacccgagagacugagaggcgacggcgacagaagagagugcgacuucagagaggacgacagcgugcacgccuaccacagagccaccaacgccgacuacagaggcagcggcuucgacagaggccaccuggccgccgccgccaaccacagauggagccagaaggccauggacgacaccuucuaccugagcaacguggccccccaggugccccaccugaaccagaacgccuggaacaaccuggagaaguacagcagaagccugaccagaagcuaccagaacguguacgugugcaccggcccccuguuccugcccagaaccgaggccgacggcaagagcuacgugaaguaccaggugaucggcaagaaccacguggccgugcccacccacuucuucaaggugcugauccuggaggccgccggcggccagaucgagcugagaaccuacgugaugcccaacgcccccguggacgaggccaucccccuggagagauuccuggugcccaucgagagcaucgagagagccagcggccugcuguucgugcccaacauccuggccagagccggcagccugaaggccaucaccgccggcagcaaguaa

SEQ ID NO: 16610 - RNA, 1233 nt, Artificial Sequence
  ENDOU__Homo_sapiens__NP_001165910
augagagccugcaucagccuggugcuggccgugcugugcggccuggccugggccggcaagaucgagagcugcgccagcagaugcaacgagaaguucaacagagacgccgccugccagugcgacagaagaugccuguggcacggcaacugcugcgaggacuacgagcaccugugcaccgaggaccacaaggagagcgagccccugccccagcuggaggaggagaccgaggaggcccuggccagcaaccuguacagcgcccccaccagcugccagggcagaugcuacgaggccuucgacaagcaccaccagugccacugcaacgccagaugccaggaguucggcaacugcugcaaggacuucgagagccugugcagcgaccacgaggugagccacagcagcgacgccaucaccaaggaggagauccagagcaucagcgagaagaucuacagagccgacaccaacaaggcccagaaggaggacaucgugcugaacagccagaacugcaucagccccagcgagaccagaaaccagguggacagaugccccaagccccuguucaccuacgugaacgagaagcuguucagcaagcccaccuacgccgccuucaucaaccugcugaacaacuaccagagagccaccggccacggcgagcacuucagcgcccaggagcuggccgagcaggacgccuuccugagagagaucaugaagaccgccgugaugaaggagcuguacagcuuccugcaccaccagaacagauacggcagcgagcaggaguucguggacgaccugaagaacaugugguucggccuguacagcagaggcaacgaggagggcgacagcagcggcuucgagcacguguucagcggcgaggugaagaagggcaaggugaccggcuuccacaacuggaucagauucuaccuggaggagaaggagggccugguggacuacuacagccacaucuacgacggccccugggacagcuaccccgacgugcuggccaugcaguucaacugggacggcuacuacaaggaggugggcagcgccuucaucggcagcagccccgaguucgaguucgcccuguacagccugugcuucaucgccagacccggcaaggugugccagcugagccugggcggcuacccccuggccgugagaaccuacaccugggacaagagcaccuacggcaacggcaagaaguacaucgccaccgccuacaucgugagcagcaccuaa

SEQ ID NO: 16611 - RNA, 714 nt, Artificial Sequence
  ENDOV__Homo_sapiens__NP_001158109
auggcccuggaggccgccggcggcccccccgaggagacccugagccuguggaagagagagcaggccagacugaaggcccacgugguggacagagacaccgaggccuggcagagagaccccgccuucagcggccugcagagagugggcggcguggacgugagcuucgugaagggcgacagcgugagagccugcgccagccugguggugcugagcuuccccgagcuggaggugcugcugguggacggcaacggcgugcugcaccacagaggcuucggcguggccugccaccugggcgugcugaccgaccugcccugcgugggcguggccaagaagcugcugcagguggacggccuggagaacaacgcccugcacaaggagaagaucagacugcugcagaccagaggcgacagcuucccccugcugggcgacagcggcaccgugcugggcauggcccugagaagccacgacagaagcaccagaccccuguacaucagcgugggccacagaaugagccuggaggccgccgugagacugaccugcugcugcugcagauucagaauccccgagcccgugagacaggccgacaucugcagcagagagcacaucagaaagagccugggccugcccggcccccccacccccagaagccccaaggcccagagacccguggccugccccaagggcgacagcggcgagagcagcgcccugugcuaa

SEQ ID NO: 16612 - RNA, 2232 nt, Artificial Sequence
  ENGASE__Homo_sapiens__NP_001036038
auggaggccgccgccgugaccgugaccagaagcgccaccagaagaagaagaagacagcugcagggccuggccgcccccgaggccggcacccaggaggagcaggaggaccaggagcccagacccagaagaagaagacccggcagaagcaucaaggacgaggaggaggagaccguguucagagagguggugagcuucagccccgacccccugcccgugagauacuacgacaaggacaccaccaagcccaucagcuucuaccugagcagccuggaggagcugcuggccuggaagcccagacuggaggacggcuucaacguggcccuggagccccuggccugcagacagcccccccugagcagccagagacccagaacccugcugugccacgacaugaugggcggcuaccuggacgacagauucauccagggcagcguggugcagacccccuacgccuucuaccacuggcagugcaucgacguguucguguacuucagccaccacaccgugaccaucccccccgugggcuggaccaacaccgcccacagacacggcgugugcgugcugggcaccuucaucaccgaguggaacgagggcggcagacugugcgaggccuuccuggccggcgacgagagaagcuaccaggccguggccgacagacuggugcagaucacccaguucuucagauucgacggcuggcugaucaacaucgagaacagccugagccuggccgccgugggcaacaugccccccuuccugagauaccugaccacccagcugcacagacaggugcccggcggccuggugcugugguacgacagcguggugcagagcggccagcugaaguggcaggacgagcugaaccagcacaacagaguguucuucgacagcugcgacggcuucuucaccaacuacaacuggagagaggagcaccuggagagaaugcugggccaggccggcgagagaagagccgacguguacgugggcguggacguguucgccagaggcaacguggugggcggcagauucgacaccgacaagagccuggagcugaucagaaagcacggcuucagcguggcccuguucgcccccggcuggguguacgagugccuggagaagaaggacuucuuccagaaccaggacaaguucuggggcagacuggagagauaccugcccacccacagcaucugcagccugcccuucgugaccagcuucugccugggcaugggcgccagaagagugugcuacggccaggaggaggccgugggccccugguaccaccugagcgcccaggagauccagccccuguucggcgagcacagacugggcggcgacggcagaggcugggugagaacccacugcugccuggaggacgccuggcacggcggcagcagccugcuggugagaggcgugaucccccccgaggugggcaacguggccgugagacuguucagccugcaggcccccgugccccccaagaucuaccugagcaugguguacaagcuggagggccccaccgacgugaccguggcccuggagcugaccaccggcgacgccggcagcugccacaucggcggcaucagcgugcugaacgccgagaccagcagcagacacagccugagaccccugagagugccccccaccaagcuggccagaugggugggcagaugcggcagacagcugagcggcggcugggugcagcacugcuacgaggugagccugagaggcugccugcugcuggaccugcuggugugcuucagcagaccccccggcagcagagaggaggagagcuucaccugcagacugggcgagauccaggugguggacgccgccagccugcuggccccccugccccaggugcaggccgugaccaucagccacaucagauggcagcccagcgccagcgagagagagggcccccccgcccugcugcagcugagcugcacccugcacuggagcuuccugcugagccaggugagaugcuucagaauccacugcuggggcggcaugagcgacgacagccccggcagagagcugcccagacccgagaugcccauguuccugggccuggccuucgccacccaguacagaaucguggaccugcugguggaggccgccggccccggccaggacagaagaauggaguuccugguggagcccgugcccaaggagggcuucagagugccccaggccgaguggggcagagccgugcugcuguacagcgcccccgccuaa

SEQ ID NO: 16613 - RNA, 1878 nt, Artificial Sequence
  ENG__Homo_sapiens__NP_000109
auggacagaggcacccugccccuggccguggcccugcugcuggccagcugcagccugagccccaccagccuggccgagaccgugcacugcgaccugcagcccgugggccccgagagaggcgaggugaccuacaccaccagccaggugagcaagggcugcguggcccaggcccccaacgccauccuggaggugcacgugcuguuccuggaguuccccaccggccccagccagcuggagcugacccugcaggccagcaagcagaacggcaccuggcccagagaggugcugcuggugcugagcgugaacagcagcguguuccugcaccugcaggcccugggcaucccccugcaccuggccuacaacagcagccuggugaccuuccaggagccccccggcgugaacaccaccgagcugcccagcuuccccaagacccagauccuggagugggccgccgagagaggccccaucaccagcgccgccgagcugaacgacccccagagcauccugcugagacugggccaggcccagggcagccugagcuucugcaugcuggaggccagccaggacaugggcagaacccuggaguggagacccagaacccccgcccuggugagaggcugccaccuggagggcguggccggccacaaggaggcccacauccugagagugcugcccggccacagcgccggccccagaaccgugaccgugaagguggagcugagcugcgcccccggcgaccuggacgccgugcugauccugcagggcccccccuacgugagcuggcugaucgacgccaaccacaacaugcagaucuggaccaccggcgaguacagcuucaagaucuuccccgagaagaacaucagaggcuucaagcugcccgacaccccccagggccugcugggcgaggccagaaugcugaacgccagcaucguggccagcuucguggagcugccccuggccagcaucgugagccugcacgccagcagcugcggcggcagacugcagaccagccccgcccccauccagaccaccccccccaaggacaccugcagccccgagcugcugaugagccugauccagaccaagugcgccgacgacgccaugacccuggugcugaagaaggagcugguggcccaccugaagugcaccaucaccggccugaccuucugggaccccagcugcgaggccgaggacagaggcgacaaguucgugcugagaagcgccuacagcagcugcggcaugcaggugagcgccagcaugaucagcaacgaggccguggugaacauccugagcagcagcagcccccagagaaagaaggugcacugccugaacauggacagccugagcuuccagcugggccuguaccugagcccccacuuccugcaggccagcaacaccaucgagcccggccagcagagcuucgugcaggugagagugagccccagcgugagcgaguuccugcugcagcuggacagcugccaccuggaccugggccccgagggcggcaccguggagcugauccagggcagagccgccaagggcaacugcgugagccugcugagccccagccccgagggcgaccccagauucagcuuccugcugcacuucuacaccgugcccauccccaagaccggcacccugagcugcaccguggcccugagacccaagaccggcagccaggaccaggaggugcacagaaccguguucaugagacugaacaucaucagccccgaccugagcggcugcaccagcaagggccuggugcugcccgccgugcugggcaucaccuucggcgccuuccugaucggcgcccugcugaccgccgcccugugguacaucuacagccacaccagagaguaccccagacccccccaguaa

SEQ ID NO: 16614 - RNA, 231 nt, Artificial Sequence
  ENHO__Homo_sapiens__NP_940975
augggcgccgccaucagccagggcgcccugaucgccaucgugugcaacggccuggugggcuuccugcugcugcugcugugggugauccugugcugggccugccacagcagaagcgccgacguggacagccugagcgagagcagccccaacagcagccccggccccugccccgagaaggccccccccccccagaagcccagccacgagggcagcuaccugcugcagcccuaa

SEQ ID NO: 16615 - RNA, 1305 nt, Artificial Sequence
  ENO2__Homo_sapiens__NP_001966
augagcaucgagaagaucugggccagagagauccuggacagcagaggcaaccccaccguggagguggaccuguacaccgccaagggccuguucagagccgccgugcccagcggcgccagcaccggcaucuacgaggcccuggagcugagagacggcgacaagcagagauaccugggcaagggcgugcugaaggccguggaccacaucaacagcaccaucgcccccgcccugaucagcagcggccugagcgugguggagcaggagaagcuggacaaccugaugcuggagcuggacggcaccgagaacaagagcaaguucggcgccaacgccauccugggcgugagccuggccgugugcaaggccggcgccgccgagagagagcugccccuguacagacacaucgcccagcuggccggcaacagcgaccugauccugcccgugcccgccuucaacgugaucaacggcggcagccacgccggcaacaagcuggccaugcaggaguucaugauccugcccgugggcgccgagagcuucagagacgccaugagacugggcgccgagguguaccacacccugaagggcgugaucaaggacaaguacggcaaggacgccaccaacgugggcgacgagggcggcuucgcccccaacauccuggagaacagcgaggcccuggagcuggugaaggaggccaucgacaaggccggcuacaccgagaagaucgugaucggcauggacguggccgccagcgaguucuacagagacggcaaguacgaccuggacuucaagagccccaccgaccccagcagauacaucaccggcgaccagcugggcgcccuguaccaggacuucgugagagacuaccccguggugagcaucgaggaccccuucgaccaggacgacugggccgccuggagcaaguucaccgccaacgugggcauccagaucgugggcgacgaccugaccgugaccaaccccaagagaaucgagagagccguggaggagaaggccugcaacugccugcugcugaaggugaaccagaucggcagcgugaccgaggccauccaggccugcaagcuggcccaggagaacggcuggggcgugauggugagccacagaagcggcgagaccgaggacaccuucaucgccgaccugguggugggccugugcaccggccagaucaagaccggcgcccccugcagaagcgagagacuggccaaguacaaccagcugaugagaaucgaggaggagcugggcgacgaggccagauucgccggccacaacuucagaaaccccagcgugcuguaa

SEQ ID NO: 16616 - RNA, 1176 nt, Artificial Sequence
  ENO3__Homo_sapiens__NP_001180432
auggccaugcagaagaucuucgccagagagauccuggacagcagaggcaaccccaccguggagguggaccugcacaccgccaagggcagauucagagccgccgugcccagcggcgccagcaccggcaucuacgaggcccuggagcugagagacggcgacaagggcagauaccugggcaaggccaaguucggcgccaacgccauccugggcgugagccuggccgugugcaaggccggcgccgccgagaagggcgugccccuguacagacacaucgccgaccuggccggcaaccccgaccugauccugcccgugcccgccuucaacgugaucaacggcggcagccacgccggcaacaagcuggccaugcaggaguucaugauccugcccgugggcgccagcagcuucaaggaggccaugagaaucggcgccgagguguaccaccaccugaagggcgugaucaaggccaaguacggcaaggacgccaccaacgugggcgacgagggcggcuucgcccccaacauccuggagaacaacgaggcccuggagcugcugaagaccgccauccaggccgccggcuaccccgacaagguggugaucggcauggacguggccgccagcgaguucuacagaaacggcaaguacgaccuggacuucaagagccccgacgaccccgccagacacaucaccggcgagaagcugggcgagcuguacaagagcuucaucaagaacuaccccguggugagcaucgaggaccccuucgaccaggacgacugggccaccuggaccagcuuccugagcggcgugaacauccagaucgugggcgacgaccugaccgugaccaaccccaagagaaucgcccaggccguggagaagaaggccugcaacugccugcugcugaaggugaaccagaucggcagcgugaccgagagcauccaggccugcaagcuggcccagagcaacggcuggggcgugauggugagccacagaagcggcgagaccgaggacaccuucaucgccgaccugguggugggccugugcaccggccagaucaagaccggcgcccccugcagaagcgagagacuggccaaguacaaccagcugaugagaaucgaggaggcccugggcgacaaggccaucuucgccggcagaaaguucagaaaccccaaggccaaguaa

SEQ ID NO: 16617 - RNA, 1878 nt, Artificial Sequence
  ENO4__Homo_sapiens__NP_001229628
auggaggaggagggcggcggcagaagcugcggcaccaccagagagcugcagaagcugaagcagcaggccauggaguacuacagagagaacgacgugcccagaagacuggaggagcugcugaacagcaccuucuaccugcagcccgccgacguguacggccaccuggccaacugcuucagcaagcuggccaagccccccaccaucugcaagaucgugggcaaggacgugcuggacggccugggccugcccacccugcagguggacaucuucugcaccauccagaacuuccccaagaacgugugcagcguggugaucagcacccacuucgaggugcacgagaacgcccugcccgagcuggccaaggccgaggaggccgagagagccagcgccgugagcaccgccgugcagugggugaacagcaccaucacccacgagcugcagggcauggcccccagcgaccaggccgagguggaccaccugcugagaaucuucuucgccagcaaggugcaggaggacaagggcagaaaggagcuggagaagagccuggaguacagcaccgugcccaccccccugccccccgugcccccccccccccccccccccccccccaccaagaagaagggccagaagcccggcagaaaggacaccaucaccgagaagcccaucgcccccgccgagcccguggagcccgugcugagcggcagcauggccaucggcgccgugagccuggccguggccaaggccugcgccaugcugcugaacaagccccuguaccugaacaucgcccugcugaagcacaaccaggagcagcccaccacccugagcaugccccugcugauggugagccuggugagcugcggcaagagcagcagcggcaagcugaaccugaugaaggaggugaucugcaucccccaccccgagcugaccaccaagcagggcguggagaugcugauggagaugcagaagcacaucaacaagaucaucgagaugcccagcccccccaaggccgagaccaagaagggccacgacggcagcaagagaggccagcagcagaucaccggcaagaugagccaccugggcugccugaccaucaacugcgacagcaucgagcagccccugcugcugauccaggagaucugcgccaaccugggccuggagcugggcaccaaccugcaccuggccaucaacugcgccggccacgagcugauggacuacaacaagggcaaguacgaggugaucaugggcaccuacaagaacgccgccgagaugguggaccuguacguggaccugaucaacaaguaccccagcaucaucgcccugaucgaccccuucagaaaggaggacagcgagcagugggacagcaucuaccacgcccugggcagcagaugcuacaucaucgccggcaccgccagcaagagcaucagcaagcugcuggagcagggcaacaucagcauccccaagagcaacggccugaucaucaagcacaccaaccagaccaccaugagcgaccugguggagaucaccaaccugaucgacagcaagaagcacaucaccguguucggcagcaccgagggcgagagcagcgacgacagccugguggaccuggccgugggccugggcgugagauucaucaagcugggcggccugagcagaggcgagagagugaccaaguacaacagacugcugaccaucgaggaggagcuggugcagaacggcacccugggcuucaaggaggagcacaccuucuucuacuucaacgaggaggccgagaaggccgccgaggcccuggaggccgccgccgccagagagccccuggugcccaccuuccccacccagggcguggaggagagcgccgagaccggcgccagcagcggcuaa

SEQ ID NO: 16618 - RNA, 786 nt, Artificial Sequence
  ENOPH1__Homo_sapiens__NP_067027
augguggugcugagcgugcccgccgaggugaccgugauccugcuggacaucgagggcaccaccacccccaucgccuucgugaaggacauccuguuccccuacaucgaggagaacgugaaggaguaccugcagacccacugggaggaggaggagugccagcaggacgugagccugcugagaaagcaggccgaggaggacgcccaccuggacggcgccgugcccauccccgccgccagcggcaacggcguggacgaccugcagcagaugauccaggccgugguggacaacgugugcuggcagaugagccuggacagaaagaccaccgcccugaagcagcugcagggccacauguggagagccgccuucaccgccggcagaaugaaggccgaguucuucgccgacguggugcccgccgugagaaaguggagagaggccggcaugaagguguacaucuacagcagcggcagcguggaggcccagaagcugcuguucggccacagcaccgagggcgacauccuggagcugguggacggccacuucgacaccaagaucggccacaagguggagagcgagagcuacagaaagaucgccgacagcaucggcugcagcaccaacaacauccuguuccugaccgacgugaccagagaggccagcgccgccgaggaggccgacgugcacguggccgugguggugagacccggcaacgccggccugaccgacgacgagaagaccuacuacagccugaucaccagcuucagcgagcuguaccugcccagcagcaccuaa

SEQ ID NO: 16619 - RNA, 1086 nt, Artificial Sequence
  ENOSF1__Homo_sapiens__NP_001119595
augcagaagauggagagcagaggcguggagcugcccagccugugggagaaggcccugaagcugaucggccccgagaagggcguggugcaccuggccaccgccgccgugcugaacgccgugugggaccugugggccaagcaggagggcaagcccguguggaagcugcugguggacauggaccccagaaugcuggugagcugcaucgacuucagauacaucaccgacgugcugaccgaggaggacgcccuggagauccugcagaagggccagaucggcaagaaggagagagagaagcagaugcuggcccagggcuaccccgccuacaccaccagcugcgccuggcugggcuacagcgacgacacccugaagcagcugugcgcccaggcccugaaggacggcuggaccagauucaaggugaaggugggcgccgaccugcaggacgacaugagaagaugccagaucaucagagacaugaucggccccgagaagacccugaugauggacgccaaccagagaugggacgugcccgaggccguggaguggaugagcaagcuggccaaguucaagccccuguggaucgaggagcccaccagccccgacgacauccugggccacgccaccaucagcaaggcccuggugccccugggcaucggcaucgccaccggcgagcagugccacaacagagugaucuucaagcagcugcugcaggccaaggcccugcaguuccugcagaucgacagcugcagacugggcagcgugaacgagaaccugagcgugcugcugauggccaagaaguucgagauccccgugugcccccacgccggcggcgugggccugugcgagcuggugcagcaccugaucaucuucgacuacaucagcgugagcgccagccuggagaacagagugugcgaguacguggaccaccugcacgagcacuucaaguaccccgugaugauccagagagccagcuacaugccccccaaggaccccggcuacagcaccgagaugaaggaggagagcgugaagaagcaccaguaccccgacggcgagguguggaagaagcugcugcccgcccaggagaacuaa

SEQ ID NO: 16620 - RNA, 1932 nt, Artificial Sequence
  ENOX1__Homo_sapiens__NP_001121087
augguggacgccggcggcguggagaacaucacccagcugccccaggagcugccccagaugauggccgccgccgccgacggccugggcagcaucgccaucgacaccacccagcugaacaugagcgugaccgaccccaccgccugggccaccgccaugaacaaccugggcauggugcccgugggccugcccggccagcagcuggugagcgacagcaucugcgugcccggcuucgaccccagccugaacaugaugaccggcaucacccccaucaaccccaugauccccggccugggccuggugcccccccccccccccaccgagguggccguggugaaggagaucauccacugcaagagcugcacccuguucccccagaaccccaaccugcccccccccagcaccagagagagaccccccggcugcaagaccguguucgugggcggccugcccgagaacgccaccgaggagaucauccaggagguguucgagcagugcggcgacaucaccgccaucagaaagagcaagaagaacuucugccacaucagauucgccgaggaguucaugguggacaaggccaucuaccugagcggcuacagaaugagacugggcagcagcaccgacaagaaggacagcggcagacugcacguggacuucgcccaggccagagacgacuucuacgagugggagugcaagcagagaaugagagccagagaggagagacacagaagaaagcuggaggaggacagacugagaccccccagcccccccgccaucaugcacuacagcgagcacgaggccgcccugcuggccgagaagcugaaggacgacagcaaguucagcgaggccaucaccgugcugcugagcuggaucgagagaggcgaggugaacagaagaagcgccaaccaguucuacagcauggugcagagcgccaacagccacgugagaagacugaugaacgagaaggccacccacgagcaggagauggaggaggccaaggagaacuucaagaacgcccugaccggcauccugacccaguucgagcagaucguggccguguucaacgccagcaccagacagaaggccugggaccacuucagcaaggcccagagaaagaacaucgacaucuggagaaagcacagcgaggagcugagaaacgcccagagcgagcagcugaugggcaucagaagagaggaggagauggagaugagcgacgacgagaacugcgacagccccaccaagaagaugagaguggacgagagcgcccuggccgcccaggccuacgcccugaaggaggagaacgacagccugagauggcagcuggacgccuacagaaacgagguggagcugcugaagcaggagaaggagcagcuguucagaaccgaggagaaccugaccaaggaccagcagcugcaguuccugcagcagaccaugcagggcaugcagcagcagcugcugaccauccaggaggagcugaacaacaagaagagcgagcuggagcaggccaaggaggagcagagccacacccaggcccugcugaaggugcugcaggagcagcugaagggcaccaaggagcugguggagaccaacggccacagccacgaggacagcaacgagaucaacgugcugaccguggcccuggugaaccaggacagagagaacaacaucgagaagagaagccagggccugaagagcgagaaggaggcccugcugaucggcaucaucagcaccuuccugcacgugcaccccuucggcgccaacaucgaguaccuguggagcuacaugcagcagcuggacagcaagaucagcgccaacgagaucgagaugcugcugaugagacugcccagaauguucaagcaggaguucaccggcgugggcgccacccuggagaagagauggaagcugugcgccuucgagggcaucaagaccaccuaa

SEQ ID NO: 16621 - RNA, 2022 nt, Artificial Sequence
  ENOX2__Homo_sapiens__XP_011529546
augcugcacaucaaccagcugcugcugugcaacggcaccgccagcgccgccaccaacaaggacgagaccaacugcaacuuccugaucagcagcggccugaaccagcugcccuucgaccccgccaacaacaacgagccccugcaguucggcagcgccagcggcccccuggugaccgagggccugaucgagaacggcggcgagagcagcaagaagagaaagagaaccaacacccccagcgccgacaacagcagaacccugaacguggacagcaccgccaugacccugcccaugagcgaccccaccgccugggccaccgccaugaacaaccugggcauggccccccugggcaucgccggccagcccauccugcccgacuucgaccccgcccugggcaugaugaccggcaucccccccaucacccccaugaugcccggccugggcaucgugcccccccccaucccccccgacaugcccguggugaaggagaucauccacugcaagagcugcacccuguucccccccaaccccaaccugcccccccccgccaccagagagagaccccccggcugcaagaccguguucgugggcggccugcccgagaacggcaccgagcagaucaucguggagguguucgagcagugcggcgagaucaucgccaucagaaagagcaagaagaacuucugccacaucagauucgccgaggaguacaugguggacaaggcccuguaccugagcggcuacagaaucagacugggcagcagcaccgacaagaaggacaccggcagacugcacguggacuucgcccaggccagagacgaccuguacgagugggagugcaagcagagaaugcuggccagagaggagagacacagaagaagaauggaggaggagagacugagaccccccagccccccccccguggugcacuacagcgaccacgagugcagcaucguggccgagaagcugaaggacgacagcaaguucagcgaggccgugcagacccugcugaccuggaucgagagaggcgaggugaacagaagaagcgccaacaacuucuacagcaugauccagagcgccaacagccacgugagaagacuggugaacgagaaggccgcccacgagaaggacauggaggaggccaaggagaaguucaagcaggcccugagcggcauccugauccaguucgagcagaucguggccguguaccacagcgccagcaagcagaaggccugggaccacuucaccaaggcccagagaaagaacaucagcguguggugcaagcaggccgaggagaucagaaacauccacaacgacgagcugaugggcaucagaagagaggaggagauggagaugagcgacgacgagaucgaggagaugaccgagaccaaggagaccgaggagagcgcccuggugagccaggccgaggcccugaaggaggagaacgacagccugagauggcagcuggacgccuacagaaacgagguggagcugcugaagcaggagcagggcaaggugcacagagaggacgaccccaacaaggagcagcagcugaagcugcugcagcaggcccugcagggcaugcagcagcaccugcugaaggugcaggaggaguacaagaagaaggaggccgagcuggagaagcugaaggacgacaagcugcagguggagaagaugcuggagaaccugaaggagaaggagagcugcgccagcagacugugcgccagcaaccaggacagcgaguacccccuggagaagaccaugaacagcagccccaucaagagcgagagagaggcccugcuggugggcaucaucagcaccuuccugcacgugcaccccuucggcgccagcaucgaguacaucugcagcuaccugcacagacuggacaacaagaucugcaccagcgacguggagugccugaugggcagacugcagcacaccuucaagcaggagaugaccggcgugggcgccagccuggagaagagauggaaguucugcggcuucgagggccugaagcugaccuaa

SEQ ID NO: 16622 - RNA, 2874 nt, Artificial Sequence
  ENPEP__Homo_sapiens__NP_001968
augaacuucgccgagagagagggcagcaagagauacugcauccagaccaagcacguggccauccugugcgccgugguggugggcgugggccugaucgugggccuggccgugggccugaccagaagcugcgacagcagcggcgacggcggccccggcaccgcccccgcccccagccaccugcccagcagcaccgccagccccagcggcccccccgcccaggaccaggacaucugccccgccagcgaggacgagagcggccaguggaagaacuucagacugcccgacuucgugaaccccgugcacuacgaccugcacgugaagccccugcuggaggaggacaccuacaccggcaccgugagcaucagcaucaaccugagcgcccccaccagauaccuguggcugcaccugagagagaccagaaucaccagacugcccgagcugaagagacccagcggcgaccaggugcaggugagaagaugcuucgaguacaagaagcaggaguacguggugguggaggccgaggaggagcugacccccagcagcggcgacggccuguaccugcugaccauggaguucgccggcuggcugaacggcagccuggugggcuucuacagaaccaccuacaccgagaacggccaggugaagagcaucguggccaccgaccacgagcccaccgacgccagaaagagcuuccccugcuucgacgagcccaacaagaaggccaccuacaccaucagcaucacccaccccaaggaguacggcgcccugagcaacaugcccguggccaaggaggagagcguggacgacaaguggaccagaaccaccuucgagaagagcgugcccaugagcaccuaccuggugugcuucgccgugcaccaguucgacagcgugaagagaaucagcaacagcggcaagccccugaccaucuacgugcagcccgagcagaagcacaccgccgaguacgccgccaacaucaccaagagcguguucgacuacuucgaggaguacuucgccaugaacuacagccugcccaagcuggacaagaucgccauccccgacuucggcaccggcgccauggagaacuggggccugaucaccuacagagagaccaaccugcuguacgaccccaaggagagcgccagcagcaaccagcagagaguggccaccgugguggcccacgagcuggugcaccagugguucggcaacaucgugaccauggacuggugggaggaccuguggcugaacgagggcuucgccagcuucuucgaguuccugggcgugaaccacgccgagaccgacuggcagaugagagaccagaugcugcuggaggacgugcugcccgugcaggaggacgacagccugaugagcagccaccccaucaucgugaccgugaccacccccgacgagaucaccagcguguucgacggcaucagcuacagcaagggcagcagcauccugagaaugcuggaggacuggaucaagcccgagaacuuccagaagggcugccagauguaccuggagaaguaccaguucaagaacgccaagaccagcgacuucugggccgcccuggaggaggccagcagacugcccgugaaggaggugauggacaccuggaccagacagaugggcuaccccgugcugaacgugaacggcgugaagaacaucacccagaagagauuccugcuggaccccagagccaaccccagccagccccccagcgaccugggcuacaccuggaacauccccgugaaguggaccgaggacaacaucaccagcagcgugcuguucaacagaagcgagaaggagggcaucacccugaacagcagcaaccccagcggcaacgccuuccugaagaucaaccccgaccacaucggcuucuacagagugaacuacgagguggccaccugggacagcaucgccaccgcccugagccugaaccacaagaccuucagcagcgccgacagagccagccugaucgacgacgccuucgcccuggccagagcccagcugcuggacuacaagguggcccugaaccugaccaaguaccugaagagagaggagaacuuccugcccuggcagagagugaucagcgccgugaccuacaucaucagcauguucgaggacgacaaggagcuguaccccaugaucgaggaguacuuccagggccaggugaagcccaucgccgacagccugggcuggaacgacgccggcgaccacgugaccaagcugcugagaagcagcgugcugggcuucgccugcaagaugggcgacagagaggcccugaacaacgccagcagccuguucgagcaguggcugaacggcaccgugagccugcccgugaaccugagacugcugguguacagauacggcaugcagaacagcggcaacgagaucagcuggaacuacacccuggagcaguaccagaagaccagccuggcccaggagaaggagaagcugcuguacggccuggccagcgugaagaacgugacccugcugagcagauaccuggaccugcugaaggacaccaaccugaucaagacccaggacguguucaccgugaucagauacaucagcuacaacagcuacggcaagaacauggccuggaacuggauccagcugaacugggacuaccuggugaacagauacacccugaacaacagaaaccugggcagaaucgugaccaucgccgagcccuucaacaccgagcugcagcuguggcagauggagagcuucuucgccaaguacccccaggccggcgccggcgagaagcccagagagcaggugcuggagaccgugaagaacaacaucgaguggcugaagcagcacagaaacaccaucagagagugguucuucaaccugcuggagagcggcuaa

SEQ ID NO: 16623 - RNA, 2778 nt, Artificial Sequence
  ENPP1__Homo_sapiens__NP_006199
auggagagagacggcugcgccggcggcggcagcagaggcggcgagggcggcagagcccccagagagggccccgccggcaacggcagagacagaggcagaagccacgccgccgaggcccccggcgacccccaggccgccgccagccugcuggcccccauggacgugggcgaggagccccuggagaaggccgccagagccagaaccgccaaggaccccaacaccuacaaggugcugagccuggugcugagcgugugcgugcugaccaccauccugggcugcaucuucggccugaagcccagcugcgccaaggaggugaagagcugcaagggcagaugcuucgagagaaccuucggcaacugcagaugcgacgccgccugcguggagcugggcaacugcugccuggacuaccaggagaccugcaucgagcccgagcacaucuggaccugcaacaaguucagaugcggcgagaagagacugaccagaagccugugcgccugcagcgacgacugcaaggacaagggcgacugcugcaucaacuacagcagcgugugccagggcgagaagagcuggguggaggagcccugcgagagcaucaacgagccccagugccccgccggcuucgagaccccccccacccugcuguucagccuggacggcuucagagccgaguaccugcacaccuggggcggccugcugcccgugaucagcaagcugaagaagugcggcaccuacaccaagaacaugagacccguguaccccaccaagaccuuccccaaccacuacagcaucgugaccggccuguaccccgagagccacggcaucaucgacaacaagauguacgaccccaagaugaacgccagcuucagccugaagagcaaggagaaguucaaccccgagugguacaagggcgagcccaucugggugaccgccaaguaccagggccugaagagcggcaccuucuucuggcccggcagcgacguggagaucaacggcaucuuccccgacaucuacaagauguacaacggcagcgugcccuucgaggagagaauccuggccgugcugcaguggcugcagcugcccaaggacgagagaccccacuucuacacccuguaccuggaggagcccgacagcagcggccacagcuacggccccgugagcagcgaggugaucaaggcccugcagagaguggacggcauggugggcaugcugauggacggccugaaggagcugaaccugcacagaugccugaaccugauccugaucagcgaccacggcauggagcagggcagcugcaagaaguacaucuaccugaacaaguaccugggcgacgugaagaacaucaaggugaucuacggccccgccgccagacugagacccagcgacgugcccgacaaguacuacagcuucaacuacgagggcaucgccagaaaccugagcugcagagagcccaaccagcacuucaagcccuaccugaagcacuuccugcccaagagacugcacuucgccaagagcgacagaaucgagccccugaccuucuaccuggacccccaguggcagcuggcccugaaccccagcgagagaaaguacugcggcagcggcuuccacggcagcgacaacguguucagcaacaugcaggcccuguucgugggcuacggccccggcuucaagcacggcaucgaggccgacaccuucgagaacaucgagguguacaaccugaugugcgaccugcugaaccugacccccgcccccaacaacggcacccacggcagccugaaccaccugcugaagaaccccguguacacccccaagcaccccaaggaggugcacccccuggugcagugccccuucaccagaaaccccagagacaaccugggcugcagcugcaaccccagcauccugcccaucgaggacuuccagacccaguucaaccugaccguggccgaggagaagaucaucaagcacgagacccugcccuacggcagacccagagugcugcagaaggagaacaccaucugccugcugagccagcaccaguucaugagcggcuacagccaggacauccugaugccccuguggaccagcuacaccguggacagaaacgacagcuucagcaccgaggacuucagcaacugccuguaccaggacuucagaaucccccugagccccgugcacaagugcagcuucuacaagaacaacaccaaggugagcuacggcuuccugagccccccccagcugaacaagaacagcagcggcaucuacagcgaggcccugcugaccaccaacaucgugcccauguaccagagcuuccaggugaucuggagauacuuccacgacacccugcugagaaaguacgccgaggagagaaacggcgugaacguggugagcggccccguguucgacuucgacuacgacggcagaugcgacagccuggagaaccugagacagaagagaagagugaucagaaaccaggagauccugauccccacccacuucuucaucgugcugaccagcugcaaggacaccagccagaccccccugcacugcgagaaccuggacacccuggccuucauccugccccacagaaccgacaacagcgagagcugcgugcacggcaagcacgacagcagcuggguggaggagcugcugaugcugcacagagccagaaucaccgacguggagcacaucaccggccugagcuucuaccagcagagaaaggagcccgugagcgacauccugaagcugaagacccaccugcccaccuucagccaggaggacuaa

SEQ ID NO: 16624 - RNA, 2592 nt, Artificial Sequence
  ENPP2__Homo_sapiens__NP_001035181
auggccagaagaagcagcuuccagagcugccagaucaucagccuguucaccuucgccgugggcgugaacaucugccugggcuucaccgcccacagaaucaagagagccgagggcugggaggagggcccccccaccgugcugagcgacagccccuggaccaacaucagcggcagcugcaagggcagaugcuucgagcugcaggaggccggcccccccgacugcagaugcgacaaccugugcaagagcuacaccagcugcugccacgacuucgacgagcugugccugaagaccgccagaggcugggagugcaccaaggacagaugcggcgaggugagaaacgaggagaacgccugccacugcagcgaggacugccuggccagaggcgacugcugcaccaacuaccagguggugugcaagggcgagagccacuggguggacgacgacugcgaggagaucaaggccgccgagugccccgccggcuucgugagacccccccugaucaucuucagcguggacggcuucagagccagcuacaugaagaagggcagcaaggugaugcccaacaucgagaagcugagaagcugcggcacccacagccccuacaugagacccguguaccccaccaagaccuuccccaaccuguacacccuggccaccggccuguaccccgagagccacggcaucgugggcaacagcauguacgaccccguguucgacgccaccuuccaccugagaggcagagagaaguucaaccacagaugguggggcggccagccccuguggaucaccgccaccaagcagggcgugaaggccggcaccuucuucuggagcguggugaucccccacgagagaagaauccugaccauccugcaguggcugacccugcccgaccacgagagacccagcguguacgccuucuacagcgagcagcccgacuucagcggccacaaguacggccccuucggccccgagaugaccaacccccugagagagaucgacaagaucgugggccagcugauggacggccugaagcagcugaagcugcacagaugcgugaacgugaucuucgugggcgaccacggcauggaggacgugaccugcgacagaaccgaguuccugagcaacuaccugaccaacguggacgacaucacccuggugcccggcacccugggcagaaucagaagcaaguucagcaacaacgccaaguacgaccccaaggccaucaucgccaaccugaccugcaagaagcccgaccagcacuucaagcccuaccugaagcagcaccugcccaagagacugcacuacgccaacaacagaagaaucgaggacauccaccugcugguggagagaagauggcacguggccagaaagccccuggacguguacaagaagcccagcggcaagugcuucuuccagggcgaccacggcuucgacaacaaggugaacagcaugcagaccguguucgugggcuacggcagcaccuucaaguacaagaccaaggugccccccuucgagaacaucgagcuguacaacgugaugugcgaccugcugggccugaagcccgcccccaacaacggcacccacggcagccugaaccaccugcugagaaccaacaccuucagacccaccaugcccgaggaggugaccagacccaacuaccccggcaucauguaccugcagagcgacuucgaccugggcugcaccugcgacgacaagguggagcccaagaacaagcuggacgagcugaacaagagacugcacaccaagggcagcaccgaggagagacaccugcuguacggcagacccgccgugcuguacagaaccagauacgacauccuguaccacaccgacuucgagagcggcuacagcgagaucuuccugaugccccuguggaccagcuacaccgugagcaagcaggccgaggugagcagcgugcccgaccaccugaccagcugcgugagacccgacgugagagugagccccagcuucagccagaacugccuggccuacaagaacgacaagcagaugagcuacggcuuccuguucccccccuaccugagcagcagccccgaggccaaguacgacgccuuccuggugaccaacauggugcccauguaccccgccuucaagagaguguggaacuacuuccagagagugcuggugaagaaguacgccagcgagagaaacggcgugaacgugaucagcggccccaucuucgacuacgacuacgacggccugcacgacaccgaggacaagaucaagcaguacguggagggcagcagcauccccgugcccacccacuacuacagcaucaucaccagcugccuggacuucacccagcccgccgacaagugcgacggcccccugagcgugagcagcuucauccugccccacagacccgacaacgaggagagcugcaacagcagcgaggacgagagcaaguggguggaggagcugaugaagaugcacaccgccagagugagagacaucgagcaccugaccagccuggacuucuucagaaagaccagcagaagcuaccccgagauccugacccugaagaccuaccugcacaccuacgagagcgagaucuaa

SEQ ID NO: 16625 - RNA, 2628 nt, Artificial Sequence
  ENPP3__Homo_sapiens__NP_005012
auggagagcacccugacccuggccaccgagcagcccgugaagaagaacacccugaagaaguacaagaucgccugcaucgugcugcuggcccugcuggugaucaugagccugggccugggccugggccugggccugagaaagcuggagaagcagggcagcugcagaaagaagugcuucgacgccagcuucagaggccuggagaacugcagaugcgacguggccugcaaggacagaggcgacugcugcugggacuucgaggacaccugcguggagagcaccagaaucuggaugugcaacaaguucagaugcggcgagaccagacuggaggccagccugugcagcugcagcgacgacugccugcagagaaaggacugcugcgccgacuacaagagcgugugccagggcgagaccagcuggcuggaggagaacugcgacaccgcccagcagagccagugccccgagggcuucgaccugccccccgugauccuguucagcauggacggcuucagagccgaguaccuguacaccugggacacccugaugcccaacaucaacaagcugaagaccugcggcauccacagcaaguacaugagagccauguaccccaccaagaccuuccccaaccacuacaccaucgugaccggccuguaccccgagagccacggcaucaucgacaacaacauguacgacgugaaccugaacaagaacuucagccugagcagcaaggagcagaacaaccccgccugguggcacggccagcccauguggcugaccgccauguaccagggccugaaggccgccaccuacuucuggcccggcagcgagguggccaucaacggcagcuuccccagcaucuacaugcccuacaacggcagcgugcccuucgaggagagaaucagcacccugcugaaguggcuggaccugcccaaggccgagagacccagauucuacaccauguacuucgaggagcccgacagcagcggccacgccggcggccccgugagcgccagagugaucaaggcccugcaggugguggaccacgccuucggcaugcugauggagggccugaagcagagaaaccugcacaacugcgugaacaucauccugcuggccgaccacggcauggaccagaccuacugcaacaagauggaguacaugaccgacuacuuccccagaaucaacuucuucuacauguacgagggccccgcccccagaaucagagcccacaacaucccccacgacuucuucagcuucaacagcgaggagaucgugagaaaccugagcugcagaaagcccgaccagcacuucaagcccuaccugacccccgaccugcccaagagacugcacuacgccaagaacgugagaaucgacaaggugcaccuguucguggaccagcaguggcuggccgugagaagcaagagcaacaccaacugcggcggcggcaaccacggcuacaacaacgaguucagaagcauggaggccaucuuccuggcccacggccccagcuucaaggagaagaccgagguggagcccuucgagaacaucgagguguacaaccugaugugcgaccugcugagaauccagcccgcccccaacaacggcacccacggcagccugaaccaccugcugaaggugcccuucuacgagcccagccacgccgaggaggugagcaaguucagcgugugcggcuucgccaacccccugcccaccgagagccuggacugcuucugcccccaccugcagaacagcacccagcuggagcaggugaaccagaugcugaaccugacccaggaggagaucaccgccaccgugaaggugaaccugcccuucggcagacccagagugcugcagaagaacguggaccacugccugcuguaccacagagaguacgugagcggcuucggcaaggccaugagaaugcccauguggagcagcuacaccgugccccagcugggcgacaccagcccccugccccccaccgugcccgacugccugagagccgacgugagagugccccccagcgagagccagaagugcagcuucuaccuggccgacaagaacaucacccacggcuuccuguacccccccgccagcaacagaaccagcgacagccaguacgacgcccugaucaccagcaaccuggugcccauguacgaggaguucagaaagaugugggacuacuuccacagcgugcugcugaucaagcacgccaccgagagaaacggcgugaacguggugagcggccccaucuucgacuacaacuacgacggccacuucgacgcccccgacgagaucaccaagcaccuggccaacaccgacgugcccauccccacccacuacuucguggugcugaccagcugcaagaacaagagccacacccccgagaacugccccggcuggcuggacgugcugcccuucaucaucccccacagacccaccaacguggagagcugccccgagggcaagcccgaggcccuguggguggaggagagauucaccgcccacaucgccagagugagagacguggagcugcugaccggccuggacuucuaccaggacaaggugcagcccgugagcgagauccugcagcugaagaccuaccugcccaccuucgagaccaccaucuaa

SEQ ID NO: 16626 - RNA, 1434 nt, Artificial Sequence
  ENPP5__Homo_sapiens__XP_005249317
augaccagcaaguuccugcuggugagcuucauccuggccgcccugagccugagcaccaccuucagccugcagcccgaccagcagaaggugcugcuggugagcuucgacggcuucagaugggacuaccuguacaaggugcccaccccccacuuccacuacaucaugaaguacggcgugcacgugaagcaggugaccaacguguucaucaccaagaccuaccccaaccacuacacccuggugaccggccuguucgccgagaaccacggcaucguggccaacgacauguucgaccccaucagaaacaagagcuucagccuggaccacaugaacaucuacgacagcaaguucugggaggaggccacccccaucuggaucaccaaccagagagccggccacaccagcggcgccgccauguggcccggcaccgacgugaagauccacaagagauuccccacccacuacaugcccuacaacgagagcgugagcuucgaggacagaguggccaagaucaucgagugguucaccagcaaggagcccaucaaccugggccugcuguacugggaggaccccgacgacaugggccaccaccugggccccgacagcccccugaugggccccgugaucagcgacaucgacaagaagcugggcuaccugauccagaugcugaagaaggccaagcuguggaacacccugaaccugaucaucaccagcgaccacggcaugacccagugcagcgaggagagacugaucgagcuggaccaguaccuggacaaggaccacuacacccugaucgaccagagccccguggccgccauccugcccaaggagggcaaguucgacgagguguacgaggcccugacccacgcccaccccaaccugaccguguacaagaaggaggacgugcccgagagauggcacuacaaguacaacagcagaauccagcccaucaucgccguggccgacgagggcuggcacauccugcagaacaagagcgacgacuuccugcugggcaaccacggcuacgacaacgcccuggccgacaugcaccccaucuuccuggcccacggccccgccuucagaaagaacuucagcaaggaggccaugaacagcaccgaccuguacccccugcugugccaccugcugaacaucaccgccaugccccacaacggcagcuucuggaacgugcaggaccugcugaacagcgccaugcccagaguggugcccuacacccagagcaccauccugcugcccggcagcgugaagcccgccgaguacgaccaggagggcagcuaccccuacuucaucggcgugagccugggcagcaucaucgugaucguguucuucgugaucuucaucaagcaccugauccacagccagauccccgcccugcaggacaugcacgccgagaucgcccagccccugcugcaggccuaa

SEQ ID NO: 16627 - RNA, 1377 nt, Artificial Sequence
  ENPP7__Homo_sapiens__NP_848638
augagaggccccgccgugcugcugaccguggcccuggccacccugcuggcccccggcgccggcgcccccgugcagagccagggcagccagaacaagcugcugcuggugagcuucgacggcuucagauggaacuacgaccaggacguggacacccccaaccuggacgccauggccagagacggcgugaaggccagauacaugacccccgccuucgugaccaugaccagccccugccacuucacccuggugaccggcaaguacaucgagaaccacggcguggugcacaacauguacuacaacaccaccagcaaggugaagcugcccuaccacgccacccugggcauccagagauggugggacaacggcagcgugcccaucuggaucaccgcccagagacagggccugagagccggcagcuucuucuaccccggcggcaacgugaccuaccagggcguggccgugaccagaagcagaaaggagggcaucgcccacaacuacaagaacgagaccgaguggagagccaacaucgacaccgugauggccugguucaccgaggaggaccuggaccuggugacccuguacuucggcgagcccgacagcaccggccacagauacggccccgagagccccgagagaagagagauggugagacagguggacagaaccgugggcuaccugagagagagcaucgccagaaaccaccugaccgacagacugaaccugaucaucaccagcgaccacggcaugaccaccguggacaagagagccggcgaccugguggaguuccacaaguuccccaacuucaccuucagagacaucgaguucgagcugcuggacuacggccccaacggcaugcugcugcccaaggagggcagacuggagaagguguacgacgcccugaaggacgcccaccccaagcugcacguguacaagaaggaggccuuccccgaggccuuccacuacgccaacaaccccagagugaccccccugcugauguacagcgaccugggcuacgugauccacggcagaaucaacgugcaguucaacaacggcgagcacggcuucgacaacaaggacauggacaugaagaccaucuucagagccgugggccccagcuucagagccggccuggagguggagcccuucgagagcgugcacguguacgagcugaugugcagacugcugggcaucgugcccgaggccaacgacggccaccuggccacccugcugcccaugcugcacaccgagagcgcccugccccccgacggcagacccacccugcugcccaagggcagaagcgcccugccccccagcagcagaccccugcuggugaugggccugcugggcaccgugauccugcugagcgagguggccuaa

SEQ ID NO: 16628 - RNA, 1578 nt, Artificial Sequence
  ENTHD2__Homo_sapiens__NP_653280
auggccgccgcccccccccugagagacagacugagcuuccugcacagacugcccauccugcugaagggcaccagcgacgacgacgugcccugccccggcuaccuguucgaggagaucgccaagaucagccacgagagccccggcagcagccagugccugcuggaguaccugcugagcagacugcacagcagcagcggccacggcaagcugaaggugcugaagauccugcuguaccugugcagccacggcagcagcuucuuccugcugauccugaagagaaacagcgccuucauccaggaggccgccgccuucgccggcccccccgacccccugcacggcaacagccuguaccagaaggugagagccgccgcccaggaccugggcagcacccuguucagcgacaccgugcugccccuggcccccagccagccccugggcaccccccccgccaccggcaugggcagccaggccagaccccacagcacccugcagggcuucggcuacagcaaggagcacggcagaaccgccgugagacaccagcccggccaggccggcggcggcugggacgagcuggacagcggccccagcagccagaacagcagccagaacagcgaccugagcagagugagcgacagcggcagccacagcggcagcgacagccacagcggcgccagcagagagcccggcgaccuggccgagagaguggaggugguggcccugagcgacugccagcaggagcugagccuggugagaaccgugaccagaggccccagagccuuccugagcagagaggaggcccagcacuucaucaaggccugcggccugcugaacugcgaggccgugcugcagcugcugaccugccaccugagaggcaccagcgagugcacccagcugagagcccugugcgccaucgccagccugggcagcagcgaccugcugccccaggagcacauccugcugagaaccagacccuggcugcaggagcugagcaugggcagccccggccccgugaccaacaaggccaccaagauccugagacacuucgaggccagcugcggccagcugagccccgccagaggcaccagcgccgagcccggccccaccgccgcccugcccggccccagcgaccugcugaccgacgccgugccccugcccggcagccagguguuccugcagccccugagcagcacccccgugagcagcagaagccccgcccccagcagcggcaugcccagcagccccgugcccacccccccccccgacgccagccccauccccgcccccggcgaccccagcgaggccgaggccagacuggccgagagcagaagauggagacccgagagaauccccggcggcaccgacagccccaagagaggccccagcagcugcgccuggagcagagacagccuguucgccggcauggagcugguggccugccccagacuggugggcgccggcgccgccgccggcgagagcugccccgacgcccccagagccccccagaccagcagccagagaaccgccgccaaggagccccccggcagcgagcccagcgccuucgccuuccugaacgccuaa

SEQ ID NO: 16629 - RNA, 1554 nt, Artificial Sequence
  ENTPD1__Homo_sapiens__NP_001091645
augaagggcaccaaggaccugaccagccagcagaaggagagcaacgugaagaccuucugcagcaagaacauccuggccauccugggcuucagcagcaucaucgccgugaucgcccugcuggccgugggccugacccagaacaaggcccugcccgagaacgugaaguacggcaucgugcuggacgccggcagcagccacaccagccuguacaucuacaaguggcccgccgagaaggagaacgacaccggcguggugcaccagguggaggagugcagagugaagggccccggcaucagcaaguucgugcagaaggugaacgagaucggcaucuaccugaccgacugcauggagagagccagagaggugauccccagaagccagcaccaggagacccccguguaccugggcgccaccgccggcaugagacugcugagaauggagagcgaggagcuggccgacagagugcuggacgugguggagagaagccugagcaacuaccccuucgacuuccagggcgccagaaucaucaccggccaggaggagggcgccuacggcuggaucaccaucaacuaccugcugggcaaguucagccagaagaccagaugguucagcaucgugcccuacgagaccaacaaccaggagaccuucggcgcccuggaccugggcggcgccagcacccaggugaccuucgugccccagaaccagaccaucgagagccccgacaacgcccugcaguucagacuguacggcaaggacuacaacguguacacccacagcuuccugugcuacggcaaggaccaggcccuguggcagaagcuggccaaggacauccagguggccagcaacgagauccugagagaccccugcuuccaccccggcuacaagaagguggugaacgugagcgaccuguacaagacccccugcaccaagagauucgagaugacccugcccuuccagcaguucgagauccagggcaucggcaacuaccagcagugccaccagagcauccuggagcuguucaacaccagcuacugccccuacagccagugcgccuucaacggcaucuuccugcccccccugcagggcgacuucggcgccuucagcgccuucuacuucgugaugaaguuccugaaccugaccagcgagaaggugagccaggagaaggugaccgagaugaugaagaaguucugcgcccagcccugggaggagaucaagaccagcuacgccggcgugaaggagaaguaccugagcgaguacugcuucagcggcaccuacauccugagccugcugcugcagggcuaccacuucaccgccgacagcugggagcacauccacuucaucggcaagauccagggcagcgacgccggcuggacccugggcuacaugcugaaccugaccaacaugauccccgccgagcagccccugagcaccccccugagccacagcaccuacguguuccugauggugcuguucagccuggugcuguucaccguggccaucaucggccugcugaucuuccacaagcccagcuacuucuggaaggacaugguguaa

SEQ ID NO: 16630 - RNA, 1419 nt, Artificial Sequence
  ENTPD2__Homo_sapiens__NP_001237
auggccggcaaggugagaagccugcugcccccccugcugcuggccgccgccggccuggccggccugcugcugcugugcgugcccaccagagacgugagagagccccccgcccugaaguacggcaucgugcuggacgccggcagcagccacaccagcauguucaucuacaaguggcccgccgacaaggagaacgacaccggcaucgugggccagcacagcagcugcgacgugcccggcggcggcaucagcagcuacgccgacaaccccagcggcgccagccagagccuggugggcugccuggagcaggcccugcaggacgugcccaaggagagacacgccggcaccccccuguaccugggcgccaccgccggcaugagacugcugaaccugaccaaccccgaggccagcaccagcgugcugauggccgugacccacacccugacccaguaccccuucgacuucagaggcgccagaauccugagcggccaggaggagggcguguucggcugggugaccgccaacuaccugcuggagaacuucaucaaguacggcugggugggcagaugguucagacccagaaagggcacccugggcgccauggaccugggcggcgccagcacccagaucaccuucgagaccaccagccccgccgaggacagagccagcgaggugcagcugcaccuguacggccagcacuacagaguguacacccacagcuuccugugcuacggcagagaccaggugcugcagagacugcuggccagcgcccugcagacccacggcuuccaccccugcuggcccagaggcuucagcacccaggugcugcugggcgacguguaccagagccccugcaccauggcccagagaccccagaacuucaacagcagcgccagagugagccugagcggcagcagcgacccccaccugugcagagaccuggugagcggccuguucagcuucagcagcugccccuucagcagaugcagcuucaacggcguguuccagccccccguggccggcaacuucguggccuucagcgccuucuucuacaccguggacuuccugagaaccagcaugggccugcccguggccacccugcagcagcuggaggccgccgccgugaacgugugcaaccagaccugggcccagcagcugcugagcagaggcuacggcuucgacgagagagccuucggcggcgugaucuuccagaagaaggccgccgacaccgccgugggcugggcccugggcuacaugcugaaccugaccaaccugauccccgccgacccccccggccugagaaagggcaccgacuucagcagcuggguggugcugcugcugcuguucgccagcgcccugcuggccgcccuggugcugcugcugagacaggugcacagcgccaagcugcccagcaccaucuaa

SEQ ID NO: 16631 - RNA, 1827 nt, Artificial Sequence
  ENTPD4__Homo_sapiens__NP_001122402
augggcagaaucggcaucagcugccuguuccccgccagcuggcacuucagcaucagccccgugggcugccccagaauccugaacaccaaccugagacagaucauggugaucagcgugcuggccgccgccgugagccugcuguacuucagcguggugaucaucagaaacaaguacggcagacugaccagagacaagaaguuccagagauaccuggccagagugaccgacaucgaggccaccgacaccaacaaccccaacgugaacuacggcaucgugguggacugcggcagcagcggcagcagaguguucguguacugcuggcccagacacaacggcaacccccacgaccugcuggacaucagacagaugagagacaagaacagaaagcccguggugaugaagaucaagcccggcaucagcgaguucgccaccagccccgagaaggugagcgacuacaucagcccccugcugaacuucgccgccgagcacgugcccagagccaagcacaaggagaccccccuguacauccugugcaccgccggcaugagaauccugcccgagagccagcagaaggccauccuggaggaccugcugaccgacauccccgugcacuucgacuuccuguucagcgacagccacgccgaggugaucagcggcaagcaggagggcguguacgccuggaucggcaucaacuucgugcugggcagauucgagcacaucgaggacgacgacgaggccgugguggaggugaacauccccggcagcgagagcagcgaggccaucgugagaaagagaaccgccggcauccuggacaugggcggcgugagcacccagaucgccuacgaggugcccaagaccgaggagguggccaagaaccugcuggccgaguucaaccugggcugcgacgugcaccagaccgagcacguguacagaguguacguggccaccuuccugggcuucggcggcaacgccgccagacagagauacgaggacagaaucuucgccaacaccauccagaagaacagacugcugggcaagcagaccggccugacccccgacaugcccuaccuggaccccugccugccccuggacaucaaggacgagauccagcagaacggccagaccaucuaccugagaggcaccggcgacuucgaccugugcagagagaccauccagcccuucaugaacaagaccaacgagacccagaccagccugaacggcguguaccagccccccauccacuuccagaacagcgaguucuacggcuucagcgaguucuacuacugcaccgaggacgugcugagaaugggcggcgacuacaacgccgccaaguucaccaaggccgccaaggacuacugcgccaccaaguggagcauccugagagagagauucgacagaggccuguacgccagccacgccgaccugcacagacugaaguaccagugcuucaagagcgccuggauguucgagguguuccacagaggcuucagcuuccccgugaacuacaagagccugaagaccgcccugcagguguacgacaaggaggugcaguggacccugggcgccauccuguacagaaccagauuccugccccugagagacauccagcaggaggccuucagagccagccacacccacuggagaggcgugagcuucguguacaaccacuaccuguucagcggcugcuuccugguggugcugcuggccauccugcuguaccugcugagacugagaagaauccacagaagaacccccagaagcagcagcgccgccgcccuguggauggaggagggccugcccgcccagaacgcccccggcacccuguaa

SEQ ID NO: 16632 - RNA, 1287 nt, Artificial Sequence
  ENTPD5__Homo_sapiens__XP_006720387
auggccaccagcuggggcaccguguucuucaugcugguggugagcugcgugugcagcgccgugagccacagaaaccagcagaccugguucgagggcaucuuccugagcagcaugugccccaucaacgugagcgccagcacccuguacggcaucauguucgacgccggcagcaccggcaccagaauccacguguacaccuucgugcagaagaugcccggccagcugcccauccuggagggcgagguguucgacagcgugaagcccggccugagcgccuucguggaccagcccaagcagggcgccgagaccgugcagggccugcuggagguggccaaggacagcauccccagaagccacuggaagaagacccccguggugcugaaggccaccgccggccugagacugcugcccgagcacaaggccaaggcccugcuguucgaggugaaggagaucuucagaaagagccccuuccuggugcccaagggcagcgugagcaucauggacggcagcgacgagggcauccuggccugggugaccgugaacuuccugaccggccagcugcacggccacagacaggagaccgugggcacccuggaccugggcggcgccagcacccagaucaccuuccugccccaguucgagaagacccuggagcagacccccagaggcuaccugaccagcuucgagauguucaacagcaccuacaagcuguacacccacagcuaccugggcuucggccugaaggccgccagacuggccacccugggcgcccuggagaccgagggcaccgacggccacaccuucagaagcgccugccugcccagauggcuggaggccgaguggaucuucggcggcgugaaguaccaguacggcggcaaccaggagggcgaggugggcuucgagcccugcuacgccgaggugcugagaguggugagaggcaagcugcaccagcccgaggaggugcagagaggcagcuucuacgccuucagcuacuacuacgacagagccguggacaccgacaugaucgacuacgagaagggcggcauccugaagguggaggacuucgagagaaaggccagagaggugugcgacaaccuggagaacuucaccagcggcagccccuuccugugcauggaccugagcuacaucaccgcccugcugaaggacggcuucggcuucgccgacagcaccgugcugcagcugaccaagaaggugaacaacaucgagaccggcugggcccugggcgccaccuuccaccugcugcagagccugggcaucagccacuaa

SEQ ID NO: 16633 - RNA, 1404 nt, Artificial Sequence
  ENTPD6__Homo_sapiens__NP_001107561
augcagccccagcacggccccuggcagaccagaaugagaaagaucagcaaccacggcagccugagaguggccaagguggccuacccccugggccugugcgugggcguguucaucuacguggccuacaucaaguggcacagagccaccgccacccaggccuucuucagcaucaccagagccgcccccggcgccagauggggccagcaggcccacagcccccugggcaccgccgccgacggccacgagguguucuacggcaucauguucgacgccggcagcaccggcaccagagugcacguguuccaguucaccagaccccccagagagacccccacccugacccacgagaccuucaaggcccugaagcccggccugagcgccuacgccgacgacguggagaagagcgcccagggcaucagagagcugcuggacguggccaagcaggacauccccuucgacuucuggaaggccaccccccuggugcugaaggccaccgccggccugagacugcugcccggcgagaaggcccagaagcugcugcagaaggugaaggagguguucaaggccagccccuuccuggugggcgacgacugcgugagcaucaugaacggcaccgacgagggcgugagcgccuggaucaccaucaacuuccugaccggcagccugaagacccccggcggcagcagcgugggcaugcuggaccugggcggcggcagcacccagaucgccuuccugcccagaguggagggcacccugcaggccagcccccccggcuaccugaccgcccugagaauguucaacagaaccuacaagcuguacagcuacagcuaccugggccugggccugaugagcgccagacuggccauccugggcggcguggagggccagcccgccaaggacggcaaggagcuggugagccccugccugagccccagcuucaagggcgagugggagcacgccgaggugaccuacagagugagcggccagaaggccgccgccagccugcacgagcugugcgccgccagagugagcgaggugcugcagaacagagugcacagaaccgaggaggugaagcacguggacuucuacgccuucagcuacuacuacgaccuggccgccggcgugggccugaucgacgccgagaagggcggcagccugguggugggcgacuucgagaucgccgccaaguacgugugcagaacccuggagacccagccccagagcagccccuucagcugcauggaccugaccuacgugagccugcugcugcaggaguucggcuuccccagaagcaaggugcugaagcugaccagaaagaucgacaacguggagaccagcugggcccugggcgccaucuuccacuacaucgacagccugaacagacagaagagccccgccagcuaa

SEQ ID NO: 16634 - RNA, 1815 nt, Artificial Sequence
  ENTPD7__Homo_sapiens__NP_065087
auggccagaaucagcuucagcuaccugugccccgccagcugguacuucaccgugcccaccgugagccccuuccugagacagagaguggccuuccugggccuguucuucaucagcugccugcugcugcugaugcugaucaucgacuucagacacuggagcgccagccugcccagagacagacaguacgagagauaccuggccagagugggcgagcuggaggccaccgacaccgaggaccccaaccugaacuacggccuggugguggacugcggcagcagcggcagcagaaucuucguguacuucuggcccagacacaacggcaacccccacgaccugcuggacaucaagcagaugagagacagaaacagccagcccguggugaagaagaucaagcccggcaucagcgccauggccgacacccccgagcacgccagcgacuaccugagaccccugcugagcuucgccgccgcccacgugcccgugaagaagcacaaggagaccccccuguacauccugugcaccgccggcaugagacugcugcccgagagaaagcagcuggccauccuggccgaccuggugaaggaccugccccuggaguucgacuuccuguucagccagagccaggccgaggugaucagcggcaagcaggagggcguguacgccuggaucggcaucaacuucgugcugggcagauucgaccacgaggacgagagcgacgccgaggccacccaggagcuggccgccggcagaagaagaaccgugggcauccuggacaugggcggcgccagccugcagaucgccuacgaggugcccaccagcaccagcgugcugcccgccaagcaggaggaggccgccaagauccugcuggccgaguucaaccugggcugcgacgugcagcacaccgagcacguguacagaguguacgugaccaccuuccugggcuucggcggcaacuucgccagacagagauacgaggaccuggugcugaacgagacccugaacaagaacagacugcugggccagaagaccggccugagccccgacaaccccuuccuggaccccugccugcccgugggccugaccgacgugguggagagaaacagccaggugcugcacgugagaggcagaggcgacugggugagcugcggcgccaugcugagcccccugcuggccagaagcaacaccagccaggccagccugaacggcaucuaccagagccccaucgacuucaacaacagcgaguucuacggcuucagcgaguucuucuacugcaccgaggacgugcugagaaucggcggcagauaccacggccccaccuucgccaaggccgcccaggacuacugcggcauggccuggagcgugcugacccagagauucaagaacggccuguucagcagccacgccgacgagcacagacugaaguaccagugcuucaagagcgccuggauguaccaggugcugcacgagggcuuccacuuccccuacgacuaccccaaccugagaaccgcccagcugguguacgacagagaggugcaguggacccugggcgccauccuguacaagaccagauuccugccccugagagaccugagacaggagggcgugagacaggcccacggcagcugguucagacugagcuucguguacaaccacuaccuguucuucgccugcauccugguggugcugcuggccaucuuccuguaccugcugagacugagaagaauccaccacagacagaccagagccagcgccccccuggaccugcuguggcuggaggagguggugcccaugaugggcgugcaggugggccccuaa

SEQ ID NO: 16635 - RNA, 1584 nt, Artificial Sequence
  EOGT__Homo_sapiens__NP_001265618
augcugaugcuguucguguucggcgugcugcugcacgaggugagccugagcggccagaacgaggccccccccaacacccacagcauccccggcgagccccuguacaacuacgccagcaucagacugcccgaggagcacauccccuucuuccugcacaacaacagacacaucgccaccgugugcagaaaggacagccugugccccuacaagaagcaccuggagaagcugaaguacugcuggggcuacgagaagagcugcaagcccgaguucagauucggcuaccccgugugcagcuacguggacaugggcuggaccgacacccuggagagcgccgaggacaucuucuggaagcaggccgacuucggcuacgccagagagagacuggaggagaugcacgugcugugccagcccaaggagaccagcgacagcagccuggugugcagcagauaccugcaguacugcagagccaccaaccuguaccuggaccugagaaacaucaagagaaaccacgacagauucaaggaggacuucuuccagagcggcgagaucggcggccacugcaagcuggacaucagaacccugaccagcgagggccagagaaagagcccccugcagagcugguucgccgagcugcagagcuacacccagcugaacuucagacccaucgaggacgccaagugcgacaucgugaucgagaagcccaccuacuucaugaagcuggacgccggcgugaacauguaccaccacuucugcgacuucaucaaccuguacaucacccagcacgugaacaacagcuucagcaccgacguguacaucgugaugugggacaccagcagcuacggcuacggcgaccuguucagcgacaccuggaacgccuucaccgacuacgacgugauccaccugaagaccuacgacagcaagagagugugcuucaaggaggccguguucagccugcugcccagaaugagauacggccuguucuacaacaccccccugaucagcggcugccagaacaccggccuguucagagccuucgcccagcacgugcugcacagacugaacaucacccaggagggccccaaggacggcaagaucagagugaccauccuggccagaagcaccgaguacagaaagauccugaaccagaacgagcuggugaacgcccugaagaccgugagcaccuucgaggugcagaucguggacuacaaguacagagagcugggcuuccuggaccagcugagaaucacccacaacaccgacaucuucaucggcaugcacggcgccggccugacccaccugcuguuccugcccgacugggccgccguguucgagcuguacaacugcgaggacgagagaugcuaccuggaccuggccagacugagaggcgugcacuacaucaccuggagaagacagaacaagguguucccccaggacaagggccaccaccccacccugggcgagcaccccaaguucaccaacuacagcuucgacguggaggaguucauguaccuggugcugcaggccgccgaccacgugcugcagcaccccaaguggcccuucaagaagaagcacgacgagcuguaa

SEQ ID NO: 16636 - RNA, 2118 nt, Artificial Sequence
  EOMES__Homo_sapiens__NP_001265111
augcagcugggcgagcagcugcuggugagcagcgugaaccugcccggcgcccacuucuacccccuggagagcgccagaggcggcagcggcggcagcgccggccaccugcccagcgccgcccccagcccccagaagcuggaccuggacaaggccagcaagaaguucagcggcagccugagcugcgaggccgugagcggcgagcccgccgccgccagcgccggcgcccccgccgccaugcugagcgacaccgacgccggcgacgccuucgccagcgccgccgccguggccaagcccggcccccccgacggcagaaagggcagccccugcggcgaggaggagcugcccagcgccgccgccgccgccgccgccgccgccgccgccgccgccgccaccgccagauacagcauggacagccugagcagcgagagauacuaccugcagagccccggcccccagggcagcgagcuggccgcccccugcagccuguuccccuaccaggccgccgccggcgccccccacggccccguguaccccgcccccaacggcgccagauaccccuacggcagcaugcugccccccggcggcuuccccgccgccgugugcccccccggcagagcccaguucggccccggcgccggcgccggcagcggcgccggcggcagcagcggcggcggcggcggccccggcaccuaccaguacagccagggcgccccccuguacggccccuaccccggcgccgccgccgccggcagcugcggcggccugggcggccugggcgugcccggcagcggcuucagagcccacguguaccugugcaacagaccccuguggcugaaguuccacagacaccagaccgagaugaucaucaccaagcagggcagaagaauguuccccuuccugagcuucaacaucaacggccugaaccccaccgcccacuacaacguguucguggagguggugcuggccgaccccaaccacuggagauuccagggcggcaagugggugaccugcggcaaggccgacaacaacaugcagggcaacaagauguacgugcaccccgagagccccaacaccggcagccacuggaugagacaggagaucagcuucggcaagcugaagcugaccaacaacaagggcgccaacaacaacaacacccagaugaucgugcugcagagccugcacaaguaccagcccagacugcacaucguggaggugaccgaggacggcguggaggaccugaacgagcccagcaagacccagaccuucaccuucagcgagacccaguucaucgccgugaccgccuaccagaacaccgacaucacccagcugaagaucgaccacaaccccuucgccaagggcuucagagacaacuacgacagcauguacaccgccagcgagaacgacagacugacccccagccccaccgacagccccagaagccaccagaucgugcccggcggcagauacggcgugcagagcuucuuccccgagcccuucgugaacacccugccccaggccagauacuacaacggcgagagaaccgugccccagaccaacggccugcugagcccccagcagagcgaggagguggccaaccccccccagagauggcuggugacccccgugcagcagcccggcaccaacaagcuggacaucagcagcuacgagagcgaguacaccagcagcacccugcugcccuacggcaucaagagccugccccugcagaccagccacgcccugggcuacuaccccgaccccaccuuccccgccauggccggcuggggcggcagaggcagcuaccagagaaagauggccgccggccugcccuggaccagcagaaccagccccaccguguucagcgaggaccagcugagcaaggagaaggugaaggaggagaucggcagcagcuggaucgagaccccccccagcaucaagagccuggacagcaacgacagcggcguguacaccagcgccugcaagagaagaagacugagccccagcaacagcagcaacgagaacagccccagcaucaagugcgaggacaucaacgccgaggaguacagcaaggacaccagcaagggcaugggcggcuacuacgccuucuacaccacccccuaa

SEQ ID NO: 16637 - RNA, 7245 nt, Artificial Sequence
  EP300__Homo_sapiens__NP_001420
auggccgagaacgugguggagcccggcccccccagcgccaagagacccaagcugagcagccccgcccugagcgccagcgccagcgacggcaccgacuucggcagccuguucgaccuggagcacgaccugcccgacgagcugaucaacagcaccgagcugggccugaccaacggcggcgacaucaaccagcugcagaccagccugggcauggugcaggacgccgccagcaagcacaagcagcugagcgagcugcugagaagcggcagcagccccaaccugaacaugggcgugggcggccccggccaggugauggccagccaggcccagcagagcagccccggccugggccugaucaacagcauggugaagagccccaugacccaggccggccugaccagccccaacaugggcaugggcaccagcggccccaaccagggccccacccagagcaccggcaugaugaacagccccgugaaccagcccgccaugggcaugaacaccggcaugaacgccggcaugaaccccggcaugcuggccgccggcaacggccagggcaucaugcccaaccaggugaugaacggcagcaucggcgccggcagaggcagacagaacaugcaguaccccaaccccggcaugggcagcgccggcaaccugcugaccgagccccugcagcagggcagcccccagaugggcggccagaccggccugagaggcccccagccccugaagaugggcaugaugaacaaccccaaccccuacggcagccccuacacccagaaccccggccagcagaucggcgccagcggccugggccugcagauccagaccaagaccgugcugagcaacaaccugagccccuucgccauggacaagaaggccgugcccggcggcggcaugcccaacaugggccagcagcccgccccccaggugcagcagcccggccuggugacccccguggcccagggcaugggcagcggcgcccacaccgccgaccccgagaagagaaagcugauccagcagcagcuggugcugcugcugcacgcccacaagugccagagaagagagcaggccaacggcgaggugagacagugcaaccugccccacugcagaaccaugaagaacgugcugaaccacaugacccacugccagagcggcaagagcugccagguggcccacugcgccagcagcagacagaucaucagccacuggaagaacugcaccagacacgacugccccgugugccugccccugaagaacgccggcgacaagagaaaccagcagcccauccugaccggcgcccccgugggccugggcaaccccagcagccugggcgugggccagcagagcgcccccaaccugagcaccgugagccagaucgaccccagcagcaucgagagagccuacgccgcccugggccugcccuaccaggugaaccagaugcccacccagccccaggugcaggccaagaaccagcagaaccagcagcccggccagagcccccagggcaugagacccaugagcaacaugagcgccagccccaugggcgugaacggcggcgugggcgugcagacccccagccugcugagcgacagcaugcugcacagcgccaucaacagccagaaccccaugaugagcgagaacgccagcgugcccagccugggccccaugcccaccgccgcccagcccagcaccaccggcaucagaaagcaguggcacgaggacaucacccaggaccugagaaaccaccuggugcacaagcuggugcaggccaucuuccccacccccgaccccgccgcccugaaggacagaagaauggagaaccugguggccuacgccagaaagguggagggcgacauguacgagagcgccaacaacagagccgaguacuaccaccugcuggccgagaagaucuacaagauccagaaggagcuggaggagaagagaagaaccagacugcagaagcagaacaugcugcccaacgccgccggcauggugcccgugagcaugaaccccggccccaacaugggccagccccagcccggcaugaccagcaacggcccccugcccgaccccagcaugaucagaggcagcgugcccaaccagaugaugcccagaaucaccccccagagcggccugaaccaguucggccagaugagcauggcccagccccccaucgugcccagacagacccccccccugcagcaccacggccagcuggcccagcccggcgcccugaacccccccaugggcuacggccccagaaugcagcagcccagcaaccagggccaguuccugccccagacccaguuccccagccagggcaugaacgugaccaacaucccccuggcccccagcagcggccaggcccccgugagccaggcccagaugagcagcagcagcugccccgugaacagccccaucaugccccccggcagccagggcagccacauccacugcccccagcugccccagcccgcccugcaccagaacagccccagccccgugcccagcagaacccccaccccccaccacaccccccccagcaucggcgcccagcagccccccgccaccaccauccccgcccccgugcccaccccccccgccaugccccccggcccccagagccaggcccugcaccccccccccagacagacccccaccccccccaccacccagcugccccagcaggugcagcccagccugcccgccgcccccagcgccgaccagccccagcagcagcccagaagccagcagagcaccgccgccagcgugcccacccccaccgccccccugcugcccccccagcccgccaccccccugagccagcccgccgugagcaucgagggccaggugagcaacccccccagcaccagcagcaccgaggugaacagccaggccaucgccgagaagcagcccagccaggaggugaagauggaggccaagauggagguggaccagcccgagcccgccgacacccagcccgaggacaucagcgagagcaagguggaggacugcaagauggagagcaccgagaccgaggagagaagcaccgagcugaagaccgagaucaaggaggaggaggaccagcccagcaccagcgccacccagagcagccccgcccccggccagagcaagaagaagaucuucaagcccgaggagcugagacaggcccugaugcccacccuggaggcccuguacagacaggaccccgagagccugcccuucagacagcccguggacccccagcugcugggcauccccgacuacuucgacaucgugaagagccccauggaccugagcaccaucaagagaaagcuggacaccggccaguaccaggagcccuggcaguacguggacgacaucuggcugauguucaacaacgccuggcuguacaacagaaagaccagcagaguguacaaguacugcagcaagcugagcgagguguucgagcaggagaucgaccccgugaugcagagccugggcuacugcugcggcagaaagcuggaguucagcccccagacccugugcugcuacggcaagcagcugugcaccauccccagagacgccaccuacuacagcuaccagaacagauaccacuucugcgagaagugcuucaacgagauccagggcgagagcgugagccugggcgacgaccccagccagccccagaccaccaucaacaaggagcaguucagcaagagaaagaacgacacccuggaccccgagcuguucguggagugcaccgagugcggcagaaagaugcaccagaucugcgugcugcaccacgagaucaucuggcccgccggcuucgugugcgacggcugccugaagaagagcgccagaaccagaaaggagaacaaguucagcgccaagagacugcccagcaccagacugggcaccuuccuggagaacagagugaacgacuuccugagaagacagaaccaccccgagagcggcgaggugaccgugagaguggugcacgccagcgacaagaccguggaggugaagcccggcaugaaggccagauucguggacagcggcgagauggccgagagcuuccccuacagaaccaaggcccuguucgccuucgaggagaucgacggcguggaccugugcuucuucggcaugcacgugcaggaguacggcagcgacugccccccccccaaccagagaagaguguacaucagcuaccuggacagcgugcacuucuucagacccaagugccugagaaccgccguguaccacgagauccugaucggcuaccuggaguacgugaagaagcugggcuacaccaccggccacaucugggccugcccccccagcgagggcgacgacuacaucuuccacugccacccccccgaccagaagauccccaagcccaagagacugcaggagugguacaagaagaugcuggacaaggccgugagcgagagaaucgugcacgacuacaaggacaucuucaagcaggccaccgaggacagacugaccagcgccaaggagcugcccuacuucgagggcgacuucuggcccaacgugcuggaggagagcaucaaggagcuggagcaggaggaggaggagagaaagagagaggagaacaccagcaacgagagcaccgacgugaccaagggcgacagcaagaacgccaagaagaagaacaacaagaagaccagcaagaacaagagcagccugagcagaggcaacaagaagaagcccggcaugcccaacgugagcaacgaccugagccagaagcuguacgccaccauggagaagcacaaggagguguucuucgugaucagacugaucgccggccccgccgccaacagccugccccccaucguggaccccgacccccugauccccugcgaccugauggacggcagagacgccuuccugacccuggccagagacaagcaccuggaguucagcagccugagaagagcccaguggagcaccaugugcaugcugguggagcugcacacccagagccaggacagauucguguacaccugcaacgagugcaagcaccacguggagaccagauggcacugcaccgugugcgaggacuacgaccugugcaucaccugcuacaacaccaagaaccacgaccacaagauggagaagcugggccugggccuggacgacgagagcaacaaccagcaggccgccgccacccagagccccggcgacagcagaagacugagcauccagagaugcauccagagccuggugcacgccugccagugcagaaacgccaacugcagccugcccagcugccagaagaugaagagaguggugcagcacaccaagggcugcaagagaaagaccaacggcggcugccccaucugcaagcagcugaucgcccugugcugcuaccacgccaagcacugccaggagaacaagugccccgugcccuucugccugaacaucaagcagaagcugagacagcagcagcugcagcacagacugcagcaggcccagaugcugagaagaagaauggccagcaugcagagaaccggcguggugggccagcagcagggccugcccagccccacccccgccacccccaccacccccaccggccagcagcccaccaccccccagaccccccagcccaccagccagccccagcccaccccccccaacagcaugccccccuaccugcccagaacccaggccgccggccccgugagccagggcaaggccgccggccaggugaccccccccacccccccccagaccgcccagcccccccugcccggccccccccccgccgccguggagauggccaugcagauccagagagccgccgagacccagagacagauggcccacgugcagaucuuccagagacccauccagcaccagaugccccccaugacccccauggcccccaugggcaugaaccccccccccaugaccagaggccccagcggccaccuggagcccggcaugggccccaccggcaugcagcagcagccccccuggagccagggcggccugccccagccccagcagcugcagagcggcaugcccagacccgccaugaugagcguggcccagcacggccagccccugaacauggccccccagcccggccugggccaggugggcaucagcccccugaagcccggcaccgugagccagcaggcccugcagaaccugcugagaacccugagaagccccagcagcccccugcagcagcagcaggugcugagcauccugcacgccaacccccagcugcuggccgccuucaucaagcagagagccgccaaguacgccaacagcaacccccagcccauccccggccagcccggcaugccccagggccagcccggccugcagccccccaccaugcccggccagcagggcgugcacagcaaccccgccaugcagaacaugaaccccaugcaggccggcgugcagagagccggccugccccagcagcagccccagcagcagcugcagccccccaugggcggcaugagcccccaggcccagcagaugaacaugaaccacaacaccaugcccagccaguucagagacauccugagaagacagcagaugaugcagcagcagcagcagcagggcgccggccccggcaucggccccggcauggccaaccacaaccaguuccagcagccccagggcgugggcuaccccccccagcagcagcagagaaugcagcaccacaugcagcagaugcagcagggcaacaugggccagaucggccagcugccccaggcccugggcgccgaggccggcgccagccugcaggccuaccagcagagacugcugcagcagcagaugggcagccccgugcagcccaaccccaugagcccccagcagcacaugcugcccaaccaggcccagagcccccaccugcagggccagcagauccccaacagccugagcaaccaggugagaagcccccagcccgugcccagccccagaccccagagccagcccccccacagcagccccagccccagaaugcagccccagcccagcccccaccacgugagcccccagaccagcagcccccaccccggccugguggccgcccaggccaaccccauggagcagggccacuucgccagccccgaccagaacagcaugcugagccagcuggccagcaaccccggcauggccaaccugcacggcgccagcgccaccgaccugggccugagcaccgacaacagcgaccugaacagcaaccugagccagagcacccuggacauccacuaa

SEQ ID NO: 16638 - RNA, 9372 nt, Artificial Sequence
  EP400__Homo_sapiens__NP_056224
augcaccacggcaccggcccccagaacgugcagcaccagcugcagagaagcagagccugccccggcagcgagggcgaggagcagcccgcccaccccaaccccccccccagccccgccgcccccuucgcccccagcgccagccccagcgccccccagagccccagcuaccagauccagcagcugaugaacagaagccccgccaccggccagaacgugaacaucacccugcagagcgugggccccguggugggcggcaaccagcagaucacccuggccccccugccccugcccagccccaccagccccggcuuccaguucagcgcccagcccagaagauucgagcacggcagccccagcuacauccaggugaccagcccccugagccagcaggugcagacccagagccccacccagcccagccccggccccggccaggcccugcagaacgugagagccggcgcccccggccccggccugggccugugcagcagcagccccaccggcggcuucguggacgccagcgugcuggugagacagaucagccugagccccagcagcggcggccacuucguguuccaggacggcagcggccugacccagaucgcccagggcgcccaggugcagcugcagcaccccggcacccccaucaccgugagagagagaagacccagccagccccacacccagagcggcggcaccauccaccaccugggcccccagagccccgccgccgccggcggcgccggccugcagccccuggccagccccagccacaucaccaccgccaaccugcccccccagaucagcagcaucauccagggccagcuggugcagcagcagcaggugcugcagggccccccccugcccagaccccugggcuucgagagaacccccggcgugcugcugcccggcgccggcggcgccgccggcuucggcaugaccagcccccccccccccaccagccccagcagaaccgccgugccccccggccugagcagccugccccugaccagcgugggcaacaccggcaugaagaaggugcccaagaagcuggaggagaucccccccgccagccccgagauggcccagaugagaaagcagugccuggacuaccacuaccaggagaugcaggcccugaaggagguguucaaggaguaccugaucgagcuguucuuccugcagcacuuccagggcaacaugauggacuuccuggccuucaagaagaagcacuacgccccccugcaggccuaccugagacagaacgaccuggacaucgaggaggaggaggaggaggaggaggaggaggaggagaagagcgaggugaucaacgacgagcagcaggcccuggccggcagccugguggccggcgccggcagcaccguggagaccgaccuguucaagagacagcaggccaugcccagcaccggcauggccgagcagagcaagagacccagacuggaggugggccaccagggcgugguguuccagcaccccggcgccgacgccggcgugccccugcagcagcugaugcccaccgcccagggcggcaugccccccaccccccaggccgcccagcuggccggccagagacagagccagcagcaguacgaccccagcaccggcccccccgugcagaacgccgccagccugcacaccccccugccccagcugcccggcagacugccccccgccggcgugcccaccgccgcccugagcagcgcccugcaguucgcccagcagccccaggugguggaggcccagacccagcugcagauccccgugaagacccagcagcccaacgugcccauccccgccccccccagcagccagcugcccaucccccccagccagcccgcccagcuggcccugcacgugcccacccccggcaaggugcaggugcaggccagccagcugagcagccugccccagaugguggccagcaccagacugcccguggaccccgccccccccugccccagaccccugcccaccagcagcaccagcagccuggcccccgugagcggcagcggccccggccccagccccgccagaagcagccccgugaacagacccagcagcgccaccaacaaggcccugagccccgugaccagcagaacccccggcgugguggccagcgcccccaccaagccccagagccccgcccagaacgccaccagcagccaggacagcagccaggacacccugaccgagcagaucacccuggagaaccaggugcaccagagaaucgccgagcugagaaaggccggccuguggagccagagaagacugcccaagcugcaggaggcccccagacccaagagccacugggacuaccugcuggaggagaugcaguggauggccaccgacuucgcccaggagagaagauggaagguggccgccgccaagaagcuggugagaaccguggugagacaccacgaggagaagcagcugagagaggagagaggcaagaaggaggagcagagcagacugagaagaaucgccgccagcaccgccagagagaucgagugcuucuggagcaacaucgagcaggugguggagaucaagcugagaguggagcuggaggagaagagaaagaaggcccugaaccugcagaaggugagcagaagaggcaaggagcugagacccaagggcuucgacgcccugcaggagagcagccuggacagcggcaugagcggcagaaagagaaaggccagcaucagccugaccgacgacgagguggacgacgaggaggagaccaucgaggaggaggaggccaacgagggcgugguggaccaccagaccgagcugagcaaccuggccaaggaggccgagcugccccugcuggaccugaugaagcuguacgagggcgccuuccugcccagcagccaguggcccagacccaagcccgacggcgaggacaccagcggcgaggaggacgccgacgacugccccggcgacagagagagcagaaaggaccuggugcugaucgacagccuguucaucauggaccaguucaaggccgccgagagaaugaacaucggcaagcccaacgccaaggacaucgccgacgugaccgccguggccgaggccauccugcccaagggcagcgccagagugaccaccagcgugaaguucaacgcccccagccugcuguacggcgcccugagagacuaccagaagaucggccuggacuggcuggccaagcuguacagaaagaaccugaacggcauccuggccgacgaggccggccugggcaagaccgugcagaucaucgccuucuucgcccaccuggccugcaacgagggcaacuggggcccccaccuggugguggugagaagcugcaacauccugaagugggagcuggagcugaagagauggugccccggccugaagauccugagcuacaucggcagccacagagagcugaaggccaagagacaggagugggccgagcccaacagcuuccacgugugcaucaccagcuacacccaguucuucagaggccugaccgccuucaccagagugagauggaagugccuggugaucgacgagaugcagagagugaagggcaugaccgagagacacugggaggccguguucacccugcagagccagcagagacugcugcugaucgacagcccccugcacaacaccuuccuggagcuguggaccauggugcacuuccuggugcccggcaucagcagacccuaccugagcagcccccugagagcccccagcgaggagagccaggacuacuaccacaagguggugaucagacugcacagagugacccagcccuucauccugagaagaaccaagagagacguggagaagcagcugaccaagaaguacgagcacgugcugaagugcagacugagcaacagacagaaggcccuguacgaggacgugauccugcagcccggcacccaggaggcccugaagagcggccacuucgugaacgugcugagcauccuggugagacugcagagaaucugcaaccaccccggccugguggagcccagacaccccggcagcagcuacguggccggcccccuggaguaccccagcgccagccugauccugaaggcccuggagagagacuucuggaaggaggccgaccugagcauguucgaccugaucggccuggagaacaagaucaccagacacgaggccgagcugcugagcaagaagaagauccccagaaagcugauggaggagaucagcaccagcgccgcccccgccgccagacccgccgccgccaagcugaaggccagcagacuguuccagcccgugcaguacggccagaagcccgagggcagaaccguggccuuccccagcacccacccccccagaaccgccgcccccaccaccgccagcgccgccccccagggcccccugagaggcagaccccccaucgccaccuucagcgccaaccccgaggccaaggccgccgccgcccccuuccagaccagccaggccagcgccagcgcccccagacaccagcccgccagcgccagcagcaccgccgccagccccgcccaccccgccaagcugagagcccagaccaccgcccaggccagcacccccggccagccccccccccagccccaggcccccagccacgccgccggccagagcgcccugccccagagacuggugcugcccagccaggcccaggccagacugcccagcggcgagguggugaagaucgcccagcuggccagcaucaccggcccccagagcagaguggcccagcccgagacccccgugacccugcaguuccagggcagcaaguucacccugagccacagccagcugagacagcugaccgccggccagccccugcagcugcagggcagcgugcugcagaucgugagcgcccccggccagcccuaccugagagcccccggccccguggugaugcagaccgugagccaggccggcgccgugcacggcgcccugggcagcaagccccccgccggcggccccagccccgccccccugaccccccaggugggcgugcccggcagaguggccgugaacgcccuggccgugggcgagcccggcaccgccagcaagcccgccagccccaucggcggccccacccaggaggagaagaccagacugcugaaggagagacuggaccagaucuaccuggugaacgagagaagaugcagccaggcccccguguacggcagagaccugcugagaaucugcgcccugcccagccacggcagagugcaguggagaggcagccuggacggcagaagaggcaaggaggccggccccgcccacagcuacaccagcagcagcgagagccccagcgagcugaugcugacccugugcagaugcggcgagagccugcaggacgugaucgacagaguggccuucgugaucccccccgugguggccgccccccccagccugagagugcccagaccccccccccuguacagccacagaaugagaauccugagacagggccugagagagcacgccgcccccuacuuccagcagcugagacagaccaccgcccccagacugcugcaguuccccgagcugagacuggugcaguucgacagcggcaagcuggaggcccuggccauccugcugcagaagcugaagagcgagggcagaagagugcugauccugagccagaugauccugaugcuggacauccuggagauguuccugaacuuccacuaccugaccuacgugagaaucgacgagaacgccagcagcgagcagagacaggagcugaugagaagcuucaacagagacagaagaaucuucugcgccauccugagcacccacagcagaaccaccggcaucaaccugguggaggccgacaccgugguguucuacgacaacgaccugaaccccgugauggacgccaaggcccaggaguggugcgacagaaucggcagaugcaaggacauccacaucuacagacuggugagcggcaacagcaucgaggagaagcugcugaagaacggcaccaaggaccugaucagagagguggccgcccagggcaacgacuacagcauggccuuccugacccagagaaccauccaggagcuguucgagguguacagccccauggacgacgccggcuuccccgugaaggccgaggaguucguggugcugagccaggagcccagcgugaccgagaccaucgcccccaagaucgccagacccuucaucgaggcccugaagagcaucgaguaccuggaggaggacgcccagaagagcgcccaggagggcgugcugggcccccacaccgacgcccugagcagcgacagcgagaacaugcccugcgacgaggagcccagccagcuggaggagcuggccgacuucauggagcagcugacccccaucgagaaguacgcccugaacuaccuggagcuguuccacaccagcaucgagcaggagaaggagagaaacagcgaggacgccgugaugaccgccgugagagccugggaguucuggaaccugaagacccugcaggagagagaggccagacugagacuggagcaggaggaggccgagcugcugaccuacaccagagaggacgccuacagcauggaguacguguacgaggacguggacggccagaccgaggugaugccccuguggaccccccccacccccccccaggacgacagcgacaucuaccuggacagcgugaugugccugauguacgaggccacccccauccccgaggccaagcugccccccguguacgugagaaaggagagaaagagacacaagaccgaccccagcgccgccggcagaaagaagaagcagagacacggcgaggccguggugccccccagaagccuguucgacagagccacccccggccugcugaagaucagaagagagggcaaggagcagaagaagaacauccugcugaagcagcaggugcccuucgccaagccccugcccaccuucgccaagcccaccgccgagcccggccaggacaaccccgaguggcugaucagcgaggacugggcccugcugcaggccgugaagcagcugcuggagcugccccugaaccugaccaucgugagccccgcccacacccccaacugggaccuggugagcgacguggugaacagcugcagcagaaucuacagaagcagcaagcagugcagaaacagauacgagaacgugaucauccccagagaggagggcaagagcaagaacaacagaccccugagaaccagccagaucuacgcccaggacgagaacgccacccacacccagcuguacaccagccacuucgaccugaugaagaugaccgccggcaagagaagcccccccaucaagccccugcugggcaugaaccccuuccagaagaaccccaagcacgccagcgugcuggccgagagcggcaucaacuacgacaagccccugccccccauccagguggccagccugagagccgagagaaucgccaaggagaagaaggcccuggccgaccagcagaaggcccagcagcccgccguggcccagcccccccccccccagccccagccccccccccccccccagcagcccccccccccccugccccagccccaggccgccggcagccagccccccgccggcccccccgccgugcagccccagccccagccccagccccagacccagccccagcccgugcaggcccccgccaaggcccagcccgccaucaccaccggcggcagcgccgccgugcuggccggcaccaucaagaccagcgugaccggcaccagcaugcccaccggcgccgugagcggcaacgugaucgugaacaccaucgccggcgugcccgccgccaccuuccagagcaucaacaagagacuggccagccccguggcccccggcgcccugaccacccccggcggcagcgcccccgcccagguggugcacacccagcccccccccagagccgugggcagccccgccaccgccacccccgaccuggugagcauggccaccacccagggcgugagagccgugaccagcgugaccgccagcgccguggugaccaccaaccugacccccgugcagacccccgccagaagccuggugccccaggugagccaggccaccggcgugcagcugcccggcaagaccaucacccccgcccacuuccagcugcugagacagcagcagcagcagcagcagcagcagcagcagcagcagcagcagcagcagcagcagcagcagcagcagcagcagcagcagcagcagaccaccaccaccagccaggugcaggugccccagauccagggccaggcccagagccccgcccagaucaaggccgugggcaagcugacccccgagcaccugaucaagaugcagaagcagaagcugcagaugcccccccagcccccccccccccaggcccagagcgcccccccccagcccaccgcccaggugcaggugcagaccagccagcccccccagcagcagagcccccagcugaccaccgugaccgcccccagacccggcgcccugcugaccggcaccaccguggccaaccugcagguggccagacugaccagagugcccaccagccagcugcaggcccagggccagaugcagacccaggccccccagcccgcccagguggcccuggccaagccccccguggugagcgugcccgccgccguggugagcagccccggcgugaccacccugcccaugaacguggccggcaucagcguggccaucggccagccccagaaggccgccggccagaccgugguggcccagcccgugcacaugcagcagcugcugaagcugaagcagcaggccgugcagcagcagaaggccauccagccccaggccgcccagggccccgccgccgugcagcagaagaucaccgcccagcagaucaccacccccggcgcccagcagaagguggccuacgccgcccagcccgcccugaagacccaguuccugaccacccccaucagccaggcccagaagcuggccggcgcccagcaggugcagacccagauccagguggccaagcugccccagguggugcagcagcagacccccguggccagcauccagcagguggccagcgccagccagcaggccagcccccagaccguggcccugacccaggccaccgccgccggccagcaggugcagaugauccccgccgugaccgccaccgcccagguggugcagcagaagcugauccagcagcagguggugaccaccgccagcgccccccugcagacccccggcgcccccaaccccgcccaggugcccgccagcagcgacagccccagccagcagcccaagcugcagaugagagugcccgccgugagacugaagacccccaccaagccccccugccaguaa

SEQ ID NO: 16639 - RNA, 2613 nt, Artificial Sequence
  EPAS1__Homo_sapiens__NP_001421
augaccgccgacaaggagaagaagagaagcagcagcgagagaagaaaggagaagagcagagacgccgccagaugcagaagaagcaaggagaccgagguguucuacgagcuggcccacgagcugccccugccccacagcgugagcagccaccuggacaaggccagcaucaugagacuggccaucagcuuccugagaacccacaagcugcugagcagcgugugcagcgagaacgagagcgaggccgaggccgaccagcagauggacaaccuguaccugaaggcccuggagggcuucaucgccguggugacccaggacggcgacaugaucuuccugagcgagaacaucagcaaguucaugggccugacccagguggagcugaccggccacagcaucuucgacuucacccaccccugcgaccacgaggagaucagagagaaccugagccugaagaacggcagcggcuucggcaagaagagcaaggacaugagcaccgagagagacuucuucaugagaaugaagugcaccgugaccaacagaggcagaaccgugaaccugaagagcgccaccuggaaggugcugcacugcaccggccaggugaagguguacaacaacugccccccccacaacagccugugcggcuacaaggagccccugcugagcugccugaucaucaugugcgagcccauccagcaccccagccacauggacaucccccuggacagcaagaccuuccugagcagacacagcauggacaugaaguucaccuacugcgacgacagaaucaccgagcugaucggcuaccaccccgaggagcugcugggcagaagcgccuacgaguucuaccacgcccuggacagcgagaacaugaccaagagccaccagaaccugugcaccaagggccagguggugagcggccaguacagaaugcuggccaagcacggcggcuacguguggcuggagacccagggcaccgugaucuacaaccccagaaaccugcagccccagugcaucaugugcgugaacuacgugcugagcgagaucgagaagaacgacgugguguucagcauggaccagaccgagagccuguucaagccccaccugauggccaugaacagcaucuucgacagcagcggcaagggcgccgugagcgagaagagcaacuuccuguucaccaagcugaaggaggagcccgaggagcuggcccagcuggcccccacccccggcgacgccaucaucagccuggacuucggcaaccagaacuucgaggagagcagcgccuacggcaaggccauccugccccccagccagcccugggccaccgagcugagaagccacagcacccagagcgaggccggcagccugcccgccuucaccgugccccaggccgccgcccccggcagcaccacccccagcgccaccagcagcagcagcagcugcagcacccccaacagccccgaggacuacuacaccagccuggacaacgaccugaagaucgaggugaucgagaagcuguucgccauggacaccgaggccaaggaccagugcagcacccagaccgacuucaacgagcuggaccuggagacccuggcccccuacauccccauggacggcgaggacuuccagcugagccccaucugccccgaggagagacugcuggccgagaacccccagagcaccccccagcacugcuucagcgccaugaccaacaucuuccagccccuggcccccguggccccccacagccccuuccugcuggacaaguuccagcagcagcuggagagcaagaagaccgagcccgagcacagacccaugagcagcaucuucuucgacgccggcagcaaggccagccugccccccugcugcggccaggccagcaccccccugagcagcaugggcggcagaagcaacacccaguggccccccgaccccccccugcacuucggccccaccaagugggccgugggcgaccagagaaccgaguuccugggcgccgccccccugggcccccccgugagccccccccacgugagcaccuucaagaccagaagcgccaagggcuucggcgccagaggccccgacgugcugagccccgccaugguggcccugagcaacaagcugaagcugaagagacagcuggaguacgaggagcaggccuuccaggaccugagcggcggcgacccccccggcggcagcaccagccaccugauguggaagagaaugaagaaccugagaggcggcagcugcccccugaugcccgacaagccccugagcgccaacgugcccaacgacaaguucacccagaaccccaugagaggccugggccacccccugagacaccugccccugccccagccccccagcgccaucagccccggcgagaacagcaagagcagauuccccccccagugcuacgccacccaguaccaggacuacagccugagcagcgcccacaaggugagcggcauggccagcagacugcugggccccagcuucgagagcuaccugcugcccgagcugaccagauacgacugcgaggugaacgugcccgugcugggcagcagcacccugcugcagggcggcgaccugcugagagcccuggaccaggccaccuaa

SEQ ID NO: 16640 - RNA, 2643 nt, Artificial Sequence
  EPB41L1__Homo_sapiens__NP_001245258
augaccaccgagaccggccccgacagcgaggugaagaaggcccaggaggaggccccccagcagcccgaggccgccgccgccgugaccacccccgugacccccgccggccacggccaccccgaggccaacagcaacgagaagcaccccagccagcaggacaccagacccgccgagcagagccuggacauggaggagaaggacuacagcgaggccgacggccugagcgagagaaccacccccagcaaggcccagaagagcccccagaagaucgccaagaaguacaagagcgccaucugcagagugacccugcuggacgccagcgaguacgagugcgagguggagaagcacggcagaggccaggugcuguucgaccuggugugcgagcaccugaaccugcuggagaaggacuacuucggccugaccuucugcgacgccgacagccagaagaacuggcuggaccccagcaaggagaucaagaagcagaucagaagcagccccuggaacuucgccuucaccgugaaguucuacccccccgaccccgcccagcugaccgaggacaucaccagauacuaccugugccugcagcugagagccgacaucaucaccggcagacugcccugcagcuucgugacccacgcccugcugggcagcuacgccgugcaggccgagcugggcgacuacgacgccgaggagcacgugggcaacuacgugagcgagcugagauucgcccccaaccagaccagagagcuggaggagagaaucauggagcugcacaagaccuacagaggcaugacccccggcgaggccgagauccacuuccuggagaacgccaagaagcugagcauguacggcguggaccugcaccacgccaaggacagcgagggcaucgacaucaugcugggcgugugcgccaacggccugcugaucuacagagacagacugagaaucaacagauucgccuggcccaagauccugaagaucagcuacaagagaagcaacuucuacaucaagaucagacccggcgaguacgagcaguucgagagcaccaucggcuucaagcugcccaaccacagaagcgccaagagacuguggaaggugugcaucgagcaccacaccuucuucagacuggugagccccgagcccccccccaagggcuuccuggugaugggcagcaaguucagauacagcggcagaacccaggcccagaccagacaggccagcgcccugaucgacagacccgcccccuucuucgagagaagcagcagcaagagauacaccaugagcagaagccuggacggcgccgaguucagcagacccgccagcgugagcgagaaccacgacgccggccccgacggcgacaagagagacgaggacggcgagagcggcggccagagaagcgaggccgaggagggcgaggugagaacccccaccaagaucaaggagcugaagcccgagcaggagaccacccccagacacaagcaggaguuccuggacaagcccgaggacgugcugcugaagcaccaggccagcaucaacgagcugaagagaacccugaaggagcccaacagcaagcugauccacagagacagagacugggagagagagagaagacugcccagcagccccgccagccccagccccaagggcacccccgagaaggccaacgagagagccggccugagagagggcagcgaggagaaggugaagccccccagacccagagcccccgagagcgacaccggcgacgaggaccaggaccaggagagagacaccguguuccugaaggacaaccaccuggccaucgagagaaagugcagcagcaucaccgugagcagcaccagcagccuggaggccgagguggacuucaccgugaucggcgacuaccacggcagcgccuucgaggacuucagcagaagccugcccgagcuggacagagacaagagcgacagcgacaccgagggccugcuguucagcagagaccugaacaagggcgcccccagccaggacgacgagagcggcggcaucgaggacagccccgacagaggcgccugcagcacccccgacaugccccaguucgagcccgugaagaccgagaccaugaccgugagcagccuggccaucagaaagaagaucgagcccgaggccgugcugcagaccagagugagcgccauggacaacacccagguggacggcagcgccagcgugggcagagaguucaucgccaccacccccagcaucaccaccgagaccaucagcaccaccauggagaacagccugaagagcggcaagggcgccgccgccaugauccccggcccccagaccguggccaccgagaucagaagccugagccccaucaucggcaaggacgugcugaccagcaccuacggcgccaccgccgagacccugagcaccagcaccaccacccacgugaccaagaccgugaagggcggcuucagcgagaccagaaucgagaagagaaucaucaucaccggcgacgaggacguggaccaggaccaggcccuggcccuggccaucaaggaggccaagcugcagcaccccgacaugcuggugaccaaggccgugguguacagagagaccgaccccagccccgaggagagagacaagaagccccaggagagcuaa

SEQ ID NO: 16641 - RNA, 2022 nt, Artificial Sequence
  EPB41L2__Homo_sapiens__NP_001129026
augaccaccgaggugggcagcgugagcgaggugaagaaggacagcagccagcugggcaccgacgccaccaaggagaagcccaaggagguggccgagaaccagcagaaccagagcagcgaccccgaggaggagaagggcagccagcccccccccgccgccgagagccagagcagccugagaagacagaagagagagaaggagaccagcgagagcagaggcaucagcagauucaucccccccuggcugaagaagcagaagagcuacacccuggugguggccaaggacggcggcgacaagaaggagcccacccaggccgugguggaggagcaggugcuggacaaggaggagccccugcccgaggagcagagacaggccaagggcgacgccgaggagauggcccagaagaagcaggagaucaagguggaggugaaggaggagaagcccagcgugagcaaggaggagaagcccagcgugagcaagguggagaugcagcccaccgagcuggugagcaaggagagagaggagaaggugaaggagacccaggaggacaagcuggagggcggcgccgccaagagagagaccaaggaggugcagaccaacgagcugaaggccgagaaggccagccagaaggugaccaagaagaccaagaccgugcagugcaaggugacccugcuggacggcaccgaguacagcugcgaccuggagaagcacgccaagggccaggugcuguucgacaaggugugcgagcaccugaaccugcuggagaaggacuacuucggccugcuguuccaggagagccccgagcagaagaacuggcuggaccccgccaaggagaucaagagacagcugagaaaccugcccuggcuguucaccuucaacgugaaguucuacccccccgaccccagccagcugaccgaggacaucaccagauacuuccugugccugcagcugagacaggacaucgccagcggcagacugcccugcagcuucgugacccacgcccugcugggcagcuacacccugcaggccgagcugggcgacuacgaccccgaggagcacggcagcaucgaccugagcgaguuccaguucgcccccacccagaccaaggagcuggaggagaagguggccgagcugcacaagacccacagaggccugagccccgcccaggccgacagccaguuccuggagaacgccaagagacugagcauguacggcguggaccugcaccacgccaaggacagcgagggcguggacaucaagcugggcgugugcgccaacggccugcugaucuacaaggacagacugagaaucaacagauucgccuggcccaagauccugaagaucagcuacaagagaagcaacuucuacaucaaggugagacccgccgagcuggagcaguucgagagcaccaucggcuucaagcugcccaaccacagagccgccaagagacuguggaaggugugcguggagcaccacaccuucuacagacuggugagccccgagcagccccccaaggccaaguuccugacccugggcagcaaguucagauacagcggcagaacccaggcccagaccagacaggccagcacccugaucgacagacccgccccccacuucgagagaaccagcagcaagagagugagcagaagccuggacggcgcccccaucggcgugauggaccagagccugaugaaggacuuccccggcgccgccggcgagaucagcgccuacggccccggccuggugagcaucgccguggugcaggacggcgacggcagaagagaggugagaagccccaccaaggccccccaccugcagcugaucgagggcaagaccgugaagggcggcaucagcgagaccagaaucgagaagagaaucgugaucaccggcgacggcgacaucgaccacgaccaggcccuggcccaggccaucagagaggccagagagcagcaccccgacaugagcgugaccagagugguggugcacaaggagaccgagcuggccgaggagggcgaggacuaa

SEQ ID NO: 16642 - RNA, 2652 nt, Artificial Sequence
  EPB41L3__Homo_sapiens__NP_001268462
augaccaccgagagcggcagcgacagcgagagcaagcccgaccaggaggccgagccccaggaggccgccggcgcccagggcagagccggcgcccccgugcccgagccccccaaggaggagcagcagcaggcccuggagcaguucgccgccgccgccgcccacagcacccccgugagaagagaggugaccgacaaggagcaggaguucgccgccagagccgccaagcagcuggaguaccagcagcuggaggacgacaagcugagccagaagagcagcagcagcaagcugagcagaagcccccugaagaucgugaagaagcccaagagcaugcagugcaaggugauccugcuggacggcagcgaguacaccugcgacguggagaagagaagcagaggccaggugcuguucgacaaggugugcgagcaccugaaccugcuggagaaggacuacuucggccugaccuacagagacgccgagaaccagaagaacuggcuggaccccgccaaggagaucaagaagcaggugagaagcggcgccuggcacuucagcuucaacgugaaguucuacccccccgaccccgcccagcugagcgaggacaucaccagauacuaccugugccugcagcugagagacgacaucgugagcggcagacugcccugcagcuucgugacccuggcccugcugggcagcuacaccgugcagagcgagcugggcgacuacgaccccgacgagugcggcagcgacuacaucagcgaguucagauucgcccccaaccacaccaaggagcuggaggacaaggugaucgagcugcacaagagccacagaggcaugacccccgccgaggccgagaugcacuuccuggagaacgccaagaagcugagcauguacggcguggaccugcaccacgccaaggacagcgagggcguggagaucaugcugggcgugugcgccagcggccugcugaucuacagagacagacugagaaucaacagauucgccuggcccaaggugcugaagaucagcuacaagagaaacaacuucuacaucaagaucagacccggcgaguucgagcaguucgagagcaccaucggcuucaagcugcccaaccacagagccgccaagagacuguggaaggugugcguggagcaccacaccuucuucagacugcugcugcccgaggccccccccaagaaguuccugacccugggcagcaaguucagauacagcggcagaacccaggcccagaccagaagagccagcgcccugaucgacagacccgcccccuacuucgagagaagcagcagcaagagauacaccaugagcagaagccuggacggcgccagcgugaacgagaaccacgagaucuacaugaaggacagcaugagcgccgccgaggugggcaccggccaguacgccaccaccaagggcaucagccagaccaaccugaucaccaccgugacccccgagaagaaggccgaggaggagagagacgaggaggaggacaagagaagaaagggcgaggaggugacccccaucagcgccaucagacacgagggcaagaccgacagcgagagaaccgacaccgccgccgacggcgagaccaccgccaccgagagcgaccaggaggaggacgccgagcugaaggcccaggagcuggagaagacccaggacgaccugaugaagcaccagaccaacaucagcgagcugaagagaaccuuccuggagaccagcaccgacaccgccgugaccaacgagugggagaagagacugagcaccagccccgugagacuggccgccagacaggaggacgcccccaugaucgagccccuggugcccgaggagaccaagcagagcagcggcgagaagcugauggacggcagcgagaucuucagccugcuggagagcgccagaaagcccaccgaguucaucggcggcgugaccagcaccagccagagcugggugcagaagauggagaccaagaccgagagcagcggcaucgagaccgagcccaccgugcaccaccugccccugagcaccgagaagguggugcaggagaccgugcugguggaggagagaagaguggugcacgccagcggcgacgccagcuacagcgccggcgacagcggcgacgccgccgcccagcccgccuucaccggcaucaagggcaaggagggcagcgcccugaccgagggcgccaaggaggagggcggcgaggagguggccaaggccgugcuggagcaggaggagaccgccgccgccagcagagagagacaggaggagcagagcgccgccauccacaucagcgagacccuggagcagaagccccacuucgagagcagcaccgugaagaccgagaccaucagcuucggcagcgugagccccggcggcgugaagcuggagaucagcaccaaggaggugcccguggugcacaccgagaccaagaccaucaccuacgagagcagccagguggaccccggcaccgaccuggagcccggcgugcugaugagcgcccagaccaucaccagcgagaccaccagcaccaccaccaccacccacaucaccaagaccgugaagggcggcaucagcgagaccagaaucgagaagagaaucgugaucaccggcgacgccgacaucgaccacgaccaggaguaa

SEQ ID NO: 16643 - RNA, 2061 nt, Artificial Sequence
  EPB41L4A__Homo_sapiens__NP_071423
augggcugcuucugcgccgugcccgaggaguucuacugcgaggugcugcugcuggacgagagcaagcugacccugaccacccagcagcagggcaucaagaagagcaccaagggcagcguggugcuggaccacguguuccaccacgugaaccugguggagaucgacuacuucggccugagauacugcgacagaagccaccagaccuacuggcuggaccccgccaagacccuggccgagcacaaggagcugaucaacaccggcccccccuacacccuguacuucggcaucaaguucuacgccgaggaccccugcaagcugaaggaggagaucaccagauaccaguucuuccugcaggugaagcaggacgugcugcagggcagacugcccugccccgugaacaccgccgcccagcugggcgccuacgccauccagagcgagcugggcgacuacgaccccuacaagcacaccgccggcuacgugagcgaguacagauucgugcccgaccagaaggaggagcuggaggaggccaucgagagaauccacaagacccugaugggccagauccccagcgaggccgagcugaacuaccugagaaccgccaagagccuggagauguacggcguggaccugcaccccguguacggcgagaacaagagcgaguacuuccugggccugacccccgugggcguggugguguacaagaacaagaagcaggugggcaaguacuucuggcccagaaucaccaaggugcacuucaaggagacccaguucgagcugagagugcugggcaaggacugcaacgagaccagcuucuucuucgaggccagaagcaagaccgccugcaagcaccuguggaagugcagcguggagcaccacaccuucuucagaaugcccgagaacgagagcaacagccugagcagaaagcugagcaaguucggcagcaucagauacaagcacagauacagcggcagaaccgcccugcagaugagcagagaccugagcauccagcugcccagacccgaccagaacgugaccagaagcagaagcaagaccuaccccaagagaaucgcccagacccagcccgccgagagcaacagcaucagcagaaucaccgccaacauggagaacggcgagaacgagggcaccaucaagaucaucgcccccagccccgugaagagcuucaagaaggccaagaacgagaacagccccgacacccagagaagcaagagccacgcccccugggaggagaacggcccccagagcggccuguacaacagccccagcgacagaaccaagagccccaaguuccccuacaccagaagaagaaaccccagcugcggcagcgacaacgacagcgugcagcccgugagaagaagaaaggcccacaacagcggcgaggacagcgaccugaagcagagaagaagaagcagaagcagaugcaacaccagcagcggcagcgagagcgagaacagcaacagagaguacagaaagaagagaaacagaaucagacaggagaacgacaugguggacagcgccccccagugggaggccgugcugagaagacagaaggagaagaaccaggccgaccccaacaacagaagaagcagacacagaagcagaagcagaagccccgacauccaggccaaggaggagcuguggaagcacauccagaaggagcugguggaccccagcggccugagcgaggagcagcugaaggagauccccuacaccaagaucgagacccagggcgaccccaucagaaucagacacagccacagccccagaagcuacagacaguacagaagaagccagugcagcgacggcgagagaagcgugcugagcgaggugaacagcaagaccgaccuggugcccccccugcccgugacccacagcagcgacgcccagggcagcggcgacgccaccgugcaccagagaagaaacggcagcaaggacagccugauggaggagaagccccagaccagcaccaacaaccuggccggcaagcacaccgccaagaccaucaagaccauccaggccagcagacugaagaccgagaccuaa

SEQ ID NO: 16644 - RNA, 1557 nt, Artificial Sequence
  EPB41L4B__Homo_sapiens__NP_060894
augcugagauuccugagaagaaccuucggcagaagaagcaugcagagauacgccagaggcgccgccggcagaggcgccgccggccugggcgacgagagagacggcggccccagaggcggccccgccgccgccgccagcagcagcgcccugcccgccgcccccggcggcagcguguuccccgccggcggcggcccccugcugaccggcggcgccgccgugcacaucagcgccgccggcgccgccaaggccacccuguacugcagaguguuccugcuggacggcaccgaggugagcguggaccugcccaagcacgccaagggccaggaccuguucgaccagaucguguaccaccuggaccugguggagaccgacuacuucggccugcaguuccuggacagcgcccagguggcccacuggcuggaccacgccaagcccaucaagaagcagaugaagaucggccccgccuacgcccugcacuucagagugaaguacuacagcagcgagcccaacaaccugagagaggaguucaccagauaccuguucgugcugcagcugagacacgacauccugagcggcaagcugaagugccccuacgagaccgccguggagcuggccgcccugugccugcaggccgagcugggcgagugcgagcugcccgagcacacccccgagcuggugagcgaguucagauucauccccaaccagaccgaggccauggaguucgacaucuuccagagauggaaggagugcagaggcaagagccccgcccaggccgagcugagcuaccugaacaaggccaaguggcuggagauguacggcguggacaugcacguggugagaggcagagacggcugcgaguacagccugggccugacccccaccggcauccugaucuucgagggcgccaacaagaucggccuguucuucuggcccaagaucaccaagauggacuucaagaagagcaagcugacccugguggugguggaggacgacgaccagggcagagagcaggagcacaccuucguguucagacuggacagcgccagaaccugcaagcaccuguggaagugcgccguggagcaccacgccuucuucagacugagaacccccggcaacagcaagagcaacagaagcgacuucaucagacugggcagcagauucagauucagcggcagaaccgaguaccaggccacccacggcagcagacugagaagaaccagcaccuucgagagaaagcccagcaagagauaccccagcagaagacacagcaccuucaaggccagcaaccccgugaucgccgcccagcugugcagcaagaccaaccccgaggugcacaacuaccagccccaguaccaccccaacauccaccccagccagcccagauggcacccccacagccccaacgugagacccagcuuccaggacgacagaagccacuggaaggccagcgccagcggcgacgacagccacuucgacuacgugcacgaccagaaccagaagaaccugggcggcaugcagagcaugauguacagagacaagcugaugaccgcccuguaa

SEQ ID NO: 16645 - RNA, 2076 nt, Artificial Sequence
  EPB42__Homo_sapiens__NP_001107606
augggccaggcccugggcaucaagagcugcgacuuccaggccgccagaaacaacgaggagcaccacaccaaggcccugagcagcagaagacuguucgugagaagaggccagcccuucaccaucauccuguacuucagagcccccgugagagccuuccugcccgcccugaagaagguggcccugaccgcccagaccggcgagcagcccagcaagaucaacagaacccaggccaccuuccccaucagcagccugggcgacagaaagugguggagcgccgugguggaggagagagacgcccagagcuggaccaucagcgugaccacccccgccgacgccgugaucggccacuacagccugcugcugcaggugagcggcagaaagcagcugcugcugggccaguucacccugcuguucaaccccuggaacagagaggacgccguguuccugaagaacgaggcccagagaauggaguaccugcugaaccagaacggccugaucuaccugggcaccgccgacugcauccaggccgagagcugggacuucggccaguucgagggcgacgugaucgaccugagccugagacugcugagcaaggacaagcagguggagaaguggagccagcccgugcacguggccagagugcugggcgcccugcugcacuuccugaaggagcagagagugcugcccaccccccagacccaggccacccaggagggcgcccugcugaacaagagaagaggcagcgugcccauccugagacaguggcugaccggcagaggcagacccguguacgacggccaggccugggugcuggccgccguggccugcaccgugcugagaugccugggcauccccgccagaguggugaccaccuucgccagcgcccagggcaccggcggcagacugcugaucgacgaguacuacaacgaggagggccugcagaacggcgagggccagagaggcagaaucuggaucuuccagaccagcaccgagugcuggaugaccagacccgcccugccccagggcuacgacggcuggcagauccugcaccccagcgcccccaacggcggcggcgugcugggcagcugcgaccuggugcccgugagagccgugaaggagggcacccugggccugacccccgccgugagcgaccuguucgccgccaucaacgccagcugcgugguguggaagugcugcgaggacggcacccuggagcugaccgacagcaacaccaaguacgugggcaacaacaucagcaccaagggcgugggcagcgacagaugcgaggacaucacccagaacuacaaguaccccgagggcagccugcaggagaaggaggugcuggagagaguggagaaggagaagauggagagagagaaggacaacggcaucagaccccccagccuggagaccgccagcccccuguaccugcugcugaaggcccccagcagccugccccugagaggcgacgcccagaucagcgugacccuggugaaccacagcgagcaggagaaggccgugcagcuggccaucggcgugcaggccgugcacuacaacggcgugcuggccgccaagcuguggagaaagaagcugcaccugacccugagcgccaaccuggagaagaucaucaccaucggccuguucuucagcaacuucgagagaaacccccccgagaacaccuuccugagacugaccgccauggccacccacagcgagagcaaccugagcugcuucgcccaggaggacaucgccaucugcagaccccaccuggccaucaagaugcccgagaaggccgagcaguaccagccccugaccgccagcgugagccugcagaacagccuggacgcccccauggaggacugcgugaucagcauccugggcagaggccugauccacagagagagaagcuacagauucagaagcguguggcccgagaacaccaugugcgccaaguuccaguucacccccacccacgugggccugcagagacugaccguggagguggacugcaacauguuccagaaccugaccaacuacaagagcgugaccgugguggcccccgagcugagcgccuaa

SEQ ID NO: 16646 - RNA, 2442 nt, Artificial Sequence
  EPC1__Homo_sapiens__NP_001258933
augagcaagcugagcuucagagccagagcccuggacgccagcaagccccugcccguguucagaugcgaggaccugcccgaccugcacgaguacgccagcaucaacagagccgugccccagaugcccaccggcauggagaaggaggaggagagcgagcaccaccugcagagagccaucagcgcccagcagguguacggcgagaagagagacaacauggugauccccgugcccgaggccgagagcaacaucgccuacuacgagagcaucuaccccggcgaguucaagaugcccaagcagcugauccacauccagcccuucagccuggacgccgagcagcccgacuacgaccuggacagcgaggacgagguguucgugaacaagcugaagaagaagauggacaucugcccccugcaguucgaggagaugaucgacagacuggagaagggcagcggccagcagcccgugagccugcaggaggccaagcugcugcugaaggaggacgacgagcugaucagagagguguacgaguacuggaucaagaagagaaagaacugcagaggccccagccugauccccagcgugaagcaggagaagagagacggcagcagcaccaacgaccccuacguggccuucagaagaagaaccgagaagaugcagaccagaaagaacagaaagaacgacgaggccagcuacgagaagaugcugaagcugagaagagaccugagcagagccgugaccauccuggagaugaucaagagaagagagaagagcaagagagagcugcugcaccugacccuggagaucauggagaagagauacaaccugggcgacuacaacggcgagaucaugagcgaggugauggcccagagacagcccaugaagcccaccuacgccauccccaucauccccaucaccaacagcagccaguucaagcaccaggaggccauggacgugaaggaguucaaggugaacaagcaggacaaggccgaccugaucagacccaagagaaaguacgagaagaagcccaaggugcugcccagcagcgccgccgccaccccccagcagaccagccccgccgcccugcccguguucaacgccaaggaccugaaccaguacgacuuccccagcagcgacgaggagccccugagccaggugcugagcggcagcagcgaggccgaggaggacaacgaccccgacggccccuucgccuucagaagaaaggccggcugccaguacuacgccccccaccuggaccagaccggcaacuggcccuggaccagccccaaggacggcggccugggcgacgugagauacagauacugccugaccacccugaccgugccccagagaugcaucggcuucgccagaagaagagugggcagaggcggcagagugcugcuggacagagcccacagcgacuacgacagcguguuccaccaccuggaccuggagaugcugagcagcccccagcacagccccgugaaccaguucgccaacaccagcgagaccaacaccagcgacaagagcuucagcaaggaccugagccagauccuggugaacaucaagagcugcagauggagacacuucagacccagaacccccagccugcacgacagcgacaacgacgagcugagcugcagaaagcuguacagaagcaucaacagaaccggcaccgcccagcccggcacccagaccugcagcaccagcacccagagcaagagcagcagcggcagcgcccacuucgccuucaccgccgagcaguaccagcagcaccagcagcagcuggcccugaugcagaagcagcagcuggcccagauccagcagcagcaggccaacagcaacagcagcaccaacaccagccagggcuucgugagcaagacccuggacagcgccagcgcccaguucgccgccagcgcccuggugaccagcgagcagcugaugggcuucaagaugaaggacgacguggugcugggcaucggcgugaacggcgugcugcccgccagcggcguguacaagggccugcaccugagcagcaccacccccaccgcccuggugcacaccagccccagcaccgccggcagcgcccugcugcagcccagcaacaucacccagaccagcagcagccacagcgcccugagccaccaggugaccgccgccaacagcgccaccacccaggugcugaucggcaacaacaucagacugaccgugcccagcagcguggccaccgugaacagcaucgcccccaucaacgccagacacauccccagaacccugagcgccgugcccagcagcgcccugaagcuggccgccgccgccaacugccaggugagcaaggugcccagcagcagcagcguggacagcgugcccagagagaaccacgagagcgagaagcccgcccugaacaacaucgccgacaacaccguggccauggaggugaccuaa

SEQ ID NO: 16647 - RNA, 2424 nt, Artificial Sequence
  EPC2__Homo_sapiens__NP_056445
augagcaagcugagcuucagagccagagcccuggacgccgccaagccccugcccaucuacagaggcaaggacaugcccgaccugaacgacugcgugagcaucaacagagccgugccccagaugcccaccggcauggagaaggaggaggagagcgagcaccaccugcagagagccaucagcgcccagcagguguucagagagaagaaggagagcauggugauccccgugcccgaggccgagagcaacgugaacuacuacaacagacuguacaagggcgaguucaagcagcccaagcaguucauccacauccagcccuucaaccuggacaacgagcagcccgacuacgacauggacagcgaggacgagacccugcugaacagacugaacagaaagauggagaucaagccccugcaguucgagaucaugaucgacagacuggagaaggccagcagcaaccagcuggugacccugcaggaggccaagcugcugcugaacgaggacgacuaccugaucaaggccguguacgacuacugggugagaaagagaaagaacugcagaggccccagccugaucccccagaucaagcaggagaagagagacggcagcaccaacaacgaccccuacguggccuucagaagaagaaccgagaagaugcagaccagaaagaacagaaagaacgacgaggccagcuacgagaagaugcugaagcugagaagagaguucagcagagccaucaccauccuggagaugaucaagagaagagagaagaccaagagagagcugcugcaccugacccuggaggugguggagaagagauaccaccugggcgacuacggcggcgagauccugaacgaggugaagaucagcagaagcgagaaggagcuguacgccacccccgccacccugcacaacggcaaccaccacaaggugcaggagugcaagaccaagcacccccaccaccugagccugaaggaggaggccagcgacguggugagacagaagaagaaguaccccaagaagcccaaggccgaggcccugaucaccagccagcagcccacccccgagacccugcccgugaucaacaagagcgacaucaagcaguacgacuuccacagcagcgacgaggacgaguucccccaggugcugagccccgugagcgagcccgaggaggagaacgaccccgacggccccugcgccuucagaagaagagccggcugccaguacuacgcccccagacuggaccaggccaaccacagcugcgagaacagcgagcuggccgaccuggacaagcugagauacagacacugccugaccacccugaccgugcccagaagaugcaucggcuucgccagaagaagaaucggcagaggcggcagagugaucauggacagaaucagcaccgagcacgaccccgugcugaagcagaucgaccccgagaugcugaacagcuucagcagcagcagccagaccaucgacuucagcagcaacuucagcagaaccaacgccagcagcaagcacugcgagaacagacugagccugagcgagauccugagcaacaucagaagcugcagacugcagugcuuccagcccagacugcugaaccugcaggacagcgacagcgaggagugcaccagcagaaagcccggccagaccgugaacaacaagagagugagcgccgccagcguggcccugcugaacaccagcaagaacggcaucagcgugaccggcggcaucaccgaggagcaguuccagacccaccagcagcagcuggugcagaugcagagacagcagcuggcccagcugcagcagaagcagcagagccagcacagcagccagcagacccaccccaaggcccagggcagcagcaccagcgacugcaugagcaagacccuggacagcgccagcgcccacuucgccgccagcgccguggugagcgcccccgugcccagcagaagcgagguggccaaggagcagaacaccggccacaacaacaucaacggcguggugcagcccagcggcaccagcaagacccuguacagcaccaacauggcccugagcagcagccccggcaucagcgccgugcagcuggugagaaccgugggccacaccaccaccaaccaccugauccccgcccugugcaccagcagcccccagacccugcccaugaacaacagcugccugaccaacgccgugcaccugaacaacgugagcguggugagccccgugaacgugcacaucaacaccagaaccagcgcccccagccccaccgcccugaagcuggccaccguggccgccagcauggacagagugcccaaggugacccccagcagcgccaucagcagcaucgccagagagaaccacgagcccgagagacugggccugaacggcaucgccgagaccaccguggccauggaggugaccuaa

SEQ ID NO: 16648 - RNA, 945 nt, Artificial Sequence
  EPCAM__Homo_sapiens__NP_002345
auggcccccccccaggugcuggccuucggccugcugcuggccgccgccaccgccaccuucgccgccgcccaggaggagugcgugugcgagaacuacaagcuggccgugaacugcuucgugaacaacaacagacagugccagugcaccagcgugggcgcccagaacaccgugaucugcagcaagcuggccgccaagugccuggugaugaaggccgagaugaacggcagcaagcugggcagaagagccaagcccgagggcgcccugcagaacaacgacggccuguacgaccccgacugcgacgagagcggccuguucaaggccaagcagugcaacggcaccagcaugugcuggugcgugaacaccgccggcgugagaagaaccgacaaggacaccgagaucaccugcagcgagagagugagaaccuacuggaucaucaucgagcugaagcacaaggccagagagaagcccuacgacagcaagagccugagaaccgcccugcagaaggagaucaccaccagauaccagcuggaccccaaguucaucaccagcauccuguacgagaacaacgugaucaccaucgaccuggugcagaacagcagccagaagacccagaacgacguggacaucgccgacguggccuacuacuucgagaaggacgugaagggcgagagccuguuccacagcaagaagauggaccugaccgugaacggcgagcagcuggaccuggaccccggccagacccugaucuacuacguggacgagaaggcccccgaguucagcaugcagggccugaaggccggcgugaucgccgugaucguggugguggugaucgccgugguggccggcaucguggugcuggugaucagcagaaagaagagaauggccaaguacgagaaggccgagaucaaggagaugggcgagaugcacagagagcugaacgccuaa

SEQ ID NO: 16649 - RNA, 675 nt, Artificial Sequence
  EPDR1__Homo_sapiens__NP_060019
augcccggcagagccccccugagaaccgugcccggcgcccugggcgccuggcugcugggcggccugugggccuggacccugugcggccugugcagccugggcgccgugggcgcccccagacccugccaggccccccagcagugggagggcagacaggugauguaccagcagagcagcggcagaaacagcagagcccugcugagcuacgacggccugaaccagagagugagagugcuggacgagagaaaggcccugauccccugcaagagacuguucgaguacauccugcuguacaaggacggcgugauguuccagaucgaccaggccaccaagcagugcagcaagaugacccugacccagcccugggacccccuggacaucccccagaacagcaccuucgaggaccaguacagcaucggcggcccccaggagcagaucaccgugcaggaguggagcgacagaaagagcgccagaagcuacgagaccuggaucggcaucuacaccgugaaggacugcuaccccgugcaggagaccuucaccaucaacuacagcgugauccugagcaccagauucuucgacauccagcugggcaucaaggaccccagcguguucaccccccccagcaccugccagauggcccagcuggagaagaugagcgaggacugcagcugguaa

SEQ ID NO: 16650 - RNA, 7740 nt, Artificial Sequence
  EPG5__Homo_sapiens__NP_066015
auggccgaggccgugaagccccagagaagagccaaggccaaggccagcagaaccaagaccaaggagaagaagaaguacgagaccccccagagagaggagagcagcgaggugagccugcccaagaccagcagagagcaggagauccccagccuggccugcgaguucaagggcgaccaccugaagguggugaccgacagccagcugcaggacgacgccagcggccagaacgagagcgagauguucgacgugccccugaccagccugaccaucagcaacgaggagagccugaccugcaacaccgagccccccaaggagggcggcgaggccagacccugcgugggcgacagcgccgugacccccaaggugcaccccggcgacaacgugggcaccaagguggagacccccaagaacuucaccgagguggaggagaacaugagcgugcagggcggccugagcgagagcgccccccagagcaacuucagcuacacccagcccgccauggagaacauccaggugagagagacccagaacagcaaggaggacaagcagggccuggugugcagcagcgaggugccccagaacgugggccugcagagcagcugccccgccaagcacggcuuccagacccccagagugaagaagcuguacccccagcugcccgccgagaucgccggcgaggcccccgcccugguggccgugaagccccugcugagaagcgagagacuguaccccgagcugcccagccagcuggagcuggugcccuucaccaaggagcagcugaagauccuggagcccggcagcuggcuggagaacguggagagcuaccuggaggaguucgacagcauggcccaccaggacagacacgaguucuacgagcugcugcugaacuacagcagaugcagaaagcagcugcugcuggccgaggccgagcugcugacccugaccagcgacugccagaacgccaagagcagacuguggcaguucaaggaggagcagaugagcgugcagggcaucugcgccgaccaggugaagguguucagcuaccacagauaccagagaguggagaugaacgagaacgcccugguggagcugaagaagcuguucgacgccaagagcgagcaccugcaccagacccuggcccugcacagcuacaccagcgugcugagcagacugcagguggagagcuacaucuacgcccugcugagcagcagcgccgugcugagaagcagcgccauccaccagcagggcagagccagcaagcagaccgagagcauccccagcgaccugugccagcugaaggagugcaucagcgugcuguucauguucaccagaagagugaacgaggacacccaguuccacgacgacauccugcuguggcugcagaagcuggugagcgugcugcagagagugggcugccccggcgaccaccuguuccugcugaaccacauccugagaugccccgccggcgugagcaagugggccgugcccuucauccagaucaaggugcugcacaaccccagcggcguguuccacuucaugcagagccuggcccugcugaugagccccgugaagaacagagccgaguucaugugccacaugaagcccagcgagagaaagcccagcagcagcggccccggcagcggcaccuggacccugguggacgagggcggcgaggaggacgaggaccccgagaccagcuggauccugcugaacgaggacgaccuggugaccauccuggcccaguuccccuuccacgagcuguuccagcaccugcugggcuucaaggccaagggcgacuaccugcccgagaccaccagaccccaggagaugaugaagaucuucgccuucgccaacagccugguggagcugcuggccgugggccuggagaccuucaacagagccagauacagacaguucgugaagagaaucggcuacaugaucagaaugacccugggcuacgugagcgaccacugggcccaguacgugagccacaaccagggcagcggccuggcccagcagcccuacagcauggagaagcugcagguggaguucgacgagcuguuccugagagccgugcugcacgugcugaaggccaagagacugggcaucuggcuguucaugagcgagaugcccuucggcacccugagcgugcagaugcuguggaagcuguucuaccugaugcaccagguggagagcgagaaccugcagcagcugagcagcagccugcagcccgcccagugcaagcagcagcugcaggaccccgagcacuucaccaacuucgagaagugccugagcagcaugaacagcagcgaggagaucugccugcugaccaccuucgcccagauggcccaggccagaagaaccaacguggacgaggacuucaucaagaucaucgugcuggagaucuacgaggugagcuacgugacccugagcaccagagagaccuucagcaaggugggcagagagcugcugggcaccaucaccgccgugcaccccgagaucaucagcgugcugcuggacagagugcaggagaccaucgaccaggugggcauggugagccuguaccuguucaaggagcugccccuguaccuguggcagcccagcgccagcgagaucgccgugaucagagacuggcugcugaacuacaaccugaccguggugaagaacaagcuggccugcgugauccuggagggccugaacuggggcuucgccaagcaggccacccugcaccuggaccaggccgugcacgccgagguggcccugauggugcuggaggccuaccagaaguaccuggcccagaagcccuacgccggcauccugagcgagagcaugaagcaggugagcuaccuggccagcaucgugagauacggcgagacccccgagaccagcuucaaccagugggccuggaaccugauccugagacugaagcugcacaagaacgacuacggcauccagcccaacugccccgccgugcccuucagcgugaccgugcccgacaugaccgagagccccaccuuccacccccugcugaaggccgugaaggccggcaugcccaucggcugcuaccuggcccugagcaugaccgccgugggccacagcaucgagaaguucugcgccgagggcaucccccugcugggcauccuggugcagagcagacaccugagaaccguggugcacgugcuggacaagauccugccccuguucuaccccugccaguacuaccugcugaagaacgagcaguuccugagccaccugcugcuguuccugcaccuggacagcggcgugccccagggcgugacccagcaggugacccacaagguggcccagcaccugaccggcgccagccacggcgacaacgugaagcugcugaacagcaugauccaggcccacaucagcgugagcacccagcccaacgaggugggccccguggccgugcuggaguucugggugcaggcccugaucagccagcaccugugguacagagagcagcccauccuguuccugauggaccaccugugcaaggccgccuuccagcugaugcaggaggacugcauccagaagcugcuguaccagcagcacaagaacgcccugggcuaccacugcgacagaagccugcugagcagccuggugagcuggaucguggccggcaacaucacccccagcuucguggagggccuggccacccccacccaggugugguucgccuggaccgugcugaacauggagagcaucuucgaggaggacagccagcugagaagagugaucgagggcgagcuggugaucaacagcgccuucacccccgaccaggcccugaagaaggcccagacccagcugaagcugcccaucgugcccagccugcagagacugcugaucuacagaugggcccaccaggcccuggugacccccagcgaccacccccugcugccccugaucuggcagaaguucuuccugcuguaccugcacagacccggcccccaguacggccugcccaucgacggcugcaucggcagaagauucuuccagagccccgcccacaucaaccugcugaaggagaugaagagaagacugaccgagguggccgacuuccaccacgccgccagcaaggcccugagagugcccgccgagggcagcgagggccugcccgagagccacagcggcacccccggcuaccugaccagccccgagcugcacaaggagcuggugagacuguucaacguguacauccuguggcuggaggacgagaacuuccagaagggcgacaccuacauccccagccugcccaagcacuacgacauccacagacuggccaaggugaugcagaaccagcaggaccuguggauggaguaccugaacauggagagaaucuaccacgaguuccaggagaccgugggccuguggacccaggccaagcuggagagccacagcacccccugcagccugagcgugcagcuggacuucaccgacccccugcuggccaaggagagagugcugagcaaccugagaaagcacgaggccccccagcccccccuggcccugcaccccaccaagccccccgugcccgugaucagcagcgccgugcugcugagccagaaggacgccacccagcuggugugcaccgaccugaaccugcugcagcagcaggccagaaccgccgcccugagagagagccagcagguggcccuggacggcgagcugcuggacaccaugcccaagcaguacgugaacagagaggagcagaccacccugcaccuggagugcagaggcagcagcggcaagaagugccagggcgccgccguggugaccgugcaguucgagggcaugcacaagaacgaggccaucagccagcagcugcacgugcugagaaaggaggugaagcagcugcaggccgaggccgccaagccccccagccugaacaucguggaggccgccgugcacgccgagaaccugaucaccgcccuggugaacgccuacaagcugcagcccacccccggcauccagaaggugggcaucagccuguucuucaccaucguggacuacgugagcgacgagacccagagacacccccccaccagacaguucuucaccagcugcaucgagauccugggccagguguucaucagcggcaucaagagcgagugcagaaaggugcuggagaccauccugaagaacagcagacugugcagccugcugagccccuucuucacccccaacgccgcccccgccgaguucauccagcuguacgagcagguggugaaguuccugagcgaggacaacagcgacaugaucuucaugcugcugaccaaguucgaccugaagcaguggcugagcgccaccaagcccccccugagcgacagaaccagacugcuggagagcauccaccuggcccugaccgccuggggccuggagcccgacgaggacauccugaugcccuucaaccuguucugcaagcacuggaccuaccugcugcuguaccaguuccccgaccaguacagcgacauccugagacugcugaugcagagcagcgccgagcagcugcugagccccgagugcuggaaggccacccugagagcccugggcugcugcgcccccagcugccagcagggcgccgccagcaccgagggcgccgugcugcccagcagcagcgacgcccugcugagcgacaagcaggugauggagaccauccaguggcugagcgacuucuucuacaagcugagacugagcaagauggacuucaagagcuucggccuguucagcaaguggagccccuacauggccgacgugaagaccuuccugggcuaccuggugaagagacugaucgaccuggagaugaccugccuggcccaggaccccaccgccagcagaaagaccgugcugaagagccugcacagcgugaucauccagcuguucaagcccuggauccuggugcuggaggacaacgagagcagccagcagagacacuaccccuggcuggagagcgacaccgugguggccagcagcaucgugcagcuguucaccgacugcaucgacagccugcacgagagcuucaaggacaagcugcugcccggcgacgccggcgcccuguggcugcaccugaugcacuacugcgaggccugcaccgcccccaagaugcccgaguucauccuguacgccuuccacagcaccuacagaaagcugcccuggaaggaccugcaccccgaccagaugcugauggaggccuucuucaagguggagagaggcagccccaagagcugcuuccuguuccugggcagcgugcugugcgaggugaacugggugagcgugcugagcgacgccuggaacagcagcccccaccccgagaccagaagcaugaucgugugccugcuguucaugaugauccugcuggccaaggaggugcagcugguggaccagaccgacagcccccugcugagccugcugggccagaccagcagccugagcuggcaccugguggacaucgugagcuaccagagcgugcugagcuacuucagcagccacuacccccccagcaucauccuggccaaggagagcuacgccgagcugaucaugaagcugcugaaggugagcgccggccugagcauccccaccgacagccagaagcaccuggacgccgugcccaagugccaggccuucacccaccagauggugcaguuccugagcacccuggagcagaacggcaagaucacccuggccgugcuggagcaggagaugagcaagcugcuggacgacaucaucguguucaacccccccgacauggacagccagaccagacacauggcccugagcagccuguucauggaggugcugaugaugaugaacaacgccaccauccccaccgccgaguuccugagaggcagcaucagaaccuggaucggccagaagaugcacggccugguggugcugccccugcugaccgccgccugccagagccuggccagcgugagacacauggccgagaccaccgaggccugcaucaccgccuacuucaaggagagcccccugaaccagaacagcggcuggggccccauccuggugagccugcaggugcccgagcugaccauggaggaguuccugcaggagugccugacccugggcagcuaccugacccuguacguguaccugcugcagugccugaacagcgagcagacccugagaaacgagaugaaggugcugcugauccugagcaaguggcuggagcagguguaccccagcagcguggaggaggaggccaagcuguuccugugguggcaccaggugcugcagcugagccugauccagaccgagcagaacgacagcgugcugaccgagagcgugaucagaauccugcugcuggugcagagcagacagaaccugguggccgaggagagacugagcagcggcauccugggcgccaucggcuucggcagaaagagcccccugagcaacagauucagagugguggccagaagcauggccgccuuccugagcgugcaggugcccauggaggaccagaucagacugagacccggcagcgagcugcaccugacccccaaggcccagcaggcccugaacgcccuggagagcauggccagcagcaagcaguacguggaguaccaggaccagauccugcaggccacccaguucaucagacaccccggccacugccugcaggacggcaagagcuuccuggcccugcuggugaacugccuguaccccgaggugcacuaccuggaccacaucagauaa

SEQ ID NO: 16651 - RNA, 465 nt, Artificial Sequence
  EPGN__Homo_sapiens__NP_001257918
auggcccugggcgugcccaucagcguguaccugcuguucaacgccaugaccgcccugaccgaggaggccgccgugaccgugaccccccccaucaccgcccagcagggcaacuggaccgugaacaagaccgaggccgacaacaucgagggccccaucgcccugaaguucagccaccugugccuggaggaccacaacagcuacugcaucaacggcgccugcgccuuccaccacgagcuggagaaggccaucugcagaugcuucaccggcuacaccggcgagagaugcgagcaccugacccugaccagcuacgccguggacagcuacgagaaguacaucgccaucggcaucggcgugggccugcugcugagcggcuuccuggugaucuucuacugcuacaucagaaagagaugccugaagcugaagagccccuacaacgugugcagcggcgagagaagaccccuguaa

SEQ ID NO: 16652 - RNA, 2931 nt, Artificial Sequence
  EPHA1__Homo_sapiens__NP_005223
auggagagaagauggccccugggccugggccuggugcugcugcugugcgccccccugccccccggcgccagagccaaggaggugacccugauggacaccagcaaggcccagggcgagcugggcuggcugcuggacccccccaaggacggcuggagcgagcagcagcagauccugaacggcaccccccuguacauguaccaggacugccccaugcagggcagaagagacaccgaccacuggcugagaagcaacuggaucuacagaggcgaggaggccagcagagugcacguggagcugcaguucaccgugagagacugcaagagcuuccccggcggcgccggcccccugggcugcaaggagaccuucaaccugcuguacauggagagcgaccaggacgugggcauccagcugagaagaccccuguuccagaaggugaccaccguggccgccgaccagagcuucaccaucagagaccuggugagcggcagcgugaagcugaacguggagagaugcagccugggcagacugaccagaagaggccuguaccuggccuuccacaaccccggcgccugcguggcccuggugagcgugagaguguucuaccagagaugccccgagacccugaacggccuggcccaguuccccgacacccugcccggccccgccggccugguggagguggccggcaccugccugccccacgccagagccagccccagacccagcggcgcccccagaaugcacugcagccccgacggcgaguggcuggugcccgugggcagaugccacugcgagcccggcuacgaggagggcggcagcggcgaggccugcguggccugccccagcggcagcuacagaauggacauggacaccccccacugccugaccugcccccagcagagcaccgccgagagcgagggcgccaccaucugcaccugcgagagcggccacuacagagcccccggcgagggcccccagguggccugcaccggcccccccagcgcccccagaaaccugagcuucagcgccagcggcacccagcugagccugagaugggagccccccgccgacaccggcggcagacaggacgugagauacagcgugagaugcagccagugccagggcaccgcccaggacggcggccccugccagcccugcggcgugggcgugcacuucagccccggcgccagaggccugaccacccccgccgugcacgugaacggccuggagcccuacgccaacuacaccuucaacguggaggcccagaacggcgugagcggccugggcagcagcggccacgccagcaccagcgugagcaucagcaugggccacgccgagagccugagcggccugagccugagacuggugaagaaggagcccagacagcuggagcugaccugggccggcagcagacccagaagccccggcgccaaccugaccuacgagcugcacgugcugaaccaggacgaggagagauaccagauggugcuggagcccagagugcugcugaccgagcugcagcccgacaccaccuacaucgugagagugagaaugcugaccccccugggccccggccccuucagccccgaccacgaguucagaaccagcccccccgugagcagaggccugaccggcggcgagaucguggccgugaucuucggccugcugcugggcgccgcccugcugcugggcauccugguguucagaagcagaagagcccagagacagagacagcagagacagagagacagagccaccgacguggacagagaggacaagcuguggcugaagcccuacguggaccugcaggccuacgaggaccccgcccagggcgcccuggacuucaccagagagcuggaccccgccuggcugaugguggacaccgugaucggcgagggcgaguucggcgagguguacagaggcacccugagacugcccagccaggacugcaagaccguggccaucaagacccugaaggacaccagccccggcggccagugguggaacuuccugagagaggccaccaucaugggccaguucagccacccccacauccugcaccuggagggcguggugaccaagagaaagcccaucaugaucaucaccgaguucauggagaacggcgcccuggacgccuuccugagagagagagaggaccagcuggugcccggccagcugguggccaugcugcagggcaucgccagcggcaugaacuaccugagcaaccacaacuacgugcacagagaccuggccgccagaaacauccuggugaaccagaaccugugcugcaaggugagcgacuucggccugaccagacugcuggacgacuucgacggcaccuacgagacccagggcggcaagauccccaucagauggaccgcccccgaggccaucgcccacagaaucuucaccaccgccagcgacguguggagcuucggcaucgugaugugggaggugcugagcuucggcgacaagcccuacggcgagaugagcaaccaggaggugaugaagagcaucgaggacggcuacagacugcccccccccguggacugccccgccccccuguacgagcugaugaagaacugcugggccuacgacagagccagaagaccccacuuccagaagcugcaggcccaccuggagcagcugcuggccaacccccacagccugagaaccaucgccaacuucgaccccagaaugacccugagacugcccagccugagcggcagcgacggcauccccuacagaaccgugagcgaguggcuggagagcaucagaaugaagagauacauccugcacuuccacagcgccggccuggacaccauggagugcgugcuggagcugaccgccgaggaccugacccagaugggcaucacccugcccggccaccagaagagaauccugugcagcauccagggcuucaaggacuaa

SEQ ID NO: 16653 - RNA, 2952 nt, Artificial Sequence
  EPHA3__Homo_sapiens__NP_005224
auggacugccagcugagcauccugcugcugcugagcugcagcgugcuggacagcuucggcgagcugaucccccagcccagcaacgaggugaaccugcuggacagcaagaccauccagggcgagcugggcuggaucagcuaccccagccacggcugggaggagaucagcggcguggacgagcacuacacccccaucagaaccuaccaggugugcaacgugauggaccacagccagaacaacuggcugagaaccaacugggugcccagaaacagcgcccagaagaucuacguggagcugaaguucacccugagagacugcaacagcaucccccuggugcugggcaccugcaaggagaccuucaaccuguacuacauggagagcgacgacgaccacggcgugaaguucagagagcaccaguucaccaagaucgacaccaucgccgccgacgagagcuucacccagauggaccugggcgacagaauccugaagcugaacaccgagaucagagaggugggccccgugaacaagaagggcuucuaccuggccuuccaggacgugggcgccugcguggcccuggugagcgugagaguguacuucaagaagugccccuucaccgugaagaaccuggccauguuccccgacaccgugcccauggacagccagagccugguggaggugagaggcagcugcgugaacaacagcaaggaggaggacccccccagaauguacugcagcaccgagggcgaguggcuggugcccaucggcaagugcagcugcaacgccggcuacgaggagagaggcuucaugugccaggccugcagacccggcuucuacaaggcccuggacggcaacaugaagugcgccaagugccccccccacagcagcacccaggaggacggcagcaugaacugcagaugcgagaacaacuacuucagagccgacaaggacccccccagcauggccugcaccagaccccccagcagccccagaaacgugaucagcaacaucaacgagaccagcgugauccuggacuggagcuggccccuggacaccggcggcagaaaggacgugaccuucaacaucaucugcaagaagugcggcuggaacaucaagcagugcgagcccugcagccccaacgugagauuccugcccagacaguucggccugaccaacaccaccgugaccgugaccgaccugcuggcccacaccaacuacaccuucgagaucgacgccgugaacggcgugagcgagcugagcagcccccccagacaguucgccgccgugagcaucaccaccaaccaggccgcccccagccccgugcugaccaucaagaaggacagaaccagcagaaacagcaucagccugagcuggcaggagcccgagcaccccaacggcaucauccuggacuacgaggugaaguacuacgagaagcaggagcaggagaccagcuacaccauccugagagccagaggcaccaacgugaccaucagcagccugaagcccgacaccaucuacguguuccagaucagagccagaaccgccgccggcuacggcaccaacagcagaaaguucgaguucgagaccagccccgacagcuucagcaucagcggcgagagcagccagguggugaugaucgccaucagcgccgccguggccaucauccugcugaccguggugaucuacgugcugaucggcagauucugcggcuacaagagcaagcacggcgccgacgagaagagacugcacuucggcaacggccaccugaagcugcccggccugagaaccuacguggacccccacaccuacgaggaccccacccaggccgugcacgaguucgccaaggagcuggacgccaccaacaucagcaucgacaagguggugggcgccggcgaguucggcgaggugugcagcggcagacugaagcugcccagcaagaaggagaucagcguggccaucaagacccugaaggugggcuacaccgagaagcagagaagagacuuccugggcgaggccagcaucaugggccaguucgaccaccccaacaucaucagacuggagggcguggugaccaagagcaagcccgugaugaucgugaccgaguacauggagaacggcagccuggacagcuuccugagaaagcacgacgcccaguucaccgugauccagcuggugggcaugcugagaggcaucgccagcggcaugaaguaccugagcgacaugggcuacgugcacagagaccuggccgccagaaacauccugaucaacagcaaccuggugugcaaggugagcgacuucggccugagcagagugcuggaggacgaccccgaggccgccuacaccaccagaggcggcaagauccccaucagauggaccagccccgaggccaucgccuacagaaaguucaccagcgccagcgacguguggagcuacggcaucgugcugugggaggugaugagcuacggcgagagacccuacugggagaugagcaaccaggacgugaucaaggccguggacgagggcuacagacugcccccccccauggacugccccgccgcccuguaccagcugaugcuggacugcuggcagaaggacagaaacaacagacccaaguucgagcagaucgugagcauccuggacaagcugaucagaaaccccggcagccugaagaucaucaccagcgccgccgccagacccagcaaccugcugcuggaccagagcaacguggacaucaccaccuucagaaccaccggcgacuggcugaacggcguguggaccgcccacugcaaggagaucuucaccggcguggaguacagcagcugcgacaccaucgccaagaucagcaccgacgacaugaagaaggugggcgugaccguggugggcccccagaagaagaucaucagcagcaucaaggcccuggagacccagagcaagaacggccccgugcccguguaa

SEQ ID NO: 16654 - RNA, 2961 nt, Artificial Sequence
  EPHA4__Homo_sapiens__NP_001291465
auggccggcaucuucuacuucgcccuguucagcugccuguucggcaucugcgacgccgugaccggcagcagaguguaccccgccaacgaggugacccugcuggacagcagaagcgugcagggcgagcugggcuggaucgccagcccccuggagggcggcugggaggaggugagcaucauggacgagaagaacacccccaucagaaccuaccaggugugcaacgugauggagcccagccagaacaacuggcugagaaccgacuggaucaccagagagggcgcccagagaguguacaucgagaucaaguucacccugagagacugcaacagccugcccggcgugaugggcaccugcaaggagaccuucaaccuguacuacuacgagagcgacaacgacaaggagagauucaucagagagaaccaguucgugaagaucgacaccaucgccgccgacgagagcuucacccagguggacaucggcgacagaaucaugaagcugaacaccgagaucagagacgugggcccccugagcaagaagggcuucuaccuggccuuccaggacgugggcgccugcaucgcccuggugagcgugagaguguucuacaagaagugcccccugaccgugagaaaccuggcccaguuccccgacaccaucaccggcgccgacaccagcagccugguggaggugagaggcagcugcgugaacaacagcgaggagaaggacgugcccaagauguacugcggcgccgacggcgaguggcuggugcccaucggcaacugccugugcaacgccggccacgaggagagaagcggcgagugccaggccugcaagaucggcuacuacaaggcccugagcaccgacgccaccugcgccaagugccccccccacagcuacagcgugugggagggcgccaccagcugcaccugcgacagaggcuucuucagagccgacaacgacgccgccagcaugcccugcaccagaccccccagcgccccccugaaccugaucagcaacgugaacgagaccagcgugaaccuggaguggagcagcccccagaacaccggcggcagacaggacaucagcuacaacguggugugcaagaagugcggcgccggcgaccccagcaagugcagacccugcggcagcggcgugcacuacaccccccagcagaacggccugaagaccaccaaggugagcaucaccgaccugcuggcccacaccaacuacaccuucgagaucugggccgugaacggcgugagcaaguacaaccccaaccccgaccagagcgugagcgugaccgugaccaccaaccaggccgcccccagcagcaucgcccuggugcaggccaaggaggugaccagauacagcguggcccuggccuggcuggagcccgacagacccaacggcgugauccuggaguacgaggugaaguacuacgagaaggaccagaacgagagaagcuacagaaucgugagaaccgccgccagaaacaccgacaucaagggccugaacccccugaccagcuacguguuccacgugagagccagaaccgccgccggcuacggcgacuucagcgagccccuggaggugaccaccaacaccgugcccagcagaaucaucggcgacggcgccaacagcaccgugcugcuggugagcgugagcggcagcguggugcugguggugauccugaucgccgccuucgugaucagcagaagaagaagcaaguacagcaaggccaagcaggaggccgacgaggagaagcaccugaaccagggcgugagaaccuacguggaccccuucaccuacgaggaccccaaccaggccgugagagaguucgccaaggagaucgacgccagcugcaucaagaucgagaaggugaucggcgugggcgaguucggcgaggugugcagcggcagacugaaggugcccggcaagagagagaucugcguggccaucaagacccugaaggccggcuacaccgacaagcagagaagagacuuccugagcgaggccagcaucaugggccaguucgaccaccccaacaucauccaccuggagggcguggugaccaagugcaagcccgugaugaucaucaccgaguacauggagaacggcagccuggacgccuuccugagaaagaacgacggcagauucaccgugauccagcuggugggcaugcugagaggcaucggcagcggcaugaaguaccugagcgacaugagcuacgugcacagagaccuggccgccagaaacauccuggugaacagcaaccuggugugcaaggugagcgacuucggcaugagcagagugcuggaggacgaccccgaggccgccuacaccaccagaggcggcaagauccccaucagauggaccgcccccgaggccaucgccuacagaaaguucaccagcgccagcgacguguggagcuacggcaucgugaugugggaggugaugagcuacggcgagagacccuacugggacaugagcaaccaggacgugaucaaggccaucgaggagggcuacagacugcccccccccauggacugccccaucgcccugcaccagcugaugcuggacugcuggcagaaggagagaagcgacagacccaaguucggccagaucgugaacaugcuggacaagcugaucagaaaccccaacagccugaagagaaccggcaccgagagcagcagacccaacaccgcccugcuggaccccagcagccccgaguucagcgccguggugagcgugggcgacuggcugcaggccaucaagauggacagauacaaggacaacuucaccgccgccggcuacaccacccuggaggccguggugcacgugaaccaggaggaccuggccagaaucggcaucaccgccaucacccaccagaacaagauccugagcagcgugcaggccaugagaacccagaugcagcagaugcacggcagaauggugcccguguaa

SEQ ID NO: 16655 - RNA, 3117 nt, Artificial Sequence
  EPHA5__Homo_sapiens__NP_001268694
augagaggcagcggccccagaggcgccggcagaagaagaccccccagcggcggcggcgacacccccaucacccccgccagccuggccggcugcuacagcgcccccagaagagccccccuguggaccugccugcugcugugcgccgcccugagaacccugcuggccagccccagcaacgaggugaaccugcuggacagcagaaccgugaugggcgaccugggcuggaucgccuuccccaagaacggcugggaggagaucggcgagguggacgagaacuacgcccccauccacaccuaccaggugugcaaggugauggagcagaaccagaacaacuggcugcugaccagcuggaucagcaacgagggcgccagcagaaucuucaucgagcugaaguucacccugagagacugcaacagccugcccggcggccugggcaccugcaaggagaccuucaacauguacuacuucgagagcgacgaccagaacggcagaaacaucaaggagaaccaguacaucaagaucgacaccaucgccgccgacgagagcuucaccgagcuggaccugggcgacagagugaugaagcugaacaccgaggugagagacgugggcccccugagcaagaagggcuucuaccuggccuuccaggacgugggcgccugcaucgcccuggugagcgugagaguguacuacaagaagugccccagcguggugagacaccuggccguguuccccgacaccaucaccggcgccgacagcagccagcugcuggaggugagcggcagcugcgugaaccacagcgugaccgacgagccccccaagaugcacugcagcgccgagggcgaguggcuggugcccaucggcaagugcaugugcaaggccggcuacgaggagaagaacggcaccugccaggugugcagacccggcuucuucaaggccagcccccacauccagagcugcggcaagugccccccccacagcuacacccacgaggaggccagcaccagcugcgugugcgagaaggacuacuucagaagagagagcgacccccccaccauggccugcaccagaccccccagcgcccccagaaacgccaucagcaacgugaacgagaccagcguguuccuggaguggaucccccccgccgacaccggcggcagaaaggacgugagcuacuacaucgccugcaagaagugcaacagccacgccggcgugugcgaggagugcggcggccacgugagauaccugcccagacagagcggccugaagaacaccagcgugaugaugguggaccugcuggcccacaccaacuacaccuucgagaucgaggccgugaacggcgugagcgaccugagccccggcgccagacaguacgugagcgugaacgugaccaccaaccaggccgcccccagccccgugaccaacgugaagaagggcaagaucgccaagaacagcaucagccugagcuggcaggagcccgacagacccaacggcaucauccuggaguacgagaucaaguacuucgagaaggaccaggagaccagcuacaccaucaucaagagcaaggagaccaccaucaccgccgagggccugaagcccgccagcguguacguguuccagaucagagccagaaccgccgccggcuacggcguguucagcagaagauucgaguucgagaccacccccgugagcguggccgccagcagcgaccagagccagauccccgugaucgccgugagcgugaccgugggcgugauccugcuggccguggugaucggcgugcugcugagcggcagcugcugcgagugcggcugcggcagagccagcagccugugcgccguggcccaccccagccugaucuggagaugcggcuacagcaaggccaagcaggaccccgaggaggagaagaugcacuuccacaacggccacaucaagcugcccggcgugagaaccuacaucgacccccacaccuacgaggaccccaaccaggccgugcacgaguucgccaaggagaucgaggccagcugcaucaccaucgagagagugaucggcgccggcgaguucggcgaggugugcagcggcagacugaagcugcccggcaagagagagcugcccguggccaucaagacccugaaggugggcuacaccgagaagcagagaagagacuuccugggcgaggccagcaucaugggccaguucgaccaccccaacaucauccaccuggagggcguggugaccaagagcaagcccgugaugaucgugaccgaguacauggagaacggcagccuggacaccuuccugaagaagaacgacggccaguucaccgugauccagcuggugggcaugcugagaggcaucagcgccggcaugaaguaccugagcgacaugggcuacgugcacagagaccuggccgccagaaacauccugaucaacagcaaccuggugugcaaggugagcgacuucggccugagcagagugcuggaggacgaccccgaggccgccuacaccaccagaggcggcaagauccccaucagauggaccgcccccgaggccaucgccuucagaaaguucaccagcgccagcgacguguggagcuacggcaucgugaugugggagguggugagcuacggcgagagacccuacugggagaugaccaaccaggacgugaucaaggccguggaggagggcuacagacugcccagccccauggacugccccgccgcccuguaccagcugaugcuggacugcuggcagaaggagagaaacagcagacccaaguucgacgagaucgugaacaugcuggacaagcugaucagaaaccccagcagccugaagacccuggugaacgccagcugcagagugagcaaccugcuggccgagcacagcccccugggcagcggcgccuacagaagcgugggcgaguggcuggaggccaucaagaugggcagauacaccgagaucuucauggagaacggcuacagcagcauggacgccguggcccaggugacccuggaggaccugagaagacugggcgugacccuggugggccaccagaagaagaucaugaacagccugcaggagaugaaggugcagcuggugaacggcauggugccccuguaa

SEQ ID NO: 16656 - RNA, 3393 nt, Artificial Sequence
  EPHA6__Homo_sapiens__NP_001073917
augcaguuccccagcccccccgccgccagaagcagccccgccccccaggccgccagcagcagcgaggccgccgcccccgccaccggccagcccggccccagcugccccgugcccggcaccagcagaagaggcagacccggcaccccccccgccggcagaguggaggaggaggaggaggaggaggaggaggacguggacaaggacccccaccccacccagaacaccugccugagaugcagacacuucagccugagagagagaaagagagagcccagaagaaccaugggcggcugcgaggugagagaguuccugcugcaguucggcuucuuccugccccugcugaccgccuggcccggcgacugcagccacgugagcaacaaccagguggugcugcuggacaccaccaccgugcugggcgagcugggcuggaagaccuacccccugaacggcugggacgccaucaccgagauggacgagcacaacagacccauccacaccuaccaggugugcaacgugauggagcccaaccagaacaacuggcugagaaccaacuggaucagcagagacgccgcccagaagaucuacguggagaugaaguucacccugagagacugcaacagcauccccugggugcugggcaccugcaaggagaccuucaaccuguucuacauggagagcgacgagagccacggcaucaaguucaagcccaaccaguacaccaagaucgacaccaucgccgccgacgagagcuucacccagauggaccugggcgacagaauccugaagcugaacaccgagaucagagaggugggccccaucgagagaaagggcuucuaccuggccuuccaggacaucggcgccugcaucgcccuggugagcgugagaguguucuacaagaagugccccuucaccgugagaaaccuggccauguuccccgacaccauccccagaguggacagcagcagccugguggaggugagaggcagcugcgugaagagcgccgaggagagagacacccccaagcuguacugcggcgccgacggcgacuggcuggugccccugggcagaugcaucugcagcaccggcuacgaggagaucgagggcagcugccacgccugcagacccggcuucuacaaggccuucgccggcaacaccaagugcagcaagugccccccccacagccugaccuacauggaggccaccagcgugugccagugcgagaagggcuacuucagagccgagaaggacccccccagcauggccugcaccagaccccccagcgcccccagaaacgugguguucaacaucaacgagaccgcccugauccuggaguggagcccccccagcgacaccggcggcagaaaggaccugaccuacagcgugaucugcaagaagugcggccuggacaccagccagugcgaggacugcggcggcggccugagauucauccccagacacaccggccugaucaacaacagcgugaucgugcuggacuucgugagccacgugaacuacaccuucgagaucgaggccaugaacggcgugagcgagcugagcuucagccccaagcccuucaccgccaucaccgugaccaccgaccaggacgcccccagccugaucggcguggugagaaaggacugggccagccagaacagcaucgcccugagcuggcaggcccccgccuucagcaacggcgccauccuggacuacgagaucaaguacuacgagaaggagcacgagcagcugaccuacagcagcaccagaagcaaggcccccagcgugaucaucaccggccugaagcccgccaccaaguacguguuccacaucagagugagaaccgccaccggcuacagcggcuacagccagaaguucgaguucgagaccggcgacgagaccagcgacauggccgccgagcagggccagauccuggugaucgccaccgccgccgugggcggcuucacccugcuggugauccugacccuguucuuccugaucaccggcagaugccagugguacaucaaggccaagaugaagagcgaggagaagagaagaaaccaccugcagaacggccaccugagauuccccggcaucaagaccuacaucgaccccgacaccuacgaggaccccagccuggccgugcacgaguucgccaaggagaucgaccccagcagaaucagaaucgagagagugaucggcgccggcgaguucggcgaggugugcagcggcagacugaagacccccggcaagagagagauccccguggccaucaagacccugaagggcggccacauggacagacagagaagagacuuccugagagaggccagcaucaugggccaguucgaccaccccaacaucaucagacuggagggcguggugaccaagagaagcuuccccgccaucggcguggaggccuucugccccagcuuccugagagccggcuuccugaacagcauccaggccccccaccccgugcccggcggcggcagccugccccccagaauccccgccggcagacccgugaugaucgugguggaguacauggagaacggcagccuggacagcuuccugagaaagcacgacggccacuucaccgugauccagcuggugggcaugcugagaggcaucgccagcggcaugaaguaccugagcgacaugggcuacgugcacagagaccuggccgccagaaacauccuggugaacagcaaccuggugugcaaggugagcgacuucggccugagcagagugcuggaggacgaccccgaggccgccuacaccaccaccggcggcaagauccccaucagauggaccgcccccgaggccaucgccuacagaaaguucagcagcgccagcgacgccuggagcuacggcaucgugaugugggaggugaugagcuacggcgagagacccuacugggagaugagcaaccaggacgugauccugagcaucgaggagggcuacagacugcccgcccccaugggcugccccgccagccugcaccagcugaugcugcacugcuggcagaaggagagaaaccacagacccaaguucaccgacaucgugagcuuccuggacaagcugaucagaaaccccagcgcccugcacacccugguggaggacauccuggugaugcccgagagccccggcgaggugcccgaguacccccuguucgugaccgugggcgacuggcuggacagcaucaagaugggccaguacaagaacaacuucguggccgccggcuucaccaccuucgaccugaucagcagaaugagcaucgacgacaucagaagaaucggcgugauccugaucggccaccagagaagaaucgugagcagcauccagacccugagacugcacaugaugcacauccaggagaagggcuuccacguguaa

SEQ ID NO: 16657 - RNA, 840 nt, Artificial Sequence
  EPHA7__Homo_sapiens__NP_001275559
augguguuccagaccagauaccccagcuggaucauccugugcuacaucuggcugcugagauucgcccacaccggcgaggcccaggccgccaaggaggugcugcugcuggacagcaaggcccagcagaccgagcuggaguggaucagcagcccccccaacggcugggaggagaucagcggccuggacgagaacuacacccccaucagaaccuaccaggugugccaggugauggagcccaaccagaacaacuggcugagaaccaacuggaucagcaagggcaacgcccagagaaucuucguggagcugaaguucacccugagagacugcaacagccugcccggcgugcugggcaccugcaaggagaccuucaaccuguacuacuacgagaccgacuacgacaccggcagaaacaucagagagaaccuguacgugaagaucgacaccaucgccgccgacgagagcuucacccagggcgaccugggcgagagaaagaugaagcugaacaccgaggugagagagaucggcccccugagcaagaagggcuucuaccuggccuuccaggacgugggcgccugcaucgcccuggugagcgugaagguguacuacaagaagugcuggagcaucaucgagaaccuggccaucuuccccgacaccgugaccggcagcgaguucagcagccugguggaggugagaggcaccugcgugagcagcgccgaggaggaggccgagaacgcccccagaaugcacugcagcgccgagggcgaguggcuggugcccaucggcaagugcaucugcaaggccggcuaccagcagaagggcgacaccugcgagagaaaguaa

SEQ ID NO: 16658 - RNA, 2955 nt, Artificial Sequence
  EPHB1__Homo_sapiens__NP_004432
auggcccuggacuaccugcugcugcugcugcuggccagcgccguggccgccauggaggagacccugauggacaccagaaccgccaccgccgagcugggcuggaccgccaaccccgccagcggcugggaggaggugagcggcuacgacgagaaccugaacaccaucagaaccuaccaggugugcaacguguucgagcccaaccagaacaacuggcugcugaccaccuucaucaacagaagaggcgcccacagaaucuacaccgagaugagauucaccgugagagacugcagcagccugcccaacgugcccggcagcugcaaggagaccuucaaccuguacuacuacgagaccgacagcgugaucgccaccaagaagagcgccuucuggagcgaggcccccuaccugaagguggacaccaucgccgccgacgagagcuucagccagguggacuucggcggcagacugaugaaggugaacaccgaggugagaagcuucggcccccugaccagaaacggcuucuaccuggccuuccaggacuacggcgccugcaugagccugcugagcgugagaguguucuucaagaagugccccagcaucgugcagaacuucgccguguuccccgagaccaugaccggcgccgagagcaccagccuggugaucgccagaggcaccugcauccccaacgccgaggagguggacgugcccaucaagcuguacugcaacggcgacggcgaguggauggugcccaucggcagaugcaccugcaagcccggcuacgagcccgagaacagcguggccugcaaggccugccccgccggcaccuucaaggccagccaggaggccgagggcugcagccacugccccagcaacagcagaagccccgccgaggccagccccaucugcaccugcagaaccggcuacuacagagccgacuucgacccccccgagguggccugcaccagcgugcccagcggccccagaaacgugaucagcaucgugaacgagaccagcaucauccuggaguggcacccccccagagagaccggcggcagagacgacgugaccuacaacaucaucugcaagaagugcagagccgacagaagaagcugcagcagaugcgacgacaacguggaguucgugcccagacagcugggccugaccgagugcagagugagcaucagcagccugugggcccacacccccuacaccuucgacauccaggccaucaacggcgugagcagcaagagccccuuccccccccagcacgugagcgugaacaucaccaccaaccaggccgcccccagcaccgugcccaucaugcaccaggugagcgccaccaugagaagcaucacccugagcuggccccagcccgagcagcccaacggcaucauccuggacuacgagaucagauacuacgagaaggagcacaacgaguucaacagcagcauggccagaagccagaccaacaccgccagaaucgacggccugagacccggcaugguguacguggugcaggugagagccagaaccguggccggcuacggcaaguucagcggcaagaugugcuuccagacccugaccgacgacgacuacaagagcgagcugagagagcagcugccccugaucgccggcagcgccgccgccggcgugguguucguggugagccugguggccaucagcaucgugugcagcagaaagagagccuacagcaaggaggccguguacagcgacaagcugcagcacuacagcaccggcagaggcagccccggcaugaagaucuacaucgaccccuucaccuacgaggaccccaacgaggccgugagagaguucgccaaggagaucgacgugagcuucgugaagaucgaggaggugaucggcgccggcgaguucggcgagguguacaagggcagacugaagcugcccggcaagagagagaucuacguggccaucaagacccugaaggccggcuacagcgagaagcagagaagagacuuccugagcgaggccagcaucaugggccaguucgaccaccccaacaucaucagacuggagggcguggugaccaagagcagacccgugaugaucaucaccgaguucauggagaacggcgcccuggacagcuuccugagacagaacgacggccaguucaccgugauccagcuggugggcaugcugagaggcaucgccgccggcaugaaguaccuggccgagaugaacuacgugcacagagaccuggccgccagaaacauccuggugaacagcaaccuggugugcaaggugagcgacuucggccugagcagauaccugcaggacgacaccagcgaccccaccuacaccagcagccugggcggcaagauccccgugagauggaccgcccccgaggccaucgccuacagaaaguucaccagcgccagcgacguguggagcuacggcaucgugaugugggaggugaugagcuucggcgagagacccuacugggacaugagcaaccaggacgugaucaacgccaucgagcaggacuacagacugcccccccccauggacugccccgccgcccugcaccagcugaugcuggacugcuggcagaaggacagaaacagcagacccagauucgccgagaucgugaacacccuggacaagaugaucagaaaccccgccagccugaagaccguggccaccaucaccgccgugcccagccagccccugcuggacagaagcauccccgacuucaccgccuucaccaccguggacgacuggcugagcgccaucaagauggugcaguacagagacagcuuccugaccgccggcuucaccagccugcagcuggugacccagaugaccagcgaggaccugcugagaaucggcaucacccuggccggccaccagaagaagauccugaacagcauccacagcaugagagugcagaucagccagagccccaccgccauggccuaa

SEQ ID NO: 16659 - RNA, 2997 nt, Artificial Sequence
  EPHB3__Homo_sapiens__NP_004434
auggccagagccagacccccccccccccccagccccccccccggccugcugccccugcugcccccccugcugcugcugccccugcugcugcugcccgccggcugcagagcccuggaggagacccugauggacaccaagugggugaccagcgagcuggccuggaccagccaccccgagagcggcugggaggaggugagcggcuacgacgaggccaugaaccccaucagaaccuaccaggugugcaacgugagagagagcagccagaacaacuggcugagaaccggcuucaucuggagaagagacgugcagagaguguacguggagcugaaguucaccgugagagacugcaacagcauccccaacauccccggcagcugcaaggagaccuucaaccuguucuacuacgaggccgacagcgacguggccagcgccagcagccccuucuggauggagaaccccuacgugaagguggacaccaucgcccccgacgagagcuucagcagacuggacgccggcagagugaacaccaaggugagaagcuucggcccccugagcaaggccggcuucuaccuggccuuccaggaccagggcgccugcaugagccugaucagcgugagagccuucuacaagaagugcgccagcaccaccgccggcuucgcccuguuccccgagacccugaccggcgccgagcccaccagccuggugaucgcccccggcaccugcauccccaacgccguggaggugagcgugccccugaagcuguacugcaacggcgacggcgaguggauggugcccgugggcgccugcaccugcgccaccggccacgagcccgccgccaaggagagccagugcagacccugcccccccggcagcuacaaggccaagcagggcgagggccccugccugcccugcccccccaacagcagaaccaccagccccgccgccagcaucugcaccugccacaacaacuucuacagagccgacagcgacagcgccgacagcgccugcaccaccgugcccagcccccccagaggcgugaucagcaacgugaacgagaccagccugauccuggaguggagcgagcccagagaccugggcggcagagacgaccugcuguacaacgugaucugcaagaagugccacggcgccggcggcgccagcgccugcagcagaugcgacgacaacguggaguucgugcccagacagcugggccugaccgagagaagagugcacaucagccaccugcuggcccacaccagauacaccuucgaggugcaggccgugaacggcgugagcggcaagagcccccugccccccagauacgccgccgugaacaucaccaccaaccaggccgcccccagcgaggugcccacccugagacugcacagcagcagcggcagcagccugacccugagcugggccccccccgagagacccaacggcgugauccuggacuacgagaugaaguacuucgagaagagcgagggcaucgccagcaccgugaccagccagaugaacagcgugcagcuggacggccugagacccgacgccagauacguggugcaggugagagccagaaccguggccggcuacggccaguacagcagacccgccgaguucgagaccaccagcgagagaggcagcggcgcccagcagcugcaggagcagcugccccugaucgugggcagcgccaccgccggccugguguucgugguggccgugguggugaucgccaucgugugccugagaaagcagagacacggcagcgacagcgaguacaccgagaagcugcagcaguacaucgcccccggcaugaagguguacaucgaccccuucaccuacgaggaccccaacgaggccgugagagaguucgccaaggagaucgacgugagcugcgugaagaucgaggaggugaucggcgccggcgaguucggcgaggugugcagaggcagacugaagcagcccggcagaagagagguguucguggccaucaagacccugaaggugggcuacaccgagagacagagaagagacuuccugagcgaggccagcaucaugggccaguucgaccaccccaacaucaucagacuggagggcguggugaccaagagcagacccgugaugauccugaccgaguucauggagaacugcgcccuggacagcuuccugagacugaacgacggccaguucaccgugauccagcuggugggcaugcugagaggcaucgccgccggcaugaaguaccugagcgagaugaacuacgugcacagagaccuggccgccagaaacauccuggugaacagcaaccuggugugcaaggugagcgacuucggccugagcagauuccuggaggacgaccccagcgaccccaccuacaccagcagccugggcggcaagauccccaucagauggaccgcccccgaggccaucgccuacagaaaguucaccagcgccagcgacguguggagcuacggcaucgugaugugggaggugaugagcuacggcgagagacccuacugggacaugagcaaccaggacgugaucaacgccguggagcaggacuacagacugcccccccccauggacugccccaccgcccugcaccagcugaugcuggacugcugggugagagacagaaaccugagacccaaguucagccagaucgugaacacccuggacaagcugaucagaaacgccgccagccugaaggugaucgccagcgcccagagcggcaugagccagccccugcuggacagaaccgugcccgacuacaccaccuucaccaccgugggcgacuggcuggacgccaucaagaugggcagauacaaggagagcuucgugagcgccggcuucgccagcuucgaccugguggcccagaugaccgccgaggaccugcugagaaucggcgugacccuggccggccaccagaagaagauccugagcagcauccaggacaugagacugcagaugaaccagacccugcccgugcagguguaa

SEQ ID NO: 16660 - RNA, 2964 nt, Artificial Sequence
  EPHB4__Homo_sapiens__NP_004435
auggagcugagagugcugcugugcugggccagccuggccgccgcccuggaggagacccugcugaacaccaagcuggagaccgccgaccugaagugggugaccuucccccagguggacggccagugggaggagcugagcggccuggacgaggagcagcacagcgugagaaccuacgaggugugcgacgugcagagagcccccggccaggcccacuggcugagaaccggcugggugcccagaagaggcgccgugcacguguacgccacccugagauucaccaugcuggagugccugagccugcccagagccggcagaagcugcaaggagaccuucaccguguucuacuacgagagcgacgccgacaccgccaccgcccugacccccgccuggauggagaaccccuacaucaagguggacaccguggccgccgagcaccugaccagaaagagacccggcgccgaggccaccggcaaggugaacgugaagacccugagacugggcccccugagcaaggccggcuucuaccuggccuuccaggaccagggcgccugcauggcccugcugagccugcaccuguucuacaagaagugcgcccagcugaccgugaaccugaccagauuccccgagaccgugcccagagagcugguggugcccguggccggcagcugcgugguggacgccgugcccgcccccggccccagccccagccuguacugcagagaggacggccagugggccgagcagcccgugaccggcugcagcugcgcccccggcuucgaggccgccgagggcaacaccaagugcagagccugcgcccagggcaccuucaagccccugagcggcgagggcagcugccagcccugccccgccaacagccacagcaacaccaucggcagcgccgugugccagugcagagugggcuacuucagagccagaaccgaccccagaggcgcccccugcaccaccccccccagcgcccccagaagcguggugagcagacugaacggcagcagccugcaccuggaguggagcgccccccuggagagcggcggcagagaggaccugaccuacgcccugagaugcagagagugcagacccggcggcagcugcgcccccugcggcggcgaccugaccuucgaccccggccccagagaccugguggagcccugggugguggugagaggccugagacccgacuucaccuacaccuucgaggugaccgcccugaacggcgugagcagccuggccaccggccccgugcccuucgagcccgugaacgugaccaccgacagagaggugccccccgccgugagcgacaucagagugaccagaagcagccccagcagccugagccuggccugggccgugcccagagcccccagcggcgccgugcuggacuacgaggugaaguaccacgagaagggcgccgagggccccagcagcgugagauuccugaagaccagcgagaacagagccgagcugagaggccugaagagaggcgccagcuaccuggugcaggugagagccagaagcgaggccggcuacggccccuucggccaggagcaccacagccagacccagcuggacgagagcgagggcuggagagagcagcuggcccugaucgccggcaccgccguggugggcguggugcuggugcugguggugaucgugguggccgugcugugccugagaaagcagagcaacggcagagaggccgaguacagcgacaagcacggccaguaccugaucggccacggcaccaagguguacaucgaccccuucaccuacgaggaccccaacgaggccgugagagaguucgccaaggagaucgacgugagcuacgugaagaucgaggaggugaucggcgccggcgaguucggcgaggugugcagaggcagacugaaggcccccggcaagaaggagagcugcguggccaucaagacccugaagggcggcuacaccgagagacagagaagagaguuccugagcgaggccagcaucaugggccaguucgagcaccccaacaucaucagacuggagggcguggugaccaacagcaugcccgugaugauccugaccgaguucauggagaacggcgcccuggacagcuuccugagacugaacgacggccaguucaccgugauccagcuggugggcaugcugagaggcaucgccagcggcaugagauaccuggccgagaugagcuacgugcacagagaccuggccgccagaaacauccuggugaacagcaaccuggugugcaaggugagcgacuucggccugagcagauuccuggaggagaacagcagcgaccccaccuacaccagcagccugggcggcaagauccccaucagauggaccgcccccgaggccaucgccuucagaaaguucaccagcgccagcgacgccuggagcuacggcaucgugaugugggaggugaugagcuucggcgagagacccuacugggacaugagcaaccaggacgugaucaacgccaucgagcaggacuacagacugccccccccccccgacugccccaccagccugcaccagcugaugcuggacugcuggcagaaggacagaaacgccagacccagauucccccagguggugagcgcccuggacaagaugaucagaaaccccgccagccugaagaucguggccagagagaacggcggcgccagccacccccugcuggaccagagacagccccacuacagcgccuucggcagcgugggcgaguggcugagagccaucaagaugggcagauacgaggagagcuucgccgccgccggcuucggcagcuucgagcuggugagccagaucagcgccgaggaccugcugagaaucggcgugacccuggccggccaccagaagaagauccuggccagcgugcagcacaugaagagccaggccaagcccggcacccccggcggcaccggcggccccgccccccaguacuaa

SEQ ID NO: 16661 - RNA, 2190 nt, Artificial Sequence
  EPHB6__Homo_sapiens__NP_001267724
augguggccgugggcggcugcagaugccagcccggcuaccagcccgccagaggcgacaaggccugccaggccugccccagaggccuguacaaggccagcgccggcaacgcccccugcagccccugccccgccagaagccacgcccccaaccccgccgcccccgugugccccugccuggagggcuucuacagagccagcagcgacccccccgaggcccccugcaccggcccccccagcgccccccaggagcugugguucgaggugcagggcagcgcccugaugcugcacuggagacugcccagagagcugggcggcagaggcgaccugcuguucaacguggugugcaaggagugcgagggcagacaggagcccgccagcggcggcggcggcaccugccacagaugcagagacgaggugcacuucgaccccagacagagaggccugaccgagagcagagugcuggugggcggccugagagcccacgugcccuacauccuggaggugcaggccgugaacggcgugagcgagcugagccccgaccccccccaggccgccgccaucaacgugagcaccagccacgaggugcccagcgccgugcccguggugcaccaggugagcagagccagcaacagcaucaccgugagcuggccccagcccgaccagaccaacggcaacauccuggacuaccagcugagauacuacgaccaggccgaggacgagagccacagcuucacccugaccagcgagaccaacaccgccaccgugacccagcugagccccggccacaucuacggcuuccaggugagagccagaaccgccgccggccacggccccuacggcggcaagguguacuuccagacccugccccagggcgagcugagcagccagcugcccgagagacugagccuggugaucggcagcauccugggcgcccuggccuuccugcugcuggccgccaucaccgugcuggccgugguguuccagagaaagagaagaggcaccggcuacaccgagcagcugcagcaguacagcagccccggccugggcgugaaguacuacaucgaccccagcaccuacgaggaccccugccaggccaucagagagcuggccagagagguggaccccgccuacaucaagaucgaggaggugaucggcaccggcagcuucggcgaggugagacagggcagacugcagcccagaggcagaagagagcagaccguggccauccaggcccugugggccggcggcgccgagagccugcagaugaccuuccugggcagagccgccgugcugggccaguuccagcaccccaacauccugagacuggagggcguggugaccaagagcagaccccugauggugcugaccgaguucauggagcugggcccccuggacagcuuccugagacagagagagggccaguucagcagccugcagcugguggccaugcagagaggcguggccgccgccaugcaguaccugagcagcuucgccuucgugcacagaagccugagcgcccacagcgugcuggugaacagccaccuggugugcaagguggccagacugggccacagcccccagggccccagcugccugcugagaugggccgcccccgaggugaucgcccacggcaagcacaccaccagcagcgacguguggagcuucggcauccugaugugggaggugaugagcuacggcgagagacccuacugggacaugagcgagcaggaggugcugaacgccaucgagcaggaguucagacugccccccccccccggcugcccccccggccugcaccugcugaugcuggacaccuggcagaaggacagagccagaagaccccacuucgaccagcugguggccgccuucgacaagaugaucagaaagcccgacacccugcaggccggcggcgaccccggcgagagacccagccaggcccugcugacccccguggcccuggacuuccccugccuggacagcccccaggccuggcugagcgccaucggccuggagugcuaccaggacaacuucagcaaguucggccugugcaccuucagcgacguggcccagcugagccuggaggaccugcccgcccugggcaucacccuggccggccaccagaagaagcugcugcaccacauccagcugcugcagcagcaccugagacagcagggcagcguggagguguaa

SEQ ID NO: 16662 - RNA, 1368 nt, Artificial Sequence
  EPHX1__Homo_sapiens__NP_000111
auguggcuggagauccugcugaccagcgugcugggcuucgccaucuacugguucaucagcagagacaaggaggagacccugccccuggaggacggcugguggggccccggcaccagaagcgccgccagagaggacgacagcaucagacccuucaagguggagaccagcgacgaggagauccacgaccugcaccagagaaucgacaaguucagauucacccccccccuggaggacagcugcuuccacuacggcuucaacagcaacuaccugaagaaggugaucagcuacuggagaaacgaguucgacuggaagaagcagguggagauccugaacagauacccccacuucaagaccaagaucgagggccuggacauccacuucauccacgugaagcccccccagcugcccgccggccacacccccaagccccugcugauggugcacggcuggcccggcagcuucuacgaguucuacaagaucaucccccugcugaccgaccccaagaaccacggccugagcgacgagcacguguucgaggugaucugccccagcauccccggcuacggcuucagcgaggccagcagcaagaagggcuucaacagcguggccaccgccagaaucuucuacaagcugaugcugagacugggcuuccaggaguucuacauccagggcggcgacuggggcagccugaucugcaccaacauggcccagcuggugcccagccacgugaagggccugcaccugaacauggcccuggugcugagcaacuucagcacccugacccugcugcugggccagagauucggcagauuccugggccugaccgagagagacguggagcugcuguaccccgugaaggagaagguguucuacagccugaugagagagagcggcuacaugcacauccagugcaccaagcccgacaccgugggcagcgcccugaacgacagccccgugggccuggccgccuacauccuggagaaguucagcaccuggaccaacaccgaguucagauaccuggaggacggcggccuggagagaaaguucagccuggacgaccugcugaccaacgugaugcuguacuggaccaccggcaccaucaucagcagccagagauucuacaaggagaaccugggccagggcuggaugacccagaagcacgagagaaugaagguguacgugcccaccggcuucagcgccuuccccuucgagcugcugcacacccccgagaagugggugagauucaaguaccccaagcugaucagcuacagcuacauggugagaggcggccacuucgccgccuucgaggagcccgagcugcuggcccaggacaucagaaaguuccugagcgugcuggagagacaguaa

SEQ ID NO: 16663 - RNA, 1509 nt, Artificial Sequence
  EPHX2__Homo_sapiens__NP_001243411
augaagggcgagaucacccugagccaguggaucccccugauggaggagaacugcagaaagugcagcgagaccgccaaggugugccugcccaagaacuucagcaucaaggagaucuucgacaaggccaucagcgccagaaagaucaacagacccaugcugcaggccgcccugaugcugagaaagaagggcuucaccaccgccauccugaccaacaccuggcuggacgacagagccgagagagacggccuggcccagcugaugugcgagcugaagaugcacuucgacuuccugaucgagagcugccaggugggcauggugaagcccgagccccagaucuacaaguuccugcuggacacccugaaggccagccccagcgaggugguguuccuggacgacaucggcgccaaccugaagcccgccagagaccugggcauggugaccauccuggugcaggacaccgacaccgcccugaaggagcuggagaaggugaccggcauccagcugcugaacacccccgccccccugcccaccagcugcaaccccagcgacaugagccacggcuacgugaccgugaagcccagagugagacugcacuucguggagcugggcagcggccccgccgugugccugugccacggcuuccccgagagcugguacagcuggagauaccagauccccgcccuggcccaggccggcuacagagugcuggccauggacaugaagggcuacggcgagagcagcgccccccccgagaucgaggaguacugcauggaggugcugugcaaggagauggugaccuuccuggacaagcugggccugagccaggccguguucaucggccacgacuggggcggcaugcuggugugguacauggcccuguucuaccccgagagagugagagccguggccagccugaacacccccuucauccccgccaaccccaacaugagcccccuggagagcaucaaggccaaccccguguucgacuaccagcuguacuuccaggagcccggcguggccgaggccgagcuggagcagaaccugagcagaaccuucaagagccuguucagagccagcgacgagagcgugcugagcaugcacaaggugugcgaggccggcggccuguucgugaacagccccgaggagcccagccugagcagaauggugaccgaggaggagauccaguucuacgugcagcaguucaagaagagcggcuucagaggcccccugaacugguacagaaacauggagagaaacuggaagugggccugcaagagccugggcagaaagauccugauccccgcccugauggugaccgccgagaaggacuucgugcuggugccccagaugagccagcacauggaggacuggaucccccaccugaagagaggccacaucgaggacugcggccacuggacccagauggacaagcccaccgaggugaaccagauccugaucaaguggcuggacagcgacgccagaaacccccccguggugagcaagauguaa

SEQ ID NO: 16664 - RNA, 1083 nt, Artificial Sequence
  EPHX3__Homo_sapiens__NP_001136358
augcccgagcugguggugaccgcccugcuggcccccagcagacugagccugaagcugcugagagccuucauguggagccugguguucagcguggcccugguggccgccgccguguacggcugcaucgcccugacccacgugcugugcagacccagaagaggcugcugcggcagaagaagaagcgccagccccgccugccugagcgaccccagccugggcgagcacggcuuccugaaccugaagagcagcggccugagacugcacuacgugagcgccggcagaggcaacggcccccugaugcuguuccugcacggcuuccccgagaacugguucagcuggagauaccagcugagagaguuccagagcagauuccacgugguggccguggaccugagaggcuacggccccagcgacgcccccagagacguggacugcuacaccaucgaccugcugcugguggacaucaaggacgugauccugggccugggcuacagcaagugcauccugguggcccacgacuggggcgcccugcuggccuggcacuucagcaucuacuaccccagccugguggagagaauggugguggugagcggcgcccccaugagcguguaccaggacuacagccugcaccacaucagccaguucuucagaagccacuacauguuccuguuccagcugcccuggcugcccgagaagcugcugagcaugagcgacuuccagauccugaagaccacccugacccacagaaagaccggcauccccugccugacccccagcgagcuggaggccuuccuguacaacuucagccagcccggcggccugaccggcccccugaacuacuacagaaaccuguucagaaacuucccccuggagccccaggagcugaccacccccacccugcugcuguggggcgagaaggacaccuaccuggagcugggccugguggaggccaucggcagcagauucgugcccggcagacuggaggcccacauccugcccggcaucggccacuggaucccccagagcaacccccaggagaugcaccaguacaugugggccuuccugcaggaccugcuggacuaa

SEQ ID NO: 16665 - RNA, 954 nt, Artificial Sequence
  EPM2A__Homo_sapiens__NP_001018051
augagauucagauucggcgugguggugccccccgccguggccggcgccagacccgagcugcugguggugggcagcagacccgagcugggcagaugggagcccagaggcgccgugagacugagacccgccggcaccgccgccggcgacggcgcccuggcccugcaggagcccggccuguggcugggcgagguggagcuggccgccgaggaggccgcccaggacggcgccgagcccggcagaguggacaccuucugguacaaguuccugaagagagagcccggcggcgagcugagcugggagggcaacggcccccaccacgacagaugcugcaccuacaacgagaacaaccugguggacggcguguacugccugcccaucggccacuggaucgaggccaccggccacaccaacgagaugaagcacaccaccgacuucuacuucaacaucgccggccaccaggccaugcacuacagcagaauccugcccaacaucuggcugggcagcugccccagacagguggagcacgugaccaucaagcugaagcacgagcugggcaucaccgccgugaugaacuuccagaccgagugggacaucgugcagaacagcagcggcugcaacagauaccccgagcccaugacccccgacaccaugaucaagcuguacagagaggagggccuggccuacaucuggaugcccacccccgacaugagcaccgagggcagagugcagaugcugccccaggccgugugccugcugcacgcccugcuggagaagggccacaucguguacgugcacugcaacgccggcgugggcagaagcaccgccgccgugugcggcuggcugcaguacgugaugggcuggaaccugagaaaggugcaguacuuccugauggccaagagacccgccguguacaucgacgaggaggccgccagccaggacaccuucccccuguaa

SEQ ID NO: 16666 - RNA, 1824 nt, Artificial Sequence
  EPM2AIP1__Homo_sapiens__NP_055620
auguggaugacccccaagagaagcaagauggagguggacgaggcccugguguucagacccgaguggacccagagauaccuggugguggagccccccgagggcgacggcgcccugugccuggugugcagaagacugaucguggccaccagagagagagacgugagaagacacuacgaggccgagcacgaguacuacgagagauacguggccgacggcgagagagccgcccugguggagagacugagacagggcgaccugcccguggccagcuucacccccgaggagagagccgccagagccggccugggccugugcagacugcuggcccugaagggcagaggcuggggcgagggcgacuucguguaccagugcauggaggugcugcugagagaggugcugcccgagcacgugagcgugcugcagggcguggaccugagccccgacaucaccagacagagaauccugagcaucgacagaaaccugagaaaccagcuguucaacagagccagagacuucaaggccuacagccuggcccuggacgaccaggccuucguggccuacgagaacuaccugcugguguucaucagaggcgugggccccgagcuggaggugcaggaggaccugcugaccaucaucaaccugacccaccacuucagcgugggcgcccugaugagcgccauccuggagagccugcagaccgccggccugagccugcagagaauggugggccugaccaccacccacacccugagaaugaucggcgagaacagcggccuggugagcuacaugagagagaaggccgugagccccaacugcuggaacgugauccacuacagcggcuuccugcaccuggagcugcugagcagcuacgacguggacgugaaccagaucaucaacaccaucagcgaguggaucgugcugaucaagaccagaggcgugagaagacccgaguuccagacccugcugaccgagagcgagagcgagcacggcgagagagugaacggcagaugccugaacaacuggcugagaagaggcaagacccugaagcugaucuucagccugagaaaggagauggaggccuuccuggugagcgugggcgccaccaccgugcacuucagcgacaagcaguggcugugcgacuucggcuuccugguggacaucauggagcaccugagagagcugagcgaggagcugagagugagcaagguguucgccgccgccgccuucgaccacaucugcaccuucgaggugaagcugaaccuguuccagagacacaucgaggagaagaaccugaccgacuuccccgcccugagagaggugguggacgagcugaagcagcagaacaaggaggacgagaagaucuucgaccccgacagauaccagauggugaucugcagacugcagaaggaguucgagagacacuucaaggaccugagauucaucaagaaggaccuggagcuguucagcaaccccuucaacuucaagcccgaguacgcccccaucagcgugagaguggagcugaccaagcugcaggccaacaccaaccuguggaacgaguacagaaucaaggaccugggccaguucuacgccggccugagcgccgagagcuaccccaucaucaagggcguggccugcaagguggccagccuguucgacagcaaccagaucugcgagaaggccuucagcuaccugaccagaaaccagcacacccugagccagccccugaccgacgagcaccugcaggcccuguucagaguggccaccaccgagauggagcccggcugggacgaccuggugagagagagaaacgagagcaaccccuaa

SEQ ID NO: 16667 - RNA, 1989 nt, Artificial Sequence
  EPN1__Homo_sapiens__NP_001123543
augggcgaccagagcuggcuguggaaccaggccgcccccggcgugagaagccccguguucgccugcagcguggagaagggcaacgugccccuggugcugagcgagcaccuggcccacagcagagaccccggcagcggcgccgugagauuccugaucagccccgagcccugggccagcgccauccugggcaccagcggccugcuggccagccccgugcugcccgccgcccuggacgccgugaccugccagcaccugccccagcccagcagcggcagcagacccaucagccccagaaucggcgcccugugcccccugcugcugcagcccggcaccaugagcaccagcagccugagaagacagaugaagaacaucgugcacaacuacagcgaggccgagaucaaggugagagaggccaccagcaacgaccccuggggccccagcagcagccugaugagcgagaucgccgaccugaccuacaacgugguggccuucagcgagaucaugagcaugaucuggaagagacugaacgaccacggcaagaacuggagacacguguacaaggccaugacccugauggaguaccugaucaagaccggcagcgagagagugagccagcagugcaaggagaacauguacgccgugcagacccugaaggacuuccaguacguggacagagacggcaaggaccagggcgugaacgugagagagaaggccaagcagcugguggcccugcugagagacgaggacagacugagagaggagagagcccacgcccugaagaccaaggagaagcuggcccagaccgccaccgccagcagcgccgccgugggcagcggccccccccccgaggccgagcaggccuggccccagagcagcggcgaggaggagcugcagcugcagcuggcccuggccaugagcaaggaggaggccgaccaggaggagagaaucagaagaggcgacgaccugagacugcagauggccaucgaggagagcaagagagagaccggcggcaaggaggagagcagccugauggaccuggccgacguguucaccgcccccgcccccgcccccaccaccgaccccuggggcggccccgcccccauggccgccgccgugcccaccgccgcccccaccagcgaccccuggggcggcccccccgugccccccgccgccgaccccuggggcggccccgcccccacccccgccagcggcgaccccuggagacccgccgcccccgccggccccagcguggaccccuggggcggcacccccgcccccgccgccggcgagggccccacccccgaccccuggggcagcagcgacggcggcgugcccgugagcggccccagcgccagcgaccccuggacccccgcccccgccuucagcgaccccuggggcggcagccccgccaagcccagcaccaacggcaccaccgccgccggcggcuucgacaccgagcccgacgaguucagcgacuucgacagacugagaaccgcccugcccaccagcggcagcagcgccggcgagcuggagcugcuggccggcgaggugcccgccagaagccccggcgccuucgacaugagcggcgugagaggcagccuggccgaggccgugggcagccccccccccgccgccacccccacccccaccccccccaccagaaagacccccgagagcuuccugggccccaacgccgcccugguggaccuggacagccuggugagcagacccggccccaccccccccggcgccaaggccagcaaccccuuccugcccggcggcggccccgccaccggccccagcgugaccaaccccuuccagcccgccccccccgccacccugacccugaaccagcugagacugagccccgugccccccgugcccggcgccccccccaccuacaucagcccccugggcggcggccccggccugccccccaugaugccccccggcccccccgcccccaacaccaaccccuuccugcuguaa

SEQ ID NO: 16668 - RNA, 582 nt, Artificial Sequence
  EPO__Homo_sapiens__NP_000790
augggcgugcacgagugccccgccuggcuguggcugcugcugagccugcugagccugccccugggccugcccgugcugggcgccccccccagacugaucugcgacagcagagugcuggagagauaccugcuggaggccaaggaggccgagaacaucaccaccggcugcgccgagcacugcagccugaacgagaacaucaccgugcccgacaccaaggugaacuucuacgccuggaagagaauggaggugggccagcaggccguggagguguggcagggccuggcccugcugagcgaggccgugcugagaggccaggcccugcuggugaacagcagccagcccugggagccccugcagcugcacguggacaaggccgugagcggccugagaagccugaccacccugcugagagcccugggcgcccagaaggaggccaucagcccccccgacgccgccagcgccgccccccugagaaccaucaccgccgacaccuucagaaagcuguucagaguguacagcaacuuccugagaggcaagcugaagcuguacaccggcgaggccugcagaaccggcgacagauaa

SEQ ID NO: 16669 - RNA, 1527 nt, Artificial Sequence
  EPOR__Homo_sapiens__NP_000112
auggaccaccugggcgccagccuguggccccaggugggcagccugugccugcugcuggccggcgccgccugggcccccccccccaaccugcccgaccccaaguucgagagcaaggccgcccugcuggccgccagaggccccgaggagcugcugugcuucaccgagagacuggaggaccuggugugcuucugggaggaggccgccagcgccggcgugggccccggcaacuacagcuucagcuaccagcuggaggacgagcccuggaagcugugcagacugcaccaggcccccaccgccagaggcgccgugagauucuggugcagccugcccaccgccgacaccagcagcuucgugccccuggagcugagagugaccgccgccagcggcgcccccagauaccacagagugauccacaucaacgagguggugcugcuggacgcccccgugggccugguggccagacuggccgacgagagcggccacguggugcugagauggcugcccccccccgagacccccaugaccagccacaucagauacgagguggacgugagcgccggcaacggcgccggcagcgugcagagaguggagauccuggagggcagaaccgagugcgugcugagcaaccugagaggcagaaccagauacaccuucgccgugagagccagaauggccgagcccagcuucggcggcuucuggagcgccuggagcgagcccgugagccugcugacccccagcgaccuggacccccugauccugacccugagccugauccugguggugauccuggugcugcugaccgugcuggcccugcugagccacagaagagcccugaagcagaagaucuggcccggcauccccagccccgagagcgaguucgagggccuguucaccacccacaagggcaacuuccagcuguggcuguaccagaacgacggcugccugugguggagccccugcacccccuucaccgaggacccccccgccagccuggaggugcugagcgagagaugcuggggcaccaugcaggccguggagcccggcaccgacgacgagggcccccugcuggagcccgugggcagcgagcacgcccaggacaccuaccuggugcuggacaaguggcugcugcccagaaacccccccagcgaggaccugcccggccccggcggcagcguggacaucguggccauggacgagggcagcgaggccagcagcugcagcagcgcccuggccagcaagcccagccccgagggcgccagcgccgccagcuucgaguacaccauccuggaccccagcagccagcugcugagacccuggacccugugccccgagcugccccccacccccccccaccugaaguaccuguaccugguggugagcgacagcggcaucagcaccgacuacagcagcggcgacagccagggcgcccagggcggccugagcgacggccccuacagcaaccccuacgagaacagccugauccccgccgccgagccccugccccccagcuacguggccugcagcuaa

SEQ ID NO: 16670 - RNA, 384 nt, Artificial Sequence
  EPPIN__Homo_sapiens__NP_001289790
augggcagcagcggccugcugagccugcuggugcuguucgugcugcuggccaacgugcagggccccggccugaccgacuggcuguuccccagaagaugccccaagaucagagaggagugcgaguuccaggagagagacgugugcaccaaggacagacagugccaggacaacaagaagugcugcguguucagcugcggcaagaagugccuggaccugaagcaggugagccugcagauguacgccaagugccagaagaagcuggcccccgccuggcugaucuucuucaucggcggcaugaccagaaagaucauccuggcccccugccugagcaugguggccgccagagagaccaucaccaccagcaaccccaagcccaccgccuaa

SEQ ID NO: 16671 - RNA, 540 nt, Artificial Sequence
  EPPIN-WFDC6__Homo_sapiens__NP_001185915
augggcagcagcggccugcugagccugcuggugcuguucgugcugcuggccaacgugcagggccccggccugaccgacuggcuguuccccagaagaugccccaagaucagagaggagugcgaguuccaggagagagacgugugcaccaaggacagacagugccaggacaacaagaagugcugcguguucagcugcggcaagaagugccuggaccugaagcaggacgugugcgagaugcccaaggagaccggccccugccuggccuacuuccugcacuggugguacgacaagaaggacaacaccugcagcauguucguguacggcggcugccagggcaacaacaacaacuuccagagcaaggccaacugccugaacaccugcaagaacaagcagcccugccccaagaucaagguggagugcgagguggaggagaucgaccagugcaccaagcccagagacugccccgagaacaugaagugcugccccuucagcagaggcaagaagugccuggacuucagaaaggccagccugagcaccuaa

SEQ ID NO: 16672 - RNA, 15267 nt, Artificial Sequence
  EPPK1__Homo_sapiens__XP_011515627
augagcggccacacccugcccccccugcccgugcccggcaccaacagcaccgagcaggccagcgugcccagagccauggccgccacccugggcgccggcaccccccccagaccccaggccagaagcaucgccggcguguacguggaggccagcggccaggcccagagcguguacgccgccauggagcagggccugcugcccgccggccugggccaggcccugcuggaggcccaggccgccaccggcggccugguggaccuggccagaggccagcugcugcccgugagcaaggcccugcagcagggccuggugggccuggagcugaaggagaagcugcuggccgccgagagagccaccaccggcuaccccgaccccuacggcggcgagaagcuggcccuguuccaggccaucggcaaggaggugguggacagagcccugggccagagcuggcuggaggugcagcuggccaccggcggccugguggaccccgcccagggcgugcugguggcccccgagcccgccugccaccagggccugcuggacagagagaccuggcacaagcugagcgagcuggagcccggcaccggcgaccugagauuccuggaccccaacacccuggagagacugaccuaccaccagcugcuggagagaugcgugagagcccccggcagcggccuggcccugcugccccugaagaucaccuucagaagcaugggcggcgccgugagcgccgccgagcugcuggaggugggcauccuggacgagcaggccgugcagggccugagagagggcagacuggccgccguggacgugagcgccagagccgaggugagaagauaccuggagggcaccggcagcguggccggcguggugcugcugcccgagggccacaagaagagcuucuuccaggccgccaccgagcaccugcugcccaugggcaccgcccugccccugcuggaggcccaggccgccacccacacccugguggaccccaucaccggccagagacuguggguggacgaggccgugagagccggccuggugagccccgagcugcacgagcagcugcugguggccgagcaggccgugaccggccaccacgaccccuucagcggcagccagaucccccuguuccaggccaugaagaagggccugguggacagaccccuggcccugagacugcuggacgcccagcuggccaccggcggccuggugugccccgccagaagacugagacugccccuggaggccgcccugagaugcggcugccuggacgaggacacccagagacagcugagccaggccggcagcuucagcgacggcacccacggcggccugagauacgagcagcugcuggcccugugcgugaccgaccccgagaccggccuggccuuccugccccugagcggcggccccagaggcggcgagccccagggcccccccuucaucaaguacagcaccagacaggcccugagcaccgccaccgccaccgugagcgugggcaaguucagaggcagacccgugagccugugggagcugcuguucagcgaggccaucagcagcgagcagagagccaugcuggcccagcaguaccaggagggcacccugagcguggagaagcuggccgccaagcugagcgccacccuggagcaggccgccgccaccgccagagugaccuucagcggccugagagacaccgugacccccggcgagcugcugaaggccgagaucaucgaccaggaccuguacgagagacuggagcacggccaggccaccgccaaggacgugggcagccuggccagcgugcagagauaccugcagggcaccggcugcaucgccggccugcugcugcccggcagccaggagagacugagcaucuacgaggccagaugcaagggccugcugagacccggcaccgcccugauccugcuggaggcccaggccgccaccggcuucaucaucgaccccaaggccaacaagggccacagcguggaggaggcccugagagccgccgugaucggccccgacguguucgccaagcugcugagcgccgagagagccgugaccggcuacaccgaccccuacaccggccagcagaucagccuguuccaggccaugcagaagggccugaucgugagagagcacggcaucagacugcuggaggcccagaucgccaccggcggcgugaucgaccccgugcacagccacagagugcccguggacguggccuacagaagaggcuacuucgaccagaugcugaaccugauccugcuggaccccagcgacgacaccaagggcuucuucgaccccaacacccacgagaaccugaccuaccugcagcugcuggagagaugcgugagagaccccgagaccggccuguaccugcugccccugagcagcacccagagcccccugguggacagcgccacccagcaggccuuccagaaccugcugcugagcgugaaguacggcagauuccagggccagagagugagcgccugggagcugaucaacagcgaguacuucagcgagggcagaagaagacagcugcugagaagauacagacagagagaggugacccugggccagguggccaagcugcuggaggccgagacccagagacaggccgacaucaugcugcccgcccugagaagcagagugaccgugcaccagcugcuggaggccggcaucaucgaccagcagcugcuggaccaggugcuggccggcaccaucagccccgaggcccugcugcugauggacggcgugagaagauaccugugcggccugggcgccgugggcggcgugagacugcugcccagcggccagagacugagccuguaccaggccaugagacagaagcugcugggccccagaguggcccuggcccugcuggaggcccaggccgccaccggcaccaucauggacccccacagccccgagagccugagcguggacgaggccgugagaagaggcguggugggccccgagcuguacggcagacugaagagagccgagggcgccaucgccggcuucagagaccccuucagcggcaagcaggugagcguguuccaggccaugaagaagggccugauccccugggagcaggccgccagacugcuggaggcccagguggccaccggcggcaucaucgaccccaccagccaccaccaccugcccaugcccguggccauccagagaggcuacguggaccaggagauggagaccgcccugagcagcagcagcgagaccuuccccacccccgacggccagggcagaaccagcuacgcccagcugcuggaggagugccccagagacgagaccagcggccugcaccugcugccccugcccgagagcgcccccgcccugcccaccgaggagcaggugcagagaagccugcaggccgugcccggcgccaaggacggcaccagccugugggaccugcugagcagcugccacuucaccgaggagcagagaagaggccugcuggaggacgugcaggagggcagaaccaccgugccccagcugcuggccagcgugcagagaugggugcaggagaccaagcugcuggcccaggccagagugauggugcccggccccagaggcgaggugcccgccguguggcugcuggacgccggcaucaucacccaggagacccuggaggcccuggcccagggcacccagagccccgcccagguggccgagcagcccgccgugaaggccugccuguggggcaccggcugcguggccggcgugcugcugcagcccagcggcgccaaggccagcaucgcccaggccgugagagacggccugcugcccaccggccugggccagagacugcuggaggcccagguggccagcggcuuccugguggacccccugaacaaccagagacugagcguggaggacgccgugaaggugggccuggugggcagagagcugagcgagcagcugggccaggccgagagagccgccgccggcuaccccgaccccuacagcagagccagccugagccuguggcaggccauggagaagggccuggugccccagaacgagggccugccccugcugcaggugcagcuggccaccggcggcgugguggaccccgugcacggcgugcaccugccccaggccgccgccugcagacugggccugcuggacacccagaccagccaggugcugaccgccguggacaaggacaacaaguucuucuucgaccccagcgccagagaccaggugaccuaccagcagcugagagagagaugcgugugcgacagcgagaccggccugcugcugcugccccugcccagcgacaccgugcuggagguggacgaccacaccgccguggcccugagagccaugaaggugcccgugagcaccggcagauucaagggcugcagcgugagccugugggaccugcugcugagcgaguacgugggcgccgacaagagaagagagcugguggcccugugcagaagcggcagagccgccgcccugagacagguggugagcgccgugaccacccugguggaggccgccgagagacagccccugcaggccaccuucagaggccugagaaagcaggugagcgccagagaccuguucagagcccagcugaucagcagaaagacccuggacgagcugagccagggcaccaccaccgugaaggagguggccgagauggacagcgugaagagaagccuggagggcggcaacuucaucgccggcgugcugauccagggcacccaggagagaaugagcauccccgaggcccugagaagacacauccugagacccggcaccgcccuggugcugcuggaggcccaggccgccaccggcuucaucaucgaccccguggagaacagaaagcugaccguggaggaggccuucaaggccggcauguucggcaaggagaccuacgugaagcugcugagcgccgagagagccgugaccggcuacaccgaccccuacaccggccagcagaucagccuguuccaggccaugcagaaggaccugaucgugagagagcacggcaucagacugcuggaggcccagaucgccaccggcggcaucaucgaccccgugcacagccacagagugcccguggacguggccuacagaugcggcuacuucgacgaggagaugaacagaauccuggccgaccccagcgacgacaccaagggcuucuucgaccccaacacccacgagaaccugaccuaccugcagcugcuggagagaugcguggaggaccccgagaccggccuguaccugcugcagaucaucaagaagggcgagaacuacguguacaucaacgaggccaccagacacgugcugcagagcagaaccgccaagaugagagugggcagauucgccgaccagguggugagcuucugggaccugcugagcagccccuacuucaccgaggacagaaagagagagcugauccaggaguacggcgcccagagcggcggccuggagaagcugcuggagaucaucaccaccaccaucgaggagaccgagacccagaaccagggcaucaagguggccgccaucagaggcgaggugaccgccgccgaccuguucaacagcagagugaucgaccagaagacccugcacacccugagagugggcagaaccggcggccaggcccugagcacccuggagugcgugaagcccuaccuggagggcagcggcugcaucgccggcgugaccgugcccagcaccagagaggugaugagccugcacgaggccagcagaaaggagcugauccccgccgccuucgccaccuggcugcuggaggcccaggccgccaccggcuuccugcuggaccccugcaccagacagaagcugagcguggacgaggccguggacgugggccuggugaacgaggagcugagagagagacugcugaaggccgagagagccgccaccggcuacagagaccccgccaccggcgacaccaucccccuguuccaggccaugcagaagcagcugaucgagaaggccgaggcccugagacugcuggaggugcagguggccaccggcggcgugaucgacccccagcaccaccacagacugccccuggagaccgccuacagaagaggcugccugcacaaggacaucuacgcccugaucagcgaccagaagcacaugagaaagagauucguggaccccaacacccaggagaaggugagcuacagagagcugcaggagagaugcagaccccaggaggacaccggcuggcugcuguuccccgugaacaaggccgccagagacagcgagcacaucgacgacgagaccagaagagcccuggaggccgagcagguggagaucaccgugggcagauucagaggccagaagcccacccugugggcccugcugaacagcgaguacgugaccgaggagaagaagcugcagcuggugagaauguacagaacccacaccagaagagcccugcagaccguggcccagcugauccuggagcugaucgagaagcaggagaccagcaacaagcaccugugguuccagggcaucagaagacagaucaccgccagcgagcugcugagcagcgccaucaucaccgaggagaugcugcaggaccuggagaccggcagaagcaccacccaggagcugauggaggacgacagagugaagagauaccuggagggcaccagcugcaucgccggcgugcuggugcccgccaaggaccagcccggcagacaggagaagaugagcaucuaccaggccauguggaagggcgugcugagacccggcaccgcccuggugcugcuggaggcccaggccgccaccggcuucgugaucgaccccgugagaaaccugagacugagcguggaggaggccguggccgccggcguggugggcggcgagauccaggagaagcugcugagcgccgagagagccgugaccggcuacaccgaccccuacaccggccagcagaucagccuguuccaggccaugcagaaggaccugaucgugagagagcacggcaucagacugcuggaggcccagaucgccaccggcggcgugaucgaccccgugcacagccacagagugcccguggacguggccuacagaagaggcuacuucgacgaggagaugaacagagugcuggccgaccccagcgacgacaccaagggcuucuucgaccccaacacccacgagaaccugaccuacgugcagcugcugagaagaugcgugcccgaccccgacaccggccuguacaugcugcagcuggccggcagaggcagcgccgugcaccagcugagcgaggagcugagaugcgcccugagagacgccagagugacccccggcagcggcgcccugcagggccagagcgugagcgugugggagcugcuguucuacagagaggugagcgaggacagaagacaggaccugcugagcagauacagagccggcacccugaccguggaggagcugggcgccacccugaccagccugcuggcccaggcccaggcccaggccagagccgaggccgaggccggcagccccagacccgaccccagagaggcccugagagccgccaccauggaggugaaggugggcagacugagaggcagagccgugcccgugugggacgugcuggccagcggcuacgugagcagagccgccagagaggagcugcuggccgaguucggcagcggcacccuggaccugcccgcccugaccagaagacugaccgccaucaucgaggaggccgaggaggcccccggcgccagaccccagcugcaggacgccuggagaggccccagagagcccggccccgccggcagaggcgacggcgacagcggcagaagccagagagagggccagggcgagggcgagacccaggaggccgccgccgccgccgccgccgccgccgccagaagacaggagcagacccugagagacgccaccauggaggugcagagaggccaguuccagggcagacccgugagcgugugggacgugcuguucagcagcuaccugagcgaggccagaagagacgagcugcuggcccagcacgccgccggcgcccugggccugcccgaccugguggccgugcugaccagagugaucgaggagaccgaggagagacugagcaaggugagcuucagaggccugagaagacaggugagcgccagcgagcugcacaccagcggcauccugggccccgagacccugagagaccuggcccagggcaccaagacccugcaggaggugaccgagauggacagcgugaagagauaccuggagggcaccagcugcaucgccggcgugcuggugcccgccaaggaccagcccggcagacaggagaagaugagcaucuaccaggccauguggaagggcgugcugagacccggcaccgcccuggugcugcuggaggcccaggccgccaccggcuucgugaucgaccccgugagaaaccugagacugagcguggaggaggccguggccgccggcguggugggcggcgagauccaggagaagcugcugagcgccgagagagccgugaccggcuacaccgaccccuacaccggccagcagaucagccuguuccaggccaugcagaaggaccugaucgugagagagcacggcaucagacugcuggaggcccagaucgccaccggcggcgugaucgaccccgugcacagccacagagugcccguggacguggccuaccagagaggcuacuucgacgaggagaugaacagagugcuggccgaccccagcgacgacaccaagggcuucuucgaccccaacacccacgagaaccugaccuacgugcagcugcugagaagaugcgugcccgaccccgacaccggccuguacaugcugcagcuggccggcagaggcagcgccgugcaccagcugagcgaggagcugagaugcgcccugagagacgccagagugacccccggcagcggcgcccugcagggccagagcgugagcgugugggagcugcuguucuacagagaggugagcgaggacagaagacaggaccugcugagcagauacagagccggcacccugaccguggaggagcugggcgccacccugaccagccugcuggcccaggcccaggcccaggccagagccgaggccgaggccggcagccccagacccgaccccagagaggcccugagagccgccaccauggaggugaaggugggcagacugagaggcagagccgugcccgugugggacgugcuggccagcggcuacgugagcagagccgccagagaggagcugcuggccgaguucggcagcggcacccuggaccugcccgcccugaccagaagacugaccgccaucaucgaggaggccgaggaggcccccggcgccagaccccagcugcaggacgccuggagaggccccagagagcccggccccgccggcagaggcgacggcgacagcggcagaagccagagagagggccagggcgagggcgagacccaggaggccgccgccgccgccagaagacaggagcagacccugagagacgccaccauggaggugcagagaggccaguuccagggcagacccgugagcgugugggacgugcuguucagcagcuaccugagcgaggccagaagagacgagcugcuggcccagcacgccgccggcgcccugggccugcccgaccugguggccgugcugaccagagugaucgaggagaccgaggagagacugagcaaggugagcuucagaggccugagaugccaggugagcgccagcgagcugcacaccagcggcauccugggccccgagacccugagagaccuggcccagggcaccaagacccugcaggaggugaccgagauggacagcgugaagagauaccuggagggcaccagcugcaucgccggcgugcuggugcccgccaaggaccagcccggcagacaggagaagaugagcaucuaccaggccauguggaagggcgugcugagacccggcaccgcccuggugcugcuggaggcccaggccgccaccggcuucgugaucgaccccgugagaaaccugagacugagcguggaggaggccguggccgccggcguggugggcggcgagauccaggagaagcugcugagcgccgagagagccgugaccggcuacaccgaccccuacaccggccagcagaucagccuguuccaggccaugcagaaggaccugaucgugagagagcacggcaucagacugcuggaggcccagaucgccaccggcggcgugaucgaccccgugcacagccacagagugcccguggacguggccuacagaagaggcuacuucgacgaggagaugaacagagugcuggccgaccccagcgacgacaccaagggcuucuucgaccccaacacccacgagaaccugaccuacgugcagcugcugagaagaugcgugcccgaccccgacaccggccuguacaugcugcagcuggccggcagaggcagcgccgugcaccagcugagcgaggagcugagaugcgcccugagagacgccagagugacccccggcagcggcgcccugcagggccagagcgugagcgugugggagcugcuguucuacagagaggugagcgaggacagaagacaggaccugcugagcagauacagagccggcacccugaccguggaggagcugggcgccacccugaccagccugcuggcccaggcccaggcccaggccagagccgaggccgaggccggcagccccagacccgaccccagagaggcccugagagccgccaccauggaggugaaggugggcagacugagaggcagagccgugcccgugugggacgugcuggccagcggcuacgugagcagagccgccagagaggagcugcuggccgaguucggcagcggcacccuggaccugcccgcccugaccagaagacugaccgccaucaucgaggaggccgaggaggcccccggcgccagaccccagcugcaggacgccuggagaggccccagagagcccggccccgccggcagaggcgacggcgacagcggcagaagccagagagagggccagggcgagggcgagacccaggaggccgccgccgccaccgccgccgccagaagacaggagcagacccugagagacgccaccauggaggugcagagaggccaguuccagggcagacccgugagcgugugggacgugcuguucagcagcuaccugagcgaggccagaagagacgagcugcuggcccagcacgccgccggcgcccugggccugcccgaccugguggccgugcugaccagagugaucgaggagaccgaggagagacugagcaaggugagcuucagaggccugagaagacaggugagcgccagcgagcugcacaccagcggcauccugggccccgagacccugagagaccuggcccagggcaccaagacccugcaggaggugaccgagauggacagcgugaagagauaccuggagggcaccagcugcaucgccggcgugcuggugcccgccaaggaccagcccggcagacaggagaagaugagcaucuaccaggccauguggaagggcgugcugagacccggcaccgcccuggugcugcuggaggcccaggccgccaccggcuucgugaucgaccccgugagaaaccugagacugagcguggaggaggccguggccgccggcguggugggcggcgagauccaggagaagcugcugagcgccgagagagccgugaccggcuacaccgaccccuacaccggccagcagaucagccuguuccaggccaugcagaaggaccugaucgugagagagcacggcaucagacugcuggaggcccagaucgccaccggcggcgugaucgaccccgugcacagccacagagugcccguggacguggccuacagaagaggcuacuucgacgaggagaugaacagagugcuggccgaccccagcgacgacaccaagggcuucuucgaccccaacacccacgagaaccugaccuacgugcagcugcugagaagaugcgugcccgaccccgacaccggccuguacaugcugcagcuggccggcagaggcagcgccgugcaccagcugagcgaggagcugagaugcgcccugagagacgccagagugacccccggcagcggcgcccugcagggccagagcgugagcgugugggagcugcuguucuacagagaggugagcgaggacagaagacaggaccugcugagcagauacagagccggcacccugaccguggaggagcugggcgccacccugaccagccugcuggcccaggcccaggcccaggccagagccgaggccgaggccggcagccccagacccgaccccagagaggcccugagagccgccaccauggaggugaaggugggcagacugagaggcagagccgugcccgugugggacgugcuggccagcggcuacgugagcagagccgccagagaggagcugcuggccgaguucggcagcggcacccuggaccugcccgcccugaccagaagacugaccgccaucaucgaggaggccgaggaggcccccggcgccagaccccagcugcaggacgccuggagaggccccagagagcccggccccgccggcagaggcgacggcgacagcggcagaagccagagagagggccagggcgagggcgagacccaggaggccgccgccgccaccgccgccgccagaagacaggagcagacccugagagacgccaccauggaggugcagagaggccaguuccagggcagacccgugagcgugugggacgugcuguucagcagcuaccugagcgaggccagaagagacgagcugcuggcccagcacgccgccggcgcccugggccugcccgaccugguggccgugcugaccagagugaucgaggagaccgaggagagacugagcaaggugagcuucagaggccugagaagacaggugagcgccagcgagcugcacaccagcggcauccugggccccgagacccugagagaccuggcccagggcaccaagacccugcaggaggugaccgagauggacagcgugaagagauaccuggagggcaccagcugcaucgccggcgugcuggugcccgccaaggaccagcccggccaccaggagaagaugagcaucuaccaggccauguggaagggcgugcugagacccggcaccgcccuggugcugcuggaggcccaggccgccaccggcuucgugaucgaccccgugagaaaccugagacugagcguggaggaggccguggccgccggcguggugggcggcgagauccaggagaagcugcugagcgccgagagagccgugaccggcuacaccgaccccuacaccggccagcagaucagccuguuccaggccaugcagaaggaccugaucgugagagagcacggcaucagacugcuggaggcccagaucgccaccggcggcgugaucgaccccgugcacagccacagagugcccguggacguggccuacagaagaggcuacuucgacgaggagaugaacagagugcuggcccaccccagcgacgacaccaagggcuucuucgaccccaacacccacgagaaccugaccuacgugcagcugcugagaagaugcgugcccgaccccgacaccggccuguacaugcugcagcuggccggcagaggcagcgccgugcaccagcugagcgaggagcugagaugcgcccugagagacgccagagugaugcccggcagcggcgcccugcagggccagagcgugagcgugugggagcugcuguucuacagagaggugagcgaggacagaagacaggaccugcugagcagauacagagccggcacccugaccguggaggagcugggcgccacccugaccagccugcuggcccaggcccaggcccaggccagagccgaggccgaggccgaggccggcagccccagacccgaccccagagaggcccugagagccgccaccauggaggugaaggugggcagacugagaggcagagccgugcccgugugggacgugcuggccagcggcuacgugagcggcgccgccagagaggagcugcuggccgaguucggcagcggcacccuggaccugcccgcccugaccagaagacugaccgccaucaucgaggaggccgaggaggcccccggcgccagaccccagcugcaggacgccuggagaggccccagagagcccggccccgccggcagaggcgacggcgacagcggcagaagccagagagagggccagggcgagggcgagacccaggaggccgccgccgccgccagaagacaggagcagacccugagagacgccaccauggaggugcagagaggccaguuccagggcagacccgugagcgugugggacgugcuguucagcagcuaccugagcgaggcccacagagacgagcugcuggcccagcacgccgccggcgcccugggccugcccgaccugguggccgugcugaccagagugaucgaggagaccgaggagagacugagcaaggugagcuucagaggccugagaagacaggugagcgccagcgagcugcacaccagcggcauccugggccccgagacccugagagaccuggcccagggcaccaagacccugcaggaggugaccgagauggacagcgugaagagauaccuggagggcaccagcugcaucgccggcgugcuggugcccgccaaggaccagcccggcagacaggagaagaugagcaucuaccaggccauguggaagggcgugcugagacccggcaccgcccuggugcugcuggaggcccaggccgccaccggcuucgugaucgaccccgugagaaaccugagacugagcguggaggaggccguggccgccggcguggugggcggcgagauccaggagaagcugcugagcgccgagagagccgugaccggcuacaccgaccccuacaccggccagcagaucagccuguuccaggccaugcagaaggaccugaucgugagagagcacggcaucagacugcuggaggcccagaucgccaccggcggcgugaucgaccccgugcacagccacagagugcccguggacguggccuacagaagaggcuacuucgacgaggagaugaacagagugcuggccgaccccagcgacgacaccaagggcuucuucgaccccaacacccacgagaaccugaccuaccugcagcugcugcagagagccacccuggaccccgagaccggccugcuguuccugagccugagccugcaguaa

SEQ ID NO: 16673 - RNA, 4539 nt, Artificial Sequence
  EPRS__Homo_sapiens__NP_004437
auggccacccugagccugaccgugaacagcggcgaccccccccugggcgcccugcuggccguggagcacgugaaggacgacgugagcaucagcguggaggagggcaaggagaacauccugcacgugagcgagaacgugaucuucaccgacgugaacagcauccugagauaccuggccagaguggccaccaccgccggccuguacggcagcaaccugauggagcacaccgagaucgaccacuggcuggaguucagcgccaccaagcugagcagcugcgacagcuucaccagcaccaucaacgagcugaaccacugccugagccugagaaccuaccuggugggcaacagccugagccuggccgaccugugcgugugggccacccugaagggcaacgccgccuggcaggagcagcugaagcagaagaaggcccccgugcacgugaagagaugguucggcuuccuggaggcccagcaggccuuccagagcgugggcaccaagugggacgugagcaccaccaaggccagaguggcccccgagaagaagcaggacgugggcaaguucguggagcugcccggcgccgagaugggcaaggugaccgugagauucccccccgaggccagcggcuaccugcacaucggccacgccaaggccgcccugcugaaccagcacuaccaggugaacuucaagggcaagcugaucaugagauucgacgacaccaaccccgagaaggagaaggaggacuucgagaaggugauccuggaggacguggccaugcugcacaucaagcccgaccaguucaccuacaccagcgaccacuucgagaccaucaugaaguacgccgagaagcugauccaggagggcaaggccuacguggacgacacccccgccgagcagaugaaggccgagagagagcagagaaucgacagcaagcacagaaagaaccccaucgagaagaaccugcagaugugggaggagaugaagaagggcagccaguucggccagagcugcugccugagagccaagaucgacaugagcagcaacaacggcugcaugagagaccccacccuguacagaugcaagauccagccccaccccagaaccggcaacaaguacaacguguaccccaccuacgacuucgccugccccaucguggacagcaucgagggcgugacccacgcccugagaaccaccgaguaccacgacagagacgagcaguucuacuggaucaucgaggcccugggcaucagaaagcccuacaucugggaguacagcagacugaaccugaacaacaccgugcugagcaagagaaagcugaccugguucgugaacgagggccugguggacggcugggacgaccccagauuccccaccgugagaggcgugcugagaagaggcaugaccguggagggccugaagcaguucaucgccgcccagggcagcagcagaagcguggugaacauggagugggacaagaucugggccuucaacaagaaggugaucgaccccguggcccccagauacguggcccugcugaagaaggaggugauccccgugaacgugcccgaggcccaggaggagaugaaggagguggccaagcaccccaagaaccccgaggugggccugaagcccgugugguacagccccaagguguucaucgagggcgccgacgccgagaccuucagcgagggcgagauggugaccuucaucaacuggggcaaccugaacaucaccaagauccacaagaacgccgacggcaagaucaucagccuggacgccaagcugaaccuggagaacaaggacuacaagaagaccaccaaggugaccuggcuggccgagaccacccacgcccugcccauccccgugaucugcgugaccuacgagcaccugaucaccaagcccgugcugggcaaggacgaggacuucaagcaguacgugaacaagaacagcaagcacgaggagcugaugcugggcgaccccugccugaaggaccugaagaagggcgacaucauccagcugcagagaagaggcuucuucaucugcgaccagcccuacgagcccgugagccccuacagcugcaaggaggcccccugcgugcugaucuacauccccgacggccacaccaaggagaugcccaccagcggcagcaaggagaagaccaagguggaggccaccaagaacgagaccagcgcccccuucaaggagagacccacccccagccugaacaacaacugcaccaccagcgaggacagccuggugcuguacaacagaguggccgugcagggcgacguggugagagagcugaaggccaagaaggcccccaaggaggacguggacgccgccgugaagcagcugcugagccugaaggccgaguacaaggagaagaccggccaggaguacaagcccggcaacccccccgccgagaucggccagaacaucagcagcaacagcagcgccagcauccuggagagcaagagccuguacgacgagguggccgcccagggcgagguggugagaaagcugaaggccgagaagagccccaaggccaagaucaacgaggccguggagugccugcugagccugaaggcccaguacaaggagaagaccggcaaggaguacauccccggccagcccccccugagccagagcagcgacagcagccccaccagaaacagcgagcccgccggccuggagacccccgaggccaaggugcuguucgacaagguggccagccagggcgagguggugagaaagcugaagaccgagaaggcccccaaggaccagguggacaucgccgugcaggagcugcugcagcugaaggcccaguacaagagccugaucggcguggaguacaagcccgugagcgccaccggcgccgaggacaaggacaagaagaagaaggagaaggagaacaagagcgagaagcagaacaagccccagaagcagaacgacggccagagaaaggaccccagcaagaaccagggcggcggccugagcagcagcggcgccggcgagggccagggccccaagaagcagaccagacugggccuggaggccaagaaggaggagaaccuggccgacugguacagccaggugaucaccaagagcgagaugaucgaguaccacgacaucagcggcugcuacauccugagacccugggccuacgccaucugggaggccaucaaggacuucuucgacgccgagaucaagaagcugggcguggagaacugcuacuuccccauguucgugagccagagcgcccuggagaaggagaagacccacguggccgacuucgcccccgagguggccugggugaccagaagcggcaagaccgagcuggccgagcccaucgccaucagacccaccagcgagaccgugauguaccccgccuacgccaagugggugcagagccacagagaccugcccaucaagcugaaccaguggugcaacguggugagaugggaguucaagcacccccagcccuuccugagaaccagagaguuccuguggcaggagggccacagcgccuucgccaccauggaggaggccgccgaggaggugcugcagauccuggaccuguacgcccagguguacgaggagcugcuggccauccccguggugaagggcagaaagaccgagaaggagaaguucgccggcggcgacuacaccaccaccaucgaggccuucaucagcgccagcggcagagccauccagggcggcaccagccaccaccugggccagaacuucagcaagauguucgagaucguguucgaggaccccaagauccccggcgagaagcaguucgccuaccagaacagcuggggccugaccaccagaaccaucggcgugaugaccauggugcacggcgacaacaugggccuggugcugccccccagaguggccugcgugcagguggugaucauccccugcggcaucaccaacgcccugagcgaggaggacaaggaggcccugaucgccaagugcaacgacuacagaagaagacugcugagcgugaacaucagagugagagccgaccugagagacaacuacagccccggcuggaaguucaaccacugggagcugaagggcgugcccaucagacuggaggugggccccagagacaugaagagcugccaguucguggccgugagaagagacaccggcgagaagcugaccguggccgagaacgaggccgagaccaagcugcaggccauccuggaggacauccaggugacccuguucaccagagccagcgaggaccugaagacccacauggugguggccaacaccauggaggacuuccagaagauccuggacagcggcaagaucgugcagauccccuucugcggcgagaucgacugcgaggacuggaucaagaagaccaccgccagagaccaggaccuggagcccggcgcccccagcaugggcgccaagagccugugcauccccuucaagccccugugcgagcugcagcccggcgccaagugcgugugcggcaagaaccccgccaaguacuacacccuguucggcagaagcuacuaa

SEQ ID NO: 16674 - RNA, 2733 nt, Artificial Sequence
  EPS15L1__Homo_sapiens__NP_001245303
auggccgccccccugaucccccugagccagcagauccccaccggcaacagccuguacgagagcuacuacaagcagguggaccccgccuacaccggcagagugggcgccagcgaggccgcccuguuccugaagaagagcggccugagcgacaucauccugggcaagaucugggaccuggccgaccccgagggcaagggcuuccuggacaagcagggcuucuacguggcccugagacugguggccugcgcccagagcggccacgaggugacccugagcaaccugaaccugagcaugcccccccccaaguuccacgacaccagcagcccccugauggugaccccccccagcgccgaggcccacugggccgugagaguggaggagaaggccaaguucgacggcaucuucgagagccugcugcccaucaacggccugcugagcggcgacaaggugaagcccgugcugaugaacagcaagcugccccuggacgugcugggcagagugugggaccugagcgacaucgacaaggacggccaccuggacagagacgaguucgccguggccaugcaccugguguacagagcccuggagaaggagcccgugcccagcgcccugccccccagccugaucccccccagcaagagaaagaagaccguguuccccggcgccgugcccgugcugcccgccagccccccccccaaggacagccugagaagcacccccagccacggcagcgugagcagccugaacagcaccggcagccugagccccaagcacagccugaagcagacccagcccaccgugaacuggguggugcccguggccgacaagaugagauucgacgagaucuuccugaagaccgaccuggaccuggacggcuacgugagcggccaggaggugaaggagaucuucaugcacagcggccugacccagaaccugcuggcccacaucugggcccuggccgacaccagacagaccggcaagcugagcaaggaccaguucgcccuggccauguacuucauccagcagaaggugagcaagggcaucgaccccccccaggugcugagccccgacauggugccccccagcgagagaggcacccccggccccgacagcagcggcagccugggcagcggcgaguucaccggcgugaaggagcuggacgacaucagccaggagaucgcccagcugcagagagagaaguacagccuggagcaggacaucagagagaaggaggaggccaucagacagaagaccagcgaggugcaggagcugcagaacgaccuggacagagagaccagcagccugcaggagcuggaggcccagaagcaggacgcccaggacagacuggacgagauggaccagcagaaggccaagcugagagacaugcugagcgacgugagacagaagugccaggacgagacccagaugaucagcagccugaagacccagauccagagccaggagagcgaccugaagagccaggaggacgaccugaacagagccaagagcgagcugaacagacugcagcaggaggagacccagcuggagcagagcauccaggccggcagagugcagcuggagaccaucaucaagagccugaagagcacccaggacgagaucaaccaggccagaagcaagcugagccagcugcacgagagcagacaggaggcccacagaagccuggagcaguacgaccaggugcuggacggcgcccacggcgccagccugaccgaccuggccaaccugagcgagggcgugagccuggccgagagaggcagcuucggcgccauggacgaccccuucaagaacaaggcccugcuguucagcaacaacacccaggagcugcaccccgaccccuuccagaccgaggaccccuucaagagcgaccccuucaagggcgccgaccccuucaagggcgaccccuuccagaacgaccccuucgccgagcagcagaccaccagcaccgaccccuucggcggcgaccccuucaaggagagcgaccccuucagaggcagcgccaccgacgacuucuucaagaagcagaccaagaacgaccccuucaccagcgaccccuucaccaagaaccccagccugcccagcaagcuggaccccuucgagagcagcgaccccuucagcagcagcagcgugagcagcaagggcagcgaccccuucggcacccuggaccccuucggcagcggcagcuucaacagcgccgagggcuucgccgacuucagccagaugagcaagcccccccccagcggccccuucaccagcagccugggcggcgccggcuucagcgacgaccccuucaagagcaagcaggacacccccgcccugccccccaagaagcccgccccccccagacccaagccccccagcggcaagagcacccccgugagccagcugggcagcgccgacuuccccgaggcccccgaccccuuccagccccugggcgccgacagcggcgaccccuuccagagcaagaagggcuucggcgaccccuucagcggcaaggaccccuucgugcccagcagcgccgccaagcccagcaaggccagcgccagcggcuucgccgacuucaccagcuucggcaacgaggagcagcagcuggccugggccaagagagagagcgagaaggccgagcaggagagacuggccagacugagaagacaggagcaggaggaccuggagcuggccaucgcccugagcaaggccgacaugcccgccgccuaa

SEQ ID NO: 16675 - RNA, 2502 nt, Artificial Sequence
  EPS8__Homo_sapiens__XP_005253396
augagcaaccugaacacccaggugaaggacaccaugaacggccacaucagcaaccaccccagcagcuucggcauguaccccagccagaugaacggcuacggcagcagccccaccuucagccagaccgacagagagcacggcagcaagaccagcgccaaggcccuguacgagcagagaaagaacuacgccagagacagcgugagcagcgugagcgacaucagccaguacagaguggagcaccugaccaccuucgugcuggacagaaaggacgccaugaucaccguggacgacggcaucagaaagcugaagcugcuggacgccaagggcaagguguggacccaggacaugauccugcagguggacgacagagccgugagccugaucgaccuggagagcaagaacgagcuggagaacuucccccugaacaccauccagcacugccaggccgugaugcacagcugcagcuacgacagcgugcuggcccuggugugcaaggagcccacccagaacaagcccgaccugcaccuguuccagugcgacgaggugaaggccaaccugaucagcgaggacaucgagagcgccaucagcgacagcaagggcggcaagcagaagagaagacccgacgcccugagaaugaucagcaacgccgaccccagcaucccccccccccccagagcccccgcccccgccccccccggcaccgugacccagguggacgugagaagcagaguggccgccuggagcgccugggccgccgaccagggcgacuucgagaagcccagacaguaccacgagcaggaggagacccccgagaugauggccgccagaaucgacagagacgugcagauccugaaccacauccuggacgacaucgaguucuucaucaccaagcugcagaaggccgccgaggccuucagcgagcugagcaagagaaagaagaacaagaagggcaagagaaagggccccggcgagggcgugcugacccugagagccaagccccccccccccgacgaguuccuggacugcuuccagaaguucaagcacggcuucaaccugcuggccaagcugaagagccacauccagaaccccagcgccgccgaccuggugcacuuccuguucaccccccugaacaugguggugcaggccaccggcggccccgagcuggccagcagcgugcugagcccccugcugaacaaggacaccaucgacuuccugaacuacaccgugaacggcgacgagagacagcuguggaugagccugggcggcaccuggaugaaggccagagccgaguggcccaaggagcaguucaucccccccuacgugcccagauucagaaacggcugggagccccccaugcugaacuucaugggcgccaccauggagcaggaccuguaccagcuggccgagagcguggccaacguggccgagcaccagagaaagcaggagaucaagagacugagcaccgagcacagcagcgugagcgaguaccaccccgccgacggcuacgccuucagcagcaacaucuacaccagaggcagccaccuggaccagggcgaggccgccguggccuucaagcccaccagcaacagacacaucgacagaaacuacgagccccugaagacccagcccaagaaguacgccaagagcaaguacgacuucguggccagaaacaacagcgagcugagcgugcugaaggacgacauccuggagauccuggacgacagaaagcagugguggaaggugagaaacgccagcggcgacagcggcuucgugcccaacaacauccuggacaucgugagaccccccgagagcggccugggcagagccgacccccccuacacccacaccauccagaagcagagaauggaguacggccccagacccgccgacaccccccccgcccccagccccccccccacccccgcccccgugcccgugccccugccccccagcacccccgcccccgugcccgugagcaaggugcccgccaacaucaccagacagaacagcagcagcagcgacagcggcggcagcaucgugagagacagccagagacacaagcagcugcccguggacagaagaaagagccagauggaggaggugcaggacgagcugauccacagacugaccaucggcagaagcgccgcccagaagaaguuccacgugcccagacagaacgugcccgugaucaacaucaccuacgacagcacccccgaggacgugaagaccuggcugcagagcaagggcuucaaccccgugaccgugaacagccugggcgugcugaacggcgcccagcuguucagccugaacaaggacgagcugagaaccgugugccccgagggcgccagaguguacagccagaucaccgugcagaaggccgcccuggaggacagcagcggcagcagcgagcugcaggagaucaugagaagaagacaggagaagaucagcgccgccgccagcgacagcggcguggagagcuucgacgagggcagcagccacuaa

SEQ ID NO: 16676 - RNA, 2148 nt, Artificial Sequence
  EPS8L2__Homo_sapiens__NP_073609
augagccagagcggcgccgugagcugcugccccggcgccaccaacggcagccugggcagaagcgacggcguggccaagaugagccccaaggaccuguucgagcagagaaagaaguacagcaacagcaacgugaucaugcacgagaccagccaguaccacgugcagcaccuggccaccuucaucauggacaagagcgaggccaucaccagcguggacgacgccaucagaaagcuggugcagcugagcagcaaggagaagaucuggacccaggagaugcugcugcaggugaacgaccagagccugagacugcuggacaucgagagccaggaggagcuggaggacuucccccugcccaccgugcagagaagccagaccgugcugaaccagcugagauaccccagcgugcugcugcuggugugccaggacagcgagcagagcaagcccgacgugcacuucuuccacugcgacgagguggaggccgagcuggugcacgaggacaucgagagcgcccuggccgacugcagacugggcaagaagaugagaccccagacccugaagggccaccaggagaagaucagacagagacagagcauccugccccccccccagggccccgcccccauccccuuccagcacagaggcggcgacagccccgaggccaagaacagagugggcccccaggugccccugagcgagcccggcuucagaagaagagagagccaggaggagcccagagccgugcuggcccagaagaucgagaaggagacccagauccugaacugcgcccuggacgacaucgagugguucguggccagacugcagaaggccgccgaggccuucaagcagcugaaccagagaaagaagggcaagaagaagggcaagaaggcccccgccgagggcgugcugacccugagagccagaccccccagcgagggcgaguucaucgacugcuuccagaagaucaagcuggccaucaaccugcuggccaagcugcagaagcacauccagaaccccagcgccgccgagcuggugcacuuccuguucggcccccuggaccugaucgugaacaccugcagcggccccgacaucgccagaagcgugagcugcccccugcugagcagagacgccguggacuuccugagaggccaccuggugcccaaggagaugagccugugggagagccugggcgagagcuggaugagacccagaagcgaguggcccagagagccccaggugccccuguacgugcccaaguuccacagcggcugggagccccccguggacgugcugcaggaggcccccugggagguggagggccuggccagcgcccccaucgaggaggugagccccgugagcagacagagcaucagaaacagccagaagcacagccccaccagcgagcccaccccccccggcgacgcccugccccccgugagcagcccccacacccacagaggcuaccagcccacccccgccauggccaaguacgugaagauccuguacgacuucaccgccagaaacgccaacgagcugagcgugcugaaggacgaggugcuggaggugcuggaggacggcagacagugguggaagcugagaagcagaagcggccaggccggcuacgugcccugcaacauccugggcgaggccagacccgaggacgccggcgcccccuucgagcaggccggccagaaguacuggggccccgccagccccacccacaagcugccccccagcuuccccggcaacaaggacgagcugaugcagcacauggacgaggugaacgacgagcugaucagaaagaucagcaacaucagagcccagccccagagacacuucagaguggagagaagccagcccgugagccagccccugaccuacgagagcggccccgacgaggugagagccuggcuggaggccaaggccuucagccccagaaucguggagaaccugggcauccugaccggcccccagcuguucagccugaacaaggaggagcugaagaaggugugcggcgaggagggcgugagaguguacagccagcugaccaugcagaaggccuuccuggagaagcagcagagcggcagcgagcuggaggagcugaugaacaaguuccacagcaugaaccagagaagaggcgaggacagcuaa

SEQ ID NO: 16677 - RNA, 1233 nt, Artificial Sequence
  EPSTI1__Homo_sapiens__NP_001002264
augaacaccagaaacagaguggugaacagcggccugggcgccagccccgccagcagacccaccagagacccccaggaccccagcggcagacagggcgagcugagccccguggaggaccagagagagggccuggaggccgcccccaagggccccagcagagagagcguggugcacgccggccagagaagaaccagcgccuacacccugaucgcccccaacaucaacagaagaaacgagauccagagaaucgccgagcaggagcuggccaaccuggagaaguggaaggagcagaacagagccaagcccgugcaccuggugcccagaagacugggcggcagccagagcgagaccgaggugagacagaagcagcagcugcagcugaugcagagcaaguacaagcagaagcugaagagagaggagagcgugagaaucaagaaggaggccgaggaggccgagcugcagaagaugaaggccauccagagagagaagagcaacaagcuggaggagaagaagagacugcaggagaaccugagaagagaggccuucagagagcaccagcaguacaagaccgccgaguuccugagcaagcugaacaccgagagccccgacagaagcgccugccagagcgccgugugcggcccccagagcagcaccuggaagcugcccauccugcccagagaccacagcugggccagaagcugggccuacagagacagccugaaggccgaggagaacagaaagcugcagaagaugaaggacgagcagcaccagaagagcgagcugcuggagcugaagagacagcagcaggagcaggagagagccaagauccaccagaccgagcacagaagagugaacaacgccuuccuggacagacugcagggcaagagccagcccggcggccuggagcagagcggcggcugcuggaacaugaacagcggcaacagcuggggcagccugcugguguucagcagacaccugagaguguacgagaagauccugacccccaucuggcccagcagcaccgaccuggagaagccccacgagaugcuguuccugaacgugauccuguucagccugaccguguucacccugaucagcaccgcccacacccuggacagagccgugagaagcgacuggcugcugcuggugcugaucuacgccugccuggaggagcugauccccgagcugaucuucaaccuguacugccagggcaacgccacccuguucuucuaa

SEQ ID NO: 16678 - RNA, 2148 nt, Artificial Sequence
  EPX__Homo_sapiens__NP_000493
augcaccugcugcccgcccuggccggcgugcuggccacccuggugcuggcccagcccugcgagggcaccgaccccgccagccccggcgccguggagaccagcgugcugagagacugcaucgccgaggccaagcugcugguggacgccgccuacaacuggacccagaagagcaucaagcagagacugagaagcggcagcgccagccccauggaccugcugagcuacuucaagcagcccguggccgccaccagaaccguggugagagccgccgacuacaugcacguggcccugggccugcuggaggagaagcugcagccccagagaagcggccccuucaacgugaccgacgugcugaccgagccccagcugagacugcugagccaggccagcggcugcgcccugagagaccaggccgagagaugcagcgacaaguacagaaccaucaccggcagaugcaacaacaagagaagaccccugcugggcgccagcaaccaggcccuggccagauggcugcccgccgaguacgaggacggccugagccugcccuucggcuggacccccagcagaagaagaaacggcuuccugcugccccuggugagagccgugagcaaccagaucgugagauuccccaacgagagacugaccagcgacagaggcagagcccugauguucaugcaguggggccaguucaucgaccacgaccuggacuucagccccgagagccccgccagaguggccuucaccgccggcguggacugcgagagaaccugcgcccagcugccccccugcuuccccaucaagaucccccccaacgaccccagaaucaagaaccagagagacugcauccccuucuucagaagcgcccccagcugcccccagaacaagaacagagugagaaaccagaucaacgcccugaccagcuucguggacgccagcaugguguacggcagcgaggugagccugagccugagacugagaaacagaaccaacuaccugggccugcuggccaucaaccagagauuccaggacaacggcagagcccugcugcccuucgacaaccugcacgacgaccccugccugcugaccaacagaagcgccagaauccccugcuuccuggccggcgacaccagaagcaccgagacccccaagcuggccgccaugcacacccuguucaugagagagcacaacagacuggccaccgagcugagaagacugaaccccagauggaacggcgacaagcuguacaacgaggccagaaagaucaugggcgccauggugcagaucaucaccuacagagacuuccugccccuggugcugggcaaggccagagccagaagaacccugggccacuacagaggcuacugcagcaacguggaccccagaguggccaacguguucacccuggccuucagauucggccacaccaugcugcagcccuucauguucagacuggacagccaguacagagccagcgcccccaacagccacgugccccugagcagcgccuucuucgccagcuggagaaucguguacgagggcggcaucgaccccauccugagaggccugauggccacccccgccaagcugaacagacaggacgccaugcugguggacgagcugagagacagacuguucagacaggugagaagaaucggccuggaccuggccgcccugaacaugcagagaagcagagaccacggccugcccggcuacaacgccuggagaagauucugcggccugagccagcccagaaaccuggcccagcugagcagagugcugaagaaccaggaccuggccagaaaguuccugaaccuguacggcacccccgacaacaucgacaucuggaucggcgccaucgccgagccccugcugcccggcgccagagugggcccccugcuggccugccuguucgagaaccaguucagaagagccagagacggcgacagauucugguggcagaagagaggcguguucaccaagagacagagaaaggcccugagcagaaucagccugagcagaaucaucugcgacaacaccggcaucaccaccgugagcagagacaucuucagagccaacaucuaccccagaggcuucgugaacugcagcagaauccccagacugaaccugagcgccuggagaggcaccuaa

SEQ ID NO: 16679 - RNA, 969 nt, Artificial Sequence
  EPYC__Homo_sapiens__NP_004941
augaagacccuggccggccuggugcugggccuggugaucuucgacgccgccgugaccgcccccacccuggagagcaucaacuacgacagcgagaccuacgacgccacccuggaggaccuggacaaccuguacaacuacgagaacauccccguggacaagguggagaucgagaucgccaccgugaugcccagcggcaacagagagcugcugaccccccccccccagcccgagaaggcccaggaggaggaggaggaggaggagagcacccccagacugaucgacggcagcagcccccaggagcccgaguucaccggcgugcugggcccccacaccaacgaggacuuccccaccugccugcugugcaccugcaucagcaccaccguguacugcgacgaccacgagcuggacgccauccccccccugcccaagaacaccgccuacuucuacagcagauucaacagaaucaagaagaucaacaagaacgacuucgccagccugagcgaccugaagagaaucgaccugaccagcaaccugaucagcgagaucgacgaggacgccuucagaaagcugccccagcugagagagcuggugcugagagacaacaagaucagacagcugcccgagcugcccaccacccugaccuucaucgacaucagcaacaacagacugggcagaaagggcaucaagcaggaggccuucaaggacauguacgaccugcaccaccuguaccugaccgacaacaaccuggaccacaucccccugccccugcccgagaaccugagagcccugcaccugcagaacaacaacauccuggagaugcacgaggacaccuucugcaacgugaagaaccugaccuacaucagaaaggcccuggaggacaucagacuggacggcaaccccaucaaccugagcaagaccccccaggccuacaugugccugcccagacugcccgugggcagccugguguaa

SEQ ID NO: 16680 - RNA, 1314 nt, Artificial Sequence
  ERAL1__Homo_sapiens__NP_005693
auggccgcccccagcuggagaggcgccagacuggugcagagcgugcugagaguguggcaggugggcccccacguggccagagagagagugauccccuucagcagccugcugggcuuccagagaagaugcgugagcugcguggccggcagcgccuucagcggccccagacuggccagcgccagcagaagcaacggccagggcagcgcccuggaccacuuccugggcuucagccagcccgacagcagcgugacccccugcgugcccgccgugagcaugaacagagacgagcaggacgugcugcuggugcaccaccccgacaugcccgagaacagcagagugcugagaguggugcugcugggcgcccccaacgccggcaagagcacccugagcaaccagcugcugggcagaaagguguuccccgugagcagaaaggugcacaccaccagaugccaggcccugggcgugaucaccgagaaggagacccaggugauccugcuggacacccccggcaucaucagccccggcaagcagaagagacaccaccuggagcugagccugcuggaggaccccuggaagagcauggagagcgccgaccuggugguggugcugguggacgugagcgacaaguggaccagaaaccagcugagcccccagcugcugagaugccugaccaaguacagccagauccccagcgugcuggugaugaacaagguggacugccugaagcagaagagcgugcugcuggagcugaccgccgcccugaccgagggcguggugaacggcaagaagcugaagaugagacaggccuuccacagccaccccggcacccacugccccagccccgccgugaaggaccccaacacccagagcgugggcaacccccagagaaucggcuggccccacuucaaggagaucuucaugcugagcgcccugagccaggaggacgugaagacccugaagcaguaccugcugacccaggcccagcccggccccugggaguaccacagcgccgugcugaccagccagacccccgaggagaucugcgccaacaucaucagagagaagcugcuggagcaccugccccaggaggugcccuacaacgugcagcagaagaccgccgugugggaggagggccccggcggcgagcuggugauccagcagaagcugcuggugcccaaggagagcuacgugaagcugcugaucggccccaagggccacgugaucagccagaucgcccaggaggccggccacgaccugauggacaucuuccugugcgacguggacaucagacugagcgugaagcugcugaaguaa

SEQ ID NO: 16681 - RNA, 2826 nt, Artificial Sequence
  ERAP1__Homo_sapiens__NP_001185470
augguguuccugccccugaaguggagccuggccaccaugagcuuccugcugagcagccugcuggcccugcugaccgugagcacccccagcuggugccagagcaccgaggccagccccaagagaagcgacggcacccccuuccccuggaacaagaucagacugcccgaguacgugauccccgugcacuacgaccugcugauccacgccaaccugaccacccugaccuucuggggcaccaccaagguggagaucaccgccagccagcccaccagcaccaucauccugcacagccaccaccugcagaucagcagagccacccugagaaagggcgccggcgagagacugagcgaggagccccugcaggugcuggagcaccccagacaggagcagaucgcccugcuggcccccgagccccugcuggugggccugcccuacaccguggugauccacuacgccggcaaccugagcgagaccuuccacggcuucuacaagagcaccuacagaaccaaggagggcgagcugagaauccuggccagcacccaguucgagcccaccgccgccagaauggccuuccccugcuucgacgagcccgccuucaaggccagcuucagcaucaagaucagaagagagcccagacaccuggccaucagcaacaugccccuggugaagagcgugaccguggccgagggccugaucgaggaccacuucgacgugaccgugaagaugagcaccuaccugguggccuucaucaucagcgacuucgagagcgugagcaagaucaccaagagcggcgugaaggugagcguguacgccgugcccgacaagaucaaccaggccgacuacgcccuggacgccgccgugacccugcuggaguucuacgaggacuacuucagcauccccuacccccugcccaagcaggaccuggccgccauccccgacuuccagagcggcgccauggagaacuggggccugaccaccuacagagagagcgcccugcuguucgacgccgagaagagcagcgccagcagcaagcugggcaucaccaugaccguggcccacgagcuggcccaccagugguucggcaaccuggugaccauggagugguggaacgaccuguggcugaacgagggcuucgccaaguucauggaguucgugagcgugagcgugacccaccccgagcugaaggugggcgacuacuucuucggcaagugcuucgacgccauggagguggacgcccugaacagcagccaccccgugagcacccccguggagaaccccgcccagaucagagagauguucgacgacgugagcuacgacaagggcgccugcauccugaacaugcugagagaguaccugagcgccgacgccuucaagagcggcaucgugcaguaccugcagaagcacagcuacaagaacaccaagaacgaggaccugugggacagcauggccagcaucugccccaccgacggcgugaagggcauggacggcuucugcagcagaagccagcacagcagcagcagcagccacuggcaccaggagggcguggacgugaagaccaugaugaacaccuggacccugcagaagggcuucccccugaucaccaucaccgugagaggcagaaacgugcacaugaagcaggagcacuacaugaagggcagcgacggcgcccccgacaccggcuaccuguggcacgugccccugaccuucaucaccagcaagagcgacauggugcacagauuccugcugaagaccaagaccgacgugcugauccugcccgaggagguggaguggaucaaguucaacgugggcaugaacggcuacuacaucgugcacuacgaggacgacggcugggacagccugaccggccugcugaagggcacccacaccgccgugagcagcaacgacagagccagccugaucaacaacgccuuccagcuggugagcaucggcaagcugagcaucgagaaggcccuggaccugagccuguaccugaagcacgagaccgagaucaugcccguguuccagggccugaacgagcugauccccauguacaagcugauggagaagagagacaugaacgagguggagacccaguucaaggccuuccugaucagacugcugagagaccugaucgacaagcagaccuggaccgacgagggcagcgugagcgagagaaugcugagaagccagcugcugcugcuggccugcgugcacaacuaccagcccugcgugcagagagccgagggcuacuucagaaaguggaaggagagcaacggcaaccugagccugcccguggacgugacccuggccguguucgccgugggcgcccagagcaccgagggcugggacuuccuguacagcaaguaccaguucagccugagcagcaccgagaagagccagaucgaguucgcccugugcagaacccagaacaaggagaagcugcaguggcugcuggacgagagcuucaagggcgacaagaucaagacccaggaguucccccagauccugacccugaucggcagaaaccccgugggcuacccccuggccuggcaguuccugagaaagaacuggaacaagcuggugcagaaguucgagcugggcagcagcagcaucgcccacauggugaugggcaccaccaaccaguucagcaccagaaccagacuggaggaggugaagggcuucuucagcagccugaaggagaacggcagccagcugagaugcgugcagcagaccaucgagaccaucgaggagaacaucggcuggauggacaagaacuucgacaagaucagaguguggcugcagagcgagaagcuggagagaauguaa

SEQ ID NO: 16682 - RNA, 2883 nt, Artificial Sequence
  ERAP2__Homo_sapiens__NP_001123612
auguuccacagcagcgccauggugaacagccacagaaagcccauguucaacauccacagaggcuucuacugccugaccgccauccugccccagaucugcaucugcagccaguucagcgugcccagcagcuaccacuucaccgaggaccccggcgccuuccccguggccaccaacggcgagagauuccccuggcaggagcugagacugcccagcguggugaucccccugcacuacgaccuguucgugcaccccaaccugaccagccuggacuucguggccagcgagaagaucgaggugcuggugagcaacgccacccaguucaucauccugcacagcaaggaccuggagaucaccaacgccacccugcagagcgaggaggacagcagauacaugaagcccggcaaggagcugaaggugcugagcuaccccgcccacgagcagaucgcccugcuggugcccgagaagcugaccccccaccugaaguacuacguggccauggacuuccaggccaagcugggcgacggcuucgagggcuucuacaagagcaccuacagaacccugggcggcgagaccagaauccuggccgugaccgacuucgagcccacccaggccagaauggccuuccccugcuucgacgagccccuguucaaggccaacuucagcaucaagaucagaagagagagcagacacaucgcccugagcaacaugcccaaggugaagaccaucgagcuggagggcggccugcuggaggaccacuucgagaccaccgugaagaugagcaccuaccugguggccuacaucgugugcgacuuccacagccugagcggcuucaccagcagcggcgugaaggugagcaucuacgccagccccgacaagagaaaccagacccacuacgcccugcaggccagccugaagcugcuggacuucuacgagaaguacuucgacaucuacuacccccugagcaagcuggaccugaucgccauccccgacuucgcccccggcgccauggagaacuggggccugaucaccuacagagagaccagccugcuguucgaccccaagaccagcagcgccagcgacaagcugugggugaccagagugaucgcccacgagcuggcccaccagugguucggcaaccuggugaccauggagugguggaacgacaucuggcugaaggagggcuucgccaaguacauggagcugaucgccgugaacgccaccuaccccgagcugcaguucgacgacuacuuccugaacgugugcuucgaggugaucaccaaggacagccugaacagcagcagacccaucagcaagcccgccgagacccccacccagauccaggagauguucgacgaggugagcuacaacaagggcgccugcauccugaacaugcugaaggacuuccugggcgaggagaaguuccagaagggcaucauccaguaccugaagaaguucagcuacagaaacgccaagaacgacgaccuguggagcagccugagcaacagcugccuggagagcgacuucaccagcggcggcgugugccacagcgaccccaagaugaccagcaacaugcuggccuuccugggcgagaacgccgaggugaaggagaugaugaccaccuggacccugcagaagggcaucccccugcugguggugaagcaggacggcugcagccugagacugcagcaggagagauuccugcagggcguguuccaggaggaccccgaguggagagcccugcaggagagauaccuguggcacaucccccugaccuacagcaccagcagcagcaacgugauccacagacacauccugaagagcaagaccgacacccuggaccugcccgagaagaccagcugggugaaguucaacguggacagcaacggcuacuacaucgugcacuacgagggccacggcugggaccagcugaucacccagcugaaccagaaccacacccugcugagacccaaggacagagugggccugauccacgacguguuccagcuggugggcgccggcagacugacccuggacaaggcccuggacaugaccuacuaccugcagcacgagaccagcagccccgcccugcuggagggccugagcuaccuggagagcuucuaccacaugauggacagaagaaacaucagcgacaucagcgagaaccugaagagauaccugcugcaguacuucaagcccgugaucgacagacagagcuggagcgacaagggcagcgugugggacagaaugcugagaagcgcccugcugaagcuggccugcgaccugaaccacgcccccugcauccagaaggccgccgagcuguucagccaguggauggagagcagcggcaagcugaacauccccaccgacgugcugaagaucguguacagcgugggcgcccagaccaccgccggcuggaacuaccugcuggagcaguacgagcugagcaugagcagcgccgagcagaacaagauccuguacgcccugagcaccagcaagcaccaggagaagcugcugaagcugaucgagcugggcauggagggcaaggugaucaagacccagaaccuggccgcccugcugcacgccaucgccagaagacccaagggccagcagcuggccugggacuucgugagagagaacuggacccaccugcugaagaaguucgaccugggcagcuacgacaucagaaugaucaucagcggcaccaccgcccacuucagcagcaaggacaagcugcaggaggugaagcuguucuucgagagccuggaggcccagggcagccaccuggacaucuuccagaccgugcuggagaccaucaccaagaacaucaaguggcuggagaagaaccugcccacccugagaaccuggcugauggugaacaccuaa

SEQ ID NO: 16683 - RNA, 702 nt, Artificial Sequence
  ERAS__Homo_sapiens__NP_853510
auggagcugcccaccaagcccggcaccuucgaccugggccuggccaccuggagccccagcuuccagggcgagacccacagagcccaggccagaagaagagacgugggcagacagcugcccgaguacaaggccgugguggugggcgccagcggcgugggcaagagcgcccugaccauccagcugaaccaccagugcuucguggaggaccacgaccccaccauccaggacagcuacuggaaggagcugacccuggacagcggcgacugcauccugaacgugcuggacaccgccggccaggccauccacagagcccugagagaccagugccuggccgugugcgacggcgugcugggcguguucgcccuggacgaccccagcagccugauccagcugcagcagaucugggccaccuggggcccccaccccgcccagccccuggugcuggugggcaacaagugcgaccuggugaccaccgccggcgacgcccacgccgccgccgccgcccuggcccacagcuggggcgcccacuucguggagaccagcgccaagaccagacagggcguggaggaggccuucagccugcuggugcacgagauccagagagugcaggaggccauggccaaggagcccauggccagaagcugcagagagaagaccagacaccagaaggccaccugccacugcggcugcagcguggccuaa

SEQ ID NO: 16684 - RNA, 3678 nt, Artificial Sequence
  ERBB2__Homo_sapiens__NP_001005862
augaagcugagacugcccgccagccccgagacccaccuggacaugcugagacaccuguaccagggcugccagguggugcagggcaaccuggagcugaccuaccugcccaccaacgccagccugagcuuccugcaggacauccaggaggugcagggcuacgugcugaucgcccacaaccaggugagacaggugccccugcagagacugagaaucgugagaggcacccagcuguucgaggacaacuacgcccuggccgugcuggacaacggcgacccccugaacaacaccacccccgugaccggcgccagccccggcggccugagagagcugcagcugagaagccugaccgagauccugaagggcggcgugcugauccagagaaacccccagcugugcuaccaggacaccauccuguggaaggacaucuuccacaagaacaaccagcuggcccugacccugaucgacaccaacagaagcagagccugccaccccugcagccccaugugcaagggcagcagaugcuggggcgagagcagcgaggacugccagagccugaccagaaccgugugcgccggcggcugcgccagaugcaagggcccccugcccaccgacugcugccacgagcagugcgccgccggcugcaccggccccaagcacagcgacugccuggccugccugcacuucaaccacagcggcaucugcgagcugcacugccccgcccuggugaccuacaacaccgacaccuucgagagcaugcccaaccccgagggcagauacaccuucggcgccagcugcgugaccgccugccccuacaacuaccugagcaccgacgugggcagcugcacccuggugugcccccugcacaaccaggaggugaccgccgaggacggcacccagagaugcgagaagugcagcaagcccugcgccagagugugcuacggccugggcauggagcaccugagagaggugagagccgugaccagcgccaacauccaggaguucgccggcugcaagaagaucuucggcagccuggccuuccugcccgagagcuucgacggcgaccccgccagcaacaccgccccccugcagcccgagcagcugcagguguucgagacccuggaggagaucaccggcuaccuguacaucagcgccuggcccgacagccugcccgaccugagcguguuccagaaccugcaggugaucagaggcagaauccugcacaacggcgccuacagccugacccugcagggccugggcaucagcuggcugggccugagaagccugagagagcugggcagcggccuggcccugauccaccacaacacccaccugugcuucgugcacaccgugcccugggaccagcuguucagaaacccccaccaggcccugcugcacaccgccaacagacccgaggacgagugcgugggcgagggccuggccugccaccagcugugcgccagaggccacugcuggggccccggccccacccagugcgugaacugcagccaguuccugagaggccaggagugcguggaggagugcagagugcugcagggccugcccagagaguacgugaacgccagacacugccugcccugccaccccgagugccagccccagaacggcagcgugaccugcuucggccccgaggccgaccagugcguggccugcgcccacuacaaggacccccccuucugcguggccagaugccccagcggcgugaagcccgaccugagcuacaugcccaucuggaaguuccccgacgaggagggcgccugccagcccugccccaucaacugcacccacagcugcguggaccuggacgacaagggcugccccgccgagcagagagccagcccccugaccagcaucaucagcgccguggugggcauccugcuggugguggugcugggcgugguguucggcauccugaucaagagaagacagcagaagaucagaaaguacaccaugagaagacugcugcaggagaccgagcugguggagccccugacccccagcggcgccaugcccaaccaggcccagaugagaauccugaaggagaccgagcugagaaaggugaaggugcugggcagcggcgccuucggcaccguguacaagggcaucuggauccccgacggcgagaacgugaagauccccguggccaucaaggugcugagagagaacaccagccccaaggccaacaaggagauccuggacgaggccuacgugauggccggcgugggcagccccuacgugagcagacugcugggcaucugccugaccagcaccgugcagcuggugacccagcugaugcccuacggcugccugcuggaccacgugagagagaacagaggcagacugggcagccaggaccugcugaacuggugcaugcagaucgccaagggcaugagcuaccuggaggacgugagacuggugcacagagaccuggccgccagaaacgugcuggugaagagccccaaccacgugaagaucaccgacuucggccuggccagacugcuggacaucgacgagaccgaguaccacgccgacggcggcaaggugcccaucaaguggauggcccuggagagcauccugagaagaagauucacccaccagagcgacguguggagcuacggcgugaccgugugggagcugaugaccuucggcgccaagcccuacgacggcauccccgccagagagauccccgaccugcuggagaagggcgagagacugccccagccccccaucugcaccaucgacguguacaugaucauggugaagugcuggaugaucgacagcgagugcagacccagauucagagagcuggugagcgaguucagcagaauggccagagacccccagagauucguggugauccagaacgaggaccugggccccgccagcccccuggacagcaccuucuacagaagccugcuggaggacgacgacaugggcgaccugguggacgccgaggaguaccuggugccccagcagggcuucuucugccccgaccccgcccccggcgccggcggcauggugcaccacagacacagaagcagcagcaccagaagcggcggcggcgaccugacccugggccuggagcccagcgaggaggaggcccccagaagcccccuggcccccagcgagggcgccggcagcgacguguucgacggcgaccugggcaugggcgccgccaagggccugcagagccugcccacccacgaccccagcccccugcagagauacagcgaggaccccaccgugccccugcccagcgagaccgacggcuacguggccccccugaccugcagcccccagcccgaguacgugaaccagcccgacgugagaccccagccccccagccccagagagggcccccugcccgccgccagacccgccggcgccacccuggagagacccaagacccugagccccggcaagaacggcguggugaaggacguguucgccuucggcggcgccguggagaaccccgaguaccugaccccccagggcggcgccgccccccagccccaccccccccccgccuucagccccgccuucgacaaccuguacuacugggaccaggacccccccgagagaggcgccccccccagcaccuucaagggcacccccaccgccgagaaccccgaguaccugggccuggacgugcccguguaa

SEQ ID NO: 16685 - RNA, 3909 nt, Artificial Sequence
  ERBB2IP__Homo_sapiens__NP_001006600
augaccaccaagagaagccuguucgugagacuggugcccugcagaugccugagaggcgaggaggagaccgugaccacccuggacuacagccacugcagccuggagcaggugcccaaggagaucuucaccuucgagaagacccuggaggagcuguaccuggacgccaaccagaucgaggagcugcccaagcagcuguucaacugccagagccugcacaagcugagccugcccgacaacgaccugaccacccugcccgccagcaucgccaaccugaucaaccugagagagcuggacgugagcaagaacggcauccaggaguuccccgagaacaucaagaacugcaaggugcugaccaucguggaggccagcgugaaccccaucagcaagcugcccgacggcuucagccagcugcugaaccugacccagcuguaccugaacgacgccuuccuggaguuccugcccgccaacuucggcagacugaccaagcugcagauccuggagcugagagagaaccagcugaagaugcugcccaagaccaugaacagacugacccagcuggagagacuggaccugggcagcaacgaguucaccgaggugcccgaggugcuggagcagcugagcggccugaaggaguucuggauggacgccaacagacugaccuucauccccggcuucaucggcagccugaagcagcugaccuaccuggacgugagcaagaacaacaucgagaugguggaggagggcaucagcaccugcgagaaccugcaggaccugcugcugagcagcaacagccugcagcagcugcccgagaccaucggcagccugaagaacaucaccacccugaagaucgacgagaaccagcugauguaccugcccgacagcaucggcggccugaucagcguggaggagcuggacugcagcuucaacgagguggaggcccugcccagcagcaucggccagcugaccaaccugagaaccuucgccgccgaccacaacuaccugcagcagcugccccccgagaucggcagcuggaagaacaucaccgugcuguuccugcacagcaacaagcuggagacccugcccgaggagaugggcgacaugcagaagcugaaggugaucaaccugagcgacaacagacugaagaaccugcccuucagcuucaccaagcugcagcagcugaccgccauguggcugagcgacaaccagagcaagccccugaucccccugcagaaggagaccgacagcgagacccagaagauggugcugaccaacuacauguucccccagcagcccagaaccgaggacgugauguucaucagcgacaacgagagcuucaaccccagccugugggaggagcagagaaagcagagagcccagguggccuucgagugcgacgaggacaaggacgagagagaggccccccccagagagggcaaccugaagagauaccccacccccuaccccgacgagcugaagaacauggugaagaccgugcagaccaucgugcacagacugaaggacgaggagaccaacgaggacagcggcagagaccugaagccccacgaggaccagcaggacaucaacaaggacgugggcgugaagaccagcgagagcaccaccaccgugaagagcaagguggacgagagagagaaguacaugaucggcaacagcgugcagaagaucagcgagcccgaggccgagaucagccccggcagccugcccgugaccgccaacaugaaggccagcgagaaccugaagcacaucgugaaccacgacgacguguucgaggagagcgaggagcugagcagcgacgaggagaugaagauggccgagaugagacccccccugaucgagaccagcaucaaccagcccaaggugguggcccugagcaacaacaagaaggacgacaccaaggagaccgacagccugagcgacgaggugacccacaacagcaaccagaacaacagcaacugcagcagccccagcagaaugagcgacagcgugagccugaacaccgacagcagccaggacaccagccugugcagccccgugaagcagacccacaucgacaucaacagcaagaucagacaggaggacgagaacuucaacagccugcugcagaacggcgacauccugaacagcagcaccgaggagaaguucaaggcccacgacaagaaggacuucaaccugcccgaguacgaccugaacguggaggagagacuggugcugaucgagaagagcguggacagcaccgccaccgccgacgacacccacaagcuggaccacaucaacaugaaccugaacaagcugaucaccaacgacaccuuccagcccgagaucauggagagaagcaagacccaggacaucgugcugggcaccagcuuccugagcaucaacagcaaggaggagaccgagcaccuggagaacggcaacaaguaccccaaccuggagagcgugaacaaggugaacggccacagcgaggagaccagccagagccccaacagaaccgagccccacgacagcgacugcagcguggaccugggcaucagcaagagcaccgaggaccugagcccccagaagagcggccccgugggcagcguggugaagagccacagcaucaccaacauggagaucggcggccugaagaucuacgacauccugagcgacaacggcccccagcagcccagcaccaccgugaagaucaccagcgccguggacggcaagaacaucgugagaagcaagagcgccacccugcuguacgaccagccccugcagguguucaccggcagcagcagcagcagcgaccugaucagcggcaccaaggccaucuucaaguucgacagcaaccacaaccccgaggagcccaacaucaucagaggccccaccagcggcccccagagcgccccccagaucuacggccccccccaguacaacauccaguacagcagcagcgccgccgugaaggacacccuguggcacagcaagcagaacccccagaucgaccacgccagcuuccccccccagcugcugcccagaagcgagagcaccgagaaccagagcuacgccaagcacagcgccaacaugaacuucagcaaccacaacaacgugagagccaacaccgccuaccaccugcaccagagacugggccccgccagacacggcgagaugugggccaucagccccaacgacagacugauccccgccgugaccagaagcaccauccagagacagagcagcgugagcagcaccgccagcgugaaccugggcgaccccggcagcaccagaagagcccagauccccgagggcgacuaccugagcuacagagaguuccacagcgccggcagaaccccccccaugaugcccggcagccagagaccccugagcgccagaaccuacagcaucgacggccccaacgccagcagaccccagagcgccagacccagcaucaacgagauccccgagagaaccaugagcgugagcgacuucaacuacagcagaaccagccccagcaagagacccaacgccagagugggcagcgagcacagccugcuggacccccccggcaagagcaaggugcccagagacuggagagagcaggugcugagacacaucgaggccaagaagcuggagaagaucagagugagaguggagaaggaccccgagcugggcuucagcaucagcggcggcgugggcggcagaggcaaccccuucagacccgacgacgacggcaucuucgugaccagagugcagcccgagggccccgccagcaagcugcugcagcccggcgacaagaucauccaggccaacggcuacagcuucaucaacaucgagcacggccaggccgugagccugcugaagaccuuccagaacaccguggagcugaucaucgugagagaggugagcagcuaa

SEQ ID NO: 16686 - RNA, 552 nt, Artificial Sequence
  ERBB3__Homo_sapiens__NP_001005915
augagagccaacgacgcccugcaggugcugggccugcuguucagccuggccagaggcagcgaggugggcaacagccaggccgugugccccggcacccugaacggccugagcgugaccggcgacgccgagaaccaguaccagacccuguacaagcuguacgagagaugcgagguggugaugggcaaccuggagaucgugcugaccggccacaacgccgaccugagcuuccugcaguggaucagagaggugaccggcuacgugcugguggccaugaacgaguucagcacccugccccugcccaaccugagaguggugagaggcacccagguguacgacggcaaguucgccaucuucgugaugcugaacuacaacaccaacagcagccacgcccugagacagcugagacugacccagcugaccggccaguuccccauggugcccagcggccugaccccccagcccgcccaggacugguaccugcuggacgacgaccccagacugcugacccugagcgccagcagcaaggugcccgugacccuggccgccguguaa

SEQ ID NO: 16687 - RNA, 3879 nt, Artificial Sequence
  ERBB4__Homo_sapiens__NP_001036064
augaagcccgccaccggccugugggugugggugagccugcugguggccgccggcaccgugcagcccagcgacagccagagcgugugcgccggcaccgagaacaagcugagcagccugagcgaccuggagcagcaguacagagcccugagaaaguacuacgagaacugcgagguggugaugggcaaccuggagaucaccagcaucgagcacaacagagaccugagcuuccugagaagcgugagagaggugaccggcuacgugcugguggcccugaaccaguucagauaccugccccuggagaaccugagaaucaucagaggcaccaagcuguacgaggacagauacgcccuggccaucuuccugaacuacagaaaggacggcaacuucggccugcaggagcugggccugaagaaccugaccgagauccugaacggcggcguguacguggaccagaacaaguuccugugcuacgccgacaccauccacuggcaggacaucgugagaaaccccuggcccagcaaccugacccuggugagcaccaacggcagcagcggcugcggcagaugccacaagagcugcaccggcagaugcuggggccccaccgagaaccacugccagacccugaccagaaccgugugcgccgagcagugcgacggcagaugcuacggccccuacgugagcgacugcugccacagagagugcgccggcggcugcagcggccccaaggacaccgacugcuucgccugcaugaacuucaacgacagcggcgccugcgugacccagugcccccagaccuucguguacaaccccaccaccuuccagcuggagcacaacuucaacgccaaguacaccuacggcgccuucugcgugaagaagugcccccacaacuucgugguggacagcagcagcugcgugagagccugccccagcagcaagauggagguggaggagaacggcaucaagaugugcaagcccugcaccgacaucugccccaaggccugcgacggcaucggcaccggcagccugaugagcgcccagaccguggacagcagcaacaucgacaaguucaucaacugcaccaagaucaacggcaaccugaucuuccuggugaccggcauccacggcgaccccuacaacgccaucgaggccaucgaccccgagaagcugaacguguucagaaccgugagagagaucaccggcuuccugaacauccagagcuggccccccaacaugaccgacuucagcguguucagcaaccuggugaccaucggcggcagagugcuguacagcggccugagccugcugauccugaagcagcagggcaucaccagccugcaguuccagagccugaaggagaucagcgccggcaacaucuacaucaccgacaacagcaaccugugcuacuaccacaccaucaacuggaccacccuguucagcaccaucaaccagagaaucgugaucagagacaacagaaaggccgagaacugcaccgccgagggcauggugugcaaccaccugugcagcagcgacggcugcuggggccccggccccgaccagugccugagcugcagaagauucagcagaggcagaaucugcaucgagagcugcaaccuguacgacggcgaguucagagaguucgagaacggcagcaucugcguggagugcgacccccagugcgagaagauggaggacggccugcugaccugccacggccccggccccgacaacugcaccaagugcagccacuucaaggacggccccaacugcguggagaagugccccgacggccugcagggcgccaacagcuucaucuucaaguacgccgaccccgacagagagugccaccccugccaccccaacugcacccagggcugcaacggccccaccagccacgacugcaucuacuaccccuggaccggccacagcacccugccccagcacgccagaaccccccugaucgccgccggcgugaucggcggccuguucauccuggugaucgugggccugaccuucgccguguacgugagaagaaagagcaucaagaagaagagagcccugagaagauuccuggagaccgagcugguggagccccugacccccagcggcaccgcccccaaccaggcccagcugagaauccugaaggagaccgagcugaagagagugaaggugcugggcagcggcgccuucggcaccguguacaagggcaucugggugcccgagggcgagaccgugaagauccccguggccaucaagauccugaacgagaccaccggccccaaggccaacguggaguucauggacgaggcccugaucauggccagcauggaccacccccaccuggugagacugcugggcgugugccugagccccaccauccagcuggugacccagcugaugccccacggcugccugcuggaguacgugcacgagcacaaggacaacaucggcagccagcugcugcugaacuggugcgugcagaucgccaagggcaugauguaccuggaggagagaagacuggugcacagagaccuggccgccagaaacgugcuggugaagagccccaaccacgugaagaucaccgacuucggccuggccagacugcuggagggcgacgagaaggaguacaacgccgacggcggcaagaugcccaucaaguggauggcccuggagugcauccacuacagaaaguucacccaccagagcgacguguggagcuacggcgugaccaucugggagcugaugaccuucggcggcaagcccuacgacggcauccccaccagagagauccccgaccugcuggagaagggcgagagacugccccagccccccaucugcaccaucgacguguacauggugauggugaagugcuggaugaucgacgccgacagcagacccaaguucaaggagcuggccgccgaguucagcagaauggccagagacccccagagauaccuggugauccagggcgacgacagaaugaagcugcccagccccaacgacagcaaguucuuccagaaccugcuggacgaggaggaccuggaggacaugauggacgccgaggaguaccuggugccccaggccuucaacauccccccccccaucuacaccagcagagccagaaucgacagcaacagaaaccaguucguguacagagacggcggcuucgccgccgagcagggcgugagcgugcccuacagagcccccaccagcaccauccccgaggcccccguggcccagggcgccaccgccgagaucuucgacgacagcugcugcaacggcacccugagaaagcccguggccccccacgugcaggaggacagcagcacccagagauacagcgccgaccccaccguguucgcccccgagagaagccccagaggcgagcuggacgaggagggcuacaugacccccaugagagacaagcccaagcaggaguaccugaaccccguggaggagaaccccuucgugagcagaagaaagaacggcgaccugcaggcccuggacaaccccgaguaccacaacgccagcaacggcccccccaaggccgaggacgaguacgugaacgagccccuguaccugaacaccuucgccaacacccugggcaaggccgaguaccugaagaacaacauccugagcaugcccgagaaggccaagaaggccuucgacaaccccgacuacuggaaccacagccugccccccagaagcacccugcagcaccccgacuaccugcaggaguacagcaccaaguacuucuacaagcagaacggcagaaucagacccaucguggccgagaaccccgaguaccugagcgaguucagccugaagcccggcaccgugcugccccccccccccuacagacacagaaacaccgugguguaa

SEQ ID NO: 16688 - RNA, 3456 nt, Artificial Sequence
  ERC1__Homo_sapiens__XP_011519238
auguacggcagcgccagaagcgugggcaagguggagcccagcagccagagccccggcagaagccccagacugcccagaagccccagacugggccacagaagaaccaacagcaccggcggcagcagcggcagcagcgugggcggcggcagcggcaagacccugagcauggagaacauccagagccugaacgccgccuacgccaccagcggccccauguaccugagcgaccacgagaacgugggcagcgagacccccaagagcaccaugacccugggcagaagcggcggcagacugcccuacggcgugagaaugaccgccaugggcagcagccccaacaucgccagcagcggcguggccagcgacaccaucgccuucggcgagcaccaccugccccccgugagcauggccagcaccgugccccacagccugagacaggccagagacaacaccaucauggaccugcagacccagcugaaggaggugcugagagagaacgaccugcugagaaaggacguggaggugaaggagagcaagcugagcagcagcaugaacagcaucaagaccuucuggagccccgagcugaagaaggagagagcccugagaaaggacgaggccagcaagaucaccaucuggaaggagcaguacagaguggugcaggaggagaaccagcacaugcagaugaccauccaggcccugcaggacgagcugagaauccagagagaccugaaccagcuguuccagcaggacagcagcagcagaaccggcgagcccugcguggccgagcugaccgaggagaacuuccagagacugcacgccgagcacgagagacaggccaaggagcuguuccugcugagaaagacccuggaggagauggagcugagaaucgagacccagaagcagacccugaacgccagagacgagagcaucaagaagcugcuggagaugcugcagagcaagggccugagcgccaaggccaccgaggaggaccacgagagaaccagaagacuggccgaggccgagaugcacgugcaccaccuggagagccugcuggagcagaaggagaaggagaacagcaugcugagagaggagaugcacagaagauucgagaacgcccccgacagcgccaagaccaaggcccugcagaccgugaucgagaugaaggacagcaagaucagcagcauggagagaggccugagagaccuggaggaggagauccagaugcugaagagcaacggcgcccugagcaccgaggagagagaggaggagaugaagcagauggagguguacagaagccacagcaaguucaugaagaacaagaucggccaggugaagcaggagcugagcagaaaggacaccgagcugcuggcccugcagaccaagcuggagacccugaccaaccaguucagcgacagcaagcagcacaucgaggugcugaaggagagccugaccgccaaggagcagagagccgccauccugcagaccgagguggacgcccugagacugagacuggaggagaaggagaccaugcugaacaagaagaccaagcagauccaggacauggccgaggagaagggcacccaggccggcgagauccacgaccugaaggacaugcuggacgugaaggagagaaaggugaacgugcugcagaagaagaucgagaaccugcaggagcagcugagagacaaggagaagcagaugagcagccugaaggagagagugaagagccugcaggccgacaccaccaacaccgacaccgcccugaccacccuggaggaggcccuggccgagaaggagagaaccaucgagagacugaaggagcagagagacagagacgagagagagaagcaggaggagaucgacaacuacaagaaggaccugaaggaccugaaggagaaggugagccugcugcagggcgaccugagcgagaaggaggccagccugcuggaccugaaggagcacgccagcagccuggccagcagcggccugaagaaggacagcagacugaagacccuggagaucgcccuggagcagaagaaggaggagugccugaagauggagagccagcugaagaaggcccacgaggccgcccuggaggccagagccagccccgagaugagcgacagaauccagcaccuggagagagagaucaccagauacaaggacgagagcagcaaggcccaggccgagguggacagacugcuggagauccugaaggagguggagaacgagaagaacgacaaggacaagaagaucgccgagcuggagagccugaccagcagacaggugaaggaccagaacaagaagguggccaaccugaagcacaaggagcagguggagaagaagaagagcgcccagaugcuggaggaggccagaagaagagaggacaaccugaacgacagcagccagcagcugcaggacagccugagaaagaaggacgacagaaucgaggagcuggaggaggcccugagagagagcgugcagaucaccgccgagagagagauggugcuggcccaggaggagagcgccagaaccaacgccgagaagcagguggaggagcugcugauggccauggagaaggugaagcaggagcuggagagcaugaaggccaagcugagcagcacccagcagagccuggccgagaaggagacccaccugaccaaccugagagccgagagaagaaagcaccuggaggaggugcuggagaugaagcaggaggcccugcuggccgccaucagcgagaaggacgccaacaucgcccugcuggagcugagcagcagcaagaagaagacccaggaggagguggccgcccugaagagagagaaggacagacuggugcagcagcugaagcagcagacccagaacagaaugaagcugauggccgacaacuacgaggacgaccacuucaagagcagccacagcaaccagaccaaccacaagcccagccccgaccagaucauccagccccugcuggagcuggaccagaacagaagcaagcugaagcuguacaucggccaccugaccacccugugccacgacagagacccccugauccugagaggccugaccccccccgccagcuacaaccuggacgacgaccaggccgccugggagaacgagcugcagaagaugaccagaggccagaacaccccccacuuccugaagcccgccagcgccaaccuguggcccgacaaggacuuccagagccccagcgugcaccugcugcugcaggacugcaccagcagcaagcacagcacccagaaggagagcguggccagccagagccacggcaagaccgccuucuuccacgugaugcugaugcugcaggacgagcuggagaagggcgagagagacaacgccgagcugcaggaguucgccaacgccauccugcagcagaucgccgaccacugccccgacauccuggagcagguggugaacgcccuggaggagagcagcuaa

SEQ ID NO: 16689 - RNA, 2874 nt, Artificial Sequence
  ERC2__Homo_sapiens__NP_056391
auguacggcagcgccagaaccaucaccaaccuggagggcagccccagcagaagccccagacugcccagaagccccagacugggccacagaagaaccagcagcggcggcggcggcggcaccggcaagacccugagcauggagaacauccagagccugaacgccgccuacgccaccagcggccccauguaccugagcgaccacgagggcguggccagcaccaccuaccccaagggcaccaugacccugggcagagccaccaacagagccguguacggcggcagagugaccgccaugggcagcagccccaacaucgccagcgccggccugagccacaccgacgugcugagcuacaccgaccagcacggcggccugaccggcagcagccaccaccaccaccaccaggugcccagcaugcugagacaggugagagacagcaccaugcuggaccugcaggcccagcugaaggagcugcagagagagaacgaccugcugagaaaggagcuggacaucaaggacagcaagcugggcagcagcaugaacagcaucaagaccuucuggagccccgagcugaagaaggagagagugcugagaaaggaggaggccgccagaaugagcgugcugaaggagcagaugagagugagccacgaggagaaccagcaccugcagcugaccauccaggcccugcaggacgagcugagaacccagagagaccugaaccaccugcugcagcaggagagcggcaacagaggcgccgagcacuucaccaucgagcugaccgaggagaacuucagaagacugcaggccgagcacgacagacaggccaaggagcuguuccugcugagaaagacccuggaggagauggagcugagaaucgagacccagaagcagacccugaacgccagagacgagagcaucaagaagcugcuggagaugcugcagagcaagggccugcccagcaagagccuggaggacgacaacgagagaaccagaagaauggccgaggccgagagccaggugagccaccuggaggugauccuggaccagaaggagaaggagaacauccaccugagagaggagcugcacagaagaagccagcugcagcccgagcccgccaagaccaaggcccugcagaccgugaucgagaugaaggacaccaagaucgccagccuggagagaaacaucagagaccuggaggacgagauccagaugcugaaggccaacggcgugcugaacaccgaggacagagaggaggagaucaagcagaucgagguguacaagagccacagcaaguucaugaagaccaagaucgaccagcugaagcaggagcugagcaagaaggagagcgagcugcuggcccugcagaccaagcuggagacccugagcaaccagaacagcgacugcaagcagcacaucgaggugcugaaggagagccugaccgccaaggagcagagagccgccauccugcagaccgagguggacgcccugagacugagacuggaggagaaggagagcuuccugaacaagaagaccaagcagcugcaggaccugaccgaggagaagggcacccuggccggcgagaucagagacaugaaggacaugcuggaggugaaggagagaaagaucaacgugcugcagaagaagaucgagaaccugcaggagcagcugagagacaaggacaagcagcugaccaaccugaaggacagagugaagagccugcagaccgacagcagcaacaccgacaccgcccuggccacccuggaggaggcccugagcgagaaggagagaaucaucgagagacugaaggagcagagagagagagacgacagagagagacuggaggagaucgagagcuucagaaaggagaacaaggaccugaaggagaaggugaacgcccugcaggccgagcugaccgagaaggagagcagccugaucgaccugaaggagcacgccagcagccuggccagcgccggccugaagagagacagcaagcugaagagccuggagaucgccaucgagcagaagaaggaggagugcagcaagcuggaggcccagcugaagaaggcccacaacaucgaggacgacagcagaaugaaccccgaguucgccgaccagaucaagcagcuggacaaggaggccagcuacuacagagacgagugcggcaaggcccaggccgagguggacagacugcuggagauccugaaggagguggagaacgagaagaacgacaaggacaagaagaucgccgagcuggagagccugacccugagacacaugaaggaccagaacaagaagguggccaaccugaagcacaaccagcagcuggagaagaagaagaacgcccagcugcuggaggaggugagaagaagagaggacagcauggccgacaacagccagcaccugcagaucgaggagcugaugaacgcccuggagaagaccagacaggagcuggacgccaccaaggccagacuggccagcacccagcagagccuggccgagaaggaggcccaccuggccaaccugagaaucgagagaagaaagcagcuggaggagauccuggagaugaagcaggaggcccugcuggccgccaucagcgagaaggacgccaacaucgcccugcuggagcugagcgccagcaagaagaagaagacccaggaggaggugauggcccugaagagagagaaggacagacuggugcaccagcugaagcagcagacccagaacagaaugaagcugauggccgacaacuacgacgacgaccaccaccacuaccaccaccaccaccaccaccaccaccacagaagccccggcagaagccagcacagcaaccacagacccagccccgaccaggacgacgaggagggcaucugggccuaa

SEQ ID NO: 16690 - RNA, 822 nt, Artificial Sequence
  ERCC1__Homo_sapiens__NP_001159521
auggaccccggcaaggacaaggagggcgugccccagcccagcggcccccccgccagaaagaaguucgugaucccccuggacgaggacgaggugccccccggcguggccaagccccuguucagaagcacccagagccugcccaccguggacaccagcgcccaggccgccccccagaccuacgccgaguacgccaucagccagccccuggagggcgccggcgccaccugccccaccggcagcgagccccuggccggcgagacccccaaccaggcccugaagcccggcgccaagagcaacagcaucaucgugagccccagacagagaggcaaccccgugcugaaguucgugagaaacgugcccugggaguucggcgacgugauccccgacuacgugcugggccagagcaccugcgcccuguuccugagccugagauaccacaaccugcaccccgacuacauccacggcagacugcagagccugggcaagaacuucgcccugagagugcugcuggugcagguggacgugaaggacccccagcaggcccugaaggagcuggccaagaugugcauccuggccgacugcacccugauccuggccuggagccccgaggaggccggcagauaccuggagaccuacaaggccuacgagcagaagcccgccgaccugcugauggagaagcuggagcaggacuucgugagcagaagccuggagcagcugaucgccgccagcagagaggaccuggcccugugccccggccugggcccccagaaggccagaagacuguucgacgugcugcacgagcccuuccugaaggugcccuaa

SEQ ID NO: 16691 - RNA, 2283 nt, Artificial Sequence
  ERCC2__Homo_sapiens__NP_000391
augaagcugaacguggacggccugcugguguacuuccccuacgacuacaucuaccccgagcaguucagcuacaugagagagcugaagagaacccuggacgccaagggccacggcgugcuggagaugcccagcggcaccggcaagaccgugagccugcuggcccugaucauggccuaccagagagccuacccccuggaggugaccaagcugaucuacugcagcagaaccgugcccgagaucgagaaggugaucgaggagcugagaaagcugcugaacuucuacgagaagcaggagggcgagaagcugcccuuccugggccuggcccugagcagcagaaagaaccugugcauccaccccgaggugaccccccugagauucggcaaggacguggacggcaagugccacagccugaccgccagcuacgugagagcccaguaccagcacgacaccagccugccccacugcagauucuacgaggaguucgacgcccacggcagagaggugccccugcccgccggcaucuacaaccuggacgaccugaaggcccugggcagaagacagggcuggugccccuacuuccuggccagauacagcauccugcacgccaacguggugguguacagcuaccacuaccugcuggaccccaagaucgccgaccuggugagcaaggagcuggccagaaaggccguggugguguucgacgaggcccacaacaucgacaacgugugcaucgacagcaugagcgugaaccugaccagaagaacccuggacagaugccagggcaaccuggagacccugcagaagaccgugcugagaaucaaggagaccgacgagcagagacugagagacgaguacagaagacugguggagggccugagagaggccagcgccgccagagagaccgacgcccaccuggccaaccccgugcugcccgacgaggugcugcaggaggccgugcccggcagcaucagaaccgccgagcacuuccugggcuuccugagaagacugcuggaguacgugaaguggagacugagagugcagcacguggugcaggagagcccccccgccuuccugagcggccuggcccagagagugugcauccagagaaagccccugagauucugcgccgagagacugagaagccugcugcacacccuggagaucaccgaccuggccgacuucagcccccugacccugcuggccaacuucgccacccuggugagcaccuacgccaagggcuucaccaucaucaucgagcccuucgacgacagaacccccaccaucgccaaccccauccugcacuucagcugcauggacgccagccuggccaucaagcccguguucgagagauuccagagcgugaucaucaccagcggcacccugagcccccuggacaucuaccccaagauccuggacuuccaccccgugaccauggccaccuucaccaugacccuggccagagugugccugugccccaugaucaucggcagaggcaacgaccagguggccaucagcagcaaguucgagaccagagaggacaucgccgugaucagaaacuacggcaaccugcugcuggagaugagcgccguggugcccgacggcaucguggccuucuucaccagcuaccaguacauggagagcaccguggccagcugguacgagcagggcauccuggagaacauccagagaaacaagcugcuguucaucgagacccaggacggcgccgagaccagcguggcccuggagaaguaccaggaggccugcgagaacggcagaggcgccauccugcugagcguggccagaggcaaggugagcgagggcaucgacuucgugcaccacuacggcagagccgugaucauguucggcgugcccuacguguacacccagagcagaauccugaaggccagacuggaguaccugagagaccaguuccagaucagagagaacgacuuccugaccuucgacgccaugagacacgccgcccagugcgugggcagagccaucagaggcaagaccgacuacggccugaugguguucgccgacaagagauucgccagaggcgacaagagaggcaagcugcccagauggauccaggagcaccugaccgacgccaaccugaaccugaccguggacgagggcgugcagguggccaaguacuuccugagacagauggcccagcccuuccacagagaggaccagcugggccugagccugcugagccuggagcagcuggagagcgaggagacccugaagagaaucgagcagaucgcccagcagcuguaa

SEQ ID NO: 16692 - RNA, 2349 nt, Artificial Sequence
  ERCC3__Homo_sapiens__NP_000113
augggcaagagagacagagccgacagagacaagaagaagagcagaaagagacacuacgaggacgaggaggacgacgaggaggacgcccccggcaacgacccccaggaggccgugcccagcgccgccggcaagcagguggacgagagcggcaccaagguggacgaguacggcgccaaggacuacagacugcagaugccccugaaggacgaccacaccagcagaccccuguggguggcccccgacggccacaucuuccuggaggccuucagccccguguacaaguacgcccaggacuuccugguggccaucgccgagcccgugugcagacccacccacgugcacgaguacaagcugaccgccuacagccuguacgccgccgugagcgugggccugcagaccagcgacaucaccgaguaccugagaaagcugagcaagaccggcgugcccgacggcaucaugcaguucaucaagcugugcaccgugagcuacggcaaggugaagcuggugcugaagcacaacagauacuucguggagagcugccaccccgacgugauccagcaccugcugcaggaccccgugaucagagagugcagacugagaaacagcgagggcgaggccaccgagcugaucaccgagaccuucaccagcaagagcgccaucagcaagaccgccgagagcagcggcggccccagcaccagcagagugaccgacccccagggcaagagcgacauccccauggaccuguucgacuucuacgagcagauggacaaggacgaggaggaggaggaggagacccagaccgugagcuucgaggugaagcaggagaugaucgaggagcugcagaagagaugcauccaccuggaguacccccugcuggccgaguacgacuucagaaacgacagcgugaaccccgacaucaacaucgaccugaagcccaccgccgugcugagacccuaccaggagaagagccugagaaagauguucggcaacggcagagccagaagcggcgugaucgugcugcccugcggcgccggcaagagccuggugggcgugaccgccgccugcaccgugagaaagagaugccuggugcugggcaacagcgccgugagcguggagcaguggaaggcccaguucaagauguggagcaccaucgacgacagccagaucugcagauucaccagcgacgccaaggacaagcccaucggcugcagcguggccaucagcaccuacagcaugcugggccacaccaccaagagaagcugggaggccgagagagugauggaguggcugaagacccaggaguggggccugaugauccuggacgaggugcacaccauccccgccaagauguucagaagagugcugaccaucgugcaggcccacugcaagcugggccugaccgccacccuggugagagaggacgacaagaucguggaccugaacuuccugaucggccccaagcuguacgaggccaacuggauggagcugcagaacaacggcuacaucgccaaggugcagugcgccgagguguggugccccaugagccccgaguucuacagagaguacguggccaucaagaccaagaagagaauccugcuguacaccaugaaccccaacaaguucagagccugccaguuccugaucaaguuccacgagagaagaaacgacaagaucaucguguucgccgacaacguguucgcccugaaggaguacgccaucagacugaacaagcccuacaucuacggccccaccagccagggcgagagaaugcagauccugcagaacuucaagcacaaccccaagaucaacaccaucuucaucagcaaggugggcgacaccagcuucgaccugcccgaggccaacgugcugauccagaucagcagccacggcggcagcagaagacaggaggcccagagacugggcagagugcugagagccaagaagggcaugguggccgaggaguacaacgccuucuucuacagccuggugagccaggacacccaggagauggccuacagcaccaagagacagagauuccugguggaccagggcuacagcuucaaggugaucaccaagcuggccggcauggaggaggaggaccuggccuucagcaccaaggaggagcagcagcagcugcugcagaaggugcuggccgccaccgaccuggacgccgaggaggaggugguggccggcgaguucggcagcagaagcagccaggccagcagaagauucggcaccaugagcagcaugagcggcgccgacgacaccguguacauggaguaccacagcagcagaagcaaggcccccagcaagcacgugcacccccuguucaagagauucagaaaguaa

SEQ ID NO: 16693 - RNA, 2751 nt, Artificial Sequence
  ERCC4__Homo_sapiens__NP_005227
auggagagcggccagcccgccagaagaaucgccauggccccccugcuggaguacgagagacagcuggugcuggagcugcuggacaccgacggccugguggugugcgccagaggccugggcgccgacagacugcuguaccacuuccugcagcugcacugccaccccgccugccuggugcuggugcugaacacccagcccgccgaggaggaguacuucaucaaccagcugaagaucgagggcguggagcaccugcccagaagagugaccaacgagaucaccagcaacagcagauacgagguguacacccagggcggcgugaucuucgccaccagcagaauccuggugguggacuuccugaccgacagaauccccagcgaccugaucaccggcauccugguguacagagcccacagaaucaucgagagcugccaggaggccuucauccugagacuguucagacagaagaacaagagaggcuucaucaaggccuucaccgacaacgccguggccuucgacaccggcuucugccacguggagagagugaugagaaaccuguucgugagaaagcuguaccuguggcccagauuccacguggccgugaacagcuuccuggagcagcacaagcccgaggugguggagauccacgugagcaugacccccaccaugcuggccauccagaccgccauccuggacauccugaacgccugccugaaggagcugaagugccacaaccccagccuggagguggaggaccugagccuggagaacgccaucggcaagcccuucgacaagaccaucagacacuaccuggacccccuguggcaccagcugggcgccaagaccaagagccuggugcaggaccugaagauccugagaacccugcugcaguaccugagccaguacgacugcgugaccuuccugaaccugcuggagagccugagagccaccgagaaggccuucggccagaacagcggcuggcuguuccuggacagcagcaccagcauguucaucaacgccagagccagaguguaccaccugcccgacgccaagaugagcaagaaggagaagaucagcgagaagauggagaucaaggagggcgaggagaccaagaaggagcuggugcuggagagcaaccccaagugggaggcccugaccgaggugcugaaggagaucgaggccgagaacaaggagagcgaggcccugggcggccccggccaggugcugaucugcgccagcgacgacagaaccugcagccagcugagagacuacaucacccugggcgccgaggccuuccugcugagacuguacagaaagaccuucgagaaggacagcaaggccgaggagguguggaugaaguucagaaaggaggacagcagcaagagaaucagaaagagccacaagagacccaaggacccccagaacaaggagagagccagcaccaaggagagaacccugaagaagaagaagagaaagcugacccugacccagauggugggcaagcccgaggagcuggaggaggagggcgacguggaggagggcuacagaagagagaucagcagcagccccgagagcugccccgaggagaucaagcacgaggaguucgacgugaaccugagcagcgacgccgccuucggcauccugaaggagccccugaccaucauccacccccugcugggcugcagcgaccccuacgcccugaccagagugcugcacgagguggagcccagauacguggugcuguacgacgccgagcugaccuucgugagacagcuggagaucuacagagccagcagacccggcaagccccugagaguguacuuccugaucuacggcggcagcaccgaggagcagagauaccugaccgcccugagaaaggagaaggaggccuucgagaagcugaucagagagaaggccagcaugguggugcccgaggagagagagggcagagacgagaccaaccuggaccuggugagaggcaccgccagcgccgacgugagcaccgacaccagaaaggccggcggccaggagcagaacggcacccagcagagcaucgugguggacaugagagaguucagaagcgagcugcccagccugauccacagaagaggcaucgacaucgagcccgugacccuggaggugggcgacuacauccugacccccgagaugugcguggagagaaagagcaucagcgaccugaucggcagccugaacaacggcagacuguacagccagugcaucagcaugagcagauacuacaagagacccgugcugcugaucgaguucgaccccagcaagcccuucagccugaccagcagaggcgcccuguuccaggagaucagcagcaacgacaucagcagcaagcugacccugcugacccugcacuuccccagacugagaauccuguggugccccagcccccacgccaccgccgagcuguucgaggagcugaagcagagcaagccccagcccgacgccgccaccgcccuggccaucaccgccgacagcgagacccugcccgagagcgagaaguacaaccccggcccccaggacuuccugcugaagaugcccggcgugaacgccaagaacugcagaagccugaugcaccacgugaagaacaucgccgagcuggccgcccugagccaggacgagcugaccagcauccugggcaacgccgccaacgccaagcagcuguacgacuucauccacaccagcuucgccgagguggugagcaagggcaagggcaagaaguaa

SEQ ID NO: 16694 - RNA, 3561 nt, Artificial Sequence
  ERCC5__Homo_sapiens__NP_000114
augggcgugcagggccuguggaagcugcuggagugcagcggcagacaggugagccccgaggcccuggagggcaagauccuggccguggacaucagcaucuggcugaaccaggcccugaagggcgugagagacagacacggcaacagcaucgagaacccccaccugcugacccuguuccacagacugugcaagcugcuguucuucagaaucagacccaucuucguguucgacggcgacgccccccugcugaagaagcagacccuggugaagagaagacagagaaaggaccuggccagcagcgacagcagaaagaccaccgagaagcugcugaagaccuuccugaagagacaggccaucaagaccgccuucagaagcaagagagacgaggcccugcccagccugacccaggugagaagagagaacgaccuguacgugcugcccccccugcaggaggaggagaagcacagcagcgaggaggaggacgagaaggaguggcaggagagaaugaaccagaagcaggcccugcaggaggaguucuuccacaacccccaggccaucgacaucgagagcgaggacuucagcagccugccccccgaggugaagcacgagauccugaccgacaugaaggaguucaccaagagaagaagaacccuguucgaggccaugcccgaggagagcgacgacuucagccaguaccagcugaagggccugcugaagaagaacuaccugaaccagcacaucgagcacgugcagaaggagaugaaccagcagcacagcggccacaucagaagacaguacgaggacgagggcggcuuccugaaggagguggagagcagaagaguggugagcgaggacaccagccacuacauccugaucaagggcauccaggccaagaccguggccgagguggacagcgagagccugcccagcagcagcaagaugcacggcaugagcuucgacgugaagagcagccccugcgagaagcugaagaccgagaaggagcccgacgccaccccccccagccccagaacccugcuggccaugcaggccgcccugcugggcagcagcagcgaggaggagcuggagagcgagaacagaagacaggccagaggcagaaacgcccccgccgccguggacgagggcagcaucagccccagaacccugagcgccaucaagagagcccuggacgacgacgaggacgugaaggugugcgccggcgacgacgugcagaccggcggccccggcgccgaggagaugagaaucaacagcagcaccgagaacagcgacgagggccugaaggugagagacggcaagggcauccccuucaccgccacccuggccagcagcagcgugaacagcgccgaggagcacguggccagcaccaacgagggcagagagcccaccgacagcgugcccaaggagcagaugagccuggugcacgugggcaccgaggccuuccccaucagcgacgagagcaugaucaaggacagaaaggacagacugccccuggagagcgccguggugagacacagcgacgcccccggccugcccaacggcagagagcugacccccgccagccccaccugcaccaacagcgugagcaagaacgagacccacgccgaggugcuggagcagcagaacgagcugugccccuacgagagcaaguucgacagcagccugcugagcagcgacgacgagaccaagugcaagcccaacagcgccagcgaggugaucggccccgugagccugcaggagaccagcagcaucgugagcgugcccagcgaggccguggacaacguggagaacguggugagcuucaacgccaaggagcacgagaacuuccuggagaccauccaggagcagcagaccaccgagagcgccggccaggaccugaucagcauccccaaggccguggagcccauggagaucgacagcgaggagagcgagagcgacggcagcuucaucgaggugcagagcgugaucagcgacgaggagcugcaggccgaguuccccgagaccagcaagccccccagcgagcagggcgaggaggagcuggugggcaccagagagggcgaggcccccgccgagagcgagagccugcugagagacaacagcgagagagacgacguggacggcgagccccaggaggccgagaaggacgccgaggacagccugcacgaguggcaggacaucaaccuggaggagcuggagacccuggagagcaaccugcuggcccagcagaacagccugaaggcccagaagcagcagcaggagagaaucgccgccaccgugaccggccagauguuccuggagagccaggagcugcugagacuguucggcauccccuacauccaggcccccauggaggccgaggcccagugcgccauccuggaccugaccgaccagaccagcggcaccaucaccgacgacagcgacaucuggcuguucggcgccagacacguguacagaaacuucuucaacaagaacaaguucguggaguacuaccaguacguggacuuccacaaccagcugggccuggacagaaacaagcugaucaaccuggccuaccugcugggcagcgacuacaccgagggcauccccaccgugggcugcgugaccgccauggagauccugaacgaguuccccggccacggccuggagccccugcugaaguucagcgagugguggcacgaggcccagaagaaccccaagaucagacccaacccccacgacaccaaggugaagaagaagcugagaacccugcagcugacccccggcuuccccaaccccgccguggccgaggccuaccugaagcccgugguggacgacagcaagggcagcuuccuguggggcaagcccgaccuggacaagaucagagaguucugccagagauacuucggcuggaacagaaccaagaccgacgagagccuguuccccgugcugaagcagcuggacgcccagcagacccagcugagaaucgacagcuucuucagacuggcccagcaggagaaggaggacgccaagagaaucaagagccagagacugaacagagccgugaccugcaugcugagaaaggagaaggaggccgccgccagcgagaucgaggccgugagcguggccauggagaaggaguucgagcugcuggacaaggccaagagaaagacccagaagagaggcaucaccaacacccuggaggagagcagcagccugaagagaaagagacugagcgacagcaagagaaagaacaccugcggcggcuuccugggcgagaccugccugagcgagagcagcgacggcagcagcagcgaggacgccgagagcagcagccugaugaacgugcagagaagaaccgccgccaaggagcccaagaccagcgccagcgacagccagaacagcgugaaggaggcccccgugaagaacggcggcgccaccaccagcagcagcagcgacagcgacgacgacggcggcaaggagaagauggugcuggugaccgccagaagcguguucggcaagaagagaagaaagcugagaagagccagaggcagaaagagaaagaccuaa

SEQ ID NO: 16695 - RNA, 4482 nt, Artificial Sequence
  ERCC6__Homo_sapiens__NP_000115
augcccaacgagggcaucccccacagcagccagacccaggagcaggacugccugcagagccagcccgugagcaacaacgaggagauggccaucaagcaggagagcggcggcgacggcgagguggaggaguaccugagcuucagaagcgugggcgacggccugagcaccagcgccgugggcugcgccagcgccgcccccagaagaggccccgcccugcugcacaucgacagacaccagauccaggccguggagcccagcgcccaggcccuggagcugcagggccugggcguggacguguacgaccaggacgugcuggagcagggcgugcugcagcagguggacaacgccauccacgaggccagcagagccagccagcugguggacguggagaaggaguacagaagcgugcuggacgaccugaccagcugcaccaccagccugagacagaucaacaagaucaucgagcagcugagcccccaggccgccaccagcagagacaucaacagaaagcuggacagcgugaagagacagaaguacaacaaggagcagcagcugaagaagaucaccgccaagcagaagcaccugcaggccauccugggcggcgccgaggugaagaucgagcuggaccacgccagccuggaggaggacgccgagcccggccccagcagccugggcagcaugcugaugcccgugcaggagaccgccugggaggagcugaucagaaccggccagaugacccccuucggcacccagaucccccagaagcaggagaagaagcccagaaagaucaugcugaacgaggccagcggcuucgagaaguaccuggccgaccaggccaagcugagcuucgagagaaagaagcagggcugcaacaagagagccgccagaaaggcccccgcccccgugaccccccccgcccccgugcagaacaagaacaagcccaacaagaaggccagagugcugagcaagaaggaggagagacugaagaagcacaucaagaagcugcagaagagagcccugcaguuccagggcaaggugggccugcccaaggccagaagacccugggagagcgacaugagacccgaggccgagggcgacagcgagggcgaggagagcgaguacuuccccaccgaggaggaggaggaggaggaggacgacgagguggagggcgccgaggccgaccugagcggcgacggcaccgacuacgagcugaagccccugcccaagggcggcaagagacagaagaaggugcccgugcaggagaucgacgacgacuucuuccccagcagcggcgaggaggccgaggccgccagcgugggcgagggcggcggcggcggcagaaaggugggcagauacagagacgacggcgacgaggacuacuacaagcagagacugagaagauggaacaagcugagacugcaggacaaggagaagagacugaagcuggaggacgacagcgaggagagcgacgccgaguucgacgagggcuucaaggugcccggcuuccuguucaagaagcuguucaaguaccagcagaccggcgugagauggcugugggagcugcacugccagcaggccggcggcauccugggcgacgagaugggccugggcaagaccauccagaucaucgccuuccuggccggccugagcuacagcaagaucagaaccagaggcagcaacuacagauucgagggccugggccccaccgugaucgugugccccaccaccgugaugcaccagugggugaaggaguuccacaccugguggccccccuucagaguggccauccugcacgagaccggcagcuacacccacaagaaggagaagcugaucagagacguggcccacugccacggcauccugaucaccagcuacagcuacaucagacugaugcaggacgacaucagcagauacgacuggcacuacgugauccuggacgagggccacaagaucagaaaccccaacgccgccgugacccuggccugcaagcaguucagaaccccccacagaaucauccugagcggcagccccaugcagaacaaccugagagagcuguggagccuguucgacuucaucuuccccggcaagcugggcacccugcccguguucauggagcaguucagcgugcccaucaccaugggcggcuacagcaacgccagccccgugcaggugaagaccgccuacaagugcgccugcgugcugagagacaccaucaaccccuaccugcugagaagaaugaagagcgacgugaagaugagccugagccugcccgacaagaacgagcaggugcuguucugcagacugaccgacgagcagcacaagguguaccagaacuucguggacagcaaggagguguacagaauccugaacggcgagaugcagaucuucagcggccugaucgcccugagaaagaucugcaaccaccccgaccuguucagcggcggccccaagaaccugaagggccugcccgacgacgagcuggaggaggaccaguucggcuacuggaagagaagcggcaagaugaucgugguggagagccugcugaagaucuggcacaagcagggccagagagugcugcuguucagccagagcagacagaugcuggacauccuggagguguuccugagagcccagaaguacaccuaccugaagauggacggcaccaccaccaucgccagcagacagccccugaucaccagauacaacgaggacaccagcaucuucguguuccugcugaccaccagagugggcggccugggcgugaaccugaccggcgccaacagaguggugaucuacgaccccgacuggaaccccagcaccgacacccaggccagagagagagccuggagaaucggccagaagaagcaggugaccguguacagacugcugaccgccggcaccaucgaggagaagaucuaccacagacagaucuucaagcaguuccugaccaacagagugcugaaggaccccaagcagagaagauucuucaagagcaacgaccuguacgagcuguucacccugaccagccccgacgccagccagagcaccgagaccagcgccaucuucgccggcaccggcagcgacgugcagacccccaagugccaccugaagagaagaauccagcccgccuucggcgccgaccacgacgugcccaagagaaagaaguuccccgccagcaacaucagcgugaacgacgccaccagcagcgaggagaagagcgaggccaagggcgccgaggugaacgccgugaccagcaacagaagcgacccccugaaggacgacccccacaugagcagcaacgugaccagcaacgacagacugggcgaggagaccaacgccgugagcggccccgaggagcugagcgugaucagcggcaacggcgagugcagcaacagcagcggcaccggcaagaccagcaugcccagcggcgacgagagcaucgacgagaagcugggccugagcuacaagagagagagacccagccaggcccagaccgaggccuucugggagaacaagcagauggagaacaacuucuacaagcacaagagcaagaccaagcaccacagcguggccgaggaggagacccuggagaagcaccugagacccaagcagaagcccaagaacagcaagcacugcagagacgccaaguucgagggcaccagaaucccccaccuggugaagaagagaagauaccagaagcaggacagcgagaacaagagcgaggccaaggagcagagcaacgacgacuacgugcuggagaagcuguucaagaagagcgugggcgugcacagcgugaugaagcacgacgccaucauggacggcgccagccccgacuacgugcugguggaggccgaggccaacagaguggcccaggacgcccugaaggcccugagacugagcagacagagaugccugggcgccgugagcggcgugcccaccuggaccggccacagaggcaucagcggcgcccccgccggcaagaagagcagauucggcaagaagagaaacagcaacuucagcgugcagcaccccagcagcaccagccccaccgagaagugccaggacggcaucaugaagaaggagggcaaggacaacgugcccgagcacuucagcggcagagccgaggacgccgacagcagcagcggcccccuggccagcagcagccugcuggccaagaugagagccagaaaccaccugauccugcccgagagacuggagagcgagagcggccaccugcaggaggccagcgcccugcugcccaccaccgagcacgacgaccugcugguggagaugagaaacuucaucgccuuccaggcccacaccgacggccaggccagcaccagagagauccugcaggaguucgagagcaagcugagcgccagccagagcugcguguucagagagcugcugagaaaccugugcaccuuccacagaaccagcggcggcgagggcaucuggaagcugaagcccgaguacugcuaa

SEQ ID NO: 16696 - RNA, 2139 nt, Artificial Sequence
  ERCC6L2__Homo_sapiens__NP_001010895
augcagcccggcagcgcccccccccccggcagaauggaccccagcgccccccagcccagagccgagaccagcggcaaggacaucuggcaccccggcgagagaugccuggcccccagccccgacaacggcaagcugugcgaggccagcaucaagagcaucaccguggacgagaacggcaagagcuucgccguggugcuguacgccgacuuccaggagagaaagaucccccugaagcagcugcaggaggugaaguucgugaaggacugccccagaaaccugaucuucgacgacgaggaccuggagaagcccuacuuccccaacagaaaguuccccagcagcagcguggccuucaagcugagcgacaacggcgacagcauccccuacaccaucaacagauaccugagagacuaccagagagagggcaccagauuccuguacggccacuacauccacggcggcggcugcauccugggcgacgacaugggccugggcaagaccgugcaggugaucagcuuccuggccgccgugcugcacaagaagggcaccagagaggacaucgagaacaacaugcccgaguuccugcugagaagcaugaagaaggagccccugagcagcaccgccaagaagauguuccugaucguggccccccugagcgugcuguacaacuggaaggacgagcuggacaccuggggcuacuucagagugaccgugcugcacggcaacagaaaggacaacgagcugaucagagugaagcagagaaagugcgagaucgcccugaccaccuacgagacccugagacugugccuggacgagcugaacagccuggaguggagcgccgugaucguggacgaggcccacagaaucaagaaccccaaggccagagugaccgaggugaugaaggcccugaagugcaacgugagaaucggccugaccggcaccauccugcagaacaacaugaaggagcuguggugcgugauggacugggccgugcccggccugcugggcagcggcaccuacuucaagaagcaguucagcgaccccguggagcacggccagagacacaccgccaccaagagagagcuggccaccggcagaaaggccaugcagagacuggccaagaagaugagcggcugguuccugagaagaaccaagacccugaucaaggaccagcugcccaagaaggaggacagaaugguguacugcagccugaccgacuuccagaaggccguguaccagaccgugcuggagaccgaggacgugacccugauccugcagagcagcgagcccugcaccugcagaagcggccagaagagaagaaacugcugcuacaagaccaacagccacggcgagaccgugaagacccuguaccugagcuaccugaccgugcugcagaagguggccaaccacguggcccugcugcaggccgccagcaccagcaagcagcaggagacccugaucaagagaaucugcgaccagguguucagcagauuccccgacuucgugcagaagagcaaggacgccgccuucgagacccugagcgaccccaaguacagcggcaagaugaaggugcugcagcagcugcugaaccacugcagaaagaacagagacaaggugcugcuguucagcuucagcaccaagcugcuggacgugcugcagcaguacugcauggccagcggccuggacuacagaagacuggacggcagcaccaagagcgaggagagacugaagaucgugaaggaguucaacagcacccaggacgugaacaucugccuggugagcaccauggccggcggccugggccugaacuucgugggcgccaacgugguggugcuguucgaccccaccuggaaccccgccaacgaccugcaggccaucgacagagccuacagaaucggccagugcagagacgugaaggugcugagacugaucagccugggcaccguggaggagaucauguaccugagacagaucuacaagcagcagcugcacugcgugguggugggcagcgagaacgccaagagauacuucgaggccgugcagggcagcaaggagcaccagggcgagcuguucggcauccacaaccuguucaaguucagaagccagggcagcugccugaccaaggacauccuggagguguaa

SEQ ID NO: 16697 - RNA, 3186 nt, Artificial Sequence
  ERCC6-PGBD3__Homo_sapiens__NP_001263988
augcccaacgagggcaucccccacagcagccagacccaggagcaggacugccugcagagccagcccgugagcaacaacgaggagauggccaucaagcaggagagcggcggcgacggcgagguggaggaguaccugagcuucagaagcgugggcgacggccugagcaccagcgccgugggcugcgccagcgccgcccccagaagaggccccgcccugcugcacaucgacagacaccagauccaggccguggagcccagcgcccaggcccuggagcugcagggccugggcguggacguguacgaccaggacgugcuggagcagggcgugcugcagcagguggacaacgccauccacgaggccagcagagccagccagcugguggacguggagaaggaguacagaagcgugcuggacgaccugaccagcugcaccaccagccugagacagaucaacaagaucaucgagcagcugagcccccaggccgccaccagcagagacaucaacagaaagcuggacagcgugaagagacagaaguacaacaaggagcagcagcugaagaagaucaccgccaagcagaagcaccugcaggccauccugggcggcgccgaggugaagaucgagcuggaccacgccagccuggaggaggacgccgagcccggccccagcagccugggcagcaugcugaugcccgugcaggagaccgccugggaggagcugaucagaaccggccagaugacccccuucggcacccagaucccccagaagcaggagaagaagcccagaaagaucaugcugaacgaggccagcggcuucgagaaguaccuggccgaccaggccaagcugagcuucgagagaaagaagcagggcugcaacaagagagccgccagaaaggcccccgcccccgugaccccccccgcccccgugcagaacaagaacaagcccaacaagaaggccagagugcugagcaagaaggaggagagacugaagaagcacaucaagaagcugcagaagagagcccugcaguuccagggcaaggugggccugcccaaggccagaagacccugggagagcgacaugagacccgaggccgagggcgacagcgagggcgaggagagcgaguacuuccccaccgaggaggaggaggaggaggaggacgacgagguggagggcgccgaggccgaccugagcggcgacggcaccgacuacgagcugaagccccugcccaagggcggcaagagacagaagaaggugcccgugcaggagaucgacgacgacuucuuccccagcagcggcgaggaggccgaggccgccagcgugggcgagggcggcggcggcggcagaaaggugggcagauacagagacgacggcgacgaggacuacuacaagcagagacugagccccaagaugcccagaacccugagccugcacgagaucaccgaccugcuggagaccgacgacagcaucgaggccagcgccaucgugauccagccccccgagaacgccaccgcccccgugagcgacgaggagagcggcgacgaggagggcggcaccaucaacaaccugcccggcagccugcugcacaccgccgccuaccugauccaggacggcagcgacgccgagagcgacagcgacgaccccagcuacgcccccaaggacgacagccccgacgaggugcccagcaccuucaccgugcagcagcccccccccagcagaagaagaaagaugaccaagauccugugcaaguggaagaaggccgaccugaccgugcagcccguggccggcagagugaccgccccccccaacgacuucuucaccgugaugagaacccccaccgagauccuggagcuguuccuggacgacgaggugaucgagcugaucgugaaguacagcaaccuguacgccugcagcaagggcgugcaccugggccugaccagcagcgaguucaagugcuuccugggcaucaucuuccugagcggcuacgugagcgugcccagaagaagaauguucugggagcagagaaccgacgugcacaacgugcuggugagcgccgccaugagaagagacagauucgagaccaucuucagcaaccugcacguggccgacaacgccaaccuggaccccguggacaaguucagcaagcugagaccccugaucagcaagcugaacgagagaugcaugaaguucgugcccaacgagaccuacuucagcuucgacgaguucauggugcccuacuucggcagacacggcugcaagcaguucaucagaggcaagcccaucagauucggcuacaaguucuggugcggcgccaccugccugggcuacaucugcugguuccagcccuaccagggcaagaaccccaacaccaagcacgaggaguacggcgugggcgccagccuggugcugcaguucagcgaggcccugaccgaggcccaccccggccaguaccacuucguguucaacaacuucuucaccagcaucgcccugcuggacaagcugagcagcaugggccaccaggccaccggcaccgugagaaaggaccacaucgacagagugccccuggagagcgacguggcccugaagaagaaggagagaggcaccuucgacuacagaaucgacggcaagggcaacaucgugugcagauggaacgacaacagcguggugaccguggccagcagcggcgccggcauccacccccugugccuggugagcagauacagccagaagcugaagaagaagauccaggugcagcagcccaacaugaucaagguguacaaccaguucaugggcggcguggacagagccgacgagaacaucgacaaguacagagccagcaucagaggcaagaagugguacagcagcccccugcuguucugcuucgagcuggugcugcagaacgccuggcagcugcacaagaccuacgacgagaagcccguggacuuccuggaguucagaagaagaguggugugccacuaccuggagacccacggccacccccccgagcccggccagaagggcagaccccagaagagaaacaucgacagcagauacgacggcaucaaccacgugaucgugaagcagggcaagcagaccagaugcgccgagugccacaagaacaccaccuucagaugcgagaagugcgacguggcccugcacgugaagugcagcguggaguaccacaccgaguaa

SEQ ID NO: 16698 - RNA, 1191 nt, Artificial Sequence
  ERCC8__Homo_sapiens__NP_000073
augcugggcuuccugagcgccagacagaccggccuggaggacccccugagacugagaagagccgagagcaccagaagagugcugggccuggagcugaacaaggacagagacguggagagaauccacggcggcggcaucaacacccuggacaucgagcccguggagggcagauacaugcugagcggcggcagcgacggcgugaucgugcuguacgaccuggagaacagcagcagacagagcuacuacaccugcaaggccgugugcagcaucggcagagaccaccccgacgugcacagauacagcguggagaccgugcagugguacccccacgacaccggcauguucaccagcagcagcuucgacaagacccugaaggugugggacaccaacacccugcagaccgccgacguguucaacuucgaggagaccguguacagccaccacaugagccccgugagcaccaagcacugccugguggccgugggcaccagaggccccaaggugcagcugugcgaccugaagagcggcagcugcagccacauccugcagggccacagacaggagauccuggccgugagcuggagccccagauacgacuacauccuggccaccgccagcgccgacagcagagugaagcugugggacgugagaagagccagcggcugccugaucacccuggaccagcacaacggcaagaagagccaggccguggagagcgccaacaccgcccacaacggcaaggugaacggccugugcuucaccagcgacggccugcaccugcugaccgugggcaccgacaacagaaugagacuguggaacagcagcaacggcgagaacacccuggugaacuacggcaaggugugcaacaacagcaagaagggccugaaguucaccgugagcugcggcugcagcagcgaguucguguucgugcccuacggcagcaccaucgccguguacaccguguacagcggcgagcagaucaccaugcugaagggccacuacaagaccguggacugcugcguguuccagagcaacuuccaggagcuguacagcggcagcagagacugcaacauccuggccugggugcccagccuguacgagcccgugcccgacgacgacgagaccaccaccaagagccagcugaaccccgccuucgaggacgccuggagcagcagcgacgaggagggcuaa

SEQ ID NO: 16699 - RNA, 510 nt, Artificial Sequence
  EREG__Homo_sapiens__NP_001423
augaccgccggcagaagaauggagaugcugugcgccggcagagugcccgcccugcugcugugccugggcuuccaccugcugcaggccgugcugagcaccaccgugauccccagcugcauccccggcgagagcagcgacaacugcaccgcccuggugcagaccgaggacaaccccagaguggcccaggugagcaucaccaagugcagcagcgacaugaacggcuacugccugcacggccagugcaucuaccugguggacaugagccagaacuacugcagaugcgaggugggcuacaccggcgugagaugcgagcacuucuuccugaccgugcaccagccccugagcaaggaguacguggcccugaccgugauccugaucauccuguuccugaucaccguggugggcagcaccuacuacuucugcagaugguacagaaacagaaagagcaaggagcccaagaaggaguacgagagagugaccagcggcgaccccgagcugccccagguguaa

SEQ ID NO: 16700 - RNA, 1422 nt, Artificial Sequence
  ERF__Homo_sapiens__NP_001287964
augaacuacgacaagcugagcagagcccugagauacuacuacaacaagagaauccugcacaagaccaagggcaagagauucaccuacaaguucaacuucaacaagcuggugcuggugaacuaccccuucaucgacgugggccuggccggcggcgccgugccccagagcgccccccccgugcccagcggcggcagccacuucagauucccccccagcacccccagcgaggugcugagccccaccgaggaccccagaagcccccccgccugcagcagcagcagcagcagccuguucagcgccgugguggccagaagacugggcagaggcagcgugagcgacugcagcgacggcaccagcgagcuggaggagccccugggcgaggaccccagagccagaccccccggcccccccgaccugggcgccuucagaggccccccccuggccagacugccccacgaccccggcguguucagaguguaccccagacccagaggcggccccgagccccugagccccuuccccgugagcccccuggccggccccggcagccugcugcccccccagcugagccccgcccugcccaugacccccacccaccuggccuacacccccagccccacccugagccccauguaccccagcggcggcggcggccccagcggcagcggcggcggcagccacuucagcuucagccccgaggacaugaagagauaccugcaggcccacacccagagcguguacaacuaccaccugagccccagagccuuccugcacuaccccggccugguggugccccagccccagagacccgacaagugcccccugccccccauggcccccgagaccccccccgugcccagcagcgccagcagcagcagcagcagcagcagcagccccuucaaguucaagcugcagccccccccccugggcagaagacagagagccgccggcgagaaggccguggccggcgccgacaagagcggcggcagcgccggcggccuggccgagggcgccggcgcccuggcccccccccccccccccccccagaucaagguggagcccaucagcgagggcgagagcgaggagguggaggugaccgacaucagcgacgaggacgaggaggacggcgagguguucaagacccccagagccccccccgccccccccaagcccgagcccggcgaggcccccggcgccagccagugcaugccccugaagcugagauucaagagaagauggagcgaggacugcagacuggagggcggcggcggccccgccggcggcuucgaggacgagggcgaggacaagaaggugagaggcgagggccccggcgaggccggcggcccccugacccccagaagagugagcagcgaccugcagcacgccaccgcccagcugagccuggagcacagagacagcuaa

SEQ ID NO: 16701 - RNA, 1461 nt, Artificial Sequence
  ERG__Homo_sapiens__NP_001129626
augauccagaccgugcccgaccccgccgcccacaucaaggaggcccugagcguggugagcgaggaccagagccuguucgagugcgccuacggcaccccccaccuggccaagaccgagaugaccgccagcagcagcagcgacuacggccagaccagcaagaugagccccagagugccccagcaggacuggcugagccagccccccgccagagugaccaucaagauggagugcaaccccagccaggugaacggcagcagaaacagccccgacgagugcagcguggccaagggcggcaagauggugggcagccccgacaccgugggcaugaacuacggcagcuacauggaggagaagcacaugcccccccccaacaugaccaccaacgagagaagagugaucgugcccgccgaccccacccuguggagcaccgaccacgugagacaguggcuggagugggccgugaaggaguacggccugcccgacgugaacauccugcuguuccagaacaucgacggcaaggagcugugcaagaugaccaaggacgacuuccagagacugacccccagcuacaacgccgacauccugcugagccaccugcacuaccugagagagaccccccugccccaccugaccagcgacgacguggacaaggcccugcagaacagccccagacugaugcacgccagaaacaccggcggcgccgccuucaucuuccccaacaccagcguguaccccgaggccacccagagaaucaccaccagacccgaccugcccuacgagccccccagaagaagcgccuggaccggccacggccaccccaccccccagagcaaggccgcccagcccagccccagcaccgugcccaagaccgaggaccagagaccccagcuggaccccuaccagauccugggccccaccagcagcagacuggccaaccccggcagcggccagauccagcuguggcaguuccugcuggagcugcugagcgacagcagcaacagcagcugcaucaccugggagggcaccaacggcgaguucaagaugaccgaccccgacgagguggccagaagauggggcgagagaaagagcaagcccaacaugaacuacgacaagcugagcagagcccugagauacuacuacgacaagaacaucaugaccaaggugcacggcaagagauacgccuacaaguucgacuuccacggcaucgcccaggcccugcagccccacccccccgagagcagccuguacaaguaccccagcgaccugcccuacaugggcagcuaccacgcccacccccagaagaugaacuucguggccccccacccccccgcccugcccgugaccagcagcagcuucuucgccgcccccaaccccuacuggaacagccccaccggcggcaucuaccccaacaccagacugcccaccagccacaugcccagccaccugggcaccuacuacuaa

SEQ ID NO: 16702 - RNA, 873 nt, Artificial Sequence
  ERGIC1__Homo_sapiens__NP_001026881
augcccuucgacuucagaagauucgacaucuacagaaaggugcccaaggaccugacccagcccaccuacaccggcgccaucaucagcaucugcugcugccuguucauccuguuccuguuccugagcgagcugaccggcuucaucaccaccgagguggugaacgagcuguacguggacgaccccgacaaggacagcggcggcaagaucgacgugagccugaacaucagccugcccaaccugcacugcgagcuggugggccuggacauccaggacgagaugggcagacacgaggugggccacaucgacaacagcaugaagaucccccugaacaacggcgccggcugcagauucgagggccaguucagcaucaacaaggugcccggcaacuuccacgugagcacccacagcgccaccgcccagccccagaaccccgacaugacccacgugauccacaagcugagcuucggcgacacccugcaggugcagaacauccacggcgccuucaacgcccugggcggcgccgacagacugaccagcaacccccuggccagccacgacuacauccugaagaucgugcccaccguguacgaggacaagagcggcaagcagagauacagcuaccaguacaccguggccaacaaggaguacguggccuacagccacaccggcagaaucauccccgccaucugguucagauacgaccugagccccaucaccgugaaguacaccgagagaagacagccccuguacagauucaucaccaccaucugcgccaucaucggcggcaccuucaccguggccggcauccuggacagcugcaucuucaccgccagcgaggccuggaagaagauccagcugggcaagaugcacuaa

SEQ ID NO: 16703 - RNA, 1134 nt, Artificial Sequence
  ERGIC2__Homo_sapiens__NP_057654
augagaagacugaacagaaagaagacccugagccuggugaaggagcuggacgccuuccccaaggugcccgagagcuacguggagaccagcgccagcggcggcaccgugagccugaucgccuucaccaccauggcccugcugaccaucauggaguucagcguguaccaggacaccuggaugaaguacgaguacgagguggacaaggacuucagcagcaagcugagaaucaacaucgacaucaccguggccaugaagugccaguacgugggcgccgacgugcuggaccuggccgagaccaugguggccagcgccgacggccugguguacgagcccaccguguucgaccugagcccccagcagaaggaguggcagagaaugcugcagcugauccagagcagacugcaggaggagcacagccugcaggacgugaucuucaagagcgccuucaagagcaccagcaccgcccugccccccagagaggacgacagcagccagagccccaacgccugcagaauccacggccaccuguacgugaacaagguggccggcaacuuccacaucaccgugggcaaggccaucccccaccccagaggccacgcccaccuggccgcccuggugaaccacgagagcuacaacuucagccacagaaucgaccaccugagcuucggcgagcuggugcccgccaucaucaacccccuggacggcaccgagaagaucgccaucgaccacaaccagauguuccaguacuucaucaccguggugcccaccaagcugcacaccuacaagaucagcgccgacacccaccaguucagcgugaccgagagagagagaaucaucaaccacgccgccggcagccacggcgugagcggcaucuucaugaaguacgaccugagcagccugauggugaccgugaccgaggagcacaugcccuucuggcaguucuucgugagacugugcggcaucgugggcggcaucuucagcaccaccggcaugcugcacggcaucggcaaguucaucguggagaucaucugcugcagauucagacugggcagcuacaagcccgugaacagcgugcccuucgaggacggccacaccgacaaccaccugccccugcuggagaacaacacccacuaa

SEQ ID NO: 16704 - RNA, 1152 nt, Artificial Sequence
  ERGIC3__Homo_sapiens__NP_057050
auggaggcccugggcaagcugaagcaguucgacgccuaccccaagacccuggaggacuucagagugaagaccugcggcggcgccaccgugaccaucgugagcggccugcugaugcugcugcuguuccugagcgagcugcaguacuaccugaccaccgaggugcaccccgagcuguacguggacaagagcagaggcgacaagcugaagaucaacaucgacgugcuguucccccacaugcccugcgccuaccugagcaucgacgccauggacguggccggcgagcagcagcuggacguggagcacaaccuguucaagcagagacuggacaaggacggcauccccgugagcagcgaggccgagagacacgagcugggcaagguggaggugaccguguucgaccccgacagccuggaccccgacagaugcgagagcugcuacggcgccgaggccgaggacaucaagugcugcaacaccugcgaggacgugagagaggccuacagaagaagaggcugggccuucaagaaccccgacaccaucgagcagugcagaagagagggcuucagccagaagaugcaggagcagaagaacgagggcugccagguguacggcuuccuggaggugaacaagguggccggcaacuuccacuucgcccccggcaagagcuuccagcagagccacgugcacgugcacgaccugcagagcuucggccuggacaacaucaacaugacccacuacauccagcaccugagcuucggcgaggacuaccccggcaucgugaacccccuggaccacaccaacgugaccgccccccaggccagcaugauguuccaguacuucgugaagguggugcccaccguguacaugaagguggacggcgaggugcugagaaccaaccaguucagcgugaccagacacgagaagguggccaacggccugcugggcgaccagggccugcccggcguguucgugcuguacgagcugagccccaugauggugaagcugaccgagaagcacagaagcuucacccacuuccugaccggcgugugcgccaucaucggcggcauguucaccguggccggccugaucgacagccugaucuaccacagcgccagagccauccagaagaagaucgaccugggcaagaccaccuaa

SEQ ID NO: 16705 - RNA, 780 nt, Artificial Sequence
  ERI3__Homo_sapiens__NP_001288628
augcuggccccccugcagaccggcgccgccagauucagcagcuaccugcugagcagagccagaaaggugcugggcagccaccuguucagccccugcggcgugcccgaguucugcagcaucagcaccagaaagcuggccgcccacggcuucggcgccagcauggccgccauggugagcuuccccccccagagauaccacuacuuccuggugcuggacuucgaggccaccugcgacaagccccagauccacccccaggagaucaucgaguuccccauccugaagcugaacggcagaaccauggagaucgagagcaccuuccacauguacgugcagcccguggugcacccccagcugacccccuucugcaccgagcugaccggcaucauccaggccaugguggacggccagcccagccugcagcaggugcuggagagaguggacgaguggauggccaaggagggccugcuggaccccaacgugaagagcaucuucgugaccugcggcgacugggaccugaaggugaugcugcccggccagugccaguaccugggccugcccguggccgacuacuucaagcaguggaucaaccugaagaaggccuacagcuucgccaugggcugcuggcccaagaacggccugcuggacaugaacaagggccugagccugcagcacaucggcagaccccacagcggcaucgacgacugcaagaacaucgccaacaucaugaagacccuggccuacagaggcuucaucuucaagcagaccagcaagcccuucuaa

SEQ ID NO: 16706 - RNA, 171 nt, Artificial Sequence
  ERICH5__Homo_sapiens__NP_001164277
augggcugcagcagcagcgcccugaacaaggccggcgacagcagcagauuccccagcggcgagaccggcgagaagguggagaccgacauggagaacgagaaggugagcgagggcgccgagaccaaggaggaggagaccggcgaggugguggaccugagcgccgccaccuaa

SEQ ID NO: 16707 - RNA, 2091 nt, Artificial Sequence
  ERICH6B__Homo_sapiens__NP_872348
augagcgccgagaacaaccagcugagcggcgccagccccccccacccccccaccaccccccaguacagcacccagaaccugcccagcgagaaggaggacaccgagguggagcuggacgaggagagccugcaggacgagagccccuucagccccgagggcgagagccuggaggacaaggaguaccuggaggaggaggaggaccuggaggaggaggaguaccugggcaaggaggaguaccugaaggaggaggaguaccugggcaaggaggagcaccuggaggaggaggaguaccuggagaaggccggcuaccuggaggaggaggaguacaucgaggaggaggaguaccugggcaaggagggcuaccuggaggaggaggaguaccugggcaaggaggagcaccuggaggaggaggaguaccugggcaaggagggcuaccuggagaaggaggacuacaucgaggagguggacuaccugggcaagaaggccuaccuggaggaggaggaguaccugggcaagaagagcuaccuggaggaggagaaggcccuggagaaggaggagaaccuggaggaggaggaggcccuggagaaggaggagaaccuggacggcaaggagaaccuguacaagaaguaccugaaggagcccaaggccagcuacagcagccagaccaugcugcugagagacgccagaagccccgacgccggccccagccaggugaccaccuuccugaccgugccccugaccuucgccacccccagccccgugagcgagagcgccaccgagagcagcgagcugcugcugacccuguacagaagaagccaggccagccagaccgacuggugcuacgacagaaccgccgugaagagccugaagagcaagagcgagaccgagcaggagaccaccaccaagcuggcccccgaggagcacgugaacaccaaggugcagcagaagaaggaggagaacgugcuggaguucgccagcaaggagaacuucugggacggcaucaccgacgagagcaucgacaagcuggagguggaggaccuggacgagaacuuccugaacagcagcuaccagaccguguucaagaccaucaucaaggagauggccgcccacaacgagcuggaggaggacuucgacaucccccugaccaagcugcuggagagcgagaacagauggaagcuggugaucaugcugaagaagaacuacgagaaguucaaggagaccauccugagaaucaagagaagaagagaggcccagaagcugaccgagaugaccagcuucaccuuccaccugaugagcaagcccacccccgagaagcccgagaccgaggagauccagaagccccagagaguggugcaccacagaaagaagcuggagagagacaaggaguggauccagaagaagaccguggugcaccagggcgacggcaagcugauccuguaccccaacaagaacguguaccagauccuguuccccgacggcaccggccagauccacuaccccagcggcaaccuggccaugcugauccuguacgccaagaugaagaaguucaccuacaucauccuggaggacagccuggagggcagaaucagagcccugaucaacaacagcggcaacgccaccuucuacgacgagaacagcgacaucuggcugaaccugagcagcaaccugggcuacuacuuccccaaggacaagagacagaaggccuggaacugguggaaccugaacauccacgugcacgccccccccgugcagcccaucagccugaagaucaacgaguacauccaggugcagaucagaagccaggacaagaucaucuucugcuucaccuacgagcagaagcagaucugccugaaccugggcaccagauacaaguucgugauccccgaggugcugagcgagaugaagaagaagaccauccuggaggccgagcccggccccaccgcccagaagaucagagugcugcugggcaagaugaacagacugcugaacuacgccaccacccccgaccuggagaacuucaucgaggccgugagcaucagccugauggacaacaaguaccugaagaagaugcugagcaagcugugguucuaa

SEQ ID NO: 16708 - RNA, 1374 nt, Artificial Sequence
  ERLEC1__Homo_sapiens__NP_001120869
auggaggagggcggcggcggcgugagaagccuggugcccggcggccccgugcugcuggugcugugcggccugcuggaggccagcggcggcggcagagcccugccccagcugagcgacgacauccccuucagagugaacuggcccggcaccgaguucagccugcccaccaccggcgugcuguacaaggaggacaacuacgugaucaugaccaccgcccacaaggagaaguacaagugcauccugccccuggugaccagcggcgacgaggaggaggagaaggacuacaagggccccaaccccagagagcugcuggagccccuguucaagcagagcagcugcagcuacagaaucgagagcuacuggaccuacgaggugugccacggcaagcacaucagacaguaccacgaggagaaggagaccggccagaagaucaacauccacgaguacuaccugggcaacaugcuggccaagaaccugcuguucgagaaggagagagaggccgaggagaaggagaagagcaacgagauccccaccaagaacaucgagggccagaugacccccuacuaccccgugggcaugggcaacggcacccccugcagccugaagcagaacagacccagaagcagcaccgugauguacaucugccaccccgagagcaagcacgagauccugagcguggccgaggugaccaccugcgaguacgagguggugauccugaccccccugcugugcagccaccccaaguacagauucagagccagccccgugaacgacaucuucugccagagccugcccggcagccccuucaagccccugacccugagacagcuggagcagcaggaggagauccugagagugcccuucagaagaaacaaggaggaggaccugcagagcaccaaggaggagagauuccccgccauccacaagagcaucgccaucggcagccagcccgugcugaccgugggcaccacccacaucagcaagcugaccgacgaccagcugaucaaggaguuccugagcggcagcuacugcuucagaggcggcgugggcugguggaaguacgaguucugcuacggcaagcacgugcaccaguaccacgaggacaaggacagcggcaagaccagcgugguggugggcaccuggaaccaggaggagcacaucgagugggccaagaagaacaccgccagagccuaccaccugcaggacgacggcacccagaccgugagaugcaaggagagcgacagcccccacgccgugaccguguacaugcuggagccccacagcugccaguacauccugggcguggagagccccgugaucugcaagauccuggacaccgccgacgagaacggccugcugagccugcccaacuaa

SEQ ID NO: 16709 - RNA, 1047 nt, Artificial Sequence
  ERLIN1__Homo_sapiens__XP_005269499
augaacaugacccaggccagagugcugguggccgccguggugggccugguggccgugcugcuguacgccagcauccacaagaucgaggagggccaccuggccguguacuacagaggcggcgcccugcugaccagccccagcggccccggcuaccacaucaugcugcccuucaucaccaccuucagaagcgugcagaccacccugcagaccgacgaggugaagaacgugcccugcggcaccagcggcggcgugaugaucuacaucgacagaaucgagguggugaacaugcuggcccccuacgccguguucgacaucgugagaaacuacaccgccgacuacgacaagacccugaucuucaacaagauccaccacgagcugaaccaguucugcagcgcccacacccugcaggagguguacaucgagcuguucgaccagaucgacgagaaccugaagcaggcccugcagaaggaccugaaccugauggcccccggccugaccauccaggccgugagagugaccaagcccaagauccccgaggccaucagaagaaacuucgagcugauggaggccgagaagaccaagcugcugaucgccgcccagaagcagaaggugguggagaaggaggccgagaccgagagaaagaaggccgugaucgaggccgagaagaucgcccagguggccaagaucagauuccagcagaaggugauggagaaggagaccgagaagagaaucagcgagaucgaggacgccgccuuccuggccagagagaaggccaaggccgacgccgaguacuacgccgcccacaaguacgccaccagcaacaagcacaagcugacccccgaguaccuggagcugaagaaguaccaggccaucgccagcaacagcaagaucuacuucggcagcaacauccccaacauguucguggacagcagcugcgcccugaaguacagcgacaucagaaccggcagagagagcagccugcccagcaaggaggcccuggagcccagcggcgagaacgugauccagaacaaggagagcaccggcuaa

SEQ ID NO: 16710 - RNA, 459 nt, Artificial Sequence
  ERLIN2__Homo_sapiens__NP_001003791
auggcccagcugggcgccgugguggccguggccagcagcuucuucugcgccagccuguucagcgccgugcacaagaucgaggagggccacaucggcguguacuacagaggcggcgcccugcugaccagcaccagcggccccggcuuccaccugaugcugcccuucaucaccagcuacaagagcgugcagaccacccugcagaccgacgaggugaagaacgugcccugcggcaccagcggcggcgugaugaucuacuucgacagaaucgagguggugaacuuccuggugcccaacgccguguacgacaucgugaagaacuacaccgccgacuacgacaaggcccugaucuucaacaagauccaccacgagcugaaccaguucugcagcgugcacacccugcaggagguguacaucgagcuguucggccuggagaacgacuucagccaggagagcagcuaa

SEQ ID NO: 16711 - RNA, 1428 nt, Artificial Sequence
  ERMAP__Homo_sapiens__XP_011538872
auggagauggccagcagcgccggcagcuggcugagcggcugccugaucccccugguguuccugagacugagcgugcacgugagcggccacgccggcgacgccggcaaguuccacguggcccugcugggcggcaccgccgagcugcugugcccccugagccuguggcccggcaccgugcccaaggaggugagauggcugagaagccccuucccccagagaagccaggccgugcacaucuucagagacggcaaggaccaggacgaggaccugaugcccgaguacaagggcagaaccgugcuggugagagacgcccaggagggcagcgugacccugcagauccuggacgugagacuggaggaccagggcagcuacagaugccugauccaggugggcaaccugagcaaggaggacaccgugauccugcagguggccgcccccagcgugggcagccugagccccagcgccguggcccuggccgugauccugcccgugcuggugcugcugaucauggugugccugugccugaucuggaagcagagaagagccaaggagaagcugcuguacgagcacgugaccgagguggacaaccugcugagcgaccacgccaaggagaagggcaagcugcacaaggccgugaagaagcugagaagcgagcugaagcugaagagagccgccgccaacagcggcuggagaagagccagacugcacuucguggccgugacccuggaccccgacaccgcccaccccaagcugauccugagcgaggaccagagaugcgugagacugggcgacagaagacagcccgugcccgacaacccccagagauucgacuucguggugagcauccugggcagcgaguacuucaccaccggcugccacuacugggagguguacgugggcgacaagaccaaguggauccugggcgugugcagcgagagcgugagcagaaagggcaaggugaccgccagccccgccaacggccacuggcugcugagacagagcagaggcaacgaguacgaggcccugaccagcccccagaccagcuucagacugaaggagccccccagaugcgugggcaucuuccuggacuacgaggccggcgugaucagcuucuacaacgugaccaacaagagccacaucuucaccuucacccacaacuucagcggcccccugagacccuucuucgagcccugccugcacgacggcggcaagaacaccgccccccuggugaucugcagcgagcugcacaagagcgaggagagcaucgugcccagacccgagggcaagggccacgccaacggcgacgugagccugaaggugaacagcagccugcugccccccaaggcccccgagcugaaggacaucauccugagccugccccccgaccugggccccgcccugcaggagcugaaggcccccagcuucuaa

SEQ ID NO: 16712 - RNA, 1896 nt, Artificial Sequence
  ERMARD__Homo_sapiens__NP_001265460
auggaggugcugaucggcgaccccaucaccaccugccugagccccagcguguacgacaucaucugcaaccugggcuuccagcugagagagaacugcgacaucaacagcaucgugacccagaacggcgaggugugcuggaagaccaucaccgacugcgugagcuacaccgagagcgagcagggccuggacuacuggggcagcgugagacugcugggccccgugugcgaggccgugcacagccacuuccugagccugaccaagggccaguucgagaucagauacgcccccugguuccaguggaccagcuuccccgagcuguuccccgagaucuucgacgcccuggagagccugcagagccccgccaucagccugagccugaugaagcugaccagcugccuggagagagcccugggcgacguguuccugcugaucggcaaggagugccccuuccugcugagagaccugcugagcagcgaggagcuggcccagguguucagccagagcgugaugaacgugcugaagguguucgugggcagccccugcggccugaaccugagaaacgugcuguggcacggcuucgccagccccgaggagaucccccccaaguacugcagcaugaugauccugcugaccgccggccugggccagcugcugaagagcuaccugcagaacaccaagcugacccuggcccacagaagcuucaucagccugaccaaccuggaggaccugaucguguuccccgacgugaccuacgaggugcugagcgugcuggaggaggugaugaugaagagcgccuucauccugaagaucaugcugcccuacugggagguggcccuggugaaguucaagagccacagauucgccgacugcgccauccugcugcugacccagcuggagaccggccugagaaacguguucgccacccugaacagaugccccaagagacugcugaccgccgagagcaccgcccuguacaccaccuucgaccagauccuggccaagcaccugaacgacggcaagaucaaccagcugccccuguuccugggcgagcccgccauggaguuccugugggacuuccugaaccaccaggagggccccagaaucagagaccaccugagccacggcgagaucaaccugcacgaguucagcaaggagaccaccaaccagcugcuggccuucagccuggugcugcugcugagauucguggacgacugccugcugagcguguucaaggagaagagcgccguggagcugcugaucagccuggccgagggcuacagcagcagaugccaccccguguuccagcugaagaagcaggugcugagcugcgaggagagcaucagagugugggcccugcugcccuuccccgaggagcugaccagacaggccgugagacuggaggacaacagcgagaccaacgccugccacagccugaucaccaagaugaccgacgagcuguaccaccacaugcccgagaacagaugcgugcugaaggaccuggacagacugcccaccgagacccccaccagcgacaccccccuggcccuggcccccagaaagccccagcccugcagaugcagaagaagagugagacccagcaucagacugcugagccccgugcugagccugauccugcugcugaucgcccuggagcuggugaacauccacgccgugugcggcaagaacgcccacgaguaccagcaguaccugaaguucgugaagagcauccugcaguacaccgagaaccugguggccuacaccagcuacgagaagaacaaguggaacgagaccaucaaccugacccacaccgcccugcugaagauguggaccuucagcgagaagaagcagaugcugauccaccuggccaagaagagcaccagcaaggugcugcuguaa

SEQ ID NO: 16713 - RNA, 2715 nt, Artificial Sequence
  ERMP1__Homo_sapiens__NP_079172
auggaguggggcagcgagagcgccgccgugagaagacacagagugggcguggagagaagagagggcgccgccgccgcccccccccccgagagagaggccagagcccaggagccccugguggacggcugcagcggcggcggcagaaccagaaagagaagccccggcggcagcggcggcgccagcagaggcgccggcaccggccugagcgaggugagagccgcccugggccuggcccuguaccugaucgcccugagaacccuggugcagcugagccugcagcagcuggugcugagaggcgccgccggccacagaggcgaguucgacgcccugcaggccagagacuaccuggagcacaucaccagcaucggccccagaaccaccggcagccccgagaacgagauccugaccgugcacuaccugcuggagcagaucaagcugaucgaggugcagagcaacagccugcacaagaucagcguggacgugcagagacccaccggcagcuucagcaucgacuuccugggcggcuucaccagcuacuacgacaacaucaccaacgugguggugaagcuggagcccagagacggcgcccagcacgccgugcuggccaacugccacuucgacagcguggccaacagccccggcgccagcgacgacgccgugagcugcagcgugaugcuggaggugcugagagugcugagcaccagcagcgaggcccugcaccacgccgugaucuuccuguucaacggcgccgaggagaacgugcugcaggccagccacggcuucaucacccagcaccccugggccagccugaucagagccuucaucaaccuggaggccgccggcgugggcggcaaggagcugguguuccagaccggccccgagaaccccuggcuggugcaggccuacgugagcgccgccaagcaccccuucgccagcgugguggcccaggagguguuccagagcggcaucauccccagcgacaccgacuucagaaucuacagagacuucggcaacauccccggcaucgaccuggccuucaucgagaacggcuacaucuaccacaccaaguacgacaccgccgacagaauccugaccgacagcauccagagagccggcgacaacauccuggccgugcugaagcaccuggccaccagcgacaugcuggccgccgccagcaaguacagacacggcaacaugguguucuucgacgugcugggccuguucgugaucgccuaccccagcagaaucggcagcaucaucaacuacaugguggugaugggcguggugcuguaccugggcaagaaguuccugcagcccaagcacaagaccggcaacuacaagaaggacuuccugugcggccugggcaucacccugaucagcugguucaccagccuggugaccgugcugaucaucgccguguucaucagccugaucggccagagccugagcugguacaaccacuucuacgugagcgugugccuguacggcaccgccaccguggccaagaucauccugauccacacccuggccaagagauucuacuacaugaacgccagcgcccaguaccugggcgagguguucuucgacaucagccuguucgugcacugcugcuuccuggugacccugaccuaccagggccugugcagcgccuucaucagcgccguguggguggccuucccccugcugaccaagcugugcgugcacaaggacuucaagcagcacggcgcccagggcaaguucaucgccuucuaccugcugggcauguucauccccuaccuguacgcccuguaccugaucugggccguguucgagauguucacccccauccugggcagaagcggcagcgagaucccccccgacguggugcuggccagcauccuggccggcugcaccaugauccugagcagcuacuucaucaacuucaucuaccuggccaagagcaccaagaagaccaugcugacccugacccuggugugcgccaucaccuuccugcuggugugcagcggcaccuucuuccccuacagcagcaaccccgccaaccccaagcccaagagaguguuccugcagcacaugaccagaaccuuccacgaccuggagggcaacgccgugaagagagacagcggcaucuggaucaacggcuucgacuacaccggcaucagccacaucaccccccacauccccgagaucaacgacagcaucagagcccacugcgaggagaacgccccccugugcggcuuccccugguaccugcccgugcacuuccugaucagaaagaacugguaccugcccgcccccgaggugagccccagaaaccccccccacuucagacugaucagcaaggagcagacccccugggacagcaucaagcugaccuucgaggccaccggccccagccacaugagcuucuacgugagagcccacaagggcagcacccugagccaguggagccugggcaacggcacccccgugaccagcaagggcggcgacuacuucguguucuacagccacggccugcaggccagcgccuggcaguucuggaucgaggugcaggugagcgaggagcaccccgagggcauggugaccguggccaucgccgcccacuaccugagcggcgaggacaagagaagcccccagcuggacgcccugaaggagaaguuccccgacuggaccuuccccagcgccugggugugcaccuacgaccuguucguguucuaa

SEQ ID NO: 16714 - RNA, 2934 nt, Artificial Sequence
  ERN1__Homo_sapiens__NP_001424
augcccgccagaagacugcugcugcugcugacccugcugcugcccggccugggcaucuucggcagcaccagcaccgugacccugcccgagacccugcuguucgugagcacccuggacggcagccugcacgccgugagcaagagaaccggcagcaucaaguggacccugaaggaggaccccgugcugcaggugcccacccacguggaggagcccgccuuccugcccgaccccaacgacggcagccuguacacccugggcagcaagaacaacgagggccugaccaagcugcccuucaccauccccgagcuggugcaggccagccccugcagaagcagcgacggcauccuguacaugggcaagaagcaggacaucugguacgugaucgaccugcugaccggcgagaagcagcagacccugagcagcgccuucgccgacagccugugccccagcaccagccugcuguaccugggcagaaccgaguacaccaucaccauguacgacaccaagaccagagagcugagauggaacgccaccuacuucgacuacgccgccagccugcccgaggacgacguggacuacaagaugagccacuucgugagcaacggcgacggccugguggugaccguggacagcgagagcggcgacgugcuguggauccagaacuacgccagccccgugguggccuucuacguguggcagagagagggccugagaaaggugaugcacaucaacguggccguggagacccugagauaccugaccuucaugagcggcgaggugggcagaaucaccaaguggaaguaccccuuccccaaggagaccgaggccaagagcaagcugacccccacccuguacgugggcaaguacagcaccagccuguacgccagccccagcauggugcacgagggcguggccguggugcccagaggcagcacccugccccugcuggagggcccccagaccgacggcgugaccaucggcgacaagggcgagugcgugaucacccccagcaccgacgugaaguucgaccccggccugaagagcaagaacaagcugaacuaccugagaaacuacuggcugcugaucggccaccacgagaccccccugagcgccagcaccaagaugcuggagagauuccccaacaaccugcccaagcacagagagaacgugauccccgccgacagcgagaagaagagcuucgaggaggugaucaaccugguggaccagaccagcgagaacgcccccaccaccgugagcagagacguggaggagaagcccgcccacgcccccgccagacccgaggcccccguggacagcaugcugaaggacauggccaccaucauccugagcaccuuccugcugaucggcuggguggccuucaucaucaccuacccccugagcaugcaccagcagcagcagcugcagcaccagcaguuccagaaggagcuggagaagauccagcugcugcagcagcagcagcagcagcugcccuuccacccccccggcgacaccgcccaggacggcgagcugcuggacaccagcggccccuacagcgagagcagcggcaccagcagccccagcaccagccccagagccagcaaccacagccugugcagcggcagcagcgccagcaaggccggcagcagccccagccuggagcaggacgacggcgacgaggagaccagcguggugaucgugggcaagaucagcuucugccccaaggacgugcugggccacggcgccgagggcaccaucguguacagaggcauguucgacaacagagacguggccgugaagagaauccugcccgagugcuucagcuucgccgacagagaggugcagcugcugagagagagcgacgagcaccccaacgugaucagauacuucugcaccgagaaggacagacaguuccaguacaucgccaucgagcugugcgccgccacccugcaggaguacguggagcagaaggacuucgcccaccugggccuggagcccaucacccugcugcagcagaccaccagcggccuggcccaccugcacagccugaacaucgugcacagagaccugaagccccacaacauccugaucagcaugcccaacgcccacggcaagaucaaggccaugaucagcgacuucggccugugcaagaagcuggccgugggcagacacagcuucagcagaagaagcggcgugcccggcaccgagggcuggaucgcccccgagaugcugagcgaggacugcaaggagaaccccaccuacaccguggacaucuucagcgccggcugcguguucuacuacgugaucagcgagggcagccaccccuucggcaagagccugcagagacaggccaacauccugcugggcgccugcagccuggacugccugcaccccgagaagcacgaggacgugaucgccagagagcugaucgagaagaugaucgccauggacccccagaagagacccagcgccaagcacgugcugaagcaccccuucuucuggagccuggagaagcagcugcaguucuuccaggacgugagcgacagaaucgagaaggagagccuggacggccccaucgugaagcagcuggagagaggcggcagagccguggugaagauggacuggagagagaacaucaccgugccccugcagaccgaccugagaaaguucagaaccuacaagggcggcagcgugagagaccugcugagagccaugagaaacaagaagcaccacuacagagagcugcccgccgaggugagagagacccugggcagccugcccgacgacuucgugugcuacuucaccagcagauucccccaccugcuggcccacaccuacagagccauggagcugugcagccacgagagacuguuccagcccuacuacuuccacgagccccccgagccccagccccccgugacccccgacgcccuguaa

SEQ ID NO: 16715 - RNA, 2781 nt, Artificial Sequence
  ERN2__Homo_sapiens__NP_150296
auggccagcgccgugagaggcagcagacccuggcccagacugggccugcagcugcaguucgccgcccugcugcugggcacccugagcccccaggugcacacccugagacccgagaaccugcugcuggugagcacccuggacggcagccugcacgcccugagcaagcagaccggcgaccugaaguggacccugagagacgaccccgugaucgagggccccauguacgugaccgagauggccuuccugagcgaccccgccgacggcagccuguacauccugggcacccagaagcagcagggccugaugaagcugcccuucaccauccccgagcuggugcacgccagccccugcagaagcagcgacggcguguucuacaccggcagaaagcaggacgccugguucgugguggaccccgagagcggcgagacccagaugacccugaccaccgagggccccagcacccccagacuguacaucggcagaacccaguacaccgugaccaugcacgaccccagagcccccgcccugagauggaacaccaccuacagaagauacagcgccccccccauggacggcagccccggcaaguacaugagccaccuggccagcugcggcaugggccugcugcugaccguggaccccggcagcggcaccgugcuguggacccaggaccugggcgugcccgugaugggcguguacaccuggcaccaggacggccugagacagcugccccaccugacccuggccagagacacccugcacuuccuggcccugagauggggccacaucagacugcccgccagcggccccagagacaccgccacccuguucagcacccuggacacccagcugcugaugacccuguacgugggcaaggacgagaccggcuucuacgugagcaaggcccuggugcacaccggcguggcccuggugcccagaggccugacccuggcccccgccgacggccccaccaccgacgaggugacccugcaggugagcggcgagagagagggcagccccagcaccgccgugagauaccccagcggcagcguggcccugcccagccaguggcugcugaucggccaccacgagcugccccccgugcugcacaccaccaugcugagagugcaccccacccugggcagcggcaccgccgagaccagaccccccgagaacacccaggcccccgccuucuuccuggagcugcugagccugagcagagagaagcugugggacagcgagcugcaccccgaggagaagacccccgacagcuaccugggccugggcccccaggaccugcuggccgccagccugaccgccgugcugcugggcggcuggauccuguucgugaugagacagcagcagccccaggugguggagaagcagcaggagaccccccuggcccccgccgacuucgcccacaucagccaggacgcccagagccugcacagcggcgccagcagaagaagccagaagagacugcagagccccagcaagcaggcccagccccuggacgaccccgaggccgagcagcugaccguggugggcaagaucagcuucaaccccaaggacgugcugggcagaggcgccggcggcaccuucguguucagaggccaguucgagggcagagccguggccgugaagagacugcugagagagugcuucggccuggugagaagagaggugcagcugcugcaggagagcgacagacaccccaacgugcugagauacuucugcaccgagagaggcccccaguuccacuacaucgcccuggagcugugcagagccagccugcaggaguacguggagaaccccgaccuggacagaggcggccuggagcccgagguggugcugcagcagcugaugagcggccuggcccaccugcacagccugcacaucgugcacagagaccugaagcccggcaacauccugaucaccggccccgacagccagggccugggcagaguggugcugagcgacuucggccugugcaagaagcugcccgccggcagaugcagcuucagccugcacagcggcauccccggcaccgagggcuggauggcccccgagcugcugcagcugcugccccccgacagccccaccagcgccguggacaucuucagcgccggcugcguguucuacuacgugcugagcggcggcagccaccccuucggcgacagccuguacagacaggccaacauccugaccggcgcccccugccuggcccaccuggaggaggaggugcacgacaaggugguggccagagaccuggugggcgccaugcugagcccccugccccagcccagacccagcgccccccaggugcuggcccaccccuucuucuggagcagagccaagcagcugcaguucuuccaggacgugagcgacuggcuggagaaggagagcgagcaggagccccuggugagagcccuggaggccggcggcugcgccguggugagagacaacuggcacgagcacaucagcaugccccugcagaccgaccugagaaaguucagaagcuacaagggcaccagcgugagagaccugcugagagccgugagaaacaagaagcaccacuacagagagcugcccguggaggugagacaggcccugggccaggugcccgacggcuucgugcaguacuucaccaacagauuccccagacugcugcugcacacccacagagccaugagaagcugcgccagcgagagccuguuccugcccuacuacccccccgacagcgaggccagaagacccugccccggcgccaccggcagauaa

SEQ ID NO: 16716 - RNA, 1404 nt, Artificial Sequence
  ERO1LB__Homo_sapiens__NP_063944
augagccagggcgugagaagagccggcgccggccagggcguggccgccgccgugcagcugcuggugacccugagcuuccugagaagcgugguggaggcccaggugaccggcgugcuggacgacugccugugcgacaucgacagcaucgacaacuucaacaccuacaagaucuuccccaagaucaagaagcugcaggagagagacuacuucagauacuacaaggugaaccugaagagacccugccccuucugggccgaggacggccacugcagcaucaaggacugccacguggagcccugccccgagagcaagauccccgugggcaucaaggccggccacagcaacaaguaccugaagauggccaacaacaccaaggagcuggaggacugcgagcaggccaacaagcugggcgccaucaacagcacccugagcaaccagagcaaggaggccuucaucgacugggccagauacgacgacagcagagaccacuucugcgagcuggacgacgagagaagccccgccgcccaguacguggaccugcugcugaaccccgagagauacaccggcuacaagggcaccagcgccuggagaguguggaacagcaucuacgaggagaacugcuucaagcccagaagcguguacagaccccugaacccccuggcccccagcagaggcgaggacgacggcgagagcuucuacaccuggcuggagggccugugccuggagaagagaguguucuacaagcugaucagcggccugcacgccagcaucaaccugcaccugugcgccaacuaccugcuggaggagaccuggggcaagcccagcuggggccccaacaucaaggaguucaagcacagauucgaccccguggagaccaagggcgagggccccagaagacugaagaaccuguacuuccuguaccugaucgagcugagagcccugagcaagguggcccccuacuucgagagaagcaucguggaccuguacaccggcaacgccgaggaggacgccgacaccaagacccugcugcugaacaucuuccaggacaccaagagcuuccccaugcacuucgacgagaagagcauguucgccggcgacaagaagggcgccaagagccugaaggaggaguucagacugcacuucaagaacaucagcagaaucauggacugcgugggcugcgacaagugcagacuguggggcaagcugcagacccagggccugggcaccgcccugaagauccuguucagcgagaaggagauccagaagcugcccgagaacagccccagcaagggcuuccagcugaccagacaggagaucguggcccugcugaacgccuucggcagacugagcaccagcaucagagaccugcagaacuucaaggugcugcugcagcacagcagauaa

SEQ ID NO: 16717 - RNA, 1407 nt, Artificial Sequence
  ERO1L__Homo_sapiens__NP_055399
augggcagaggcuggggcuuccuguucggccugcugggcgccguguggcugcugagcagcggccacggcgaggagcagccccccgagaccgccgcccagagaugcuucugccaggugagcggcuaccuggacgacugcaccugcgacguggagaccaucgacagauucaacaacuacagacuguuccccagacugcagaagcugcuggagagcgacuacuucagauacuacaaggugaaccugaagagacccugccccuucuggaacgacaucagccagugcggcagaagagacugcgccgugaagcccugccagagcgacgaggugcccgacggcaucaagagcgccagcuacaaguacagcgaggaggccaacaaccugaucgaggagugcgagcaggccgagagacugggcgccguggacgagagccugagcgaggagacccagaaggccgugcugcaguggaccaagcacgacgacagcagcgacaacuucugcgaggccgacgacauccagagccccgaggccgaguacguggaccugcugcugaaccccgagagauacaccggcuacaagggccccgacgccuggaagaucuggaacgugaucuacgaggagaacugcuucaagccccagaccaucaagagaccccugaacccccuggccagcggccagggcaccagcgaggagaacaccuucuacagcuggcuggagggccugugcguggagaagagagccuucuacagacugaucagcggccugcacgccagcaucaacgugcaccugagcgccagauaccugcugcaggagaccuggcuggagaagaaguggggccacaacaucaccgaguuccagcagagauucgacggcauccugaccgagggcgagggccccagaagacugaagaaccuguacuuccuguaccugaucgagcugagagcccugagcaaggugcugcccuucuucgagagacccgacuuccagcuguucaccggcaacaagauccaggacgaggagaacaagaugcugcugcuggagauccugcacgagaucaagagcuucccccugcacuucgacgagaacagcuucuucgccggcgacaagaaggaggcccacaagcugaaggaggacuucagacugcacuucagaaacaucagcagaaucauggacugcgugggcugcuucaagugcagacuguggggcaagcugcagacccagggccugggcaccgcccugaagauccuguucagcgagaagcugaucgccaacaugcccgagagcggccccagcuacgaguuccaccugaccagacaggagaucgugagccuguucaacgccuucggcagaaucagcaccagcgugaaggagcuggagaacuucagaaaccugcugcagaacauccacuaa

SEQ ID NO: 16718 - RNA, 162 nt, Artificial Sequence
  ERP29__Homo_sapiens__NP_001029197
auggccgccgccgugcccagagccgccuuccugagcccccugcugccccugcugcugggcuuccugcugcugagcgccccccacggcggcagcggccugcacaccaagggcgcccugccccuggacaccgugaccuucuacaagaucauggugaccagcuaa

SEQ ID NO: 16719 - RNA, 1221 nt, Artificial Sequence
  ERP44__Homo_sapiens__NP_055866
augcaccccgccguguuccugagccugcccgaccugagaugcagccugcugcugcuggugaccuggguguucacccccgugaccaccgagaucaccagccuggacaccgagaacaucgacgagauccugaacaacgccgacguggcccuggugaacuucuacgccgacuggugcagauucagccagaugcugcaccccaucuucgaggaggccagcgacgugaucaaggaggaguuccccaacgagaaccaggugguguucgccagaguggacugcgaccagcacagcgacaucgcccagagauacagaaucagcaaguaccccacccugaagcuguucagaaacggcaugaugaugaagagagaguacagaggccagagaagcgugaaggcccuggccgacuacaucagacagcagaagagcgaccccauccaggagaucagagaccuggccgagaucaccacccuggacagaagcaagagaaacaucaucggcuacuucgagcagaaggacagcgacaacuacagaguguucgagagaguggccaacauccugcacgacgacugcgccuuccugagcgccuucggcgacgugagcaagcccgagagauacagcggcgacaacaucaucuacaagccccccggccacagcgcccccgacaugguguaccugggcgccaugaccaacuucgacgugaccuacaacuggauccaggacaagugcgugccccuggugagagagaucaccuucgagaacggcgaggagcugaccgaggagggccugcccuuccugauccuguuccacaugaaggaggacaccgagagccuggagaucuuccagaacgagguggccagacagcugaucagcgagaagggcaccaucaacuuccugcacgccgacugcgacaaguucagacacccccugcugcacauccagaagacccccgccgacugccccgugaucgccaucgacagcuucagacacauguacguguucggcgacuucaaggacgugcugauccccggcaagcugaagcaguucguguucgaccugcacagcggcaagcugcacagagaguuccaccacggccccgaccccaccgacaccgcccccggcgagcaggcccaggacguggccagcagcccccccgagagcagcuuccagaagcuggcccccagcgaguacagauacacccugcugagagacagagacgagcuguaa

SEQ ID NO: 16720 - RNA, 1815 nt, Artificial Sequence
  ERV3-1__Homo_sapiens__NP_001007254
augcugggcaugaacaugcugcugaucacccuguuccugcugcugccccugagcaugcugaagggcgagcccugggagggcugccugcacugcacccacaccaccuggagcggcaacaucaugaccaagacccugcuguaccacaccuacuacgagugcgccggcaccugccugggcaccugcacccacaaccagaccaccuacagcgugugcgaccccggcagaggccagcccuacgugugcuacgaccccaagagcagccccggcaccugguucgagauccacgugggcagcaaggagggcgaccugcugaaccagaccaagguguuccccagcggcaaggacguggugagccuguacuucgacgugugccagaucgugagcaugggcagccuguuccccgugaucuucagcagcauggaguacuacagcagcugccacaagaacagauacgcccaccccgccugcagcaccgacagccccgugaccaccugcugggacugcaccaccuggagcaccaaccagcagagccugggccccaucaugcugaccaagaucccccuggagcccgacugcaagaccagcaccugcaacagcgugaaccugaccauccuggagcccgaccagcccaucuggaccaccggccugaaggccccccugggcgccagagugagcggcgaggagaucggccccggcgccuacguguaccuguacaucaucaagaagaccagaaccagaagcacccagcaguucagaguguucgagagcuucuacgagcacgugaaccagaagcugcccgagccccccccccuggccagcaaccuguucgcccagcuggccgagaacaucgccagcagccugcacguggccagcugcuacgugugcggcggcaugaacaugggcgaccaguggcccugggaggccagagagcugaugccccaggacaacuucacccugaccgccagcagccuggagcccgcccccagcagccagagcaucugguuccugaagaccagcaucaucggcaaguucugcaucgccagauggggcaaggccuucaccgaccccgugggcgagcugaccugccugggccagcaguacuacaacgagacccugggcaagacccuguggagaggcaagagcaacaacagcgagagcccccaccccagccccuucagcagauuccccagccugaaccacagcugguaccagcuggaggcccccaacaccuggcaggcccccagcggccuguacuggaucugcggcccccaggccuacagacagcugcccgccaaguggagcggcgccugcgugcugggcaccaucagacccagcuucuuccugaugccccugaagcagggcgaggcccugggcuaccccaucuacgacgagaccaagagaaagagcaagagaggcaucaccaucggcgacuggaaggacaacgaguggccccccgagagaaucauccaguacuacggccccgccaccugggccgaggacggcauguggggcuacagaacccccguguacaugcugaacagaaucaucagacugcaggccgugcuggagaucaucaccaacgagaccgccggcgcccugaaccugcuggcccagcaggccaccaagaugagaaacgugaucuaccagaacagacuggcccuggacuaccugcuggcccaggaggagggcgugugcggcaaguucaaccugaccaacugcugccuggagcuggacgacgagggcaaggugaucaaggagaucaccgccaagauccagaagcuggcccacauccccgugcagaccuggaagggcuaa

SEQ ID NO: 16721 - RNA, 1617 nt, Artificial Sequence
  ERVW-1__Homo_sapiens__NP_055405
auggcccugcccuaccacaucuuccuguucaccgugcugcugcccagcuucacccugaccgcccccccccccugcagaugcaugaccagcagcagccccuaccaggaguuccuguggagaaugcagagacccggcaacaucgacgcccccagcuacagaagccugagcaagggcacccccaccuucaccgcccacacccacaugcccagaaacugcuaccacagcgccacccugugcaugcacgccaacacccacuacuggaccggcaagaugaucaaccccagcugccccggcggccugggcgugaccgugugcuggaccuacuucacccagaccggcaugagcgacggcggcggcgugcaggaccaggccagagagaagcacgugaaggaggugaucagccagcugaccagagugcacggcaccagcagccccuacaagggccuggaccugagcaagcugcacgagacccugagaacccacaccagacuggugagccuguucaacaccacccugaccggccugcacgaggugagcgcccagaaccccaccaacugcuggaucugccugccccugaacuucagacccuacgugagcauccccgugcccgagcaguggaacaacuucagcaccgagaucaacaccaccagcgugcuggugggcccccuggugagcaaccuggagaucacccacaccagcaaccugaccugcgugaaguucagcaacaccaccuacaccaccaacagccagugcaucagaugggugaccccccccacccagaucgugugccugcccagcggcaucuucuucgugugcggcaccagcgccuacagaugccugaacggcagcagcgagagcaugugcuuccugagcuuccuggugccccccaugaccaucuacaccgagcaggaccuguacagcuacgugaucagcaagcccagaaacaagagagugcccauccugcccuucgugaucggcgccggcgugcugggcgcccugggcaccggcaucggcggcaucaccaccagcacccaguucuacuacaagcugagccaggagcugaacggcgacauggagagaguggccgacagccuggugacccugcaggaccagcugaacagccuggccgccguggugcugcagaacagaagagcccuggaccugcugaccgccgagagaggcggcaccugccuguuccugggcgaggagugcugcuacuacgugaaccagagcggcaucgugaccgagaaggugaaggagaucagagacagaauccagagaagagccgaggagcugagaaacaccggccccuggggccugcugagccaguggaugcccuggauccugcccuuccugggcccccuggccgccaucauccugcugcugcuguucggccccugcaucuucaaccugcuggugaacuucgugagcagcagaaucgaggccgugaagcugcagauggagcccaagaugcagagcaagaccaagaucuacagaagaccccuggacagacccgccagccccagaagcgacgugaacgacaucaagggcaccccccccgaggagaucagcgccgcccagccccugcugagacccaacagcgccggcagcagcuaa

SEQ ID NO: 16722 - RNA, 1173 nt, Artificial Sequence
  ESAM__Homo_sapiens__NP_620411
augaucagccugcccggcccccuggugaccaaccugcugagauuccuguuccugggccugagcgcccuggccccccccagcagagcccagcugcagcugcaccugcccgccaacagacugcaggccguggagggcggcgagguggugcugcccgccugguacacccugcacggcgaggugagcagcagccagcccugggaggugcccuucgugaugugguucuucaagcagaaggagaaggaggaccaggugcugagcuacaucaacggcgugaccaccagcaagcccggcgugagccugguguacagcaugcccagcagaaaccugagccugagacuggagggccugcaggagaaggacagcggccccuacagcugcagcgugaacgugcaggacaagcagggcaagagcagaggccacagcaucaagacccuggagcugaacgugcuggugccccccgccccccccagcugcagacugcagggcgugccccacgugggcgccaacgugacccugagcugccagagccccagaagcaagcccgccgugcaguaccagugggacagacagcugcccagcuuccagaccuucuucgcccccgcccuggacgugaucagaggcagccugagccugaccaaccugagcagcagcauggccggcguguacgugugcaaggcccacaacgaggugggcaccgcccagugcaacgugacccuggaggugagcaccggccccggcgccgccgugguggccggcgccguggugggcacccuggugggccugggccugcuggccggccuggugcugcuguaccacagaagaggcaaggcccuggaggagcccgccaacgacaucaaggaggacgccaucgcccccagaacccugcccuggcccaagagcagcgacaccaucagcaagaacggcacccugagcagcgugaccagcgccagagcccugagacccccccacggcccccccagacccggcgcccugacccccacccccagccugagcagccaggcccugcccagccccagacugcccaccaccgacggcgcccacccccagcccaucagccccauccccggcggcgugagcagcagcggccugagcagaaugggcgccgugcccgugauggugcccgcccagagccaggccggcagccugguguaa

SEQ ID NO: 16723 - RNA, 2523 nt, Artificial Sequence
  ESCO1__Homo_sapiens__NP_443143
augaugagcauccaggagaagagcaaggagaacagcagcaaggugaccaagaagagcgacgacaagaacagcgagaccgagauccaggacagccagaagaaccuggccaagaagagcggccccaaggagaccaucaagagccaggccaagagcagcagcgagagcaagaucaaccagcccgagcuggagaccagaaugagcaccagaagcagcaaggccgccagcaacgacaaggccaccaagagcaucaacaagaacaccgugaccgugagaggcuacagccaggagagcaccaagaagaagcugagccagaagaagcuggugcacgagaaccccaaggccaacgagcagcugaacagaagaagccagagacugcagcagcugaccgaggugagcagaagaagccugagaagcagagagauccagggccaggugcaggccgugaagcagagccugccccccaccaagaaggagcagugcagcagcacccagagcaagagcaacaagaccagccagaagcacgugaagagaaaggugcuggaggugaagagcgacagcaaggaggacgagaaccuggugaucaacgaggugaucaacagccccaagggcaagaagagaaagguggagcaccagaccgccugcgccugcagcagccagugcacccagggcagcgagaagugcccccagaagaccaccagaagagacgagaccaagcccgugcccgugaccagcgaggugaagagaagcaagauggccaccagcguggugcccaagaagaacgagaugaagaagagcgugcacacccaggugaacaccaacaccacccugcccaagagcccccagcccagcgugcccgagcagagcgacaacgagcuggagcaggccggcaagagcaagagaggcagcauccugcagcugugcgaggagaucgccggcgagaucgagagcgacaacguggaggugaagaaggagagcagccagauggagagcgugaaggaggagaagcccaccgagaucaagcuggaggagaccagcguggagagacagauccugcaccagaaggagaccaaccaggacgugcagugcaacagauucuuccccagcagaaagaccaagcccgugaagugcauccugaacggcaucaacagcagcgccaagaagaacagcaacuggaccaagaucaagcugagcaaguucaacagcgugcagcacaacaagcuggacagccaggugagccccaagcugggccugcugagaaccagcuucagcccccccgcccuggagaugcaccaccccgugacccagagcaccuuccugggcaccaagcugcacgacagaaacaucaccugccagcaggagaagaugaaggagaucaacagcgaggaggugaagaucaacgacaucaccguggagaucaacaagaccaccgagagagcccccgagaacugccaccuggccaacgagaucaagcccagcgaccccccccuggacaaccagaugaagcacagcuucgacagcgccagcaacaagaacuucagccagugccuggagagcaagcuggagaacagccccguggagaacgugaccgccgccagcacccugcugagccaggccaagaucgacaccggcgagaacaaguuccccggcagcgccccccagcagcacagcauccugagcaaccagaccagcaagagcagcgacaacagagagacccccagaaaccacagccugcccaagugcaacagccaccuggagaucaccauccccaaggaccugaagcugaaggaggccgagaagaccgacgagaagcagcugaucaucgacgccggccagaagagauucggcgccgugagcugcaacgugugcggcaugcuguacaccgccagcaaccccgaggacgagacccagcaccugcuguuccacaaccaguucaucagcgccgugaaguacgugggcuggaagaaggagagaauccuggccgaguaccccgacggcagaaucaucauggugcugcccgaggaccccaaguacgcccugaagaagguggacgagaucagagagaugguggacaacgaccugggcuuccagcaggccccccugaugugcuacagcagaaccaagacccugcuguucaucagcaacgacaagaagguggugggcugccugaucgccgagcacauccaguggggcuacagagugaucgaggagaagcugcccgugaucagaagcgaggaggagaaggugagauucgagagacagaaggccuggugcugcagcacccugcccgagcccgccaucugcggcaucagcagaaucuggguguucagcaugaugagaagaaagaagaucgccagcagaaugaucgagugccugagaagcaacuucaucuacggcagcuaccugagcaaggaggagaucgccuucagcgaccccacccccgacggcaagcuguucgccacccaguacugcggcaccggccaguuccugguguacaacuucaucaacggccagaacagcaccuaa

SEQ ID NO: 16724 - RNA, 1806 nt, Artificial Sequence
  ESCO2__Homo_sapiens__XP_011542723
auggccgcccugacccccagaaagagaaagcaggacagccugaagugcgacagccugcugcacuucaccgagaaccuguuccccagccccaacaagaagcacugcuucuaccagaacagcgacaagaacgaggagaaccugcacugcagccagcaggagcacuucgugcugagcgcccugaagaccaccgagaucaacagacugcccagcgccaaccagggcagccccuucaagagcgcccugagcaccgugagcuucuacaaccagaacaagugguaccugaacccccuggagagaaagcugaucaaggagagcagaagcaccugccugaagaccaacgacgaggacaagagcuuccccaucgugaccgagaagaugcagggcaagcccgugugcagcaagaagaacaacaagaagccccagaagagccugaccgccaaguaccagcccaaguacagacacaucaagcccgugagcagaaacagcagaaacagcaagcagaacagagugaucuacaagcccaucguggagaaggagaacaacugccacagcgccgagaacaacagcaacgcccccagagugcugagccagaagaucaagccccaggugacccugcagggcggcgccgccuucuucgugagaaagaagagcagccugagaaagagcagccuggagaacgagcccagccugggcagaacccagaagagcaagagcgaggugaucgaggacagcgacguggagaccgugagcgagaagaagaccuucgccaccagacaggugcccaagugccuggugcuggaggagaagcugaagaucggccugcugagcgccagcagcaagaacaaggagaagcugaucaaggacagcagcgacgacagagugagcagcaaggagcacaagguggacaagaacgaggccuucagcagcgaggacagccugggcgagaacaagaccaucagccccaagagcaccguguaccccaucuucagcgccagcagcgugaacagcaagagaagccugggcgaggagcaguucagcgugggcagcgugaacuucaugaagcagaccaacauccagaagaacaccaacaccagagacaccagcaagaagaccaaggaccagcugaucaucgacgccggccagaagcacuucggcgccaccgugugcaagagcugcggcaugaucuacaccgccagcaaccccgaggacgagaugcagcacgugcagcaccaccacagauuccuggagggcaucaaguacgugggcuggaagaaggagagagugguggccgaguucugggacggcaagaucgugcuggugcugccccacgaccccagcuucgccaucaagaagguggaggacgugcaggagcugguggacaacgagcugggcuuccagcagguggugcccaagugccccaacaagaucaagaccuuccuguucaucagcgacgagaagagaguggugggcugccugaucgccgagcccaucaagcaggccuucagagugcugagcgagcccaucggccccgagagccccagcagcaccgagugccccagagccuggcagugcagcgacgugcccgagcccgccgugugcggcaucagcagaaucuggguguucagacugaagagaagaaagagaaucgccagaagacugguggacacccugagaaacugcuucauguucggcugcuuccugagcaccgacgagaucgccuucagcgaccccacccccgacggcaagcuguucgccaccaaguacugcaacacccccaacuuccugguguacaacuucaacagcuaa

SEQ ID NO: 16725 - RNA, 849 nt, Artificial Sequence
  ESD__Homo_sapiens__XP_011533256
auggcccugaagcagaucagcagcaacaagugcuucggcggccugcagaagguguucgagcacgacagcguggagcugaacugcaagaugaaguucgccguguaccugccccccaaggccgagaccggcaagugccccgcccuguacuggcugagcggccugaccugcaccgagcagaacuucaucagcaagagcggcuaccaccagagcgccagcgagcacggccugguggugaucgcccccgacaccagccccagaggcugcaacaucaagggcgaggacgagagcugggacuucggcaccggcgccggcuucuacguggacgccaccgaggaccccuggaagaccaacuacagaauguacagcuacgugaccgaggagcugccccagcugaucaacgccaacuuccccguggacccccagagaaugagcaucuucggccacagcaugggcggccacggcgcccugaucugcgcccugaagaaccccggcaaguacaagagcgugagcgccuucgcccccaucugcaaccccgugcugugccccuggggcaagaaggccuucagcggcuaccugggcaccgaccagagcaaguggaaggccuacgacgccacccaccuggugaagagcuaccccggcagccagcuggacauccugaucgaccagggcaaggacgaccaguuccugcuggacggccagcugcugcccgacaacuucaucgccgccugcaccgagaagaagauccccgugguguucagacugcaggagggcuacgaccacagcuacuacuucaucgccaccuucaucaccgaccacaucagacaccacgccaaguaccugaacgccuaa

SEQ ID NO: 16726 - RNA, 2556 nt, Artificial Sequence
  ESF1__Homo_sapiens__NP_001263309
augagcagcaagcaggagaucaugagcgaccagagauucagaagaguggccaaggaccccagauucugggagaugcccgagaaggacagaaaggugaagaucgacaagagauucagagccauguuccacgacaagaaguucaagcugaacuacgccguggacaagagaggcagacccaucagccacagcaccaccgaggaccugaagagauucuacgaccugagcgacagcgacagcaaccugagcggcgaggacagcaaggcccugagccagaagaagaucaagaagaagaagacccagaccaagaaggagaucgacagcaagaaccugguggagaagaagaaggagaccaagaaggccaaccacaagggcagcgagaacaagaccgaccuggacaacagcaucggcaucaagaagaugaagaccagcugcaaguucaagaucgacagcaacaucagccccaagaaggacagcaaggaguucacccagaagaacaagaaggagaagaagaacaucgugcagcacaccaccgacagcagccuggaggagaagcagagaacccuggacagcggcaccagcgagaucgugaagagccccagaaucgagugcagcaagaccagaagagagaugcagagcguggugcagcugaucaugaccagagacagcgacggcuacgagaacagcaccgacggcgagaugugcgacaaggacgcccuggaggaggacagcgagagcgugagcgagaucggcagcgacgaggagagcgagaacgagaucaccagcgugggcagagccagcggcgacgacgacggcagcgaggacgacgaggaggaggacgaggacgaggaggaggacgaggacgaggacagcgaggacgacgacaagagcgacagcggccccgaccuggccagaggcaagggcaacaucgagaccagcagcgaggacgaggacgacaccgccgaccuguuccccgaggagagcggcuucgagcacgccuggagagagcuggacaaggacgcccccagagccgacgagaucaccagaagacuggccgugugcaacauggacugggacagacugaaggccaaggaccugcuggcccuguucaacagcuucaagcccaagggcggcgugaucuucagcgugaagaucuaccccagcgaguucggcaaggagagaaugaaggaggagcaggugcagggccccguggagcugcugagcauccccgaggacgcccccgagaaggacuggaccagcagagagaagcugagagacuaccaguucaagagacugaaguacuacuacgccgugguggacugcgacagccccgagaccgccagcaagaucuacgaggacugcgacggccuggaguucgagagcagcugcagcuucaucgaccugagauucauccccgacgacaucaccuucgacgacgagcccaaggacguggccagcgaggugaaccugaccgccuacaagcccaaguacuucaccagcgccgccaugggcaccagcaccguggagaucaccugggacgagaccgaccacgagagaaucaccaugcugaacagaaaguucaagaaggaggagcugcuggacauggacuuccaggccuaccuggccagcagcagcgaggacgaggaggagaucgaggaggagcugcagggcgacgacggcgugaacguggaggaggacggcaagaccaagaagagccagaaggacgacgaggagcagaucgccaaguacagacagcugcugcaggugauccaggagaaggagaagaagggcaaggagaacgacauggagauggagaucaagugggugcccggccugaaggagagcgccgaggagauggugaagaacaagcuggagggcaaggacaagcugacccccugggagcaguuccuggagaagaagaaggagaagaagagacugaagagaaagcagaaggcccuggccgaggaggccagcgaggaggagcugcccagcgacguggaccugaacgaccccuacuucgccgaggaggugaagcagaucggcaucaacaagaagagcgugaagagcgccaaggacggcaccagccccgaggaggagaucgagaucgagagacagaaggccgagauggcccugcugaugauggacgaggacgaggacagcaagaagcacuucaacuacaacaagaucguggagcaccagaaccugagcaagaagaagaagaagcagcugaugaagaagaaggagcugaucgaggacgacuucgaggugaacgugaacgacgccagauuccaggccauguacaccagccaccuguucaaccuggaccccagcgaccccaacuucaagaagaccaaggccauggagaagauccuggaggagaaggccagacagagagagagaaaggagcaggagcugacccaggccaucaagaagaaggagagcgagaucgagaaggagagccagagaaagagcaucgaccccgcccugagcaugcugaucaagagcaucaagaccaagaccgagcaguuccaggccagaaagaagcagaaggugaaguaa

SEQ ID NO: 16727 - RNA, 405 nt, Artificial Sequence
  ESM1__Homo_sapiens__NP_001129076
augaagagcgugcugcugcugaccacccugcuggugcccgcccaccugguggccgccuggagcaacaacuacgccguggacugcccccagcacugcgacagcagcgagugcaagagcagccccagaugcaagagaaccgugcuggacgacugcggcugcugcagagugugcgccgccggcagaggcgagaccugcuacagaaccgugagcggcauggacggcaugaagugcggccccggccugagaugccagcccagcaacggcgaggaccccuucggcgaggaguucggcaucugcaaggagcacgacauggccagcggcgacggcaacaucgugagagaggagguggugaaggagaacgccgccggcagccccgugaugagaaaguggcugaaccccagauaa

SEQ ID NO: 16728 - RNA, 6363 nt, Artificial Sequence
  ESPL1__Homo_sapiens__NP_036423
augagaagcuucaagagagugaacuucggcacccugcugagcagccagaaggaggccgaggagcugcugcccgcccugaaggaguuccugagcaacccccccgccggcuuccccagcagcagaagcgacgccgagagaagacaggccugcgacgccauccugagagccugcaaccagcagcugaccgccaagcuggccugccccagacaccugggcagccugcuggagcuggccgagcuggccugcgacggcuaccuggugagcaccccccagagacccccccuguaccuggagagaauccuguucgugcugcugagaaacgccgccgcccagggcagccccgaggccacccugagacuggcccagccccugcacgccugccuggugcagugcagcagagaggccgccccccaggacuacgaggccguggccagaggcagcuucagccugcuguggaagggcgccgaggcccugcuggagagaagagccgccuucgccgccagacugaaggcccugagcuuccuggugcugcuggaggacgagagcacccccugcgaggugccccacuucgccagccccaccgccugcagagccguggccgcccaccagcuguucgacgccagcggccacggccugaacgaggccgacgccgacuuccuggacgaccugcugagcagacacgugaucagagcccuggugggcgagagaggcagcagcagcggccugcugagcccccagagagcccugugccugcuggagcugacccuggagcacugcagaagauucugcuggagcagacaccacgacaaggccaucagcgccguggagaaggcccacagcuaccugagaaacaccaaccuggcccccagccugcagcugugccagcugggcgugaagcugcugcaggugggcgaggagggcccccaggccguggccaagcugcugaucaaggccagcgccgugcugagcaagagcauggaggcccccagccccccccugagagcccuguacgagagcugccaguucuuccugagcggccuggagagaggcaccaagagaagauacagacuggacgccauccugagccuguucgccuuccugggcggcuacugcagccugcugcagcagcugagagacgacggcguguacggcggcagcagcaagcagcagcagagcuuccugcagauguacuuccagggccugcaccuguacaccguggugguguacgacuucgcccagggcugccagaucguggaccuggccgaccugacccagcugguggacagcugcaagagcaccgugguguggaugcuggaggcccuggagggccugagcggccaggagcugaccgaccacaugggcaugaccgccagcuacaccagcaaccuggccuacagcuucuacagccacaagcuguacgccgaggccugcgccaucagcgagccccugugccagcaccugggccuggugaagcccggcaccuaccccgaggugccccccgagaagcugcacagaugcuucagacugcagguggagagccugaagaagcugggcaagcaggcccagggcugcaagauggugauccuguggcuggccgcccugcagcccugcagccccgagcacauggccgagcccgugaccuucugggugagagugaagauggacgccgccagagccggcgacaaggagcugcagcugaagacccugagagacagccugagcggcugggaccccgagacccuggcccugcugcugagagaggagcugcaggccuacaaggccgugagagccgacaccggccaggagagauucaacaucaucugcgaccugcuggagcugagccccgaggagacccccgccggcgccugggccagagccacccaccugguggagcuggcccaggugcugugcuaccacgacuucacccagcagaccaacugcagcgcccuggacgccaucagagaggcccugcagcugcuggacagcgugagacccgaggcccaggccagagaccagcugcuggacgacaaggcccaggcccugcuguggcuguacaucugcacccuggaggccaagaugcaggagggcaucgagagagacagaagagcccaggcccccggcaaccuggaggaguucgaggugaacgaccugaacuacgaggacaagcugcaggaggacagauuccuguacagcaacaucgccuucaaccuggccgccgacgccgcccagagcaagugccuggaccaggcccuggcccuguggaaggagcugcugaccaagggccaggcccccgccgugagaugccugcagcagaccgccgccagccugcagauccuggccgcccuguaccagcugguggccaagcccaugcaggcccuggaggugcugcugcugcugagaaucgugagcgagagacugaaggaccacagcaaggccgccggcagcagcugccacaucacccagcugcugcugacccugggcugccccagcuacgcccagcugcaccuggaggaggccgccagcagccugaagcaccuggaccagaccaccgacaccuaccugcugcugagccugaccugcgaccugcugagaagccagcuguacuggacccaccagaaggugaccaagggcgugagccugcugcugagcgugcugagagaccccgcccugcagaagagcagcaaggccugguaccugcugagagugcaggugcugcagcugguggccgccuaccugagccugcccagcaacaaccugagccacagccugugggagcagcugugcgcccagggcuggcagacccccgagaucgcccugaucgacagccacaagcugcugagaagcaucauccugcugcugaugggcagcgacauccugagcacccagaaggccgccguggagaccagcuuccuggacuacggcgagaaccuggugcagaaguggcaggugcugagcgaggugcugagcugcagcgagaagcuggugugccaccugggcagacugggcagcgugagcgaggccaaggccuucugccuggaggcccugaagcugaccaccaagcugcagauccccagacagugcgcccuguuccuggugcugaagggcgagcuggagcuggccagaaacgacaucgaccugugccagagcgaccugcagcaggugcuguuccugcuggagagcugcaccgaguucggcggcgugacccagcaccuggacagcgugaagaaggugcaccugcagaagggcaagcagcaggcccaggugcccugccccccccagcugcccgaggaggagcuguuccugagaggccccgcccuggagcugguggccaccguggccaaggagcccggccccaucgcccccagcaccaacagcagccccgugcugaagaccaagccccagcccauccccaacuuccugagccacagccccaccugcgacugcagccugugcgccagccccgugcugaccgccgugugccugagaugggugcuggugaccgccggcgugagacuggccaugggccaccaggcccagggccuggaccugcugcagguggugcugaagggcugccccgaggccgccgagagacugacccaggcccugcaggccagccugaaccacaagaccccccccagccuggugcccagccugcuggacgagauccuggcccaggccuacacccugcuggcccuggagggccugaaccagcccagcaacgagagccugcagaaggugcugcagagcggccugaaguucguggccgccagaaucccccaccuggagcccuggagagccagccugcugcugaucugggcccugaccaagcugggcggccugagcugcugcaccacccagcuguucgccagcagcuggggcuggcagcccccccugaucaagagcgugcccggcagcgagcccagcaagacccagggccagaagagaagcggcagaggcagacagaagcuggccagcgccccccugagacugaacaacaccagccagaagggccuggagggcagaggccugcccugcacccccaagccccccgacagaaucagacaggccggcccccacgugcccuucaccguguucgaggaggugugccccaccgagagcaagcccgaggugccccaggcccccagagugcagcagagagugcagaccagacugaaggugaacuucagcgacgacagcgaccuggaggaccccgugagcgccgaggccuggcuggccgaggagcccaagagaagaggcaccgccagcagaggcagaggcagagccagaaagggccugagccugaagaccgacgccgugguggcccccggcagcgcccccggcaaccccggccugaacggcagaagcagaagagccaagaagguggccagcagacacugcgaggagagaagaccccagagagccagcgaccaggccagacccggccccgagaucaugagaaccauccccgaggaggagcugaccgacaacuggagaaagaugagcuucgagauccugagaggcagcgacggcgaggacagcgccagcggcggcaagacccccgcccccggccccgaggccgccagcggcgagugggagcugcugagacuggacagcagcaagaagaagcugcccagccccugccccgacaaggagagcgacaaggaccugggccccagacugagacugcccagcgcccccguggccaccggccugagcacccuggacagcaucugcgacagccugagcguggccuucagaggcaucagccacugcccccccagcggccuguacgcccaccugugcagauuccuggcccugugccugggccacagagaccccuacgccaccgccuuccuggugaccgagagcgugagcaucaccugcagacaccagcugcugacccaccugcacagacagcugagcaaggcccagaagcacagaggcagccuggagaucgccgaccagcugcagggccugagccugcaggagaugcccggcgacgugccccuggccagaauccagagacuguucagcuucagagcccuggagagcggccacuucccccagcccgagaaggagagcuuccaggagagacuggcccugauccccagcggcgugaccgugugcgugcuggcccuggccacccugcagcccggcaccgugggcaacacccugcugcugaccagacuggagaaggacagcccccccgugagcgugcagauccccaccggccagaacaagcugcaccugagaagcgugcugaacgaguucgacgccauccagaaggcccagaaggagaacagcagcugcaccgacaagagagagugguggaccggcagacuggcccuggaccacagaauggaggugcugaucgccagccuggagaagagcgugcugggcugcuggaagggccugcugcugcccagcagcgaggagcccggccccgcccaggaggccagcagacugcaggagcugcugcaggacugcggcuggaaguaccccgacagaacccugcugaagaucaugcugagcggcgccggcgcccugaccccccaggacauccaggcccuggccuacggccugugccccacccagcccgagagagcccaggagcugcugaacgaggccgugggcagacugcagggccugaccgugcccagcaacagccaccuggugcuggugcuggacaaggaccugcagaagcugcccugggagagcaugcccagccugcaggcccugcccgugaccagacugcccagcuucagauuccugcugagcuacagcaucaucaaggaguacggcgccagccccgugcugagccagggcguggaccccagaagcaccuucuacgugcugaacccccacaacaaccugagcagcaccgaggagcaguucagagccaacuucagcagcgaggccggcuggagaggcguggugggcgaggugcccagacccgagcaggugcaggaggcccugaccaagcacgaccuguacaucuacgccggccacggcgccggcgccagauuccuggacggccaggccgugcugagacugagcugcagagccguggcccugcuguucggcugcagcagcgccgcccuggccgugagaggcaaccuggagggcgccggcaucgugcugaaguacaucauggccggcugcccccuguuccugggcaaccugugggacgugaccgacagagacaucgacagauacaccgaggcccugcugcagggcuggcugggcgccggccccggcgccccccugcuguacuacgugaaccaggccagacaggcccccagacugaaguaccugaucggcgccgcccccaucgccuacggccugcccgugagccugagauaa

SEQ ID NO: 16729 - RNA, 2475 nt, Artificial Sequence
  ESPN__Homo_sapiens__XP_011540537
auggcccuggagcaggcccugcaggccgccagacagggcgagcuggacgugcugagaagccugcacgccgccggccugcugggccccagccugagagacccccuggacgcccugcccgugcaccacgccgccagagccggcaagcugcacugccugagauuccugguggaggaggccgcccugcccgccgccgccagagccagaaacggcgccacccccgcccacgacgccagcgccaccggccaccuggccugccugcaguggcugcugagccagggcggcugcagagugcaggacaaggacaacagcggcgccaccgugcugcaccuggccgccagauucggccaccccgagguggugaacuggcugcugcaccacggcggcggcgaccccaccgccgccaccgacaugggcgcccugcccauccacuacgccgccgccaagggcgacuuccccagccugagacugcugguggagcacuaccccgagggcgugaacgcccagaccaagaacggcgccaccccccuguaccuggccugccaggagggccaccuggaggugacccaguaccuggugcaggagugcggcgccgacccccacgccagagcccacgacggcaugaccccccugcacgccgccgcccagaugggccacagccccgugaucguguggcuggugagcugcaccgacgugagccugagcgagcaggacaaggacggcgccaccgccaugcacuucgccgccagcagaggccacaccaaggugcugagcuggcugcugcugcacggcggcgagaucagcgccgaccuguggggcggcaccccccugcacgacgccgccgagaacggcgagcuggagugcugccagauccugguggugaacggcgccgagcuggacgugagagacagagacggcuacaccgccgccgaccugagcgacuucaacggccacagccacugcaccagauaccugagaaccguggagaaccugagcguggagcacagagugcugagcagagaccccagcgccgagcuggaggccaagcagcccgacagcggcaugagcagccccaacaccaccgugagcgugcagccccugaacuucgaccugagcagccccaccagcacccugagcaacuacgacagcugcagcagcagccacagcagcaucaagggccagcacccccccugcggccugagcagcgccagagccgccgacauccagagcuacauggacaugcugaaccccgagcugggccugcccagaggcaccaucggcaagcccaccccccccccccccccccccagcuuccccccccccccccccccccccggcacccagcugcccccccccccccccggcuaccccgcccccaagccccccgugggcccccaggccgccgacaucuacaugcagaccaagaacaagcugagacacguggagaccgaggcccugaagaaggagcugagcagcugcgacggccacgacggccugagaagacaggacagcagcagaaagcccagagccuucagcaagcagcccagcaccggcgacuacuacagacagcugggcagaugccccggcgagacccuggccgccagacccggcauggcccacagcgaggaggccgcccugcugcccggcaaccacgugcccaacggcugcgccgccgaccccaaggccagcagagagcugcccccccccccccccccccccccccccccccugcccgaggccgccagcagccccccccccgcccccccccugccccuggagagcgccggccccggcugcggccagagaagaagcagcagcagcaccggcagcaccaagagcuucaacaugaugagccccaccggcgacaacagcgagcugcuggccgagaucaaggccggcaagagccugaagcccaccccccagagcaagggccugaccaccguguucagcggcaucggccagcccgccuuccagcccgacagcccccugcccagcgugagccccgcccugagccccgugagaagccccaccccccccgccgccggcuuccagccccugcugaacggcagccuggugcccgugccccccaccacccccgcccccggcgugcagcuggacguggaggcccugauccccacccacgacgagcagggcagacccauccccgaguggaagagacaggugauggugagaaagaugcagcugaagaugcaggaggaggaggagcagagaagaaaggaggaggaggaggaggccagacuggccagcaugcccgccuggagaagagaccugcugagaaagaagcuggaggaggagagagagcagaagagaaaggaggaggagagacagaagcaggaggagcugagaagagagaaggagcagagcgagaagcugagaacccugggcuacgacgagagcaagcuggcccccuggcagagacaggugauccugaagaagggcgacaucgccaaguacuaa

SEQ ID NO: 16730 - RNA, 1794 nt, Artificial Sequence
  ESR1__Homo_sapiens__NP_001278159
augaccaugacccugcacaccaaggccagcggcauggcccugcugcaccagauccagggcaacgagcuggagccccugaacagaccccagcugaagaucccccuggagagaccccugggcgagguguaccuggacagcagcaagcccgccguguacaacuaccccgagggcgccgccuacgaguucaacgccgccgccgccgccaacgcccagguguacggccagaccggccugcccuacggccccggcagcgaggccgccgccuucggcagcaacggccugggcggcuuccccccccugaacagcgugagccccagcccccugaugcugcugcacccccccccccagcugagccccuuccugcagccccacggccagcaggugcccuacuaccuggagaacgagcccagcggcuacaccgugagagaggccggcccccccgccuucuacagacccaacagcgacaacagaagacagggcggcagagagagacuggccagcaccaacgacaagggcagcauggccauggagagcgccaaggagaccagauacugcgccgugugcaacgacuacgccagcggcuaccacuacggcguguggagcugcgagggcugcaaggccuucuucaagagaagcauccagggcaacagacacaacgacuacaugugccccgccaccaaccagugcaccaucgacaagaacagaagaaagagcugccaggccugcagacugagaaagugcuacgaggugggcaugaugaagggcggcaucagaaaggacagaagaggcggcagaaugcugaagcacaagagacagagagacgacggcgagggcagaggcgaggugggcagcgccggcgacaugagagccgccaaccuguggcccagcccccugaugaucaagagaagcaagaagaacagccuggcccugagccugaccgccgaccagauggugagcgcccugcuggacgccgagccccccauccuguacagcgaguacgaccccaccagacccuucagcgaggccagcaugaugggccugcugaccaaccuggccgacagagagcuggugcacaugaucaacugggccaagagagugcccggcuucguggaccugacccugcacgaccaggugcaccugcuggagugcgccuggcuggagauccugaugaucggccugguguggagaagcauggagcaccccggcaagcugcuguucgcccccaaccugcugcuggacagaaaccagggcaagugcguggagggcaugguggagaucuucgacaugcugcuggccaccagcagcagauucagaaugaugaaccugcagggcgaggaguucgugugccugaagagcaucauccugcugaacagcggcguguacaccuuccugagcagcacccugaagagccuggaggagaaggaccacauccacagagugcuggacaagaucaccgacacccugauccaccugauggccaaggccggccugacccugcagcagcagcaccagagacuggcccagcugcugcugauccugagccacaucagacacaugagcaacaagggcauggagcaccuguacagcaugaagugcaagaacguggugccccuguacgaccugcugcuggagaugcuggacgcccacagacugcacgcccccaccagcagaggcggcgccagcguggaggagaccgaccagagccaccuggccaccgccggcagcaccagcagccacagccugcagaaguacuacaucaccggcgaggccgagggcuuccccgccaccguguaa

SEQ ID NO: 16731 - RNA, 1446 nt, Artificial Sequence
  ESR2__Homo_sapiens__NP_001201831
auggacaucaagaacagccccagcagccugaacagccccagcagcuacaacugcagccagagcauccugccccuggagcacggcagcaucuacauccccagcagcuacguggacagccaccacgaguaccccgccaugaccuucuacagccccgccgugaugaacuacagcauccccagcaacgugaccaaccuggagggcggccccggcagacagaccaccagccccaacgugcuguggcccacccccggccaccugagcccccugguggugcacagacagcugagccaccuguacgccgagccccagaagagccccuggugcgaggccagaagccuggagcacacccugcccgugaacagagagacccugaagagaaaggugagcggcaacagaugcgccagccccgugaccggccccggcagcaagagagacgcccacuucugcgccgugugcagcgacuacgccagcggcuaccacuacggcguguggagcugcgagggcugcaaggccuucuucaagagaagcauccagggccacaacgacuacaucugccccgccaccaaccagugcaccaucgacaagaacagaagaaagagcugccaggccugcagacugagaaagugcuacgaggugggcauggugaagugcggcagcagaagagagagaugcggcuacagacuggugagaagacagagaagcgccgacgagcagcugcacugcgccggcaaggccaagagaagcggcggccacgcccccagagugagagagcugcugcuggacgcccugagccccgagcagcuggugcugacccugcuggaggccgagcccccccacgugcugaucagcagacccagcgcccccuucaccgaggccagcaugaugaugagccugaccaagcuggccgacaaggagcuggugcacaugaucagcugggccaagaagauccccggcuucguggagcugagccuguucgaccaggugagacugcuggagagcugcuggauggaggugcugaugaugggccugauguggagaagcaucgaccaccccggcaagcugaucuucgcccccgaccuggugcuggacagagacgagggcaagugcguggagggcauccuggagaucuucgacaugcugcuggccaccaccagcagauucagagagcugaagcugcagcacaaggaguaccugugcgugaaggccaugauccugcugaacagcagcauguacccccuggugaccgccacccaggacgccgacagcagcagaaagcuggcccaccugcugaacgccgugaccgacgcccuggugugggugaucgccaagagcggcaucagcagccagcagcagagcaugagacuggccaaccugcugaugcugcugagccacgugagacacgccagauggggcgagaagcaguucauccaccugaagcugagcuaa

SEQ ID NO: 16732 - RNA, 2034 nt, Artificial Sequence
  ESRP1__Homo_sapiens__NP_001030087
augaccgccagccccgacuaccugguggugcuguucggcaucaccgccggcgccaccggcgccaagcugggcagcgacgagaaggagcugauccugcuguucuggaaggugguggaccuggccaacaagaaggugggccagcugcacgaggugcuggugagacccgaccagcuggagcugaccgaggacugcaaggaggagaccaagaucgacguggagagccugagcagcgccagccagcuggaccaggcccugagacaguucaaccagagcgugagcaacgagcugaacaucggcgugggcaccagcuucugccugugcaccgacggccagcugcacgugagacagauccugcaccccgaggccagcaagaagaacgugcugcugcccgagugcuucuacagcuucuucgaccugagaaaggaguucaagaagugcugccccggcagccccgacaucgacaagcuggacguggccaccaugaccgaguaccugaacuucgagaagagcagcagcgugagcagauacggcgccagccagguggaggacaugggcaacaucauccuggccaugaucagcgagcccuacaaccacagauucagcgaccccgagagagugaacuacaaguucgagagcggcaccugcagcaagauggagcugaucgacgacaacaccguggugagagccagaggccugcccuggcagagcagcgaccaggacaucgccagauucuucaagggccugaacaucgccaagggcggcgccgcccugugccugaacgcccagggcagaagaaacggcgaggcccuggugagauucgugagcgaggagcacagagaccuggcccugcagagacacaagcaccacaugggcaccagauacaucgagguguacaaggccaccggcgaggacuuccugaagaucgccggcggcaccagcaacgagguggcccaguuccugagcaaggagaaccaggugaucgugagaaugagaggccugcccuucaccgccaccgccgaggaggugguggccuucuucggccagcacugccccaucaccggcggcaaggagggcauccuguucgugaccuaccccgacggcagacccaccggcgacgccuucgugcuguucgccugcgaggaguacgcccagaacgcccugagaaagcacaaggaccugcugggcaagagauacaucgagcuguucagaagcaccgccgccgaggugcagcaggugcugaacagauucagcagcgccccccugaucccccugcccaccccccccaucauccccgugcugccccagcaguucgugccccccaccaacgugagagacugcaucagacugagaggccugcccuacgccgccaccaucgaggacauccuggacuuccugggcgaguucgccaccgacaucagaacccacggcgugcacauggugcugaaccaccagggcagacccagcggcgacgccuucauccagaugaagagcgccgacagagccuucauggccgcccagaagugccacaagaagaacaugaaggacagauacguggagguguuccagugcagcgccgaggagaugaacuucgugcugaugggcggcacccugaacagaaacggccugagccccccccccugccugagcccccccagcuacaccuuccccgcccccgccgccgugauccccaccgaggccgccaucuaccagcccagcgugauccugaaccccagagcccugcagcccagcaccgccuacuaccccgccggcacccagcuguucaugaacuacaccgccuacuaccccagcccccccggcagccccaacagccugggcuacuuccccaccgccgccaaccugagcggcgugcccccccagcccggcaccguggugagaaugcagggccuggccuacaacaccggcgugaaggagauccugaacuucuuccagggcuaccaguacgccaccgaggacggccugauccacaccaacgaccaggccagaacccugcccaaggagugggugugcaucuaa

SEQ ID NO: 16733 - RNA, 2154 nt, Artificial Sequence
  ESRP2__Homo_sapiens__NP_079215
augacccccccccccccccccccccccccccccggccccgaccccgccgccgaccccgccgccgaccccugccccuggcccggcagccugguggugcuguucggcgccaccgccggcgcccugggcagagaccugggcagcgacgagaccgaccugauccugcugguguggcaggugguggagcccagaagcagacaggugggcacccugcacaagagccuggugagagccgaggccgccgcccugagcacccagugcagagaggccagcggccugagcgccgacagccuggccagagccgagccccuggacaaggugcugcagcaguucagccagcuggugaacggcgacguggcccugcugggcggcggccccuacaugcugugcaccgacggccagcagcugcugagacaggugcugcaccccgaggccagcagaaagaaccuggugcugcccgacauguucuucagcuucuacgaccugagaagagaguuccacaugcagcaccccagcaccugccccgccagagaccugaccguggccaccauggcccagggccugggccuggagaccgacgccaccgaggacgacuucggcgugugggaggugaagaccaugguggccgugauccugcaccugcugaaggagcccagcagccagcuguucagcaagcccgaggugaucaagcagaaguacgagaccggccccugcagcaaggccgacgugguggacagcgagaccguggugagagccagaggccugcccuggcagagcagcgaccaggacguggccagauucuucaagggccugaacguggccagaggcggcguggcccugugccugaacgcccagggcagaagaaacggcgaggcccugaucagauucguggacagcgagcagagagaccuggcccugcagagacacaagcaccacaugggcgugagauacaucgagguguacaaggccaccggcgaggaguucgugaagaucgccggcggcaccagccuggagguggccagauuccugagcagagaggaccaggugauccugagacugagaggccugcccuucagcgccggccccaccgacgugcugggcuuccugggccccgagugccccgugaccggcggcaccgagggccugcuguucgugagacaccccgacggcagacccaccggcgacgccuucgcccuguucgccugcgaggagcuggcccaggccgcccugagaagacacaagggcaugcugggcaagagauacaucgagcuguucagaagcaccgccgccgaggugcagcaggugcugaacagauacgccagcggcccccugcugcccacccugaccgccccccugcugcccauccccuucccccuggcccccggcaccggcagagacugcgugagacugagaggccugcccuacaccgccaccaucgaggacauccugagcuuccugggcgaggccgccgccgacaucagaccccacggcgugcacauggugcugaaccagcagggcagacccagcggcgacgccuucauccagaugaccagcgccgagagagcccuggccgccgcccagagaugccacaagaaggugaugaaggagagauacguggagguggugcccugcagcaccgaggagaugagcagagugcugaugggcggcacccugggcagaagcggcaugagccccccccccugcaagcugcccugccugagcccccccaccuacaccaccuuccaggccacccccacccugauccccaccgagaccgccgcccuguaccccagcagcgcccugcugcccgccgccagagugcccgccgcccccacccccguggccuacuaccccggccccgccacccagcuguaccugaacuacaccgccuacuaccccagcccccccgugagccccaccaccgugggcuaccugaccacccccaccgccgcccuggccagcgcccccaccagcgugcugagccagagcggcgcccuggugagaaugcagggcgugcccuacaccgccggcaugaaggaccugcugagcguguuccaggccuaccagcugcccgccgacgacuacaccagccugaugcccgugggcgacccccccagaaccgugcugcaggcccccaaggagugggugugccuguaa

SEQ ID NO: 16734 - RNA, 1272 nt, Artificial Sequence
  ESRRA__Homo_sapiens__NP_001269379
augagcagccagguggugggcaucgagccccuguacaucaaggccgagcccgccagccccgacagccccaagggcagcagcgagaccgagaccgagccccccguggcccuggcccccggccccgcccccaccagaugccugcccggccacaaggaggaggaggacggcgagggcgccggccccggcgagcagggcggcggcaagcuggugcugagcagccugcccaagagacugugccuggugugcggcgacguggccagcggcuaccacuacggcguggccagcugcgaggccugcaaggccuucuucaagagaaccauccagggcagcaucgaguacagcugccccgccagcaacgagugcgagaucaccaagagaagaagaaaggccugccaggccugcagauucaccaagugccugagagugggcaugcugaaggagggcgugagacuggacagagugagaggcggcagacagaaguacaagagaagacccgagguggacccccugcccuuccccggccccuuccccgccggcccccuggccguggccggcggccccagaaagaccgccgcccccgugaacgcccuggugagccaccugcuggugguggagcccgagaagcuguacgccaugcccgaccccgccggccccgacggccaccugcccgccguggccacccugugcgaccuguucgacagagagaucguggugaccaucagcugggccaagagcauccccggcuucagcagccugagccugagcgaccagaugagcgugcugcagagcguguggauggaggugcuggugcugggcguggcccagagaagccugccccugcaggacgagcuggccuucgccgaggaccuggugcuggacgaggagggcgccagagccgccggccugggcgagcugggcgccgcccugcugcagcuggugagaagacugcaggcccugagacuggagagagaggaguacgugcugcugaaggcccuggcccuggccaacagcgacagcgugcacaucgaggacgccgaggccguggagcagcugagagaggcccugcacgaggcccugcuggaguacgaggccggcagagccggccccggcggcggcgccgagagaagaagagccggcagacugcugcugacccugccccugcugagacagaccgccggcaaggugcuggcccacuucuacggcgugaagcuggagggcaaggugcccaugcacaagcuguuccuggagaugcuggaggccaugauggacuaa

SEQ ID NO: 16735 - RNA, 1527 nt, Artificial Sequence
  ESRRB__Homo_sapiens__NP_004443
augagcagcgacgacagacaccugggcagcagcugcggcagcuucaucaagaccgagcccagcagccccagcagcggcaucgacgcccugagccaccacagccccagcggcagcagcgacgccagcggcggcuucggccuggcccugggcacccacgccaacggccuggacagcccccccauguucgccggcgccggccugggcggcacccccugcagaaagagcuacgaggacugcgccagcggcaucauggaggacagcgccaucaagugcgaguacaugcugaacgccauccccaagagacugugccuggugugcggcgacaucgccagcggcuaccacuacggcguggccagcugcgaggccugcaaggccuucuucaagagaaccauccagggcaacaucgaguacagcugccccgccaccaacgagugcgagaucaccaagagaagaagaaagagcugccaggccugcagauucaugaagugccugaaggugggcaugcugaaggagggcgugagacuggacagagugagaggcggcagacagaaguacaagagaagacuggacagcgagagcagccccuaccugagccugcagaucagcccccccgccaagaagccccugaccaagaucgugagcuaccugcugguggccgagcccgacaagcuguacgccaugcccccccccggcaugcccgagggcgacaucaaggcccugaccacccugugcgaccuggccgacagagagcugguggugaucaucggcugggccaagcacauccccggcuucagcagccugagccugggcgaccagaugagccugcugcagagcgccuggauggagauccugauccugggcaucguguacagaagccugcccuacgacgacaagcugguguacgccgaggacuacaucauggacgaggagcacagcagacuggccggccugcuggagcuguacagagccauccugcagcuggugagaagauacaagaagcugaagguggagaaggaggaguucgugacccugaaggcccuggcccuggccaacagcgacagcauguacaucgaggaccuggaggccgugcagaagcugcaggaccugcugcacgaggcccugcaggacuacgagcugagccagagacacgaggagcccuggagaaccggcaagcugcugcugacccugccccugcugagacagaccgccgccaaggccgugcagcacuucuacagcgugaagcugcagggcaaggugcccaugcacaagcuguuccuggagaugcuggaggccaaggugggccaggagcagcugagaggcagccccaaggacgagagaaugagcagccacgacggcaagugccccuuccagagcgccgccuucaccagcagagaccagagcaacagccccggcauccccaaccccagacccagcagccccaccccccugaacgagagaggcagacagaucagccccagcaccagaacccccggcggccagggcaagcaccuguggcugaccauguaa

SEQ ID NO: 16736 - RNA, 1191 nt, Artificial Sequence
  ESRRG__Homo_sapiens__NP_001230436
augagcaacaaggacagacacaucgacagcagcugcagcagcuucaucaagaccgagcccagcagccccgccagccugaccgacagcgugaaccaccacagccccggcggcagcagcgacgccagcggcagcuacagcagcaccaugaacggccaccagaacggccuggacagccccccccuguaccccagcgcccccauccugggcggcagcggccccgugagaaagcuguacgacgacugcagcagcaccaucguggaggacccccagaccaagugcgaguacaugcugaacagcaugcccaagagacugugccuggugugcggcgacaucgccagcggcuaccacuacggcguggccagcugcgaggccugcaaggccuucuucaagagaaccauccagggcgugagacuggacagagugagaggcggcagacagaaguacaagagaagaaucgacgccgagaacagccccuaccugaacccccagcuggugcagcccgccaagaagcccuacaacaagaucgugagccaccugcugguggccgagcccgagaagaucuacgccaugcccgaccccaccgugcccgacagcgacaucaaggcccugaccacccugugcgaccuggccgacagagagcugguggugaucaucggcugggccaagcacauccccggcuucagcacccugagccuggccgaccagaugagccugcugcagagcgccuggauggagauccugauccugggcgugguguacagaagccugagcuucgaggacgagcugguguacgccgacgacuacaucauggacgaggaccagagcaagcuggccggccugcuggaccugaacaacgccauccugcagcuggugaagaaguacaagagcaugaagcuggagaaggaggaguucgugacccugaaggccaucgcccuggccaacagcgacagcaugcacaucgaggacguggaggccgugcagaagcugcaggacgugcugcacgaggcccugcaggacuacgaggccggccagcacauggaggaccccagaagagccggcaagaugcugaugacccugccccugcugagacagaccagcaccaaggccgugcagcacuucuacaacaucaagcuggagggcaaggugcccaugcacaagcuguuccuggagaugcuggaggccaagguguaa

SEQ ID NO: 16737 - RNA, 1221 nt, Artificial Sequence
  ESX1__Homo_sapiens__NP_703149
auggagagccugagaggcuacacccacagcgacaucggcuacagaagccuggccgugggcgaggacaucgaggaggugaacgacgagaagcugaccgugaccagccugauggccagaggcggcgaggacgaggagaacaccagaagcaagcccgaguacggcaccgaggccgagaacaacgugggcaccgagggcagcgugcccagcgacgaccaggacagagagggcggcggcggccacgagcccgagcagcagcaggaggagcccccccugaccaagcccgagcagcagcaggaggagcccccccugcuggagcugaagcaggagcaggaggagcccccccagaccaccguggagggcccccagcccgccgagggcccccagaccgccgagggcccccagccccccgagagaaagagaagaagaagaaccgccuucacccaguuccagcugcaggagcuggagaacuucuucgacgagagccaguaccccgacgugguggccagagagagacuggccgccagacugaaccugaccgaggacagagugcaggugugguuccagaacagaagagccaaguggaagagaaaccagagagugcugaugcugagaaacaccgccaccgccgaccuggcccacccccuggacauguuccugggcggcgccuacuacgccgcccccgcccuggaccccgcccugugcgugcaccuggugccccagcugcccagaccccccgugcugcccgugccccccaugccccccagaccccccauggugcccaugccccccagaccccccaucgcccccaugccccccauggcccccgugccccccggcagcagaauggcccccgugccccccggccccagaauggcccccgugccccccuggccccccauggcccccgugccccccuggccccccauggcccccgugcccaccggcccccccauggcccccgugccccccggcccccccauggccagagugccccccggcccccccauggccagagugccccccggcccccccauggccccccugccccccggcccccccauggccccccugccccccggcccccccauggccccccugccccccggcccccccauggccccccugccccccagaagccacgugccccacaccggccuggcccccgugcacaucaccugggcccccgugaucaacagcuacuacgccugccccuucuucuaa

SEQ ID NO: 16738 - RNA, 3345 nt, Artificial Sequence
  ESYT1__Homo_sapiens__NP_001171725
auggagagaagccccggcgagggccccagccccagccccauggaccagcccagcgcccccagcgaccccaccgaccagccccccgccgcccacgccaagcccgaccccggcagcggcggccagcccgccggccccggcgccgccggcgaggcccuggccgugcugaccagcuucggcagaagacugcuggugcugauccccguguaccuggccggcgccgugggccugagcgugggcuucgugcuguucggccuggcccuguaccugggcuggagaagagugagagacgagaaggagagaagccugagagccgccagacagcugcuggacgacgaggagcagcugaccgccaagacccuguacaugagccacagagagcugcccgccugggugagcuuccccgacguggagaaggccgaguggcugaacaagaucguggcccagguguggcccuuccugggccaguacauggagaagcugcuggccgagaccguggcccccgccgugagaggcagcaacccccaccugcagaccuucaccuucaccagaguggagcugggcgagaagccccugagaaucaucggcgugaaggugcaccccggccagagaaaggagcagauccugcuggaccugaacaucagcuacgugggcgacgugcagaucgacguggaggugaagaaguacuucugcaaggccggcgugaagggcaugcagcugcacggcgugcugagagugauccuggagccccugaucggcgaccugcccuucgugggcgccgugagcauguucuucaucagaagacccacccuggacaucaacuggaccggcaugaccaaccugcuggacauccccggccugagcagccugagcgacaccaugaucauggacagcaucgccgccuuccuggugcugcccaacagacugcuggugccccuggugcccgaccugcaggacguggcccagcugagaagcccccugcccagaggcaucaucagaauccaccugcuggccgccagaggccugagcagcaaggacaaguacgugaagggccugaucgagggcaagagcgaccccuacgcccuggugagacugggcacccagaccuucugcagcagagugaucgacgaggagcugaacccccaguggggcgagaccuacgaggugauggugcacgaggugcccggccaggagaucgagguggagguguucgacaaggaccccgacaaggacgacuuccugggcagaaugaagcuggacgugggcaaggugcugcaggccagcgugcuggacgacugguucccccugcagggcggccagggccaggugcaccugagacuggaguggcugagccugcugagcgacgccgagaagcuggagcaggugcugcaguggaacuggggcgugagcagcagacccgacccccccagcgccgccauccuggugguguaccuggacagagcccaggaccugcccauggugaccagcgagcuguaccccccccagcugaagaagggcaacaaggagcccaaccccauggugcagcugagcauccaggacgugacccaggagagcaaggccguguacagcaccaacugccccgugugggaggaggccuucagauucuuccugcaggacccccagagccaggagcuggacgugcaggugaaggacgacagcagagcccugacccugggcgcccugacccugccccuggccagacugcugaccgcccccgagcugauccuggaccagugguuccagcugagcagcagcggccccaacagcagacuguacaugaagcuggugaugagaauccuguaccuggacagcagcgagaucugcuuccccaccgugcccggcugccccggcgccugggacguggacagcgagaacccccagagaggcagcagcguggacgccccccccagacccugccacaccacccccgacagccaguucggcaccgagcacgugcugagaauccacgugcuggaggcccaggaccugaucgccaaggacagauuccugggcggccuggugaagggcaagagcgaccccuacgugaagcugaagcuggccggcagaagcuucagaagccacguggugagagaggaccugaaccccagauggaacgagguguucgaggugaucgugaccagcgugcccggccaggagcuggagguggagguguucgacaaggaccuggacaaggacgacuuccugggcagaugcaaggugagacugaccaccgugcugaacagcggcuuccuggacgaguggcugacccuggaggacgugcccagcggcagacugcaccugagacuggagagacugacccccagacccaccgccgccgagcuggaggaggugcugcaggugaacagccugauccagacccagaagagcgccgagcuggccgccgcccugcugagcaucuacauggagagagccgaggaccugccccugagaaagggcaccaagcaccugagccccuacgccacccugaccgugggcgacagcagccacaagaccaagaccaucagccagaccagcgcccccgugugggacgagagcgccagcuuccugaucagaaagccccacaccgagagccuggagcugcaggugagaggcgagggcaccggcgugcugggcagccugagccugccccugagcgagcugcugguggccgaccagcugugccuggacagaugguucacccugagcagcggccagggccaggugcugcugagagcccagcugggcauccuggugagccagcacagcggcguggaggcccacagccacagcuacagccacagcagcagcagccugagcgaggagcccgagcugagcggcggccccccccacaucaccagcagcgcccccgagcugagacagagacugacccacguggacagcccccuggaggcccccgccggcccccugggccaggugaagcugacccugugguacuacagcgaggagagaaagcuggugagcaucgugcacggcugcagaagccugagacagaacggcagagacccccccgaccccuacgugagccugcugcugcugcccgacaagaacagaggcaccaagagaagaaccagccagaagaagagaacccugagccccgaguucaacgagagauucgagugggagcugccccuggacgaggcccagagaagaaagcuggacgugagcgugaagagcaacagcagcuucaugagcagagagagagagcugcugggcaaggugcagcuggaccuggccgagaccgaccugagccagggcguggccagaugguacgaccugauggacaacaaggacaagggcagcagcuaa

SEQ ID NO: 16739 - RNA, 2682 nt, Artificial Sequence
  ESYT2__Homo_sapiens__NP_065779
augaccccccccagcagagccgaggccggcgugagaagaagcagagugcccagcgagggcagauggagaggcgccgagccccccggcaucagcgccagcacccagcccgccagcgccggcagagccgccagacacugcggcgccaugagcggcgccagaggcgagggccccgaggccggcgccggcggcgccggcggcagagccgcccccgagaaccccggcggcgugcugagcguggagcugcccggccugcuggcccagcuggccagaagcuucgcccugcugcugcccguguacgcccugggcuaccugggccugagcuucagcugggugcugcuggcccuggcccugcuggccuggugcagaagaagcagaggccugaaggcccugagacugugcagagcccuggcccugcuggaggacgaggagagaguggugagacugggcgugagagccugcgaccugcccgccugggugcacuuccccgacaccgagagagccgaguggcugaacaagaccgugaagcacauguggcccuucaucugccaguucaucgagaagcuguucagagagaccaucgagcccgccgugagaggcgccaacacccaccugagcaccuucagcuucaccaagguggacgugggccagcagccccugagaaucaacggcgugaagguguacaccgagaacguggacaagagacagaucauccuggaccugcagaucagcuucgugggcaacugcgagaucgaccuggagaucaagagauacuucugcagagccggcgugaagagcauccagauccacggcaccaugagagugauccuggagccccugaucggcgacaugccccuggugggcgcccugagcaucuucuuccugagaaagccccugcuggagaucaacuggaccggccugaccaaccugcuggacgugcccggccugaacggccugagcgacaccaucauccuggacaucaucagcaacuaccuggugcugcccaacagaaucaccgugccccuggugagcgaggugcagaucgcccagcugagauuccccgugcccaagggcgugcugagaauccacuucaucgaggcccaggaccugcagggcaaggacaccuaccugaagggccuggugaagggcaagagcgaccccuacggcaucaucagagugggcaaccagaucuuccagagcagagugaucaaggagaaccugagccccaaguggaacgagguguacgaggcccugguguacgagcaccccggccaggagcuggagaucgagcuguucgacgaggaccccgacaaggacgacuuccugggcagccugaugaucgaccugaucgagguggagaaggagagacugcuggacgagugguucacccuggacgaggugcccaagggcaagcugcaccugagacuggaguggcugacccugaugcccaacgccagcaaccuggacaaggugcugaccgacaucaaggccgacaaggaccaggccaacgacggccugagcagcgcccugcugauccuguaccuggacagcgccagaaaccugcccagcggcaagaagaucagcagcaaccccaaccccguggugcagaugagcgugggccacaaggcccaggagagcaagaucagauacaagaccaacgagcccgugugggaggagaacuucaccuucuucauccacaaccccaagagacaggaccuggagguggaggugagagacgagcagcaccagugcagccugggcaaccugaaggugccccugagccagcugcugaccagcgaggacaugaccgugagccagagauuccagcugagcaacagcggccccaacagcaccaucaagaugaagaucgcccugagagugcugcaccuggagaagagagagagaccccccgaccaccagcacagcgcccaggugaagagacccagcgugagcaaggagggcagaaagaccagcaucaagagccacaugagcggcagccccggccccggcggcagcaacaccgcccccagcacccccgugaucggcggcagcgacaagcccggcauggaggagaaggcccagccccccgaggccggcccccagggccugcacgaccugggcagaagcagcagcagccugcuggccagccccggccacaucagcgugaaggagcccacccccagcaucgccagcgacaucagccugcccaucgccacccaggagcugagacagagacugagacagcuggagaacggcaccacccugggccagagcccccugggccagauccagcugaccaucagacacagcagccagagaaacaagcugaucgugguggugcacgccugcagaaaccugaucgccuucagcgaggacggcagcgaccccuacgugagaauguaccugcugcccgacaagagaagaagcggcagaagaaagacccacgugagcaagaagacccugaaccccguguucgaccagagcuucgacuucagcgugagccugcccgaggugcagagaagaacccuggacguggccgugaagaacagcggcggcuuccugagcaaggacaagggccugcugggcaaggugcugguggcccuggccagcgaggagcuggccaagggcuggacccagugguacgaccugaccgaggacggcaccagaccccaggccaugaccuaa

SEQ ID NO: 16740 - RNA, 2661 nt, Artificial Sequence
  ESYT3__Homo_sapiens__NP_114119
augagagccgaggagcccugcgcccccggcgcccccagcgcccugggcgcccagagaacccccggccccgagcugagacugagcagccagcugcugcccgagcugugcaccuucguggugagagugcuguucuaccugggccccguguaccuggccggcuaccugggccugagcaucaccuggcugcugcugggcgcccugcuguggaugugguggagaagaaacagaagaggcaagcugggcagacuggccgccgccuucgaguuccuggacaacgagagagaguucaucagcagagagcugagaggccagcaccugcccgccuggauccacuuccccgacguggagagaguggagugggccaacaagaucaucagccagaccuggcccuaccugagcaugaucauggagagcaaguucagagagaagcuggagcccaagaucagagagaagagcauccaccugagaaccuucaccuucaccaagcuguacuucggccagaagugccccagagugaacggcgugaaggcccacaccaacaccugcaacagaagaagagugaccguggaccugcagaucugcuacaucggcgacugcgagaucagcguggagcugcagaagauccaggccggcgugaacggcauccagcugcagggcacccugagagugauccuggagccccugcugguggacaagcccuucgugggcgccgugaccguguucuuccugcagaagccccaccugcagaucaacuggaccggccugaccaaccugcuggacgcccccggcaucaacgacgugagcgacagccugcuggaggaccugaucgccacccaccuggugcugcccaacagagugaccgugcccgugaagaagggccuggaccugaccaaccugagauucccccugcccugcggcgugaucagagugcaccugcuggaggccgagcagcuggcccagaaggacaacuuccugggccugagaggcaagagcgaccccuacgccaaggugagcaucggccugcagcacuucagaagcagaaccaucuacagaaaccugaaccccaccuggaacgagguguucgaguucaugguguacgaggugcccggccaggaccuggagguggaccuguacgacgaggacaccgacagagacgacuuccugggcagccugcagaucugccugggcgacgugaugaccaacagagugguggacgagugguucgugcugaacgacaccaccagcggcagacugcaccugagacuggaguggcugagccugcugaccgaccaggaggugcugaccgaggaccacggcggccugagcaccgccauccuggugguguuccuggagagcgccugcaaccugcccagaaaccccuucgacuaccugaacggcgaguacagagccaagaagcugagcagauucgccagaaacaaggugagcaaggaccccagcagcuacgugaagcugagcgugggcaagaagacccacaccagcaagaccugcccccacaacaaggaccccguguggagccagguguucagcuucuucgugcacaacguggccaccgagagacugcaccugaaggugcuggacgacgaccaggagugcgcccugggcaugcuggaggugccccugugccagauccugcccuacgccgaccugacccuggagcagagauuccagcuggaccacagcggccuggacagccugaucagcaugagacuggugcugagauuccugcagguggaggagagagagcugggcagccccuacaccggccccgaggcccugaagaagggcccccugcugaucaagaagguggccaccaaccagggccccaaggcccagccccaggaggagggccccaccgaccugcccugcccccccgaccccgccagcgacaccaaggacgugagcagaagcaccaccaccaccaccagcgccaccaccguggccaccgagcccaccagccaggagaccggccccgagcccaagggcaaggacagcgccaagagauucugcgagcccaucggcgagaagaagagccccgccaccaucuuccugaccgugcccggcccccacagccccggccccaucaagagccccagacccaugaagugccccgccagccccuucgccuggccccccaagagacuggcccccagcaugagcagccugaacagccuggccagcagcugcuucgaccuggccgacaucagccugaacaucgagggcggcgaccugagaagaagacagcugggcgagauccagcugaccgugagauacgugugccugagaagaugccugagcgugcugaucaacggcugcagaaaccugacccccugcaccagcagcggcgccgaccccuacgugagaguguaccugcugcccgagagaaagugggccugcagaaagaagaccagcgugaagagaaagacccuggagccccuguucgacgagaccuucgaguucuucgugcccauggaggaggugaagaagagaagccuggacguggccgugaagaacagcagaccccugggcagccacagaagaaaggagcugggcaaggugcugaucgaccugagcaaggaggaccugaucaagggcuucagccagugguacgagcugacccccaacggccagcccagaagcuaa

SEQ ID NO: 16741 - RNA, 2781 nt, Artificial Sequence
  ETAA1__Homo_sapiens__NP_061875
augagcagaagaagaaagcacgacgacagccccagccccaagaagaccccccacaagaccguggccgccgaggagugcggcagcgugguggagcccggcagaagaagacugagaagcgccagaggcagcuggcccugcggcgccagagagggcccccccggccccgugagacagagagagcagccccccaccgccgcccugugcagcaagagcaaccccgaggagagauacgagacccccaagagagcccugaagauggacagccugagcagcagcuucagcagccccaacgaccccgacggccagaacgacaucuucugggaccagaacagcccccugaccaagcagcugggcaagggcagaaagaagcagaucuacaccaccgacagcgacgagaucagccacaucgugaacagaaucgccccccaggacgagaagcccaccaccaacagcaugcuggacauguggaucggcgagaccgccauccccugcacccccagcguggccaagggcaagagcagagccaagaucagcugcaccaagcugaagacccagagccaggaggaggagcugaugaagcuggccaagcaguucgacaagaacauggaggagcuggacgugauccaggagcagaacaagagaaacuacgacuucacccagaugaucagcgagaccgagauccugagcaacuacaaggacaacauccagauguggagccugcacaacaucgugcccgagaucgacaacgccaccaagaagcccaucaagggcaacaccaagaucagcguggccaacaaccagaacagcagccagaagcccuucgaccagaucgccgaggccgccuucaacgccaucuucgacggcagcacccagaagugcagcggccagcugagccaggagcugcccgaggccuucuggagcaccagcaacaccaccuucgugaagaccaacgcccugaaggaggagaagaucaucaccaacgagacccuggugaucgagaagcugagcaacaagacccccagaagccugagcagccagguggacacccccaucaugaccaagagcugcgugaccagcugcaccaaggagcccgagaccagcaacaaguacaucgacgccuucaccaccagcgacuucgaggacgacugggagaaccugcugggcagcgagcccuucgccaugcagaacaucgacaugcccgagcuguuccccagcaagaccgcccacgugaccgaccagaaggagaucugcaccuucaacagcaagaccgugaagaacaccagcagagccaacaccagccccgacgccagacugggcgacagcaaggugcugcaggaccugagcagcaagaccuacgacagagagcugaucgacgccgaguacagauucagccccaacagcaacaagagcaacaagcugagcaccggcaacaagaugaaguucgagaacagcagcaacaagaucgugauccaggacgagauccagaacugcaucgugaccagcaaccugaccaagaucaaggaggacauccugaccaacagcaccgaggccagcgagagaaagagcgcccugaacaccagauacagcaacgagcagaagaacaagugcauccugaaccagagcaucaaggcccccgugaacaccgaccuguucggcagcgccaaccugggcagcaagaccagcgugagcaaccccaaccagaccagcgccagcaaggugggcagcuucuucgacgacuggaacgaccccagcuucgccaacgagaucaucaaggccugccaccagcuggacaacaccugggaggccgacgacguggacgacgaccugcuguaccaggccugcgacgacaucgagagacugacccagcagcaggacaucagaaaggacagcaagaccagcgagagcaucugcgagaucaacaacaacagcgagcacggcgccaagcugacccagcagcaggacaucagaaaggacagcaagaccagcgagagcaucugcgagaucaacaacaacagcgagcacggcgccaagaacauguucgccaucagcaagcagggcagcaaccuggugcagagcaagcaccugaaccccggcagcaucagcgugcagaccagccugaccaacagcagccagaucgacaagcccaugaagauggagaagggcgagauguacggcaacagccccagauuccugggcgccaccaaccugaccauguacagcaagaucagcaacugccagaucaacaaccugcacgugagcuacaccaacaccgacgugcccauccaggugaacagcagcaagcuggugcugcccggcagcagcagccugaacgugaccagcgaccacaugaacaccgagaucaccaccuacaagaagaagcugagcaccaaccagcccugccacaagaccgugaccgacgaggcccagagcaaccugaacaccaccgugggcuucagcaaguucaccuucaccagaaugaagaacagccagauccugagccaguucaaccagaacugcaucaccggcagcaugagcgacaccaagaucacccagggcguggagaagaagaagggcgugaacccccugcuggaggaggccgugggccagcagagccuggugaagcugagcgagagccugaagcagagcagcaaggaggaggaggagaagaacagaaagugcagccccgaggagauccagagaaagagacaggaggcccuggugagaagaauggccaaggccagagccagcagcgugaacgccgcccccaccagcuuccuguaa

SEQ ID NO: 16742 - RNA, 1272 nt, Artificial Sequence
  ETF1__Homo_sapiens__NP_001269114
augaagcaggacgugcugaacugcaccgagggccccauccacagcaacggcaccagcaugaucagccugaucaucccccccaaggaccagaucagcagaguggccaagaugcuggccgacgaguucggcaccgccagcaacaucaagagcagagugaacagacugagcgugcugggcgccaucaccagcgugcagcagagacugaagcuguacaacaaggugccccccaacggccuggugguguacugcggcaccaucgugaccgaggagggcaaggagaagaaggugaacaucgacuucgagcccuucaagcccaucaacaccagccuguaccugugcgacaacaaguuccacaccgaggcccugaccgcccugcugagcgacgacagcaaguucggcuucaucgugaucgacggcagcggcgcccuguucggcacccugcagggcaacaccagagaggugcugcacaaguucaccguggaccugcccaagaagcacggcagaggcggccagagcgcccugagauucgccagacugagaauggagaagagacacaacuacgugagaaagguggccgagaccgccgugcagcuguucaucagcggcgacaaggugaacguggccggccuggugcuggccggcagcgccgacuucaagaccgagcugagccagagcgacauguucgaccagagacugcagagcaaggugcugaagcugguggacaucagcuacggcggcgagaacggcuucaaccaggccaucgagcugagcaccgaggugcugagcaacgugaaguucauccaggagaagaagcugaucggcagauacuucgacgagaucagccaggacaccggcaaguacugcuucggcguggaggacacccugaaggcccuggagaugggcgccguggagauccugaucguguacgagaaccuggacaucaugagauacgugcugcacugccagggcaccgaggaggagaagauccuguaccugacccccgagcaggagaaggacaagagccacuucaccgacaaggagaccggccaggagcacgagcugaucgagagcaugccccugcuggagugguucgccaacaacuacaagaaguucggcgccacccuggagaucgugaccgacaagagccaggagggcagccaguucgugaagggcuucggcggcaucggcggcauccugagauacagaguggacuuccagggcauggaguaccagggcggcgacgacgaguucuucgaccuggacgacuacuaa

SEQ ID NO: 16743 - RNA, 1002 nt, Artificial Sequence
  ETFA__Homo_sapiens__NP_000117
auguucagagccgccgcccccggccagcugagaagagccgccagccugcugagauuccagagcacccuggugaucgccgagcacgccaacgacagccuggcccccaucacccugaacaccaucaccgccgccaccagacugggcggcgaggugagcugccugguggccggcaccaagugcgacaagguggcccaggaccugugcaagguggccggcaucgccaaggugcugguggcccagcacgacguguacaagggccugcugcccgaggagcugaccccccugauccuggccacccagaagcaguucaacuacacccacaucugcgccggcgccagcgccuucggcaagaaccugcugcccagaguggccgccaagcuggagguggcccccaucagcgacaucaucgccaucaagagccccgacaccuucgugagaaccaucuacgccggcaacgcccugugcaccgugaagugcgacgagaaggugaagguguucagcgugagaggcaccagcuucgacgccgccgccaccagcggcggcagcgccagcagcgagaaggccagcagcaccagccccguggagaucagcgaguggcuggaccagaagcugaccaagagcgacagacccgagcugaccggcgccaaggugguggugagcggcggcagaggccugaagagcggcgagaacuucaagcugcuguacgaccuggccgaccagcugcacgccgccgugggcgccagcagagccgccguggacgccggcuucgugcccaacgacaugcaggugggccagaccggcaagaucguggcccccgagcuguacaucgccgugggcaucagcggcgccauccagcaccuggccggcaugaaggacagcaagaccaucguggccaucaacaaggaccccgaggcccccaucuuccagguggccgacuacggcaucguggccgaccuguucaagguggugcccgagaugaccgagauccugaagaagaaguaa

SEQ ID NO: 16744 - RNA, 1041 nt, Artificial Sequence
  ETFB__Homo_sapiens__NP_001014763
auguaccugagccugugggugaccaucaacaccgugaaccugagaaacacccugagcggccugagaggcgccgugaccaccgugggcaugaucaagagcgacgugcccggcacccaggaguggcuggacgagagaagaagacagggcgaccugccccugcccaccaacagcaaccccgugcugagccuggagcugugcgaccccggccagggccccgcccccuuccaggccgugguggugcugauccagcccggcagaggccuggcccugagacccccccccagcugccuguucccccccgaccccacccccagcccccccgccggccagaucagagugaagcccgacagaaccggcguggugaccgacggcgugaagcacagcaugaaccccuucugcgagaucgccguggaggaggccgugagacugaaggagaagaagcuggugaaggaggugaucgccgugagcugcggccccgcccagugccaggagaccaucagaaccgcccuggccaugggcgccgacagaggcauccacguggaggugccccccgccgaggccgagagacugggcccccugcagguggccagagugcuggccaagcuggccgagaaggagaagguggaccuggugcugcugggcaagcaggccaucgacgacgacugcaaccagaccggccagaugaccgccggcuuccuggacuggccccagggcaccuucgccagccaggugacccuggagggcgacaagcugaagguggagagagagaucgacggcggccuggagacccugagacugaagcugcccgccguggugaccgccgaccugagacugaacgagcccagauacgccacccugcccaacaucaugaaggccaagaagaagaagaucgaggugaucaagcccggcgaccugggcguggaccugaccagcaagcugagcgugaucagcguggaggaccccccccagagaaccgccggcgugaagguggagaccaccgaggaccugguggccaagcugaaggagaucggcagaaucuaa

SEQ ID NO: 16745 - RNA, 1713 nt, Artificial Sequence
  ETFDH__Homo_sapiens__NP_001268666
augcuggugccccuggccaagcugagcugccugggcgugaacauggagagauucgccgaggaggccgacguggugaucgugggcgccggccccgccggccugagcgccgccgugagacugaagcagcuggccguggcccacgagaaggacaucagagugugccugguggagaaggccgcccagaucggcgcccacacccugagcggcgccugccuggaccccggcgccuucaaggagcuguuccccgacuggaaggagaagggcgccccccugaacacccccgugaccgaggacagauucggcauccugaccgagaaguacagaauccccgugcccauccugcccggccugcccaugaacaaccacggcaacuacaucgugagacugggccaccuggugagcuggaugggcgagcaggccgaggcccugggcguggagguguaccccggcuacgccgccgccgaggugcuguuccacgacgacggcagcgugaagggcaucgccaccaacgacgugggcauccagaaggacggcgcccccaaggccaccuucgagagaggccuggagcugcacgccaaggugaccaucuucgccgagggcugccacggccaccuggccaagcagcuguacaagaaguucgaccugagagccaacugcgagccccagaccuacggcaucggccugaaggagcugugggugaucgacgagaagaacuggaagcccggcagaguggaccacaccgugggcuggccccuggacagacacaccuacggcggcagcuuccuguaccaccugaacgagggcgagccccugguggcccugggccugguggugggccuggacuaccagaaccccuaccugagccccuucagagaguuccagagauggaagcaccaccccagcaucagacccacccuggagggcggcaagagaaucgccuacggcgccagagcccugaacgagggcggcuuccagagcauccccaagcugaccuuccccggcggccugcugaucggcugcagccccggcuucaugaacgugcccaagaucaagggcacccacaccgccaugaagagcggcauccuggccgccgagagcaucuucaaccagcugaccagcgagaaccugcagagcaagaccaucggccugcacgugaccgaguacgaggacaaccugaagaacagcuggguguggaaggagcuguacagcgugagaaacaucagacccagcugccacggcgugcugggcguguacggcggcaugaucuacaccggcaucuucuacuggauccugagaggcauggagcccuggacccugaagcacaagggcagcgacuucgagagacugaagcccgccaaggacugcacccccaucgaguaccccaagcccgacggccagaucagcuucgaccugcugagcagcguggcccugagcggcaccaaccacgagcacgaccagcccgcccaccugacccugagagacgacagcauccccgugaacagaaaccugagcaucuacgacggccccgagcagagauucugccccgccggcguguacgaguucgugcccguggagcagggcgacggcuucagacugcagaucaacgcccagaacugcgugcacugcaagaccugcgacaucaaggaccccagccagaacaucaacuggguggugcccgagggcggcggcggccccgccuacaacggcauguaa

SEQ ID NO: 16746 - RNA, 765 nt, Artificial Sequence
  ETHE1__Homo_sapiens__NP_055112
auggccgaggccgugcugagaguggccagaagacagcugagccagagaggcggcagcggcgcccccauccugcugagacagauguucgagcccgugagcugcaccuucaccuaccugcugggcgacagagagagcagagaggccgugcugaucgaccccgugcuggagaccgcccccagagacgcccagcugaucaaggagcugggccugagacugcuguacgccgugaacacccacugccacgccgaccacaucaccggcagcggccugcugagaagccugcugcccggcugccagagcgugaucagcagacugagcggcgcccaggccgaccugcacaucgaggacggcgacagcaucagauucggcagauucgcccuggagaccagagccagccccggccacacccccggcugcgugaccuucgugcugaacgaccacagcauggccuucaccggcgacgcccugcugaucagaggcugcggcagaaccgacuuccagcagggcugcgccaagacccuguaccacagcgugcacgagaagaucuucacccugcccggcgacugccugaucuaccccgcccacgacuaccacggcuucaccgugagcaccguggaggaggagagaacccugaaccccagacugacccugagcugcgaggaguucgugaagaucaugggcaaccugaaccugcccaagccccagcagaucgacuucgccgugcccgccaacaugagaugcggcgugcagacccccaccgccuaa

SEQ ID NO: 16747 - RNA, 777 nt, Artificial Sequence
  ETNK1__Homo_sapiens__NP_001034570
augcugugcggcagacccagaagcagcagcgacaacagaaacuuccugagagagagagccggccugagcagcgccgccgugcagaccagaaucggcaacagcgccgccagcagaagaagccccgccgccagaccccccgugcccgccccccccgcccugcccagaggcagacccggcaccgagggcagcaccagccugagcgcccccgccgugcuggugguggccguggccguggugguggugguggugagcgccguggccugggccauggccaacuacauccacgugccccccggcagccccgaggugcccaagcugaacgugaccgugcaggaccaggaggagcacagaugcagagagggcgcccugagccugcugcagcaccugagaccccacugggacccccaggaggugacccugcagcuguucaccgacggcaucaccaacaagcugaucggcugcuacgugggcaacaccauggaggacguggugcuggugagaaucuacggcaacaagaccgagcugcugguggacagagacgaggaggugaagagcuucagagugcugcaggcccacggcugcgccccccagcuguacugcaccuucaacaacggccugugcuacgaguucauccagggcgaggcccuggaccccaagcacgugugcaaccccgccaucuucagccugagcagccugacccugugcaagggcaagaccaccagaugcuucggccugaccggcugcagaggcagcagacugcugcugagcuucuucuaa

SEQ ID NO: 16748 - RNA, 1185 nt, Artificial Sequence
  ETNK2__Homo_sapiens__NP_001284689
auggccgugccccccagcgccccccagcccagagccagcuuccaccugagaagacacacccccugcccccagugcagcuggggcauggaggagaaggccgccgccagcgccagcugcagagagccccccggcccccccagagccgccgccguggccuacuucggcaucagcguggaccccgacgacauccugcccggcgcccugagacugauccaggagcugagaccccacuggaagcccgagcaggugagaaccaagagauucaccgacggcaucaccaacaagcugguggccugcuacguggaggaggacaugcaggacugcgugcuggugagaguguacggcgagagaaccgagcugcugguggacagagagaacgaggugagaaacuuccagcugcugagagcccacagcugcgcccccaagcuguacugcaccuuccagaacggccugugcuacgaguacaugcagggcguggcccuggagcccgagcacaucagagagcccagacuguucagacugaucgcccuggagauggccaagauccacaccauccacgccaacggcagccugcccaagcccauccuguggcacaagaugcacaacuacuucacccuggugaagaacgagaucaaccccagccugagcgccgacgugcccaagguggaggugcuggagagagagcuggccuggcugaaggagcaccugagccagcuggagagccccgugguguucugccacaacgaccugcugugcaagaacaucaucuacgacagcaucaagggccacgugagauucaucgacuacgaguacgccggcuacaacuaccaggccuucgacaucggcaaccacuucaacgaguucgccggcgugaacgagguggacuacugccuguaccccgccagagagacccagcugcaguggcugcacuacuaccugcaggcccagaagggcauggccgugacccccagagaggugcagagacuguacgugcaggugaacaaguucgcccugggccccagcugcgugagcagcaccaugaccgccagccugcagugcugcagagugggcaacagacacggcgagaucgccagacugacccugagcggccuguuccccggcgugagccugcugcugggcagccugggcccccaccccgagcccgugcugcaccacagacuguaa

SEQ ID NO: 16749 - RNA, 1482 nt, Artificial Sequence
  ETNPPL__Homo_sapiens__NP_001140062
augugcgagcuguacagcaagagagacacccugggccugagaaagaagcacaucggccccagcugcaagguguucuucgccagcgaccccaucaagaucgugagagcccagagacaguacauguucgacgagaacggcgagcaguaccuggacugcaucaacaacguggcccacggcguggugaaggccgcccugaagcagauggagcugcugaacaccaacagcagauuccugcacgacaacaucguggaguacgccaagagacugagcgccacccugcccgagaagcugagcgugugcuacuucaccaacagcggcagcgaggccaacgaccuggcccugagacuggccagacaguucagaggccaccaggacgugaucacccuggaccacgccuaccacggccaccugagcagccugaucgagaucagccccuacaaguuccagaagggcaaggacgugaagaaggaguucgugcacguggcccccacccccgacaccuacagaggcaaguacagagaggaccacgccgacagcgccagcgccuacgccgacgaggugaagaagaucaucgaggacgcccacaacagcggcagaaagaucgccgccuucaucgccgagagcaugcagagcugcggcggccagaucaucccccccgccggcuacuuccagaagguggccgaguacgugcacggcgccggcggcguguucaucgccgacgaggugcaggugggcuucggcagagugggcaagcacuucuggagcuuccagauguacggcgaggacuucgugcccgacaucgugaccaugggcaagcccaugggcaacggccaccccguggccugcguggugaccaccaaggagaucgccgaggccuucagcagcagcggcauggaguacuucaacaccuacggcggcaaccccgugagcugcgccgugggccuggccgugcuggacaucaucgagaacgaggaccugcagggcaacgccaagagagugggcaacuaccugaccgagcugcugaagaagcagaaggccaagcacacccugaucggcgacaucagaggcaucggccuguucaucggcaucgaccuggugaaggaccaccugaagagaacccccgccaccgccgaggcccagcacaucaucuacaagaugaaggagaagagagugcugcugagcgccgacggcccccacagaaacgugcugaagaucaagccccccaugugcuucaccgaggaggacgccaaguucaugguggaccagcuggacagaauccugaccgugcuggaggaggccaugggcaccaagaccgagagcgugaccagcgagaacacccccugcaagaccaagaugcugaaggaggcccacaucgagcugcugagagacagcaccaccgacagcaaggagaaccccagcagaaagagaaacggcaugugcaccgacacccacagccugcugagcaagagacugaagaccuaa

SEQ ID NO: 16750 - RNA, 1458 nt, Artificial Sequence
  ETS1__Homo_sapiens__NP_001137292
augagcuacuucguggacagcgccggcagcagccccgugcccuacagcgcccccagacccgccguggugagacagggccccagcaacaccuacgaggaccccagaaugaacugcggcuuccagagcaacuaccaccagcagagacccugcuaccccuucugggacgagauggccacccaggaggugcccaccggccuggagcacugcgugagcgacauggagugcgccgacgugccccugcugacccccagcagcaaggagaugaugagccaggcccugaaggccaccuucagcggcuucaccaaggagcagcagagacugggcauccccaaggaccccagacaguggaccgagacccacgugagagacugggugaugugggccgugaacgaguucagccugaagggcguggacuuccagaaguucugcaugaacggcgccgcccugugcgcccugggcaaggacugcuuccuggagcuggcccccgacuucgugggcgacauccugugggagcaccuggagauccugcagaaggaggacgugaagcccuaccaggugaacggcgugaaccccgccuaccccgagagcagauacaccagcgacuacuucaucagcuacggcaucgagcacgcccagugcgugccccccagcgaguucagcgagcccagcuucaucaccgagagcuaccagacccugcaccccaucagcagcgaggagcugcugagccugaaguacgagaacgacuaccccagcgugauccugagagacccccugcagaccgacacccugcagaacgacuacuucgccaucaagcaggagguggugacccccgacaacaugugcaugggcagaaccagcagaggcaagcugggcggccaggacagcuucgagagcaucgagagcuacgacagcugcgacagacugacccagagcuggagcagccagagcagcuucaacagccugcagagagugcccagcuacgacagcuucgacagcgaggacuaccccgccgcccugcccaaccacaagcccaagggcaccuucaaggacuacgugagagacagagccgaccugaacaaggacaagcccgugauccccgccgccgcccuggccggcuacaccggcagcggccccauccagcuguggcaguuccugcuggagcugcugaccgacaagagcugccagagcuucaucagcuggaccggcgacggcugggaguucaagcugagcgaccccgacgagguggccagaagauggggcaagagaaagaacaagcccaagaugaacuacgagaagcugagcagaggccugagauacuacuacgacaagaacaucauccacaagaccgccggcaagagauacguguacagauucgugugcgaccugcagagccugcugggcuacacccccgaggagcugcacgccaugcuggacgugaagcccgacgccgacgaguaa

SEQ ID NO: 16751 - RNA, 1830 nt, Artificial Sequence
  ETS2__Homo_sapiens__NP_001243224
augggcagcgcccaguuccagggccugaucacccaggccagacugcccuucggcgccaccagcaccaccgcccccagccugagaaacagcaagggcagauucggcgugagagcccuggcccccgagagaacccccagcgcccccagaaaggugagcgccagacugcccggcagaacccuggccagaaccuggggcagaggccccgcccccggcgccagcggccccgccggcgagggccccagcagagugaccgccggcggcggcggcaagcugagagcccccggcgccgccagacccgccagcggccugcccgacagacuguggcccgcccccagccccagccccggcgcccacagagccgccgccggcgccgagcagccccccagcagacccagcgccggccccgccagaagcggcagaaugaacgacuucggcaucaagaacauggaccagguggcccccguggccaacagcuacagaggcacccugaagagacagcccgccuucgacaccuucgacggcagccuguucgccguguuccccagccugaacgaggagcagacccugcaggaggugcccaccggccuggacagcaucagccacgacagcgccaacugcgagcugccccugcugacccccugcagcaaggccgugaugagccaggcccugaaggccaccuucagcggcuucaagaaggagcagagaagacugggcauccccaagaaccccuggcuguggagcgagcagcaggugugccaguggcugcugugggccaccaacgaguucagccuggugaacgugaaccugcagagauucggcaugaacggccagaugcugugcaaccugggcaaggagagauuccuggagcuggcccccgacuucgugggcgacauccugugggagcaccuggagcagaugaucaaggagaaccaggagaagaccgaggaccaguacgaggagaacagccaccugaccagcgugccccacuggaucaacagcaacacccugggcuucggcaccgagcaggcccccuacggcaugcagacccagaacuaccccaagggcggccugcuggacagcaugugccccgccagcacccccagcgugcugagcagcgagcaggaguuccagauguuccccaagagcagacugagcagcgugagcgugaccuacugcagcgugagccaggacuuccccggcagcaaccugaaccugcugaccaacaacagcggcacccccaaggaccacgacagccccgagaacggcgccgacagcuucgagagcagcgacagccugcugcagagcuggaacagccagagcagccugcuggacgugcagagagugcccagcuucgagagcuucgaggacgacugcagccagagccugugccugaacaagcccaccaugagcuucaaggacuacauccaggagagaagcgaccccguggagcagggcaagcccgugauccccgccgccgugcuggccggcuucaccggcagcggccccauccagcuguggcaguuccugcuggagcugcugagcgacaagagcugccagagcuucaucagcuggaccggcgacggcugggaguucaagcuggccgaccccgacgagguggccagaagauggggcaagagaaagaacaagcccaagaugaacuacgagaagcugagcagaggccugagauacuacuacgacaagaacaucauccacaagaccagcggcaagagauacguguacagauucgugugcgaccugcagaaccugcugggcuucacccccgaggagcugcacgccauccugggcgugcagcccgacaccgaggacuaa

SEQ ID NO: 16752 - RNA, 1365 nt, Artificial Sequence
  ETV1__Homo_sapiens__NP_001156619
auggacggcuucuacgaccagcaggugcccuacauggugaccaacagccagagaggcagaaacugcaacgagaagcccaccaacgugagaaagagaaaguucaucaacagagaccuggcccacgacagcgaggagcuguuccaggaccugagccagcugcaggagaccuggcuggccgaggcccaggugcccgacaacgacgagcaguucgugcccgacuaccaggccgagagccuggccuuccacggccugccccugaagaucaagaaggagccccacagccccugcagcgagaucagcagcgccugcagccaggagcagcccuucaaguucagcuacggcgagaagugccuguacaacgugagcgccuacgaccagaagccccaggugggcaugagacccagcaacccccccacccccagcagcacccccgugagcccccugcaccacgccagccccaacagcacccacacccccaagcccgacagagccuuccccgcccaccugccccccagccagagcauccccgacagcagcuaccccauggaccacagauucagaagacagcugagcgagcccugcaacagcuuccccccccugcccaccaugcccagagagggcagacccauguaccagagacagaugagcgagcccaacauccccuuccccccccagggcuucaagcaggaguaccacgaccccguguacgagcacaacaccauggugggcagcgccgccagccagagcuucccccccccccugaugaucaagcaggagcccagagacuucgccuacgacagcggcugcauguucgagaagggccccagacaguucuacgacgacaccugcguggugcccgagaaguucgacggcgacaucaagcaggagcccggcauguacagagagggccccaccuaccagagaagaggcagccugcagcuguggcaguuccugguggcccugcuggacgaccccagcaacagccacuucaucgccuggaccggcagaggcauggaguucaagcugaucgagcccgaggagguggccagaagauggggcauccagaagaacagacccgccaugaacuacgacaagcugagcagaagccugagauacuacuacgagaagggcaucaugcagaagguggccggcgagagauacguguacaaguucgugugcgaccccgaggcccuguucagcauggccuuccccgacaaccagagaccccugcugaagaccgacauggagagacacaucaacgaggaggacaccgugccccugagccacuucgacgagagcauggccuacaugcccgagggcggcugcugcaacccccaccccuacaacgagggcuacguguacuaa

SEQ ID NO: 16753 - RNA, 432 nt, Artificial Sequence
  ETV3__Homo_sapiens__NP_005231
augaaggccggcugcagcaucguggagaagcccgagggcggcggcggcuaccaguuccccgacugggccuacaagaccgagagcagccccggcagcagacagauccagcuguggcacuucauccuggagcugcugcagaaggaggaguucagacacgugaucgccuggcagcagggcgaguacggcgaguucgugaucaaggaccccgacgagguggccagacuguggggcagaagaaagugcaagccccagaugaacuacgacaagcugagcagagcccugagauacuacuacaacaagagaauccugcacaagaccaagggcaagagauucaccuacaaguucaacuucaacaagcuggugaugcccaacuaccccuucaucaacaucagaagcagcggcaagauccagacccugcuggugggcaacuaa

SEQ ID NO: 16754 - RNA, 1455 nt, Artificial Sequence
  ETV4__Homo_sapiens__NP_001073143
auggagagaagaaugaaggccggcuaccuggaccagcaggugcccuacaccuucagcagcaagagccccggcaacggcagccugagagaggcccugaucggcccccugggcaagcugauggaccccggcagccugcccccccuggacagcgaggaccuguuccaggaccugagccacuuccaggagaccuggcuggccgaggcccaggugcccgacagcgacgagcaguucgugcccgacuuccacagcgagaaccuggccuuccacagccccaccaccagaaucaagaaggagccccagagccccagaaccgaccccgcccugagcugcagcagaaagcccccccugcccuaccaccacggcgagcagugccuguacagcagcgccuacgacccccccagacagaucgccaucaagagccccgcccccggcgcccugggccagagcccccugcagcccuuccccagagccgagcagagaaacuuccugagaagcagcggcaccagccagccccaccccggccacggcuaccugggcgagcacagcagcguguuccagcagccccuggacaucugccacagcuucaccagccagggcggcggcagagagccccugcccgcccccuaccagcaccagcugagcgagcccugcccccccuacccccagcagagcuucaagcaggaguaccacgacccccuguacgagcaggccggccagcccgccguggaccagggcggcgugaacggccacagauaccccggcgccggcguggugaucaagcaggagcagaccgacuucgccuacgacagcgacgugaccggcugcgccagcauguaccugcacaccgagggcuucagcggccccagccccggcgacggcgccaugggcuacggcuacgagaagccccugagacccuuccccgacgacgugugcguggugcccgagaaguucgagggcgacaucaagcaggagggcgugggcgccuucagagagggcccccccuaccagagaagaggcgcccugcagcuguggcaguuccugguggcccugcuggacgaccccaccaacgcccacuucaucgccuggaccggcagaggcauggaguucaagcugaucgagcccgaggagguggccagacuguggggcauccagaagaacagacccgccaugaacuacgacaagcugagcagaagccugagauacuacuacgagaagggcaucaugcagaagguggccggcgagagauacguguacaaguucgugugcgagcccgaggcccuguucagccuggccuuccccgacaaccagagacccgcccugaaggccgaguucgacagacccgugagcgaggaggacaccgugccccugagccaccuggacgagagccccgccuaccugcccgagcuggccggccccgcccagcccuucggccccaagggcggcuacagcuacuaa

SEQ ID NO: 16755 - RNA, 1533 nt, Artificial Sequence
  ETV5__Homo_sapiens__NP_004445
auggacggcuucuacgaccagcaggugcccuucauggugcccggcaagagcagaagcgaggagugcagaggcagacccgugaucgacagaaagagaaaguuccuggacaccgaccuggcccacgacagcgaggagcuguuccaggaccugagccagcugcaggaggccuggcuggccgaggcccaggugcccgacgacgagcaguucgugcccgacuuccagagcgacaaccuggugcugcacgcccccccccccaccaagaucaagagagagcugcacagccccagcagcgagcugagcagcugcagccacgagcaggcccugggcgccaacuacggcgagaagugccuguacaacuacugcgccuacgacagaaagccccccagcggcuucaagccccugaccccccccaccaccccccugagccccacccaccagaacccccuguucccccccccccaggccacccugcccaccagcggccacgcccccgccgccggccccgugcagggcgugggccccgcccccgccccccacagccugcccgagcccggcccccagcagcagaccuucgccgugcccagacccccccaccagccccugcagaugcccaagaugaugcccgagaaccaguaccccagcgagcagagauuccagagacagcugagcgagcccugccaccccuuccccccccagcccggcgugcccggcgacaacagacccagcuaccacagacagaugagcgagcccaucgugcccgccgcccccccccccccccagggcuucaagcaggaguaccacgacccccuguacgagcacggcgugcccggcaugcccggcccccccgcccacggcuuccagagccccaugggcaucaagcaggagcccagagacuacugcguggacagcgaggugcccaacugccagagcagcuacaugagaggcggcuacuucagcagcagccacgagggcuucagcuacgagaaggaccccagacuguacuucgacgacaccugcguggugcccgagagacuggagggcaaggugaagcaggagcccaccauguacagagagggcccccccuaccagagaagaggcagccugcagcuguggcaguuccuggugacccugcuggacgaccccgccaacgcccacuucaucgccuggaccggcagaggcauggaguucaagcugaucgagcccgaggagguggccagaagauggggcauccagaagaacagacccgccaugaacuacgacaagcugagcagaagccugagauacuacuacgagaagggcaucaugcagaagguggccggcgagagauacguguacaaguucgugugcgaccccgacgcccuguucagcauggccuuccccgacaaccagagacccuuccugaaggccgagagcgagugccaccugagcgaggaggacacccugccccugacccacuucgaggacagccccgccuaccugcuggacauggacagaugcagcagccugcccuacgccgagggcuucgccuacuaa

SEQ ID NO: 16756 - RNA, 1359 nt, Artificial Sequence
  ETV6__Homo_sapiens__NP_001978
augagcgagacccccgcccagugcagcaucaagcaggagagaaucagcuacaccccccccgagagccccgugcccagcuacgccagcagcaccccccugcacgugcccgugcccagagcccugagaauggaggaggacagcaucagacugcccgcccaccugagacugcagcccaucuacuggagcagagacgacguggcccaguggcugaagugggccgagaacgaguucagccugagacccaucgacagcaacaccuucgagaugaacggcaaggcccugcugcugcugaccaaggaggacuucagauacagaagcccccacagcggcgacgugcuguacgagcugcugcagcacauccugaagcagagaaagcccagaauccuguucagccccuucuuccaccccggcaacagcauccacacccagcccgaggugauccugcaccagaaccacgaggaggacaacugcgugcagagaacccccagacccagcguggacaacgugcaccacaacccccccaccaucgagcugcugcacagaagcagaagccccaucaccaccaaccacagacccagccccgaccccgagcagagaccccugagaagcccccuggacaacaugaucagaagacugagccccgccgagagagcccagggccccagaccccaccaggagaacaaccaccaggagagcuacccccugagcgugagccccauggagaacaaccacugccccgccagcagcgagagccaccccaagcccagcagccccagacaggagagcaccagagugauccagcugaugcccagccccaucaugcacccccugauccugaaccccagacacagcguggacuucaagcagagcagacugagcgaggacggccugcacagagagggcaagcccaucaaccugagccacagagaggaccuggccuacaugaaccacaucauggugagcgugagcccccccgaggagcacgccaugcccaucggcagaaucgccgacugcagacugcugugggacuacguguaccagcugcugagcgacagcagauacgagaacuucaucagaugggaggacaaggagagcaagaucuucagaaucguggaccccaacggccuggccagacuguggggcaaccacaagaacagaaccaacaugaccuacgagaagaugagcagagcccugagacacuacuacaagcugaacaucaucagaaaggagcccggccagagacugcuguucagauucaugaagacccccgacgagaucaugagcggcagaaccgacagacuggagcaccuggagagccaggagcuggacgagcagaucuaccaggaggacgagugcuaa

SEQ ID NO: 16757 - RNA, 954 nt, Artificial Sequence
  ETV7__Homo_sapiens__NP_001193964
augcaggagggcgagcuggccaucagccccaucagccccguggccgccaugcccccccugggcacccacgugcaggccagaugcgaggcccagaucaaccugcugggcgagggcggcaucugcaagcugcccggcagacugagaauccagcccgcccuguggagcagagaggacgugcugcacuggcugagaugggccgagcaggaguacagccugcccugcaccgccgagcacggcuucgagaugaacggcagagcccugugcauccugaccaaggacgacuucagacacagagcccccagcagcggcgacgugcuguacgagcugcugcaguacaucaagacccagagaagagcccuggugugcggccccuucuucggcggcaucuucagacugaagacccccacccagcacagccccgugccccccgaggaggugaccggccccagccagauggacaccagaagaggccaccugcugcagccccccgaccccggccugaccagcaacuucggccaccuggacgaccccggccuggccagauggacccccggcaaggaggagagccugaaccugugccacugcgccgagcugggcugcagaacccagggcgugugcagcuuccccgccaugccccaggcccccaucgacggcagaaucgccgacugcagacugcugugggacuacguguaccagcugcugcuggacaccagauacgagcccuacaucaagugggaggacaaggacgccaagaucuucagagugguggaccccaacggccuggccagacuguggggcaaccacaagaacagagugaacaugaccuacgagaagaugagcagagcccugagacacuacuacaagcugaacaucaucaagaaggagcccggccagaagcugcuguucagaaacggccugcagcugaucuucaucuucaucuggagcuuccaguaa

SEQ ID NO: 16758 - RNA, 459 nt, Artificial Sequence
  EVA1A__Homo_sapiens__NP_115557
augagacugccccugagccacagccccgagcacguggagauggcccugcugagcaacauccuggccgccuacagcuucgugagcgagaaccccgagagagccgcccuguacuucgugagcggcgugugcaucggccuggugcugacccuggccgcccuggugaucagaaucagcugccacaccgacugcagaagaagacccggcaagaaguuccugcaggacagagagagcagcagcgacagcagcgacagcgaggacggcagcgaggacaccgugagcgaccugagcgugagaagacacagaagauucgagagaacccugaacaagaacguguucaccagcgccgaggagcuggagagagcccagagacuggaggagagagagagaaucaucagagagaucuggaugaacggccagcccgaggugcccggcaccagaagccugaacagauacuacuaa

SEQ ID NO: 16759 - RNA, 1326 nt, Artificial Sequence
  EVA1C__Homo_sapiens__NP_478067
augcugcugcccggcagagccagacagccccccaccccccagcccgugcagcaccccggccugagaagacagguggagccccccggccagcugcugagacuguucuacugcaccgugcuggugugcagcaaggagaucagcgcccugaccgacuucagcggcuaccugaccaagcugcugcagaaccacaccaccuacgccugcgacggcgacuaccugaaccugcagugccccagacacagcaccaucagcgugcagagcgccuucuacggccaggacuaccagaugugcagcagccagaagcccgccagccagagagaggacagccugaccugcguggccgccaccaccuuccagaaggugcuggacgagugccagaaccagagagccugccaccugcuggugaacagcagaguguucggccccgaccugugccccggcagcagcaaguaccugcuggugagcuucaagugccagcccaacgagcugaagaacaagaccgugugcgaggaccaggagcugaagcugcacugccacgagagcaaguuccugaacaucuacagcgccaccuacggcagaagaacccaggagagagacaucugcagcagcaaggccgagagacugccccccuucgacugccugagcuacagcgcccugcaggugcugagcagaagaugcuacggcaagcagagaugcaagaucaucgugaacaaccaccacuucggcagccccugccugcccggcgugaagaaguaccugaccgugaccuacgccugcgugcccaagaacauccugaccgccaucgaccccgccaucgccaaccugaagcccagccugaagcagaaggacggcgaguacggcaucaacuucgaccccagcggcagcaaggugcugagaaaggacggcauccuggugagcaacagccuggccgccuucgccuacaucagagcccaccccgagagagccgcccugcuguucgugagcagcgugugcaucggccuggcccugacccugugcgcccuggugaucagagagagcugcgccaaggacuucagagaccugcagcugggcagagagcagcuggugcccggcagcgacaagguggaggaggacagcgaggacgaggaggaggaggaggaccccagcgagagcgacuuccccggcgagcugagcggcuucugcagaaccagcuaccccaucuacagcagcaucgaggccgccgagcuggccgagagaaucgagagaagagagcagaucauccaggagaucuggaugaacagcggccuggacaccagccugcccagaaacaugggccaguucuacuaa

SEQ ID NO: 16760 - RNA, 3687 nt, Artificial Sequence
  EVC2__Homo_sapiens__NP_001159608
augaucuggcccaagguggagugcugccacuucaagaccgccguggaggccccccugggcaugaagcuggacaagaagauggagguguucaucccccugagcaccagcgccgccagcagcggccccugggcccacagccuguucgccuucauccccagcuggcccaagaagaaccuguucaagagagagagccccaucacccacagacuguacggcgacaucagcagagaggugcagggcaccagcgagaacggcgugaucuuccagaagugcgcccuggugagcggcagcagcgaggcccagaccgccagaaucuggcugcuggugaacaacaccaagaccaccagcagcgccaaccugagcgagcugcugcugcuggacagcaucgccggccugaccaucugggacagcgugggcaacagaaccagcgagggcuuccaggccuucagcaagaaguuccugcaggugggcgacgccuucgccgugagcuacgccgccacccugcaggccggcgaccugggcaacggcgagagccugaagcugcccgcccagcugaccuuccagagcagcagcagaaacagaacccagcugaaggugcuguucagcaucaccgccgaggagaacgugaccgugcugccccaccacggccugcacgccgccggcuucuucaucgccuuccugcugagccuggugcugaccugggccgcccuguuccugauggugagauaccagugccugaagggcaacaugcugaccagacacagaguguggcaguacgagagcaagcuggagccccugcccuucaccagcgccgacggcgugaacgaggaccugagccugaacgaccagaugaucgacauccugagcagcgaggaccccggcagcaugcugcaggcccuggaggagcuggagaucgccacccugaacagagccgacgccgaccuggaggccugcagaacccagaucagcaaggacaucaucgcccugcugcugaagaaccugaccagcagcggccaccugagcccccagguggagagaaagaugagcgccguguucaagaagcaguuccugcugcuggagaacgagauccaggaggaguacgacagaaagaugguggcccugaccgccgagugcgaccuggagaccagaaagaagauggagaaccaguaccagagagagaugauggccauggaggaggccgaggagcugcugaagagagccggcgagagaagcgccguggagugcagcaaccugcugagaacccugcacggccuggagcaggagcaccugagaaagagccuggcccugcagcaggaggaggacuucgccaaggcccacagacagcuggccguguuccagagaaacgagcugcacagcaucuucuucacccagaucaagagcgccaucuucaagggcgagcugaagcccgaggccgccaagaugcugcugcagaacuacagcaagauccaggagaacguggaggagcugauggacuucuuccaggccagcaagagauaccaccugagcaagagauucggccacagagaguaccuggugcagaaccugcagagcagcgagaccagagugcagggccugcugagcaccgccgccgcccagcugacccaccugauccagaagcacgagagagccggcuaccuggacgaggaccagauggagaugcugcuggagagagcccagaccgagguguucagcaucaagcagaagcuggacaacgaccugaagcaggagaagaagaagcugcaccagaagcugaucaccaagagaagaagagagcugcugcagaagcacagagagcagagaagagagcaggccagcgugggcgaggccuucagaaccguggaggacgccggccaguaccugcaccagaagagaagccugauggaggagcacggcgccacccuggaggagcugcaggagagacuggaccaggccgcccuggacgaccugagaacccugacccugagccuguucgagaaggccaccgacgagcugagaagacugcagaacagcgccaugacccaggagcugcugaagagaggcgugcccuggcuguuccugcagcagauccuggaggagcacggcaaggagauggccgccagagccgagcagcuggagggcgaggagagagacagagaccaggagggcgugcagagcgugagacagagacugaaggacgacgcccccgaggccgugaccgaggagcaggccgagcugagaagaugggagcaccugaucuucaugaagcugugcagcagcguguucagccugagcgaggaggagcugcugagaaugagacaggaggugcacggcugcuucgcccagauggacagaagccuggcccugcccaagaucagagccagagugcugcugcagcaguuccagaccgccuggagagaggccgaguucgugaagcuggaccaggccguggccgcccccgagcugcagcagcagagcaaggugagaaagagcagaagcaagagcaagagcaagggcgagcugcugaagaagugcaucgaggacaagauccaccugugcgaggagcaggccagcgaggaccugguggagaaggugagaggcgagcugcugagagagagagugcagagaauggaggcccaggagggcggcuucgcccagagccugguggcccugcaguuccagaaggccagcagagugaccgagacccugagcgccuacaccgcccugcugagcauccaggaccugcugcuggaggagcugagcgccagcgagaugcugaccaagagcgccugcacccagauccuggagagccacagcagagagcugcaggagcuggagagaaagcuggaggaccagcuggugcagcaggaggccgcccagcagcagcaggcccuggccagcuggcagcaguggguggccgacggccccggcauccugaacgagcccggcgagguggacagcgagagacaggugagcaccgugcugcaccaggcccugagcaagagccagacccugcuggagcagcaccagcagugccugagagaggagcagcagaacagcguggugcuggaggaccugcuggagaacauggaggccgacaccuucgccacccugugcagccaggagcugagacuggccagcuaccuggccagaauggccauggugcccggcgccacccugagaagacugcugagcguggugcugcccaccgccagccagccccagcugcuggcccugcuggacagcgccaccgagagacacguggaccacgccgccgagagcgacggcggcgccgagcaggccgacgugggcagaagaagaaagcaccagagcugguggcaggcccuggacggcaagcugagaggcgaccugaucagcagaggccuggagaagaugcugugggccagaaagagaaagcagagcauccugaagaagaccugccugccccugagagagagaaugaucuucagcggcaagggcagcuggccccaccugagccuggagcccaucggcgagcuggcccccgugcccaucgugggcgccgagaccaucgaccugcugaacaccggcgagaagcuguucaucuucagaaaccccaaggagcccgagaucagccugcacgugccccccagaaagaagaagaacuuccugaacgccaagaaggccaugagagcccugggcauggacuaa

SEQ ID NO: 16761 - RNA, 2979 nt, Artificial Sequence
  EVC__Homo_sapiens__NP_714928
auggccagaggcggcgccgccugcaagagcgacgccagacugcugcugggcagagacgcccugagacccgcccccgcccugcuggcccccgccgugcugcugggcgccgcccugggccugggccugggccuguggcugggcugcagagccggcagacagagaaccagacaccagaaggacgacacccagaaccugcugaagaaccuggagagcaacgcccagacccccagcgagaccggcagccccagcagaagaagaaagagagaggugcagaugagcaaggacaaggaggccguggacgagugcgagccccccagcaacagcaacaucaccgccuucgcccugaaggccaaggugaucuaccccaucaaccagaaguucagaccccuggccgacggcagcagcaaccccagccugcacgagaaccugaagcaggccgugcugccccaccagcccguggaggccagccccagcagcagccugggcagccugagccagggcgagaaggacgacugcagcagcagcagcagcgugcacagcgccaccagcgacgacagauuccugagcagaaccuuccugagagugaacgccuuccccgaggugcuggccugcgagagcguggacguggaccugugcaucuacagccugcaccugaaggaccugcugcaccuggacaccgcccugagacaggagaagcacaugauguucauccagaucuucaagaugugccugcuggaccugcugcccaagaagaagagcgacgacgagcuguaccagaagauccugagcaagcaggagaaggaccuggaggagcuggagaagggccugcaggugaagcugagcaacaccgagaugagcggcgccggcgacagcgaguacaucacccuggccgacguggagaagaaggagagagaguacagcgagcagcugaucgacaacauggaggccuucuggaagcagauggccaacauccagcacuuccugguggaccaguucaagugcagcagcagcaaggccagacagcugaugaugacccugaccgagagaaugaucgccgccgagggccugcugugcgacagccaggagcugcaggcccuggacgcccuggagagaaccaugggcagagcccacauggccaaggugaucgaguuccugaagcugcaggugcaggaggagaccagaugcagacuggccgccaucagccacggccuggagcugcuggccggcgagggcaagcugagcggcagacagaaggaggagcugcugacccagcagcacaaggccuucuggcaggaggccgagagauucagcagagaguucgugcagagaggcaaggaccuggugaccgccagccuggcccaccagguggagggcaccgccaagcugacccuggcccaggaggaggagcagagaagcuuccuggccgaggcccagcccaccgccgaccccgagaaguuccuggaggccuuccacgaggugcuggagagacagagacugaugcagugcgaccuggaggaggaggagaacgugagagccaccgaggccgugguggcccugugccaggagcuguacuucagcaccguggacaccuuccagaaguucguggacgcccuguuccugcagacccugcccggcaugaccggccugccccccgaggagugcgacuaccugagacaggaggugcaggagaacgccgccuggcagcugggcaagagcaacagauucagaagacagcaguggaagcuguuccaggagcugcuggagcaggaccagcagguguggauggaggagugcgcccugagcagcgugcugcagacccaccugagagaggaccacgagggcaccaucagaggcgugcugggcagacugggcggccugaccgaggagagcaccagaugcgugcugcagggccacgaccugcugcugagaagcgcccugagaagacuggcccugagaggcaacgcccuggccacccugacccagaugagacugagcggcaagaagcaccugcugcaggagcugagagagcagagagcccuggagcagggcagcagccagugccuggacgagcaccaguggcagcugcugagagcccuggaggccagagugcuggaggaggccagcagacuggaggaggaggcccagcagaccagacugcagcugcagcagagacugcuggccgaggcccaggaggugggccagcugcugcagcagcacauggagugcgccaucggccaggcccugcuggugcacgccagaaacgccgccaccaagagcagagccaaggacagagacgacuucaagagaacccugauggaggccgccguggagagcguguacgugaccagcgccggcgugagcagacuggugcaggccuacuaccagcagaucggcagaaucauggaggaccacgaggagagaaagcugcagcaccugaagacccugcagggcgagagaauggagaacuacaagcugagaaagaagcaggagcugagcaaccccagcagcggcagcagaaccgccggcggcgcccacgagaccagccaggccgugcaccagagaaugcugagccagcagaagagauuccuggcccaguuccccgugcaccagcagaugagacugcacgcccagcagcagcaggccggcgugauggaccugcuggaggcccagcuggagacccagcugcaggaggccgagcagaacuucaucagcgagcuggccgcccuggccagagugccccuggccgagagcaagcugcugcccgccaagagaggccugcuggagaagccccugagaaccaagagaaagaagccccugccccaggagagaggcgaccugggcgugcccaacaacgaggaccuggccagcggcgaccagaccagcggcagccugagcagcaagagacugagccagcaggagagcgaggccggcgacagcggcaacagcaagaagaugcugaagagaagaagcaaccuguaa

SEQ ID NO: 16762 - RNA, 780 nt, Artificial Sequence
  EVI2A__Homo_sapiens__NP_001003927
augcugcugagaagcugguucggcaacaaggacuuccaggcccugcccauccuggccagacugcccagcaugcccaccgacauggagcacaccggccacuaccugcaccuggccuuccugaugaccaccguguucagccugagccccggcaccaaggccaacuacaccagacugugggccaacagcaccagcagcugggacagcgugauccagaacaagaccggcagaaaccagaacgagaacaucaacaccaaccccaucacccccgagguggacuacaagggcaacagcaccaacaugcccgagaccagccacaucguggcccugaccagcaagagcgagcaggagcuguacauccccagcguggugagcaacagccccagcaccgugcagagcaucgagaacaccagcaagagccacggcgagaucuucaagaaggacgugugcgccgagaacaacaacaacauggccaugcugaucugccugaucaucaucgccgugcuguuccugaucugcaccuuccuguuccugagcaccguggugcuggccaacaaggugagcagccugagaagaagcaagcaggugggcaagagacagcccagaagcaacggcgacuuccuggccagcggccuguggcccgccgagagcgacaccuggaagagaaccaagcagcugaccggccccaaccuggugaugcagagcaccggcgugcugaccgccaccagagagagaaaggacgaggagggcaccgagaagcugaccaacaagcagaucggcuaa

SEQ ID NO: 16763 - RNA, 1347 nt, Artificial Sequence
  EVI2B__Homo_sapiens__NP_006486
auggaccccaaguacuucauccugauccuguucugcggccaccugaacaacaccuucuucagcaagaccgagaccaucaccaccgagaagcagagccagcccacccuguucaccagcagcaugagccaggugcuggccaacagccagaacaccaccggcaacccccugggccagcccacccaguucagcgacaccuucagcggccagagcaucagccccgccaaggugaccgccggccagcccacccccgccguguacaccagcagcgagaagcccgaggcccacaccagcgccggccagccccuggccuacaacaccaagcagcccacccccaucgccaacaccagcagccagcaggccguguucaccagcgccagacagcugcccagcgccagaaccagcaccacccagccccccaagagcuucguguacaccuucacccagcagagcagcagcgugcagauccccagcagaaagcagaucaccgugcacaaccccagcacccagcccaccagcaccgugaagaacagccccagaagcacccccggcuucauccuggacaccaccagcaacaagcagaccccccagaagaacaacuacaacagcaucgccgccauccugaucggcgugcugcugaccagcaugcugguggccaucaucaucaucgugcuguggaagugccugagaaagcccgugcugaacgaccagaacugggccggcagaagccccuucgccgacggcgagacccccgacaucugcauggacaacaucagagagaacgagaucagcaccaagagaaccagcaucaucagccugacccccuggaagcccagcaagagcacccugcuggccgacgaccuggagaucaagcuguucgagagcagcgagaacaucgaggacagcaacaaccccaagaccgagaagaucaaggaccaggugaacggcaccagcgaggacagcgccgacggcagcaccgugggcaccgccgugagcagcagcgacgacgccgaccugccccccccccccccccugcuggaccuggagggccaggagagcaaccagagcgacaagcccaccaugaccaucgugagcccccugcccaacgacagcaccagccugccccccagccuggacugccugaaccaggacugcggcgaccacaagagcgagaucauccagagcuuccccccccuggacagccugaaccugccccugccccccguggacuucaugaagaaccaggaggacagcaaccuggagauccagugccaggaguucagcaucccccccaacagcgaccaggaccugaacgagagccugccccccccccccgccgagcugcuguaa

SEQ ID NO: 16764 - RNA, 2685 nt, Artificial Sequence
  EVI5__Homo_sapiens__XP_011540402
augaccagcggcgccagccugaagcugaccagcggcuuccccguggccaccgacaagguggccgagaagcugagcagcacccugagcugggugaagaacaccgugagccacaccgugagccagauggccagccagguggccagccccagcaccagccugcacaccaccagcagcagcaccacccugagcacccccgcccugagccccagcagccccagccagcugagccccgacgaccuggagcugcuggccaagcuggaggagcagaacagacugcuggagaccgacagcaagagccugagaagcgugaacggcagcagaagaaacagcggcagcagccuggugagcagcagcagcgccagcagcaaccugagccaccuggaggaggacagcuggauccuguggggcagaaucgugaacgagugggaggacgugagaaagaagaaggagaagcaggugaagcccuucgagugcugggugcuguaccaccacagccagcugugcagauuccaggugcacuaccugaagagaagccacaccgaggagcuggugcacaagggcaucccccaccacuucagagccaucguguggcagcugcugugcagcgcccagagcaugcccaucaaggaccaguacagcgagcugcugaagaugaccagccccugcgagaagcugaucagaagagacaucgccagaaccuaccccgagcacaacuucuucaaggagaaggacagccugggccaggaggugcuguucaacgugaugaaggccuacagccugguggacagagaggugggcuacugccagggcagcgccuucaucgugggccugcugcugaugcagaugcccgaggaggaggccuucugcguguucgugaagcugaugcaggacuacagacugagagagcuguucaagcccagcauggccgagcugggccugugcauguaccaguucgagugcaugauccaggagcaccugcccgagcuguucgugcacuuccagagccagagcuuccacaccagcauguacgccagcagcugguuccugaccaucuuccugaccaccuucccccugcccaucgccaccagaaucuucgacaucuucaugagcgagggccuggagaucguguucagagugggccuggcccugcugcagaugaaccaggccgagcugaugcagcuggacauggagggcaugcugcagcacuuccagaaggugaucccccaccaguucgacggcgugcccgacaagcugauccaggccgccuaccaggugaaguacaacagcaagaagaugaagaagcuggagaaggaguacaccaccaucaagaccaaggagauggaggagcagguggagaucaagagacugagaaccgagaacagacugcugaagcagagaaucgagacccuggagaaggagagcgccagccuggccgacagacugauccagggccaggugaccagagcccaggaggccgaggagaacuaccugaucaagagagagcuggccaccaucaagcagcagagcgacgaggccagcgccaagcuggagcaggccgagaacaccaucagaaagcugcagcaccagcagcaguggcacaagugcagcagcaacuacaacgaggacuucgugcugcagcuggagaaggagcuggugcaggccagacugagcgaggccgagagccagugcgcccugaaggagaugcaggacaaggugcuggacaucgagaagagaaacaacagccugcccgacgagaacaacaucgccagacugcaggaggagcugaucgccgugaagcugagagaggccgaggccaucaugggccugaaggagcugagacagcaggugaaggaccuggaggagcacuggcagagacaccuggccagaaccaccggcagauggaaggacccccccaagaagaacgccaugaacgagcugcaggacgagcugaugaccaucagacugagagaggccgagacccaggccgagaucagagagaucaagcagagaaugauggagauggagacccagaaccagaucaacagcaaccaccugagaagagccgagcaggaggugaucagccugcaggagaaggugcaguaccugagcgcccagaacaagggccugcugacccagcugagcgaggccaagagaaagcaggccgagaucgagugcaagaacaaggaggaggugauggccgugagacugagagaggccgacagcaucgccgccguggccgagcugagacagcacaucgccgagcuggagauccagaaggaggagggcaagcugcagggccagcugaacaagagcgacagcaaccaguacaucggcgagcugaaggaccagaucgccgagcugaaccacgagcugagaugccugaagggccagagaggcuucagcggccagccccccuucgacggcauccacaucgugaaccaccugaucggcgacgacgagagcuuccacagcagcgacgaggacuucaucgacaacagccugcaggagaccggcgugggcuucccccugcacggcaagagcggcagcaugagccuggaccccgccguggccgacggcagcgagagcgagaccgaggacagcgugcuggagaccagagagagcaaccagguggugcagaaggagagaccccccagaagaagagagagcuacagcaccaccguguaa

SEQ ID NO: 16765 - RNA, 1257 nt, Artificial Sequence
  EVL__Homo_sapiens__NP_057421
auggccaccagcgagcagagcaucugccaggccagagccagcgugaugguguacgacgacaccagcaagaagugggugcccaucaagcccggccagcagggcuucagcagaaucaacaucuaccacaacaccgccagcaacaccuucagaguggugggcgugaagcugcaggaccagcagguggugaucaacuacagcaucgugaagggccugaaguacaaccaggccacccccaccuuccaccaguggagagacgccagacagguguacggccugaacuucgccagcaaggaggaggccaccaccuucagcaacgccaugcuguucgcccugaacaucaugaacagccaggagggcggccccagcagccagagacaggugcagaacggccccagccccgacgagauggacauccagagaagacaggugauggagcagcaccagcagcagagacaggagagccuggagagaagaaccagcgccaccggccccauccugccccccggccaccccagcagcgccgccagcgcccccgugagcugcagcggcccccccccccccccccccccccccgugccccccccccccaccggcgccacccccccccccccccccccccugcccgccggcggcgcccagggcagcagccacgacgagagcagcaugagcggccuggccgccgccaucgccggcgccaagcugagaagagugcagagacccgaggacgccagcggcggcagcagccccagcggcaccagcaagagcgacgccaacagagccagcagcggcggcggcggcggcggccugauggaggagaugaacaagcugcuggccaagagaagaaaggccgccagccagagcgacaagcccgccgagaagaaggaggacgagagccagauggaggaccccagcaccagccccagccccggcaccagagccgccagccagccccccaacagcagcgaggccggcagaaagcccugggagagaagcaacagcguggagaagcccgugagcagcauccugagcagaacccccagcguggccaagagccccgaggccaagagcccccugcagagccagccccacagcagaaugaagcccgccggcagcgugaacgacauggcccuggacgccuucgaccuggacagaaugaagcaggagauccuggaggagguggugagagagcugcacaaggugaaggaggagaucaucgacgccaucagacaggagcugagcggcaucagcaccaccuaa

SEQ ID NO: 16766 - RNA, 6102 nt, Artificial Sequence
  EVPL__Homo_sapiens__NP_001979
auguucaagggccugagcaagggcagccagggcaagggcagccccaagggcagccccgccaagggcagccccaagggcagccccagcagacacagcagagccgccacccaggagcuggcccugcugaucagcagaaugcaggccaacgccgaccagguggagagagacauccuggagacccagaagagacugcagcaggacagacugaacagcgagcagagccaggcccugcagcaccagcaggagaccggcagaagccugaaggaggccgaggugcugcugaaggaccuguuccuggacguggacaaggccagaagacugaagcacccccaggccgaggagaucgagaaggacaucaagcagcugcacgagagagugacccaggagugcgccgaguacagagcccuguacgagaagauggugcugccccccgacgugggccccagaguggacugggccagagugcuggagcagaagcagaagcaggugugcgccggccaguacggccccggcauggccgagcuggagcagcagaucgccgagcacaacauccugcagaaggagaucgacgccuacggccagcagcugagaagccuggugggccccgacgccgccaccaucagaagccaguacagagaccugcugaaggccgccagcuggagaggccagagccugggcagccuguacacccaccugcagggcugcaccagacagcugagcgcccuggccgagcagcagagaagaauccugcagcaggacuggagcgaccugauggccgaccccgccggcgugagaagagaguacgagcacuucaagcagcacgagcugcugagccaggagcagagcgugaaccagcuggaggacgacggcgagagaaugguggagcugagacaccccgccgugggccccauccaggcccaccaggaggcccugaagauggaguggcagaacuuccugaaccugugcaucugccaggagacccagcugcagcacguggaggacuacagaagauuccaggaggaggccgacagcgugagccagacccuggccaagcugaacagcaaccuggacgccaaguacagccccgcccccggcggcccccccggcgcccccaccgagcugcugcagcagcuggaggccgaggagaagagacuggccgugaccgagagagccaccggcgaccugcagagaagaagcagagacguggccccccugccccagagaagaaaccccccccagcagccccugcacguggacagcaucugcgacugggacagcggcgaggugcagcugcugcagggcgagagauacaagcugguggacaacaccgacccccacgccuggguggugcagggccccggcggcgagaccaagagagcccccgccgccugcuucugcauccccgcccccgaccccgacgccguggccagagccagcagacuggccagcgagcugcaggcccugaagcagaagcuggccaccgugcagagcagacugaaggccagcgccguggagagccugagacccagccagcaggcccccagcggcagcgaccuggccaacccccaggcccagaagcugcugacccagaugaccagacuggacggcgaccugggccagaucgagagacaggugcuggccugggccagagccccccugagcagacccaccccccuggaggaccuggagggcagaauccacagccacgagggcaccgcccagagacugcagagccugggcaccgagaaggagaccgcccagaaggagugcgaggccuuccugagcaccagacccgugggccccgccgcccugcagcugcccguggcccugaacagcgugaagaacaaguucagcgacgugcaggugcugugcagccuguacggcgagaaggccaaggccgcccuggaccuggagagacagauccaggacgccgacagagugaucagaggcuucgaggccacccuggugcaggaggcccccauccccgccgagcccggcgcccugcaggagagagugagcgagcugcagagacagagaagagagcugcuggagcagcagaccugcgugcugagacugcacagagcccugaaggccagcgagcacgccugcgccgcccugcagaacaacuuccaggaguucugccaggaccugcccagacagcagagacaggugagagcccugaccgacagauaccacgccgugggcgaccagcuggaccugagagagaagguggugcaggacgccgcccugaccuaccagcaguucaagaacugcaaggacaaccugagcagcuggcuggagcaccugcccagaagccaggugagacccagcgacggccccagccagaucgccuacaagcugcaggcccagaagagacugacccaggagauccagagcagagagagagacagagccaccgccagccaccugagccaggcccugcaggccgcccugcaggacuacgagcugcaggccgacaccuacagaugcagccuggagcccacccuggccgugagcgcccccaagagacccagaguggccccccugcaggagagcauccaggcccaggagaagaaccuggccaaggccuacaccgagguggccgccgcccagcagcagcugcugcagcagcuggaguucgccagaaagaugcuggagaagaaggagcugagcgaggacaucagaagaacccacgacgccaagcagggcagcgagagccccgcccaggccggcagagagagcgaggcccugaaggcccagcuggaggaggagagaaagagaguggccagagugcagcacgagcuggaggcccagagaagccagcugcugcagcugagaacccagagaccccuggagagacuggaggagaaggaggugguggaguucuacagagacccccagcuggagggcagccugagcagagugaaggcccagguggaggaggagggcaagagaagagccggccugcaggccgaccuggagguggccgcccagaagguggugcagcuggagagcaagagaaagaccaugcagccccaccugcugaccaaggaggugacccagguggagagagaccccggccuggacagccaggccgcccagcugagaauccagauccagcagcugagaggcgaggacgccgugaucagcgccagacuggagggccugaagaaggagcugcuggcccuggagaagagagagguggacgugaaggagaaggugguggugaaggagguggugaagguggagaagaaccuggagauggugaaggccgcccaggcccugagacugcagauggaggaggacgccgccagaagaaagcaggccgaggaggccguggccaagcugcaggccagaaucgaggaccuggagagagccaucagcagcguggagcccaaggugaucgugaaggaggugaagaagguggagcaggaccccggccugcugcaggagagcagcagacugagaagccugcuggaggaggagagaaccaagaacgccacccuggccagagagcugagcgaccugcacagcaaguacagcgugguggagaagcagagacccaaggugcagcugcaggagagagugcacgagaucuuccagguggaccccgagaccgagcaggagaucaccagacugaaggccaagcugcaggagauggccggcaagagaagcggcguggagaaggagguggagaagcugcugcccgaccuggaggugcugagagcccagaagcccaccguggaguacaaggaggugacccaggagguggugagacacgagagaagccccgaggugcugagagagaucgacagacugaaggcccagcugaacgagcuggugaacagccacggcagaagccaggagcagcugaucagacugcagggcgagagagacgaguggagaagagagagagccaagguggagaccaagaccgugagcaaggagguggugagacacgagaaggaccccgugcuggagaaggaggccgagagacugagacaggaggugagagaggccgcccagaagagaagagccgccgaggacgccguguacgagcugcagagcaagagacugcugcuggagagaagaaagcccgaggagaaggugguggugcaggaggugguggugacccagaaggaccccaagcugagagaggagcacagcagacugagcggcagccuggacgaggaggugggcagaagaagacagcuggagcuggaggugcagcagcugagagccggcguggaggagcaggagggccugcugagcuuccaggaggacagaagcaagaagcuggccguggagagagagcugagacagcugacccugagaauccaggagcuggagaagagaccccccaccgugcaggagaagaucaucauggaggagguggugaagcuggagaaggaccccgaccuggagaagagcaccgaggcccugagaugggaccuggaccaggagaagacccaggugaccgagcugaacagagagugcaagaaccugcaggugcagaucgacgugcugcagaaggccaagagccaggagaagaccaucuacaaggaggugaucagagugcagaaggacagagugcuggaggacgagagagccagagugugggagaugcugaacagagagagaaccgccagacaggccagagaggaggaggccagaagacugagagagagaaucgacagagccgagacccugggcagaaccuggagcagagaggagagcgagcugcagagagccagagaccaggccgaccaggagugcggcagacugcagcaggagcugagagcccuggagagacagaagcagcagcagacccugcagcugcaggaggagagcaagcugcugagccagaagaccgagagcgagagacagaaggccgcccagagaggccaggagcugagcagacuggaggccgccauccugagagagaaggaccagaucuacgagaaggagagaacccugagagaccugcacgccaaggugagcagagaggagcugagccaggagacccagaccagagagaccaaccugagcaccaagaucagcauccuggagcccgagaccggcaaggacaugagccccuacgaggccuacaagagaggcaucaucgacagaggccaguaccugcagcugcaggagcuggagugcgacugggaggaggugaccaccagcggccccugcggcgaggagagcgugcugcuggacagaaagagcggcaagcaguacagcaucgaggccgcccugagaugcagaagaaucagcaaggaggaguaccaccuguacaaggacggccaccugcccaucagcgaguucgcccugcugguggccggcgagaccaagcccagcagcagccugagcaucggcagcaucaucagcaagagcccccuggccagccccgccccccagagcaccagcuucuucagccccagcuucagccugggccugggcgacgacagcuuccccaucgccggcaucuacgacaccaccaccgacaacaagugcagcaucaagaccgccguggccaagaacaugcuggaccccaucaccggccagaagcugcuggaggcccaggccgccaccggcggcaucguggaccugcugagcagagagagauacagcgugcacaaggccauggagagaggccugaucgagaacaccagcacccagagacugcugaacgcccagaaggccuucaccggcaucgaggaccccgugaccaagaagagacugagcgugggcgaggccgugcagaagggcuggaugcccagagagagcgugcugccccaccugcaggugcagcaccugaccggcggccugaucgaccccaagagaaccggcagaauccccauccagcaggcccugcugagcggcaugaucagcgaggagcuggcccagcugcugcaggacgagagcagcuacgagaaggaccugaccgaccccaucagcaaggagagacugagcuacaaggaggccaugggcagaugcagaaaggacccccugagcggccugcugcugcugcccgccgcccuggagggcuacagaugcuacagaagcgccagccccaccgugcccagaagccugagauaa

SEQ ID NO: 16767 - RNA, 678 nt, Artificial Sequence
  EVX1__Homo_sapiens__NP_001291449
augagaagauacagaaccgccuucaccagagagcagaucgccagacuggagaaggaguucuacagagagaacuacgugagcagacccagaagaugcgagcuggccgccgcccugaaccugcccgagaccaccaucaaggugugguuccagaacagaagaaugaaggacaagagacagagacuggccaugaccuggccccaccccgccgaccccgccuucuacaccuacaugaugagccacgccgccgccgccggcggccugcccuaccccuuccccagccaccugccccugcccuacuacagccccgugggccugggcgccgccagcgccgccagcgccgccgccagccccuucagcggcagccugagaccccuggacaccuucagagugcugagccagcccuaccccagacccgagcugcugugcgccuucagacaccccccccuguaccccggccccgcccacggccugggcgccagcgccggcggccccugcagcugccuggccugccacagcggccccgccaacggccuggcccccagagccgccgccgccagcgacuucaccugcgccagcaccagcagaagcgacagcuuccugaccuucgcccccagcgugcugagcaaggccagcagcguggcccuggaccagagagaggaggugccccugaccagauaa

SEQ ID NO: 16768 - RNA, 1431 nt, Artificial Sequence
  EVX2__Homo_sapiens__XP_011509410
augauggagagaaucagaaaggagaugauccugauggagagaggccugcacagccccaccgccggcaagagauucagcaaccugagcaacagcgccggcaacgccgugcuggaggcccuggagaacagccagcaccccgccagacugagccccagacugcccagcgccccccugcacagcgcccugggcgagcugcccgccaagggcaaguucgagaucgacacccuguucaaccugcagcacaccggcagcgagagcaccgugagcagcgagaucagcagcgccgccgagagcagaaagaagcccggccacuacagcgaggccgccgccgaggccgacaugagcagcgacguggaggugggcugcagcgcccugagaagccccggcggccugggcgccgcccagcugaaggagaacaacggcaagggcuacgccgagagcggcagcgccgccggcaccaccaccagcgccagcggcagcggccugggcagccugcacggcggcagcggcggcagcggcggcagcgccgcccugggcggcagcggcagcggcgccgaccaggugagaagauacagaaccgccuucaccagagagcagaucgccagacuggagaaggaguucuacagagagaacuacgugagcagacccagaagaugcgagcuggccgccgcccugaaccugcccgagaccaccaucaaggugugguuccagaacagaagaaugaaggacaagagacagagacuggccaugagcuggccccaccccgccgaccccagcuucuacaccuacaugaugacccacgccgccgccaccggcagccugcccuaccccuuccacagccacgugccccugcacuacuacccccacgugggcgugaccgccgccgccgccgccgccgccgccagcggcgccgccgccgccgccagcagccccuucgccaccagcaucagaccccuggacaccuucagagcccugagccaccccuacagcagacccgagcugcugugcagcuucagacaccccggccuguaccaggcccccgccgccgccgccggccugaacagcgccgccagcgccgccgccgccgccgccgccgccgccgccgccgccagcagcgccgccgccgccggcgccccccccagcggcggcagcgcccccugcagcugccugagcugccacagcagccagagcgccgccgccgccgccgccgccgccgccgccgcccugggcagcagaggcggcggcggcggcggcggcggcggcggcggcggcggcggcggcggcgccggcgccggcggcggcagcgacuucggcugcagcgccgccgcccccagaagcgagagcggcuuccugcccuacagcgccgccgugcugagcaagaccgccgugagcccccccgaccagagagacgaggccccccugaccagauaa

SEQ ID NO: 16769 - RNA, 1968 nt, Artificial Sequence
  EWSR1__Homo_sapiens__NP_001156757
auggccagcaccgacuacagcaccuacagccaggccgccgcccagcagggcuacagcgccuacaccgcccagcccacccagggcuacgcccagaccacccaggccuacggccagcagagcuacggcaccuacggccagcccaccgacgugagcuacacccaggcccagaccaccgccaccuacggccagaccgccuacgccaccagcuacggccagccccccaccggcuacaccacccccaccgccccccaggccuacagccagcccgugcagggcuacggcaccggcgccuacgacaccaccaccgccaccgugaccaccacccaggccagcuacgccgcccagagcgccuacggcacccagcccgccuaccccgccuacggccagcagcccgccgccaccgcccccaccagaccccaggacggcaacaagcccaccgagaccagccagccccagagcagcaccggcggcuacaaccagcccagccugggcuacggccagagcaacuacagcuacccccaggugcccggcagcuaccccaugcagcccgugaccgccccccccagcuacccccccaccagcuacagcagcacccagcccaccagcuacgaccagagcagcuacagccagcagaacaccuacggccagcccagcagcuacggccagcagagcagcuacggccagcagagcagcuacggccagcagccccccaccagcuaccccccccagaccggcagcuacagccaggcccccagccaguacagccagcagagcagcagcuacggccagcagagcagcuucagacaggaccaccccagcagcaugggcguguacggccaggagagcggcggcuucagcggccccggcgagaacagaagcaugagcggccccgacaacagaggcagaggcagaggcggcuucgacagaggcggcaugagcagaggcggcagaggcggcggcagaggcggcaugggcgccggcgagagaggcggcuucaacaagcccggcggccccauggacgagggccccgaccuggaccugggcccccccguggaccccgacgaggacagcgacaacagcgccaucuacgugcagggccugaacgacagcgugacccuggacgaccuggccgacuucuucaagcagugcggcguggugaagaugaacaagagaaccggccagcccaugauccacaucuaccuggacaaggagaccggcaagcccaagggcgacgccaccgugagcuacgaggacccccccaccgccaaggccgccguggagugguucgacggcaaggacuuccagggcagcaagcugaaggugagccuggccagaaagaagccccccaugaacagcaugagaggcggccugccccccagagagggcagaggcaugccccccccccugagaggcggccccggcggccccggcggccccggcggccccaugggcagaaugggcggcagaggcggcgacagaggcggcuucccccccagaggccccagaggcagcagaggcaaccccagcggcggcggcaacgugcagcacagagccggcgacuggcagugccccaaccccggcugcggcaaccagaacuucgccuggagaaccgagugcaaccagugcaaggcccccaagcccgagggcuuccugcccccccccuuccccccccccggcggcgacagaggcagaggcggccccggcggcaugagaggcggcagaggcggccugauggacagaggcggccccggcggcauguucagaggcggcagaggcggcgacagaggcggcuucagaggcggcagaggcauggacagaggcggcuucggcggcggcagaagaggcggccccggcggcccccccggcccccugauggagcagaugggcggcagaagaggcggcagaggcggccccggcaagauggacaagggcgagcacagacaggagagaagagacagacccuacuaa

SEQ ID NO: 16770 - RNA, 1866 nt, Artificial Sequence
  EXD2__Homo_sapiens__NP_001180292
augagcagacagaaccugguggcccugaccgugaccacccugcugggcguggccgugggcggcuucgugcuguggaagggcauccagagaagaagaagaagcaagaccagccccgugacccagcagccccagcagaaggugcugggcagcagagagcugcccccccccgaggacgaccagcugcacagcagcgcccccagaagcagcuggaaggagagaauccugaaggccaagguggugaccgugagccaggaggccgagugggaccagaucgagccccugcugagaagcgagcuggaggacuuccccgugcugggcaucgacugcgagugggugaaccuggagggcaaggccagcccccugagccugcugcagauggccagccccagcggccugugcgugcuggugagacugcccaagcugaucugcggcggcaagacccugcccagaacccugcuggacauccuggccgacggcaccauccugaaggugggcgugggcugcagcgaggacgccagcaagcugcugcaggacuacggccugguggugagaggcugccuggaccugagauaccuggccaugagacagagaaacaaccugcugugcaacggccugagccugaagagccuggccgagaccgugcugaacuucccccuggacaagagccugcugcugagaugcagcaacugggacgccgagacccugaccgaggaccaggugaucuacgccgccagagacgcccagaucagcguggcccuguuccugcaccugcugggcuaccccuucagcagaaacagccccggcgagaagaacgacgaccacagcagcuggagaaaggugcuggagaagugccagggcgugguggacauccccuucagaagcaagggcaugagcagacugggcgaggaggugaacggcgaggccaccgagagccagcagaagcccagaaacaagaagagcaagauggacggcauggugcccggcaaccaccagggcagagaccccagaaagcacaagagaaagccccugggcgugggcuacagcgccagaaagagcccccuguacgacaacugcuuccugcacgcccccgacggccagccccugugcaccugcgacagaagaaaggcccagugguaccuggacaagggcaucggcgagcuggugagcgaggagcccuucguggugaagcugagauucgagcccgccggcagacccgagagccccggcgacuacuaccugauggugaaggagaaccugugcguggugugcggcaagagagacagcuacaucagaaagaacgugaucccccacgaguacagaaagcacuuccccaucgagaugaaggaccacaacagccacgacgugcugcugcugugcaccagcugccacgccaucagcaacuacuacgacaaccaccugaagcagcagcuggccaaggaguuccaggcccccaucggcagcgaggagggccugagacugcuggaggaccccgagagaagacaggugagaagcggcgccagagcccugcugaacgccgagagccugcccacccagagaaaggaggagcugcugcaggcccugagagaguucuacaacaccgacguggugaccgaggagaugcugcaggaggccgccagccuggagaccagaaucagcaacgagaacuacgugccccacggccugaagguggugcagugccacagccagggcggccugagaagccugaugcagcuggagagcagauggagacagcacuuccuggacagcaugcagcccaagcaccugccccagcaguggagcguggaccacaaccaccagaagcugcugagaaaguucggcgaggaccugcccauccagcugagcuaa

SEQ ID NO: 16771 - RNA, 2631 nt, Artificial Sequence
  EXD3__Homo_sapiens__NP_060290
auggaccccggcgaccccgccggcgaccccgccgccggcgagagacacagaaugggcagagacccccugcugcugcugcaggcccugcagacccuguggagcaccagagagagaaagcagcugagagaggaggccuggagaggcuucgccgcccuggacgacccccuggccggccugcuggacaugcuggagagcugcagaggccagagaggcgagggccccagccuggccgccuggaucagccaccagcugcagugcuggcugcaggcccagcccugccccagccuggcccagcacagccugagacugaagcagcugcaggccagagccgugaaggugcugaccgagagcccccccagccuggccgccccccuggccagcaucuuccagcugcaggacgccgacagaagcugccugcuggcccacgugcacagacugcaccacgagggcagauucagagaggccgccacccugggcgccacccugaagcugcagagcgagcugggcguggagaagaugagcaucccccugcugcugcaggacaagguggcccugguggagagauacguggccggcuuccccgaccugcagagaagacugcuggugcugauggacagcuggugccagcccggcuucgacaucaaggacguggccagaagauaccccgaggugaccagccugagccuggagaagcugagccccaaggcccugagcagacaggugcugagacugcaggagagauacggcguggcccccgcccugugccccaacgccgccauccagcagagacuggccgcccugagacaccugugccacaagagauucguggagaagagccugagccaggagaacuggaccgaccacgugcagggccuggugggccagagccccuggcugcaggagcagcugagccagcugcuggugagccacagcgaccccgugaccgccgcccagugcgccauggagcugcugcugcccgaggagagacugcccgccgccguggccguggagcugagaagauucagacugcagggcagagccaccgaggccgacagcagacuggaggugaaggacaugaaggacagauacuaccagcugcccauccccagagagaacgugcaccugcuggccagcugggaggaccugaccagacacgagggcgcccugcugcagugccaccagguggugggcguggacguggaguggacccccguguucguggccggcggcagacccagacccagccugcugcagguggccguggagggccacguguuccugcuggacgugcuggcccugagccagccccccaccggccagggcgcccaggccuucagcagacugguggcccagcugcugagcgaccccagcaucaccaagcugggcuacggcauggugggcgaccugcagaagcugggcaccagcugccccgcccuggcccacguggagaagcagauccugggcggcauggaccugcugcuggugcacagacagaugagaguggccagcgugcccgcccccgccguggacagagccagagagcugagaggccugagccugcuggugcagcaggugcugggcaccgcccuggacaagacccagcagcugagcaacugggacagaagaccccugugcgaggagcaggugaucuacgccgccgccgacgccuacugccugcuggaggugcaccaggcccugugcagagagcccgccagauuccaccugagcgaggaccuggccggcagcagaagacccagacacagagagagacccggcgccagaaagccccccggccugcagaaggccagcgcccccgccgcccccagacaggugcccguggccguggccgugagcgagggcgccgccccccagauccccgccagagccuucagaguggugugcgacaacaugcugcagggccuggccagaagccugagaugccugggcguggacgccagaaugcugggcaacggcgaggaccacagaagagccgccgagguggccagacaggagggcagaaucauccugaccagcggccagcccuuccacaagcugagagcccaggugggcgccggcagaugccugagcguggacugcagccugaaggcccagcagcaggccaaggccgugcugaagcacuucaacgugagagugacccacgccgacaucuucagcagaugccaggccugcaacugcgaccaguaccugaaggugagcagagacaugaugaagcagcugauguggcugagcagccaccaggagggccccagaagcagcggcgacgaggccacccagagccaggccgugcaggagcccggccccgcccccgacgccgcccccgagggcugcaccuacgacagacccugcagauggcugcagauggccgaccugagagccgagacccccgacaugcuggccgacggcaccagacugcagcuggccggcgugcccgugggcgugcugagaacccccggccugagaugcuucuacugcugcaccggcugcggcaagguguucugggacggcagccaccugggcagaguggccacccacuucagagacaugcuggagagcgcccccagccccugcgagcccagccccgcccccagccccgccagcagccccuucuaa

SEQ ID NO: 16772 - RNA, 2412 nt, Artificial Sequence
  EXO1__Homo_sapiens__NP_003677
augggcauccagggccugcugcaguucaucaaggaggccagcgagcccauccacgugagaaaguacaagggccaggugguggccguggacaccuacugcuggcugcacaagggcgccaucgccugcgccgagaagcuggccaagggcgagcccaccgacagauacgugggcuucugcaugaaguucgugaacaugcugcugagccacggcaucaagcccauccugguguucgacggcugcacccugcccagcaagaaggagguggagagaagcagaagagagagaagacaggccaaccugcugaagggcaagcagcugcugagagagggcaaggugagcgaggccagagagugcuucaccagaagcaucaacaucacccacgccauggcccacaaggugaucaaggccgccagaagccagggcguggacugccugguggcccccuacgaggccgacgcccagcuggccuaccugaacaaggccggcaucgugcaggccaucaucaccgaggacagcgaccugcuggccuucggcugcaagaaggugauccugaagauggaccaguucggcaacggccuggagaucgaccaggccagacugggcaugugcagacagcugggcgacguguucaccgaggagaaguucagauacaugugcauccugagcggcugcgacuaccugagcagccugagaggcaucggccuggccaaggccugcaaggugcugagacuggccaacaaccccgacaucgugaaggugaucaagaagaucggccacuaccugaagaugaacaucaccgugcccgaggacuacaucaacggcuucaucagagccaacaacaccuuccuguaccagcugguguucgaccccaucaagagaaagcugaucccccugaacgccuacgaggacgacguggaccccgagacccugagcuacgccggccaguacguggacgacagcaucgcccugcagaucgcccugggcaacaaggacaucaacaccuucgagcagaucgacgacuacaaccccgacaccgccaugcccgcccacagcagaagccacagcugggacgacaagaccugccagaagagcgccaacgugagcagcaucuggcacagaaacuacagccccagacccgagagcggcaccgugagcgacgccccccagcugaaggagaaccccagcaccgugggcguggagagagugaucagcaccaagggccugaaccugcccagaaagagcagcaucgugaagagacccagaagcgccgagcugagcgaggacgaccugcugagccaguacagccugagcuucaccaagaagaccaagaagaacagcagcgagggcaacaagagccugagcuucagcgagguguucgugcccgaccuggugaacggccccaccaacaagaagagcgugagcaccccccccagaaccagaaacaaguucgccaccuuccugcagagaaagaacgaggagagcggcgccgugguggugcccggcaccagaagcagauucuucugcagcagcgacagcaccgacugcgugagcaacaaggugagcauccagccccuggacgagaccgccgugaccgacaaggagaacaaccugcacgagagcgaguacggcgaccaggagggcaagagacugguggacaccgacguggccagaaacagcagcgacgacauccccaacaaccacauccccggcgaccacauccccgacaaggccaccguguucaccgacgaggagagcuacagcuucgagagcagcaaguucaccagaaccaucagcccccccacccugggcacccugagaagcugcuucagcuggagcggcggccugggcgacuucagcagaacccccagccccagccccagcaccgcccugcagcaguucagaagaaagagcgacagccccaccagccugcccgagaacaacaugagcgacgugagccagcugaagagcgaggagagcagcgacgacgagagccacccccugagagaggaggccugcagcagccagagccaggagagcggcgaguucagccugcagagcagcaacgccagcaagcugagccagugcagcagcaaggacagcgacagcgaggagagcgacugcaacaucaagcugcuggacagccagagcgaccagaccagcaagcugagacugagccacuucagcaagaaggacaccccccugagaaacaaggugcccggccuguacaagagcagcagcgccgacagccugagcaccaccaagaucaagccccugggccccgccagagccagcggccugagcaagaagcccgccagcauccagaagagaaagcaccacaacgccgagaacaagcccggccugcagaucaagcugaacgagcuguggaagaacuucggcuucaagaaguucuaa

SEQ ID NO: 16773 - RNA, 2685 nt, Artificial Sequence
  EXOC1__Homo_sapiens__NP_001020095
augaccgccaucaagcacgcccugcagagagacaucuucacccccaacgacgagagacugcugagcaucgugaacgugugcaaggccggcaagaagaagaagaacugcuuccugugcgccaccgugaccaccgagagacccgugcaggugaagguggugaaggugaagaagagcgacaagggcgacuucuacaagagacagaucgccugggcccugagagaccuggccgugguggacgccaaggacgccaucaaggagaaccccgaguucgaccugcacuucgagaagaucuacaaguggguggccagcagcaccgccgagaagaacgccuucaucagcugcaucuggaagcugaaccagagauaccugagaaagaagaucgacuucgugaacgugagcagccagcugcuggaggagagcgugcccagcggcgagaaccagagcgugaccggcggcgacgaggaggugguggacgaguaccaggagcugaacgccagagaggagcaggacaucgagaucaugauggagggcugcgaguacgccaucagcaacgccgaggccuucgccgagaagcugagcagagagcugcaggugcuggacggcgccaacauccagagcaucauggccagcgagaagcaggugaacauccugaugaagcugcuggacgaggcccugaaggagguggaccagaucgagcugaagcugagcagcuacgaggagaugcugcagagcgugaaggagcagauggaccagaucagcgagagcaaccaccugauccaccugagcaacaccaacaacgugaagcugcugagcgagaucgaguuccuggugaaccacauggaccuggccaagggccacaucaaggcccugcaggagggcgaccuggccagcagcagaggcaucgaggccugcaccaacgccgccgacgcccugcugcagugcaugaacguggcccugagacccggccacgaccugcugcuggccgugaagcagcagcagcagagauucagcgaccugagagagcuguucgccagaagacuggccagccaccugaacaacguguucgugcagcagggccacgaccagagcagcacccuggcccagcacagcguggagcugacccugcccaaccaccaccccuuccacagagaccugcugagauacgccaagcugauggaguggcugaagagcaccgacuacggcaaguacgagggccugaccaagaacuacauggacuaccugagcagacuguacgagagagagaucaaggacuucuucgagguggccaagaucaagaugaccggcaccaccaaggagagcaagaaguucgccacccugcccagaaaggagagcgccgugaagcaggagaccgagagccugcacggcagcagcggcaagcugaccggcagcaccagcagccugaacaagcugagcgugcagagcagcggcaacagaagaagccagagcagcagccugcuggacaugggcaacaugagcgccagcgaccuggacguggccgacagaaccaaguucgacaagaucuucgagcaggugcugagcgagcuggagccccugugccuggccgagcaggacuucaucagcaaguucuucaagcugcagcagcaccagagcaugcccggcaccauggccgaggccgaggaccuggacggcggcacccugagcagacagcacaacugcggcaccccccugcccgugagcagcgagaaggacaugaucagacagaugaugaucaagaucuucagaugcaucgagcccgagcugaacaaccugaucgcccugggcgacaagaucgacagcuucaacagccuguacaugcuggugaagaugagccaccacguguggaccgcccagaacguggaccccgccagcuuccugagcaccacccugggcaacgugcuggugaccgugaagagaaacuucgacaagugcaucagcaaccagaucagacagauggaggaggugaagaucagcaagaagagcaaggugggcauccugcccuucguggccgaguucgaggaguucgccggccuggccgagagcaucuucaagaacgccgagagaagaggcgaccuggacaaggccuacaccaagcugaucagaggcguguucgugaacguggagaagguggccaacgagagccagaagacccccagagacguggugaugauggagaacuuccaccacaucuucgccacccugagcagacugaagaucagcugccuggaggccgagaagaaggaggccaagcagaaguacaccgaccaccugcagagcuacgugaucuacagccugggccagccccuggagaagcugaaccacuucuucgagggcguggaggccagaguggcccagggcaucagagaggaggaggugagcuaccagcuggccuucaacaagcaggagcugagaaaggugaucaaggaguaccccggcaaggaggugaagaagggccuggacaaccuguacaagaagguggacaagcaccugugcgaggaggagaaccugcugcaggugguguggcacagcaugcaggacgaguucaucagacaguacaagcacuucgagggccugaucgccagaugcuaccccggcagcggcgugaccauggaguucaccauccaggacauccuggacuacugcagcagcaucgcccagagccacuaa

SEQ ID NO: 16774 - RNA, 2775 nt, Artificial Sequence
  EXOC2__Homo_sapiens__NP_060773
augagcagaagcagacagcccccccuggugaccggcaucagccccaacgagggcauccccuggaccaaggugaccaucagaggcgagaaccugggcaccggccccaccgaccugaucggccugaccaucugcggccacaacugccugcugaccgccgaguggaugagcgccagcaagaucgugugcagagugggccaggccaagaacgacaagggcgacaucaucgugaccaccaagagcggcggcagaggcaccagcaccgugagcuucaagcugcugaagcccgagaagaucggcauccuggaccagagcgccguguggguggacgagaugaacuacuacgacaugagaaccgacagaaacaagggcauccccccccugagccugagacccgccaacccccugggcaucgagaucgagaagagcaaguucagccagaaggaccuggagaugcuguuccacggcaugagcgccgacuucaccagcgagaacuucagcgccgccugguaccugaucgagaaccacagcaacaccagcuucgagcagcugaagauggccgugaccaaccugaagagacaggccaacaagaagagcgagggcagccuggccuacgugaagggcggccugagcaccuucuucgaggcccaggacgcccugagcgccauccaccagaagcuggaggccgacggcaccgagaagguggagggcagcaugacccagaagcuggagaacgugcugaacagagccagcaacaccgccgacacccuguuccaggaggugcugggcagaaaggacaaggccgacagcaccagaaacgcccugaacgugcugcagagauucaaguuccuguucaaccugccccugaacaucgagagaaacauccagaagggcgacuacgacguggugaucaacgacuacgagaaggccaagagccuguucggcaagaccgaggugcagguguucaagaaguacuacgccgagguggagaccagaaucgaggcccugagagagcugcugcuggacaagcugcuggagacccccagcacccugcacgaccagaagagauacaucagauaccugagcgaccugcacgccagcggcgaccccgccuggcagugcaucggcgcccagcacaaguggauccugcagcugaugcacagcugcaaggagggcuacgugaaggaccugaagggcaaccccggccugcacagccccaugcuggaccuggacaacgacaccagacccagcgugcugggccaccugagccagaccgccagccugaagagaggcagcagcuuccagagcggcagagacgacaccuggagauacaagaccccccacagaguggccuucguggagaagcugaccaagcuggugcugagccagcugcccaacuucuggaagcuguggaucagcuacgugaacggcagccuguucagcgagaccgccgagaagagcggccagaucgagagaagcaagaacgugagacagagacagaacgacuucaagaagaugauccaggaggugaugcacagccuggugaagcugaccagaggcgcccugcugccccugagcaucagagacggcgaggccaagcaguacggcggcugggaggugaagugcgagcugagcggccaguggcuggcccacgccauccagaccgugagacugacccacgagagccugaccgcccuggagauccccaacgaccugcugcagaccauccaggaccugauccuggaccugagagugagaugcgugauggccacccugcagcacaccgccgaggagaucaagagacuggccgagaaggaggacuggaucguggacaacgagggccugaccagccugcccugccaguucgagcagugcaucgugugcagccugcagagccugaagggcgugcuggagugcaagcccggcgaggccagcguguuccagcagcccaagacccaggaggaggugugccagcugagcaucaacaucaugcagguguucaucuacugccuggagcagcugagcaccaagcccgacgccgacaucgacaccacccaccugagcguggacgugagcagccccgaccuguucggcagcauccacgaggacuucagccugaccagcgagcagagacugcugaucgugcugagcaacugcugcuaccuggagagacacaccuuccugaacaucgccgagcacuucgagaagcacaacuuccagggcaucgagaagaucacccaggugagcauggccagccugaaggagcuggaccagagacuguucgagaacuacaucgagcugaaggccgaccccaucgugggcagccuggagcccggcaucuacgccggcuacuucgacuggaaggacugccugccccccaccggcgugagaaacuaccugaaggaggcccuggugaacaucaucgccgugcacgccgagguguucaccaucagcaaggagcuggugcccagagugcugagcaaggugaucgaggccgugagcgaggagcugagcagacugaugcagugcgugagcagcuucagcaagaacggcgcccugcaggccagacuggagaucugcgcccugagagacaccguggccguguaccugacccccgagagcaagagcagcuucaagcaggcccuggaggcccugccccagcugagcagcggcgccgacaagaagcugcuggaggagcugcugaacaaguucaagagcagcaugcaccugcagcugaccugcuuccaggccgccagcagcaccaugaugaagaccuaa

SEQ ID NO: 16775 - RNA, 2241 nt, Artificial Sequence
  EXOC3L1__Homo_sapiens__NP_848611
auggacagcgccgccaaggacgagaugcagcccgcccugagccccggccccgaguggcccgagcaggagagagccgagcagcuggccagaggcgccgcccugaagugggccagcggcaucuucuacagacccgagcagcuggccagacugggccaguacagaagcagagaggugcagagaaccugcagccuggagagcagacugaagagcgugaugcagagcuaccuggagggcgugcagaccggcguguggcagcuggcccaggccaucgagguggugcagggcaccagagaggcccugagccaggccagaggccugcugcagggcaugagccaggcccugcagacccuggagccccugagagagagaguggcccagcacaagcagcugcaggcccugagccaccugcugcccagacugagagccgugcccgccgccgugagccacacccagacccugaucgacggccagcaguuccuggaggccuacgugagccugagagagcuggagcagcugagagaggacaccugggccccccugggcggccuggagcugcccguguuccagggccuggaccugcuguucgaggcccugggccaggccguggaggccgccgccggcgccgccggcaagcuggccagagaggaccccgcccugcugguggccgccgugagaguggccgagguggagaccggcagaaccaccccccugggccaggugcccagagacuggagacagagaugccugagagcccugcaggagggccuggagcaggcccacuucggcagcccccugcugcccgcccccggcgcccugcccggcuggcuggaggcccugagaguggcccugcccguggagcuggccaccgccgaggcccugguggcccccugcugccccccccaguacaacguggugcagcugugggcccacacccugcacagcggccugagaagaagccugcagaaccugcuggccggccccgagcuggaggccgccgacgccuucgcccugcugcacugggcccugcacguguaccugggccaggagaugaugggcagccuggagcugggccccgaggccgacgugagccagcuggagccccugcugacccuggagaacaucgagcagcuggaggccaccuucguggccaacauccaggccagcgugagccaguggcugcagaacgcccuggacggcgagguggccgaguggggcagagagcacggccccaacaccgaccccagcggcagcuacuacagccccaugcccgccaucgugcugcagauccuggaggagaacaucagaguggccagccuggugagcgagagccugcagcagagagugcacggcauggcccugagcgagcugggcaccuuccugagaagcuucagcgacgcccugaucagauucagcagagaccacuucagaggcaagagcauggccccccacuacgugcccuaccugcuggccgcccugaaccacaagagcgcccugagcagcagcgugagcgugcugcagcuggacggcgcccccagcggcgcccuggcccccguggaggccgcccuggacgagcugcagagaagaaucuacagacuggugcuggaggcccugcaggccgagcugcagccccuguucgccgaccugcccagcagacaguggcugagcagccccgagcugcugcagagcgugugcgagagaaccggcagauucugcagagacuucuggagagugagaaaccccaccgugcagcugcugcuggccgaggccgagagagccguggugcugcaguaccugagcgcccugaugcagggcagacuggugugcagaggcgccgacgagagaacccaggccgccgagagacugagacacgacgccgcccagcugcagcagcuguuccugagccugggccuggaggagaacgcccacugcgcccccgugcugcuggcccugagagagcugcugaaccugagagaccccgcccugcugggccuggagguggccggccugagacagcaguuccccgacgugagcgaggaccacgugagcgcccugcugggccugagaggcgaccugagcagagagcagcaccuggccgcccugagcagccugcaggccgcccugccccccagccccagagccagcagaagagugcuguucagccuggugcccgcccccgcccuggcccccgccagcugccugcccagcggcagcugcgccagagcccugcugcuggccgaguaa

SEQ ID NO: 16776 - RNA, 1230 nt, Artificial Sequence
  EXOC3L2__Homo_sapiens__NP_612635
auggccgcccuggagaacggcgagcugggcccccugcugagccccggcacccugagaggccuggaggacgagugcgugaccgacgugaaggcccagaccagagccgcccugcugagagugcugcaggaggacgaggagcacuggggcagccuggaggaccagcccagcagccuggcccaggacgugugcgagcugcuggaggagcacaccgagagagcccccagaaucagccaggaguucggcgagagaauggcccacugcugccugggcggccuggccgaguuccugcagagcuuccagcagagaguggagagauuccacgagaaccccgccgugagagagaugcugcccgacaccuacaucagcaagaccaucgcccuggugaacugcggccccccccugagagcccuggccgagagacuggccagagugggcccccccgagagcgagcccgccagagaggccagcgccagcgcccuggaccacgugaccagacugugccacagagugguggccaaccugcuguuccaggagcugcagccccacuucaacaagcugaugagaagaaaguggcugagcagccccgaggcccuggacggcaucgugggcacccugggcgcccaggcccuggcccugagaagaaugcaggacgagcccuaccaggcccugguggccgagcugcacagaagagcccugguggaguacgugagaccccugcugagaggcagacugagaugcagcagcgccagaaccagaagcagaguggccggcagacugagagaggacgccgcccagcugcagagacuguucagaagacuggagagccaggccagcuggcuggacgccguggugccccaccuggccgaggugaugcagcuggaggacacccccagcauccagguggaggugggcgugcuggugagagacuaccccgacaucagacagaagcacguggccgcccugcuggacaucagaggccugagaaacaccgccgccagacaggagauccuggccguggccagagaccuggagcugagcgaggagggcgcccugagcccccccagagacagagccuucuucgccgacauccccgugcccagacccagcuucugccugagccugccccuguuccugggcagacugccccugagcagacuggccagacccagccuggccugccugcccagacccagaccccccagccuggccagacccagagcccagagauaa

SEQ ID NO: 16777 - RNA, 1422 nt, Artificial Sequence
  EXOC4__Homo_sapiens__NP_001032203
auggccgccgaggccgccggcggcaaguacagaagcaccgugagcaagagcaaggaccccagcggccugcugaucagcgugaucagaacccugagcaccagcgacgacguggaggacagagagaacgagaagggcagacuggaggaggccuacgagaagugcgacagagaccuggacgagcugaucgugcagcacuacaccgagcugaccaccgccaucagaaccuaccagagcaucaccgagagaaucaccaacagcagaaacaagaucaagcaggugaaggagaaccugcugagcugcaagaugcugcugcacugcaagagagacgagcugagaaagcuguggaucgagggcaucgagcacaagcacgugcugaaccugcuggacgagaucgagaacaucaagcaggugccccagaagcuggagcagugcauggccagcaagcacuaccugagcgccaccgacaugcuggugagcgccguggagagccuggagggcccccugcugcagguggagggccugagcgaccugagacuggagcugcacagcaagaagaugaaccugcaccuggugcugaucgacgagcugcacagacaccuguacaucaagagcaccagcagaguggugcagagaaacaaggagaagggcaagaucagcagccuggugaaggacgccagcgugccccugaucgacgugaccaaccugcccacccccagaaaguuccuggacaccagccacuacagcaccgccggcagcagcagcgugagagagaucaaccugcaggacaucaaggaggaccuggagcuggaccccgaggagaacagcacccuguucaugggcauccugaucaagggccuggccaagcugaagaagauccccgagaccgugaaggccaucaucgagagacuggagcaggagcugaagcagaucgugaagagaagcaccacccagguggccgacagcggcuaccagagaggcgagaacgugaccguggagaaccagcccagacugcugcuggagcugcuggagcugcuguucgacaaguucaacgccguggccgccgcccacagcguggugcugggcuaccugcaggacaccguggugaccccccugacccagcaggaggacaucaagcuguacgacauggccgacgugugggugaagauccaggacgugcugcagaugcugcugaccgaguaccuggacaugaagaacaccagaaccgccagcgagcccagcgcccagcugagcuacgccagcaccggcagagaguucgccgccuucuucgccaagaagaagccccagagacccaagaacagccuguucaaguucgagagcagcagccacgccaucagcaugagcgccuaccugagagagcagagaagagagcuguacagcagaagcggcgagcugcagggcuaa

SEQ ID NO: 16778 - RNA, 2127 nt, Artificial Sequence
  EXOC5__Homo_sapiens__NP_006535
auggccaccaccgccgagcuguucgaggagcccuucguggccgacgaguacaucgagagacugguguggagaacccccggcggcggcagcagaggcggccccgaggccuucgaccccaagagacugcuggaggaguucgugaaccacauccaggagcugcagaucauggacgagagaauccagagaaagguggagaagcuggagcagcagugccagaaggaggccaaggaguucgccaagaaggugcaggagcugcagaagagcaaccagguggccuuccagcacuuccaggagcuggacgagcacaucagcuacguggccaccaaggugugccaccugggcgaccagcuggagggcgugaacacccccagacagagagccguggaggcccagaagcugaugaaguacuucaacgaguuccuggacggcgagcugaagagcgacguguucaccaacagcgagaagaucaaggaggccgccgacaucauccagaagcugcaccugaucgcccaggagcugcccuucgacagauucagcgaggugaagagcaagaucgccagcaaguaccacgaccuggagugccagcugauccaggaguucaccagcgcccagagaagaggcgagaucagcagaaugagagagguggccgccgugcugcugcacuucaagggcuacagccacugcguggacguguacaucaagcagugccaggagggcgccuaccugagaaacgacaucuucgaggacgccggcauccugugccagagagugaacaagcaggugggcgacaucuucagcaaccccgagaccgugcuggccaagcugauccagaacguguucgagaucaagcugcagagcuucgugaaggagcagcuggaggagugcagaaagagcgacgccgagcaguaccugaagaaccuguacgaccuguacaccagaaccaccaaccugagcagcaagcugauggaguucaaccugggcaccgacaagcagaccuuccugagcaagcugaucaagagcaucuucaucagcuaccuggagaacuacaucgagguggagaccggcuaccugaagagcagaagcgccaugauccugcagagauacuacgacagcaagaaccaccagaagagaagcaucggcaccggcggcauccaggaccugaaggagagaaucagacagagaaccaaccugccccugggccccagcaucgacacccacggcgagaccuuccugagccaggaggugguggugaaccugcugcaggagaccaagcaggccuucgagagaugccacagacugagcgaccccagcgaccugcccagaaacgccuucagaaucuucaccauccugguggaguuccugugcaucgagcacaucgacuacgcccuggagaccggccuggccggcauccccagcagcgacagcagaaacgccaaccuguacuuccuggacguggugcagcaggccaacaccaucuuccaccuguucgacaagcaguucaacgaccaccugaugccccugaucagcagcagccccaagcugagcgagugccugcagaagaagaaggagaucaucgagcagauggagaugaagcuggacaccggcaucgacagaacccugaacugcaugaucggccagaugaagcacauccuggccgccgagcagaagaagaccgacuucaagcccgaggacgagaacaacgugcugauccaguacaccaacgccugcgugaaggugugcgccuacgugagaaagcagguggagaagaucaagaacagcauggacggcaagaacguggacaccgugcugauggagcugggcgugagauuccacagacugaucuacgagcaccugcagcaguacagcuacagcugcaugggcggcaugcuggccaucugcgacguggccgaguacagaaagugcgccaaggacuucaagauccccauggugcugcaccuguucgacacccugcacgcccugugcaaccugcuggugguggcccccgacaaccugaagcaggugugcagcggcgagcagcuggccaaccuggacaagaacauccugcacagcuucgugcagcugagagccgacuacagaagcgccagacuggccagacacuucagcuaa

SEQ ID NO: 16779 - RNA, 2055 nt, Artificial Sequence
  EXOC7__Homo_sapiens__NP_001013861
augauccccccccaggaggccagcgccagaagaagagagaucgaggacaagcugaagcaggaggaggagacccugagcuucaucagagacagccuggagaagagcgaccagcugaccaagaacauggugagcauccugagcagcuucgagagcagacugaugaagcuggagaacagcaucauccccgugcacaagcagaccgagaaccugcagagacugcaggagaacguggagaagacccugagcugccuggaccacgugaucagcuacuaccacguggccagcgacaccgagaagaucaucagagagggccccaccggcagacuggaggaguaccugggcagcauggccaagauccagaaggccguggaguacuuccaggacaacagccccgacagccccgagcugaacaaggugaagcugcuguucgagagaggcaaggaggcccuggagagcgaguucagaagccugaugaccagacacagcaagguggugagccccgugcugauccuggaccugaucagcggcgacgacgaccuggaggcccaggaggacgugacccuggagcaccugcccgagagcgugcugcaggacgugaucagaaucagcagauggcugguggaguacggcagaaaccaggacuucaugaacguguacuaccagaucagaagcagccagcuggacagaagcaucaagggccugaaggagcacuuccacaagagcagcagcagcagcggcgugcccuacagccccgccauccccaacaagagaaaggacacccccaccaagaagcccgugaagagacccggcaccaucagaaaggcccagaaccugcugaagcaguacagccagcacggccuggacggcaagaagggcggcagcaaccugaucccccuggagggcagagacgacaugcuggacguggagaccgacgccuacauccacugcgugagcgccuucgugaagcuggcccagagcgaguaccagcugcuggccgacaucauccccgagcaccaccagaagaagaccuucgacagccugauccaggacgcccuggacggccugaugcuggagggcgagaacaucgugagcgccgccagaaaggccaucgugagacacgacuucagcaccgugcugaccguguuccccauccugagacaccugaagcagaccaagcccgaguucgaccaggugcugcagggcaccgccgccagcaccaagaacaagcugcccggccugaucaccagcauggagaccaucggcgccaaggcccuggaggacuucgccgacaacaucaagaacgaccccgacaaggaguacaacaugcccaaggacggcaccgugcacgagcugaccagcaacgccauccuguuccugcagcagcugcuggacuuccaggagaccgccggcgccaugcuggccagccaggagaccagcagcagcgccaccagcuacagcagcgaguucagcaagagacugcugagcaccuacaucugcaaggugcugggcaaccugcagcugaaccugcugagcaagagcaagguguacgaggaccccgcccugagcgccaucuuccugcacaacaacuacaacuacauccugaagagccuggagaagagcgagcugauccagcugguggccgugacccagaagaccgccgagagaagcuacagagagcacaucgagcagcagauccagaccuaccagagaagcuggcugaaggugaccgacuacaucgccgagaagaaccugcccguguuccagcccggcgugaagcugagagacaaggagagacagaucaucaaggagagauucaagggcuucaacgacggccuggaggagcugugcaagauccagaaggccugggccauccccgacaccgagcagagagacagaaucagacaggcccagaagaccaucgugaaggagaccuacggcgccuuccugcagaaguucggcagcgugcccuucaccaagaaccccgagaaguacaucaaguacggcguggagcaggugggcgacaugaucgacagacuguucgacaccagcgccuaa

SEQ ID NO: 16780 - RNA, 957 nt, Artificial Sequence
  EXOG__Homo_sapiens__NP_001138936
auggccaucaagagcaucgccagcagacugagaggcagcagaagauuccugagcggcuucguggccggcgccguggugggcgccgccggcgccggccuggccgcccugcaguucuucagaagccagggcgccgagggcgcccugaccggcaagcagcccgacggcgacgccgacagaaagcacugcaaguucaagcccgaccccaacaucccccccaccuucagcgccuucaacgaggacuacgugggcagcggcuggagcagaggccacauggcccccgccggcaacaacaaguucagcagcaaggccauggccgagaccuucuaccugagcaacaucgugccccaggacuucgacaacaacagcggcuacuggaacagaaucgagauguacugcagagagcugaccgagagauucgaggacguguggguggugagcggcccccugacccugccccagaccagaggcgacggcaagaagaucgugagcuaccaggugaucggcgaggacaacguggccgugcccagccaccuguacaaggugauccuggccagaagaagcagcgugagcaccgagccccuggcccugggcgccuucguggugcccaacgaggccaucggcuuccagccccagcugaccgaguuccaggugagccugcaggaccuggagaagcugagcggccugguguucuucccccaccuggacagaaccagcgacaucagaaacaucugcagcguggacaccugcaagcugcuggacuuccaggaguucacccuguaccugagcaccagaaagaucgagggcgccagaagcgugcugagacuggagaagaucauggagaaccugaagaacgccgagaucgagcccgacgacuacuucaugagcagauacgagaagaagcuggaggagcugaaggccaaggagcagagcggcacccagaucagaaagcccagcuaa

SEQ ID NO: 16781 - RNA, 588 nt, Artificial Sequence
  EXOSC1__Homo_sapiens__NP_057130
auggccccccccgugagauacugcauccccggcgagagacugugcaaccuggaggagggcagccccggcagcggcaccuacaccagacacggcuacaucuucagcagccuggccggcugccugaugaagagcagcgagaacggcgcccugcccguggugagcguggugagagagaccgagagccagcugcugcccgacgugggcgccaucgugaccugcaaggugagcagcaucaacagcagauucgccaaggugcacauccuguacgugggcagcaugccccugaagaacagcuucagaggcaccaucagaaaggaggacgugagagccaccgagaaggacaagguggagaucuacaagagcuucagacccggcgacaucgugcuggccaaggugaucagccugggcgacgcccagagcaacuaccugcugaccaccgccgagaacgagcugggcguggugguggcccacagcgagagcggcauccagauggugcccaucagcuggugcgagaugcagugccccaagacccacaccaaggaguucagaaagguggccagagugcagcccgaguuccugcagaccuaa

SEQ ID NO: 16782 - RNA, 804 nt, Artificial Sequence
  EXOSC2__Homo_sapiens__NP_001269637
auggccauggagaugagacugcccguggccagaaagccccugagcgagagacugggcagagacaccaagaagcaccugguggugcccggcgacaccaucaccaccgacaccggcuucaugagaggccacggcaccuacaugggcgaggagaagcugaucgccagcguggccggcagcguggagagagugaacaagcugaucugcgugaaggcccugaagaccagauacaucggcgaggugggcgacaucguggugggcagaaucaccgaggugcagcagaagagauggaagguggagaccaacagcagacuggacagcgugcugcugcugagcagcaugaaccugcccggcggcgagcugagaagaagaagcgccgaggacgagcuggccaugagaggcuuccugcaggagggcgaccugaucagcggcgugcuggugcaggugagccccagccuggugaagagacagaagacccacuuccacgaccugcccugcggcgccagcgugauccugggcaacaacggcuucaucuggaucuaccccacccccgagcacaaggaggaggaggccggcggcuucaucgccaaccuggagcccgugagccuggccgacagagaggugaucagcagacugagaaacugcaucaucagccuggugacccagagaaugaugcuguacgacaccagcauccuguacugcuacgaggccagccugccccaccagaucaaggacauccugaagcccgagaucauggaggagaucgugauggagaccagacagagacugcuggagcaggagggcuaa

SEQ ID NO: 16783 - RNA, 495 nt, Artificial Sequence
  EXOSC3__Homo_sapiens__NP_001002269
auggccgagcccgccagcguggccgccgagagccuggccggcagcagagccagagccgccagaaccgugcugggccagguggugcugcccggcgaggagcugcugcugcccgagcaggaggacgccgagggccccggcggcgccguggagagaccccugagccugaacgccagagccugcagcagagugagaguggugugcggccccggccugagaagaugcggcgacagacugcuggugaccaagugcggcagacugagacacaaggagcccggcagcggcagcggcggcggcguguacuggguggacagccagcagaagagauacgugcccgugaagggcgaccacgugaucggcaucgugaccgccaagagcggcgacaucuucaagguggacgugggcggcagcgagcccgccagccugagcuaccugagcuucgagggcgccaccaagagaaacagacccaacgugcaggccaucagcagcagacuguaa

SEQ ID NO: 16784 - RNA, 738 nt, Artificial Sequence
  EXOSC4__Homo_sapiens__NP_061910
auggccggccuggagcugcugagcgaccagggcuacagaguggacggcagaagagccggcgagcugagaaagauccaggccagaaugggcguguucgcccaggccgacggcagcgccuacaucgagcagggcaacaccaaggcccuggccgugguguacggcccccacgagaucagaggcagcagagccagagcccugcccgacagagcccuggugaacugccaguacagcagcgccaccuucagcaccggcgagagaaagagaagaccccacggcgacagaaagagcugcgagaugggccugcagcugagacagaccuucgaggccgccauccugacccagcugcaccccagaagccagaucgacaucuacgugcaggugcugcaggccgacggcggcaccuacgccgccugcgugaacgccgccacccuggccgugcuggacgccggcauccccaugagagacuucgugugcgccugcagcgccggcuucguggacggcaccgcccuggccgaccugagccacguggaggaggccgccggcggcccccagcuggcccuggcccugcugcccgccagcggccagaucgcccugcuggagauggacgccagacugcacgaggaccaccuggagagagugcuggaggccgccgcccaggccgccagagacgugcacacccugcuggacagaguggugagacagcacgugagagaggccagcauccugcugggcgacuaa

SEQ ID NO: 16785 - RNA, 708 nt, Artificial Sequence
  EXOSC5__Homo_sapiens__NP_064543
auggaggaggagacccacaccgacgccaagaucagagccgagaacggcaccggcagcagccccagaggccccggcugcagccugagacacuucgccugcgagcagaaccugcugagcagacccgacggcagcgccagcuuccugcagggcgacaccagcgugcuggccggcguguacggccccgccgaggugaaggugagcaaggagaucuucaacaaggccacccuggaggugauccugagacccaagaucggccugcccggcguggccgagaagagcagagagagacugaucagaaacaccugcgaggccguggugcugggcacccugcaccccagaaccagcaucaccguggugcugcagguggugagcgacgccggcagccugcuggccugcugccugaacgccgccugcauggcccugguggacgccggcgugcccaugagagcccuguucugcggcguggccugcgcccuggacagcgacggcacccuggugcuggaccccaccagcaagcaggagaaggaggccagagccgugcugaccuucgcccuggacagcguggagagaaagcugcugaugagcagcaccaagggccuguacagcgacaccgagcugcagcagugccuggccgccgcccaggccgccagccagcacguguucagauucuacagagagagccugcagagaagauacagcaagagcuaa

SEQ ID NO: 16786 - RNA, 819 nt, Artificial Sequence
  EXOSC6__Homo_sapiens__NP_478126
augcccggcgaccacagaagaaucagaggccccgaggagagccagcccccccagcuguacgccgccgacgaggaggaggcccccggcaccagagaccccaccagacugagacccguguacgccagagccggccugcugagccaggccaagggcagcgccuaccuggaggccggcggcaccaaggugcugugcgccgugagcggccccagacaggccgagggcggcgagagaggcggcggccccgccggcgccggcggcgaggcccccgccgcccugagaggcagacugcugugcgacuucagaagagcccccuucgccggcagaagaagaagagccccccccggcggcugcgaggagagagagcuggcccuggcccugcaggaggcccuggagcccgccgugagacugggcagauaccccagagcccagcuggaggugagcgcccugcugcuggaggacggcggcagcgcccuggccgccgcccugaccgccgccgcccuggcccuggccgacgccggcguggagauguacgaccugguggugggcugcggccugagccuggcccccggccccgcccccaccuggcugcuggaccccaccagacuggaggaggagagagccgccgccggccugaccguggcccugaugcccgugcugaaccagguggccggccugcugggcagcggcgagggcggccugaccgagagcugggccgaggccgugagacugggccuggagggcugccagagacuguaccccgugcugcagcagagccuggugagagccgccagaagaagaggcgccgccgcccagcccuaa

SEQ ID NO: 16787 - RNA, 876 nt, Artificial Sequence
  EXOSC7__Homo_sapiens__NP_055819
auggccagcgugacccugagcgaggccgagaagguguacaucgugcacggcgugcaggaggaccugagaguggacggcagaggcugcgaggacuacagaugcguggagguggagaccgacguggugagcaacaccagcggcagcgccagagugaagcugggccacaccgacauccuggugggcgugaaggccgagaugggcacccccaagcuggagaagcccaacgagggcuaccuggaguucuucguggacugcagcgccagcgccacccccgaguucgagggcagaggcggcgacgaccugggcaccgagaucgccaacacccuguacagaaucuucaacaacaagagcagcguggaccugaagacccugugcaucagccccagagagcacugcugggugcuguacguggacgugcugcugcuggagugcggcggcaaccuguucgacgccaucagcaucgccgugaaggccgcccuguucaacaccagaauccccagagugagagugcuggaggacgaggagggcagcaaggacaucgagcugagcgacgaccccuacgacugcaucagacugagcguggagaacgugcccugcaucgugacccugugcaagaucggcuacagacacgugguggacgccacccugcaggaggaggccugcagccuggccagccugcuggugagcgugaccagcaagggcguggugaccugcaugagaaaggugggcaagggcagccuggaccccgagagcaucuucgagaugauggagaccggcaagagagugggcaaggugcugcacgccagccugcagagcguggugcacaaggaggagagccugggccccaagagacagaaggugggcuuccugggcuaa

SEQ ID NO: 16788 - RNA, 831 nt, Artificial Sequence
  EXOSC8__Homo_sapiens__NP_852480
auggccgccggcuucaagaccguggagccccuggaguacuacagaagauuccugaaggagaacugcagacccgacggcagagagcugggcgaguucagaaccaccaccgugaacaucggcagcaucagcaccgccgacggcagcgcccuggugaagcugggcaacaccaccgugaucugcggcgugaaggccgaguucgccgcccccagcaccgacgcccccgacaagggcuacguggugcccaacguggaccugcccccccugugcagcagcagauucagaagcggcccccccggcgaggaggcccagguggccagccaguucaucgccgacgugaucgagaacagccagaucauccagaaggaggaccugugcaucagccccggcaagcuggugugggugcuguacugcgaccugaucugccuggacuacgacggcaacauccuggacgccugcaccuucgcccugcuggccgcccugaagaacgugcagcugcccgaggugaccaucaacgaggagaccgcccuggccgaggugaaccugaagaagaagagcuaccugaacaucagaacccaccccguggccaccagcuucgccguguucgacgacacccugcugaucguggaccccaccggcgaggaggagcaccuggccaccggcacccugaccaucgugauggacgaggagggcaagcugugcugccugcacaagcccggcggcagcggccugaccggcgccaagcugcaggacugcaugagcagagccgugaccagacacaaggaggugaagaagcugauggacgaggugaucaagagcaugaagcccaaguaa

SEQ ID NO: 16789 - RNA, 5970 nt, Artificial Sequence
  EXPH5__Homo_sapiens__NP_055880
augaccaaggugccccccgccuucgacuucagcuuccugaacgacgaggaggccagaaagauccugcaggugcuggagagaaacgaggagcugcagagagccgagaaggacagaaucagcaagcugcagaagaccaagagagacaucagauggcugcagggcgugaccggcgagugguucgaggagauccagagaaagaaguucugcaacgagaccgacgugagccagaugcugaagcagccccugaccuacagacugagcaaggagauggccaagaacgaccccaucgagcugcccaccagcagaagcaagaacgugaccaaccagaagaagcccacccccuucagcagcagaaugagcuucagaagcagcuucgccagccuguucagcuucagaaagagcggcaaggagaccagcaagcugcccagccugggccagaagggcugcgacggccacgccggcccccccaugcccgugagaggcgccgccgugcaggccaagaucuacaacagcccccuggagaaccaccugguggacagcaccuucgugcccaagcccgccgugaugagagaggagagcggcaugcccccccccugggacgccagccugcuggagaacgaguucuuccaggugcuggacgaccuggacagcaagcuggcccaggagcagagcgccagcagcgugaacaccagaaccccccugaacuacggcagcagaacccaguucggccacuucuacagcagcggcaacagacacggcaacaucaccgagagacacaagaagcacuacaacgagaccagcaacaugagcaucuacgacauccugagacccggcacccccagagagggcuucaagaccuucagccccagaaccagcaccaucuacgacauguacagaaccagagagcccagaguguucaaggaggacuacgugcagaagaacaccuucggcagcaccagccugugcuucgacagcagacagagaagcgcccugcccgccaccggccacuucaccgccagaagccugcacuuccccgccaccacccagagcaagagcggcuucaucccccccagacaccagcagagccccaagagaaccccccugagcagcaucaucuggaacagaagcgacagcagcagagacagagagaaccaggaggaguuccugagagcccccagccccauggagaucgaccccgccgacaaguacguguaccccagaggcuuccaggagaacaagagauacgagagcuaccacagccagaacguguaccagagagugagccugaacgcccccauggagaacgccaugagccccgacaccuucgagaacagcgagaacaugcccuucuaccaccagagcaacaccuucaccagaagcuucuucagcaacaccuucggcagaagcggcgagcagagaagauucggccagggccccuucuggggccaggagaagggccacagcuucuggagcgacuuccacagaagcagaaagagcuucagcagcagcgacagagacuucgagaugaucagcauggaggccaacagcgugagcgccauccacggccacaacgugagcagcgagcacugggagagcuucagcagcggcuacggcaccgacgugagcagaggccaggaggagccccaccccuggcaguucgacuuccagagaagcacccuggacagcaugguggugagccacggcaacgagacccagcugaccccccacuucggcacccccaacgugugcagcaugaccggcagcagcuaccacgugaagagcagcgagcuggugagccagcaggacagcagccccguggaggugcacaucaacaaggaggccagcagcuucggcaucgcccagacccuggccagcagcuucaagaccagcuucagccagaucagcgacgacagaagaaacccccagagccccaaccugcagaaccccaccgugacccugcagaagaucuuccccaacaagcccgccagccaccccaugagaagccacaccgaggugaccgugaccagcagcaacagcguggacagccugccccuggccaagagccagcccaacauccuggugaccgaggugaacaacgagaaggaccugaacgagagcaucagcgaggaggacaagcagcugagcaagauggaccagaccaacaaggccggcgagaucccccagcccgugagccagaccggcaucagcaacagccugcccgacuuccagaacccccugagccaggacagcgccaagagcaacggcuucggcuucaacgccagcaccaucaucagcagcaagaagagccccagaguguucagcagaaaggacaccagcaagauguacaucccccacaccgacaagagcaacgacaucaagcaggacaagagauucaccgagaacagaaagcugggcagcaccgccagccugcccuucauccaggagcacagaaccccccccagcuuccccagaaccgaccagggcugccaccaggagcugaccgugaacaacgaggacaucagcagaaucaucaccaacaaccacuggagcagcgcccugaccgacacccagaacgcccaguacagcaagugcaagcugacccccggccacaagaccagcugcgacagccuggaccugagcagcgccgcccugcccgacagcagccccagcaagaacagcagccuggacgcccccguggugcccagcaccaccguguucagcagaagaagccccagcgacaaggaccccagccugggcgagagagaggagaaggacaacgccggcaagaaccagaagaaccaguucaucgugagccacagcgagaaccaggagagaaacgacagccccgugcccacccacgacgaggugguggacgugaagugccacagccacagccccuucagaaacgagagaggcaagggcaagaucagacaccacaucagcugcaucgagaagcugagcaagaccgagagcaucagcgugcccaccagcgaccacagaagccugaucgaggccaaccagagcaacagcaaggugagcgagcuggacaccaucuacugcacccugcccagaaagagcagcagcuuccugauccacggcagacagagcggcagcaagaucauggccgccagccugagaaacggccccccccccuuccagaucaagaacaacguggaggacgccaugggcaacuacaugcugaacaaguucagccccagcagccccgagagcgccaacgagugcagcaaggugcugagcgacagcgcccuggaggcccccgaggccaccgagagaaugaccaacgugaagagcagcggcagcaccagcgugagaaagggcccccugcccuuccugaucaacagagccaugagcugccccagcggcgagccccacgccagcaccggcagagagggcagaaagaagccccugaccagcggcauggacgccagcgagcugacccccagagccugggagagaaucaucagccccguggagagcgacagcagcgugagagacugcagccugaccaagagacagcaccagaaggagaacuuccaggaguacaccgagaaggagggcaagauggccgccagcagaagaagcguguucgcccugagcaacgaggacccccugcccuucugcagcgaccugagcggcaaggagagaggcaagacccugcacaaggugaagaccaccagcaccuucagcgugagcggcgacgaggacaacgugaagugccuggagguggugagcaucuacuacacccugcccagaaagcccagcaagaaguucugcaaccugcugcagcaguacacccagaacaccaaccugcugaucgagagcccccagguggagaccgagaccuuccccaacgcccuggagaaggacaagcagaacuacagcaccagagagcagagcggcacccccagcugcgagaaccugaagaugagcgugaacagcgaccagacccugaccaccgagaacaugaccgccuucagacugagcaacagaggcccccuggcccccacccugcaggagauggccagcguggaggccgccgugagccugcccgaggaggagagcaaggccagagagaucuucagcgacaaccuggccaagaccccccugggcgacagcgagaacaagaaggagagaggcaagaagcugcagagcgagacccugcacaccagccugaugcugcagagaaagaacgugagcgaggagaagagcgagaacugccagcagagcaucaacagcagcaacagcggccccagcagccugcccgcccugagcgaggugaacaucggcaacagccagaccagaagaagcagcugggagugcaccggcagcggcagagccauccccuucaccggcagcggcaagugcccccagaaggaccacaccagcaccgccgugggcgacggcagcagcggcagccagcccagagagggcagaggcgacaucggcaccaacugccagaagaugaccaacaagacccugagccacagcgagagccagguguucgcccugacccccgcccugcacaagcugcagcugggcgaggagacccagagcgacgagcccaaccuggagagccugcagagcgagcccagagagcugccccagagaagccaggaggccaacaugaccgagagcagaaaggccgaggacgagaugcagaagagcgccugggaccagcccagccugcccgagggcaacaagaacaagaccaaccuggacgaccuggugaagggcgagaacagaagcagcgugaagcacagacuggccgccaugagcaaggccagcagaaaguuccccgccaaggacgugagccccagaagacacguggccaccaucuucccccagagcggcagcagaagcggcuucgaccaccugagccugggcaccguggagugcaacccccuguuccccgagcccacccccaagagcgccgagagcaucggcgagagcagacugagcgagaacggcaagcacgugaagaagagcgagaaccugcugcccaucaccgugcugcccaacagagagcccagcacccacgugagcaaccagaagagcaacagcaucagccagagacaccagaacgaguucaagaacgugagcgagagccccagcaagcacgagaacagcaaggacgugaccgccgcccagaaccuggugagagagagcggcgcccccagccccaucaccuucaccagccugagagaggccgaguucagcgacaaccagagaagacugagcccccccuucccccuggagcccgcccagaagagcagagugagcagcccccuggccagcuuccugcagcagcagagaagcgccagcagccuggagugggagcccgagccccaccuguacagaagcaagagccugaagagcaucaacgugcacggcgaccugcugagaaagagccacccccccaaggugagagagagacacuucagcgagagcaccagcaucgacaacgcccugagcagacugacccugggcaacgaguucagcgugaacaacggcuacagcagaagauucagaagcuucagcgagcugcccagcugcgacggcaacgagagcugggccuacagaagcggcaccaagaccggccccagaagcgccaucagcaucuacagacccaucgacuacggcaucuucggcaaggagcagcagcuggccuuccuggagaacgugaagagaagccugacccagggcagacuguggaagcccagcuuccugaagaaccccggcuuccugaaggacgaccugagaaacccccccaaccccagcgagagccugagcagcaacagccccagcagccaggugcccgaggacggccugagccccagcgagccccugaacaucuacgaggacgaccccguggacagcgacugcgacaccgacaccaccaccgacgacgaguacuaccuggacgagaacgacaaggagagcgagcuguaa

SEQ ID NO: 16790 - RNA, 2241 nt, Artificial Sequence
  EXT1__Homo_sapiens__NP_000118
augcaggccaagaagagauacuucauccugcugagcgccggcagcugccuggcccugcuguucuacuucggcggccugcaguucagagccagcagaagccacagcagaagagaggagcacagcggcagaaacggccugcaccaccccagccccgaccacuucuggcccagauuccccgacgcccugagacccuucgugcccugggaccagcuggagaacgaggacagcagcgugcacaucagccccagacagaagagagacgccaacagcagcaucuacaagggcaagaagugcagaauggagagcugcuucgacuucacccugugcaagaagaacggcuucaagguguacguguacccccagcagaagggcgagaagaucgccgagagcuaccagaacauccuggccgccaucgagggcagcagauucuacaccagcgaccccagccaggccugccuguucgugcugagccuggacacccuggacagagaccagcugagcccccaguacgugcacaaccugagaagcaaggugcagagccugcaccuguggaacaacggcagaaaccaccugaucuucaaccuguacagcggcaccuggcccgacuacaccgaggacgugggcuucgacaucggccaggccaugcuggccaaggccagcaucagcaccgagaacuucagacccaacuucgacgugagcaucccccuguucagcaaggaccaccccagaaccggcggcgagagaggcuuccugaaguucaacaccauccccccccugagaaaguacaugcugguguucaagggcaagagauaccugaccggcaucggcagcgacaccagaaacgcccuguaccacgugcacaacggcgaggacguggugcugcugaccaccugcaagcacggcaaggacuggcagaagcacaaggacagcagaugcgacagagacaacaccgaguacgagaaguacgacuacagagagaugcugcacaacgccaccuucugccuggugcccagaggcagaagacugggcagcuucagauuccuggaggcccugcaggccgccugcgugcccgugaugcugagcaacggcugggagcugcccuucagcgaggugaucaacuggaaccaggccgccgugaucggcgacgagagacugcugcugcagauccccagcaccaucagaagcauccaccaggacaagauccuggcccugagacagcagacccaguuccugugggaggccuacuucagcagcguggagaagaucgugcugaccacccuggagaucauccaggacagaaucuucaagcacaucagcagaaacagccugaucuggaacaagcaccccggcggccuguucgugcugccccaguacagcagcuaccugggcgacuuccccuacuacuacgccaaccugggccugaagccccccagcaaguucaccgccgugauccacgccgugaccccccuggugagccagagccagcccgugcugaagcugcugguggccgccgccaagagccaguacugcgcccagaucaucgugcuguggaacugcgacaagccccugcccgccaagcacagauggcccgccaccgccgugcccgugguggugaucgagggcgagagcaaggugaugagcagcagauuccugcccuacgacaacaucaucaccgacgccgugcugagccuggacgaggacaccgugcugagcaccaccgagguggacuucgccuucaccguguggcagagcuuccccgagagaaucgugggcuaccccgccagaagccacuucugggacaacagcaaggagagauggggcuacaccagcaaguggaccaacgacuacagcauggugcugaccggcgccgccaucuaccacaaguacuaccacuaccuguacagccacuaccugcccgccagccugaagaacaugguggaccagcuggccaacugcgaggacauccugaugaacuuccuggugagcgccgugaccaagcugccccccaucaaggugacccagaagaagcaguacaaggagaccaugaugggccagaccagcagagccagcagaugggccgaccccgaccacuucgcccagagacagagcugcaugaacaccuucgccagcugguucggcuacaugccccugauccacagccagaugagacuggaccccgugcuguucaaggaccaggugagcauccugagaaagaaguacagagacaucgagagacuguaa

SEQ ID NO: 16791 - RNA, 2256 nt, Artificial Sequence
  EXT2__Homo_sapiens__NP_000392
augagcugcgccagcggcagcggcggcggccugagacacccccugagaugccagaagcccugggacgaggagugcgaggaggaggccgugugcgugaucaugugcgccagcgugaaguacaacaucagaggccccgcccugauccccagaaugaagaccaagcacagaaucuacuacaucacccuguucagcaucgugcugcugggccugaucgccaccggcauguuccaguucuggccccacagcaucgagagcagcaacgacuggaacguggagaagagaagcaucagagacgugcccguggugagacugcccgccgacagccccauccccgagagaggcgaccugagcugcagaaugcacaccugcuucgacguguacagaugcggcuucaaccccaagaacaagaucaagguguacaucuacgcccugaagaaguacguggacgacuucggcgugagcgugagcaacaccaucagcagagaguacaacgagcugcugauggccaucagcgacagcgacuacuacaccgacgacaucaacagagccugccuguucgugcccagcaucgacgugcugaaccagaacacccugagaaucaaggagaccgcccaggccauggcccagcugagcagaugggacagaggcaccaaccaccugcuguucaacaugcugcccggcggcccccccgacuacaacaccgcccuggacgugcccagagacagagcccugcuggccggcggcggcuucagcaccuggaccuacagacagggcuacgacgugagcauccccguguacagcccccugagcgccgagguggaccugcccgagaagggccccggccccagacaguacuuccugcugagcagccaggugggccugcaccccgaguacagagaggaccuggaggcccugcaggugaagcacggcgagagcgugcuggugcuggacaagugcaccaaccugagcgagggcgugcugagcgugagaaagagaugccacaagcaccagguguucgacuacccccaggugcugcaggaggccaccuucugcguggugcugagaggcgccagacugggccaggccgugcugagcgacgugcugcaggccggcugcgugcccguggugaucgccgacagcuacauccugcccuucagcgaggugcuggacuggaagagagccagcgugguggugcccgaggagaagaugagcgacguguacagcauccugcagagcaucccccagagacagaucgaggagaugcagagacaggccagaugguucugggaggccuacuuccagagcaucaaggccaucgcccuggccacccugcagaucaucaacgacagaaucuaccccuacgccgccaucagcuacgaggaguggaacgacccccccgccgugaaguggggcagcgugagcaacccccuguuccugccccugauccccccccagagccagggcuucaccgccaucgugcugaccuacgacagaguggagagccuguucagagugaucaccgaggugagcaaggugcccagccugagcaagcugcuggugguguggaacaaccagaacaagaacccccccgaggacagccuguggcccaagaucagagugccccugaagguggugagaaccgccgagaacaagcugagcaacagauucuuccccuacgacgagaucgagaccgaggccgugcuggccaucgacgacgacaucaucaugcugaccagcgacgagcugcaguucggcuacgagguguggagagaguuccccgacagacuggugggcuaccccggcagacugcaccugugggaccacgagaugaacaaguggaaguacgagagcgaguggaccaacgaggugagcauggugcugaccggcgccgccuucuaccacaaguacuucaacuaccuguacaccuacaagaugcccggcgacaucaagaacuggguggacgcccacaugaacugcgaggacaucgccaugaacuuccugguggccaacgugaccggcaaggccgugaucaaggugacccccagaaagaaguucaagugccccgagugcaccgccaucgacggccugagccuggaccagacccacaugguggagagaagcgagugcaucaacaaguucgccagcguguucggcaccaugccccugaaggugguggagcacagagccgaccccgugcuguacaaggacgacuuccccgagaagcugaagagcuuccccaacaucggcagccuguaa

SEQ ID NO: 16792 - RNA, 1014 nt, Artificial Sequence
  EXTL2__Homo_sapiens__XP_011539298
augagaaccuggaacagcggcggcaccaagugcugccacaucugcaagcugcccggcagagugaugggcaucagagugcugagacugagccugguggugauccuggugcugcugcugguggccggcgcccugaccgcccugcugcccagcgugaaggaggacaagaugcugaugcugagaagagagaucaagagccagggcaagagcaccauggacagcuucacccugaucaugcagaccuacaacagaaccgaccugcugcugaagcugcugaaccacuaccaggccgugcccaaccugcacaaggugaucgugguguggaacaacaucggcgagaaggcccccgacgagcuguggaacagccugggcccccaccccauccccgugaucuucaagcagcagaccgccaacagaaugagaaacagacugcagguguuccccgagcuggagaccaacgugcugaugguggacgacgacacccugaucagcacccccgaccugguguucgccuucagcguguggcagcaguuccccgaccagaucgugggcuucgugcccagaaagcacgugagcaccagcagcggcaucuacagcuacggcagcuucgagaugcaggcccccggcagcggcaacggcgaccaguacagcauggugcugaucggcgccagcuucuucaacagcaaguaccuggagcuguuccagagacagcccgccgccgugcacgcccugaucgacgacacccagaacugcgacgacaucgccaugaacuucaucaucgccaagcacaucggcaagaccagcggcaucuucgugaagcccgugaacauggacaaccuggagaaggagaccaacagcggcuacagcggcauguggcacagagccgagcacgcccugcagagaagcuacugcaucaacaagcuggugaacaucuacgacagcaugccccugagauacagcaacaucaugaucagccaguucggcuuccccuacgccaacuacaagagaaagaucuaa

SEQ ID NO: 16793 - RNA, 2760 nt, Artificial Sequence
  EXTL3__Homo_sapiens__NP_001431
augaccggcuacaccaugcugagaaacggcggcgccggcaacggcggccagaccugcaugcugagauggagcaacagaaucagacugaccuggcugagcuucacccuguucgugauccugguguucuucccccugaucgcccacuacuaccugaccacccuggacgaggccgacgaggccggcaagagaaucuucggccccagagugggcaacgagcugugcgaggugaagcacgugcuggaccugugcagaaucagagagagcgugagcgaggagcugcugcagcuggaggccaagagacaggagcugaacagcgagaucgccaagcugaaccugaagaucgaggccugcaagaagagcaucgagaacgccaagcaggaccugcugcagcugaagaacgugaucagccagaccgagcacagcuacaaggagcugauggcccagaaccagcccaagcugagccugcccaucagacugcugcccgagaaggacgacgccggccugcccccccccaaggccaccagaggcugcagacugcacaacugcuucgacuacagcagaugcccccugaccagcggcuuccccguguacguguacgacagcgaccaguucguguucggcagcuaccuggacccccuggugaagcaggccuuccaggccaccgccagagccaacguguacgugaccgagaacgccgacaucgccugccuguacgugauccuggugggcgagaugcaggagcccguggugcugagacccgccgagcuggagaagcagcuguacagccugccccacuggagaaccgacggccacaaccacgugaucaucaaccugagcagaaagagcgacacccagaaccugcuguacaacgugagcaccggcagagccaugguggcccagagcaccuucuacaccgugcaguacagacccggcuucgaccugguggugagcccccuggugcacgccaugagcgagcccaacuucauggagauccccccccaggugcccgugaagagaaaguaccuguucaccuuccagggcgagaagaucgagagccugagaagcagccugcaggaggccagaagcuucgaggaggagauggagggcgacccccccgccgacuacgacgacagaaucaucgccacccugaaggccgugcaggacagcaagcuggaccaggugcugguggaguucaccugcaagaaccagcccaagcccagccugcccaccgagugggcccugugcggcgagagagaggacagacuggagcugcugaagcugagcaccuucgcccugaucaucacccccggcgaccccagacuggugaucagcagcggcugcgccaccagacuguucgaggcccuggaggugggcgccgugcccguggugcugggcgagcaggugcagcugcccuaccaggacaugcugcaguggaacgaggccgcccugguggugcccaagcccagagugaccgaggugcacuuccugcugagaagccugagcgacagcgaccugcuggccaugagaagacagggcagauuccugugggagaccuacuucagcaccgccgacagcaucuucaacaccgugcuggccaugaucagaaccagaauccagauccccgccgcccccaucagagaggaggccgccgccgagaucccccacagaagcggcaaggccgccggcaccgaccccaacauggccgacaacggcgaccuggaccugggccccguggagaccgagccccccuacgccagccccagauaccugagaaacuucacccugaccgugaccgacuucuacagaagcuggaacugcgcccccggccccuuccaccuguucccccacacccccuucgaccccgugcugcccagcgaggccaaguuccugggcagcggcaccggcuucagacccaucggcggcggcgccggcggcagcggcaaggaguuccaggccgcccugggcggcaacgugcccagagagcaguucaccguggugaugcugaccuacgagagagaggaggugcugaugaacagccuggagagacugaacggccugcccuaccugaacaaggugguggugguguggaacagccccaagcugcccagcgaggaccugcuguggcccgacaucggcgugcccaucaugguggugagaaccgagaagaacagccugaacaacagauuccugcccuggaacgagaucgagaccgaggccauccugagcaucgacgacgacgcccaccugagacacgacgagaucauguucggcuucagaguguggagagaggccagagacagaaucgugggcuuccccggcagauaccacgccugggacaucccccaccagagcuggcuguacaacagcaacuacagcugcgagcugagcauggugcugaccggcgccgccuucuuccacaaguacuacgccuaccuguacagcuacgugaugccccaggccaucagagacaugguggacgaguacaucaacugcgaggacaucgccaugaacuuccuggugagccacaucaccagaaagccccccaucaaggugaccagcagauggaccuucagaugccccggcugcccccaggcccugagccacgacgacagccacuuccacgagagacacaagugcaucaacuucuucgugaagguguacggcuacaugccccugcuguacacccaguucagaguggacagcgugcuguucaagaccagacugccccacgacaagaccaagugcuucaaguucaucuaa

SEQ ID NO: 16794 - RNA, 1779 nt, Artificial Sequence
  EYA1__Homo_sapiens__NP_000494
auggagaugcaggaccugaccagcccccacagcagacugagcggcagcagcgagagccccagcggccccaagcugggcaacagccacaucaacagcaacagcaugacccccaacggcaccgaggugaagaccgagcccaugagcagcagcgagaccgccagcaccaccgccgacggcagccugaacaacuucagcggcagcgccaucggcagcagcagcuucagccccagacccacccaccaguucagccccccccagaucuaccccagcaacagacccuacccccacauccugcccacccccagcagccagaccauggccgccuacggccagacccaguucaccaccggcaugcagcaggccaccgccuacgccaccuacccccagcccggccagcccuacggcaucagcagcuacggcgcccugugggccggcaucaagaccgagggcggccugagccagagccagagccccggccagaccggcuuccugagcuacggcaccagcuucagcaccccccagcccggccaggcccccuacagcuaccagaugcagggcagcagcuucaccaccagcagcggcaucuacaccggcaacaacagccugaccaacagcagcggcuucaacagcagccagcaggacuaccccagcuaccccagcuucggccagggccaguacgcccaguacuacaacagcagccccuaccccgcccacuacaugaccagcagcaacaccagccccaccacccccagcaccaacgccaccuaccagcugcaggagccccccagcggcaucaccagccaggccgugaccgaccccaccgccgaguacagcaccauccacagccccagcacccccaucaaggacagcgacagcgacagacugagaagaggcagcgacggcaagagcagaggcagaggcagaagaaacaacaaccccagccccccccccgacagcgaccuggagagaguguucaucugggaccuggacgagaccaucaucguguuccacagccugcugaccggcagcuacgccaacagauacggcagagacccccccaccagcgugagccugggccugagaauggaggagaugaucuucaaccuggccgacacccaccuguucuucaacgaccuggaggagugcgaccaggugcacaucgacgacgugagcagcgacgacaacggccaggaccugagcaccuacaacuucggcaccgacggcuuccccgccgccgccaccagcgccaaccugugccuggccaccggcgugagaggcggcguggacuggaugagaaagcuggccuucagauacagaagagugaaggagaucuacaacaccuacaagaacaacgugggcggccugcugggccccgccaagagagaggccuggcugcagcugagagccgagaucgaggcccugaccgacagcuggcugacccuggcccugaaggcccugagccugauccacagcagaaccaacugcgugaacauccuggugaccaccacccagcugauccccgcccuggccaaggugcugcuguacggccugggcaucguguuccccaucgagaacaucuacagcgccaccaagaucggcaaggagagcugcuucgagagaaucauccagagauucggcagaaaggugguguacguggugaucggcgacggcguggaggaggagcagggcgccaagaagcacgccaugcccuucuggagaaucagcagccacagcgaccugauggcccugcaccacgcccuggagcuggaguaccuguaa

SEQ ID NO: 16795 - RNA, 1617 nt, Artificial Sequence
  EYA2__Homo_sapiens__NP_005235
augguggagcuggugaucagccccagccugaccgugaacagcgacugccuggacaagcugaaguucaacagagccgacgccgccguguggacccugagcgacagacagggcaucaccaagagcgccccccugagagugagccagcuguucagcagaagcugccccagagugcugcccagacagcccagcaccgccauggccgccuacggccagacccaguacagcgccggcauccagcaggccacccccuacaccgccuaccccccccccgcccaggccuacggcauccccagcuacagcaucaagaccgaggacagccugaaccacagccccggccagagcggcuuccugagcuacggcagcagcuucagcaccagccccaccggccagagccccuacaccuaccagaugcacggcaccaccggcuucuaccagggcggcaacggccugggcaacgccgccggcuucggcagcgugcaccaggacuaccccagcuaccccggcuucccccagagccaguacccccaguacuacggcagcagcuacaacccccccuacgugcccgccagcagcaucugccccagcccccugagcaccagcaccuacgugcugcaggaggccagccacaacgugcccaaccagagcagcgagagccuggccggcgaguacaacacccacaacggccccagcacccccgccaaggagggcgacaccgacagaccccacagagccagcgacggcaagcugagaggcagaagcaagagaagcagcgaccccagccccgccggcgacaacgagaucgagagaguguucgugugggaccuggacgagaccaucaucaucuuccacagccugcugaccggcaccuucgccagcagauacggcaaggacaccaccaccagcgugagaaucggccugaugauggaggagaugaucuucaaccuggccgacacccaccuguucuucaacgaccuggaggacugcgaccagauccacguggacgacgugagcagcgacgacaacggccaggaccugagcaccuacaacuucagcgccgacggcuuccacagcagcgcccccggcgccaaccugugccugggcagcggcgugcacggcggcguggacuggaugagaaagcuggccuucagauacagaagagugaaggagauguacaacaccuacaagaacaacgugggcggccugaucggcacccccaagagagagaccuggcugcagcugagagccgagcuggaggcccugaccgaccuguggcugacccacagccugaaggcccugaaccugaucaacagcagacccaacugcgugaacgugcuggugaccaccacccagcugauccccgcccuggccaaggugcugcuguacggccugggcagcguguuccccaucgagaacaucuacagcgccaccaagaccggcaaggagagcugcuucgagagaaucaugcagagauucggcagaaaggccguguacguggugaucggcgacggcguggaggaggagcagggcgccaagaagcacaacaugcccuucuggagaaucagcugccacgccgaccuggaggcccugagacacgcccuggagcuggaguaccuguaa

SEQ ID NO: 16796 - RNA, 1920 nt, Artificial Sequence
  EYA4__Homo_sapiens__NP_004091
auggaggacagccaggaccugaacgagcagagcgugaagaagaccugcaccgagagcgacgugagccagagccagaacagcagaagcauggagaugcaggaccuggccagcccccacacccuggugggcggcggcgacacccccggcagcagcaagcuggagaagagcaaccugagcagcaccagcgugaccaccaacggcaccggcggcgagaacaugaccgugcugaacaccgccgacuggcugcugagcugcaacacccccagcagcgccaccaugagccugcuggccgugaagaccgagccccugaacagcagcgagaccaccgccaccaccggcgacggcgcccuggacaccuucaccggcagcgugaucaccagcagcggcuacagccccagaagcgcccaccaguacagcccccagcuguaccccagcaagcccuacccccacauccugagcacccccgccgcccagaccaugagcgccuacgccggccagacccaguacagcggcaugcagcagcccgccguguacaccgccuacagccagaccggccagcccuacagccugcccaccuacgaccugggcgugaugcugcccgccaucaagaccgagagcggccugagccagacccagagcccccugcagagcggcugccugagcuacagccccggcuucagcaccccccagcccggccagacccccuacagcuaccagaugcccggcagcagcuucgcccccagcagcaccaucuacgccaacaacagcgugagcaacagcaccaacuucagcggcagccagcaggacuaccccagcuacaccgccuucggccagaaccaguacgcccaguacuacagcgccagcaccuacggcgccuacaugaccagcaacaacaccgccgacggcacccccagcagcaccagcaccuaccagcugcaggagagccugcccggccugaccaaccagcccggcgaguucgacaccaugcagagccccagcacccccaucaaggaccuggacgagagaaccugcagaagcagcggcagcaagagcagaggcagaggcagaaagaacaaccccagccccccccccgacagcgaccuggagagaguguucgugugggaccuggacgagaccaucaucguguuccacagccugcugaccggcagcuacgcccagaaguacggcaaggacccccccauggccgugacccugggccugagaauggaggagaugaucuucaaccuggccgacacccaccuguucuucaacgaccuggaggagugcgaccaggugcacaucgacgacgugagcagcgacgacaacggccaggaccugagcaccuacagcuucgccaccgacggcuuccacgccgccgccagcagcgccaaccugugccugcccaccggcgugagaggcggcguggacuggaugagaaagcuggccuucagauacagaagagugaaggagcuguacaacaccuacaagaacaacgugggcggccugcugggccccgccaagagagacgccuggcugcagcugagagccgagaucgagggccugaccgacagcuggcugaccaacgcccugaagagccugagcaucaucagcaccagaagcaacugcaucaacgugcuggugaccaccacccagcugauccccgcccuggccaaggugcugcuguacagccugggcggcgccuuccccaucgagaacaucuacagcgccaccaagaucggcaaggagagcugcuucgagagaaucaugcagagauucggcagaaaggugguguacguggugaucggcgacggcguggaggaggagcaggccgccaagaagcacaacaugcccuucuggagaaucagcagccacagcgaccugcuggcccugcaccaggcccuggagcuggaguaccuguaa

SEQ ID NO: 16797 - RNA, 9435 nt, Artificial Sequence
  EYS__Homo_sapiens__NP_001136272
augaccgacaagagcaucgugauccugagccugaugguguuccacagcagcuucaucaacggcaagaccugcagaagacagcugguggaggaguggcacccccagcccagcagcuacguggugaacuggacccugaccgagaacaucugccuggacuucuacagagacugcugguuccugggcgugaacaccaagaucgacaccagcggcaaccaggccgugccccagaucugcccccugcagauccagcugggcgacauccuggugaucagcagcgagcccagccugcaguuccccgagaucaaccugaugaacgugagcgagaccagcuucgugggcugcgugcagaacaccaccaccgaggaccagcugcuguucggcugcagacugaagggcaugcacaccgugaacagcaaguggcugagcgugggcacccacuacuucaucaccgugauggccagcggccccagccccugcccccugggccugagacugaacgugaccgugaagcagcaguucugccaggagagccugagcagcgaguucugcagcggccacggcaagugccugagcgaggccuggagcaagaccuacagcugccacugccagccccccuucagcggcaaguacugccaggagcuggacgccugcagcuucaagcccugcaagaacaacggcagcugcaucaacaagagagagaacugggacgagcaggccuacgagugcgugugccacccccccuucaccggcaagaacugcagcgagaucaucggccagugccagccccacgugugcuuccacggcaacugcagcaacaucaccagcaacagcuucaucugcgagugcgacgagcaguucagcggccccuucugcgaggugagcgccaagcccugcgugagccugcuguucuggaagagaggcaucugccccaacagcagcagcgccuacaccuacgagugccccaagggcagcagcagccagaacggcgagaccgacgugagcgaguucagccuggugcccugccagaacggcaccgacugcaucaagaucagcaacgacgugaugugcaucugcagccccaucuucaccgaccugcugugcaagagcauccagaccagcugcgagagcuucccccugagaaacaacgccaccugcaagaagugcgagaaggacuaccccugcagcugcaucagcggcuucaccgagaagaacugcgagaaggccaucgaccacugcaagcugcugagcaucaacugccugaacgaggaguggugcuucaacaucaucggcagauucaaguacgugugcauccccggcugcaccaagaaccccugcugguuccugaagaacguguaccugauccaccagcaccugugcuacugcggcgugaccuuccacggcaucugccaggacaagggccccgcccaguucgaguacguguggcagcugggcuucgccggcagcgagggcgagaagugccagggcgugaucgacgccuacuucuuccuggccgccaacugcaccgaggacgccaccuacgugaacgaccccgaggacaacaacagcagcugcugguucccccacgagggcaccaaggagaucugcgccaacggcugcagcugccugagcgaggaggacagccaggaguacagauaccugugcuuccugagaugggccggcaacauguaccuggagaacaccaccgacgaccaggagaacgagugccagcacgaggccgugugcaaggacgagaucaacagacccagaugcagcugcagccugagcuacaucggcagacugugcguggugaacguggacuacugccugggcaaccacagcaucagcgugcacggccugugccuggcccugagccacaacugcaacugcagcggccugcagagauacgagagaaacaucugcgagaucgacaccgaggacugcaagagcgccagcugcaagaacggcaccaccagcacccaccugagaggcuacuucuucagaaagugcgugcccggcuucaagggcacccagugcgagaucgacaucgacgagugcgccagccaccccugcaagaacggcgccaccugcaucgaccagcccggcaacuacuucugccagugcgugccccccuucaaggugguggacggcuucagcugccugugcaaccccggcuacgugggcaucagaugcgagcaggacaucgacgacugcauccugaacgccugcgagcacaacagcaccugcaaggaccugcaccugagcuaccagugcgugugccugagcgacugggagggcaacuucugcgagcaggagagcaacgagugcaagaugaaccccugcaagaacaacagcaccugcaccgaccuguacaagagcuacagaugcgagugcaccagcggcuggaccggccagaacugcagcgaggagaucaacgagugcgacagcgaccccugcaugaacggcggccugugccacgagagcaccauccccggccaguucgugugccugugccccccccuguacaccggccaguucugccaccagagauacaaccugugcgaccugcugcacaaccccugcagaaacaacagcaccugccuggcccugguggacgccaaccagcacugcaucugcagagaggaguucgagggcaagaacugcgagaucgacgugaaggacugccuguuccugagcugccaggacuacggcgacugcgaggacauggugaacaacuucagaugcaucugcagacccggcuucagcggcagccugugcgagaucgagaucaacgagugcagcagcgagcccugcaagaacaacggcaccugcguggaccugaccaacagauucuucugcaacugcgagcccgaguaccacggccccuucugcgagcuggacgugaacaagugcaagaucagccccugccuggacgaggagaacugcguguacagaaccgacggcuacaacugccugugcgcccccggcuacaccggcaucaacugcgagaucaaccuggacgagugccugagcgagcccugccugcacgacggcgugugcaucgacggcaucaaccacuacaccugcgacugcaagagcggcuucuucggcacccacugcgagaccaacgccaacgacugccugagcaaccccugccugcacggcagaugcaccgagcugaucaacgaguaccccugcagcugcgacgccgacggcaccagcacccagugcaagaucaagaucaacgacugcaccagcauccccugcaugaacgagggcuucugccagaagagcgcccacggcuucaccugcaucugccccagaggcuacaccggcgccuacugcgagaagagcaucgacaacugcgccgagcccgagcugaacagcgugaucugccugaacggcggcaucugcguggacggccccggccacaccuucgacugcagaugccugcccggcuucagcggccaguucugcgagaucaacaucaacgagugcagcagcagccccugccugcacggcgccgacugcgaggaccacaucaacggcuacgugugcaagugccagcccggcuggagcggccaccacugcgagaacgagcuggagugcauccccaacagcugcgugcacgagcugugcauggagaacgagcccggcagcaccugccugugcacccccggcuucaugaccugcagcaucggccugcugugcggcgacgagaucagaagaaucaccugccugacccccaucuuccagagaaccgaccccaucagcacccagaccuacaccaucccccccagcgagacccuggugagcagcuuccccagcaucaaggccaccagaauccccgccaucauggacaccuaccccguggaccagggccccaagcagaccggcaucgugaagcacgacauccugcccaccaccggccuggccacccugagaaucagcaccccccuggagagcuaccugcugcaggagcugaucgugaccagagagcugagcgccaagcacagccugcugagcagcgccgacgugagcagcagcagauuccugaacuucggcaucagagaccccgcccagaucgugcaggacaagaccagcgugagccacaugcccaucagaaccagcgccgccacccugggcuucuucuuccccgacagaagagccagaacccccuucaucaugagcagccugaugagcgacuucaucuuccccacccagagccugcuguucgagaacugccagaccguggcccugagcgccacccccaccaccagcgugaucagaagcauccccggcgccgacaucgagcugaacagacagagccugcugagcagaggcuuccugcugaucgccgccagcaucagcgccacccccguggugagcagaggcgcccaggaggacaucgaggaguacagcgccgacagccugaucagcagaagagagcacuggagacugcugagccccagcaugagccccaucuuccccgccaaggugaucaucagcaagcaggugaccauccugaacagcagcgcccugcacagauucagcaccaaggccuucaaccccagcgaguaccaggccaucaccgaggccagcagcaaccagagacugaccaacaucaagagccaggccgccgacagccugagagagcugagccagaccugcgccaccugcagcaugaccgagaucaagagcagcagagaguucagcgaccaggugcugcacagcaagcagagccacuucuacgagaccuucuggaugaacagcgccauccuggccagcugguacgcccugaugggcgcccagaccaucaccagcggccacagcuucagcagcgccaccgagaucacccccagcguggccuucaccgaggugcccagccuguuccccagcaagaagagcgccaagagaaccauccugagcagcagccuggaggagagcaucacccugagcagcaaccuggacgugaaccugugccuggacaagaccugccugagcaucgugcccagccagaccaucagcagcgaccugaugaacagcgaccugaccagcaagaugaccaccgacgagcugagcgugagcgagaacauccugaagcugcugaagaucagacaguacggcaucaccaugggccccaccgaggugcugaaccaggagagccugcuggacauggagaagagcaagggcagccacacccuguucaagcugcaccccagcgacagcagccuggacuucgagcugaaccugcagaucuaccccgacgugacccugaagaccuacagcgagaucacccacgccaacgacuucaagaacaaccugcccccccugaccggcagcgugcccgacuucagcgaggugaccaccaacguggccuucuacaccgugagcgccacccccgcccugagcauccagaccagcagcagcaugagcgugaucagacccgacuggcccuacuucaccgacuacaugaccagccugaagaaggaggugaagaccagcagcgaguggagcaagugggagcugcagcccagcgugcaguaccaggaguuccccaccgccagcagacaccugcccuucaccagaagccugacccugagcagccuggagagcauccuggccccccagagacugaugaucagcgacuucagcugcgugagauacuacggcgacagcuaccuggaguuccagaacguggcccugaacccccagaacaacaucagccuggaguuccagaccuucagcagcuacggccugcugcuguacgugaagcaggacagcaaccugguggacggcuucuucauccagcuguucaucgagaacggcacccugaaguaccacuucuacugccccggcgaggccaaguucaagagcaucaacaccaccgugagaguggacaacggccagaaguacacccugcugaucagacaggagcuggaccccugcaacgccgagcugaccauccugggcagaaacacccagaucugcgagagcaucaaccacgugcugggcaagccccugcccaagagcggcagcguguucaucggcggcuuccccgaccugcacggcaagauccagaugcccgugcccgugaagaacuucaccggcugcaucgaggugaucgagaucaacaacuggagaagcuucauccccagcaaggccgugaagaacuaccacaucaacaacugcagaagccagggcuucaugcugagccccaccgccagcuucguggacgccagcgacgugacccagggcguggacaccauguggaccagcgugagccccagcguggccgcccccagcgugugccagcaggacgugugccacaacggcggcaccugccacgccaucuuccugagcagcggcaucgugagcuuccagugcgacugcccccugcacuucaccggcagauucugcgagaaggacgccggccuguucuuccccagcuucaacggcaacagcuaccuggagcugcccuuccugaaguucgugcuggagaaggagcacaacagaaccgugaccaucuaccugaccaucaagaccaacagccugaacggcaccauccuguacagcaacggcaacaacugcggcaagcaguuccugcaccuguuccugguggagggcagacccagcgugaaguacggcugcggcaacagccagaacauccugaccgugagcgccaacuacagcaucaacaccaacgccuucacccccaucaccaucagauacaccacccccgugggcagccccggcguggugugcaugaucgagaugaccgccgacggcaagccccccgugcagaagaaggacaccgagaucagccacgccagccaggccuacuucgagagcauguuccugggccacauccccgccaacgugcagauccacaagaaggccggccccguguacggcuucagaggcugcauccuggaccugcaggugaacaacaaggaguucuucaucaucgacgaggccagacacggcaagaacaucgagaacugccacgugcccuggugcgcccaccaccugugcagaaacaacggcaccugcaucagcgacaacgagaaccuguucugcgagugccccagacuguacagcggcaagcugugccaguucgccagcugcgagaacaaccccugcggcaacggcgccaccugcgugcccaagagcggcaccgacaucgugugccugugccccuacggcagaagcggcccccugugcaccgacgccaucaacaucacccagcccagauucagcggcaccgacgccuucggcuacaccagcuuccuggccuacagcagaaucagcgacaucagcuuccacuacgaguuccaccugaaguuccagcuggccaacaaccacagcgcccugcagaacaaccugaucuucuucaccggccagaagggccacggccugaacggcgacgacuuccuggccgugggccugcugaacggcagcgugguguacagcuacaaccugggcagcggcaucgccagcaucagaagcgagccccugaaccugagccugggcgugcacaccgugcaccugggcaaguucuuccaggagggcuggcugaagguggacgaccacaagaacaagagcaucaucgcccccggcagacuggugggccugaacguguucagccaguucuacgugggcggcuacagcgaguacacccccgaccugcugcccaacggcgccgacuucaagaacggcuuccagggcugcaucuucacccugcaggugagaaccgagaaggacggccacuucagaggccugggcaaccccgagggccaccccaacgccggcagaagcgugggccagugccacgccagccccugcagccugaugaagugcggcaacggcggcaccugcaucgagagcggcaccagcguguacugcaacugcaccaccggcuggaagggcagcuucugcaccgagaccgugagcaccugcgaccccgagcacgaccccccccaccacugcagcagaggcgccaccugcaucagccugccccacggcuacaccugcuucugcccccugggcaccaccggcaucuacugcgagcaggcccugagcaucagcgaccccagcuucagaagcaacgagcugagcuggaugagcuucgccagcuuccacgugagaaagaagacccacauccagcugcaguuccagccccuggccgccgacggcauccuguucuacgccgcccagcaccugaaggcccagagcggcgacuuccugugcaucagccuggugaacagcagcgugcagcugagauacaaccugggcgacagaaccaucauccuggagacccugcagaaggugaccaucaacggcagcaccuggcacaucaucaaggccggcagagugggcgccgagggcuaccuggaccuggacggcaucaacgugaccgagaaggccagcaccaagaugagcagccuggacaccaacaccgacuucuacaucggcggcgugagcagccugaaccuggugaaccccauggccaucgagaacgagcccgugggcuuccagggcugcaucagacaggugaucaucaacaaccaggagcugcagcugaccgaguucggcgccaagggcggcagcaacgugggcgacugcgacggcaccgccugcggcuacaacaccugcagaaacggcggcgagugcaccgugaacggcaccaccuucagcugcagaugccugcccgacugggccggcaacaccugcaaccagagcgugagcugccugaacaaccugugccugcaccagagccugugcauccccgaccagagcuucagcuacagcugccugugcacccugggcugggugggcagauacugcgagaacaagaccagcuucagcaccgccaaguucaugggcaacagcuacaucaaguacaucgaccccaacuacagaaugagaaaccugcaguucaccaccaucagccugaacuucagcaccaccaagaccgagggccugaucguguggaugggcaucgcccagaacgaggagaacgacuuccuggccaucggccugcacaaccagacccugaagaucgccgugaaccugggcgagagaaucagcgugcccaugagcuacaacaacggcaccuucugcugcaacaaguggcaccacgugguggugauccagaaccagacccugaucaaggccuacaucaacaacagccugauccugagcgaggacaucgacccccacaagaacuucguggcccugaacuacgacggcaucugcuaccugggcggcuucgaguacggcagaaaggugaacaucgugacccaggagaucuucaagaccaacuucgugggcaagaucaaggacgugguguucuuccaggagcccaagaacaucgagcugaucaagcuggagggcuacaacguguacgacggcgacgagcagaacgaggugaccuaa

SEQ ID NO: 16798 - RNA, 2244 nt, Artificial Sequence
  EZH1__Homo_sapiens__NP_001982
auggagauccccaacccccccaccagcaagugcaucaccuacuggaagagaaaggugaagagcgaguacaugagacugagacagcugaagagacugcaggccaacaugggcgccaaggcccuguacguggccaacuucgccaaggugcaggagaagacccagauccugaacgaggaguggaagaagcugagagugcagcccgugcagagcaugaagcccgugagcggccaccccuuccugaagaagugcaccaucgagagcaucuuccccggcuucgccagccagcacaugcugaugagaagccugaacaccguggcccuggugcccaucauguacagcuggagcccccugcagcagaacuucaugguggaggacgagaccgugcugugcaacauccccuacaugggcgacgaggugaaggaggaggacgagaccuucaucgaggagcugaucaacaacuacgacggcaaggugcacggcgaggaggagaugauccccggcagcgugcugaucagcgacgccguguuccuggagcugguggacgcccugaaccaguacagcgacgaggaggaggagggccacaacgacaccagcgacggcaagcaggacgacagcaaggaggaccugcccgugaccagaaagagaaagagacacgccaucgagggcaacaagaagagcagcaagaagcaguuccccaacgacaugaucuucagcgccaucgccagcauguuccccgagaacggcgugcccgacgacaugaaggagagauacagagagcugaccgagaugagcgaccccaacgcccugcccccccagugcacccccaacaucgacggccccaacgccaagagcgugcagagagagcagagccugcacagcuuccacacccuguucugcagaagaugcuucaaguacgacugcuuccugcaccccuuccacgccacccccaacguguacaagagaaagaacaaggagaucaagaucgagcccgagcccugcggcaccgacugcuuccugcugcuggagggcgccaaggaguacgccaugcugcacaaccccagaagcaagugcagcggcagaagaagaagaagacaccacaucgugagcgccagcugcagcaacgccagcgccagcgccguggccgagaccaaggagggcgacagcgacagagacaccggcaacgacugggccagcagcagcagcgaggccaacagcagaugccagacccccaccaagcagaaggccagccccgcccccccccagcugugcgugguggaggcccccagcgagcccguggaguggaccggcgccgaggagagccuguucagaguguuccacggcaccuacuucaacaacuucugcagcaucgccagacugcugggcaccaagaccugcaagcagguguuccaguucgccgugaaggagagccugauccugaagcugcccaccgacgagcugaugaaccccagccagaagaagaagagaaagcacagacugugggccgcccacugcagaaagauccagcugaagaaggacaacagcagcacccagguguacaacuaccagcccugcgaccaccccgacagacccugcgacagcaccugccccugcaucaugacccagaacuucugcgagaaguucugccagugcaaccccgacugccagaacagauuccccggcugcagaugcaagacccagugcaacaccaagcagugccccugcuaccuggccgugagagagugcgaccccgaccugugccugaccugcggcgccagcgagcacugggacugcaagguggugagcugcaagaacugcagcauccagagaggccugaagaagcaccugcugcuggcccccagcgacguggccggcuggggcaccuucaucaaggagagcgugcagaagaacgaguucaucagcgaguacugcggcgagcugaucagccaggacgaggccgacagaagaggcaagguguacgacaaguacaugagcagcuuccuguucaaccugaacaacgacuucgugguggacgccaccagaaagggcaacaagaucagauucgccaaccacagcgugaaccccaacugcuacgccaagguggugauggugaacggcgaccacagaaucggcaucuucgccaagagagccauccaggccggcgaggagcuguucuucgacuacagauacagccaggccgacgcccugaaguacgugggcaucgagagagagaccgacgugcuguaa

SEQ ID NO: 16799 - RNA, 2265 nt, Artificial Sequence
  EZH2__Homo_sapiens__XP_005250019
augaucuacuucaucagaaucaucaugggccagaccggcaagaagagcgagaagggccccgugugcuggagaaagagagugaagagcgaguacaugagacugagacagcugaagagauucagaagagccgacgaggugaagagcauguucagcagcaacagacagaagauccuggagagaaccgagauccugaaccaggaguggaagcagagaagaauccagcccgugcacauccugaccagcgugagcagccugagaggcaccagagagugcagcgugaccagcgaccuggacuuccccacccaggugaucccccugaagacccugaacgccguggccagcgugcccaucauguacagcuggagcccccugcagcagaacuucaugguggaggacgagaccgugcugcacaacauccccuacaugggcgacgaggugcuggaccaggacggcaccuucaucgaggagcugaucaagaacuacgacggcaaggugcacggcgacagagagugcggcuucaucaacgacgagaucuucguggagcuggugaacgcccugggccaguacaacgacgacgacgacgacgacgacggcgacgaccccgaggagagagaggagaagcagaaggaccuggaggaccacagagacgacaaggagagcagaccccccagaaaguuccccagcgacaagaucuucgaggccaucagcagcauguuccccgacaagggcaccgccgaggagcugaaggagaaguacaaggagcugaccgagcagcagcugcccggcgcccugccccccgagugcacccccaacaucgacggccccaacgccaagagcgugcagagagagcagagccugcacagcuuccacacccuguucugcagaagaugcuucaaguacgacugcuuccugcaccccuuccacgccacccccaacaccuacaagagaaagaacaccgagaccgcccuggacaacaagcccugcggcccccagugcuaccagcaccuggagggcgccaaggaguucgccgccgcccugaccgccgagagaaucaagaccccccccaagagacccggcggcagaagaagaggcagacugcccaacaacagcagcagacccagcacccccaccaucaacgugcuggagagcaaggacaccgacagcgacagagaggccggcaccgagaccggcggcgagaacaacgacaaggaggaggaggagaagaaggacgagaccagcagcagcagcgaggccaacagcagaugccagacccccaucaagaugaagcccaacaucgagccccccgagaacguggaguggagcggcgccgaggccagcauguucagagugcugaucggcaccuacuacgacaacuucugcgccaucgccagacugaucggcaccaagaccugcagacagguguacgaguucagagugaaggagagcagcaucaucgcccccgcccccgccgaggacguggacaccccccccagaaagaagaagagaaagcacagacugugggccgcccacugcagaaagauccagcugaagaaggacggcagcagcaaccacguguacaacuaccagcccugcgaccaccccagacagcccugcgacagcagcugccccugcgugaucgcccagaacuucugcgagaaguucugccagugcagcagcgagugccagaacagauuccccggcugcagaugcaaggcccagugcaacaccaagcagugccccugcuaccuggccgugagagagugcgaccccgaccugugccugaccugcggcgccgccgaccacugggacagcaagaacgugagcugcaagaacugcagcauccagagaggcagcaagaagcaccugcugcuggcccccagcgacguggccggcuggggcaucuucaucaaggaccccgugcagaagaacgaguucaucagcgaguacugcggcgagaucaucagccaggacgaggccgacagaagaggcaagguguacgacaaguacaugugcagcuuccuguucaaccugaacaacgacuucgugguggacgccaccagaaagggcaacaagaucagauucgccaaccacagcgugaaccccaacugcuacgccaaggugaugauggugaacggcgaccacagaaucggcaucuucgccaagagagccauccagaccggcgaggagcuguucuucgacuacagauacagccaggccgacgcccugaaguacgugggcaucgagagagagauggagauccccuaa

SEQ ID NO: 16800 - RNA, 1761 nt, Artificial Sequence
  EZR__Homo_sapiens__NP_001104547
augcccaagcccaucaacgugagagugaccaccauggacgccgagcuggaguucgccauccagcccaacaccaccggcaagcagcuguucgaccagguggugaagaccaucggccugagagaggugugguacuucggccugcacuacguggacaacaagggcuuccccaccuggcugaagcuggacaagaaggugagcgcccaggaggugagaaaggagaacccccugcaguucaaguucagagccaaguucuaccccgaggacguggccgaggagcugauccaggacaucacccagaagcuguucuuccugcaggugaaggagggcauccugagcgacgagaucuacugcccccccgagaccgccgugcugcugggcagcuacgccgugcaggccaaguucggcgacuacaacaaggaggugcacaagagcggcuaccugagcagcgagagacugaucccccagagagugauggaccagcacaagcugaccagagaccagugggaggacagaauccagguguggcacgccgagcacagaggcaugcugaaggacaacgccaugcuggaguaccugaagaucgcccaggaccuggagauguacggcaucaacuacuucgagaucaagaacaagaagggcaccgaccuguggcugggcguggacgcccugggccugaacaucuacgagaaggacgacaagcugacccccaagaucggcuuccccuggagcgagaucagaaacaucagcuucaacgacaagaaguucgugaucaagcccaucgacaagaaggcccccgacuucguguucuacgcccccagacugagaaucaacaagagaauccugcagcugugcaugggcaaccacgagcuguacaugagaagaagaaagcccgacaccaucgaggugcagcagaugaaggcccaggccagagaggagaagcaccagaagcagcuggagagacagcagcuggagaccgagaagaagagaagagagaccguggagagagagaaggagcagaugaugagagagaaggaggagcugaugcugagacugcaggacuacgaggagaagaccaagaaggccgagagagagcugagcgagcagauccagagagcccugcagcuggaggaggagagaaagagagcccaggaggaggccgagagacuggaggccgacagaauggccgcccugagagccaaggaggagcuggagagacaggccguggaccagaucaagagccaggagcagcuggccgccgagcuggccgaguacaccgccaagaucgcccugcuggaggaggccagaagaagaaaggaggacgagguggaggaguggcagcacagagccaaggaggcccaggacgaccuggugaagaccaaggaggagcugcaccuggugaugaccgcccccccccccccccccccccccguguacgagcccgugagcuaccacgugcaggagagccugcaggacgagggcgccgagcccaccggcuacagcgccgagcugagcagcgagggcaucagagacgacagaaacgaggagaagagaaucaccgaggccgagaagaacgagagagugcagagacagcugcugacccugagcagcgagcugagccaggccagagacgagaacaagagaacccacaacgacaucauccacaacgagaacaugagacagggcagagacaaguacaagacccugagacagaucagacagggcaacaccaagcagagaaucgacgaguucgaggcccuguaa

SEQ ID NO: 16801 - RNA, 1467 nt, Artificial Sequence
  F10__Homo_sapiens__NP_000495
augggcagaccccugcaccuggugcugcugagcgccagccuggccggccugcugcugcugggcgagagccuguucaucagaagagagcaggccaacaacauccuggccagagugaccagagccaacagcuuccuggaggagaugaagaagggccaccuggagagagagugcauggaggagaccugcagcuacgaggaggccagagagguguucgaggacagcgacaagaccaacgaguucuggaacaaguacaaggacggcgaccagugcgagaccagccccugccagaaccagggcaagugcaaggacggccugggcgaguacaccugcaccugccuggagggcuucgagggcaagaacugcgagcuguucaccagaaagcugugcagccuggacaacggcgacugcgaccaguucugccacgaggagcagaacagcguggugugcagcugcgccagaggcuacacccuggccgacaacggcaaggccugcauccccaccggccccuaccccugcggcaagcagacccuggagagaagaaagagaagcguggcccaggccaccagcagcagcggcgaggcccccgacagcaucaccuggaagcccuacgacgccgccgaccuggaccccaccgagaaccccuucgaccugcuggacuucaaccagacccagcccgagagaggcgacaacaaccugaccagaaucgugggcggccaggagugcaaggacggcgagugccccuggcaggcccugcugaucaacgaggagaacgagggcuucugcggcggcaccauccugagcgaguucuacauccugaccgccgcccacugccuguaccaggccaagagauucaaggugagagugggcgacagaaacaccgagcaggaggagggcggcgaggccgugcacgagguggagguggugaucaagcacaacagauucaccaaggagaccuacgacuucgacaucgccgugcugagacugaagacccccaucaccuucagaaugaacguggcccccgccugccugcccgagagagacugggccgagagcacccugaugacccagaagaccggcaucgugagcggcuucggcagaacccacgagaagggcagacagagcaccagacugaagaugcuggaggugcccuacguggacagaaacagcugcaagcugagcagcagcuucaucaucacccagaacauguucugcgccggcuacgacaccaagcaggaggacgccugccagggcgacagcggcggcccccacgugaccagauucaaggacaccuacuucgugaccggcaucgugagcuggggcgagggcugcgccagaaagggcaaguacggcaucuacaccaaggugaccgccuuccugaaguggaucgacagaagcaugaagaccagaggccugcccaaggccaagagccacgcccccgaggugaucaccagcagcccccugaaguaa

SEQ ID NO: 16802 - RNA, 1878 nt, Artificial Sequence
  F11__Homo_sapiens__NP_000119
augaucuuccuguaccagguggugcacuucauccuguucaccagcgugagcggcgagugcgugacccagcugcugaaggacaccugcuucgagggcggcgacaucaccaccguguucacccccagcgccaaguacugccagguggugugcaccuaccaccccagaugccugcuguucaccuucaccgccgagagccccagcgaggaccccaccagaugguucaccugcgugcugaaggacagcgugaccgagacccugcccagagugaacagaaccgccgccaucagcggcuacagcuucaagcagugcagccaccagaucagcgccugcaacaaggacaucuacguggaccuggacaugaagggcaucaacuacaacagcagcguggccaagagcgcccaggagugccaggagagaugcaccgacgacgugcacugccacuucuucaccuacgccaccagacaguuccccagccuggagcacagaaacaucugccugcugaagcacacccagaccggcacccccaccagaaucaccaagcuggacaagguggugagcggcuucagccugaagagcugcgcccugagcaaccuggccugcaucagagacaucuuccccaacaccguguucgccgacagcaacaucgacagcgugauggcccccgacgccuucgugugcggcagaaucugcacccaccaccccggcugccuguucuucaccuucuucagccaggaguggcccaaggagagccagagaaaccugugccugcugaagaccagcgagagcggccugcccagcaccagaaucaagaagagcaaggcccugagcggcuucagccugcagagcugcagacacagcauccccguguucugccacagcagcuucuaccacgacaccgacuuccugggcgaggagcuggacaucguggccgccaagagccacgaggccugccagaagcugugcaccaacgccgugagaugccaguucuucaccuacacccccgcccaggccagcugcaacgagggcaagggcaagugcuaccugaagcugagcagcaacggcagccccaccaagauccugcacggcagaggcggcaucagcggcuacacccugagacugugcaagauggacaacgagugcaccaccaagaucaagcccagaaucgugggcggcaccgccagcgugagaggcgaguggcccuggcaggugacccugcacaccaccagccccacccagagacaccugugcggcggcagcaucaucggcaaccaguggauccugaccgccgcccacugcuucuacggcguggagagccccaagauccugagaguguacagcggcauccugaaccagagcgagaucaaggaggacaccagcuucuucggcgugcaggagaucaucauccacgaccaguacaagauggccgagagcggcuacgacaucgcccugcugaagcuggagaccaccgugaacuacaccgacagccagagacccaucugccugcccagcaagggcgacagaaacgugaucuacaccgacugcugggugaccggcuggggcuacagaaagcugagagacaagauccagaacacccugcagaaggccaagaucccccuggugaccaacgaggagugccagaagagauacagaggccacaagaucacccacaagaugaucugcgccggcuacagagagggcggcaaggacgccugcaagggcgacagcggcggcccccugagcugcaagcacaacgagguguggcaccuggugggcaucaccagcuggggcgagggcugcgcccagagagagagacccggcguguacaccaacgugguggaguacguggacuggauccuggagaagacccaggccguguaa

SEQ ID NO: 16803 - RNA, 900 nt, Artificial Sequence
  F11R__Homo_sapiens__NP_058642
augggcaccaaggcccagguggagagaaagcugcugugccuguucauccuggccauccugcugugcagccuggcccugggcagcgugaccgugcacagcagcgagcccgaggugagaauccccgagaacaaccccgugaagcugagcugcgccuacagcggcuucagcagccccagaguggaguggaaguucgaccagggcgacaccaccagacuggugugcuacaacaacaagaucaccgccagcuacgaggacagagugaccuuccugcccaccggcaucaccuucaagagcgugaccagagaggacaccggcaccuacaccugcauggugagcgaggagggcggcaacagcuacggcgaggugaaggugaagcugaucgugcuggugccccccagcaagcccaccgugaacauccccagcagcgccaccaucggcaacagagccgugcugaccugcagcgagcaggacggcagcccccccagcgaguacaccugguucaaggacggcaucgugaugcccaccaaccccaagagcaccagagccuucagcaacagcagcuacgugcugaaccccaccaccggcgagcugguguucgacccccugagcgccagcgacaccggcgaguacagcugcgaggccagaaacggcuacggcacccccaugaccagcaacgccgugagaauggaggccguggagagaaacgugggcgugaucguggccgccgugcuggugacccugauccugcugggcauccugguguucggcaucugguucgccuacagcagaggccacuucgacagaaccaagaagggcaccagcagcaagaaggugaucuacagccagcccagcgccagaagcgagggcgaguucaagcagaccagcagcuuccugguguaa

SEQ ID NO: 16804 - RNA, 1848 nt, Artificial Sequence
  F12__Homo_sapiens__NP_000496
augagagcccugcugcugcugggcuuccugcuggugagccuggagagcacccugagcaucccccccugggaggcccccaaggagcacaaguacaaggccgaggagcacaccguggugcugaccgugaccggcgagcccugccacuuccccuuccaguaccacagacagcuguaccacaagugcacccacaagggcagacccggcccccagcccuggugcgccaccacccccaacuucgaccaggaccagagauggggcuacugccuggagcccaagaaggugaaggaccacugcagcaagcacagccccugccagaagggcggcaccugcgugaacaugcccagcggcccccacugccugugcccccagcaccugaccggcaaccacugccagaaggagaagugcuucgagccccagcugcugagauucuuccacaagaacgagaucugguacagaaccgagcaggccgccguggccagaugccagugcaagggccccgacgcccacugccagagacuggccagccaggccugcagaaccaaccccugccugcacggcggcagaugccuggagguggagggccacagacugugccacugccccgugggcuacaccggcgccuucugcgacguggacaccaaggccagcugcuacgacggcagaggccugagcuacagaggccuggccagaaccacccugagcggcgcccccugccagcccugggccagcgaggccaccuacagaaacgugaccgccgagcaggccagaaacuggggccugggcggccacgccuucugcagaaaccccgacaacgacaucagacccuggugcuucgugcugaacagagacagacugagcugggaguacugcgaccuggcccagugccagacccccacccaggccgccccccccacccccgugagccccagacugcacgugccccugaugcccgcccagcccgccccccccaagccccagcccaccaccagaacccccccccagagccagacccccggcgcccugcccgccaagagagagcagccccccagccugaccagaaacggcccccugagcugcggccagagacugagaaagagccugagcagcaugaccagaguggugggcggccugguggcccugagaggcgcccaccccuacaucgccgcccuguacuggggccacagcuucugcgccggcagccugaucgcccccugcugggugcugaccgccgcccacugccugcaggacagacccgcccccgaggaccugaccguggugcugggccaggagagaagaaaccacagcugcgagcccugccagacccuggccgugagaagcuacagacugcacgaggccuucagccccgugagcuaccagcacgaccuggcccugcugagacugcaggaggacgccgacggcagcugcgcccugcugagccccuacgugcagcccgugugccugcccagcggcgccgccagacccagcgagaccacccugugccagguggccggcuggggccaccaguucgagggcgccgaggaguacgccagcuuccugcaggaggcccaggugcccuuccugagccuggagagaugcagcgcccccgacgugcacggcagcagcauccugcccggcaugcugugcgccggcuuccuggagggcggcaccgacgccugccagggcgacagcggcggcccccuggugugcgaggaccaggccgccgagagaagacugacccugcagggcaucaucagcuggggcagcggcugcggcgacagaaacaagcccggcguguacaccgacguggccuacuaccuggccuggaucagagagcacaccgugagcuaa

SEQ ID NO: 16805 - RNA, 2199 nt, Artificial Sequence
  F13A1__Homo_sapiens__NP_000120
augagcgagaccagcagaaccgccuucggcggcagaagagccgugccccccaacaacagcaacgccgccgaggacgaccugcccaccguggagcugcagggcguggugcccagaggcgugaaccugcaggaguuccugaacgugaccagcgugcaccuguucaaggagagaugggacaccaacaagguggaccaccacaccgacaaguacgagaacaacaagcugaucgugagaagaggccagagcuucuacgugcagaucgacuucagcagacccuacgaccccagaagagaccuguucagaguggaguacgugaucggcagauacccccaggagaacaagggcaccuacauccccgugcccaucgugagcgagcugcagagcggcaaguggggcgccaagaucgugaugagagaggacagaagcgugagacugagcauccagagcagccccaagugcaucgugggcaaguucagaauguacguggccguguggacccccuacggcgugcugagaaccagcagaaaccccgagaccgacaccuacauccuguucaaccccuggugcgaggacgacgccguguaccuggacaacgagaaggagagagaggaguacgugcugaacgacaucggcgugaucuucuacggcgaggugaacgacaucaagaccagaagcuggagcuacggccaguucgaggacggcauccuggacaccugccuguacgugauggacagagcccagauggaccugagcggcagaggcaaccccaucaaggugagcagagugggcagcgccauggugaacgccaaggacgacgagggcgugcuggugggcagcugggacaacaucuacgccuacggcgugccccccagcgccuggaccggcagcguggacauccugcuggaguacagaagcagcgagaaccccgugagauacggccagugcuggguguucgccggcguguucaacaccuuccugagaugccugggcauccccgccagaaucgugaccaacuacuucagcgcccacgacaacgacgccaaccugcagauggacaucuuccuggaggaggacggcaacgugaacagcaagcugaccaaggacagcguguggaacuaccacugcuggaacgaggccuggaugaccagacccgaccugcccgugggcuucggcggcuggcaggccguggacagcaccccccaggagaacagcgacggcauguacagaugcggccccgccagcgugcaggccaucaagcacggccacgugugcuuccaguucgacgcccccuucguguucgccgaggugaacagcgaccugaucuacaucaccgccaagaaggacggcacccacgugguggagaacguggacgccacccacaucggcaagcugaucgugaccaagcagaucggcggcgacggcaugauggacaucaccgacaccuacaaguuccaggagggccaggaggaggagagacuggcccuggagaccgcccugauguacggcgccaagaagccccugaacaccgagggcgugaugaagagcagaagcaacguggacauggacuucgagguggagaacgccgugcugggcaaggacuucaagcugagcaucaccuucagaaacaacagccacaacagauacaccaucaccgccuaccugagcgccaacaucaccuucuacaccggcgugcccaaggccgaguucaagaaggagaccuucgacgugacccuggagccccugagcuucaagaaggaggccgugcugauccaggccggcgaguacaugggccagcugcuggagcaggccagccugcacuucuucgugaccgccagaaucaacgagaccagagacgugcuggccaagcagaagagcaccgugcugaccauccccgagaucaucaucaaggugagaggcacccagguggugggcagcgacaugaccgugaccguggaguucaccaacccccugaaggagacccugagaaacgugugggugcaccuggacggccccggcgugaccagacccaugaagaagauguucagagagaucagacccaacagcaccgugcagugggaggaggugugcagacccugggugagcggccacagaaagcugaucgccagcaugagcagcgacagccugagacacguguacggcgagcuggacgugcagauccagagaagacccagcauguaa

SEQ ID NO: 16806 - RNA, 1986 nt, Artificial Sequence
  F13B__Homo_sapiens__NP_001985
augagacugaagaaccugaccuucaucaucauccugaucaucagcggcgagcuguacgccgaggagaagcccugcggcuucccccacguggagaacggcagaaucgcccaguacuacuacaccuucaagagcuucuacuuccccaugagcaucgacaagaagcugagcuucuucugccuggccggcuacaccaccgagagcggcagacaggaggagcagaccaccugcaccaccgagggcuggagccccgagcccagaugcuucaagaagugcaccaagcccgaccugagcaacggcuacaucagcgacgugaagcugcuguacaagauccaggagaacaugagauacggcugcgccagcggcuacaagaccaccggcggcaaggacgaggagguggugcagugccugagcgacggcuggagcagccagcccaccugcagaaaggagcacgagaccugccuggcccccgagcuguacaacggcaacuacagcaccacccagaagaccuucaaggugaaggacaaggugcaguacgagugcgccaccggcuacuacaccgccggcggcaagaagaccgaggagguggagugccugaccuacggcuggagccugacccccaagugcaccaagcugaagugcagcagccugagacugaucgagaacggcuacuuccaccccgugaagcagaccuacgaggagggcgacguggugcaguucuucugccacgagaacuacuaccugagcggcagcgaccugauccagugcuacaacuucggcugguaccccgagagccccgugugcgagggcagaagaaacagaugccccccccccccccugcccaucaacagcaagauccagacccacagcaccaccuacagacacggcgagaucgugcacaucgagugcgagcugaacuucgagauccacggcagcgccgagaucagaugcgaggacggcaaguggaccgagccccccaagugcaucgagggccaggagaagguggccugcgaggagccccccuucaucgagaacggcgccgccaaccugcacagcaagaucuacuacaacggcgacaaggugaccuacgccugcaagagcggcuaccugcugcacggcagcaacgagaucaccugcaacagaggcaaguggacccugccccccgagugcguggagaacaacgagaacugcaagcacccccccguggugaugaacggcgccguggccgacggcauccuggccagcuacgccaccggcagcagcguggaguacagaugcaacgaguacuaccugcugagaggcagcaagaucagcagaugcgagcagggcaaguggagcagcccccccgugugccuggagcccugcaccgugaacguggacuacaugaacagaaacaacaucgagaugaaguggaaguacgagggcaaggugcugcacggcgaccugaucgacuucgugugcaagcagggcuacgaccugagcccccugaccccccugagcgagcugagcgugcagugcaacagaggcgaggugaaguacccccugugcaccagaaaggagagcaagggcaugugcaccagccccccccugaucaagcacggcgugaucaucagcagcaccguggacaccuacgagaacggcagcagcguggaguacagaugcuucgaccaccacuuccuggagggcagcagagaggccuacugccuggacggcauguggaccacccccccccugugccuggagcccugcacccugagcuucaccgagauggagaagaacaaccugcugcugaagugggacuucgacaacagaccccacauccugcacggcgaguacaucgaguucaucugcagaggcgacaccuaccccgccgagcuguacaucaccggcagcauccugagaaugcagugcgacagaggccagcugaaguaccccagaugcauccccagacagagcacccugagcuaccaggagccccugagaaccuaa

SEQ ID NO: 16807 - RNA, 1869 nt, Artificial Sequence
  F2__Homo_sapiens__NP_000497
auggcccacgugagaggccugcagcugcccggcugccuggcccuggccgcccugugcagccuggugcacagccagcacguguuccuggccccccagcaggccagaagccugcugcagagagugagaagagccaacaccuuccuggaggaggugagaaagggcaaccuggagagagagugcguggaggagaccugcagcuacgaggaggccuucgaggcccuggagagcagcaccgccaccgacguguucugggccaaguacaccgccugcgagaccgccagaacccccagagacaagcuggccgccugccuggagggcaacugcgccgagggccugggcaccaacuacagaggccacgugaacaucaccagaagcggcaucgagugccagcuguggagaagcagauacccccacaagcccgagaucaacagcaccacccaccccggcgccgaccugcaggagaacuucugcagaaaccccgacagcagcaccaccggccccuggugcuacaccaccgaccccaccgugagaagacaggagugcagcauccccgugugcggccaggaccaggugaccguggccaugacccccagaagcgagggcagcagcgugaaccugagccccccccuggagcagugcgugcccgacagaggccagcaguaccagggcagacuggccgugaccacccacggccugcccugccuggccugggccagcgcccaggccaaggcccugagcaagcaccaggacuucaacagcgccgugcagcugguggagaacuucugcagaaaccccgacggcgacgaggagggcguguggugcuacguggccggcaagcccggcgacuucggcuacugcgaccugaacuacugcgaggaggccguggaggaggagaccggcgacggccuggacgaggacagcgacagagccaucgagggcagaaccgccaccagcgaguaccagaccuucuucaaccccagaaccuucggcagcggcgaggccgacugcggccugagaccccuguucgagaagaagagccuggaggacaagaccgagagagagcugcuggagagcuacaucgacggcagaaucguggagggcagcgacgccgagaucggcaugagccccuggcaggugaugcuguucagaaagagcccccaggagcugcugugcggcgccagccugaucagcgacagaugggugcugaccgccgcccacugccugcuguacccccccugggacaagaacuucaccgagaacgaccugcuggugagaaucggcaagcacagcagaaccagauacgagagaaacaucgagaagaucagcaugcuggagaagaucuacauccaccccagauacaacuggagagagaaccuggacagagacaucgcccugaugaagcugaagaagcccguggccuucagcgacuacauccaccccgugugccugcccgacagagagaccgccgccagccugcugcaggccggcuacaagggcagagugaccggcuggggcaaccugaaggagaccuggaccgccaacgugggcaagggccagcccagcgugcugcagguggugaaccugcccaucguggagagacccgugugcaaggacagcaccagaaucagaaucaccgacaacauguucugcgccggcuacaagcccgacgagggcaagagaggcgacgccugcgagggcgacagcggcggccccuucgugaugaagagccccuucaacaacagaugguaccagaugggcaucgugagcuggggcgagggcugcgacagagacggcaaguacggcuucuacacccacguguucagacugaagaaguggauccagaaggugaucgaccaguucggcgaguaa

SEQ ID NO: 16808 - RNA, 1278 nt, Artificial Sequence
  F2R__Homo_sapiens__NP_001983
augggccccagaagacugcugcugguggccgccugcuucagccugugcggcccccugcugagcgccagaaccagagccagaagacccgagagcaaggccaccaacgccacccuggaccccagaagcuuccugcugagaaaccccaacgacaaguacgagcccuucugggaggacgaggagaagaacgagagcggccugaccgaguacagacuggugagcaucaacaagagcagcccccugcagaagcagcugcccgccuucaucagcgaggacgccagcggcuaccugaccagcagcuggcugacccuguucgugcccagcguguacaccggcguguucguggugagccugccccugaacaucauggccaucgugguguucauccugaagaugaaggugaagaagcccgccgugguguacaugcugcaccuggccaccgccgacgugcuguucgugagcgugcugcccuucaagaucagcuacuacuucagcggcagcgacuggcaguucggcagcgagcugugcagauucgugaccgccgccuucuacugcaacauguacgccagcauccugcugaugaccgugaucagcaucgacagauuccuggccgugguguaccccaugcagagccugagcuggagaacccugggcagagccagcuucaccugccuggccaucugggcccuggccaucgccggcguggugccccugcugcugaaggagcagaccauccaggugcccggccugaacaucaccaccugccacgacgugcugaacgagacccugcuggagggcuacuacgccuacuacuucagcgccuucagcgccguguucuucuucgugccccugaucaucagcaccgugugcuacgugagcaucaucagaugccugagcagcagcgccguggccaacagaagcaagaagagcagagcccuguuccugagcgccgccguguucugcaucuucaucaucugcuucggccccaccaacgugcugcugaucgcccacuacagcuuccugagccacaccagcaccaccgaggccgccuacuucgccuaccugcugugcgugugcgugagcagcaucagcugcugcaucgacccccugaucuacuacuacgccagcagcgagugccagagauacguguacagcauccugugcugcaaggagagcagcgaccccagcagcuacaacagcagcggccagcugauggccagcaagauggacaccugcagcagcaaccugaacaacagcaucuacaagaagcugcugaccuaa

SEQ ID NO: 16809 - RNA, 1194 nt, Artificial Sequence
  F2RL1__Homo_sapiens__NP_005233
augagaagccccagcgccgccuggcugcugggcgccgccauccugcuggccgccagccugagcugcagcggcaccauccagggcaccaacagaagcagcaagggcagaagccugaucggcaagguggacggcaccagccacgugaccggcaagggcgugaccguggagaccguguucagcguggacgaguucagcgccagcgugcugaccggcaagcugaccaccguguuccugcccaucguguacaccaucguguucguggugggccugcccagcaacggcauggcccuguggguguuccuguucagaaccaagaagaagcaccccgccgugaucuacauggccaaccuggcccuggccgaccugcugagcgugaucugguucccccugaagaucgccuaccacauccacggcaacaacuggaucuacggcgaggcccugugcaacgugcugaucggcuucuucuacggcaacauguacugcagcauccuguucaugaccugccugagcgugcagagauacugggugaucgugaaccccaugggccacagcagaaagaaggccaacaucgccaucggcaucagccuggccaucuggcugcugauccugcuggugaccaucccccuguacguggugaagcagaccaucuucauccccgcccugaacaucaccaccugccacgacgugcugcccgagcagcugcuggugggcgacauguucaacuacuuccugagccuggccaucggcguguuccuguuccccgccuuccugaccgccagcgccuacgugcugaugaucagaaugcugagaagcagcgccauggacgagaacagcgagaagaagagaaagagagccaucaagcugaucgugaccgugcuggccauguaccugaucugcuucacccccagcaaccugcugcugguggugcacuacuuccugaucaagagccagggccagagccacguguacgcccuguacaucguggcccugugccugagcacccugaacagcugcaucgaccccuucguguacuacuucgugagccacgacuucagagaccacgccaagaacgcccugcugugcagaagcgugagaaccgugaagcagaugcaggugagccugaccagcaagaagcacagcagaaagagcagcagcuacagcagcagcagcaccaccgugaagaccagcuacuaa

SEQ ID NO: 16810 - RNA, 1059 nt, Artificial Sequence
  F2RL2__Homo_sapiens__NP_001243495
auggagaacgacaccaacaaccuggccaagcccacccugcccaucaagaccuucagaggcgccccccccaacagcuucgaggaguuccccuucagcgcccuggagggcuggaccggcgccaccaucaccgugaagaucaagugccccgaggagagcgccagccaccugcacgugaagaacgccaccaugggcuaccugaccagcagccugagcaccaagcugauccccgccaucuaccugcugguguucguggugggcgugcccgccaacgccgugacccuguggaugcuguucuucagaaccagaagcaucugcaccaccguguucuacaccaaccuggccaucgccgacuuccuguucugcgugacccugcccuucaagaucgccuaccaccugaacggcaacaacuggguguucggcgaggugcugugcagagccaccaccgugaucuucuacggcaacauguacugcagcauccugcugcuggccugcaucagcaucaacagauaccuggccaucgugcaccccuucaccuacagaggccugcccaagcacaccuacgcccuggugaccugcggccuggugugggccaccguguuccuguacaugcugcccuucuucauccugaagcaggaguacuaccuggugcagcccgacaucaccaccugccacgacgugcacaacaccugcgagagcagcagccccuuccagcuguacuacuucaucagccuggccuucuucggcuuccugauccccuucgugcugaucaucuacugcuacgccgccaucaucagaacccugaacgccuacgaccacagauggcugugguacgugaaggccagccugcugauccuggugaucuucaccaucugcuucgcccccagcaacaucauccugaucauccaccacgccaacuacuacuacaacaacaccgacggccuguacuucaucuaccugaucgcccugugccugggcagccugaacagcugccuggaccccuuccuguacuuccugaugagcaagaccagaaaccacagcaccgccuaccugaccaaguaa

SEQ ID NO: 16811 - RNA, 1158 nt, Artificial Sequence
  F2RL3__Homo_sapiens__NP_003941
auguggggcagacugcugcuguggccccuggugcugggcuucagccugagcggcggcacccagacccccagcguguacgacgagagcggcagcaccggcggcggcgacgacagcacccccagcauccugcccgcccccagaggcuaccccggccaggugugcgccaacgacagcgacacccuggagcugcccgacagcagcagagcccugcugcugggcugggugcccaccagacuggugcccgcccuguacggccuggugcugguggugggccugcccgccaacggccuggcccugugggugcuggccacccaggcccccagacugcccagcaccaugcugcugaugaaccuggccgccgccgaccugcugcuggcccuggcccugccccccagaaucgccuaccaccugagaggccagagauggcccuucggcgaggccgccugcagacuggccaccgccgcccuguacggccacauguacggcagcgugcugcugcuggccgccgugagccuggacagauaccuggcccuggugcacccccugagagccagagcccugagaggcagaagacuggcccugggccugugcauggccgccuggcugauggccgccgcccuggcccugccccugacccugcagagacagaccuucagacuggccagaagcgacagagugcugugccacgacgcccugccccuggacgcccaggccagccacuggcagcccgccuucaccugccuggcccugcugggcugcuuccugccccugcuggccaugcugcugugcuacggcgccacccugcacacccuggccgccagcggcagaagauacggccacgcccugagacugaccgccguggugcuggccagcgccguggccuucuucgugcccagcaaccugcugcugcugcugcacuacagcgaccccagccccagcgccuggggcaaccuguacggcgccuacgugcccagccuggcccugagcacccugaacagcugcguggaccccuucaucuacuacuacgugagcgccgaguucagagacaaggugagagccggccuguuccagagaagccccggcgacaccguggccagcaaggccagcgccgagggcggcagcagaggcaugggcacccacagcagccugcugcaguaa

SEQ ID NO: 16812 - RNA, 6675 nt, Artificial Sequence
  F5__Homo_sapiens__NP_000121
auguuccccggcugccccagacugugggugcugguggugcugggcaccagcugggugggcuggggcagccagggcaccgaggccgcccagcugagacaguucuacguggccgcccagggcaucagcuggagcuacagacccgagcccaccaacagcagccugaaccugagcgugaccagcuucaagaagaucguguacagagaguacgagcccuacuucaagaaggagaagccccagagcaccaucagcggccugcugggccccacccuguacgccgaggugggcgacaucaucaaggugcacuucaagaacaaggccgacaagccccugagcauccacccccagggcaucagauacagcaagcugagcgagggcgccagcuaccuggaccacaccuuccccgccgagaagauggacgacgccguggcccccggcagagaguacaccuacgaguggagcaucagcgaggacagcggccccacccacgacgacccccccugccugacccacaucuacuacagccacgagaaccugaucgaggacuucaacagcggccugaucggcccccugcugaucugcaagaagggcacccugaccgagggcggcacccagaagaccuucgacaagcagaucgugcugcuguucgccguguucgacgagagcaagagcuggagccagagcagcagccugauguacaccgugaacggcuacgugaacggcaccaugcccgacaucaccgugugcgcccacgaccacaucagcuggcaccugcugggcaugagcagcggccccgagcuguucagcauccacuucaacggccaggugcuggagcagaaccaccacaaggugagcgccaucacccuggugagcgccaccagcaccaccgccaacaugaccgugggccccgagggcaaguggaucaucagcagccugacccccaagcaccugcaggccggcaugcaggccuacaucgacaucaagaacugccccaagaagaccagaaaccugaagaagaucaccagagagcagagaagacacaugaagagaugggaguacuucaucgccgccgaggaggugaucugggacuacgcccccgugauccccgccaacauggacaagaaguacagaagccagcaccuggacaacuucagcaaccagaucggcaagcacuacaagaaggugauguacacccaguacgaggacgagagcuucaccaagcacaccgugaaccccaacaugaaggaggacggcauccugggccccaucaucagagcccaggugagagacacccugaagaucguguucaagaacauggccagcagacccuacagcaucuacccccacggcgugaccuucagccccuacgaggacgaggugaacagcagcuucaccagcggcagaaacaacaccaugaucagagccgugcagcccggcgagaccuacaccuacaaguggaacauccuggaguucgacgagcccaccgagaacgacgcccagugccugaccagacccuacuacagcgacguggacaucaugagagacaucgccagcggccugaucggccugcugcugaucugcaagagcagaagccuggacagaagaggcauccagagagccgccgacaucgagcagcaggccguguucgccguguucgacgagaacaagagcugguaccuggaggacaacaucaacaaguucugcgagaaccccgacgaggugaagagagacgaccccaaguucuacgagagcaacaucaugagcaccaucaacggcuacgugcccgagagcaucaccacccugggcuucugcuucgacgacaccgugcaguggcacuucugcagcgugggcacccagaacgagauccugaccauccacuucaccggccacagcuucaucuacggcaagagacacgaggacacccugacccuguuccccaugagaggcgagagcgugaccgugaccauggacaacgugggcaccuggaugcugaccagcaugaacagcagccccagaagcaagaagcugagacugaaguucagagacgugaagugcauccccgacgacgacgaggacagcuacgagaucuucgagccccccgagagcaccgugauggccaccagaaagaugcacgacagacuggagcccgaggacgaggagagcgacgccgacuacgacuaccagaacagacuggccgccgcccugggcaucagaagcuucagaaacagcagccugaaccaggaggaggaggaguucaaccugaccgcccuggcccuggagaacggcaccgaguucgugagcagcaacaccgacaucaucgugggcagcaacuacagcagccccagcaacaucagcaaguucaccgugaacaaccuggccgagccccagaaggcccccagccaccagcaggccaccaccgccggcagcccccugagacaccugaucggcaagaacagcgugcugaacagcagcaccgccgagcacagcagccccuacagcgaggaccccaucgaggacccccugcagcccgacgugaccggcaucagacugcugagccugggcgccggcgaguucaagagccaggagcacgccaagcacaagggccccaagguggagagagaccaggccgccaagcacagauucagcuggaugaagcugcuggcccacaaggugggcagacaccugagccaggacaccggcagccccagcggcaugagacccugggaggaccugcccagccaggacaccggcagccccagcagaaugagacccuggaaggacccccccagcgaccugcugcugcugaagcagagcaacagcagcaagauccuggugggcagauggcaccuggccagcgagaagggcagcuacgagaucauccaggacaccgacgaggacaccgccgugaacaacuggcugaucagcccccagaacgccagcagagccuggggcgagagcaccccccuggccaacaagcccggcaagcagagcggccaccccaaguuccccagagugagacacaagagccugcaggugagacaggacggcggcaagagcagacugaagaagagccaguuccugaucaagaccagaaagaagaagaaggagaagcacacccaccacgccccccugagccccagaaccuuccacccccugagaagcgaggccuacaacaccuucagcgagagaagacugaagcacagccuggugcugcacaagagcaacgagaccagccugcccaccgaccugaaccagacccugcccagcauggacuucggcuggaucgccagccugcccgaccacaaccagaacagcagcaacgacaccggccaggccagcugcccccccggccuguaccagaccgugccccccgaggagcacuaccagaccuuccccauccaggaccccgaccagaugcacagcaccagcgaccccagccacagaagcagcagccccgagcugagcgagaugcuggaguacgacagaagccacaagagcuuccccaccgacaucagccagaugagccccagcagcgagcacgagguguggcagaccgugaucagccccgaccugagccaggugacccugagccccgagcugagccagaccaaccugagccccgaccugagccacaccacccugagccccgagcugauccagagaaaccugagccccgcccugggccagaugcccaucagccccgaccugagccacaccacccugagccccgaccugagccacaccacccugagccuggaccugagccagaccaaccugagccccgagcugagccagaccaaccugagccccgcccugggccagaugccccugagccccgaccugagccacaccacccugagccuggacuucagccagaccaaccugagccccgagcugagccacaugacccugagccccgagcugagccagaccaaccugagccccgcccugggccagaugcccaucagccccgaccugagccacaccacccugagccuggacuucagccagaccaaccugagccccgagcugagccagaccaaccugagccccgcccugggccagaugccccugagccccgaccccagccacaccacccugagccuggaccugagccagaccaaccugagccccgagcugagccagaccaaccugagccccgaccugagcgagaugccccuguucgccgaccugagccagaucccccugacccccgaccuggaccagaugacccugagccccgaccugggcgagaccgaccugagccccaacuucggccagaugagccugagccccgaccugagccaggugacccugagccccgacaucagcgacaccacccugcugcccgaccugagccagaucagccccccccccgaccuggaccagaucuucuaccccagcgagagcagccagagccugcugcugcaggaguucaacgagagcuuccccuaccccgaccugggccagaugcccagccccagcagccccacccugaacgacaccuuccugagcaaggaguucaacccccuggugaucgugggccugagcaaggacggcaccgacuacaucgagaucauccccaaggaggaggugcagagcagcgaggacgacuacgccgagaucgacuacgugcccuacgacgaccccuacaagaccgacgugagaaccaacaucaacagcagcagagaccccgacaacaucgccgccugguaccugagaagcaacaacggcaacagaagaaacuacuacaucgccgccgaggagaucagcugggacuacagcgaguucgugcagagagagaccgacaucgaggacagcgacgacauccccgaggacaccaccuacaagaaggugguguucagaaaguaccuggacagcaccuucaccaagagagaccccagaggcgaguacgaggagcaccugggcauccugggccccaucaucagagccgagguggacgacgugauccaggugagauucaagaaccuggccagcagacccuacagccugcacgcccacggccugagcuacgagaagagcagcgagggcaagaccuacgaggacgacagccccgagugguucaaggaggacaacgccgugcagcccaacagcagcuacaccuacguguggcacgccaccgagagaagcggccccgagagccccggcagcgccugcagagccugggccuacuacagcgccgugaaccccgagaaggacauccacagcggccugaucggcccccugcugaucugccagaagggcauccugcacaaggacagcaacaugcccauggacaugagagaguucgugcugcuguucaugaccuucgacgagaagaagagcugguacuacgagaagaagagcagaagcagcuggagacugaccagcagcgagaugaagaagagccacgaguuccacgccaucaacggcaugaucuacagccugcccggccugaagauguacgagcaggagugggugagacugcaccugcugaacaucggcggcagccaggacauccacguggugcacuuccacggccagacccugcuggagaacggcaacaagcagcaccagcugggcguguggccccugcugcccggcagcuucaagacccuggagaugaaggccagcaagcccggcugguggcugcugaacaccgaggugggcgagaaccagagagccggcaugcagacccccuuccugaucauggacagagacugcagaaugcccaugggccugagcaccggcaucaucagcgacagccagaucaaggccagcgaguuccugggcuacugggagcccagacuggccagacugaacaacggcggcagcuacaacgccuggagcguggagaagcuggccgccgaguucgccagcaagcccuggauccagguggacaugcagaaggaggugaucaucaccggcauccagacccagggcgccaagcacuaccugaagagcugcuacaccaccgaguucuacguggccuacagcagcaaccagaucaacuggcagaucuucaagggcaacagcaccagaaacgugauguacuucaacggcaacagcgacgccagcaccaucaaggagaaccaguucgacccccccaucguggccagauacaucagaaucagccccaccagagccuacaacagacccacccugagacuggagcugcagggcugcgaggugaacggcugcagcaccccccugggcauggagaacggcaagaucgagaacaagcagaucaccgccagcagcuucaagaagagcugguggggcgacuacugggagcccuucagagccagacugaacgcccagggcagagugaacgccuggcaggccaaggccaacaacaacaagcaguggcuggagaucgaccugcugaagaucaagaagaucaccgccaucaucacccagggcugcaagagccugagcagcgagauguacgugaagagcuacaccauccacuacagcgagcagggcguggaguggaagcccuacagacugaagagcagcaugguggacaagaucuucgagggcaacaccaacaccaagggccacgugaagaacuucuucaacccccccaucaucagcagauucaucagagugauccccaagaccuggaaccagagcaucgcccugagacuggagcuguucggcugcgacaucuacuaa

SEQ ID NO: 16813 - RNA, 1401 nt, Artificial Sequence
  F7__Homo_sapiens__NP_000122
auggugagccaggcccugagacugcugugccugcugcugggccugcagggcugccuggccgccggcggcguggccaaggccagcggcggcgagaccagagacaugcccuggaagcccggcccccacagaguguucgugacccaggaggaggcccacggcgugcugcacagaagaagaagagccaacgccuuccuggaggagcugagacccggcagccuggagagagagugcaaggaggagcagugcagcuucgaggaggccagagagaucuucaaggacgccgagagaaccaagcuguucuggaucagcuacagcgacggcgaccagugcgccagcagccccugccagaacggcggcagcugcaaggaccagcugcagagcuacaucugcuucugccugcccgccuucgagggcagaaacugcgagacccacaaggacgaccagcugaucugcgugaacgagaacggcggcugcgagcaguacugcagcgaccacaccggcaccaagagaagcugcagaugccacgagggcuacagccugcuggccgacggcgugagcugcacccccaccguggaguaccccugcggcaagauccccauccuggagaagagaaacgccagcaagccccagggcagaaucgugggcggcaaggugugccccaagggcgagugccccuggcaggugcugcugcuggugaacggcgcccagcugugcggcggcacccugaucaacaccaucuggguggugagcgccgcccacugcuucgacaagaucaagaacuggagaaaccugaucgccgugcugggcgagcacgaccugagcgagcacgacggcgacgagcagagcagaagaguggcccaggugaucauccccagcaccuacgugcccggcaccaccaaccacgacaucgcccugcugagacugcaccagcccguggugcugaccgaccacguggugccccugugccugcccgagagaaccuucagcgagagaacccuggccuucgugagauucagccuggugagcggcuggggccagcugcuggacagaggcgccaccgcccuggagcugauggugcugaacgugcccagacugaugacccaggacugccugcagcagagcagaaaggugggcgacagccccaacaucaccgaguacauguucugcgccggcuacagcgacggcagcaaggacagcugcaagggcgacagcggcggcccccacgccacccacuacagaggcaccugguaccugaccggcaucgugagcuggggccagggcugcgccaccgugggccacuucggcguguacaccagagugagccaguacaucgaguggcugcagaagcugaugagaagcgagcccagacccggcgugcugcugagagcccccuuccccuaa

SEQ ID NO: 16814 - RNA, 7056 nt, Artificial Sequence
  F8__Homo_sapiens__NP_000123
augcagaucgagcugagcaccugcuucuuccugugccugcugagauucugcuucagcgccaccagaagauacuaccugggcgccguggagcugagcugggacuacaugcagagcgaccugggcgagcugcccguggacgccagauucccccccagagugcccaagagcuuccccuucaacaccagcgugguguacaagaagacccuguucguggaguucaccgaccaccuguucaacaucgccaagcccagaccccccuggaugggccugcugggccccaccauccaggccgagguguacgacaccguggugaucacccugaagaacauggccagccaccccgugagccugcacgccgugggcgugagcuacuggaaggccagcgagggcgccgaguacgacgaccagaccagccagagagagaaggaggacgacaagguguuccccggcggcagccacaccuacguguggcaggugcugaaggagaacggccccauggccagcgacccccugugccugaccuacagcuaccugagccacguggaccuggugaaggaccugaacagcggccugaucggcgcccugcuggugugcagagagggcagccuggccaaggagaagacccagacccugcacaaguucauccugcuguucgccguguucgacgagggcaagagcuggcacagcgagaccaagaacagccugaugcaggacagagacgccgccagcgccagagccuggcccaagaugcacaccgugaacggcuacgugaacagaagccugcccggccugaucggcugccacagaaagagcguguacuggcacgugaucggcaugggcaccacccccgaggugcacagcaucuuccuggagggccacaccuuccuggugagaaaccacagacaggccagccuggagaucagccccaucaccuuccugaccgcccagacccugcugauggaccugggccaguuccugcuguucugccacaucagcagccaccagcacgacggcauggaggccuacgugaagguggacagcugccccgaggagccccagcugagaaugaagaacaacgaggaggccgaggacuacgacgacgaccugaccgacagcgagauggacguggugagauucgacgacgacaacagccccagcuucauccagaucagaagcguggccaagaagcaccccaagaccugggugcacuacaucgccgccgaggaggaggacugggacuacgccccccuggugcuggcccccgacgacagaagcuacaagagccaguaccugaacaacggcccccagagaaucggcagaaaguacaagaaggugagauucauggccuacaccgacgagaccuucaagaccagagaggccauccagcacgagagcggcauccugggcccccugcuguacggcgaggugggcgacacccugcugaucaucuucaagaaccaggccagcagacccuacaacaucuacccccacggcaucaccgacgugagaccccuguacagcagaagacugcccaagggcgugaagcaccugaaggacuuccccauccugcccggcgagaucuucaaguacaaguggaccgugaccguggaggacggccccaccaagagcgaccccagaugccugaccagauacuacagcagcuucgugaacauggagagagaccuggccagcggccugaucggcccccugcugaucugcuacaaggagagcguggaccagagaggcaaccagaucaugagcgacaagagaaacgugauccuguucagcguguucgacgagaacagaagcugguaccugaccgagaacauccagagauuccugcccaaccccgccggcgugcagcuggaggaccccgaguuccaggccagcaacaucaugcacagcaucaacggcuacguguucgacagccugcagcugagcgugugccugcacgagguggccuacugguacauccugagcaucggcgcccagaccgacuuccugagcguguucuucagcggcuacaccuucaagcacaagaugguguacgaggacacccugacccuguuccccuucagcggcgagaccguguucaugagcauggagaaccccggccuguggauccugggcugccacaacagcgacuucagaaacagaggcaugaccgcccugcugaaggugagcagcugcgacaagaacaccggcgacuacuacgaggacagcuacgaggacaucagcgccuaccugcugagcaagaacaacgccaucgagcccagaagcuucagccagaacagcagacaccccagcaccagacagaagcaguucaacgccaccaccauccccgagaacgacaucgagaagaccgaccccugguucgcccacagaacccccaugcccaagauccagaacgugagcagcagcgaccugcugaugcugcugagacagagccccaccccccacggccugagccugagcgaccugcaggaggccaaguacgagaccuucagcgacgaccccagccccggcgccaucgacagcaacaacagccugagcgagaugacccacuucagaccccagcugcaccacagcggcgacaugguguucacccccgagagcggccugcagcugagacugaacgagaagcugggcaccaccgccgccaccgagcugaagaagcuggacuucaaggugagcagcaccagcaacaaccugaucagcaccauccccagcgacaaccuggccgccggcaccgacaacaccagcagccugggcccccccagcaugcccgugcacuacgacagccagcuggacaccacccuguucggcaagaagagcagcccccugaccgagagcggcggcccccugagccugagcgaggagaacaacgacagcaagcugcuggagagcggccugaugaacagccaggagagcagcuggggcaagaacgugagcagcaccgagagcggcagacuguucaagggcaagagagcccacggccccgcccugcugaccaaggacaacgcccuguucaaggugagcaucagccugcugaagaccaacaagaccagcaacaacagcgccaccaacagaaagacccacaucgacggccccagccugcugaucgagaacagccccagcguguggcagaacauccuggagagcgacaccgaguucaagaaggugaccccccugauccacgacagaaugcugauggacaagaacgccaccgcccugagacugaaccacaugagcaacaagaccaccagcagcaagaacauggagauggugcagcagaagaaggagggccccaucccccccgacgcccagaaccccgacaugagcuucuucaagaugcuguuccugcccgagagcgccagauggauccagagaacccacggcaagaacagccugaacagcggccagggccccagccccaagcagcuggugagccugggccccgagaagagcguggagggccagaacuuccugagcgagaagaacaaggugguggugggcaagggcgaguucaccaaggacgugggccugaaggagaugguguuccccagcagcagaaaccuguuccugaccaaccuggacaaccugcacgagaacaacacccacaaccaggagaagaagauccaggaggagaucgagaagaaggagacccugauccaggagaacguggugcugccccagauccacaccgugaccggcaccaagaacuucaugaagaaccuguuccugcugagcaccagacagaacguggagggcagcuacgacggcgccuacgcccccgugcugcaggacuucagaagccugaacgacagcaccaacagaaccaagaagcacaccgcccacuucagcaagaagggcgaggaggagaaccuggagggccugggcaaccagaccaagcagaucguggagaaguacgccugcaccaccagaaucagccccaacaccagccagcagaacuucgugacccagagaagcaagagagcccugaagcaguucagacugccccuggaggagaccgagcuggagaagagaaucaucguggacgacaccagcacccaguggagcaagaacaugaagcaccugacccccagcacccugacccagaucgacuacaacgagaaggagaagggcgccaucacccagagcccccugagcgacugccugaccagaagccacagcaucccccaggccaacagaagcccccugcccaucgccaaggugagcagcuuccccagcaucagacccaucuaccugaccagagugcuguuccaggacaacagcagccaccugcccgccgccagcuacagaaagaaggacagcggcgugcaggagagcagccacuuccugcagggcgccaagaagaacaaccugagccuggccauccugacccuggagaugaccggcgaccagagagaggugggcagccugggcaccagcgccaccaacagcgugaccuacaagaagguggagaacaccgugcugcccaagcccgaccugcccaagaccagcggcaagguggagcugcugcccaaggugcacaucuaccagaaggaccuguuccccaccgagaccagcaacggcagccccggccaccuggaccugguggagggcagccugcugcagggcaccgagggcgccaucaaguggaacgaggccaacagacccggcaaggugcccuuccugagaguggccaccgagagcagcgccaagacccccagcaagcugcuggacccccuggccugggacaaccacuacggcacccagauccccaaggaggaguggaagagccaggagaagagccccgagaagaccgccuucaagaagaaggacaccauccugagccugaacgccugcgagagcaaccacgccaucgccgccaucaacgagggccagaacaagcccgagaucgaggugaccugggccaagcagggcagaaccgagagacugugcagccagaacccccccgugcugaagagacaccagagagagaucaccagaaccacccugcagagcgaccaggaggagaucgacuacgacgacaccaucagcguggagaugaagaaggaggacuucgacaucuacgacgaggacgagaaccagagccccagaagcuuccagaagaagaccagacacuacuucaucgccgccguggagagacugugggacuacggcaugagcagcagcccccacgugcugagaaacagagcccagagcggcagcgugccccaguucaagaaggugguguuccaggaguucaccgacggcagcuucacccagccccuguacagaggcgagcugaacgagcaccugggccugcugggccccuacaucagagccgagguggaggacaacaucauggugaccuucagaaaccaggccagcagacccuacagcuucuacagcagccugaucagcuacgaggaggaccagagacagggcgccgagcccagaaagaacuucgugaagcccaacgagaccaagaccuacuucuggaaggugcagcaccacauggcccccaccaaggacgaguucgacugcaaggccugggccuacuucagcgacguggaccuggagaaggacgugcacagcggccugaucggcccccugcuggugugccacaccaacacccugaaccccgcccacggcagacaggugaccgugcaggaguucgcccuguucuucaccaucuucgacgagaccaagagcugguacuucaccgagaacauggagagaaacugcagagcccccugcaacauccagauggaggaccccaccuucaaggagaacuacagauuccacgccaucaacggcuacaucauggacacccugcccggccuggugauggcccaggaccagagaaucagaugguaccugcugagcaugggcagcaacgagaacauccacagcauccacuucagcggccacguguucaccgugagaaagaaggaggaguacaagauggcccuguacaaccuguaccccggcguguucgagaccguggagaugcugcccagcaaggccggcaucuggagaguggagugccugaucggcgagcaccugcacgccggcaugagcacccuguuccugguguacagcaacaagugccagaccccccugggcauggccagcggccacaucagagacuuccagaucaccgccagcggccaguacggccagugggcccccaagcuggccagacugcacuacagcggcagcaucaacgccuggagcaccaaggagcccuucagcuggaucaagguggaccugcuggcccccaugaucauccacggcaucaagacccagggcgccagacagaaguucagcagccuguacaucagccaguucaucaucauguacagccuggacggcaagaaguggcagaccuacagaggcaacagcaccggcacccugaugguguucuucggcaacguggacagcagcggcaucaagcacaacaucuucaacccccccaucaucgccagauacaucagacugcaccccacccacuacagcaucagaagcacccugagaauggagcugaugggcugcgaccugaacagcugcagcaugccccugggcauggagagcaaggccaucagcgacgcccagaucaccgccagcagcuacuucaccaacauguucgccaccuggagccccagcaaggccagacugcaccugcagggcagaagcaacgccuggagaccccaggugaacaaccccaaggaguggcugcagguggacuuccagaagaccaugaaggugaccggcgugaccacccagggcgugaagagccugcugaccagcauguacgugaaggaguuccugaucagcagcagccaggacggccaccaguggacccuguucuuccagaacggcaaggugaagguguuccagggcaaccaggacagcuucacccccguggugaacagccuggaccccccccugcugaccagauaccugagaauccacccccagagcugggugcaccagaucgcccugagaauggaggugcugggcugcgaggcccaggaccuguacuaa

SEQ ID NO: 16815 - RNA, 1386 nt, Artificial Sequence
  F9__Homo_sapiens__NP_000124
augcagagagugaacaugaucauggccgagagccccggccugaucaccaucugccugcugggcuaccugcugagcgccgagugcaccguguuccuggaccacgagaacgccaacaagauccugaacagacccaagagauacaacagcggcaagcuggaggaguucgugcagggcaaccuggagagagagugcauggaggagaagugcagcuucgaggaggccagagagguguucgagaacaccgagagaaccaccgaguucuggaagcaguacguggacggcgaccagugcgagagcaaccccugccugaacggcggcagcugcaaggacgacaucaacagcuacgagugcuggugccccuucggcuucgagggcaagaacugcgagcuggacgugaccugcaacaucaagaacggcagaugcgagcaguucugcaagaacagcgccgacaacaagguggugugcagcugcaccgagggcuacagacuggccgagaaccagaagagcugcgagcccgccgugcccuuccccugcggcagagugagcgugagccagaccagcaagcugaccagagccgagaccguguuccccgacguggacuacgugaacagcaccgaggccgagaccauccuggacaacaucacccagagcacccagagcuucaacgacuucaccagaguggugggcggcgaggacgccaagcccggccaguuccccuggcagguggugcugaacggcaagguggacgccuucugcggcggcagcaucgugaacgagaaguggaucgugaccgccgcccacugcguggagaccggcgugaagaucaccgugguggccggcgagcacaacaucgaggagaccgagcacaccgagcagaagagaaacgugaucagaaucaucccccaccacaacuacaacgccgccaucaacaaguacaaccacgacaucgcccugcuggagcuggacgagccccuggugcugaacagcuacgugacccccaucugcaucgccgacaaggaguacaccaacaucuuccugaaguucggcagcggcuacgugagcggcuggggcagaguguuccacaagggcagaagcgcccuggugcugcaguaccugagagugccccugguggacagagccaccugccugagaagcaccaaguucaccaucuacaacaacauguucugcgccggcuuccacgagggcggcagagacagcugccagggcgacagcggcggcccccacgugaccgagguggagggcaccagcuuccugaccggcaucaucagcuggggcgaggagugcgccaugaagggcaaguacggcaucuacaccaaggugagcagauacgugaacuggaucaaggagaagaccaagcugaccuaa

SEQ ID NO: 16816 - RNA, 1119 nt, Artificial Sequence
  FA2H__Homo_sapiens__NP_077282
auggcccccgcccccccccccgccgccagcuucagccccagcgaggugcagagaagacuggccgccggcgccugcugggugagaagaggcgccagacuguacgaccugagcagcuucgugagacaccaccccggcggcgagcagcugcugagagccagagccggccaggacaucagcgccgaccuggacggccccccccacagacacagcgccaacgccagaagauggcuggagcaguacuacgugggcgagcugagaggcgagcagcagggcagcauggagaacgagcccguggcccuggaggagacccagaagaccgaccccgccauggagcccagauucaaggugguggacugggacaaggaccugguggacuggagaaagccccugcuguggcaggugggccaccugggcgagaaguacgacgagugggugcaccagcccgugaccagacccaucagacuguuccacagcgaccugaucgagggccugagcaagaccgugugguacagcgugcccaucaucugggugccccuggugcuguaccugagcuggagcuacuacagaaccuucgcccagggcaacgugagacuguucaccagcuucaccaccgaguacaccguggccgugcccaagagcauguuccccggccuguucaugcugggcaccuuccuguggagccugaucgaguaccugauccacagauuccuguuccacaugaagccccccagcgacagcuacuaccugaucaugcugcacuucgugaugcacggccagcaccacaaggcccccuucgacggcagcagacugguguucccccccgugcccgccagccuggugaucggcguguucuaccugugcaugcagcugauccugcccgaggccgugggcggcaccguguucgccggcggccugcugggcuacgugcuguacgacaugacccacuacuaccugcacuucggcagcccccacaagggcagcuaccuguacagccugaaggcccaccacgugaagcaccacuucgcccaccagaagagcggcuucggcaucagcaccaagcugugggacuacugcuuccacacccugacccccgagaagccccaccugaagacccaguaa

SEQ ID NO: 16817 - RNA, 1599 nt, Artificial Sequence
  FAAH2__Homo_sapiens__NP_777572
auggcccccagcuucaccgccagaauccagcuguuccugcugagagcccugggcuuccugaucggccuggugggcagagccgcccuggugcugggcggccccaaguucgccagcaagacccccagacccgugaccgagccccugcugcugcugagcggcaugcagcuggccaagcugaucagacagagaaaggugaagugcaucgacguggugcaggccuacaucaacagaaucaaggacgugaaccccaugaucaacggcaucgugaaguacagauucgaggaggccaugaaggaggcccacgccguggaccagaagcuggccgagaagcaggaggacgaggccacccuggagaacaaguggcccuuccugggcgugccccugaccgugaaggaggccuuccagcugcagggcaugcccaacagcagcggccugaugaacagaagagacgccaucgccaagaccgacgccaccgugguggcccugcugaagggcgccggcgccaucccccugggcaucaccaacugcagcgagcugugcaugugguacgagagcagcaacaagaucuacggcagaagcaacaaccccuacgaccugcagcacaucgugggcggcagcagcggcggcgagggcugcacccuggccgccgccugcagcgugaucggcgugggcagcgacaucggcggcagcaucagaaugcccgccuucuucaacggcaucuucggccacaagcccagccccggcguggugcccaacaagggccaguucccccuggccgugggcgcccaggagcuguuccugugcaccggccccaugugcagauacgccgaggaccuggcccccaugcugaaggugauggccggccccggcaucaagagacugaagcuggacaccaaggugcaccugaaggaccugaaguucuacuggauggagcacgacggcggcagcuuccugaugagcaagguggaccaggaccugaucaugacccagaagaaggugguggugcaccuggagaccauccugggcgccagcgugcagcacgugaagcugaagaagaugaaguacagcuuccagcuguggaucgccaugaugagcgccaagggccacgacggcaaggagcccgugaaguucguggaccugcugggcgaccacggcaagcacgugagcccccugugggagcugaucaaguggugccugggccugagcguguacaccauccccagcaucggccuggcccugcuggaggagaagcugagauacagcaacgagaaguaccagaaguucaaggccguggaggagagccugagaaaggagcugguggacaugcugggcgacgacggcguguuccuguaccccagccaccccaccguggcccccaagcaccacgugccccugaccagacccuucaacuucgccuacaccggcguguucagcgcccugggccugcccgugacccagugcccccugggccugaacgccaagggccugccccugggcauccaggugguggccggccccuucaacgaccaccugacccuggccguggcccaguaccuggagaagaccuucggcggcugggugugccccggcaaguucuaa

SEQ ID NO: 16818 - RNA, 384 nt, Artificial Sequence
  FABP1__Homo_sapiens__NP_001434
augagcuucagcggcaaguaccagcugcagagccaggagaacuucgaggccuucaugaaggccaucggccugcccgaggagcugauccagaagggcaaggacaucaagggcgugagcgagaucgugcagaacggcaagcacuucaaguucaccaucaccgccggcagcaaggugauccagaacgaguucaccgugggcgaggagugcgagcuggagaccaugaccggcgagaaggugaagaccguggugcagcuggagggcgacaacaagcuggugaccaccuucaagaacaucaagagcgugaccgagcugaacggcgacaucaucaccaacaccaugacccugggcgacaucguguucaagagaaucagcaagagaaucuaa

SEQ ID NO: 16819 - RNA, 399 nt, Artificial Sequence
  FABP2__Homo_sapiens__NP_000125
auggccuucgacagcaccuggaagguggacagaagcgagaacuacgacaaguucauggagaagaugggcgugaacaucgugaagagaaagcuggccgcccacgacaaccugaagcugaccaucacccaggagggcaacaaguucaccgugaaggagagcagcaccuucagaaacaucgaggugguguucgagcugggcgugaccuucaacuacaaccuggccgacggcaccgagcugagaggcaccuggagccuggagggcaacaagcugaucggcaaguucaagagaaccgacaacggcaacgagcugaacaccgugagagagaucaucggcgacgagcuggugcagaccuacguguacgagggcguggaggccaagagaaucuucaagaaggacuaa

SEQ ID NO: 16820 - RNA, 399 nt, Artificial Sequence
  FABP4__Homo_sapiens__NP_001433
augugcgacgccuucgugggcaccuggaagcuggugagcagcgagaacuucgacgacuacaugaaggaggugggcgugggcuucgccaccagaaagguggccggcauggccaagcccaacaugaucaucagcgugaacggcgacgugaucaccaucaagagcgagagcaccuucaagaacaccgagaucagcuucauccugggccaggaguucgacgaggugaccgccgacgacagaaaggugaagagcaccaucacccuggacggcggcgugcuggugcacgugcagaagugggacggcaagagcaccaccaucaagagaaagagagaggacgacaagcuggugguggagugcgugaugaagggcgugaccagcaccagaguguacgagagagccuaa

SEQ ID NO: 16821 - RNA, 408 nt, Artificial Sequence
  FABP5__Homo_sapiens__NP_001435
auggccaccgugcagcagcuggagggcagauggagacugguggacagcaagggcuucgacgaguacaugaaggagcugggcgugggcaucgcccugagaaagaugggcgccauggccaagcccgacugcaucaucaccugcgacggcaagaaccugaccaucaagaccgagagcacccugaagaccacccaguucagcugcacccugggcgagaaguucgaggagaccaccgccgacggcagaaagacccagaccgugugcaacuucaccgacggcgcccuggugcagcaccaggagugggacggcaaggagagcaccaucaccagaaagcugaaggacggcaagcuggugguggagugcgugaugaacaacgugaccugcaccagaaucuacgagaagguggaguaa

SEQ ID NO: 16822 - RNA, 534 nt, Artificial Sequence
  FABP6__Homo_sapiens__NP_001124430
augaagaccgugaccaugaugauggugguggagaugcaggcccugacccaggugcugagagccgugcugagcgccugcaccugggugagcagaaagggcgaccugcagagaaugaagcagacccacaagggcaagccccccagcagcauggccuucaccggcaaguucgagauggagagcgagaagaacuacgacgaguucaugaagcugcugggcaucagcagcgacgugaucgagaaggccagaaacuucaagaucgugaccgaggugcagcaggacggccaggacuucaccuggagccagcacuacagcggcggccacaccaugaccaacaaguucaccgugggcaaggagagcaacauccagaccaugggcggcaagaccuucaaggccaccgugcagauggagggcggcaagcugguggugaacuuccccaacuaccaccagaccagcgagaucgugggcgacaagcugguggaggugagcaccaucggcggcgugaccuacgagagagugagcaagagacuggccuaa

SEQ ID NO: 16823 - RNA, 399 nt, Artificial Sequence
  FABP7__Homo_sapiens__NP_001437
augguggaggccuucugcgccaccuggaagcugaccaacagccagaacuucgacgaguacaugaaggcccugggcgugggcuucgccaccagacaggugggcaacgugaccaagcccaccgugaucaucagccaggagggcgacaagguggugaucagaacccugagcaccuucaagaacaccgagaucagcuuccagcugggcgaggaguucgacgagaccaccgccgacgacagaaacugcaagagcguggugagccuggacggcgacaagcuggugcacauccagaagugggacggcaaggagaccaacuucgugagagagaucaaggacggcaagauggugaugacccugaccuucggcgacgugguggccgugagacacuacgagaaggccuaa

SEQ ID NO: 16824 - RNA, 399 nt, Artificial Sequence
  FABP9__Homo_sapiens__NP_001073995
augguggagcccuuccugggcaccuggaagcuggugagcagcgagaacuucgaggacuacaugaaggagcugggcgugaacuucgccgccagaaacauggccggccuggugaagcccaccgugaccaucagcguggacggcaagaugaugaccaucagaaccgagagcagcuuccaggacaccaagaucagcuucaagcugggcgaggaguucgacgagaccaccgccgacaacagaaaggugaagagcaccaucacccuggagaacggcagcaugauccacgugcagaaguggcugggcaaggagaccaccaucaagagaaagaucguggacgagaagauggugguggagugcaagaugaacaacaucgugagcaccagaaucuacgagaagguguaa

SEQ ID NO: 16825 - RNA, 627 nt, Artificial Sequence
  FADD__Homo_sapiens__NP_003815
auggaccccuuccuggugcugcugcacagcgugagcagcagccugagcagcagcgagcugaccgagcugaaguuccugugccugggcagagugggcaagagaaagcuggagagagugcagagcggccuggaccuguucagcaugcugcuggagcagaacgaccuggagcccggccacaccgagcugcugagagagcugcuggccagccugagaagacacgaccugcugagaagaguggacgacuucgaggccggcgccgccgccggcgccgcccccggcgaggaggaccugugcgccgccuucaacgugaucugcgacaacgugggcaaggacuggagaagacuggccagacagcugaaggugagcgacaccaagaucgacagcaucgaggacagauaccccagaaaccugaccgagagagugagagagagccugagaaucuggaagaacaccgagaaggagaacgccaccguggcccaccuggugggcgcccugagaagcugccagaugaaccugguggccgaccuggugcaggaggugcagcaggccagagaccugcagaacagaagcggcgccaugagccccaugagcuggaacagcgacgccagcaccagcgaggccagcuaa

SEQ ID NO: 16826 - RNA, 1506 nt, Artificial Sequence
  FADS1__Homo_sapiens__NP_037534
augggcaccagagccgccagacccgccggccugcccugcggcgccgagaaccccgccagaagaagacuggcccugggcgccagacagcagauccacagcuggagccccagaacccccagcaccagacugaccgcccccgccggccccgccagaggcguggccagacccgccauggcccccgaccccguggccgccgagaccgccgcccagggccccacccccagauacuucaccugggacgagguggcccagagaagcggcugcgaggagagauggcuggugaucgacagaaagguguacaacaucagcgaguucaccagaagacaccccggcggcagcagagugaucagccacuacgccggccaggacgccaccgaccccuucguggccuuccacaucaacaagggccuggugaagaaguacaugaacagccugcugaucggcgagcugagccccgagcagcccagcuucgagcccaccaagaacaaggagcugaccgacgaguucagagagcugagagccaccguggagagaaugggccugaugaaggccaaccacguguucuuccugcuguaccugcugcacauccugcugcuggacggcgccgccuggcugacccuguggguguucggcaccagcuuccugcccuuccugcugugcgccgugcugcugagcgccgugcaggcccaggccggcuggcugcagcacgacuucggccaccugagcguguucagcaccagcaaguggaaccaccugcugcaccacuucgugaucggccaccugaagggcgcccccgccagcugguggaaccacaugcacuuccagcaccacgccaagcccaacugcuucagaaaggaccccgacaucaacaugcaccccuucuucuucgcccugggcaagauccugagcguggagcugggcaagcagaagaagaaguacaugcccuacaaccaccagcacaaguacuucuuccugaucggcccccccgcccugcugccccuguacuuccagugguacaucuucuacuucgugauccagagaaagaaguggguggaccuggccuggaugaucaccuucuacgugagauucuuccugaccuacgugccccugcugggccugaaggccuuccugggccuguucuucaucgugagauuccuggagagcaacugguucgugugggugacccagaugaaccacauccccaugcacaucgaccacgacagaaacauggacugggugagcacccagcugcaggccaccugcaacgugcacaagagcgccuucaacgacugguucagcggccaccugaacuuccagaucgagcaccaccuguuccccaccaugcccagacacaacuaccacaagguggccccccuggugcagagccugugcgccaagcacggcaucgaguaccagagcaagccccugcugagcgccuucgccgacaucauccacagccugaaggagagcggccagcuguggcuggacgccuaccugcaccaguaa

SEQ ID NO: 16827 - RNA, 1269 nt, Artificial Sequence
  FADS2__Homo_sapiens__NP_001268430
augcacggcagagaggccggccccuucgugugcgugugcgugcugcuggccagcauccccaccccccagaccccccugcugcaggccagccugccccccuuccaccccgccagcgccggccaccccaucaccggccagcaggacgccuucagagccuuccaccccgaccuggaguucgugggcaaguuccugaagccccugcugaucggcgagcuggcccccgaggagcccagccaggaccacggcaagaacagcaagaucaccgaggacuucagagcccugagaaagaccgccgaggacaugaaccuguucaagaccaaccacguguucuuccugcugcugcuggcccacaucaucgcccuggagagcaucgccugguucaccguguucuacuucggcaacggcuggauccccacccugaucaccgccuucgugcuggccaccagccaggcccaggccggcuggcugcagcacgacuacggccaccugagcguguacagaaagcccaaguggaaccaccuggugcacaaguucgugaucggccaccugaagggcgccagcgccaacugguggaaccacagacacuuccagcaccacgccaagcccaacaucuuccacaaggaccccgacgugaacaugcugcacguguucgugcugggcgaguggcagcccaucgaguacggcaagaagaagcugaaguaccugcccuacaaccaccagcacgaguacuucuuccugaucggccccccccugcugauccccauguacuuccaguaccagaucaucaugaccaugaucgugcacaagaacuggguggaccuggccugggccgugagcuacuacaucagauucuucaucaccuacauccccuucuacggcauccugggcgcccugcuguuccugaacuucaucagauuccuggagagccacugguucgugugggugacccagaugaaccacaucgugauggagaucgaccaggaggccuacagagacugguucagcagccagcugaccgccaccugcaacguggagcagagcuucuucaacgacugguucagcggccaccugaacuuccagaucgagcaccaccuguuccccaccaugcccagacacaaccugcacaagaucgccccccuggugaagagccugugcgccaagcacggcaucgaguaccaggagaagccccugcugagagcccugcuggacaucaucagaagccugaagaagagcggcaagcuguggcuggacgccuaccugcacaaguaa

SEQ ID NO: 16828 - RNA, 1338 nt, Artificial Sequence
  FADS3__Homo_sapiens__NP_068373
augggcggcgugggcgagcccggccccagagagggccccgcccagcccggcgccccccugcccaccuucugcugggagcagaucagagcccacgaccagcccggcgacaaguggcuggugaucgagagaagaguguacgacaucagcagaugggcccagagacaccccggcggcagcagacugaucggccaccacggcgccgaggacgccaccgacgccuucagagccuuccaccaggaccugaacuucgugagaaaguuccugcagccccugcugaucggcgagcuggcccccgaggagcccagccaggacggcccccugaacgcccagcugguggaggacuucagagcccugcaccaggccgccgaggacaugaagcuguucgacgccagccccaccuucuucgccuuccugcugggccacauccuggccauggaggugcuggccuggcugcugaucuaccugcugggccccggcugggugcccagcgcccuggccgccuucauccuggccaucagccaggcccagagcuggugccugcagcacgaccugggccacgccagcaucuucaagaagagcugguggaaccacguggcccagaaguucgugaugggccagcugaagggcuucagcgcccacugguggaacuucagacacuuccagcaccacgccaagcccaacaucuuccacaaggaccccgacgugaccguggcccccguguuccugcugggcgagagcagcguggaguacggcaagaagaagagaagauaccugcccuacaaccagcagcaccuguacuucuuccugaucggccccccccugcugacccuggugaacuucgagguggagaaccuggccuacaugcuggugugcaugcagugggccgaccugcugugggccgccagcuucuacgccagauucuuccugagcuaccugcccuucuacggcgugcccggcgugcugcuguucuucguggccgugagagugcuggagagccacugguucguguggaucacccagaugaaccacauccccaaggagaucggccacgagaagcacagagacugggugagcagccagcuggccgccaccugcaacguggagcccagccuguucaccaacugguucagcggccaccugaacuuccagaucgagcaccaccuguuccccagaaugcccagacacaacuacagcagaguggccccccuggugaagagccugugcgccaagcacggccugagcuacgaggugaagcccuuccugaccgcccugguggacaucgugagaagccugaagaagagcggcgacaucuggcuggacgccuaccugcaccaguaa

SEQ ID NO: 16829 - RNA, 1338 nt, Artificial Sequence
  FAF2__Homo_sapiens__NP_055428
auggccgcccccgaggagagagaccugacccaggagcagaccgagaagcugcugcaguuccaggaccugaccggcaucgagagcauggaccagugcagacacacccuggagcagcacaacuggaacaucgaggccgccgugcaggacagacugaacgagcaggagggcgugcccagcguguucaaccccccccccagcagaccccugcaggugaacaccgccgaccacagaaucuacagcuacguggugagcagaccccagcccagaggccugcugggcuggggcuacuaccugaucaugcugcccuucagauucaccuacuacaccauccuggacaucuucagauucgcccugagauucaucagacccgaccccagaagcagagugaccgaccccgugggcgacaucgugagcuucaugcacagcuucgaggagaaguacggcagagcccaccccguguucuaccagggcaccuacagccaggcccugaacgacgccaagagagagcugagauuccugcugguguaccugcacggcgacgaccaccaggacagcgacgaguucugcagaaacacccugugcgcccccgaggugaucagccugaucaacaccagaaugcuguucugggccugcagcaccaacaagcccgagggcuacagagugagccaggcccugagagagaacaccuaccccuuccuggccaugaucaugcugaaggacagaagaaugaccguggugggcagacuggagggccugauccagcccgacgaccugaucaaccagcugaccuucaucauggacgccaaccagaccuaccuggugagcgagagacuggagagagaggagagaaaccagacccaggugcugagacagcagcaggacgaggccuaccuggccagccugagagccgaccaggagaaggagagaaagaagagagaggagagagagagaaagagaagaaaggaggaggaggugcagcagcagaagcuggccgaggagagaagaagacagaaccugcaggaggagaaggagagaaagcuggagugccugccccccgagcccagccccgacgaccccgagagcgugaagaucaucuucaagcugcccaacgacagcagaguggagagaagauuccacuucagccagagccugaccgugauccacgacuuccuguucagccugaaggagagccccgagaaguuccagaucgaggccaacuuccccagaagagugcugcccugcauccccagcgaggaguggcccaacccccccacccugcaggaggccggccugagccacaccgaggugcuguucgugcaggaccugaccgacgaguaa

SEQ ID NO: 16830 - RNA, 945 nt, Artificial Sequence
  FAHD2A__Homo_sapiens__NP_057128
augcuggugagcggcagaagaagacugcugaccgugcugcugcaggcccagaaguggcccuuccagcccagcagagacaugagacuggugcaguucagagccccccaccuggugggcccccaccugggccuggagaccggcaacggcggcggcgugaucaaccugaacgccuucgaccccacccugcccaagaccaugacccaguuccuggagcagggcgaggccacccugagcguggccagaagagcccuggccgcccagcugcccgugcugcccagaagcgaggugaccuuccuggcccccgugaccagacccgacaagguggugugcgugggcaugaacuacguggaccacugcaaggagcagaacgugcccgugcccaaggagcccaucaucuucagcaaguucgccagcagcaucgugggccccuacgacgagguggugcugcccccccagagccaggagguggacugggagguggagcuggccguggugaucggcaagaagggcaagcacaucaaggccaccgacgccauggcccacguggccggcuucaccguggcccacgacgugagcgccagagacuggcagaugagaagaaacggcaagcaguggcugcugggcaagaccuucgacaccuucugcccccugggccccgcccuggugaccaaggacagcguggccgacccccacaaccugaagaucugcugcagagugaacggcgagguggugcagagcggcaacaccaaccagaugguguucaagaccgaggaccugaucgccugggugagccaguucgugaccuucuaccccggcgacgugauccugaccggcaccccccccggcgugggcguguucagaaagccccccguguuccugaagaagggcgacgaggugcagugcgagaucgaggagcugggcgugaucaucaacaaggugguguaa

SEQ ID NO: 16831 - RNA, 1260 nt, Artificial Sequence
  FAH__Homo_sapiens__NP_000128
augagcuucauccccguggccgaggacagcgacuuccccauccacaaccugcccuacggcguguucagcaccagaggcgaccccagacccagaaucggcguggccaucggcgaccagauccuggaccugagcaucaucaagcaccuguucaccggccccgugcugagcaagcaccaggacguguucaaccagcccacccugaacagcuucaugggccugggccaggccgccuggaaggaggccagaguguuccugcagaaccugcugagcgugagccaggccagacugagagacgacaccgagcugagaaagugcgccuucaucagccaggccagcgccaccaugcaccugcccgccaccaucggcgacuacaccgacuucuacagcagcagacagcacgccaccaacgugggcaucauguucagagacaaggagaacgcccugaugcccaacuggcugcaccugcccgugggcuaccacggcagagccagcagcgugguggugagcggcacccccaucagaagacccaugggccagaugaagcccgacgacagcaagccccccguguacggcgccugcaagcugcuggacauggagcuggagauggccuucuucgugggccccggcaacagacugggcgagcccauccccaucagcaaggcccacgagcacaucuucggcauggugcugaugaacgacuggagcgccagagacauccagaagugggaguacgugccccugggccccuuccugggcaagagcuucggcaccaccgugagccccuggguggugcccauggacgcccugaugcccuucgccgugcccaaccccaagcaggaccccagaccccugcccuaccugugccacgacgagcccuacaccuucgacaucaaccugagcgugaaccugaagggcgagggcaugagccaggccgccaccaucugcaagagcaacuucaaguacauguacuggaccaugcugcagcagcugacccaccacagcgugaacggcugcaaccugagacccggcgaccugcuggccagcggcaccaucagcggccccgagcccgagaacuucggcagcaugcuggagcugagcuggaagggcaccaagcccaucgaccugggcaacggccagaccagaaaguuccugcuggacggcgacgaggugaucaucaccggcuacugccagggcgacggcuacagaaucggcuucggccagugcgccggcaaggugcugcccgcccugcugcccagcuaa

SEQ ID NO: 16832 - RNA, 951 nt, Artificial Sequence
  FAIM2__Homo_sapiens__NP_036438
augacccagggcaagcugagcguggccaacaaggcccccggcaccgagggccagcagcaggugcacggcgagaagaaggaggcccccgccgugcccagcgccccccccagcuacgaggaggccaccagcggcgagggcaugaaggccggcgccuucccccccgcccccaccgccgugccccugcaccccagcugggccuacguggaccccagcagcagcagcagcuacgacaacggcuuccccaccggcgaccacgagcuguucaccaccuucagcugggacgaccagaaggugagaagaguguucgugagaaagguguacaccauccugcugauccagcugcuggugacccuggccgugguggcccuguucaccuucugcgaccccgugaaggacuacgugcaggccaaccccggcugguacugggccagcuacgccguguucuucgccaccuaccugacccuggccugcugcagcggccccagaagacacuuccccuggaaccugauccugcugaccguguucacccugagcauggccuaccugaccggcaugcugagcagcuacuacaacaccaccagcgugcugcugugccugggcaucaccgcccuggugugccugagcgugaccguguucagcuuccagaccaaguucgacuucaccagcugccagggcgugcuguucgugcugcugaugacccuguucuucagcggccugauccuggccauccugcugcccuuccaguacgugcccuggcugcacgccguguacgccgcccugggcgccggcguguucacccuguuccuggcccuggacacccagcugcugaugggcaacagaagacacagccugagccccgaggaguacaucuucggcgcccugaacaucuaccuggacaucaucuacaucuucaccuucuuccugcagcuguucggcaccaacagagaguaa

SEQ ID NO: 16833 - RNA, 837 nt, Artificial Sequence
  FAIM3__Homo_sapiens__NP_001135945
auggacuucuggcuguggccccuguacuuccugcccgaguacgagcccagcugggaggagcagcccaugcccgagacccccaagugguuccaccugcccuaccuguuccagaugcccgccuacgccagcagcagcaaguucgugaccagagugaccacccccgcccagagaggcaaggugccccccgugcaccacagcagccccaccacccagaucacccacagacccagagugagcagagccagcagcguggccggcgacaagcccagaaccuuccugcccagcaccaccgccagcaagaucagcgcccuggagggccugcugaagccccagacccccagcuacaaccaccacaccagacugcacagacagagagcccuggacuacggcagccagagcggcagagagggccagggcuuccacauccugauccccaccauccugggccuguuccugcuggcccugcugggccugguggugaagagagccguggagagaagaaaggcccugagcagaagagccagaagacuggccgugagaaugagagcccuggagagcagccagagacccagaggcagccccagacccagaagccagaacaacaucuacagcgccugccccagaagagccagaggcgccgacgccgccggcaccggcgaggcccccgugcccggccccggcgccccccugccccccgccccccugcaggugagcgagagccccuggcugcacgcccccagccugaagaccagcugcgaguacgugagccuguaccaccagcccgccgccaugauggaggacagcgacagcgacgacuacaucaacgugcccgccuaa

SEQ ID NO: 16834 - RNA, 1155 nt, Artificial Sequence
  FAM102A__Homo_sapiens__NP_001030331
auggccuuccugaugaagaagaagaaguucaaguuccagaccaccuucacccuggaggagcugaccgccgugcccuucgugaacggcgugcuguucugcaaggugagacugcuggacggcggcgacuucgugagccugagcagcagagaggaggugcaggagaacugcgugagauggagaaagagauucaccuucgugugcaagaugagcgccaaccccgccaccggccugcuggaccccugcguguucagagugagcgugagaaaggagcugaagggcggcaaggccuacagcaagcugggcuucgccgaccugaaccuggccgaguucgccggcagcggcagcaccgugagaugcugccugcuggagggcuacgacaccaagaacaccagacaggacaacagcauccugaaggugaccaucggcauguuccugcugagcggcgaccccugcuucaagaccccccccagcaccgccaagagcaucagcauccccggccaggacagcagccugcagcugaccugcaagggcggcggcaccagcagcggcggcagcagcaccaacagccugaccggcagcagaccccccaaggccagacccaccauccugagcagcggccugcccgaggagcccgaccagaaccugagcagccccgaggagguguuccacagcggccacagcagaaacagcagcuacgccagccagcagagcaagaucagcggcuacagcaccgagcacagcagaagcagcagccugagcgaccugacccacagaagaaacaccagcaccagcagcagcgccagcggcggccugggcaugaccguggagggccccgagggcagcgagagagagcacagaccccccgagaagccccccagaccccccagaccccugcaccugagcgacagaagcuucagaagaaagaaggacagcguggagagccaccccaccuggguggacgacaccagaaucgacgccgacgccaucguggagaagaucgugcagagccaggacuucaccgacggcagcaacaccgaggacagcaaccugagacuguucgugagcagagacggcagcgccacccugagcggcauccagcuggccaccagagugagcagcggcguguacgagcccguggugaucgagagccacuaa

SEQ ID NO: 16835 - RNA, 357 nt, Artificial Sequence
  FAM103A1__Homo_sapiens__NP_113640
augaccgacaccgccgaggccgugcccaaguucgaggagauguucgccagcagauucaccgagaacgacaaggaguaccaggaguaccugaagagaccccccgagagcccccccaucguggaggaguggaacagcagagccggcggcaaccagagaaacagaggcaacagacugcaggacaacagacaguucagaggcagagacaacagauggggcuggcccagcgacaacagaagcaaccaguggcacggcagaagcuggggcaacaacuacccccagcacagacaggagcccuacuacccccagcaguacggccacuacggcuacaaccagagaccccccuacggcuacuacuaa

SEQ ID NO: 16836 - RNA, 1071 nt, Artificial Sequence
  FAM105A__Homo_sapiens__NP_061891
auggccgccaccagaagccccaccagagccagagagagagagagaagcggcgcccccgccgccggcagcgaccaggugcacagcuggaugcuggccaccagccaggcccuggacaccguguggagaauggccaagggcuucgugaugcuggccgugagcuuccugguggccgccaucugcuacuucagaagacugcaccuguacagcggccacaagcugaagugguggaucggcuaccugcagagaaaguucaagagaaaccugagcguggaggccgagguggaccugcugagcuacugcgccagagaguggaagggcgagacccccagaaacaagcugaugagaaaggccuacgaggagcuguucuggagacaccacaucaagugcgugagacaggugagaagagacaacuacgacgcccugagaagcgugcuguuccagaucuucagccagggcaucagcuuccccagcuggaugaaggagaaggacaucgugaagcugcccgagaagcugcuguucagccagggcugcaacuggauccagcaguacagcuucggccccgagaaguacaccggcagcaacguguucggcaagcugagaaaguacguggagcugcugaagacccaguggaccgaguucaacggcaucagagacuaccacaagagaggcagcaugugcaacacccuguucagcgacgccauccuggaguacaagcuguacgaggcccugaaguucaucaugcuguaccaggugaccgagguguacgagcagaugaagaccaagaaggugauccccagccuguucagacugcuguucagcagagagaccagcagcgacccccugagcuucaugaugaaccaccugaacagcgugggcgacaccugcggccuggagcagaucgacauguucauccugggcuacagccuggaggugaagaucaagguguucagacuguucaaguucaacagcagagacuucgaggugugcuaccccgaggagccccugagagacuggcccgagaucagccugcugaccgagaacgacagacacuaccacauccccguguucuaa

SEQ ID NO: 16837 - RNA, 519 nt, Artificial Sequence
  FAM107A__Homo_sapiens__NP_001269642
auggcccagagacugggcgagugggccagaggccccagcgacgccaccggccuguacagagccgugcugcugagaagcgccgccauguacagcgagauccagagagagagagccgacaucggcggccugauggccagacccgaguacagagaguggaaccccgagcugaucaagcccaagaagcugcugaaccccgugaaggccagcagaagccaccaggagcugcacagagagcugcugaugaaccacagaagaggccugggcguggacagcaagcccgagcugcagagagugcuggagcacagaagaagaaaccagcugaucaagaagaagaaggaggagcuggaggccaagagacugcagugccccuucgagcaggagcugcugagaagacagcagagacugaaccagcuggagaagccccccgagaaggaggaggaccacgcccccgaguucaucaaggugagagagaaccugagaagaaucgccacccugaccagcgaggagagagagcuguaa

SEQ ID NO: 16838 - RNA, 396 nt, Artificial Sequence
  FAM107B__Homo_sapiens__NP_001269625
auggccgagcccgacuacaucgaggacgacaaccccgagcugaucagaccccagaagcugaucaaccccgugaagaccagcagaaaccaccaggaccugcacagagagcugcugaugaaccagaagagaggccuggccccccagaacaagcccgagcugcagaaggugauggagaagagaaagagagaccaggugaucaagcagaaggaggaggaggcccagaagaagaagagcgaccuggagaucgagcugcugaagagacagcagaagcuggagcagcuggagcuggagaagcagaagcugcaggaggagcaggagaacgcccccgaguucgugaaggugaagggcaaccugagaagaaccggccaggagguggcccaggcccaggagagcuaa

SEQ ID NO: 16839 - RNA, 789 nt, Artificial Sequence
  FAM109A__Homo_sapiens__NP_001171467
auggcccccggcagcccccccggccccgccaucgccaccaugaagcugaacgagagaagccuggccuucuacgccaccugcgacgcccccguggacaacgccggcuuccuguacaagaagggcggcagacacgccgccuaccacagaagaugguucgugcugagaggcaacaugcuguucuacuucgaggacgccgccagcagagagcccgugggcgugaucauccuggagggcugcaccguggagcugguggaggccgccgaggaguucgccuucgccgugagauucgccggcaccagagccagaaccuacgugcuggccgccgagagccaggacgccauggagggcugggugaaggcccugagcagagccagcuucgacuaccugagacugguggugagagagcuggagcagcagcuggccgccgugagaggcggcggcggcauggcccugccccagccccagccccagagccugccccugccccccagccugcccagcgcccuggcccccgugcccagccugcccagcgcccccgcccccgugcccgcccugccccugcccagaagacccagcgcccugccccccaaggagaacggcugcgccguguggagcaccgaggccaccuucagacccggccccgagccccccccccccccccccagaagaagagccagcgccccccacggcccccuggacauggcccccuucgccagacugcacgagugcuacggccaggagaucagagcccugagaggccaguggcugagcagcagagugcagcccuaa

SEQ ID NO: 16840 - RNA, 888 nt, Artificial Sequence
  FAM110A__Homo_sapiens__NP_001276075
augcccgugcacacccugagccccggcgcccccagcgcccccgcccugcccugcagacugagaaccagagugcccggcuaccugcugagaggccccgccgacggcggcgccagaaagcccagcgccguggagagacuggaggccgacaaggccaaguacgugaagagccugcacguggccaacaccagacaggagcccgugcagccccugcugagcaagcagccccuguucagccccgagaccagaagaaccgugcugacccccagcagaagagcccugcccggccccugcagaagaccccagcuggaccuggacauccugagcagccugaucgaccugugcgacagccccgugagccccgccgaggccagcagaacccccggcagagccgagggcgccggcagacccccccccgccaccccccccagacccccccccagcaccagcgccgugagaagaguggacgugagaccccugcccgccagccccgccagacccugccccagccccggccccgccgccgccagcagccccgccagaccccccggccugcagagaagcaagagcgaccugagcgagagauucagcagagccgccgccgaccuggagagauucuucaacuucugcggccuggaccccgaggaggccagaggccugggcguggcccaccuggccagagccagcagcgacaucgugagccuggccggccccagcgccggccccggcagcagcgagggcggcugcagcagaagaagcagcgugaccguggaggagagagccagagagagagugcccuacggcgugagcgugguggagagaaacgccagagugaucaaguggcuguacggccugagacaggccagagagagccccgccgccgagggcuaa

SEQ ID NO: 16841 - RNA, 1113 nt, Artificial Sequence
  FAM110B__Homo_sapiens__NP_671722
augcccaccgagacccugcagaccggcagcauggugaagcccgugagccccgccggcaccuucaccagcgccgugccccugagaauccugaacaagggccccgacuacuucagaagacaggccgagcccaaccccaagagacugagcgccguggagagacuggaggccgacaaggccaaguacgugaagagccaggaggugaucaacgccaagcaggagcccgugaagcccgccgugcuggccaagccccccgugugccccgccgccaagagagcccugggcagccccacccugaagguguucggcaaccacgccaagaccgagagcggcgugcagagagagaaccugaagcuggagauccugaagaacaucaucaacagcagcgagggcagcagcagcggcagcggccacaagcacagcagcagaaacuggcccccccacagaagcgaggccaccgaccugcacagacacagcuucgccgagagccugaagguguaccccacccagggcagaagaagcccccaggagggcggcagccacgugggcagaagacugcuggagcagagcgccgagagcuuccugcacgugagccacagcagcagcgacaucagaaaggugaccagcgugaagccccugaaggccauccccugcagcagcagcgcccccccccugccccccaagcccaagaucgccgccaucgccagcaugaagagccccgaggccgaccccguggagcccgccugcggcgugagcagaagacccagccugcagagaagcaagagcgaccugagcgacagauacuucagaguggacgccgacguggagagauucuucaacuacugcggccuggaccccgaggagcuggagaaccugggcauggagaacuucgccagagccaacagcgacaucaucagccugaacuucagaagcgccagcaugaucagcagcgacugcgagcagagccaggacagcaacagcgaccugagaaacgacgacagcgccaacgacagagugcccuacggcaucagcgccaucgagagaaacgccagaaucaucaaguggcuguacagcaucaagcaggccagagagagccagaaggugagccacguguaa

SEQ ID NO: 16842 - RNA, 966 nt, Artificial Sequence
  FAM110C__Homo_sapiens__NP_001071178
augagagcccuggccgcccugagcgccccccccaacgagagacugcugcccagagaccccgccgccaccagagaccccgacgccgccagacccgccagaagaagcgccguggagagacuggccgccgacagagccaaguacgugagaggcagacccggcaccggcagaggcguggccagcgagggcagcggccccggcgccaucaagugccccggcaacgaccccggcccccccgccagagcccccgcccccguggccagaagagccaucgccagaaagccccugagacccgacagccugaucaucuacagacagaagugcgaguucgugagaggcagcggcgccgacggccccagagccagccuggugaagaagcuguuccagggccccggcaaggacaaggcccccgugcccagaaccggcgacgagggcaaggccggcaaccccgagaccgugcccaccacccccggccccgccgccgaccccgccauccccgagacccccgcccccgccgccagaagcgccgcccccagcagcgugcccgccgccccccccggccccgagcccagaguggugagaagaagaggccugcagagaagccagagcgaccugagcagcagauacagcgccgcccuggccgagagcgacaccuucuuccaguacugcggccuggaccccgaggugguggaggcccugggcagagagaacuucaccgccggcagcgacugcgugacccugaaggugagaagcgugagcguggccaccagcggcagcggcuucagcagacacagcggcggcgacgacgagggccugcaggaggaggagcugaucgagcaggugcccagcaccaccagcgugaucgagagaaacgccagaaucaucaaguggcuguacaccugcaagaaggccaaggagacccccagccaggagcagagcagaaccagaggcagcaagcccagcagauaa

SEQ ID NO: 16843 - RNA, 2115 nt, Artificial Sequence
  FAM111B__Homo_sapiens__NP_001136176
augaagcagacccacgccgacacccccguggaccacugccugagcggcaucagaaagugcagcagcaccuucaagcugaagagcgaggugaacaagcacgagaccgcccuggagaugcagaaccccaaccugaacaacaaggagugcugcuucaccuucacccugaacggcaacagcagaaagcuggacagaagcguguucaccgccuacggcaagcccagcgagagcaucuacagcgcccugagcgccaacgacuacuucagcgagagaaucaagaaccaguucaacaagaacaucaucguguacgaggagaagaccaucgacggccacaucaaccugggcaugccccugaagugccugcccagcgacagccacuucaagaucaccuucggccagagaaagagcagcaaggaggacggccacauccugagacagugcgagaaccccaacauggagugcauccuguuccacgugguggccaucggcagaaccagaaagaagaucgugaagaucaacgagcugcacgagaagggcagcaagcugugcaucuacgcccugaagggcgagaccaucgagggcgcccugugcaaggacggcagauucagaagcgacaucggcgaguucgaguggaagcugaaggagggccacaagaagaucuacggcaagcagagcaugguggacgaggugagcggcaaggugcuggagauggacaucagcaagaagaaggcccugcagcagaaggacauccacaagaagaucaagcagaacgagagcgccaccgacgagaucaaccaccagagccugauccagagcaagaagaaggugcacaagcccaagaaggacggcgagaccaaggacguggagcacagcagagagcagauccugcccccccaggaccugagccacuacaucaaggacaagaccagacagaccauccccagaaucagaaacuacuacuucugcagccugcccagaaaguacagacagaucaacagccaggugagaagaagaccccaccugggcagaagauacgccaucaaccuggacgugcagaaggaggccaucaaccugcugaagaacuaccagacccugaacgaggccaucaugcaccaguaccccaacuucaaggaggaggcccagugggugagaaaguacuucagagaggagcagaagagaaugaaccugagccccgccaagcaguucaacaucuacaagaaggacuucggcaagaugaccgccaacagcgugagcguggccaccugcgagcagcugaccuacuacagcaagagcgugggcuucaugcagugggacaacaacggcaacaccggcaacgccaccugcuucguguucaacggcggcuacaucuucaccugcagacacguggugcaccugauggugggcaagaacacccaccccagccuguggcccgacaucaucagcaagugcgccaaggugaccuucaccuacaccgaguucugccccacccccgacaacugguucagcaucgagcccuggcugaaggugagcaacgagaaccuggacuacgccauccugaagcugaaggagaacggcaacgccuucccccccggccuguggagacagaucagcccccagcccagcaccggccugaucuaccugaucggccaccccgagggccagaucaagaagaucgacggcugcaccgugaucccccugaacgagagacugaagaaguaccccaacgacugccaggacggccugguggaccuguacgacaccaccagcaacguguacugcauguucacccagagaagcuuccugagcgagguguggaacacccacacccugagcuacgacaccugcuucagcgacggcagcagcggcagccccguguucaacgccagcggcaagcugguggcccugcacaccuucggccuguucuaccagagaggcuucaacgugcacgcccugaucgaguucggcuacagcauggacagcauccugugcgacaucaagaagaccaacgagagccuguacaagagccugaacgacgagaagcuggagaccuacgacgaggagaagggcaagcaggagagcagccugcaggaccaccagaucgagcccauggagugcuaa

SEQ ID NO: 16844 - RNA, 1692 nt, Artificial Sequence
  FAM114A1__Homo_sapiens__NP_612398
augagcgacgacgccggcgacacccuggccaccggcgacaaggccgaggugaccgagaugcccaacagcgacagccugcccgaggacgccgaggugcacugcgacagcgccgccgugagccacgagcccacccccgccgaccccagaggcgagggccacgagaacgccgccgugcagggcgccggcgccgccgccaucggcccccccgugcagccccaggacgccaacgcccuggagcccccccugaacggcgacgugaccgaggacacccuggccgagugcaucgacagcgugagccuggaggccgagcccagaagcgagaucccccugcaggagcagaacuaccuggccguggacagcccccccagcggcggcggcugggccggcuggggcagcuggggcaagagccugcugagcagcgccagcgccaccgugggccacggccugaccgccgugaaggagaaggccggcgccacccugagaauccacggcgugaacagcggcagcagcgagggcgcccagcccaacaccgagaacggcgugcccgagaucaccgacgccgccaccgaccagggccccgccgagagcccccccaccagccccagcagcgccagcagaggcaugcugagcgccaucaccaacguggugcagaacaccggcaagagcgugcugaccggcggccuggacgcccuggaguucaucggcaagaagaccaugaacgugcuggccgagagcgaccccggcuucaagagaaccaagacccugauggagagaaccgugagccugagccagaugcugagagaggccaaggagaaggagaagcagagacuggcccagcagcugaccauggagagaaccgcccacuacggcaugcuguucgacgaguaccagggccugagccaccuggaggcccuggagauccugagcaacgagagcgagagcaaggugcagagcuuccuggccagccuggacggcgagaagcuggagcugcugaagaacgaccugaucagcaucaaggacaucuucgccgccaaggagcuggagaacgaggagaaccaggaggagcagggccuggaggagaagggcgaggaguucgccagaaugcugaccgagcugcuguucgagcugcacguggccgccacccccgacaagcugaacaaggccaugaagagagcccacgacuggguggaggaggaccagaccguggugagcguggacguggccaaggugagcgaggaggagaccaagaaggaggagaaggaggagaagagccaggacccccaggaggacaagaaggaggagaagaagaccaagaccaucgaggagguguacaugagcagcaucgagagccuggccgaggugaccgccagaugcaucgagcagcugcacaagguggccgagcugauccugcacggccaggaggaggagaagcccgcccaggaccaggccaaggugcugaucaagcugaccaccgccaugugcaacgagguggccagccugagcaagaaguucaccaacagccugaccaccgugggcagcaacaagaaggccgaggugcugaaccccaugaucagcagcgugcugcuggagggcugcaacagcaccaccuacauccaggacgccuuccagcugcugcugcccgugcugcaggugagccacauccagaccagcugccugaaggcccagcccuaa

SEQ ID NO: 16845 - RNA, 2769 nt, Artificial Sequence
  FAM120B__Homo_sapiens__NP_001273308
auggacagacagaugauccugagcagaagcagcgugaugggcgugagaggccugcagggcuucgugggcagcaccugcccccacaucugcaccguggugaacuucaaggagcuggccgagcaccacagaagcaaguaccccggcugcacccccaccaucgugguggacgccaugugcugccugagauacugguacacccccgagagcuggaucugcggcggccaguggagagaguacuucagcgcccugagagacuucgugaagaccuucaccgccgccggcaucaagcugaucuucuucuucgacggcaugguggagcaggacaagagagacgagugggugaagagaagacugaagaacaacagagagaucagcagaaucuuccacuacaucaagagccacaaggagcagcccggcagaaacauguucuucauccccagcggccuggccguguucaccagauucgcccugaagacccugggccaggagacccugugcagccugcaggaggccgacuacgagguggccagcuacggccugcagcacaacugccugggcauccugggcgaggacaccgacuaccugaucuacgacaccugccccuacuucagcaucagcgagcugugccuggagagccuggacaccgugaugcugugcagagagaagcugugcgagagccugggccugugcguggccgaccugccccugcuggccugccugcugggcaacgacaucauccccgagggcauguucgagagcuucagauacaagugccugagcagcuacaccagcgugaaggagaacuucgacaagaagggcaacaucauccuggccgugagcgaccacaucagcaaggugcuguaccuguaccagggcgagaagaagcuggaggagauccugccccugggccccaacaaggcccuguucuacaagggcauggccagcuaccugcugcccggccagaagagccccugguucuuccagaagcccaagggcgugaucacccuggacaagcaggugaucagcaccagcagcgacgccgagagcagagaggaggugcccaugugcagcgacgccgagagcagacaggaggugcccaugugcaccggccccgagagcagaagagaggugcccguguacaccgacagcgagcccagacaggaggugcccaugugcagcgaccccgagcccagacaggaggugcccaccugcaccggccccgagagcagaagagaggugcccaugugcagcgaccccgagcccagacaggaggugcccaugugcaccggccccgaggccagacaggaggugcccauguacaccgacagcgagcccagacaggaggugcccauguacaccgacagcgagcccagacaggaggugcccauguacaccggcagcgagcccagacaggaggugcccauguacaccggccccgagagcagacaggaggugcccauguacaccggccccgagagcagacaggaggugcugaucagaaccgaccccgagagcagacaggagaucaugugcaccggccacgagagcaagcaggaggugcccaucugcaccgaccccaucagcaagcaggaggacagcaugugcacccacgccgagaucaaccagaagcugcccguggccaccgacuucgaguucaagcuggaggcccugaugugcaccaaccccgagaucaagcaggaggaccccaccaacgugggccccgaggugaagcagcaggugaccauggugagcgacaccgagauccugaagguggccagaacccaccacgugcaggccgagagcuaccugguguacaacaucaugagcagcggcgagaucgagugcagcaacacccuggaggacgagcuggaccaggcccugcccagccaggccuucaucuacagacccaucagacagagaguguacagccugcugcuggaggacugccaggacgugaccagcaccugccuggccgugaaggagugguucguguaccccggcaacccccugagacaccccgaccuggugagaccccugcagaugaccauccccggcggcacccccagccugaagauccuguggcugaaccaggagcccgagauccaggugagaagacuggacacccugcuggccugcuucaaccugagcagcagcagagaggagcugcaggccguggagagccccuuccaggcccugugcugccugcugaucuaccuguucgugcagguggacacccugugccuggaggaccugcacgccuucaucgcccaggcccugugccugcagggcaagagcaccagccagcuggugaaccugcagcccgacuacaucaaccccagagccgugcagcugggcagccugcuggugagaggccugaccacccuggugcuggugaacagcgccugcggcuuccccuggaagaccagcgacuucaugcccuggaacguguucgacggcaagcuguuccaccagaaguaccugcagagcgagaagggcuacgccguggaggugcugcuggagcagaacagaagcagacugaccaaguuccacaaccugaaggccguggugugcaaggccugcaugaaggagaacagaagaaucaccggcagagcccacuggggcagccaccacgccggcagauggggcagacagggcagcagcuaccacagaaccggcagcggcuacagcagaagcagccagggccagcccuggagagaccagggccccggcagcagacaguacgagcacgaccaguggagaagauacuaa

SEQ ID NO: 16846 - RNA, 3291 nt, Artificial Sequence
  FAM120C__Homo_sapiens__NP_060318
augggcgugcagggcuuccaggaguuccuggagaagagaugccccggcgccguggugcccguggaccugcugaagcuggccagaaccgugagcagacagcagcagcagcagcaccugcacagacagcugccccccaccgccgcccuggcccccggcgcccccagagccgccagaggcagcgugccccugcagcccccccugccccccgccgcccugggcgccuacagcggcggcgccggccccaccagacaccaccaccccgcccaccacuuccaccaccacggccaggcccagcccggccugcaccccccccugcccccccccccccccccccagcugcccggcgccagagugcugguggacgccggcagcgcccugcccagacuguacggcggcuaccagaccgacugggugugcggcggccaguggaacgccaugcugggcuaccugagcgcccugugccaggccugcgccuaccccggcggcgacggccuggagcugguggugauguuccccggcggccugggcaaggacagacuggccgaguggggcagaagaugccaggccgagagacagaccgcccagcugaucgugggccacgugggcaacaagggcacccccccccccagagccugguuccugccccccgccugccugagccacugcgugagacuggcccugaucagauucagagugaagguguuccagagccuggaggaccaccaccuggaggugguggccuucuucagagagaacggcuuccacggccugcuggcccacgacagcgaguacgcccuguacaacauccccagcuacuacagcagccacgcccugaagcugagcuggaacggcaagaaccugaccaccaaccaguuccugaugcaggagguggccaagcagcugggccugaagagaaugaacuuccccaucuucgccgcccugcugggcaaccacauccugcccgacgaggaccuggccgccuuccacuggagccugcugggccccgagcacccccuggccagccugaaggugagagcccaccagcuggugcugccccccugcgacguggugaucaaggccgugagcgaguacgugagcagcaucaaggaccccagcaaccuggacguggugggcaaggacguguucaagcagagccagagcagaaccgaggacaagaucgagagauucaagaaggccguggaguacuacagcgugaccaccaagcugagcagccugcccgugggccccagcuuccugggcuucagaaacaacagacugggcaaccccccccugcccagaaaccaggugggcaccaucagcgccggcaagcccauguucagccaccaggugccccagaaggugaaguaccccccccccuuccccgugggccccaacagcagccugcuguucagcagccacgcccugggcgagagccacgccuucagcgaggaccccaugcugcagaacagccccuucgccaacugggccgugagcuacgacagcagcgccagccaguuccccaacuaccugcccagcaaggccagccccccccugggccccgacagcagccacagcagcagcagcgacggcgacgagcccaacggcgccagcagcgaccacaucaccgaggccuuccaccaccagcccgaguggggcaaccccaacagagacagaggcagcugggcccagcccguggacaccggcgugagcgaggccagccugggcgacggcgagccccacauccccagccugcugagcaugagcaccagaaaccacauggacaucaccauccccccccugccccccguggcccccgaggugcugagaguggccgagcacagacacagaagaggccugauguaccccuacaucuaccacgugcugaccaagggcgagaucaagauccccgugugcaucgaggacgagugcaacauggagcugccccccgccgcccugcuguucagaagcgccagacaguacguguacggcgugcuguucagccuggccgagacccagagaaagauggagagacuggccaugagaagaagacugcccguggaggugcccagcgugauccugaaggaguggagcgccuacaagggcaagagcccccagacccccgagcuggugagcgcccugaccuucagagaguggaccugccccaaccugaagaagcuguggcugggcaaggccguggaggacaagaacagaagaaugagagccuuccuggccugcaugaagagcgacacccccagcaugcugaaccccgccaacgugcccacccaccugcugcugaugugcugcgugcugagauacauggugcaguggcccggcggcagaauccugcacagacacgagcuggacaccuuccuggcccaggccgugagcacccagcuguacgagcccgacagacugcaggagcugaagaucgagaagcuggacgccagaggcauccagcuggccgcccuguucaugagcggcguggacaccgcccuguucgccaacgacgccugcggccagcccgugcccugggagcacugcugccccuggaucuacuucgacggcaagcuguuccagagcaagcugaucaaggccggcagagagagagugagccugguggagcugugcgacggccaggccgaccuggccaccaagguggagaagaugagacagagcauccuggagggcgugaacaugaaccaccccccccccagcgcccugcugcccagccccaccuucgugccccccauggugcccagccuguaccccgugagccuguacagcagagccaugggcagcaugccccugcccccccagggcagaagcagaggcuucgccggccugcaccccauccccccccagggcggcaagcuggagaucgccggcaugguggugggccagugggccggcagcagaagcagcagaggcagaggcagcuucggcaugcagguggugagcgugggcggccccggcaagggccacggcaaggagcagaccggcagaggcagcaagggccacaagaagggcaacaagcagggcagcagcgacggcgugagcaagagccuggagcugcaccagggcagaagcagaagccaggugaacggcaacagcggcgcccugaucaaggaggagaagagcgaccacagacugcccgcccccagccagugcgcccugagcagagacagcaacgagugcaacaacggcaacagauaccugcccaugaacaacagagagaagaaccaccugcaggagcagaagcuggagaccguggcccagagaaaggaggacuaa

SEQ ID NO: 16847 - RNA, 1368 nt, Artificial Sequence
  FAM124B__Homo_sapiens__NP_001116251
auggacgagacccagggcccccuggccaugaccgugcaccugcuggccaacagcggccacggcagccugcugcagagaacccuggaccagcugcuggacugcaucugccccgaggugagacuguuccaggugagcgagagagccagccccgugaaguacugcgagaagagccacagcaagagaagcagauuccccggcaugagcgugcugcuguuccugcacgagagccccggcgaggacagacuguucagagugcuggacagccugcagcacagccccuggcagugcuaccccacccaggacaccagaggcagacugugccccuacuucuucgccaaccaggaguucuacagccuggacagccagcugcccaucuggggcgugagacaggugcacugcggcagcgagauccugagagugacccuguacugcagcuucgacaacuacgaggacgccaucagacuguacgagaugauccugcagagagaggccacccugcagaagagcaacuucugcuucuucgugcuguacgccagcaagagcuucgcccugcagcugagccugaagcagcugccccccggcaugagcguggaccccaaggagagcagcgugcugcaguucaaggugcaggagaucggccagcuggugccccugcugcccaaccccugcaugcccaucagcagcaccagauggcagacccaggacuacgacggcaacaagauccugcugcaggugcagcugaaccccgagcugggcgugaagaacggcauccugggcgccggcaugcugccccugggcagcagacugaccagcgugagcgccaagagaaccagcgagcccagaagccagagaaaccagggcaagagaagccagggccacagccuggagcugcccgagcccagcggcagccccaccagcgacagaugcgccggcaccagcuggaagagccccggcagaagcuuccaggugagcagccccgccaugggcgcccaccugcaccugagcagccaccaccuggagagcggcgccagaaugaaggugcugaacagagagaacagcuuccagaagcuggaggccgagaccaacguggacaccggccugaccaucaucaacagcgagcccagacagaccuacuucggcggcuuccccagagaccugcagaccagccagccccccuucugccugcccgccagcagccugggcguggccaccagcaagaacaacagcgugcugaaggagagagugagcccccugccccuggccggccagagagaccugggcaccagaaagaccaucagcgagugccugcugcaccugcaggugcagggcgaggagaaggaggaggacgaggaggaguucuucaucuaa

SEQ ID NO: 16848 - RNA, 1566 nt, Artificial Sequence
  FAM126A__Homo_sapiens__NP_115970
auguucaccagcgagaagggcgugguggaggaguggcugagcgaguucaagacccugcccgagaccagccugcccaacuacgccaccaaccugaaggacaagagcagccuggugagcagccuguacaaggugauccaggagccccagagcgagcugcuggagcccgugugccaccagcuguucgaguucuacagaagcggcgaggagcagcugcugcaguucacccugcaguuccugcccgagcugaucuggugcuaccuggccgugagcgccagcagaaacgugcacagcagcggcugcaucgaggcccugcugcugggcguguacaaccuggagaucguggacaagcagggccacaccaaggugcugagcuucaccauccccagccugagcaagcccagcguguaccacgagcccagcagcaucggcagcauggcccugaccgagagcgcccugagccagcacggccugagcaaggugguguacagcggcccccacccccagagagagaugcugaccgcccagaacagauucgaggugcugaccuuccugcugcugugcuacaacgccgcccugaccuacaugcccagcgugagccugcagagccugugccagaucugcagcagaaucugcgugugcggcuaccccagacagcacgugagaaaguacaagggcaucagcagcagaauccccgugagcagcggcuucauggugcagaugcugaccggcaucuacuucgccuucuacaacggcgagugggaccuggcccagaaggcccuggacgacaucaucuacagagcccagcuggagcuguaccccgagccccugcugguggccaacgccaucaaggccagccugccccacggccccaugaagagcaacaaggagggcaccagaugcauccagguggagaucacccccaccagcagcagaaucagcagaaacgccgugaccagcaugagcaucagaggccacagauggaagagacacggcaacaccgagcugaccggccaggaggagcugauggagaucagcgagguggacgagggcuucuacagcagagccgccagcagcaccagccagagcggccugagcaacagcagccacaacugcagcaacaagcccagcaucggcaagaaccacagaagaagcggcggcagcaagaccggcggcaaggagaaggagaccaccggcgagagcugcaaggaccacuucgccagaaagcagacccagagagcccagagcgagaaccuggagcugcugagccugaagagacugacccugaccaccagccagagccugcccaagcccagcagccacggccuggccaagaccgccgccaccguguucagcaagagcuucgagcaggugagcggcgugaccgugccccacaaccccagcagcgccgugggcugcggcgccggcaccgacgccaacagauucagcgccugcagccugcaggaggagaagcugaucuacgugagcgagagaaccgagcugcccaugaagcaccagagcggccagcagagaccccccagcaucagcaucacccugagcaccgacuaa

SEQ ID NO: 16849 - RNA, 2787 nt, Artificial Sequence
  FAM129A__Homo_sapiens__NP_443198
augggcggcagcgccagcagccagcuggacgagggcaagugcgccuacaucagaggcaagaccgaggccgccaucaagaacuucagccccuacuacagcagacaguacagcguggccuucugcaaccacgugagaaccgagguggagcagcagagagaccugaccagccaguuccugaagaccaagcccccccuggcccccggcaccauccuguacgaggccgagcugagccaguucagcgaggacaucaagaaguggaaggagagauacgugguggugaagaacgacuacgccguggagagcuacgagaacaaggaggccuaccagagaggcgccgcccccaagugcagaauccugcccgccggcggcaaggugcugaccagcgaggacgaguacaaccugcugagcgacagacacuuccccgacccccuggccagcagcgagaaggagaacacccagcccuucguggugcugcccaaggaguuccccguguaccuguggcagcccuucuucagacacggcuacuucugcuuccacgaggccgccgaccagaagagauucagcgcccugcugagcgacugcgugagacaccugaaccacgacuacaugaagcagaugaccuucgaggcccaggccuuccuggaggccgugcaguucuucagacaggagaagggccacuacggcagcugggagaugaucaccggcgacgagauccagauccugagcaaccuggugauggaggagcugcugcccacccugcagaccgaccugcugcccaagaugaagggcaagaagaacgacagaaagagaaccuggcugggccugcuggaggaggccuacacccuggugcagcaccaggugagcgagggccugagcgcccugaaggaggagugcagagcccugaccaagggccuggagggcaccaucagaagcgacauggaccagaucgugaacagcaagaacuaccugaucggcaagaucaaggccaugguggcccagcccgccgagaagagcugccuggagagcgugcagcccuuccuggccagcauccuggaggagcugaugggccccgugagcagcggcuucagcgaggugagagugcuguucgagaaggaggugaacgaggugagccagaacuuccagaccaccaaggacagcgugcagcugaaggagcaccuggacagacugaugaaccugccccugcacagcgugaagauggagcccugcuacaccaaggugaaccugcugcacgagagacugcaggaccugaagagcagauucagauucccccacaucgaccugguggugcagagaacccagaacuacaugcaggagcugauggagaacgccguguucaccuucgagcagcugcugagcccccaccugcagggcgaggccagcaagaccgccguggccaucgagaaggugaagcugagagugcugaagcaguacgacuacgacagcagcaccaucagaaagaagaucuuccaggaggcccuggugcagaucacccugcccaccgugcagaaggcccuggccagcaccugcaagcccgagcugcagaaguacgagcaguucaucuucgccgaccacaccaacaugauccacguggagaacguguacgaggagauccugcaccagauccugcuggacgagacccugaaggugaucaaggaggccgccauccugaagaagcacaaccuguucgaggacaacauggcccugcccagcgagagcgugagcagccugaccgaccugaagccccccaccggcagcaaccaggccagccccgccagaagagccagcgccauccugcccggcgugcugggcagcgagacccugagcaacgagguguuccaggagagcgaggaggagaagcagcccgaggugcccagcagccuggccaagggcgagagccugagccugcccggccccagccccccccccgacggcaccgagcaggugaucaucagcagaguggacgaccccguggugaaccccguggccaccgaggacaccgccggccugcccggcaccugcagcagcgagcuggaguucggcggcacccuggaggacgaggagcccgcccaggaggagcccgagcccaucaccgccagcggcagccugaaggcccugagaaagcugcugaccgccagcguggaggugcccguggacagcgcccccgugauggaggaggacaccaacggcgagagccacgugccccaggagaacgaggaggaggaggagaaggagcccagccaggccgccgccauccaccccgacaacugcgaggagagcgaggugagcgagagagaggcccagccccccugccccgaggcccacggcgaggagcugggcggcuuccccgaggugggcagccccgccagcccccccgccagcggcggccugaccgaggagccccugggccccauggagggcgagcugcccggcgaggccugcacccugaccgcccacgagggcagaggcggcaagugcaccgaggagggcgacgccagccagcaggagggcugcacccugggcagcgaccccaucugccugagcgagagccaggugagcgaggagcaggaggagaugggcggccagagcagcgccgcccaggccaccgccagcgugaacgccgaggagaucaagguggccagaauccacgagugccagugggugguggaggacgcccccaaccccgacgugcugcugagccacaaggacgacgugaaggagggcgagggcggccaggagagcuuccccgagcugcccagcgaggaguaa

SEQ ID NO: 16850 - RNA, 2202 nt, Artificial Sequence
  FAM129B__Homo_sapiens__NP_001030611
augggcuggaugggcgagaagaccggcaagauccugaccgaguuccugcaguucuacgaggaccaguacggcguggcccuguucaacagcaugagacacgagaucgagggcaccggccugccccaggcccagcugcuguggagaaaggugccccuggacgagagaaucguguucagcggcaaccuguuccagcaccaggaggacagcaagaaguggagaaacagauucagccuggugccccacaacuacggccuggugcuguacgagaacaaggccgccuacgagagacaggugccccccagagccgugaucaacagcgccggcuacaagauccugaccagcguggaccaguaccuggagcugaucggcaacagccugcccggcaccaccgccaagagcggcagcgcccccauccugaagugccccacccaguucccccugauccuguggcaccccuacgccagacacuacuacuucugcaugaugaccgaggccgagcaggacaaguggcaggccgugcugcaggacugcaucagacacugcaacaacggcauccccgaggacagcaagguggagggccccgccuucaccgacgccaucagaauguacagacagagcaaggagcuguacggcaccugggagaugcugugcggcaacgaggugcagauccugagcaaccuggugauggaggagcugggccccgagcugaaggccgagcugggccccagacugaagggcaagccccaggagagacagagacaguggauccagaucagcgacgccguguaccacaugguguacgagcaggccaaggccagauucgaggaggugcugagcaaggugcagcaggugcagcccgccaugcaggccgugaucagaaccgacauggaccagaucaucaccagcaaggagcaccuggccagcaagaucagagccuucauccugcccaaggccgaggugugcgugagaaaccacgugcagcccuacauccccagcauccuggaggcccugauggugcccaccagccagggcuucaccgaggugagagacguguucuucaaggaggugaccgacaugaaccugaacgugaucaacgagggcggcaucgacaagcugggcgaguacauggagaagcugagcagacuggccuaccacccccugaagaugcagagcugcuacgagaagauggagagccugagacuggacggccugcagcagagauucgacgugagcagcaccagcguguucaagcagagagcccagauccacaugagagagcagauggacaacgccguguacaccuucgagacccugcugcaccaggagcugggcaagggccccaccaaggaggagcugugcaagagcauccagagagugcuggagagagugcugaagaaguacgacuacgacagcagcagcgugagaaagagauucuucagagaggcccugcugcagaucagcauccccuuccugcugaagaagcuggcccccaccugcaagagcgagcugcccagauuccaggagcugaucuucgaggacuucgccagauucauccugguggagaacaccuacgaggagguggugcugcagaccgugaugaaggacauccugcaggccgugaaggaggccgccgugcagagaaagcacaaccuguacagagacagcauggugaugcacaacagcgaccccaaccugcaccugcuggccgagggcgcccccaucgacuggggcgaggaguacagcaacagcggcggcggcggcagccccagccccagcacccccgagagcgccacccugagcgagaagagaagaagagccaagcagguggugagcguggugcaggacgaggaggugggccugcccuucgaggccagccccgagagccccccccccgccagccccgacggcgugaccgagaucagaggccugcuggcccagggccugagacccgagagccccccccccgccggcccccugcugaacggcgcccccgccggcgagagcccccagcccaaggccgcccccgaggccagcagcccccccgccagcccccugcagcaccugcugcccggcaaggccguggaccugggcccccccaagcccagcgaccaggagaccggcgagcaggugagcagccccagcagccaccccgcccugcacaccaccaccgaggacagcgccggcgugcagaccgaguucuaa

SEQ ID NO: 16851 - RNA, 1494 nt, Artificial Sequence
  FAM134B__Homo_sapiens__NP_001030022
auggccagccccgccccccccgagcacgccgaggagggcugccccgcccccgccgccgaggagcaggccccccccagccccccccccccccaggccagccccgccgagagacagcagcaggaggaggaggcccaggaggccggcgccgccgagggcgccggccugcagguggaggaggccgccggcagagccgccgccgccgugaccuggcugcugggcgagcccgugcuguggcugggcugcagagccgacgagcugcugagcuggaagagaccccugagaagccugcugggcuucguggccgccaaccugcuguucugguuccuggcccugacccccuggagaguguaccaccugaucagcgugaugauccugggcagagugaucaugcagaucaucaaggacauggugcugagcagaaccagaggcgcccagcuguggagaagccugagcgagagcugggaggugaucaacagcaagcccgacgagagacccagacugagccacugcaucgccgagagcuggaugaacuucagcaucuuccugcaggagaugagccuguucaagcagcagagccccggcaaguucugccugcuggugugcagcgugugcaccuucuucaccauccugggcagcuacauccccggcgugauccugagcuaccugcugcugcugugcgccuuccugugcccccuguucaagugcaacgacaucggccagaagaucuacagcaagaucaagagcgugcugcugaagcuggacuucggcaucggcgaguacaucaaccagaagaagagagagagaagcgaggccgacaaggagaagagccacaaggacgacagcgagcuggacuucagcgcccugugccccaagaucagccugaccguggccgccaaggagcugagcgugagcgacaccgacgugagcgaggugagcuggaccgacaacggcaccuucaaccugagcgagggcuacaccccccagaccgacaccagcgacgaccuggacagacccagcgaggagguguucagcagagaccugagcgacuuccccagccuggagaacggcaugggcaccaacgacgaggacgagcugagccugggccugcccaccgagcugaagagaaagaaggagcagcuggacagcggccacagacccagcaaggagacccagagcgccgccggccugacccugccccugaacagcgaccagaccuuccaccugaugagcaaccuggccggcgacgugaucaccgccgccgugaccgccgccaucaaggaccagcuggagggcgugcagcaggcccugagccaggccgcccccauccccgaggaggacaccgacaccgaggagggcgacgacuucgagcugcuggaccagagcgagcuggaccagaucgagagcgagcugggccugacccaggaccaggaggccgaggcccagcagaacaagaagagcagcggcuuccugagcaaccugcugggcggccacuaa

SEQ ID NO: 16852 - RNA, 3960 nt, Artificial Sequence
  FAM135A__Homo_sapiens__NP_001099001
augaccgaggugcaggccaugguggaguucagcguggagcugaacaaguucuacaacguggaccuguuccagagaggcuucuaccagaucagagccagcaugaagauccccagcagaaucccccacagaguggaggccagccugcugcacgccaccggcaugacccuggccuuccccgccagcgugcacgacagccugaucugcagcaagaccuuccagauccuguacaagaacgaggagguggugcugaacgacgugaugaucuucaaggugaagaugcugcuggacgagagaaagaucgaggagacccuggaggagaugaacuuccugcugagccuggaccugcacuucaccgacggcgacuacagcgccgacgaccugaacgcccugcagcugaucagcagcagaacccugaagcugcacuucagcccccacagaggccugcaccaccacgugaacgugauguucgacuacuuccaccugagcguggugagcgugaccgugcacgccagccugguggcccugcaccagccccugaucagcuuccccagacccgugaagaccaccuggcugaacagaaacgcccccgcccagaacaaggacagcgugauccccacccuggagagcgugguguucggcaucaacuacaccaagcagcugagccccgacggcugcagcuucaucaucgccgacagcuuccugcaccacgccuacagauuccacuacacccugugcgccacccugcugcuggccuucaagggccugcacagcuacuucaucaccgugaccgaggagauccccagcugccagaagcuggagcuggaggagauggacguggaggccagacugaccgagcugugcgaggaggugaagaagaucgagaaccccgacgagcuggccgagcugaucaacaugaaccuggcccagcugugcagccugcugauggcccuguggggccaguuccuggaggugaucacccugcacgaggagcugagaauccugcuggcccaggagcaccacacccugagagugagaagauucagcgaggccuucuucugcuucgagcaccccagagaggccgccaucgccuaccaggagcugcacgcccagagccaccugcagaugugcaccgccaucaagaacaccagcuucugcagcagccugcccccccugcccaucgagugcagcgagcuggacggcgaccugaacagccugcccaucaucuucgaggacagauaccuggacagcgugaccgagggcaagcuggacaucagccaggacgacagcgagaucacccagauggagcacaaccuggccagcagaagaagcagcgacgacugccacgaccaccagaccacccccagccugggcgugagaaccaucgagaucaagcccagcaacaaggaccccuucagcggcgagaacaucaccgugaagcugggccccuggaccgagcugagacaggaggagauccugguggacaaccugcugcccaacuucgagagccuggagagcaacggcaagagcaagagcaucgagaucaccuucgagaaggaggcccugcaggaggccaagugccugagcaucggcgagagccugaccaagcugagaagcaaccugcccgcccccagcaccaaggaguaccacgugguggugagcggcgacaccaucaagcugcccgacaucagcgccaccuacgccagcagcagauucagcgacagcggcguggagagcgagcccagcagcuucgccacccaccccaacaccgaccugguguucgagaccgugcagggccagggccccugcaacagcgagagacuguucccccagcugcugaugaagcccgacuacaacgugaaguucagccugggcaaccacugcaccgagagcaccagcgccaucagcgagauccagagcagccugaccagcaucaacagccugcccagcgacgacgagcugagccccgacgagaacagcaagaagagcguggugcccgagugccaccugaacgacagcaagaccgugcugaaccugggcaccaccgaccugcccaagugcgacgacaccaagaagagcagcaucacccugcagcagcagagcgugguguucagcggcaaccuggacaacgagaccguggccauccacagccugaacagcagcaucaaggacccccugcaguucguguucagcgacgaggagaccagcagcgacgugaagagcagcugcagcagcaagcccaaccuggacaccaugugcaagggcuuccagagccccgacaagagcaacaacagcaccggcaccgccaucacccugaacagcaagcugaucugccugggcacccccugcgugaucagcggcagcaucagcagcaacaccgacgugagcgaggacagaaccaugaagaagaacagcgacgugcugaaccugacccagauguacagcgagauccccaccguggagagcgagacccaccugggcaccagcgaccccuucagcgccagcaccgacaucgugaagcagggccugguggagaacuacuucggcagccagagcagcaccgacaucagcgacaccugcgccgugagcuacagcaacgcccugagcccccagaaggagaccagcgagaaggagaucagcaaccugcagcaggagcaggacaaggaggacgaggaggaggagcaggaccagcagauggugcagaacggcuacuacgaggagaccgacuacagcgcccuggacggcaccaucaacgcccacuacaccagcagagacgagcugauggaggagagacugaccaagagcgagaagaucaacagcgacuaccugagagacggcaucaacaugcccaccgugugcaccagcggcugccugagcuuccccagcgcccccagagagagccccugcaacgugaaguacagcagcaagagcaaguucgacgccaucaccaagcagcccagcagcaccagcuacaacuucaccagcagcaucagcugguacgagagcagccccaagccccagauccaggccuuccugcaggccaaggaggagcugaagcugcugaagcugcccggcuucauguacagcgaggugccccugcuggccagcagcgugcccuacuucagcguggaggaggaggacggcagcgaggacggcgugcaccugaucgugugcgugcacggccuggacggcaacagcgccgaccugagacuggugaagaccuacaucgagcugggccugcccggcggcagaaucgacuuccugaugagcgagagaaaccagaacgacaccuucgccgacuucgacagcaugaccgacagacugcuggacgagaucauccaguacauccagaucuacagccugaccgugagcaagaucagcuucaucggccacagccugggcaaccugaucaucagaagcgugcugaccagacccagauucaaguacuaccugaacaagcugcacaccuuccugagccugagcggcccccaccugggcacccuguacaacagcagcgcccuggugaacaccggccugugguucaugcagaaguggaagaagagcggcagccugcugcagcugaccugcagagaccacagcgaccccagacagaccuuccuguacaagcugagcaacaaggccggccugcacuacuucaagaacguggugcuggugggcagccugcaggacagauacgugcccuaccacagcgccagaaucgagaugugcaagaccgcccugaaggacaagcagagcggccagaucuacagcgagaugauccacaaccugcugagacccgugcugcagagcaaggacugcaaccuggugagauacaacgugaucaacgcccugcccaacaccgccgacagccugaucggcagagccgcccacaucgccgugcuggacagcgagaucuuccuggagaaguucuuccugguggccgcccugaaguacuuccaguaa

SEQ ID NO: 16853 - RNA, 4221 nt, Artificial Sequence
  FAM135B__Homo_sapiens__NP_056996
augagcgagauccagggcaccguggaguucagcguggagcugcacaaguucuacaacguggaccuguuccagagaggcuacuaccagaucagagugacccugaaggugagcagcagaaucccccacagacugagcgccagcaucgccggccagaccgagagcagcagccugcacagcgccugcgugcacgacagcaccgugcacagcagaguguuccagauccuguacagaaacgaggaggugcccaucaacgacgccgugguguucagagugcaccugcugcugggcggcgagagaauggaggacgcccugagcgagguggacuuccagcugaagguggaccugcacuucaccgacagcgagcagcagcugagagacguggccggcgcccccauggugagcagcagaacccugggccugcacuuccaccccagaaacggccugcaccaccaggugcccgugauguucgacuacuuccaccugagcgugaucagcgugaccgugcacgccgcccugguggcccugcagcagccccugaucagcuucaccagacccggcagaggcagcuggcugggcaagggcggccccgacaccggccaggagcagagcaucaucagccuggagaaccugguguucggcgccggcuacugcaagcccaccagcagcgagggcagcuucuacaucaccagcgagaacugcaugcagcacgcccacaaguggcacagagaccugugccugcugcugcugcacgccuacagaggccugagacugcacuuccuggugaucaugagagacauccccgagcugccccacaccgagcuggaggcccuggccguggaggagacccugagccagcugugcagcgagcugcagaugcugaacaaccccgagaagaucgccgagcagaucagcaaggaccuggccuggcugaccagccacaugaugacccuguggacccaguuccuggacaccgugacccugcacagccaggugaccaccuaccugacccaggagcaccacacccugagagugagaagauucagcgaggccuucuucuacauggagcaccagaagcuggccgugcugaccuuccaggagaaccugauccagacccacagccagcugagccuggacaucagaaacagcgaguaccugaccagcaugcccccccugcccgccgagugccuggacaucgacggcgacuggaacacccugcccgugaucuucgaggacagauacguggacugccccgccaccggccacaaccugagcguguaccccaacuucgacgugcccgugaccagccccaccaucaugaaccugaaggacaaggaggacaacugcauggugaacagcaaccugagcuucagagaggaccuggugcugagcaccaucaagcccagccagauggacagcgacgaggaggugaucagaugccccgagcccggcgagaacguggccacccagaaccacauggacaugugcagcgagagccagguguacaucagcaucggcgaguuccagaacaaggccggcgugcccgaggacgagugcuggaccggccagaccagcgacgccggcaccuaccccguggccgacguggacaccagcagaagaagccccggccccgaggacggccaggcccccgugcugaccuacaucgacgugaagagcagcaacaagaaccccagcagagccgagccccugguggccuucaacgcccagcacgagagcagaagcagcagagacaaguacggccuggacagaaccggccugagcaaggugguggugggcggcagccaccagaacgccaucagcagcgacaagaccacccugcacgagcugagcacccugggcaagggcaucgaccaggagggcaagauggugcugcugagccugaagcugacccccagcgagcccugcgacccccugagcagcacccugagagagccccuggacaucagaagcagccugaaggacagccacaccgaggagcaggaggagcugagcgugcugagcggcgugaucaagagaagcagcagcaucaucagcgacagcggcaucgagagcgagcccagcagcguggccuggagcgaggccagaagcagagcccuggagcugcccagcgacagagaggugcugcaccccuucgugagaagacacgcccugcacagaaacagccuggagggcggccacaccgagagcaacaccagccugcccagcggcauccaggccagccugaccagcaucagcagccugcccuucgaggaggacgagagagagguggcccugaccaagcugaccaagagcgugagcgccccccacaucagcagccccgaggaggccgccgaggacgccgacaccaagcagcaggacggcggcuucgccgagcccagcgacaugcacagcaagagccagggcagccccggcagcugcagccagcugugcggcgacagcggcaccgacgccggcgccgaccacccccugguggagaucgugcuggacgccgacaaccagcagggccccggcuacaucgacauccccaagggcaagggcaagcaguucgacgcccagggccacugccugcccgacggcagaaccgagaacacccccggcguggagaccaagggccugaaccugaagauccccagagugaucgcccuggagaaccccagaaccagaagccugcacagagcccuggaggagacccccaagggcaugcccaaggaccugaacgugggccagcaggcccugagcaacagcggcaucagcgagguggagggccugagccagcaccaggugcccgagcugagcugcaccagcgccgccgacgccaucaacagaaacagcaccggccagcagagccagagcggcagccccugcaucauggacgacaccgccuucaacagaggcgugaacgccuuccccgaggccaagcacaaggccggcaccgugugccccaccgugacccacagcgugcacagccaggugcugaagaaccaggagcugaaggccggcaccagcaucaugggcagccaccugaccagcgccgagaccuucacccuggacagccugaaggccguggagguggugaaccugagcgugagcugcaccgccaccugccugcccuucagcagcgugcccaaggagacccccgccagagccggcuucagcagcaagcagacccuguuccccaucacccaccagccccugggcagcuucggcguggugagcacccacagcagcacccuggacgaggaggugagcgagagaauguucagcuucuaccaggccaaggagaaguucaagaaggagcugaagaucgagggcuuccuguacagcgaccugaccgugcuggccagcgacauccccuacuucccccccgaggaggaggaggagaaccuggaggacggcauccaccugguggugugcgugcacggccuggacggcaacagcgccgaccugagacuggugaagaccuucaucgagcugggccugcccggcggcaagcuggacuuccugaugagcgagaagaaccagauggacaccuucgccgacuucgacaccaugaccgacagacugcuggacgagaucauccagcacauccagcuguacaaccugagcaucagcagaaucagcuucaucggccacagccugggcaacaucaucaucagaagcgugcugaccagacccagauucagauacuaccugaacaagcugcacaccuuccugagccugagcggcccccaccugggcacccuguacaacaacagcacccuggugagcaccggccuguggcugaugcagaagcugaagaagagcggcagccugcugcagcugaccuucagagacaacgccgaccugagaaagugcuuccuguaccagcugagccagaagaccggccugcaguacuucaagaacguggugcugguggccagcccccaggacagauacgugcccuuccacagcgccagaaucgagaugugcaagaccgcccugaaggacagacacaccggccccguguacgccgagaugaucaacaaccugcugggcccccugguggaggccaaggacugcacccugaucagacacaacguguuccacgcccugcccaacaccgccaacacccugaucggcagagccgcccacaucgccgugcuggacagcgagcuguuccuggagaaguucuuccugguggccggccugaacuacuucaaguaa

SEQ ID NO: 16854 - RNA, 417 nt, Artificial Sequence
  FAM136A__Homo_sapiens__NP_116211
auggccgagcugcagcagcugagagugcaggaggccguggagagcauggugaagagccuggagagagagaacaucagaaagaugcagggccugauguucagaugcagcgccagcugcugcgaggacagccaggccagcaugaagcaggugcaccagugcaucgagagaugccacgugccccuggcccaggcccaggcccuggugaccagcgagcuggagaaguuccaggacagacuggccagaugcaccaugcacugcaacgacaaggccaaggacagcaucgacgccggcagcaaggagcugcaggugaagcagcagcuggacagcugcgugaccaagugcguggacgaccacaugcaccugauccccaccaugaccaagaagaugaaggaggcccugcugagcaucggcaaguaa

SEQ ID NO: 16855 - RNA, 2094 nt, Artificial Sequence
  FAM13A__Homo_sapiens__NP_001015045
auggccugcgagaucaugccccugcagagcagccaggaggacgagagaccccugagccccuucuaccugagcgcccacgugccccaggugagcaacgugagcgccaccggcgagcugcuggagagaaccaucagaagcgccguggagcagcaccuguucgacgugaacaacagcggcggccagagcagcgaggacagcgagagcggcacccugagcgccagcagcgccaccagcgccagacagagaagaagacagagcaaggagcaggacgaggugagacacggcagagacaagggccugaucaacaaggagaacacccccagcggcuucaaccaccuggacgacugcauccugaacacccaggagguggagaaggugcacaagaacaccuucggcugcgccggcgagagaagcaagcccaagagacagaagagcagcaccaagcugagcgagcugcacgacaaccaggacggccuggugaacauggagagccugaacagcaccagaagccacgagagaaccggccccgacgacuucgaguggaugagcgacgagagaaagggcaacgagaaggacggcggccacacccagcacuucgagagccccaccaugaagauccaggagcaccccagccugagcgacaccaagcagcagagaaaccaggacgccggcgaccaggaggagagcuucgugagcgaggugccccagagcgaccugaccgcccugugcgacgagaagaacugggaggagcccauccccgccuucagcagcuggcagagagagaacagcgacagcgacgaggcccaccugagcccccaggccggcagacugaucagacagcugcuggacgaggacagcgaccccaugcugagccccagauucuacgccuacggccagagcagacaguaccuggacgacaccgaggugccccccagcccccccaacagccacagcuucaugagaagaagaagcagcagccugggcagcuacgacgacgagcaggaggaccugacccccgcccagcugaccagaagaauccagagccugaagaagaagaucagaaaguucgaggacagauucgaggaggagaagaaguacagacccagccacagcgacaaggccgccaaccccgaggugcugaaguggaccaacgaccuggccaaguucagaagacagcugaaggagagcaagcugaagaucagcgaggaggaccugacccccagaaugagacagagaagcaacacccugcccaagagcuucggcagccagcuggagaaggaggacgagaagaagcaggagcugguggacaaggccaucaagcccagcguggaggccacccuggagagcauccagagaaagcugcaggagaagagagccgagagcagcagacccgaggacaucaaggacaugaccaaggaccagaucgccaacgagaagguggcccugcagaaggcccugcuguacuacgagagcauccacggcagacccgugaccaagaacgagagacaggugaugaagccccuguacgacagauacagacuggugaagcagauccugagcagagccaacaccauccccaucaucggcagccccagcagcaagagaagaagcccccugcugcagcccaucaucgagggcgagaccgccagcuucuucaaggagaucaaggaggaggaggagggcagcgaggacgacagcaacgugaagcccgacuucauggugacccugaagaccgacuucagcgccagaugcuuccuggaccaguucgaggacgacgccgacggcuucaucagccccauggacgacaagauccccagcaagugcagccaggacaccggccugagcaaccugcacgccgccagcauccccgagcugcuggagcaccugcaggagaugagagaggagaagaagagaaucagaaagaagcugagagacuucgaggacaacuucuucagacagaacggcagaaacgugcagaaggaggacagaacccccauggccgaggaguacagcgaguacaagcacaucaaggccaagcugagacugcuggaggugcugaucagcaagagagacaccgacagcaagagcauguaa

SEQ ID NO: 16856 - RNA, 1464 nt, Artificial Sequence
  FAM13C__Homo_sapiens__NP_001001971
auguucagcugcuucugcuucagccugcaggacaacagcuucagcagcaccaccgugaccgagugcgacgaggaccccgugagccugcacgaggaccagaccgacugcagcagccugagagacgagaacaacaaggagaacuaccccgacgccggcgcccugguggaggagcacgccccccccagcugggagccccagcagcagaacguggaggccaccgugcugguggacagcgugcugagacccagcaugggcaacuucaagagcagaaagcccaagagcaucuucaaggccgagagcggcagaagccacggcgagagccaggagaccgagcacguggugagcagccagagcgagugccaggugagagccggcacccccgcccacgagagcccccagaacaacgccuucaagugccaggagaccgugagacugcagcccagaaucgaccagagaaccgccaucagccccaaggacgccuucgagaccagacaggaccugaacgaggaggaggccgcccaggugcacggcgugaaggaccccgcccccgccagcacccagagcgugcuggccgacggcaccgacagcgccgaccccagccccgugcacaaggacggccagaacgaggccgacagcgcccccgaggaccugcacagcgugggcaccagcagacugcuguaccacaucaccgacggcgacaacccccugcugagccccagaugcagcaucuucagccagagccagagauucaaccuggaccccgagagcgcccccagcccccccagcacccagcaguucaugaugcccagaagcagcagcagaugcagcugcggcgacggcaaggagccccagaccaucacccagcugaccaagcacauccagagccugaagagaaagaucagaaaguucgaggagaaguucgagcaggagaagaaguacagagugaccaagcaggacaagaaccugaucaagccccuguacgacagauacagaaucaucaagcagauccugagcacccccagccugauccccaccauccaggaggaggaggacagcgacgaggacagaccccagggcagccagcagcccagccuggccgaccccgccagccaccugcccgugggcgaccaccugaccuacagcaacgagaccgagcccgugagagcccugcugcccgacgagaagaaggaggugaagccccccgcccugagcaugagcaaccugcacgaggccaccaugcccgugcugcuggaccaccugagagagaccagagccgacaagaagagacugagaaaggcccugagagaguucgaggagcaguucuucaagcagaccggcagaagcccccagaaggaggacagaauccccauggccgacgaguacuacgaguacaagcacaucaaggccaagcugagacugcuggaggugcugaucagcaagcaggacguggccaagaccaucuaa

SEQ ID NO: 16857 - RNA, 1449 nt, Artificial Sequence
  FAM149A__Homo_sapiens__NP_056213
augcuguucgagggcaaggugaacccccagacccagagccugcuggccgagugcggcgaguggaccagaagaagccugcaccugagagugcugggcagacagcugauccugcccaccgacaagggcgugcagcacuuccagggcagcacccccgccagcgccgugcacagacccccccugagcgccugcggccacagcagcaacaucagagagcugugcaucagcggcagccagaucgugcccgccgcccugagcgccagcgcccugcccggccccgacgacaccggcguggccgaccugaccgccagaagcagccuggaggaggagguguaccacguggacggcaagaucgaggaguacuucgccuucgacagaaaggaggacgacgacgagugccuggagcagaagcccgcccagcccggcagaaaguggagaaagcugggccugccccccgugagccccagagacugcgugaaggacgccguggccgccgagguguucgaccacguguggaccaacaugguggagcugcuggaggagcugaucagaaagcacugggagaccacccugaccgagggcaagaagcagagagagacccugaagguggccggcaacagauucccccacgugcuggugccccacgcccacgccgacggcgccagcggcccccccagcggccacgccgaggcccacggcaucagccuggccagcagacugaaccccccccagauccaccacuucagcagcagcuucuacagcgacaugaacggcgugaugaccauccaggccaagccccugcagagaagacccgccuacuucgccgacagaacccagaacgagaaggaggacaaggccagcggcggcggcgccggcgcccugagcagcgccccccacagacugggcagagccagcgacacccacggccugagccccagcgccaagaagacccccgugcccuggagacugcccagccuggccagcgacagccagagacugaagacccccaacaucuacagcgacgaggugcugagaggcaccaagcugcccaccggcguggaccacauggccagcccccuggugcagaccagcagaagcagauuccccccccuggugaccgagaccagaggccagaacaccgccgugcccggcugcagacuggugagcuacagaggcagacaccugcagaacagagugcugagcgccaugcccgacggcaccgagagaagcagacugagagagagaaccgccacccuggagagacugagcagacccagcaccacccacaccuucagacagagcgacacccccagaaagagcagccugacccagauggaguucgccgcccacaccuggaccggccagagcauccugaccggcagccaguacgugcccaagagcuuccagagaaccacccugaccuucaagagaagauuccaggugaccagcuaa

SEQ ID NO: 16858 - RNA, 459 nt, Artificial Sequence
  FAM150B__Homo_sapiens__NP_001002919
augagaggccccggccacccccugcugcugggccugcugcuggugcugggcgccgccggcagaggcagaggcggcgccgagcccagagagcccgccgacggccaggcccugcugagacuggugguggagcuggugcaggagcugagaaagcaccacagcgccgagcacaagggccugcagcugcugggcagagacugcgcccugggcagagccgaggccgccggccugggccccagccccgagcagagaguggagaucgugcccagagaccugagaaugaaggacaaguuccugaagcaccugaccggcccccuguacuucagccccaagugcagcaagcacuuccacagacuguaccacaacaccagagacugcaccauccccgccuacuacaagagaugcgccagacugcugaccagacuggccgugagccccgugugcauggaggacaagcaguaa

SEQ ID NO: 16859 - RNA, 1377 nt, Artificial Sequence
  FAM155A__Homo_sapiens__NP_001073865
augaccagaggcgccuggaugugcagacaguacgacgacggccugaagaucuggcuggccgcccccagagagaacgagaagcccuucaucgacagcgagagagcccagaaguggagacugagccuggccagccugcuguucuucaccgugcugcugagcgaccaccugugguucugcgccgaggccaagcugaccagagccagagacaaggagcaccagcagcagcagagacagcagcagcagcagcagcagcagcagagacagagacagcagcagcagcagcagagaagacagcaggagcccagcuggcccgcccugcuggccagcaugggcgagagcagccccgccgcccaggcccacagacugcugagcgccagcagcagccccacccugccccccagccccggcgacggcggcggcggcggcggcaagggcaacagaggcaaggacgacagaggcaaggcccuguuccugggcaacagcgccaagcccguguggagacuggagaccugcuacccccagggcgccagcagcggccagugcuucaccguggagaacgccgacgccgugugcgccagaaacuggagcagaggcgccgccggcggcgacggccaggaggugagaagcaagcaccccaccccccuguggaaccugagcgacuucuaccugagcuucugcaacagcuacacccugugggagcuguucagcggccugagcagccccaacacccugaacugcagccuggacguggugcugaaggagggcggcgagaugaccaccugcagacagugcguggaggccuaccaggacuacgaccaccacgcccaggagaaguacgaggaguucgagagcgugcugcacaaguaccugcagagcgaggaguacagcgugaagagcugccccgaggacugcaagaucguguacaaggccuggcugugcagccaguacuucgaggugacccaguucaacugcagaaagaccauccccugcaagcaguacugccuggaggugcagaccagaugccccuucauccugcccgacaacgacgaggugaucuacggcggccugagcagcuucaucugcaccggccuguacgagaccuuccugaccaacgacgagcccgagugcugcgacgugagaagagaggagaagagcaacaaccccagcaagggcaccguggagaagagcggcagcugccacagaaccagccugaccgugagcagcgccaccagacugugcaacagcagacugaagcugugcgugcuggugcugauccugcugcacaccgugcugaccgccagcgccgcccagaacaccgccggccugagcuucggcggcaucaacacccuggaggagaacagcaccaacgaggaguaa

SEQ ID NO: 16860 - RNA, 2217 nt, Artificial Sequence
  FAM160B1__Homo_sapiens__NP_001128523
auguucagcaaguucaccagcauccugcagcacgccguggaggcccuggcccccagccugccccugcaggaggacuucguguaccacuggaaggccaucacccacuacuacaucgagaccagcgacgacaaggcccccgugaccgacaccaacauccccagccaccuggagcagaugcuggacauccuggugcaggaggagaacgagagagagagcggcgagaccggccccugcauggaguaccugcugcaccacaagauccuggagacccuguacacccugggcaaggccgacugcccccccggcaugaagcagcaggugcugguguucuacaccaagcugcugggcagaaucagacagccccugcugccccacaucaacgugcacagacccgugcagaagcugaucagacugugcggcgaggugcuggccacccccaccgagaacgaggagauccaguuccugugcaucgugugcgccaagcugaagcaggaccccuaccuggugaacuucuuccuggagaacaagaugaagagccuggccagcaagggcgugcccaacgugaucagcgaggacacccugaagggccaggacagccugagcaccgacaccggccagagcagacagcccgaggagcugagcggcgccaccggcauggagcagaccgagcuggaggacgagcccccccaccagauggaccaccugagcaccagccuggacaaccugagcgugaccagccugcccgaggccagcguggugugccccaaccaggacuacaaccuggugaacagccugcugaaccugaccagaagccccgacggcagaaucgccgugaaggccugcgagggccugaugcugcuggugagccugcccgagcccgccgccgccaagugccugacccagagcaccugccugugcgagcugcugaccgacagacuggccagccuguacaaggcccugccccagagcguggacccccuggacaucgagaccguggaggccaucaacuggggccuggacagcuacagccacaaggaggacgccagcgccuuccccggcaagagagcccugaucagcuuccugagcugguucgacuacugcgaccagcugaucaaggaggcccagaagaccgccgccguggcccuggccaaggccgugcacgagagauucuucaucggcgugauggagccccagcugaugcagaccagcgagaugggcauccugaccagcaccgcccugcugcacagaaucgugagacaggugaccagcgacgugcugcugcaggagaugguguucuucauccugggcgagcagagagagcccgagacccuggccgagaucagcagacacccccugagacacagacugaucgagcacugcgaccacaucagcgacgagaucagcaucaugacccugagaauguucgagcaccugcugcagaagcccaacgagcacauccuguacaaccuggugcugagaaaccuggaggagagaaacuacaccgaguacaagccccugugccccgaggacaaggacgugguggagaacggccugaucgccggcgccguggaccuggaggaggacccccuguucaccgacaucagccccgagaacacccugcccaaccaggaguggcugagcagcagcccccccgccacccccgaccaccccaagaacgacggcaagaccgaggugcacaagaucgugaacagcuuccugugccuggugcccgacgacgccaagagcagcuaccacguggagggcaccggcuacgacaccuaccugagagacgcccacagacaguucagagacuacugcgccaucugccugagaugggaguggcccggcagccccaaggcccuggagaagugcaaccuggaggccgccuucuucgagggccacuuccugaaggugcuguucgacagaaugggcagaauccuggaccagcccuacgacgugaaccugcaggugaccagcgugcugagcagacugagccuguucccccacccccacauccacgaguaccugcuggaccccuacgugaaccuggcccccggcugcagaagccuguucagcgugaucgugagaguggugggcgaccugaugcugagaauccagagaauccaggacuucacccccaagcugcugcuggugagaaagagacugcugggccuggagcccgagggccccaugcagacccugcccagcuggugguaa

SEQ ID NO: 16861 - RNA, 2151 nt, Artificial Sequence
  FAM161A__Homo_sapiens__NP_001188472
auggccaccagccacagaguggccaagcugguggccagcagccugcagacccccgugaaccccaucaccggcgccagaguggcccaguacgagagagaggacccccugaaggcccuggccgccgccgaggccauccuggaggacgaggaggaggagaagguggcccagcccgccggcgccagcgccgaccugaacaccagcuucagcggcguggacgagcacgcccccaucagcuacgaggacuucgugaacuuccccgacauccaccacagcaacgaggaguacuucaagaagguggaggagcugaaggccgcccacaucgagaccauggccaagcuggagaagauguaccaggacaagcugcaccugaaggaggugcagcccguggugaucagagaggacagccugagcgacagcagcagaagcgugagcgagaagaacagcuaccaccccgugagccugaugaccagcuucagcgagcccgaccugggccagagcagcagccuguacgugagcagcagcgaggaggagcugcccaaccuggagaaggaguaccccagaaagaacagaaugaugaccuacgccaaggagcugaucaacaacauguggaccgacuucugcguggaggacuacaucagaugcaaggacaccggcuuccacgccgccgagaagagaagaaagaagagaaaggagugggugcccaccaucaccgugcccgagcccuuccagaugaugaucagagagcagaagaagaaggaggagagcaugaagagcaagagcgacaucgagauggugcacaaggcccugaagaagcaggaggaggaccccgaguacaagaagaaguucagagccaaccccgugcccgccagcguguuccugccccuguaccacgaccuggugaagcagaaggaggagagaagaagaagccugaaggagaagagcaaggaggcccugcuggccagccagaagcccuucaaguucaucgccagagaggagcagaagagagccgccagagagaagcagcugagagacuuccugaaguacaagaagaagaccaacagauucaaggccagacccauccccagaagcaccuacggcagcaccaccaacgacaagcugaaggaggaggagcuguacagaaaccugagaacccagcugagagcccaggagcaccugcagaacagcagcccccugcccugcagaagcgccugcggcugcagaaaccccagaugccccgagcaggccgugaagcugaagugcaagcacaaggugagaugccccacccccgacuucgaggaccugcccgagagauaccagaagcaccugagcgagcacaagagccccaagcugcugaccgugugcaagcccuucgaccugcacgccagcccccacgccagcaucaagagagagaagauccuggccgacaucgaggccgacgaggagaaccugaaggagaccagauggcccuaccugagccccagaagaaagagccccgugagaugcgccggcgugaaccccgugcccugcaacugcaacccccccgugcccaccgugagcagcagaggcagagagcaggccgugagaagaagccuggaggagaagaagaugcuggaggaggagagaaacagaauccugaccaagcagaagcagagaaugaaggagcugcagaagcugcugaccaccagagccaaggccuacgacagccaccagagccuggcccagaucagcaagagcagagugaagugccugagaaagagcgagaaggagagaaugagagaguaccagagagagcuggaggagagagaggagaagcugaagaagagaccccugcuguucgagagaguggcccagaagaacgccagaauggccgccgagaagcacuacagcaacacccugaaggcccugggcaucagcgacgaguucgugagcaagaagggccagagcggcaaggugcuggaguacuucaacaaccaggagaccaagagcgugaccgaggacaaggagagcuucaacgaggaggagaagaucgaggagagagagaacggcgaggagaacuacuucaucgacaccaacagccaggacagcuacaaggagaaggacgaggccaacgaggagagcgaggaggagaagagcguggaggagagccacuaa

SEQ ID NO: 16862 - RNA, 504 nt, Artificial Sequence
  FAM163A__Homo_sapiens__NP_775780
augaccgccggcaccguggugaucaccggcggcauccuggccaccgugauccugcugugcaucaucgccgugcugugcuacugcagacugcaguacuacugcugcaagaagagcggcaccgagguggccgacgaggaggaggagagagagcacgaccugcccacccaccccagaggccccaccugcaacgccugcagcagccaggcccuggacggcagaggcagccuggccccccugaccagcgagcccugcagccagcccugcggcguggccgccagccacugcaccaccugcagccccuacagcagccccuucuacaucagaaccgccgacauggugcccaacggcggcggcggcgagagacugagcuucgcccccaccuacuacaaggagggcggcccccccagccugaagcuggccgccccccagagcuaccccgugaccuggcccggcagcggcagagaggccuucaccaaccccagagccaucagcaccgacguguaa

SEQ ID NO: 16863 - RNA, 501 nt, Artificial Sequence
  FAM163B__Homo_sapiens__NP_001073984
augaccgccggcaccguggugaucaccggcggcauccuggccaccgugauccugcugugcaucaucgccgugcugugcuacugcagacugcaguacuacugcugcaagaaggacgagagcgaggaggacgaggaggagcccgacuucgccgugcacagccaccugcccccccugcacagcaacagaaaccuggugcugaccaacggccccgcccuguaccccaccgccagcaccagcuucagccagaagagcccccaggccagagcccugugcagaagcugcagccacugcgagccccccaccuucuuccugcaggagccccccgaggaggaggaggacgugcugaacggcggcgagagagugcuguacaagagcgugagccaggaggacguggagcugccccccggcggcuucggcggccugcaggcccugaaccccaacagacugagcgccaugagagaggccuucgccagaagcagaagcaucagcaccgacguguaa

SEQ ID NO: 16864 - RNA, 645 nt, Artificial Sequence
  FAM167A__Homo_sapiens__NP_444509
augagcgugccccagauccacguggaggaggugggcgccgaggagggcgccggcgccgccgccccccccgacgaccaccugagaagccugaaggcccugaccgagaagcugagacuggagaccagaagacccagcuaccuggaguggcaggccagacuggaggagcacaccuggcccuuccccagacccgccgccgagccccaggccagccuggaggagggcgagagaggcggccaggagccccugcugccccugagagaggccggccagcacccccccagcgccagaagcgccagccagggcgccagaccccugagcaccggcaagcuggagggcuuccagagcaucgacgaggccaucgccuggcugagaaaggagcugaccgagaugagacugcaggaccagcagcuggccagacagcugaugagacugagaggcgacaucaacaagcugaagaucgagcacaccugcagacugcacagaagaaugcugaacgacgccaccuacgagcuggaggagagagacgagcuggccgaccuguucugcgacagcccccuggccagcagcuucagccugagcaccccccugaagcugaucggcgugaccaagaugaacaucaacagcagaagauucagccugugcuaa

SEQ ID NO: 16865 - RNA, 735 nt, Artificial Sequence
  FAM168A__Homo_sapiens__NP_001272979
augaaccccguguacagccccgugcagcccggcgcccccuacggcaaccccaagaacauggccuacaccggcuaccccaccgccuaccccgccgccgcccccgccuacaaccccagccuguaccccaccaacagccccagcuacgcccccgaguuccaguuccugcacagcgccuacgccacccugcugaugaagcaggccuggccccagaacagcagcagcugcggcaccgagggcaccuuccaccugcccguggacaccggcaccgagaacagaaccuaccaggccagcagcgccgccuucagauacaccgccggcacccccuacaaggugccccccacccagagcaacaccgcccccccccccuacagccccagccccaaccccuaccagaccgccauguaccccaucagaagcgccuacccccagcagaaccuguacgcccagggcgccuacuacacccagcccguguacgccgcccagccccacgugauccaccacaccaccguggugcagcccaacagcauccccagcgccaucuaccccgcccccguggccgcccccagaaccaacggcguggccaugggcaugguggccggcaccaccauggccaugagcgccggcacccugcugaccaccccccagcacaccgccaucggcgcccaccccgugagcaugcccaccuacagagcccagggcacccccgccuacagcuacgugcccccccacugguaa

SEQ ID NO: 16866 - RNA, 588 nt, Artificial Sequence
  FAM168B__Homo_sapiens__NP_001009993
augaaccccguguacagccccggcagcagcggcgugcccuacgccaacgccaagggcaucggcuaccccgccggcuuccccaugggcuacgccgccgccgcccccgccuacagccccaacauguaccccggcgccaaccccaccuuccagaccggcuacacccccggcacccccuacaaggugagcugcagccccaccagcggcgccgugccccccuacagcagcagccccaaccccuaccagaccgccguguaccccgugagaagcgccuacccccagcagagccccuacgcccagcagggcaccuacuacacccagccccuguacgccgcccccccccacgugauccaccacaccaccguggugcagcccaacggcaugcccgccaccguguaccccgcccccauccccccccccagaggcaacggcgugaccaugggcaugguggccggcaccaccauggccaugagcgccggcacccugcugaccgcccacagccccacccccguggccccccaccccgugaccgugcccaccuacagagcccccggcacccccaccuacagcuacgugcccccccagugguaa

SEQ ID NO: 16867 - RNA, 579 nt, Artificial Sequence
  FAM169B__Homo_sapiens__NP_872368
augaaggugcagagcuucggcgagagaguggugcuguucauccugaacgccaucaucuucggcagacuggagagaaaccuggacgacgacgacauguucuuccugccccacagcgugaaggagcaggccaagauccuguggagaagaggcgccgccgugggcuucuacaccaccaagaugaagggcagacugugcggcgacggcaccggcgccugcuaccugcugcccguguucgacaccguguucaucagaagaaagcacuggcacagaggccugggcaccgccaugcugagagacuucugcgagaccuuccccgaggacgaggcccugggcgugagcugcagcaugagccccgccauguaccaggcccaccccggcaacagcgaggacgugagcagacacgccagaaccagccagaacgacagacccagacagcccgcccccggcgacggcagcaaggagagaaugugcggcgaggagcuggaggacaccaaggacgaccccgagugcggcguggaggaggaggacgccggccuggccggccagccccccggcaagcugaccagaagcagccccuaa

SEQ ID NO: 16868 - RNA, 849 nt, Artificial Sequence
  FAM170A__Homo_sapiens__NP_001157463
augaagagaagacagaagagaaagcaccuggagaacgaggagagccaggagaccgccgagaagggcggcggcauccagagaauccacagagacagcccccagccccagagcccccuggcccaggugcaggagagaggcgagaccccccccagaagccagcacgugagccugagcagcuacagcagcuacaagaccugcgugagcagccugugcgugaacaaggaggagagaggcaugaagaucuacuacaugcaggugcagaugaacaagggcguggccgugagcugggagaccgaggagacccuggagagccuggagaagcagcccagaauggaggaggugacccugagcgagguggugagagugggcaccccccccagcgacgugagcaccagaaaccugcugagcgacagcgagcccagcggcgaggagaaggagcacgaggagagaaccgagagcgacagccugcccggcagccccaccguggaggacacccccagagccaagacccccgacuggcuggugaccauggagaacggcuucagaugcauggccugcugcagaguguucaccaccauggaggcccugcaggagcacgugcaguucggcaucagagagggcuucagcugccacguguuccaccugaccauggcccagcugaccggcaacauggagagcgagagcacccaggacgagcaggaggaggagaacggcaacgagaaggaggaggaggagaagcccgaggccaaggaggaggagggccagcccaccgaggaggaccugggccugagaagaagcuggagccagugccccggcugcguguuccacagccccaaggacagaaacuaa

SEQ ID NO: 16869 - RNA, 1113 nt, Artificial Sequence
  FAM172A__Homo_sapiens__NP_001156889
augaagaaggacgagcccccccuggacuuccccgacacccuggagggcuucgaguacgccuucaacgagaagggccagcugagacacaucaagaccggcgagcccuucguguucaacuacagagaggaccugcacagauggaaccagaagagauacgaggcccugggcgagaucaucaccaaguacguguacgagcugcuggagaaggacugcaaccugaagaaggugagcauccccguggacgccaccgagagcgagcccaagagcuucaucuucaugagcgaggacgcccugaccaacccccagaagcugauggugcugauccacggcagcggcguggugagagccggccagugggccagaagacugaucaucaacgaggaccuggacagcggcacccagauccccuucaucaagagagccguggccgagggcuacggcgugaucgugcugaaccccaacgagaacuacaucgagguggagaagcccaagauccacgugcagagcagcagcgacagcagcgacgagcccgccgagaagagagagagaaaggacaaggugagcaaggagaccaagaagagaagagacuucuacgagaaguacagaaacccccagagagagaaggagaugaugcagcuguacaucagagagaacggcagccccgaggagcacgccaucuacgugugggaccacuucaucgcccaggccgccgccgagaacguguucuucguggcccacagcuacggcggccuggccuucguggagcugaugauccagagagaggccgacgugaagaacaaggugaccgccguggcccugaccgacagcgugcacaacguguggcaccaggaggccggcaagaccaucagagaguggaugagagagaacugcugcaacugggugagcagcagcgagccccuggacaccagcguggagagcaugcugcccgacugccccagagugagcgccggcaccgacagacacgagcugaccagcuggaagagcuuccccagcaucuucaaguucuucaccgaggccagcgaggccaagaccagcagccugaagcccgccgugaccagaagaagccacagaaucaagcacgaggagcuguaa

SEQ ID NO: 16870 - RNA, 702 nt, Artificial Sequence
  FAM173B__Homo_sapiens__NP_954584
auggagggcggcggcggcaucccccuggagacccugaaggaggagagccagagcagacacgugcugcccgccagcuucgaggugaacagccugcagaagagcaacuggggcuuccugcugaccggccuggugggcggcacccugguggccguguacgccguggccacccccuucgugacccccgcccugagaaaggugugccugcccuucgugcccgccaccaccaagcagaucgagaacguggugaagaugcugagaugcagaagaggcagccugguggacaucggcagcggcgacggcagaaucgugaucgccgccgccaagaagggcuucaccgccgugggcuacgagcugaaccccuggcuggugugguacagcagauacagagccuggagagagggcgugcacggcagcgccaaguucuacaucagcgaccuguggaaggugaccuucagccaguacagcaacguggugaucuucggcgugccccagaugaugcugcagcuggagaagaagcuggagagagagcuggaggacgacgccagagugaucgccugcagauuccccuucccccacuggacccccgaccacgugaccggcgagggcaucgacaccgugugggccuacgacgccagcaccuucagaggcagagagaagagacccugcaccagcaugcacuuccagcugcccauccaggccuaa

SEQ ID NO: 16871 - RNA, 573 nt, Artificial Sequence
  FAM174A__Homo_sapiens__NP_940909
augaaggccagccagugcugcugcugccugagccaccugcuggccagcgugcugcugcugcugcugcugcccgagcugagcggcccccuggccgugcugcugcaggccgccgaggccgcccccggccugggcccccccgaccccagacccagaacccugcccccccugccccccggccccacccccgcccagcagcccggcagaggccuggccgaggccgccggccccagaggcagcgagggcggcaacggcagcaaccccguggccggccuggagaccgacgaccacggcggcaaggccggcgagggcagcgugggcggcggccuggccgugagccccaaccccggcgacaagcccaugacccagagagcccugaccgugcugaugguggugagcggcgccgugcugguguacuucguggugagaaccgugagaaugagaagaagaaacagaaagaccagaagauacggcgugcuggacaccaacaucgagaacauggagcugaccccccuggagcaggacgacgaggacgacgacaacacccuguucgacgccaaccaccccagaagauaa

SEQ ID NO: 16872 - RNA, 1230 nt, Artificial Sequence
  FAM175A__Homo_sapiens__NP_620775
auggagggcgagagcaccagcgccgugcugagcggcuucgugcugggcgcccuggccuuccagcaccugaacaccgacagcgacaccgagggcuuccugcugggcgaggugaagggcgaggccaagaacagcaucaccgacagccagauggacgacguggaggugguguacaccaucgacauccagaaguacauccccugcuaccagcuguucagcuucuacaacagcagcggcgaggugaacgagcaggcccugaagaagauccugagcaacgugaagaagaacguggugggcugguacaaguucagaagacacagcgaccagaucaugaccuucagagagagacugcugcacaagaaccugcaggagcacuucagcaaccaggaccugguguuccugcugcugacccccagcaucaucaccgagagcugcagcacccacagacuggagcacagccuguacaagccccagaagggccuguuccacagagugccccuggugguggccaaccugggcaugagcgagcagcugggcuacaagaccgugagcggcagcugcaugagcaccggcuucagcagagccgugcagacccacagcagcaaguucuucgaggaggacggcagccugaaggaggugcacaagaucaacgagauguacgccagccugcaggaggagcugaagagcaucugcaagaagguggaggacagcgagcaggccguggacaagcuggugaaggacgugaacagacugaagagagagaucgagaagagaagaggcgcccagauccaggccgccagagagaagaacauccagaaggacccccaggagaacaucuuccugugccaggcccugagaaccuucuuccccaacagcgaguuccugcacagcugcgugaugagccugaagaacagacacgugagcaagagcagcugcaacuacaaccaccaccuggacgugguggacaaccugacccugaugguggagcacaccgacauccccgaggccagccccgccagcaccccccagaucaucaagcacaaggcccuggaccuggacgacagauggcaguucaagagaagcagacugcuggacacccaggacaagagaagcaaggccgacaccggcagcagcaaccaggacaaggccagcaagaugagcagccccgagaccgacgaggagaucgagaagaugaagggcuucggcgaguacagcagaagccccaccuucuaa

SEQ ID NO: 16873 - RNA, 1248 nt, Artificial Sequence
  FAM175B__Homo_sapiens__NP_115558
auggccgccagcaucagcggcuacaccuucagcgccgugugcuuccacagcgccaacagcaacgccgaccacgagggcuuccugcugggcgaggugagacaggaggagaccuucagcaucagcgacagccagaucagcaacaccgaguuccugcaggugaucgagauccacaaccaccagcccugcagcaagcuguucagcuucuacgacuacgccagcaaggugaacgaggagagccuggacagaauccugaaggacagaagaaagaaggugaucggcugguacagauucagaagaaacacccagcagcagaugagcuacagagagcaggugcugcacaagcagcugaccagaauccugggcgugcccgaccugguguuccugcuguucagcuucaucagcaccgccaacaacagcacccacgcccuggaguacgugcuguucagacccaacagaagauacaaccagagaaucagccuggccauccccaaccugggcaacaccagccagcaggaguacaaggugagcagcgugcccaacaccagccagagcuacgccaaggugaucaaggagcacggcaccgacuucuucgacaaggacggcgugaugaaggacaucagagccaucuaccagguguacaacgcccugcaggagaaggugcaggccgugugcgccgacguggagaagagcgagagagugguggagagcugccaggccgaggugaacaagcugagaagacagaucacccagagaaagaacgagaaggagcaggagagaagacugcagcaggccgugcugagcagacagaugcccagcgagagccuggaccccgccuucagccccagaaugcccagcagcggcuucgccgccgagggcagaagcacccugggcgacgccgaggccagcgacccccccccccccuacagcgacuuccaccccaacaaccaggagagcacccugagccacagcagaauggagagaagcguguucaugcccagaccccaggccgugggcagcagcaacuacgccagcaccagcgccggccugaaguaccccggcagcggcgccgaccugccccccccccagagagccgccggcgacagcggcgaggacagcgacgacagcgacuacgagaaccugaucgaccccaccgagcccagcaacagcgaguacagccacagcaaggacagcagacccauggcccaccccgacgaggaccccagaaacacccagaccagccagaucuaa

SEQ ID NO: 16874 - RNA, 642 nt, Artificial Sequence
  FAM177A1__Homo_sapiens__NP_001072987
auggaccaggagcccgugggcggcguggagagaggcgaggccguggccgccagcggcgccgccgccgccgccgccuucggcgagagcgccggccagaugagcaacgagagaggcuucgagaacguggagcugggcgugaucggcaagaagaagaaggugcccagaagagugauccacuucgugagcggcgagaccauggaggaguacagcaccgacgaggacgagguggacggccuggagaagaaggacgugcugcccaccguggaccccaccaagcugaccuggggccccuaccugugguucuacaugcugagagccgccaccagcacccugagcgugugcgacuuccugggcgagaagaucgccagcgugcugggcaucagcacccccaaguaccaguacgccaucgacgaguacuacagaaugaagaaggaggaggaggaggaggaggaggagaacagaaugagcgaggaggccgagaagcaguaccagcagaacaagcugcagaccgacagcaucgugcagaccgaccagcccgagaccgugaucagcagcagcuucgugaacgugaacuucgagauggagggcgacagcgaggugaucauggagagcaagcagaaccccgugagcgugccccccuaa

SEQ ID NO: 16875 - RNA, 477 nt, Artificial Sequence
  FAM177B__Homo_sapiens__NP_997351
auggagaucgacggcuuccagcagcuggaccuggagaagagcgugcccagcaagaagaccacccccaagagaaucauccacuucguggacggcgacaucauggaggaguacagcaccgaggaggaggaggaggaggagaaggaggagcagagcaccaacagcacccuggaccccagcaagcugagcuggggccccuaccugagauucugggccggcagaaucgccagcaccagcuucagcaccugcgaguuccugggcggcagauucgccguguucuucggccugacccagcccaaguaccaguacgugcugaacgaguucuacagaauccagaacaagaagagcgacaacaagagcgagagaagaggcagcaaggcccaggccgccgaggugcccaacgagaagugccaccuggaggccggcgugcaggaguacggcaccauccagcaggacgugaccgaggccaucccccaguaa

SEQ ID NO: 16876 - RNA, 3561 nt, Artificial Sequence
  FAM178A__Homo_sapiens__NP_001129595
augaccagaagaugcaugcccgccagacccggcuuccccagcagccccgcccccggcagcagcccccccagaugccaccugagacccggcagcaccgcccacgccgccgccggcaagagaaccgagagccccggcgacagaaagcagagcaucaucgacuucuucaagcccgccagcaagcaggacagacacaugcuggacagcccccagaagagcaacaucaaguacggcggcagcagacugagcaucaccggcaccgagcaguucgagagaaagcugagcagccccaaggagagcaagcccaagagagugccccccgagaagagccccaucaucgaggccuucaugaagggcgugaaggagcaccacgaggaccacggcauccacgagagcagaagacccugccugagccuggccagcaaguaccuggccaagggcaccaacaucuacgugcccagcagcuaccaccugcccaaggagaugaagagccugaagaagaagcacagaagccccgagagaagaaagagccuguucauccacgagaacaacgagaagaacgacagagacagaggcaagaccaacgccgacagcaagaagcagaccaccguggccgaggccgacaucuucaacaacagcagcagaagccugagcagcagaagcagccugagcagacaccaccccgaggagagcccccugggcgccaaguuccagcugagccuggccagcuacugcagagagagagagcugaagagacugagaaaggagcagauggagcagagaaucaacagcgagaacagcuucagcgaggccagcagccugagccugaagagcagcaucgagagaaaguacaagcccagacaggagcagagaaagcagaacgacaucauccccggcaagaacaaccugagcaacguggagaacggccaccugagcagaaagagaagcagcagcgacagcugggagcccaccagcgccggcagcaagcagaacaaguuccccgagaagagaaagagaaacagcguggacagcgaccugaagagcaccagagagagcaugauccccaaggccagagagagcuuccuggagaagagacccgacggcccccaccagaaggagaaguucaucaagcacaucgcccugaagacccccggcgacgugcugagacuggaggacaucagcaaggagcccagcgacgagaccgacggcagcagcgccggccuggcccccagcaacagcggcaacagcggccaccacagcaccagaaacagcgaccagauccagguggccggcaccaaggagaccaagaugcagaagccccaccugccccugagccaggagaagagcgccaucaagaaggccagcaaccugcagaagaacaagaccgccagcagcaccaccaaggagaaggagaccaagcugccccugcugagcagagugcccagcgccggcagcagccuggugccccugaacgccaagaacugcgcccugcccgugagcaagaaggacaaggagagaagcagcagcaaggagugcagcggccacagcaccgagagcaccaagcacaaggagcacaaggccaagaccaacaaggccgacagcaacgugagcagcggcaagaucagcggcggcccccugagaagcgaguacggcacccccaccaagagcccccccgccgcccuggagguggugcccugcauccccagccccgccgcccccagcgacaaggcccccagcgagggcgagagcagcggcaacagcaacgccggcagcagcgcccugaagagaaagcugagaggcgacuucgacagcgacgaggagagccugggcuacaaccuggacagcgacgaggaggaggagacccugaagagccuggaggagaucauggcccugaacuucaaccagacccccgccgccaccggcaagccccccgcccugagcaagggccugagaagccagagcagcgacuacaccggccacgugcaccccggcaccuacaccaacacccuggagagacuggugaaggagauggaggacacccagagacuggacgagcugcagaagcagcugcaggaggacaucagacagggcagaggcaucaagagccccaucagaaucggcgaggaggacagcaccgacgacgaggacggccugcuggaggagcacaaggaguuccugaagaaguucagcgugaccaucgacgccauccccgaccaccaccccggcgaggagaucuucaacuuccugaacagcggcaagaucuucaaccaguacacccuggaccugagagacagcggcuucaucggccagagcgccguggagaagcugauccugaagagcggcaagaccgaccagaucuuccugaccacccagggcuuccugaccagcgccuaccacuacgugcagugccccgugcccgugcugaaguggcuguucagaaugaugagcgugcacaccgacugcaucgugagcgugcagauccugagcacccugauggagaucaccaucagaaacgacaccuucagcgacagccccguguggcccuggauccccagccugagcgacguggccgccguguucuucaacaugggcaucgacuucagaagccuguucccccuggagaaccugcagcccgacuucaacgaggacuaccuggugagcgagacccagaccaccagcagaggcaaggagagcgaggacagcagcuacaagcccaucuucagcacccugcccgagaccaacauccugaacguggugaaguuccugggccugugcaccagcauccaccccgagggcuaccaggacagagagaucaugcugcugauccugaugcuguucaagaugagccuggagaagcagcugaagcagaucccccugguggacuuccagagccugcugaucaaccugaugaagaacaucagagacuggaacaccaaggugcccgagcugugccugggcaucaacgagcugagcagccacccccacaaccugcuguggcuggugcagcuggugcccaacuggaccagcagaggcagacagcugagacagugccugagccuggugaucaucagcaagcugcuggacgagaagcacgaggacgugcccaacgccagcaaccugcaggugagcgugcugcacagauaccuggugcagaugaagcccagcgaccugcugaagaagauggugcugaagaagaaggccgagcagcccgacggcaucaucgacgacagccugcaccuggagcuggagaagcaggccuacuaccugaccuacauccugcugcaccuggugggcgaggugagcugcagccacagcuucagcagcggccagagaaagcacuucgugcugcugugcggcgcccuggagaagcacgugaagugcgacaucagagaggacgccagacuguucuacagaaccaaggugaaggaccugguggccagaauccacggcaaguggcaggagaucauccagaacugcagacccacccaggugagcuucugcuacaccaucagcugcauccugaacagcuucgccgaguggcacagcagcuacugccugaaguaa

SEQ ID NO: 16877 - RNA, 2040 nt, Artificial Sequence
  FAM178B__Homo_sapiens__NP_001116118
auguggcccagacugcccggcgccggccuggccccccagcugagaagacaggaccagagacugcacuucaccggccagaugagccacggccugcagauggccggcccccaggagaccgugcuggcccugccccugagagagggcgugcaggccgccgccaccgugcccauccugcuguacaaccuggaggacggccugagcgaccacccccuggaccagggccccagaugccccgccagaagacccugcagccccgccagcgcccccgcccccaccagccccaagaagcccaagauccaggcccccggcgagaccuuccccaccgacuggagccccccccccguggaguuccugaaccccagagugcugcaggccagcagagaggcccccgcccagagaugggugggcguggugggcccccagggccugagaagacuggccggcgagcugcccgaggagcuggagcaggagcaccuggaccuggaccccaagagaggccuggcccugcccgagaagcuguucuggaacaccagcggccugagccagcaggccgccgcccccgaguucagcuggggcggcagcggcagcuacuucaacaaccuggacuaccugcugcaggagaagagagagcaggcccuggagcaggagagagagagacugcugcugcaggagugccugaaccugaacagccuggaccuggacgaggaggaggugccccugacccccgagcacagaaugcugguggagaaguacagcgugagccugcagaccaucccccccgugcaccccggcgagaccguguuccugcccagaugccacccccugcccugcauccuggacagcagccugcugaagcccagaagccaccuggagggccuguuccugagcagcccccccgcccagcagcugagcuuccugagaagcggccugcugaacauccuguaccugcacaugcccgacugccccgugagccugcugcaguggcuguuccagcugcugaccuggccccccgagaccagccugggcgccuucggccugcugugggaccugaucguggacggcaucuuccugcagcccgacgaggacaagcaccuguggugccccagccugcaggaggugagagaggccuuccacagccugggcgcccacagccccgcccuguacccccugggccccuucuggcacggcggcagagugcugcccggcgaggccggccugaacgagaacgaggagcaggacgccccccaggagaucgcccuggacaucagccugggccacaucuacaaguuccuggcccugugcgcccaggcccagcccggcgccuacaccgacgagaaccugaugggccugaucgagcugcugugcagaaccagccuggacgugggccugagacugcugcccaagguggaccugcagcagcugcugcugcugcugcuggagaacaucagagaguggcccggcaagcugcaggagcugugcugcacccugagcugggugagcgaccaccaccacaaccugcuggcccuggugcaguucuuccccgacaugaccagcagaagcagaagacugagaagccagcugagccugguggugaucgccagaaugcugggccagcaggagaugcugccccuguggcaggagaagacccagcugagcagccugagcagacugcugggccugaugagacccagcagccugagacaguaccuggacagcgugccccugccccccugccaggagcagcagcccaaggccagcgccgagcuggaccacaaggccugcuaccugugccacagccugcugaugcuggccggcgugguggugagcugccaggacaucacccccgaccaguggggcgagcugcagcugcugugcaugcagcuggacagacacaucagcacccagaucagagagagcccccaggccaugcacagaaccaugcugaaggaccuggccacccagaccuacaucagauggcaggagcugcugacccacugccagccccaggcccaguacuucagccccuggaaggacaucuaa

SEQ ID NO: 16878 - RNA, 5163 nt, Artificial Sequence
  FAM179B__Homo_sapiens__NP_055906
auggccgccgcccccagcgcccugcugcugcugccccccuuccccgugcugagcaccuacagacugcagagcagaagcagacccagcgcccccgagaccgacgacagcagagugggcggcaucaugagaggcgagaagaacuacuacuucagaggcgccgccggcgaccacggcagcugccccaccaccaccagcccccuggccagcgcccugcugaugcccagcgaggccgugagcagcagcuggagcgagagcggcggcggccugagcggcggcgacgaggaggacaccagacugcugcagcugcugagaaccgccagagaccccagcgaggccuuccaggcccugcaggccgcccugcccagaagaggcggcagacugggcuuccccagaagaaaggaggcccuguacagagcccugggcagagugcugguggagggcggcagcgacgagaagagacugugccugcagcugcugagcgacgugcugagaggccagggcgaggccggccagcuggaggaggccuucagccuggcccugcugccccagcugguggugagccugagagaggagaaccccgcccugagaaaggacgcccugcagauccugcacaucugccugaagagaagccccggcgaggugcugagaacccugauccagcagggccuggagagcaccgacgccagacugagagccagcaccgcccugcugcugcccauccugcugaccaccgaggaccugcugcugggccuggaccugaccgaggugaucaucagccuggccagaaagcugggcgaccaggagaccgaggaggagagcgagaccgccuucagcgcccugcagcagaucggcgagagacugggccaggacagauuccagagcuacaucagcagacugcccagcgcccugagaagacacuacaacagaagacuggagagccaguucggcagccaggugcccuacuaccuggagcuggaggccagcggcuuccccgaggacccccugcccugcgccgugacccugagcaacagcaaccugaaguucggcaucaucccccaggagcugcacagcagacugcuggaccaggaggacuacaagaacagaacccaggccguggaggagcugaagcaggugcugggcaaguucaaccccagcagcaccccccacagcagccuggugggcuucaucagccugcuguacaaccugcuggacgacagcaacuucaagguggugcacggcacccuggaggugcugcaccugcuggugaucagacugggcgagcaggugcagcaguuccugggccccgugaucgccgccagcgugaaggugcuggccgacaacaagcuggugaucaagcaggaguacaugaagaucuuccugaagcugaugaaggaggugggcccccagcaggugcugugccugcugcuggagcaccugaagcacaagcacagcagagugagagaggagguggugaacaucugcaucugcagccugcugaccuaccccagcgaggacuucgaccugcccaagcugagcuucgaccuggcccccgcccugguggacagcaagagaagagugagacaggccgcccuggaggccuucgccgugcuggccagcagcaugggcagcggcaagaccagcauccuguucaaggccguggacaccguggagcugcaggacaacggcgacggcgugaugaacgccgugcaggccagacuggccagaaagacccugcccagacugaccgagcagggcuucguggaguacgccgugcugaugcccagcagcgccggcggcagaagcaaccaccuggcccacggcgccgacaccgacuggcugcuggccggcaacagaacccagagcgcccacugccacugcggcgaccacgugagagacagcaugcacaucuacggcagcuacagccccaccaucugcaccagaagagugcugagcgccggcaagggcaagaacaagcugcccugggagaacgagcagcccggcaucaugggcgagaaccagaccagcaccagcaaggacaucgagcaguucagcaccuacgacuucauccccagcgccaagcugaagcugagccagggcaugcccgugaacgacgaccugugcuucagcagaaagagagugagcagaaaccuguuccagaacagcagagacuucaaccccgacugccugccccugugcgccgccggcaccaccggcacccaccagaccaaccugagcggcaagugcgcccagcugggcuucagccagaucugcggcaagaccggcagcgugggcagcgaccugcaguuccugggcaccaccagcagccaccaggagaagguguacgccagccugaacuucggcagcaagacccagcagaccuucggcagccagaccgagugcaccagcagcaacggccagaaccccagccccggcgccuacauccugcccagcuaccccgugagcagccccagaaccagccccaagcacaccagcccccugaucaucagccccaagaagagccaggacaacagcgugaacuucagcaacagcuggccccugaagagcuucgagggccugagcaagcccagcccccagaagaagcuggugagccagaagagcagcgaccccaccggcagaaaccacggcgagaacagccaggagaagccccccgugcagcugacccccgcccuggugagaagccccagcagcagaagaggccugaacggcaccaagcccgugccccccauccccagaggcaucagccugcugcccgacaaggccgaccugagcaccgugggccacaagaagaaggagcccgacgacaucuggaagugcgagaaggacagccugcccaucgaccugagcgagcugaacuucaaggacaaggaccuggaccaggaggagaugcacagcagccugagaagccugagaaacagcgccgccaagaagagagccaagcugagcggcagcaccagcgaccuggagagccccgacagcgccaugaagcuggaccugaccauggacagccccagccugagcagcagccccaacaucaacagcuacagcgagagcggcguguacagccaggagagccugaccagcagccugagcaccaccccccagggcaagagaaucaugagcgacaucuuccccaccuucggcagcaagcccugccccaccagacugagcagcgccaagaagaagaucagccacaucgccgagcagagccccagcgccggcagcagcagcaacccccagcagaucagcagcuucgacuucaccaccaccaaggcccugagcgaggacagcguggugguggugggcaagggcguguucggcagccugagcagcgcccccgccaccugcagccagagcgugaucagcagcguggagaacggcgacaccuucagcaucaagcagagcaucgagccccccagcggcaucuacggcagaagcgugcagcagaacaucagcagcuaccuggacguggagaacgagaaggacgccaaggugagcaucagcaagagcaccuacaacaagaugagacagaagagaaaggaggagaaggagcuguuccacaacaaggacugcgagaagaaggagaagaacagcugggagagaaugagacacaccggcaccgagaagauggccagcgagagcgagacccccaccggcgccaucagccaguacaaggagagaaugcccagcgugacccacagccccgagaucauggaccugagcgagcugagacccuucagcaagcccgagaucgcccugaccgaggcccugagacugcuggccgacgaggacugggagaagaagaucgagggccugaacuucaucagaugccuggccgccuuccacagcgagauccugaacaccaagcugcacgagaccaacuucgccguggugcaggaggugaagaaccugagaagcggcgugagcagagccgccguggugugccugagcgaccuguucaccuaccugaagaagagcauggaccaggagcuggacaccaccgugaaggugcugcugcacaaggccggcgagagcaacaccuucaucagagaggacguggacaaggcccugagagccauggugaacaacgugacccccgccagagccguggugagccugaucaacggcggccagagauacuacggcagaaagaugcuguucuucaugaugugccaccccaacuucgagaagaugcuggagaaguacgugcccagcaaggaccugcccuacaucaaggacagcgugagaaaccugcagcagaagggccugggcgagaucccccuggacacccccagcgccaagggcagaagaagccacaccggcagcgugggcaacaccagaagcagcagcgugagcagagacgccuucaacagcgccgagagagccgugaccgaggugagagaggugaccagaaagagcgugcccagaaacagccuggagagcgccgaguaccugaagcugaucaccggccugcugaacgccaaggacuucagagacagaaucaacggcaucaagcagcugcugagcgacaccgagaacaaccaggaccugguggugggcaacaucgugaagaucuucgacgccuucaagagcagacugcacgacagcaacagcaaggugaaccugguggcccuggagaccaugcacaagaugaucccccugcugagagaccaccugagccccaucaucaacaugcugauccccgccaucguggacaacaaccugaacagcaagaaccccggcaucuacgccgccgccaccaacguggugcaggcccugagccagcacguggacaacuaccugcugcugcagcccuucugcaccaaggcccaguuccugaacggcaaggccaagcaggacaugaccgagaagcuggccgacaucgugaccgagcuguaccagagaaagccccacgccaccgagcagaaggugcugguggugcuguggcaccugcugggcaacaugaccaacagcggcagccugcccggcgccggcggcaacaucagaaccgccaccgccaagcugagcaaggcccuguucgcccagaugggccagaaccugcugaaccaggccgccagccagcccccccacaucaagaagagccuggaggagcugcuggacaugaccauccugaacgagcuguaa

SEQ ID NO: 16879 - RNA, 522 nt, Artificial Sequence
  FAM180A__Homo_sapiens__NP_995327
augcacuggaagaugcugcugcugcugcugcuguacuacaacgccgaggccagcaugugccacagauggagcagagccgugcuguuccccgccgcccacagacccaagagaagcagcagccugccccugaaccccgugcugcagaccagccuggaggagguggagcugcuguacgaguuccugcuggccgagcuggagaucagccccgaccugcagaucagcaucaaggacgaggagcuggccagccugagaaaggccagcgacuucagaaccgugugcaacaacgugauccccaagagcauccccgacaucagaagacugagcgccagccugagcagccaccccggcauccugaagaaggaggacuucgagagaaccgugcugacccuggccuacaccgccuacagaaccgcccugagccacggccaccagaaggacaucugggcccagagccuggugagccuguuccaggcccugagacacgaccugaugagaagcagccagcccggcgugccccccuaa

SEQ ID NO: 16880 - RNA, 2916 nt, Artificial Sequence
  FAM184A__Homo_sapiens__NP_001093881
augaagcagcaggcccugaccgaguucgaggccuacaagcacagaguggaggacaugcagcugugcgccgaggcccagcacgugcagagaaucgugaccaugagcagagagguggaggagaucagaagaaaguucgaggagaagcugagaagcuucggccagcugcaggugcaguucgagaaggacaagagacuggcccuggaggaccugcaggccgcccacagaagagagauccaggagcugcugaagagccagcaggaccacagcgccagcgugaacaagggccaggagaaggccgaggagcugcacagaauggagguggagagccugaacaagaugcuggaggagcugagacuggagagaaagaagcugaucgaggacuacgagggcaagcugaacaaggcccagagcuucuacgagagagagcuggacacccugaagagaagccagcuguucaccgccgagagccugcaggccagcaaggagaaggaggccgaccugagaaaggaguuccagggccaggaggccauccugagaaagaccaucggcaagcugaagaccgagcugcagauggugcaggacgaggccggcagccugcuggacaagugccagaagcugcagaccgcccuggccaucgccgagaacaacgugcaggugcugcagaagcagcuggacgacgccaaggagggcgagauggcccugcugagcaagcacaaggagguggagagcgagcuggccgccgccagagagagacugcagcagcaggccagcgaccuggugcugaaggccagccacaucggcaugcugcaggccacccagaugacccaggaggugaccaucaaggaccuggagagcgagaagagcagagugaacgagagacugagccagcuggaggaggagagagccuuccugagaagcaagacccagagccuggacgaggagcagaagcagcagauccuggagcuggagaagaaggugaacgaggccaagagaacccagcaggaguacuacgagagagagcugaagaaccugcagagcagacuggaggaggaggugacccagcugaacgaggcccacagcaagacccuggaggagcuggccuggaagcaccacauggccaucgaggccgugcacagcaacgccaucagagacaagaagaagcugcagauggaccuggaggagcagcacaacaaggacaagcugaaccuggaggaggacaagaaccagcugcagcaggagcuggagaaccugaaggaggugcuggaggacaagcugaacaccgccaaccaggagaucggccaccugcaggacauggugagaaagagcgagcagggccugggcagcgccgagggccugaucgccagccugcaggacagccaggagagacugcagaacgagcuggaccugaccaaggacagccugaaggagaccaaggacgcccugcugaacguggagggcgagcuggagcaggagagacagcagcacgaggagaccaucgccgccaugaaggaggaggagaagcugaagguggacaagauggcccacgaccuggagaucaaguggaccgagaaccugagacaggagugcagcaagcugagagaggagcugagacugcagcacgaggaggacaagaagagcgccaugagccagcugcugcagcugaaggacagagagaagaacgccgccagagacagcuggcagaagaagguggaggaccugcugaaccagaucagccugcugaagcagaaccuggagauccagcugagccagagccagaccagccugcagcagcugcaggcccaguucacccaggagagacagagacugacccaggagcuggaggagcuggaggagcagcaccagcagagacacaagagccugaaggaggcccacgugcuggccuuccagaccauggaggaggagaaggagaaggagcagagagcccuggagaaccaccugcagcagaagcacagcgccgagcugcagagccugaaggacgcccacagagagagcauggagggcuucagaaucgagauggagcaggagcugcagacccugagauucgagcuggaggacgagggcaaggccaugcuggccagccugagaagcgagcugaaccaccagcacgccgccgccaucgaccugcugagacacaaccaccaccaggagcuggccgccgccaagauggagcuggagagaagcaucgacaucagcagaagacagagcaaggagcacaucugcagaaucaccgaccugcaggaggagcugagacacagagagcaccacaucagcgagcuggacaaggaggugcagcaccugcacgagaacaucagcgcccugaccaaggagcuggaguucaagggcaaggagauccugagaaucagaagcgagagcaaccagcagaucagacuggaggagauggaggagaaguaccugaugagagagagcaagcccgaggacauccagaugaucaccgagcugaaggccaugcugaccgagagagaccagaucaucaagaagcugaucgaggacaacaaguucuaccagcuggagcuggugaacagagagaccaacuucaacaagguguucaacagcagccccaccgugggcgugaucaacccccuggccaagcagaagaagaagaacgacaagagccccaccaacagauucgugagcgugcccaaccugagcgcccuggagagcggcggcgugggcaacggccaccccaacagacuggaccccauccccaacagccccgugcacgacaucgaguucaacagcagcaagccccugccccagcccgugccccccaagggccccaagaccuuccugagccccgcccagagcgaggccagccccguggccagccccgacccccagagacaggagugguucgccagauacuucaccuucuaa

SEQ ID NO: 16881 - RNA, 3183 nt, Artificial Sequence
  FAM184B__Homo_sapiens__NP_056503
auggccagcgcccugaacagcaagaucaacccccccggcaccugccagggcagcaaggccgacggcggcgccggcuggagaauggacugcgacccccagaugcacgugaagaugugcaagaagaucgcccagcugaccaaggugaucuacgcccugaacaccagacaggacgaggccgaggccagcauggaggcccugagagaggcccaccaggaggagcugcagaacgccguggccgagaccaaggccagacugcugcaggagcagggcugcgccgaggaggaggcccugcugcagagaauccaggcccuggagagcgcccuggagcugcagaagagacugaccgaggaggcccuggccgagagcgccagcugcagacuggagaccaaggagagagagcugagaguggaggccgagcacgccgagagagugcugacccugagcagagagaugcuggagcugaaggccgacuacgagagaagacugcagcaccugaccagccacgaggccaccccccagggcagacugccccaggagagccccgagaccaagagcgagcccggccagggccccgagaugcaggaggugcugcuggaggugcagagacugagaguggagaaccagcagcugagcaaggacuacgccagaaaggccgaggagcugcaggccaccuacgagagagagaacgaggccaucagacaggccaugcagcagagcgugagccaggcccuguggcaguggcaggagaaggagagcgaccugagaaagaacuuccaggugcaggagagcgcccugcaggcccaggugagaaagcuggagggcgaccuggagcacagaggcagaaagaucagcgaccugaagaaguacgcccagaagcugaaggagagaauccaggaccuggacgugcagcugaaggaggccagacaggagaacagcgagcugaagggcaccgccaagaagcugggcgagaagcuggccguggccaaggacagaaugaugcugcaggagugcagaggcacccagcagaccgacgccaugaagaccgagcuggugagcgagaacaaggugcugagagaggagaacgaccuggaggccggcaaccugcacccccagcaggaccagagcugccugaaggagugccccugcaugaagggcggcaccgacaugcagaccaagaaggaggccagcgccgagaccgaguacaugaagcagcaguacgaggaggaccugagaaagaucaagcaccagaccgaggaggagaagaagcaccugaaggaccagcuggugaagagacuggaggaccuggugaagaagcacaccguggagaucaagagcgugagaagcagcguggaggccgagagaaagaagcugcagagagagguggaggcccagcuggaggaggugagaaagaagagcgagaaggagaucaagcagcuggaggaggagaaggccgcccugaacgugaagcugcagaacagccugcuggaggugcugagacuggaggaguucauccagcagaacaagaccagacccaccggcgccgaggagagcccccaggagcugggcagacagcacugcagcauccuggagacccaggaccccugccugaagcuggacgagaccagccccagaggcgaggaguaccaggacaagcuggccgccgaggagggcaccagcagcgacgaggaggagagaaccaaggugcugcugaaggagggcagcgacccccagcccccccugggcagccugcugaaggagaagaccagcaagauccagagacuggaggaggacuggcagagccagaaggccaagcugcaggcccaggugagccagaugcagcaggcccuggagcagugcaccagcaacuacagagaggaccugcaggcccugaagcagcugagcgaccuggagagagagaagcugcagagagagcugcaggagaccacccagcagaaccacgccaugaaggcccagcuggaggccagccaccagagagcccugagaaugcuggagaaggccagacaccaggagcugaaggccaccgaggagagacugaagaaggagagcagccacagccugcagauccagcaccagacccacagacuggagcugcaggcccuggaggagaaggccagacaggagcugcaggaggagagagagagaaugcaggcccagcaggcccugcugcuggagagccugagacaggagcugagcgagcagcaggccgccugcagcggccaccagaaggaccuggaggcccugcaggccgagcugagagcccugggcagacagcaggccagcagccagugccccggcgacagcaaggaccacaucaucgccaccgaggagagaggcggccccggccaggccggcagcccccccggcgccgccggccagggcagcggcgagggcugcggccugugggaggagaacgcccagcugcaggacgccgugagaagacugagagccgagguggagcagcaccagcaggaggcccagaagcugagagaccagagaagauuccuggaggagacccagcaggcccagagagccagagagguggagacccugagacaggagcacagaaaggagaugcaggccaugguggccgacuucagcagcgcccaggcccagcugcaggccagacuggccgcccuggaggccgagcugaaggacagcggcgagaagcccggcaagggcgccagcagacccgaggaccugcagcugaucggcagacugcagaccagacugaaggagagagaggacaucaucaagcagcugaccgaggagagaagauuccacuacgccgccuuccccagcgccaugagccacagaaacagaagcuucagcuucaacccccaccccggcuaccugacccccagcaugaagaagaagaagguggaggacgugcccagcagaguggugagcgugcccaaccuggccagcuacgccaagaacuuccugagcggcgaccugagcagcagaaucaacgccccccccaucaccaccagccccagccuggaccccagccccagcugcggcagaaccuacaagcccaaccagagcaccgacgccaagaccgccaccagaacccccgacggcgagaccgcccaggccaaggaggugcagcagaagcagggcagcccccaccaggagugguucaccaaguacuucagcuucuaa

SEQ ID NO: 16882 - RNA, 1110 nt, Artificial Sequence
  FAM187B__Homo_sapiens__NP_689694
augccccccaugcuguggcugcugcugcacuucgccgcccccgcccugggcuucuacuucagcaucagcugccccagcggcaagcagugccagcaggcccugcugagcggcaacgacauccugcuguacugcaacagcagcggcgcccacugguacuaccuguucacccagggcaagaagggcagacugaccagccugaccaacaucagcaacauggagaucaugcccgagggcagccugcugaucaaggacccccugcccagccagaccggccuguaccacugcuggaacaagaacggcagacagguggugcaguacgagaucgacuuccaggacgugaccacccugcacaucacccacaaggaccugggccagagaccccugcagaacgagacccugcaccugggcagcaagcagcugaucuucaccuggugggagcccuggcaggacugcaacagaugcgaggagcccggcgagugcaagagacugggcuacagauacaucgaggagccccuggaggaggccaugcccugcuggcuguaccugggcgaggugcugguguggagcagcagacugagacccgagcugcagguggaggccugccacgugcagugcaccaacaacacccagcugagaguggacuacgugaucuucgacaacuucagacuggacgagaagaccgaguucguguggcuggacugcccccugggcagcauguacagacccgugaacuggagagccaacgacaccccccugaccugggagagccagcugagcggccaggacuucaccaccuuccuggaccccagcaccggcggcagacagcugcagguguuccagcccgccguguacaagugcuucgugcagcaggagcugguggcccaguucaagcccgccgccagccuggagacccuggaggcccaguggagagagaacgacgcccaguggagagaggccagaaaggcccugagaggcagagccgacagcgugcugaagggccugaagcuggugcugcugguggugaccgugcuggcccugcugggcgcccugcugaagugcauccaccccagccccggcagaagaagcacccaggugcugguggugaaguaa

SEQ ID NO: 16883 - RNA, 1338 nt, Artificial Sequence
  FAM188A__Homo_sapiens__NP_079224
augagcgagcugaccaaggagcugauggagcugguguggggcaccaagagcagccccggccugagcgacaccaucuucugcagauggacccagggcuucguguucagcgagagcgagggcagcgcccuggagcaguucgagggcggccccugcgccgugaucgcccccgugcaggccuuccugcugaagaagcugcuguucagcagcgagaagagcagcuggagagacugcagcgaggaggagcagaaggagcugcugugccacacccugugcgacauccuggagagcgccugcugcgaccacagcggcagcuacugccuggugagcuggcugagaggcaagaccaccgaggagaccgccagcaucagcggcagccccgccgagagcagcugccagguggagcacagcagcgcccuggccguggaggagcugggcuucgagagauuccacgcccugauccagaagagaagcuucagaagccugcccgagcugaaggacgccgugcuggaccaguacagcauguggggcaacaaguucggcgugcugcuguuccuguacagcgugcugcugaccaagggcaucgagaacaucaagaacgagaucgaggacgccagcgagccccugaucgaccccguguacggccacggcagccagagccugaucaaccugcugcugaccggccacgccgugagcaacgugugggacggcgacagagagugcagcggcaugaagcugcugggcauccacgagcaggccgccgugggcuuccugacccugauggaggcccugagauacugcaaggugggcagcuaccugaagagccccaaguuccccaucuggaucgugggcagcgagacccaccugaccguguucuucgccaaggacauggcccugguggcccccgaggcccccagcgagcaggccagaagaguguuccagaccuacgaccccgaggacaacggcuucauccccgacagccugcuggaggacgugaugaaggcccuggaccuggugagcgaccccgaguacaucaaccugaugaagaacaagcuggaccccgagggccugggcaucauccugcugggccccuuccugcaggaguucuuccccgaccagggcagcagcggccccgagagcuucaccguguaccacuacaacggccugaagcagagcaacuacaacgagaaggugauguacguggagggcaccgccguggugaugggcuucgaggaccccaugcugcagaccgacgacacccccaucaagagaugccugcagaccaaguggcccuacaucgagcugcuguggaccaccgacagaagccccagccugaacuaa

SEQ ID NO: 16884 - RNA, 2274 nt, Artificial Sequence
  FAM188B__Homo_sapiens__NP_115598
auggacagccuguucguggaggagguggccgccagccuggugagagaguuccugagcagaaagggccugaagaagaccugcgugaccauggaccaggagagacccagaagcgaccugagcaucaacaacagaaacgaccugagaaaggugcugcaccuggaguuccuguacaaggagaacaaggccaaggagaacccccugaagaccagccuggagcugaucaccagauacuuccuggaccacuucggcaacaccgccaacaacuucacccaggacacccccauccccgcccugagcgugcccaagaagaacaacaaggugcccagcagaugcagcgagaccacccuggugaacaucuacgaccugagcgacgaggacgccggcuggagaaccagccugagcgagaccagcaaggccagacacgacaaccuggacggcgacgugcugggcaacuucgugagcagcaagagacccccccacaagagcaagcccaugcagaccgugcccggcgagacccccgugcugaccagcgccugggagaagaucgacaagcugcacagcgagcccagccuggacgugaagagaaugggcgagaacagcagacccaagagcggccugaucgugagaggcaugaugagcggccccaucgccagcagcccccaggacagcuuccacagacacuaccugagaagaagcagccccagcagcagcagcacccagccccaggaggagagcagaaaggugcccgagcuguucgugugcacccagcaggacauccuggccagcagcaacagcagccccagcagaaccagccugggccagcugagcgagcugaccguggagagacagaagaccaccgccagcagccccccccaccugcccagcaagagacugccccccugggacagagccagacccagagaccccagcgaggacacccccgccguggacggcagcaccgacaccgacagaaugccccugaagcuguaccugcccggcggcaacagcagaaugacccaggagagacuggagagagccuucaagagacagggcagccagcccgcccccgugagaaagaaccagcugcugcccagcgacaagguggacggcgagcugggcgcccugagacuggaggacguggaggacgagcugaucagagaggaggugauccugagccccgugcccagcgugcugaagcugcagaccgccagcaagcccaucgaccugagcguggccaaggagaucaagacccugcuguucggcagcagcuucugcugcuucaacgaggaguggaagcugcagagcuucagcuucagcaacaccgccagccugaaguacggcaucgugcagaacaagggcggccccugcggcgugcuggccgccgugcagggcugcgugcugcagaagcugcuguucgagggcgacagcaaggccgacugcgcccagggccugcagcccagcgacgcccacagaaccagaugccuggugcuggcccuggccgacaucguguggagagccggcggcagagagagagccgugguggcccuggccagcagaacccagcaguucagccccaccggcaaguacaaggccgacggcgugcuggagacccugacccugcacagccugaccugcuacgaggaccuggugaccuuccugcagcagagcauccaccaguucgaggugggccccuacggcugcauccugcugacccugagcgccauccugagcagaagcaccgagcugaucagacaggacuucgacgugcccaccagccaccugaucggcgcccacggcuacugcacccaggagcuggugaaccugcugcugaccggcaaggccgugagcaacguguucaacgacgugguggagcuggacagcggcgacggcaacaucacccugcugagaggcaucgccgccagaagcgacaucggcuuccugagccuguucgagcacuacaacaugugccaggugggcugcuuccugaagacccccagauuccccaucuggguggugugcagcgagagccacuucagcauccuguucagccugcagcccggccugcugagagacuggagaaccgagagacuguucgaccuguacuacuacgacggccuggccaaccagcaggagcagaucagacugaccaucgacaccacccagaccaucagcgaggacaccgacaacgaccuggugcccccccuggagcugugcaucagaaccaaguggaagggcgccagcgugaacuggaacggcagcgaccccauccuguaa

SEQ ID NO: 16885 - RNA, 1953 nt, Artificial Sequence
  FAM189B__Homo_sapiens__NP_001254537
augaugcccagccccagcgacagcagcagaagccugaccagcagacccagcaccagaggccugacccaccugagacugcacagacccuggcugcaggcccugcugacccugggccuggugcaggugcugcugggcauccugguggugaccuucagcaugguggccagcagcgugaccaccaccgagagcaucaagagaagcugccccagcugggccggcuucagcaucagcuucuucagccugcugagcgugcugugcgugaugcugagcauggccggcagcgugcugagcugcaagaacgcccagcuggccagagacuuccagcagugcagccuggagggcaaggugugcgugugcugccccagcgugccccugcugagacccugccccgagagcggccaggagcugaagguggcccccaacagcaccugcgacgaggccagaggcgcccugaagaaccugcuguucagcgugugcggccugaccaucugcgccgccaucaucugcacccugagcgccaucgugugcugcauccagaucuucagccuggaccuggugcacacccagcuggcccccgagagaagcgugagcggcccccugggcccccugggcugcaccagccccccccccgccccccugcugcacaccaugcuggaccuggaggaguucgugccccccgugccccccccccccuacuacccccccgaguacaccugcagcagcgagaccgacgcccagagcaucaccuacaacggcagcauggacagccccgugccccuguaccccaccgacugcccccccagcuacgaggccgugaugggccugagaggcgacagccaggccacccuguucgacccccagcugcacgacggcagcugcaucugcgagagaguggccagcaucguggacgugagcauggacagcggcagccuggugcugagcgccaucggcgaccugcccggcggcagcagccccagcgaggacagcugccugcuggagcugcagggcagcgugagaagcguggacuacgugcuguucagaagcauccagagaagcagagccggcuacugccugagccuggacugcggccugagaggccccuucgaggagagcccccugcccagaagaccccccagagccgccagaagcuacagcugcagcgcccccgaggccccccccccccugggcgcccccaccgccgccagaagcugccacagacuggagggcuggccccccugggugggccccugcuuccccgagcugagaagaagagugcccagaggcggcggcagacccgccgccgccccccccaccagagcccccaccagaagauucagcgacagcagcggcagccugaccccccccggccacagacccccccaccccgccagcccccccccccugcugcugcccagaagccacagcgaccccggcaucaccaccagcagcgacaccgccgacuucagagaccuguacaccaaggugcuggaggaggaggccgccagcgugagcagcgccgacaccggccugugcagcgaggccugccuguucagacuggccagaugccccagccccaagcugcugagagccagaagcgccgagaagagaagacccgugcccaccuuccagaaggugccccugcccagcggccccgcccccgcccacagccugggcgaccugaagggcagcuggcccggcagaggccuggugaccagauuccugcagaucagcagaaaggcccccgaccccagcggcaccggcgcccacggccacaagcaggugcccagaagccuguggggcagacccggcagagagagccugcaccugagaagcugcggcgaccugagcagcagcagcagccugagaagacugcugagcggcagaagacuggagagaggcaccagaccccacagccugagccugaacggcggcagcagagagaccggccuguaa

SEQ ID NO: 16886 - RNA, 2469 nt, Artificial Sequence
  FAM193B__Homo_sapiens__NP_001177875
augaccagaagaagaagcagacccagcggcggcgccggcagaagagagagagccagagccgccggcccccagaagccccaggcccccgagcccccccccccccccagccuggaggccggcgccggcgccggcccccccgaggcccccgccgagcccgaccacgacggccccagagaggacgacgagcccaaccuggugcccggcccccaggugccccccgccagcagccagcccgugcagaccugcugccugcugugccacagagagagaaagggcugggaggagggccccagccagaacggccuggugcugcagggcgagaagcugccccccgacuucaugcccaagcuggugaagaaccugcugggcgagaugccccugugggugugccagagcugcagaaagagcauggaggaggacgagagacagaccggcagagagcacgccguggccaucagccugagccacaccagcugcaagagccagagcugcggcgacgacagccacagcagcagcagcagcagcagcagcagcagcagcagcagcagcagcagcugccccggcaacagcggcgacugggaccccagcagcuuccugagcgcccacaagcugagcggccuguggaacagcccccacagcagcggcgccaugcccggcagcagccugggcagcccccccaccauccccggcgaggccuuccccgugagcgagcaccaccagcacagcgaccugaccgccccccccaacagccccaccggccaccacccccagcccgccagccugauccccagccaccccagcagcuucggcagccccccccacccccaccugcugcccaccacccccgccgcccccuuccccgcccaggccagcgagugccccguggccgccgccaccgccccccacacccccggccccugccagagcagccaccugcccagcaccagcaugccccugcugaagaugcccccccccuucagcggcugcagccaccccugcagcggccacugcggcggccacugcagcggcccccugcugcccccccccagcagccagccccugcccagcacccacagagaccccggcugcaagggccacaaguucgcccacagcggccuggccugccagcugccccagcccugcgaggccgacgagggccugggcgaggaggaggacagcagcagcgagagaagcagcugcaccagcagcagcacccaccagagagacggcaaguucugcgacugcugcuacugcgaguucuucggccacaacgccgagaaggagaaggcccagcuggccgccgaggcccugaagcaggccaacagagugagcggcagcagagagcccagacccgccagagagagacugcuggaguggcccgacagagagcuggacagagugaacagcuuccugagcagcagacugcaggagaucaagaacaccgugaaggacagcaucagagccagcuucagcgugugcgagcugagcauggacagcaacggcuucagcaaggagggcgccgccgagcccgagccccagagccugccccccagcaaccugagcggcagcagcgagcagcagcccgacaucaaccuggaccugagcccccugacccugggcagcccccagaaccacacccugcaggcccccggcgagcccgccccccccugggccgagaugagaggcccccacccccccuggaccgaggugagaggccccccccccggcaucgugcccgagaacggccuggugagaagacugaacaccgugcccaaccugagcagagugaucugggugaagacccccaagcccggcuaccccagcagcgaggagcccagcagcaaggaggugcccagcugcaagcaggagcugcccgagcccgugagcagcggcggcaagccccagaagggcaagagacagggcagccaggccaagaagagcgaggccagccccgcccccagaccccccgccagccuggaggugcccagcgccaagggccagguggccggccccaagcagcccggcagagugcuggagcugcccaaggugggcagcugcgccgaggccggcgagggcagcagaggcagcagacccggccccggcugggccggcagccccaagaccgagaaggagaagggcagcagcuggagaaacuggcccggcgaggccaaggccagaccccaggagcaggagagcgugcagcccagcggccccgccagaccccagagccugccccagggcaagggcagaagcagaagaagcagaaacaagcaggagaagcccgccagcagccuggacgacguguuccugcccaaggacauggacggcguggagauggacgagaccgacagagagguggaguacuucaagagauucugccuggacagcgccaagcagaccagacagaagguggccgugaacuggaccaacuucagccugaagaagaccacccccagcaccgcccaguaa

SEQ ID NO: 16887 - RNA, 1440 nt, Artificial Sequence
  FAM196A__Homo_sapiens__NP_001034851
auggugagcaaggacaccggcaagugcauccugaccaccagcgagagcgagguggagcccgccgccugccuggcccuggagaugaaguacgcccuggaccccaacagacagaucaagaagagaaacaaggcccugcaggugagauucaaggacaucugcgaggcccagaacgagcagagagacacccagcugagcagcggccagcugggcgagaagagagaggccaagcccgugagcugcagagccgccuacagaaaguacaugaccgugcccgccagaagaagcauccccaacgugaccaagagcaccggcgugcagaccagccccgaccugaagaagugcuaccagaccuucccccuggacagaaagaagggcaaccugaagagccugcccgccgccgaccccuucaagagccagaacaacggcuuccugaccgacgccaaggagaagaacgaggccggccccauggaggaggccagacccugcggcgccggcagagugcacaagaccaccgcccugguguuccacagcaaccagcacaugaacaccguggaccagccccugggcgugaacugcaccgagcccugcaagagccccgagccccugagcuacggcgaggccgcccugcagaacagcaccagaccccccagcgaggagcccgacuaccagcugcugggcagagccaagcaggacagaggcagacccaacagcgaggagcccgccccccccgcccugagaagaguguucaagaccgagguggccaccguguacgcccccgcccugagcgccagagcccccgagcccggccugagcgacagcgccgccgccagccaguggagccugugccccgccgacgacgagagaagaagagccacccaccugaacggccugcaggcccccagcgagaccgcccuggccugcagcccccccaugcagugccugagccccgagugcagcgagcagcccagccagacccacaccccccccggccugggcaaccagcccagccccaccgccguggccgccggcgaggagugccagagaaucgugccccacaccgaggugguggaccugaaggcccagcugcagaugauggagaaccugaucagcagcagccaggagaccaucaaggugcugcugggcgugauccaggagcuggagaagggcgaggcccacagagagggccugagcuacagaaccggccaggacaccgccaacugcgacaccugcagaaacagcgccugcaucaucuacagcguggagcuggacuucaagcagcaggaggacaagcugcagcccgugcugagaaagcugcaccccaucgaggagacccaggugauccccagccccuacagccaggagaccuacagcagcacccccaagcagaagagcaagaccgagagcaagaagcacggcagauggaagcugugguuccuguaa

SEQ ID NO: 16888 - RNA, 1608 nt, Artificial Sequence
  FAM196B__Homo_sapiens__NP_001123363
auggcccagcagaacaugaaggugagacccgugcugcugaagagaaacagccuggagagcguggaguucgugaagcagccccaccacagaagaagcaagagccagcaggugagauucaaggaggacggcaccaccaagaaccccaccggccuggccgagguggacgugcagacccccgaggaccccgccgugaugggcaagacccaggccaccagacaccaccugccccccaccuacagccugagcuuccccagaagccagaaggccggcggcuucagaaacaucgccauccagaccagccccagccugagaaagcacuuccccguguucaagagaaagagacugaccgccagcaagagccugguggagaugcccaccgccagccagagcgccauccaggugaacggcaaccugagcgagcaggacaucgugagcagcgaccuggccuaccugagacuggcccagcaccuggaggacggccccagaagagugaaggugagccacgccuuccugcccagagugcccaaggugcagagcaacggccccgugagcaucugccuggaggccggcaccuggagaagccuggagaaggccaccgccgccauccaggugcccgacgacaucuaccacagccccagcugggaggccagagagagcgcccugagccccgacagaagcgccgaggugagcaacagcauccacccccuggacgacaccagacccggcgacggcagaagagugaccccccuggacagcgagaagagcaccagcugccugaacgccaccagcguggccagccacacccccggcaccgaggagcugaagcccgagcugcugcugcccaaggacaacagcgacgacaaggaccugggcagccugagcagccagagcaaggagaccugcgugcccagcagccccagaacccacagcagccccagccagggcagccacagccagcccgcccaccccggcagagccagcgacugccccagcagcagcaacaaccaccagaaccuggugagccugaagaccaacagcgccagcaagagcgcccccggcugccaggagcagaccgccaacaaccccaccgagagcgacacccuggaguuccccaacugccccggcagcaaccaccugcccagcagccugagcagaagcgagaccaagcugcagagcaacagagagaucagcgacaucaaccagauccaccuggccagaggcgagcugugcgaccugcagggcagacugcagagcguggaggagagccugcacagcaaccaggagaagaucaaggugcugcugaacgugauccaggaccuggagaaggccagagcccugaccgagggcagaaacuucuacagaaccggccaggaccugaacaacugcagcaccugccagaacaccgccugcaucaucuacagcguggaguacgacuucagacagcaggagggcagauuccacgaggugcugcagagccuggaggaggccgagcccguggaggaggccagccccccccccaagagccccgccgagccccccgcccccgagaagcaggaccugagaagaaagaccaagaaggugaagaagaagugcuucugguggaucuaa

SEQ ID NO: 16889 - RNA, 1584 nt, Artificial Sequence
  FAM198B__Homo_sapiens__NP_001026870
augaccugccccgacaagcccggccagcugaucaacugguucaucugcagccugugcgugcccagagugagaaagcuguggagcagcagaagacccagaaccagaagaaaccugcugcugggcaccgccugcgccaucuaccugggcuuccuggugagccaggugggcagagccagccugcagcacggccaggccgccgagaagggcccccacagaagcagagacaccgccgagcccagcuuccccgagaucccccuggacggcacccuggccccccccgagagccagggcaacggcagcacccugcagcccaacgugguguacaucacccugagaagcaagagaagcaagcccgccaacaucagaggcaccgugaagcccaagagaagaaagaagcacgccguggccagcgccgcccccggccaggaggcccuggugggccccagccugcagccccaggaggccgccagagaggccgacgccguggcccccggcuacgcccagggcgccaaccuggugaagaucggcgagagacccuggagacuggugagaggccccggcgugagagccggcggccccgacuuccugcagcccagcagcagagagagcaacaucagaaucuacagcgagagcgcccccagcuggcugagcaaggacgacaucagaagaaugagacugcuggccgacagcgccguggccggccugagacccgugagcagcagaagcggcgccagacugcuggugcuggagggcggcgcccccggcgccgugcugagaugcggccccagccccugcggccugcugaagcagccccuggacaugagcgagguguucgccuuccaccuggacagaauccugggccugaacagaacccugcccagcgugagcagaaaggccgaguucauccaggccgccgccgccgccugccugagcaugagacuggccuucuucaucuuccccgccugggaggacaugagagugcccggcaagugcugcaucggccacgccagacugaccuggggcaccuaccagcagcugcugaagcagaagugcuggcagaacggcagagugcccaagcccgagagcggcugcaccgagauccaccaccacgaguggagcaagauggcccuguucgacuuccugcugcagaucuacaacagacuggacaccaacugcugcggcuucagacccagaaaggaggacgccugcgugcagaacggccugagacccaagugcgacgaccagggcagcgccgcccuggcccacaucauccagagaaagcacgaccccagacaccugguguucaucgacaacaagggcuucuucgacagaagcgaggacaaccugaacuucaagcugcuggagggcaucaaggaguuccccgccagcgccgugagcgugcugaagagccagcaccugagacagaagcugcugcagagccuguuccuggacaagguguacugggagagccagggcggcagacagggcaucgagaagcugaucgacgugaucgagcacagagccaagauccugaucaccuacaucaacgcccacggcgugaaggugcugcccaugaacgaguaa

SEQ ID NO: 16890 - RNA, 402 nt, Artificial Sequence
  FAM19A1__Homo_sapiens__NP_998774
auggccauggugagcgccaugagcugggugcuguaccuguggaucagcgccugcgccaugcugcugugccacggcagccugcagcacaccuuccagcagcaccaccugcacagacccgagggcggcaccugcgaggugaucgccgcccacagaugcugcaacaagaacagaaucgaggagagaagccagaccgugaagugcagcugccugcccggcaagguggccggcaccaccagaaacagacccagcugcguggacgccagcaucgugaucggcaagugguggugcgagauggagcccugccuggagggcgaggagugcaagacccugcccgacaacagcggcuggaugugcgccaccggcaacaagaucaagaccaccagaauccaccccagaaccuaa

SEQ ID NO: 16891 - RNA, 396 nt, Artificial Sequence
  FAM19A2__Homo_sapiens__NP_848634
augagcaagagauaccugcagaaggccaccaagggcaagcugcugaucaucaucuucaucgugacccuguggggcaagguggugagcagcgccaaccaccacaaggcccaccacgugaagaccggcaccugcgaggugguggcccugcacagaugcugcaacaagaacaagaucgaggagagaagccagaccgugaagugcagcugcuuccccggccagguggccggcaccaccagagccgcccccagcugcguggacgccagcaucguggagcagaagugguggugccacaugcagcccugccuggagggcgaggagugcaaggugcugcccgacagaaagggcuggagcugcagcagcggcaacaaggugaagaccaccagagugacccacuaa

SEQ ID NO: 16892 - RNA, 423 nt, Artificial Sequence
  FAM19A4__Homo_sapiens__NP_001005527
augagaagccccagaaugagagugugcgccaagagcgugcugcugagccacuggcuguuccuggccuacgugcugauggugugcugcaagcugaugagcgccagcagccagcaccugagaggccacgccggccaccaccagaucaagcagggcaccugcgaggugguggccgugcacagaugcugcaacaagaacagaaucgaggagagaagccagaccgugaagugcagcugcuuccccggccagguggccggcaccaccagagcccagcccagcugcguggaggccagcaucgugauccagaagugguggugccacaugaaccccugccuggagggcgaggacugcaaggugcugcccgacuacagcggcuggagcugcagcagcggcaacaaggugaagaccaccaaggugaccagauaa

SEQ ID NO: 16893 - RNA, 399 nt, Artificial Sequence
  FAM19A5__Homo_sapiens__NP_001076436
auggcccccagccccagaaccggcagcagacaggacgccaccgcccugcccagcaugagcagcaccuucugggccuucaugauccuggccagccugcugaucgccuacugcagccagcuggccgccggcaccugcgagaucgugacccuggacagagacagcagccagcccagaagaaccaucgccagacagaccgccagaugcgccugcagaaagggccagaucgccggcaccaccagagccagacccgccugcguggacgccagaaucaucaagaccaagcaguggugcgacaugcugcccugccuggagggcgagggcugcgaccugcugaucaacagaagcggcuggaccugcacccagcccggcggcagaaucaagaccaccaccgugagcuaa

SEQ ID NO: 16894 - RNA, 702 nt, Artificial Sequence
  FAM204A__Homo_sapiens__NP_071346
auguggagcggccugcugccccccggccugaacgagagcgacgccgagagcaacagcgaggacgaggccacccuggagaacagcggccugaaccugcaggaggacaaggaggacgagagcaucagaaagaccgagaucaucgacuucagcaccgacgagcccaagaccgagaccgagagcaacgugaacgccuacgaggagugccccagcggcauccccaucgacauguggaacaaguuccaggagcugcacaagaagcacagcgagcagaagagcaccaccagcagauucagaggcaagagaagaaagagaagcagaaaggacaagcugaagaacgagaaggagcugcacagcgagcccagcagcaacgagacccaguggaaggagcugacccaguacuucggcgugaacgacagauucgacccccccgugaagagaaagaagguggagaagagcggccuggagaagagaaucgaccaggccguggaggaguggaacaucgagaaggccgaggagcugagcaaccagcuggccaccagagagcugggcgugaagaucgccaaggccguggccugccacaacuucgugaaggccaagaaggagguggagaacagccaggccgccagaaagaagaagaagcuggccuggggcuucgaggccaagaagagaugggagaccaagagcaacaugggcuacauguaa

SEQ ID NO: 16895 - RNA, 4008 nt, Artificial Sequence
  FAM205A__Homo_sapiens__NP_001135389
augcugagccccaccuucgugcugugggaggugggcuacccccuguacaucuacggcagcaucuucaucgugaucgugaucaucuggcaggugaagagaagccaccacgagcugagcagcgagcccaagagaagcugcugcagaugccaccagaaggugagacagagagccagagacgccgccagcaccgccagaagaagaagcagagaggaggccgagaagccccagaagcugcugagcaucaucaagagccagggcuggcugccccuggagagaagcgugagaagaauccugugcgccgaccccugcugccagaucugcaacagcguggcccuggagauccagcagcugcuggugggcgagaacaaccagaucagccugacccugagcggcccccugcagggcagcagcugccuggagaugcugagcaccagcagcaugagccuggaccagagccuggaguuccacagcuggcacaccagagagcugagccugagcagcgugacccccacccugagccagcugaccgaccagaagagccugacccagagcgccgcccagagcaccuacgccgacggcauccaggacuacugggccgaccaccugcagcugggccaggaguuccaggugcccgacgugcugagaggccccaacaccaucgccagcagcagaaucgagaagcccagagccccccugaaccaggaggagaugacccagagcaaccccagccuggugcagggcaaccagggccagcaccaccugaacagccaggugagccugcugagccugaaccccgagacccugaacagaaugcaccccauggcccugcacauggugcugcccgcccaccugcccuuccugagccccgaggugcugagacugcuggaggugcacgugaagaaguggaugcacuuccagagauggggccugcccagaagaguggaggagagccugagacagcugaugcccaaccccccccuguacuaccagcccggcaacgaccagcccgugagcuucaaccugaagaacaccccccaggugagccugcacagauucgagaccaucagccugcagaccuggugcagcugcguggccggccagcccauccagaccuucugggugagcgaguggagcaccaugaaccccgagcagagacaccacugccagcagacccccaaccccauggcccuggcccugcccagccccgcccugaaggcccugagcggcccccacccccagagcggcggccaggacaacgacagcggcagcgaccugcagcagaaguacagccagcuguucugcggccugcccagccugcacagcgagagccugguggccaccuucaugggcagccagggccugcccaagaucgagaacgugcccaagcccccccugaaggaccccuuccuguucaacgagcugagcuucccccagcugcugcccaagaccagcccccagagcgccccccccagcagcccccugagccccaacuggaugagccccagcgaccaccagagagcccagaucaacgugcccuuccugacccuggccgaguacgaggcccuggaguggcaccugcugcagagacagcugcagcugcaguggggcuggcccgccgcccugcagagaagccagcacacccagugccugaugcagcacgagcccugcggcaaggcccagagccccgagaccaccaccgccagccagaccggcaagagcaucagcgugcugaccagagagcugcuguucuuccccgagcacgccagaaagcugcuggaguuccacauccagaagcagcugaucagacacagauggggccugccccagaagauccagcagagcauccagcugcugcugaccagcaccgaccagcagaccgugagcagcagcagcaccgcccuggccaacgugagcaucccccagcccguggcccuggaggccaacggcgccugcgacgugcugagccccaucgccgcccccgugagcauccccagaccccaccugcugacccaggugaaggccauccugcagagccacaucgacagcaagugcggccagauccaccagggcaagauccccgccugcgugcacagaagcugggacugcagaaucagcggcgugcuggccguggcccccuuccccugcauccccgagagccaguuccuggagcugcagaccgccagcgaccccgaccugcaccacaaggugaugcccuggaugcccaccgcccuggaccagcagcagcaggcccugcccggcaccgugaccgagcaccccaagcugcugagagugcugagcguggaggccaucgagaagcuggagaccacccugagacacaagcaccuggccuuccugagcggccugcccgcccuguacuacguggcccugcccagagcccuggcccccgccgugaccagccagagcgugaucaccgagauggagcccagccccguggagauccccgccgagccccugauccagauggugagcuucgaggagcagugcaucagccugggccccugcccccagggcaacaacgagagcugcaccgacguggccaaggaguuccagcccgccgugcccgugaagggcaccauggagacccugccccuggagagccagacccaccccaccagcccccacagccugcagacccacauccugaccaagcugaacuuccaccugagaaagaaggugcuggagauccaguggggcauccccaucagagccagaaagagcagagagcagaccguggccgcccccgagaacaucagcacccagaagagccuggagagccugaaccaccagggcgagacccugcugcaggagcugcccaucccccccgacacccugcccgcccccaaccccgagggcgugcaccugaaggagcagcuggccaacgaccugaaggccgugcagcagaaccagaagcagagcaacagcaaggccgugccccagggcagcgcccacagcgugagcaagaucagccagcccagcggcgacaugaccgaggcccacaugcccugcgugcagguggaggccaacgugaacaagcccagccuggaggagcccugcggccccgagccccagagccccagcaagagcaaggaccccgcccacgugcccaugcuggccggcaacagagaggaccccgaggagaccaaggccgccagagaccacagagagggcgacgccggcuucggcagaagcagcaccagagaggagagaagacccgccgaggaccagagacccgccggcaugcugcccaacaagacccccagaggcagcuggagauggagcagaagcuuccaccuggccgaccccugccagcacagcccccagcaccacccccagcugaagcugccccagcugccccccagagugcccggcgagaaggagagcgagaaggaccugcaggacagccagaccaagcugaccgugauccuggagcccgccaccauccccgagaacgcccagaccgugcugccccaggccagccagggccagcccuuccugagccagcccacccaggccaagccccugcagggccagacccugcagggccaggugcugcacggccuggugaugcccgugcacgcccagaagaagcccagccugaccgagagcagcuucagaaacaagaucaagugcuuccugcagcacaucaaccccaagaccaagggcaagggccacgaggacagcauguucagcgccgccgccaagguggccaagaccagaaaggagaacguggccaagagccuggcccccgccaagagccccgugggcagaagcaagaccgagaagcccaccggcugcagcaaggcccagagcagacccgcccagaagcuggugggccccgccuuccuggacggcccccagagccuggacgacaagcugagacugcacagcagacagcccggcagcgccagcgcccugggcuaccccagacacugccccagacacugccccagagaggccugcgccaacaagcccggccaccccaccuaa

SEQ ID NO: 16896 - RNA, 1212 nt, Artificial Sequence
  FAM20A__Homo_sapiens__NP_001230675
auguacagagagcagaugaaccugaccagccuggaccccccccugcagcugagacuggaggccagcugggugcaguuccaccugggcaucaacagacacggccuguacagcagaagcagccccguggugagcaagcugcugcaggacaugagacacuuccccaccaucagcgccgacuacagccaggacgagaaggcccugcugggcgccugcgacugcacccagaucgugaagcccagcggcgugcaccugaagcuggugcugagauucagcgacuucggcaaggccauguucaagcccaugagacagcagagagacgaggagacccccguggacuucuucuacuucaucgacuuccagagacacaacgccgagaucgccgccuuccaccuggacagaauccuggacuucagaagagugccccccaccgugggcagaaucgugaacgugaccaaggagauccuggaggugaccaagaacgagauccugcagagcguguucuucgugagccccgccagcaacgugugcuucuucgccaagugccccuacaugugcaagaccgaguacgccgugugcggcaacccccaccugcuggagggcagccugagcgccuuccugcccagccugaaccuggcccccagacugagcgugcccaaccccuggaucagaagcuacacccuggccggcaaggaggagugggaggugaacccccuguacugcgacaccgugaagcagaucuaccccuacaacaacagccagagacugcugaacgugaucgacauggccaucuucgacuuccugaucggcaacauggacagacaccacuacgagauguucaccaaguucggcgacgacggcuuccugauccaccuggacaacgccagaggcuucggcagacacagccacgacgagaucagcauccugagcccccugagccagugcugcaugaucaagaagaagacccugcugcaccugcagcugcuggcccaggccgacuacagacugagcgacgugaugagagagagccugcuggaggaccagcugagccccgugcugaccgagccccaccugcuggcccuggacagaagacugcagaccauccugagaaccguggagggcugcaucguggcccacggccagcagagcgugaucguggacggccccguggagcagcuggcccccgacagcggccaggccaaccugaccagcuaa

SEQ ID NO: 16897 - RNA, 1230 nt, Artificial Sequence
  FAM20B__Homo_sapiens__NP_055679
augaagcugaagcagagaguggugcugcuggccauccugcuggugaucuucaucuucaccaagguguuccugaucgacaaccuggacaccagcgccgccaacagagaggaccagagagccuuccacagaaugaugaccggccugagaguggagcuggcccccaagcuggaccacacccugcagagccccugggagaucgccgcccaguggguggugcccagagagguguaccccgaggagacccccgagcugggcgccgugaugcacgccauggccaccaagaagaucaucaaggccgacgugggcuacaagggcacccagcugaaggcccugcugauccuggagggcggccagaaggugguguucaagcccaagagauacagcagagaccacgugguggagggcgagcccuacgccggcuacgacagacacaacgccgagguggccgccuuccaccuggacagaauccugggcuuccacagagccccccugguggugggcagauucgugaaccugagaaccgagaucaagcccguggccaccgagcagcugcugagcaccuuccugaccgugggcaacaacaccugcuucuacggcaagugcuacuacugcagagagaccgagcccgccugcgccgacggcgacaucauggagggcagcgugacccuguggcugcccgacguguggccccugcagaagcacagacaccccuggggcagaaccuacagagagggcaagcuggccagaugggaguacgacgagagcuacugcgacgccgugaagaagaccagccccuacgacagcggccccagacugcuggacaucaucgacaccgccguguucgacuaccugaucggcaacgccgacagacaccacuacgagagcuuccaggacgacgagggcgccagcaugcugauccugcuggacaacgccaagagcuucggcaaccccagccuggacgagagaagcauccuggccccccuguaccagugcugcaucaucagagugagcaccuggaacagacugaacuaccugaagaacggcgugcugaagagcgcccugaagagcgccauggcccacgaccccaucagccccgugcugagcgacccccaccuggacgccguggaccagagacugcugagcgugcuggccaccgugaagcagugcaccgaccaguucggcauggacaccgugcugguggaggacagaaugccccugagccaccuguaa

SEQ ID NO: 16898 - RNA, 1755 nt, Artificial Sequence
  FAM20C__Homo_sapiens__NP_064608
augaagaugaugcuggugagaagauucagagugcugauccugaugguguuccugguggccugcgcccugcacaucgcccuggaccugcugcccagacuggagagaagaggcgccagacccagcggcgagcccggcugcagcugcgcccagcccgccgccgagguggccgcccccggcugggcccaggugagaggcagacccggcgagccccccgccgccagcagcgccgccggcgacgccggcuggcccaacaagcacacccugagaauccugcaggacuucagcagcgaccccagcagcaaccugagcagccacagccuggagaagcugccccccgccgccgagcccgccgagagagcccugagaggcagagaccccggcgcccugagaccccacgaccccgcccacagaccccugcugagagaccccggccccagaagaagcgagagcccccccggccccggcggcgacgccagccugcuggccagacuguucgagcacccccuguacagaguggccgugcccccccugaccgaggaggacgugcuguucaacgugaacagcgacaccagacugagccccaaggccgccgagaaccccgacuggccccacgccggcgccgagggcgccgaguuccugagccccggcgaggccgccguggacagcuaccccaacuggcugaaguuccacaucggcaucaacagauacgagcuguacagcagacacaaccccgccaucgaggcccugcugcacgaccugagcagccagagaaucaccagcguggccaugaagagcggcggcacccagcugaagcugaucaugaccuuccagaacuacggccaggcccuguucaagcccaugaagcagaccagagagcaggagaccccccccgacuucuucuacuucagcgacuacgagagacacaacgccgagaucgccgccuuccaccuggacagaauccuggacuucagaagagugccccccguggccggcagaauggugaacaugaccaaggagaucagagacgugaccagagacaagaagcuguggagaaccuucuucaucagccccgccaacaacaucugcuucuacggcgagugcagcuacuacugcagcaccgagcacgcccugugcggcaagcccgaccagaucgagggcagccuggccgccuuccugcccgaccugagccuggccaagagaaagaccuggagaaaccccuggagaagaagcuaccacaagagaaagaaggccgagugggagguggaccccgacuacugcgaggaggugaagcagaccccccccuacgacagcagccacagaauccuggacgugauggacaugaccaucuucgacuuccugaugggcaacauggacagacaccacuacgagaccuucgagaaguucggcaacgagaccuucaucauccaccuggacaacggcagaggcuucggcaaguacagccacgacgagcugagcauccuggugccccugcagcagugcugcagaaucagaaagagcaccuaccugagacugcagcugcuggccaaggaggaguacaagcugagccugcugauggccgagagccugagaggcgaccagguggcccccgugcuguaccagccccaccuggaggcccuggacagaagacugagaguggugcugaaggccgugagagacugcguggagagaaacggccugcacagcgugguggacgacgaccuggacaccgagcacagagccgccagcgccagauaa

SEQ ID NO: 16899 - RNA, 579 nt, Artificial Sequence
  FAM210B__Homo_sapiens__NP_543011
auggccggccugcuggcccugcugggccccgccggcagagugggcgccagagugagacccagagccaccuggcugcugggcgccaccgcccccugcgccccccccccccuggcccuggcccugcugccccccagacuggacgccagacugcugagaaccgccagaggcgacugcagaggccaccaggaccccagccaggccaccggcaccaccggcagcagcgugagcugcaccgaggagaagaagcagagcaagagccagcagcugaagaagaucuuccaggaguacggcaccgugggcgugagccugcacaucggcaucagccugaucagccugggcaucuucuacaugguggugagcagcggcguggacaugcccgccauccugcugaagcugggcuucaaggagagccuggugcagagcaagauggccgccggcaccagcaccuucgugguggccuacgccauccacaagcuguucgcccccgugagaaucagcaucacccuggugagcgugccccugaucgugagauacuucagaaaggugggcuucuucaagccccccgccgccaagcccuaa

SEQ ID NO: 16900 - RNA, 690 nt, Artificial Sequence
  FAM213A__Homo_sapiens__NP_001230707
augagcuuccugcaggaccccagcuucuucaccaugggcauguggagcaucggcgccggcgcccugggcgccgccgcccuggcccugcugcuggccaacaccgacguguuccugagcaagccccagaaggccgcccuggaguaccuggaggacaucgaccugaagacccuggagaaggagcccagaaccuucaaggccaaggagcugugggagaagaacggcgccgugaucauggccgugagaagacccggcugcuuccugugcagagaggaggccgccgaccugagcagccugaagagcaugcuggaccagcugggcgugccccuguacgccguggugaaggagcacaucagaaccgaggugaaggacuuccagcccuacuucaagggcgagaucuuccuggacgagaagaagaaguucuacggcccccagagaagaaagaugauguucaugggcuucaucagacugggcgugugguacaacuucuucagagccuggaacggcggcuucagcggcaaccuggagggcgagggcuucauccugggcggcguguucguggugggcagcggcaagcagggcauccugcuggagcacagagagaaggaguucggcgacaaggugaaccugcugagcgugcuggaggccgccaagaugaucaagccccagacccuggccagcgagaagaaguaa

SEQ ID NO: 16901 - RNA, 3252 nt, Artificial Sequence
  FAM214A__Homo_sapiens__NP_001273424
augguguucagcggcaacaagggccugcacagagaggacacccuggacgaguacuucgaguacgacgccgaggaguuccuggugagccuggcccugcugaucaccgagggcagaacccccgagugcagcgugaagggcagaaccgagagcuuccacugcccccccgcccagagcugcuaccccgugaccaccaagcacgagugcagcgacaagcuggcccagugcagacaggccagaagaaccagaagcgaggugacccugcuguggaagaacaaccugcccaucaugguggagaugaugcugcugcccgacugcugcuacagcgacgacggccccaccaccgagggcaucgaccugaacgaccccgccaucaagcaggacgcccugcugcuggagagauggauccuggagcccgugcccagacagaacggcgacagauucaucgaggagaagacccugcugcuggccgugagaagcuucguguucuucagccagcugagcgccuggcugagcgugagccacggcgccauccccagaaacauccuguacagaaucagcgccgccgacguggaccugcaguggaacuucagccagacccccaucgagcacguguuccccgugcccaacgugagccacaacguggcccugaaggugagcgugcagagccugcccagacagagcaacuaccccgugcugaccugcagcauccacaccaacaucggccuguacgagaagagaauccagcagcacaagcugaagacccaccagcaccacaaccccaacgaggccgagcagugcggcaccaacagcagccagagacugugcagcaagcagaccuggaccauggcccccgagagcgugcugcacgccaagagcggccccagccccgaguacaccgccgccgugaagaacaucaagcuguaccccggcaccggcagcaagagcgaccacggcaccagccaggccaacauccugggcuucagcggcaucggcgacaucaagagccaggagaccagcgugagaacccugaagagcuucagcaugguggacagcagcaucagcaacagacagagcuucuggcagagcgccggcgagaccaacccccugaucggcagccugauccaggagagacaggagaucaucgccagaaucgcccagcaccugauccacugcgaccccagcaccagccacgugagcggcagacccuucaacacccaggagagcagcagccugcacagcaagcuguucagagugagccaggagaacgagaacgugggcaagggcaaggaggccuucagcaugaccuucggcagccccgaguucagcagccccgaggacaccaacgagggcaagaucagacugaagcccgagacccccagaagcgagaccugcaucagcaacgacuucuacagccacaugcccgugggcgagaccaacccccugaucggcagccugcugcaggagagacaggacgugaucgccagaaucgcccagcaccuggagcacaucgaccccaccgccagccacauccccagacagagcuucaacaugcacgacagcagcagcguggccagcaagguguucagaagcagcuacgaggacaagaaccugcugaagaagaacaaggacgagagcagcgugagcaucagccacaccaagugcagccugcugggcgacaucagcgacggcaagaaccuggugcccaacaagugcuucaccagcuucaagaacaacagcaaggagaagugcagccugaagcaccagaccagaaaccagugccagaacaaccccagcgagaucauccagagcaccuaccaggagacccagaacaagagcagcagccugagcaccagcagcauccugagccagcacaaggagaacaaccuggaccugaccagcagauucaaggagcaggagaugagcaacggcaucgacaagcaguacagcaacugcaccaccaucgacaagcagaucugcaccaacaaguacaaggagaagaucaucaacgagaacuacaaccccaaguucuucggcaaccugcagagcgacgacagcaagaagaacgacagcaagaucaaggugaccgugcuggagaugagcgaguaccugaacaaguacgagagcaugagcagcaacaaggacagcaagagacccaagaccugcgagcagaacacccagcugaacagcaucgagaacuaccugaacaaggacaacgagggcuucaagugcaagaagagcgaccagcugaagaacgagcaggacaagcaggaggaccccaccaacgagaagagccagaacuacagccagagaagaagcaucaaggacugccugagcaccugcgagcagcccaagaacaccgaggugcugagaaccacccugaagcacagcaacguguggagaaagcacaacuuccacagccuggacggcaccagcaccagagccuuccacccccagaccggccugccccugcugagcagccccgugccccagagaaagacccagagcggcugcuucgaccuggacagcagccugcugcaccugaagagcuucagcagcagaagccccagacccugccugaacaucgaggacgaccccgacauccacgagaagcccuuccugagcagcagcgccccccccaucaccagccugagccugcugggcaacuucgaggagagcgugcugaacuacagauucgacccccugggcaucguggacggcuucaccgccgaggugggcgccagcggcgccuucugccccacccaccugacccugcccguggaggugagcuucuacagcgugagcgacgacaacgcccccagccccuacaugggcgugaucacccuggagagccugggcaagagaggcuacagagugccccccagcggcaccauccaggugacccuguucaaccccaacaagaccguggugaagauguucguggugaucuacgaccugagagacaugcccgccaaccaccagaccuuccugagacagagaaccuucagcgugcccgugaagcaggaggugaagagaagcgugaacaaggagaacaucagacacaccgaggagagacugcugagauaccugauccaccugagauuccagagcagcaagagcggcaagaucuaccugcacagagacgugagacugcuguucagcagaaagagcauggagguggacagcggcgccgccuacgagcugaagagcuacaccgagagccccaccaacccccaguucagccccagaugcuaa

SEQ ID NO: 16902 - RNA, 822 nt, Artificial Sequence
  FAM216A__Homo_sapiens__NP_037432
augcugggccagcugcugccccacaccgccagaggccugggcgccgccgagaugcccggccagggccccggcagcgacuggaccgagagaagcagcagcgccgagccccccgccguggccggcaccgagggcggcggcggcggcagcgccggcuacagcugcuaccagaacagcaagggcagcgacagaaucaaggacggcuacaaggugaacagccacaucgccaagcugcaggagcuguggaagaccccccagaaccagaccauccaccugagcaagagcaugauggaggccagcuucuucaagcaccccgaccugaccaccggccagaagagauaccugugcagcaucgccaagaucuacaacgccaacuaccugaagaugcugaugaagagacaguacaugcacgugcugcagcacagcagccagaagcccggcgugcugacccaccacagaagcagacugagcagcagauacagccagaagcagcacuaccccugcaccaccuggagacaccagcuggagagagaggacagcggcagcagcgacaucgccgccgccagcgcccccgagaugcugauccagcacagccuguggagacccgugagaaacaaggagggcaucaagaccggcuacgccagcaagaccagaugcaagagccugaagaucuucagaagacccagaaagcuguucaugcagaccgugagcagcgacgacagcgagagccacaugagcgaggagaagaaggaggaggaccugcugaacaacuucaugcagagcaugagcaucgaggagcagggcgagcaccugaugcugaccuaa

SEQ ID NO: 16903 - RNA, 780 nt, Artificial Sequence
  FAM220A__Homo_sapiens__NP_001032240
augagagacagaagaggcccccugggcaccugccuggcccaggugcagcaggccggcggcggcgacagcgacaagcugagcugcagccugaagaagagaaugcccgagggccccuggcccgccgacgcccccagcuggaugaacaagcccgugguggacggcaacagccagagcgaggcccugagccuggagaugagaaaggaccccagcggcgccggccuguggcugcacagcggcggccccgugcugcccuacgugagagagagcgugagaagaaaccccgccagcgccgccacccccagcaccgccgugggccuguuccccgcccccaccgagugcuucgccagagugagcugcagcggcguggaggcccugggcagaagagacuggcugggcggcggccccagagccaccgacggccacagaggccagugccccaagggcgagcccagagugagcagacugcccagacaccagaaggugcccgagaugggcagcuuccaggacgacccccccagcgccuuccccaagggccugggcagcgagcuggagcccgccugccugcacagcauccugagcgccacccugcacguguaccccgaggugcugcugagcgaggagaccaagagaaucuuccuggacagacugaagcccauguucagcaagcagaccaucgaguucaagaagaugcugaagagcaccagcgacggccugcagaucacccugggccugcuggcccugcagcccuucgagcuggccaacacccugugccacagcuaa

SEQ ID NO: 16904 - RNA, 1527 nt, Artificial Sequence
  FAM227B__Homo_sapiens__NP_689860
auggccggccagagaaccugccagagaagaagcagcagagccggccccggcaagaugcaggagccccccaagagcaucgaggaguuccugaaguuccagaacugggacuacuggcccagagagauccacuucagagacgacgacaaguggagcugcacccugaagaagaucaaggaggacagcagcuucgugagcaucuacacccaccugugggagaacgugcccagaaucuucgaggcccugcugaucauggagagcaagcugaaggaguacagccugauccugcagaaccacaccagcgagaucuucaaguggaagagcaugaucagcgagaccagcagcuacagaaagcuggagagauacggcgaguuccugaagaaguaccacaagaagaagaagaucaugcugagcgacgagauggagaccgagaagaacaucgagggcugcagcuucaccggcuucaaggccaacgagcugacccagcugcccagacaccuggacgccgagcagaucuaccuguucauccugaaggcccacaacuucgacgagagaguguucaagaucuggaagacccacuuccugagcgaggccagcaucgcccugcugcacgacagcuucugguggugguuccugcacaaguucagacccgacagagagaaccaggacugccuguucgacagaaucagcgagagcuacgugacccuguucaugagcaucccccugagcagaaaggacgccuucuuccagaucuaccccgacugccuggcccaggccaucuacgccaccuuccacgaggccuuccccgagagcagcuaccuguucaacgacgaguucaaggaggaccugggcaacaacaucuuccuguggugcagcggccugaagccccagaagggcuucuggauccacuggaagcugaaggagcugagcaccaccaccauccacggcagcaagaaggcccccgccaagagcgugaaggagagaaucgccgacagccaggagcacaucagcaccagcaucgacuucaacaucaucaagauccugaacaaccccagagccuacacccugcccaucagcaaggaggagagcagacugagcagacuggccaccaagagccacuacagcagcaccggccccgaguucaacagagugcuguucaacuucggcggccagagcccccugauccuguacuaccugaagaugcacgagcuggccggcaucagcaaggcccccaagaagaccaagaucaagcugaccaagaucuuccaggagccccugcccgcccccaccuacagagacgugaucaaggaggccaagagacaguucgccagaaaccagaaggacuucagaauccugcaggccaaggccaccaagaagccccacgaggugaagcaggacuucgagaaguuccugcacaagcugagaagcgaggccgagaucgagagagagugcguggccagccugagcagcagcagcagcagcagccccagcagcaccgacaacuacaacuucgaggaggaggaguacuaa

SEQ ID NO: 16905 - RNA, 339 nt, Artificial Sequence
  FAM32A__Homo_sapiens__NP_054796
auggaggccuacgagcaggugcagaagggcccccugaagcugaagggcguggccgagcugggcgugaccaagagaaagaagaagaagaaggacaaggacaaggccaagcugcuggaggccaugggcaccagcaagaagaacgaggaggagaagagaagaggccuggacaagagaacccccgcccaggccgccuucgagaagaugcaggagaagagacagauggagagaauccugaagaaggccagcaagacccacaagcagagaguggaggacuucaacagacaccuggacacccugaccgagcacuacgacauccccaaggugagcuggaccaaguaa

SEQ ID NO: 16906 - RNA, 579 nt, Artificial Sequence
  FAM3A__Homo_sapiens__NP_001164604
augagacuggccggccccgagagcagcgugaccgccgcccccagagccagaaaguacaagugcggccugccccagcccugccccgaggagcaccuggccuucagaguggugagcggcgccgccaacgugaucggccccaagaucugccuggaggacaagaugcugaugagcagcgugaaggacaacgugggcagaggccugaacaucgcccuggugaacggcgugagcggcgagcugaucgaggccagagccuucgacaugugggccggcgacgugaacgaccugcugaaguucaucagaccccugcacgagggcacccugguguucguggccagcuacgacgaccccgccaccaagaugaacgaggagaccagaaagcuguucagcgagcugggcagcagaaacgccaaggagcuggccuucagagacagcuggguguucgugggcgccaagggcgugcagaacaagagccccuucgagcagcacgugaagaacagcaagcacagcaacaaguacgagggcuggcccgaggcccuggagauggagggcugcauccccagaagaagcaccgccagcuaa

SEQ ID NO: 16907 - RNA, 708 nt, Artificial Sequence
  FAM3B__Homo_sapiens__NP_478066
augagaccccuggccggcggccugcugaaggugguguucgugguguucgccagccugugcgccugguacagcggcuaccugcuggccgagcugauccccgacgccccccugagcagcgccgccuacagcaucagaagcaucggcgagagacccgugcugaaggcccccgugcccaagagacagaagugcgaccacuggacccccugccccagcgacaccuacgccuacagacugcugagcggcggcggcagaagcaaguacgccaagaucugcuucgaggacaaccugcugaugggcgagcagcugggcaacguggccagaggcaucaacaucgccaucgugaacuacgugaccggcaacgugaccgccaccagaugcuucgacauguacgagggcgacaacagcggccccaugaccaaguucauccagagcgccgcccccaagagccugcuguucauggugaccuacgacgacggcagcaccagacugaacaacgacgccaagaacgccaucgaggcccugggcagcaaggagaucagaaacaugaaguucagaagcagcuggguguucaucgccgccaagggccuggagcugcccagcgagauccagagagagaagaucaaccacagcgacgccaagaacaacagauacagcggcuggcccgccgagauccagaucgagggcugcauccccaaggagagaagcuaa

SEQ ID NO: 16908 - RNA, 684 nt, Artificial Sequence
  FAM3C__Homo_sapiens__NP_055703
augagaguggccggcgccgccaagcuggugguggccguggccguguuccugcugaccuucuacgugaucagccagguguucgagaucaagauggacgccagccugggcaaccuguucgccagaagcgcccuggacaccgccgccagaagcaccaagccccccagauacaagugcggcaucagcaaggccugccccgagaagcacuucgccuucaagauggccagcggcgccgccaacguggugggccccaagaucugccuggaggacaacgugcugaugagcggcgugaagaacaacgugggcagaggcaucaacguggcccuggccaacggcaagaccggcgaggugcuggacaccaaguacuucgacauguggggcggcgacguggcccccuucaucgaguuccugaaggccauccaggacggcaccaucgugcugaugggcaccuacgacgacggcgccaccaagcugaacgacgaggccagaagacugaucgccgaccugggcagcaccagcaucaccaaccugggcuucagagacaacuggguguucugcggcggcaagggcaucaagaccaagagccccuucgagcagcacaucaagaacaacaaggacaccaacaaguacgagggcuggcccgaggugguggagauggagggcugcaucccccagaagcaggacuaa

SEQ ID NO: 16909 - RNA, 675 nt, Artificial Sequence
  FAM3D__Homo_sapiens__NP_620160
augagagugagcggcgugcugagacugcuggcccugaucuucgccaucgugaccaccuggauguucaucagaagcuacaugagcuucagcaugaagaccaucagacugcccagauggcuggccgccagccccaccaaggagauccaggugaagaaguacaagugcggccugaucaagcccugccccgccaacuacuucgccuucaagaucugcagcggcgccgccaacguggugggccccaccaugugcuucgaggacagaaugaucaugagccccgugaagaacaacgugggcagaggccugaacaucgcccuggugaacggcaccaccggcgccgugcugggccagaaggccuucgacauguacagcggcgacgugaugcaccuggugaaguuccugaaggagauccccggcggcgcccuggugcugguggccagcuacgacgaccccggcaccaagaugaacgacgagagcagaaagcuguucagcgaccugggcagcagcuacgccaagcagcugggcuucagagacagcuggguguucaucggcgccaaggaccugagaggcaagagccccuucgagcaguuccugaagaacagccccgacaccaacaaguacgagggcuggcccgagcugcuggagauggagggcugcaugccccccaagcccuucuaa

SEQ ID NO: 16910 - RNA, 1329 nt, Artificial Sequence
  FAM46A__Homo_sapiens__NP_060103
auggccgagggcgagggcuacuucgccaugagcgaggacgagcuggccugcagccccuacaucccccugggcggcgacuucggcggcggcgacuucggcggcggcgacuucggcggcggcgacuucggcggcggcggcagcuucggcggccacugccuggacuacugcgagagccccaccgcccacugcaacgugcugaacugggagcaggugcagagacuggacggcauccugagcgagaccauccccauccacggcagaggcaacuuccccacccuggagcugcagcccagccugaucgugaagguggugagaagaagacuggccgagaagagaaucggcgugagagacgugagacugaacggcagcgccgccagccacgugcugcaccaggacagcggccugggcuacaaggaccuggaccugaucuucugcgccgaccugagaggcgagggcgaguuccagaccgugaaggacguggugcuggacugccugcuggacuuccugcccgagggcgugaacaaggagaagaucaccccccugacccugaaggaggccuacgugcagaagauggugaaggugugcaacgacagcgacagauggagccugaucagccugagcaacaacagcggcaagaacguggagcugaaguucguggacagccugagaagacaguucgaguucagcguggacagcuuccagaucaagcuggacagccugcugcuguucuacgagugcagcgagaaccccaugaccgagaccuuccaccccaccaucaucggcgagagcguguacggcgacuuccaggaggccuucgaccaccugugcaacaagaucaucgccaccagaaaccccgaggagaucagaggcggcggccugcugaaguacugcaaccugcuggugagaggcuucagacccgccagcgacgagaucaagacccugcagagauacaugugcagcagauucuucaucgacuucagcgacaucggcgagcagcagagaaagcuggagagcuaccugcagaaccacuucgugggccuggaggacagaaaguacgaguaccugaugacccugcacggcguggugaacgagagcaccgugugccugaugggccacgagagaagacagacccugaaccugaucaccaugcuggccaucagagugcuggccgaccagaacgugauccccaacguggccaacgugaccugcuacuaccagcccgcccccuacguggccgacgccaacuucagcaacuacuacaucgcccaggugcagcccguguucaccugccagcagcagaccuacagcaccuggcugcccugcaacuaa

SEQ ID NO: 16911 - RNA, 1170 nt, Artificial Sequence
  FAM46D__Homo_sapiens__NP_689843
augagcgagaucagauucaccaaccugaccugggaccaggugaucacccuggaccaggugcuggacgaggugauccccauccacggcaagggcaacuuccccaccauggaggugaagcccaaggacaucauccacguggugaaggaccagcugaucggccagggcaucaucgugaaggacgccagacugaacggcagcguggccagcuacauccuggccagccacaacggcaucagcuacaaggaccuggacgugaucuucggcguggagcugcccggcaacgaggaguuccagguggugaaggacgccgugcuggacugccugcuggacuuccugcccaaggacgugaagaaggagaagcugagccccgacaucaugaaggacgccuacgugcagaagcuggugaaggugugcaacggccacgacugcuggagccugaucagccugagcaacaacaccggcaagaaccuggagcugaaguucgugagcagccugagaagacaguucgaguucagcguggacagcuuccagaucgugcuggaccccaugcuggacuucuacagcgacaagaacgccaagcugaccaaggagagcuaccccguggugguggccgagagcauguacggcgacuuccaggaggccaugacccaccugcagcacaagcugaucugcaccagaaagcccgaggagaucagaggcggcggccugcugaaguacugcagccugcuggugcacggcuucaagcccgccugcaugagcgagaucaagaaccuggagagauacaugugcagcagauucuucaucgacuucccccacaucgaggagcagcagaagaagaucgagagcuaccugcacaaccacuucaucggcgagggcaugaccaaguacgacuaccugaugacccugcacggcguggugaacgagagcaccgugugccugaugagcuacgagagaagacagauccugcaccugaucaccaugauggcccugaaggugcugggcgagcugaacauccugcccaacacccagaaggugaccugcuucuaccagcccgcccccuacuucgccgccgaggccagauaccccaucuacgugauccccgagcccccccccgugagcuuccagcccuaccacccccugcacuucagaggcagcaacggcaugagcuaa

SEQ ID NO: 16912 - RNA, 972 nt, Artificial Sequence
  FAM49A__Homo_sapiens__NP_110424
augggcaaccugcugaaggugcugaccagagagaucgagaacuacccccacuucuuccuggacuucgagaacgcccagcccaccgagggcgagagagagaucuggaaccagaucagcgccgugcugcaggacagcgagagcauccuggccgaccugcaggccuacaagggcgccggccccgagaucagagacgccauccagaaccccaacgacauccagcugcaggagaaggccuggaacgccgugugcccccugguggugagacugaagagauucuacgaguucagcaucagacuggagaaggcccugcagagccugcuggagagccugaccugcccccccuacacccccacccagcaccuggagagagagcaggcccuggccaaggaguucgccgagauccugcacuucacccugagauucgacgagcugaagaugagaaaccccgccauccagaacgacuucagcuacuacagaagaaccaucagcagaaacagaaucaacaacaugcaccuggacaucgagaacgaggugaacaacgagauggccaacagaaugagccuguucuacgccgaggccacccccaugcugaagacccugagcaacgccaccaugcacuucgugagcgagaacaagacccugcccaucgagaacaccaccgacugccugagcaccaugaccagcgugugcaaggugaugcuggagacccccgaguacagaagcagauucaccagcgaggagacccugauguucugcaugagagugauggugggcgugaucauccuguacgaccacgugcaccccgugggcgccuucugcaagaccagcaagaucgacaugaagggcugcaucaaggugcugaaggagcaggcccccgacagcguggagggccugcugaacgcccugagauucaccaccaagcaccugaacgacgagagcaccagcaagcagaucagagccaugcugcaguaa

SEQ ID NO: 16913 - RNA, 975 nt, Artificial Sequence
  FAM49B__Homo_sapiens__NP_001243692
augggcaaccugcugaaggugcugaccugcaccgaccuggagcagggccccaacuucuuccuggacuucgagaacgcccagcccaccgagagcgagaaggagaucuacaaccaggugaacguggugcugaaggacgccgagggcauccuggaggaccugcagagcuacagaggcgccggccacgagaucagagaggccauccagcaccccgccgacgagaagcugcaggagaaggccuggggcgccguggugccccuggugggcaagcugaagaaguucuacgaguucagccagagacuggaggccgcccugagaggccugcugggcgcccugaccagcacccccuacagccccacccagcaccuggagagagagcaggcccuggccaagcaguucgccgagauccugcacuucacccugagauucgacgagcugaagaugaccaaccccgccauccagaacgacuucagcuacuacagaagaacccugagcagaaugagaaucaacaacgugcccgccgagggcgagaacgaggugaacaacgagcuggccaacagaaugagccuguucuacgccgaggccacccccaugcugaagacccugagcgacgccaccaccaaguucgugagcgagaacaagaaccugcccaucgagaacaccaccgacugccugagcaccauggccagcgugugcagagugaugcuggagacccccgaguacagaagcagauucaccaacgaggagaccgugagcuucugccugagagugauggugggcgugaucauccuguacgaccacgugcaccccgugggcgccuucgccaagaccagcaagaucgacaugaagggcugcaucaaggugcugaaggaccagccccccaacagcguggagggccugcugaacgcccugagauacaccaccaagcaccugaacgacgagaccaccagcaagcagaucaagagcaugcugcaguaa

SEQ ID NO: 16914 - RNA, 978 nt, Artificial Sequence
  FAM50B__Homo_sapiens__NP_036267
auggcccaguacaagggcaccaugagagaggccggcagagccaugcaccugcugaagaagagagagagacagagagagcagauggaggugcugaagcagagaaucgccgaggagaccauccugaagagccagguggacaagagauucagcgcccacuacgacgccguggaggccgagcugaagagcagcaccgugggccuggugacccugaacgacaugaaggccagacaggaggcccuggugagagagagagagagacagcuggccaagagacagcaccuggaggagcagagacugcagcaggagagacagagagagcaggagcagagaagagagagaaagagaaagaucagcugccugagcuucgcccuggacgaccuggacgaccaggccgacgccgccgaggccagaagagccggcaaccugggcaagaaccccgacguggacaccagcuuccugcccgacagagacagagaggaggaggagaacagacugagagaggagcugagacaggagugggaggcccagagagagaaggugaaggacgaggagauggaggugaccuucagcuacugggacggcagcggccacagaagaaccgugagagugagaaagggcaacaccgugcagcaguuccugaagaaggcccugcagggccugagaaaggacuuccuggagcugagaagcgccggcguggagcagcugauguucaucaaggaggaccugauccugccccacuaccacaccuucuacgacuucaucaucgccagagccagaggcaagagcggcccccuguucagcuucgacgugcacgacgacgugagacugcugagcgacgccaccauggagaaggacgagagccacgccggcaagguggugcugagaagcugguacgagaagaacaagcacaucuuccccgccagcagaugggaggccuacgaccccgagaagaagugggacaaguacaccaucagauaa

SEQ ID NO: 16915 - RNA, 1269 nt, Artificial Sequence
  FAM53B__Homo_sapiens__NP_055476
auggugauggugcugagcgagagccugagcaccagaggcgccgacagcaucgccugcggcaccuucagcagagagcugcacacccccaagaagaugagccagggccccacccuguucagcugcggcaucauggagaacgacagauggagagaccuggacagaaagugcccccugcagaucgaccagcccagcaccagcaucugggagugccugcccgagaaggacagcagccuguggcacagagaggccgugaccgccugcgccgugaccagccugaucaaggaccugagcaucagcgaccacaacggcaaccccagcgccccccccagcaagagacagugcagaagccugagcuucagcgacgagaugagcagcugcagaaccagcuggagaccccugggcagcaagguguggacccccguggagaagagaagaugcuacagcggcggcagcgugcagagauacagcaacggcuucagcaccaugcagagaagcagcagcuucagccugcccagcagagccaacgugcugagcagccccugcgaccaggccggccugcaccacagauucggcggccagcccugccagggcgugcccggcagcgcccccugcggccaggccggcgacaccuggagccccgaccugcaccccgugggcggcggcagacuggaccugcagagaagccugagcugcagccacgagcaguucagcuucguggaguacugcccccccagcgccaacagcacccccgccagcacccccgagcuggccagaagaagcagcggccugagcagaagcagaagccagcccugcgugcugaacgacaagaaggugggcgugaagagaagaagacccgaggaggugcaggagcagagacccagccuggaccuggccaagauggcccagaacugccagaccuucagcagccugagcugccugagcgccggcaccgaggacugcggcccccagagccccuucgccagacacgugagcaacaccagagccuggaccgcccugcugagcgccagcggccccggcggcagaacccccgccggcacccccgugcccgagccccugccccccagcuucgacgaccaccuggccugccaggaggaccugagcugcgaggagagcgacagcugcgcccuggacgaggacugcggcagaagagccgagcccgccgccgccuggagagacagaggcgcccccggcaacagccugugcagccuggacggcgagcuggacaucgagcagaucgagaagaacuaa

SEQ ID NO: 16916 - RNA, 774 nt, Artificial Sequence
  FAM57A__Homo_sapiens__NP_079068
augcugcugacccuggccggcggcgcccuguucuuccccggccuguucgcccugugcaccugggcccugagaagaagccagcccggcuggagcagaaccgacugcgugaugaucagcaccagacuggugagcagcgugcacgccgugcuggccaccggcagcggcaucgugaucaucagaagcugcgacgacgugaucaccggcagacacuggcuggccagagaguacgugugguuccugauccccuacaugaucuacgacagcuacgccauguaccugugcgaguggugcagaaccagagaccagaacagagcccccagccugacccugagaaacuuccugagcagaaacagacugaugaucacccaccacgccgugauccuguucgugcuggugcccguggcccagagacugagaggcgaccugggcgacuucuucgugggcugcaucuucaccgccgagcugagcacccccuucgugagccugggcagagugcugauccagcugaagcagcagcacacccugcuguacaaggugaacggcauccugacccuggccaccuuccugagcugcagaauccugcuguuccccuucauguacuggagcuacggcagacagcagggccugagccugcugcaggugcccuucagcauccccuucuacugcaacguggccaacgccuuccugguggccccccagaucuacugguucugccugcugugcagaaaggccgugagacuguucgacaccccccaggccaagaaggacggcuaa

SEQ ID NO: 16917 - RNA, 687 nt, Artificial Sequence
  FAM58A__Homo_sapiens__NP_001124469
auggaggcccccgagggcggcggcggcggccccgccgccagaggccccgagggccagcccgcccccgaggccagagugcacuucagaguggccagauucaucauggaggccggcgugaagcugggcaugagaagcauccccaucgccaccgccugcaccaucuaccacaaguucuucugcgagaccaaccuggacgccuacgaccccuaccugaucgccaugagcagcaucuaccuggccggcaagguggaggagcagcaccugagaaccagagacaucaucaacgugagcaacagauacuucaaccccagcggcgagccccuggagcuggacagcagauucugggagcugagagacagcaucgugcagugcgagcugcugaugcugagagugcugagauuccaggugagcuuccagcacccccacaaguaccugcugcacuaccuggugagccugcagaacuggcugaacagacacagcuggcagagaacccccguggccgugaccgccugggcccugcugagagacagcuaccacggcgcccugugccugagauuccaggcccagcacaucgccguggccgugcuguaccuggcccugcagguguacggcguggaggugcccgccgagguggaggccgagaagcccugguggcagaucuacaccauggacaccgagauccccuaa

SEQ ID NO: 16918 - RNA, 666 nt, Artificial Sequence
  FAM60A__Homo_sapiens__NP_001129284
auguucggcuuccacaagcccaagauguacagaagcaucgagggcugcugcaucugcagagccaagagcagcagcagcagauucaccgacagcaagagauacgagaaggacuuccagagcugcuucggccugcacgagaccagaagcggcgacaucugcaacgccugcgugcugcuggugaagagauggaagaagcugcccgccggcagcaagaagaacuggaaccacgugguggacgccagagccggccccagccugaagaccacccugaagcccaagaaggugaagacccugagcggcaacagaaucaagagcaaccagaucagcaagcugcagaaggaguucaagagacacaacagcgacgcccacagcaccaccagcagcgccagccccgcccagagccccugcuacagcaaccagagcgacgacggcagcgacaccgagauggccagcggcagcaacagaacccccguguucagcuuccuggaccugaccuacuggaagagacagaagaucugcugcggcaucaucuacaagggcagauucggcgaggugcugaucgacacccaccuguucaagcccugcugcagcaacaagaaggccgccgccgagaagcccgaggagcagggccccgagccccugcccaucagcacccaggagugguaa

SEQ ID NO: 16919 - RNA, 1866 nt, Artificial Sequence
  FAM63B__Homo_sapiens__NP_001035540
auggagagcagccccgagagccugcagccccuggagcacggcguggccgccggccccgccagcggcaccggcagcagccaggagggccugcaggagaccagacuggccgccggcgacggccccggcgugugggccgccgagaccagcggcggcaacggccugggcgccgccgccgccagaagaagccugcccgacagcgccagccccgccggcagccccgaggugcccggccccugcagcagcagcgccggccuggaccugaaggacagcggccuggagagccccgccgccgccgaggccccccugagaggccaguacaaggugaccgccagccccgagaccgccguggccggcgugggccacgagcugggcaccgccggcgacgccggcgccagacccgaccuggccggcaccugccaggccgagcugaccgccgccggcagcgaggagcccagcagcgccggcggccugagcagcagcugcagcgaccccagcccccccggcgagagccccagccuggacagccuggagagcuucagcaaccugcacagcuuccccagcagcugcgaguucaacagcgaggagggcgccgagaacagagugcccgaggaggaggagggcgccgccgugcugcccggcgccgugccccugugcaaggaggaggagggcgaggagaccgcccaggugcuggccgccagcaaggagagauuccccggccagagcguguaccacaucaaguggauccaguggaaggaggagaacacccccaucaucacccagaacgagaacggccccugcccccugcuggccauccugaacgugcugcugcuggccuggaaggugaagcugccccccaugauggagaucaucaccgccgagcagcugauggaguaccugggcgacuacaugcuggacgccaagcccaaggagaucagcgagauccagagacugaacuacgagcagaacaugagcgacgccauggccauccugcacaagcugcagaccggccuggacgugaacgugagauucaccggcgugagaguguucgaguacacccccgagugcaucguguucgaccugcuggacaucccccuguaccacggcuggcugguggacccccagaucgacgacaucgugaaggccgugggcaacugcagcuacaaccagcugguggagaagaucaucagcugcaagcagagcgacaacagcgagcuggugagcgagggcuucguggccgagcaguuccugaacaacaccgccacccagcugaccuaccacggccugugcgagcugaccagcaccgugcaggagggcgagcugugcguguucuucagaaacaaccacuucagcaccaugaccaaguacaagggccagcuguaccugcuggugaccgaccagggcuuccugaccgaggagaagguggugugggagagccugcacaacguggacggcgacggcaacuucugcgacagcgaguuccaccugagaccccccagcgaccccgagaccguguacaagggccagcaggaccagaucgaccaggacuaccugauggcccugagccugcagcaggagcagcagagccaggagaucaacugggagcagauccccgagggcaucagcgaccuggagcuggccaagaagcugcaggaggaggaggacagaagagccagccaguacuaccaggagcaggagcaggccgccgccgccgccgccgccgccagcacccaggcccagcagggccagcccgcccaggccagccccagcagcggcagacagagcggcaacagcgagagaaagagaaaggagcccagagagaaggacaaggagaaggagaaggagaagaacagcugcgugauccuguaa

SEQ ID NO: 16920 - RNA, 747 nt, Artificial Sequence
  FAM64A__Homo_sapiens__NP_001182157
auggccagcagauggcagaacaugggcaccagcgugagaagaagaagccugcagcaccaggagcagcuggaggacagcaaggagcugcagcccguggugagccaccaggagaccagcgugggcgcccugggcagccugugcagacaguuccagagaagacugccccugagagccgugaaccugaaccugagagccggccccagcuggaagagacuggagacccccgagcccggccagcagggccugcaggccgccgccagaagcgccaagagcgcccugggcgccgugagccagagaauccaggagagcugccagagcggcaccaaguggcugguggagacccaggugaaggccagaagaagaaagagaggcgcccagaagggcagcggcagccccacccacagccugagccagaagagcaccagacugagcggcgccgcccccgcccacagcgccgccgaccccugggagaaggagcaccacagacugagcgugagaaugggcagccacgcccacccccugagaagaagcagaagagaggccgccuucagaagccccuacagcagcaccgagccccugugcagccccagcgagagcgacagcgaccuggagcccgugggcgccggcauccagcaccugcagaagcugagccaggagcuggacgaggccaucauggccgaggagagaaagcaggcccugagcgacagacagggcuucauccugaaggacguguacgccagccccuaa

SEQ ID NO: 16921 - RNA, 3144 nt, Artificial Sequence
  FAM65B__Homo_sapiens__NP_001273374
augcaguucuucgacgccgaggagcugcugguggacgaggaggacgacguguucggcgagggccugcccaccagacugcccgagaucaugcuggugggcagccagagcuucagccccggcggccccaacggcaucaucagaagccagagcuucgccggcuucagcggccugcaggagagaagaagcagaugcaacagcuucaucgagaacagcagcgcccugaagaagccccaggccaagcugaagaagaugcacaaccugggccacaagaacaacaacccccccaaggagccccagcccaagagaguggaggagguguacagagcccugaagaacggccuggacgaguaccuggaggugcaccagaccgagcuggacaagcugaccgcccagcugaaggacaugaagagaaacagcagacugggcgugcuguacgaccuggacaagcagaucaagaccaucgagagauacaugagaagacuggaguuccacaucagcaagguggacgagcuguacgaggccuacugcauccagagaagacugcaggacggcgccagcaagaugaagcaggccuucgccaccagccccgccagcaaggccgccagagagagccugaccgagaucaacagaagcuucaaggaguacaccgagaacaugugcaccaucgagguggagcuggagaaccugcugggcgaguucagcaucaagaugaagggccuggccggcuucgccagacugugccccggcgaccaguacgagaucuucaugaaguacggcagacagagauggaagcugaagggcaagaucgaggugaacggcaagcagagcugggacggcgaggagaccguguuccugccccugaucgugggcuucaucagcaucaaggugaccgagcugaagggccuggccacccacauccuggugggcagcgugaccugcgagaccaaggagcuguucgccgccagaccccaggugguggccguggacaucaacgaccugggcaccaucaagcugaaccuggagaucaccugguaccccuucgacguggaggacaugaccgccagcagcggcgccggcaacaaggccgccgcccugcagagaagaaugagcauguacagccagggcacccccgagacccccaccuucaaggaccacagcuucuucagcaaccugcccgacgacaucuucgagaacggcaaggccgccgaggagaagaugccccugagccugagcuucagcgaccugcccaacggcgacugcgcccugaccagccacagcaccggcagccccagcaacagcaccaaccccgagaucaccaucacccccgccgaguucaaccugagcagccuggccagccagaacgagggcauggacgacaccagcagcgccagcagcagaaacagccugggcgagggccaggagcccaagagccaccugaaggaggaggaccccgaggagcccagaaagcccgccagcgcccccagcgaggccugcagaagacagagcagcggcgccggcgccgagcaccuguuccuggagaacgacguggccgaggcccugcugcaggagagcgaggaggccagcgagcugaagcccguggagcuggacaccagcgagggcaacaucaccaagcagcuggugaagagacugaccagcgccgaggugcccauggccaccgacagacugcugagcgagggcagcgugggcggcgagagcgagggcugcagaagcuuccuggacggcagccuggaggacgccuucaacggccugcugcuggcccuggagccccacaaggagcaguacaaggaguuccaggaccugaaccaggaggugaugaaccuggacgacauccugaagugcaagcccgccgugagcagaagcagaagcagcagccugagccugaccguggagagcgcccuggagagcuucgacuuccugaacaccagcgacuucgacgaggaggaggacggcgacgaggugugcaacgugggcggcggcgccgacagcguguucagcgacaccgagaccgagaagcacagcuacagaagcgugcaccccgaggccagaggccaccugagcgaggcccugaccgaggacaccggcgugggcaccagcguggccggcagcccccugccccugaccaccggcaacgagagccuggacaucaccaucgugagacaccugcaguacugcacccagcuggugcagcagaucguguucagcagcaagacccccuucguggccagaagccugcuggagaagcugagcagacagauccaggugauggagaagcuggccgccgugagcgacgagaacaucggcaacaucagcagcgugguggaggccauccccgaguuccacaagaagcugagccugcugagcuucuggaccaagugcugcagccccgugggcguguaccacagccccgccgacagagugaugaagcagcuggaggccagcuucgccagaaccgugaacaaggaguaccccggccuggccgaccccguguucagaacccuggugagccagauccuggacagagccgagccccugcugagcagcagccugagcagcgagguggugaccguguuccaguacuacagcuacuucaccagccacggcgugagcgaccuggagagcuaccugagccagcuggccagacaggugagcauggugcagacccugcagagccugagagacgagaagcugcugcagaccaugagcgaccuggcccccagcaaccugcuggcccagcaggaggugcugagaacccuggcccugcugcugaccagagaggacaacgaggugagcgaggccgugacccuguaccuggccgccgccagcaagaaccagcacuucagagagaaggcccugcuguacuacugcgaggcccugaccaagaccaaccugcagcugcagaaggccgccugccuggcccugaagauccuggaggccaccgagagcaucaagaugcuggugacccugugccagagcgacaccgaggagaucagaaacguggccagcgagacccugcugagccugggcgaggacggcagacuggccuacgagcagcuggacaaguuccccagagacugcgugaaggugggcggcagacacggcaccgagguggccaccgccuucuaa

SEQ ID NO: 16922 - RNA, 1260 nt, Artificial Sequence
  FAM69C__Homo_sapiens__NP_001037834
auggccagagccgccggcgccagaggccccgccggcuggugcagaagaagaggcagaugcggcagaggcacccugcuggccuucgccgccuggaccgccggcugggugcuggccgccgcccugcugcugagagcccaccccggcgugcugagcgagagaugcaccgacgagaagagcagaagaauccuggccgcccugugccaggacuaccagggcggcacccuggccggcgaccugugcgaggaccugugcguggccggcgagcugcuguuccagagaugccugcacuacaacagaggcaagaaggugcugcaggccgacuggagaggcagacccguggugcugaagagcaaggaggaggccuucagcagcuuccccccccugagccugcuggaggaggaggccggcgagggcggccaggacaugcccgaggccgagcugcugcugaugguggccggcgaggugaagagcgcccugggccuggagcugagcaacagcagccugggccccugguggcccggcagaagaggccccagauggagaggccagcuggccagccugugggcccugcugcagcaggaggaguacguguacuucagccugcugcaggaccugagcccccacgugcugcccgugcugggcagcugcggccacuucuacgccguggaguuccuggccgccggcagcccccaccacagagcccuguucccccuggacagagcccccggcgcccccggcggcggccaggccaaggccaucagcgacaucgcccugagcuuccuggacauggugaaccacuucgacagcgacuucagccacagacugcaccugugcgacaucaagcccgagaacuucgccaucagaagcgacuucaccgugguggccaucgacguggacauggccuucuucgagcccaagaugagagagauccuggagcagaacugcaccggcgacgaggacugcaacuucuucgacugcuucagcagaugcgaccugagagugaacaagugcggcgcccagagagugaacaacaaccugcaggugaucugcgacaagaucuucagacacugguucagcgccccccugaagagcagcgccgugagcuuccagcugcagcugcagcugcaggaggccgugcaggagugcgccgaccccggcgugcccagcggcaacaccagaagagccgccagcagcguguucuggaagcugagacagcugcugcaggccacccugagagagcugcaggaggccgagaaguaa

SEQ ID NO: 16923 - RNA, 1035 nt, Artificial Sequence
  FAM71F1__Homo_sapiens__NP_115988
augcugagcagcuucccccacagaaagaccuggagaaagagcaagaagaccgugaaggugaccagaagcuaccccaccuuccccagccugaacgccugggaggaguucagaggccugcugcccguggacggcgagcccaaccccggcgccggccugggcguggaggagggccugcugugcagaguggugcacagccccgaguucaaccuguuccuggacagcgugguguucgagagcaacuucauccaggugaagagaggcagaaacuggagagacguguacaaggccagcaacaccauggcccugggcgugaccagcagcgugcccugccugccccugcccaacauccugcugauggccagcgugaaguggcaccagggccagaaccagaccuggaacagacccagcaucgcccccaacaucuuccugaagagaauccugccccugagauucguggagcugcaggugugcgaccacuaccagagaauccugcagcugagaaccgugaccgagaagaucuacuaccugaagcugcaccccgaccaccccgagaccguguuccacuucuggaucagacuggugcagauccugcagaagggccugagcaucaccaccaaggaccccagaauccuggugacccacugccuggugcccaagaacugcagcagccccagcggcgacagcaagcuggugcagaagaagcugcaggccagccagcccagcgagagccugauccagcugaugaccaagggcgagagcgaggcccugagccagaucuucgccgaccugcaccagcagaaccagcugagcuucagaagcagcagaaagguggagaccaacaagaacagcagcggcaaggacagcagcagagaggacagcauccccugcaccugcgaccugagauggagagccagcuucaccuacggcgagugggagagagagaaccccagcggccugcagccccugagccugcugagcacccuggccgccagcaccggcccccagcuggccccccccaucggcaacagcaucuaa

SEQ ID NO: 16924 - RNA, 930 nt, Artificial Sequence
  FAM71F2__Homo_sapiens__NP_001012457
augagcaagaucagaggccugccccccgaggugagagagcccggccccggcguggagcugggcguggagaacggccugcugugccagcugauccacagccccgaguucaaccuguucagcaacagcgugguguucgagagcaacuucauccagacccacgugcccgaggccgacuuccaggugaccaagcccggcaacuggagagacgugugcgagggcagcgccaccgugauccugggcgugaccagcagcgugcccagccugccccugcccaacgugcugcugauggccaacgugaccuggccccagggccccuucaccaccuggagcacccccggcgacgcccccgugaucaaccugagcagacugcugccccugaaguacguggagcugagaaucuacgacagacugcagagaauccugagagugagaaccgugaccgagaagaucuacuaccugaagcugcacgagaagcaccccgagaucguguuccaguucugggugagacuggugaagauccugcagaagggccugagcaucaccaccaaggaccccagaaucaaguucacccacugccuggugcccaagaugcccaccaacagcaccgagaccacccccgagaacagccugcugagcagcccccagcccagcgagccccuggugcugcuggccgccgagcagaccagcggcagcuucagccagcugagcggcaagccccagcugaccgccgacagaaacaacgacaccgccaucgagaucgacaacugcagcagcuacaagauccccagccccguggccagccccaucaaccugaacauccccaugagagccgcccugagccacagccugugggagcaggaggacuggaacgagcaccugcugcaggugcacaucgccagcuaccugggcgagcacuuccugggcgccuaa

SEQ ID NO: 16925 - RNA, 330 nt, Artificial Sequence
  FAM72B__Homo_sapiens__NP_001307078
augagcaccaacaucugcagcuucaaggacagcgccguggacuucaccggcagaugcuacuucaccaagaucugcaagugcaagcugaaggacaucgccugccugaagugcggcaacaucgugggcuaccacgugaucgugcccugcagcagcugccugcccagcugcaacaacggccacuucuggauguuccacagccaggccguguacgacaucaacagacuggacagcaccggcgugaacauccugcuguggggcaaccugcccgagaucgaggagagcaccgacgaggacgugcugaacaucagcgccgaggagugcaucagauaa

SEQ ID NO: 16926 - RNA, 786 nt, Artificial Sequence
  FAM78B__Homo_sapiens__NP_001017961
augggcugcauccagagcaucaccugcaaggccagaaucagaagagagaacaucgugguguacgacgugugcgccaccaucgaccagugccccaccagaaucgaggagaccagccccaucgugcugagauacaagacccccuacuucaaggccagcgccagaguggugaugccccccauccccagacacgagaccuggguggugggcuggauccaggccugcaaccagauggaguucuucaacaccuacagcgaccugggcaugagcagcugggagcugcccgaccugagagagggcagagugaaggccaucagcgacagcgacggcgugagcuaccccugguacggcaacaccaccgagaccgugacccuggugggccccaccaacaagaucagcagauucagcgugagcaugaacgacaacuucuaccccagcgugaccugggccgugcccgugagcgacagcaacgugccccugcugaccagaaucaagagagaccagagcuucaccaccuggcugguggccaugaacaccaccaccaaggagaagaucauccugcagaccaucaaguggagaaugagaguggacaucgagguggacccccugcagcugcugggccagagagccagacuggugggcagaacccagcaggagcagcccagaauccugagcagaauggagcccaucccccccaacgcccuggugaagcccaacgccaacgacgcccaggugcugauguggagacccaagagaggccccccccugguggugaucccccccaaguaa

SEQ ID NO: 16927 - RNA, 1359 nt, Artificial Sequence
  FAM81B__Homo_sapiens__NP_689761
augcagcugcaguuccugggcacccuggccagcagcgagaagagaaagaagagccagagacuguucuucaagaacaucaagagcaccaagaacaaggccggcaaggccagcaucaugagcagcgacaccaacgugaacaagagcgccagccccaccgccaccgccgaggagcagcccguggagcccgacggcccccugcccggcagcgacaacaaccaggagaagaaggugagacugagccccgccaagaugagcaccaagaacagcaccgaccugguggaguacguggacaagagccacgccuuccugcccaucauccccaacacccagagaggccagcuggaggacagacugaacaaccaggccagaaccaucgccuuccugcuggagcaggccuucagaaucaaggaggacaucagcgccugccugcagggcacccacggcuucagaaaggaggagagccuggccagaaagcugcuggagagccacauccagaccaucaccagcaucgugaagaagcugagccagaacaucgagauccuggaggaccagaucagagccagagaccaggccgccaccggcaccaacuucgccgugcacgagaucaacaucaagcaccugcagggcgugggcgaccugagaggcagaguggccagaugcgacagcagcaucgugaagcugagcggcgacauccaccuguucagacaggagcacagacagaucgagaaggccauccaggaguucgugcccgcccuggagacccugagcaagaaccuggacaugaaggugaugcagcugcugggcaagaucgagaccgccagcagcgagcagaccagcaaccugaagauggugcagggcgacuacagacacgagaugaaccugcuggaguucaaguuccacagccugagcagcaaccuguacgaggagguggagaacaacaagaaguggaccgagaaccaguuccugaaguacagaaaggaccaccugggccacaucaacgagugccugaaggugcugcaggagaagcuggagaagagcgagaacaagauggaggagaagcugcugcagcugagcagcaagguggagaacuucaucaacacccagaagcaggagacccagcugagcaaggugaagcacauggagaacaagcugagcaagaagauggagcagauggagaagcagaucuggggcgagcuggagaccaugcagaacgaguaccagagcggcuucaagagcauccacgacagccugagcagccugcagcagauccagaagaccaagauggaccuggagaaguacaaggugcagaaggaccugaagaagcugcagagaaagaucguggagcugcaggagguguaa

SEQ ID NO: 16928 - RNA, 885 nt, Artificial Sequence
  FAM83A__Homo_sapiens__NP_001275516
augagcagaagcagacaccugggcaagaucagaaagagacuggaggacgugaagagccagugggugagacccgccagagccgacuucagcgacaacgagagcgccagacuggccaccgacgcccugcuggacggcggcagcgaggccuacuggagagugcugagccaggagggcgagguggacuuccugagcagcguggaggcccaguacauccaggcccaggccagagagccccccugcccccccgacacccugggcggcgccgaggccggccccaagggccuggacagcagcagccugcagagcggcaccuacuuccccguggccagcgagggcagcgagcccgcccugcugcacagcugggccagcgccgagaagcccuaccugaaggagaagagcagcgccaccguguacuuccagaccgugaagcacaacaacaucagagaccuggugagaagaugcaucaccagaaccagccagaacaucagcaucagaagcguggagggcgagaucuacugcgccaagagcggcagaaaguucgccggccagaucagagagaaguucaucaucagcgacuggagauucgugcugagcggcagcuacagcuucaccuggcugugcggccacgugcacagaaacauccugagcaaguucaccggccaggccguggagcuguucgacgaggaguucagacaccuguacgccagcagcaagcccgugaugggccugaagagccccagacugguggcccccgugccccccggcgccgcccccgccaacggcagacugagcagcagcagcggcagcgccagcgacagaaccagcagcaaccccuucagcggcagaagcgccggcagccaccccggcaccagaaccgacggcuaa

SEQ ID NO: 16929 - RNA, 3036 nt, Artificial Sequence
  FAM83B__Homo_sapiens__NP_001010872
auggagaccagcagcaugcugagcagccugaacgacgagugcaagagcgacaacuacaucgagccccacuacaaggagugguacagaguggccaucgacauccugaucgagcacggccuggaggccuaccaggaguuccuggugcaggagagagugagcgacuuccuggccgaggaggagaucaacuacauccugaagaacgugcagaagguggcccagagcaccgcccacggcaccgacgacagcugcgacgacacccugagcagcggcaccuacuggcccguggagagcgacguggaggcccccaaccuggaccugggcuggcccuacgugaugcccggccugcugggcggcacccacaucgaccugcuguuccacccccccagagcccaccugcugaccaucaaggagaccaucagaaagaugaucaaggaggccagaaaggugaucgcccuggugauggacaucuucaccgacguggacaucuucaaggagaucguggaggccagcaccagaggcgugagcguguacauccugcuggacgagagcaacuucaaccacuuccugaacaugaccgagaagcagggcugcagcgugcagagacugagaaacaucagagugagaaccgugaagggccaggacuaccugagcaagaccggcgccaaguuccacggcaagauggagcagaaguuccugcugguggacugccagaaggugauguacggcagcuacagcuacauguggagcuucgagaaggcccaccugagcauggugcagaucaucaccggccagcugguggagagcuucgacgaggaguucagaacccuguacgccagaagcugcgugcccagcagcuucgcccaggaggagagcgccagagugaagcacggcaaggcccugugggagaacggcaccuaccagcacagcgugagcagccuggccagcgugagcagccagagaaaccuguucggcagacaggacaagauccacaagcuggacagcagcuacuucaagaacagaggcaucuacacccugaacgagcacgacaaguacaacaucagaagccacggcuacaagccccacuucgugcccaacuucaacggccccaacgccaucagacaguuccagcccaaccagaucaacgagaacuggaagagacacagcuacgccggcgagcagcccgagaccgugcccuaccugcugcugaacagagcccugaacagaaccaacaacccccccggcaacuggaagaagcccagcgacagccugagcguggccagcagcagcagagagggcuacgugagccaccacaacacccccgcccagagcuucgccaacagacuggcccagagaaagaccaccaaccuggccgacagaaacagcaacgugagaagaagcuucaacggcaccgacaaccacaucagauuccugcagcagagaaugcccacccuggagcacaccaccaagagcuuccugagaaacuggagaaucgagagcuaccugaacgaccacagcgaggccacccccgacagcaacggcagcgcccugggcgacagauucgagggcuacgacaaccccgagaaccugaaggccaacgcccuguacacccacagcagacugagaagcagccugguguucaagcccacccugcccgagcagaaggaggugaacagcugcaccaccggcagcagcaacagcaccaucaucggcagccagggcagcgagacccccaaggaggugcccgacacccccaccaacgugcagcaccugaccgacaagccccugcccgagagcauccccaagcugccccugcagagcgaggcccccaagaugcacacccugcaggugcccgagaaccacagcguggcccugaaccagaccaccaacggccacaccgagagcaacaacuacaucuacaagacccugggcgugaacaagcagaccgagaaccugaagaaccagcagaccgagaaccugcugaagagaagaagcuucccccuguucgacaacagcaaggccaaccuggaccccggcaacagcaagcacuacguguacagcacccugaccagaaacagagugagacagcccgagaagcccaaggaggaccugcugaagagcagcaagagcaugcacaacgugacccacaaccuggaggaggacgaggaggaggugaccaagagaaacagccccagcggcaccaccaccaagagcgugagcaucgccgcccugcuggacgugaacaaggaggagagcaacaaggagcuggccagcaagaaggaggugaagggcagccccagcuuccugaagaagggcagccagaagcugagaagccugcugagccugacccccgacaagaaggagaaccugagcaagaacaaggcccccgccuucuacagacugugcagcagcagcgacacccuggugagcgagggcgaggagaaccagaagcccaagaagagcgacaccaagguggacagcagccccagaagaaagcacagcagcagcagcaacagccagggcagcauccacaagagcaaggaggacgugaccgugagccccagccaggagaucaacgccccccccgacgagaacaagagaacccccagccccggccccguggagagcaaguuccuggagagagccggcgacgccagcgcccccagauucaacaccgagcagauccaguacagagacagcagagagaucaacgccguggugacccccgagagaagacccaccagcagccccagacccaccagcagcgagcugcugagaagccacagcaccgacagaagaguguacagcagauucgagcccuucugcaagaucgagagcagcauccagcccaccagcaacaugcccaacaccagcaucaacagacccgagaucaagagcgccaccaugggcaacagcuacggcagaagcagcccccugcugaacuacaacaccggcguguacagaagcuaccagcccaacgagaacaaguucagaggcuucaugcagaaguucggcaacuucauccacaagaacaaguaa

SEQ ID NO: 16930 - RNA, 1758 nt, Artificial Sequence
  FAM83D__Homo_sapiens__NP_112181
auggcccugcugagcgagggccuggacgaggugcccgccgccugccugagccccugcggcccccccaaccccaccgagcuguucagcgagagcagaagacuggcccuggaggagcugguggccggcggccccgaggccuucgccgccuuccugagaagagagagacuggccagauuccugaaccccgacgaggugcacgccauccugagagccgccgagagacccggcgaggagggcgccgccgccgccgccgccgccgaggacagcuucggcagcagccacgacugcagcagcggcaccuacuuccccgagcagagcgaccuggagcccccccugcuggagcugggcuggcccgccuucuaccagggcgccuacagaggcgccaccagaguggagacccacuuccagcccagaggcgccggcgagggcggccccuacggcugcaaggacgcccugagacagcagcugagaagcgccagagaggugaucgccguggugauggacguguucaccgacaucgacaucuucagagaccugcaggagaucugcagaaagcagggcguggccguguacauccugcuggaccaggcccugcugagccaguuccuggacaugugcauggaccugaaggugcaccccgagcaggagaagcugaugaccgugagaaccaucaccggcaacaucuacuacgccagaagcggcaccaagaucaucggcaaggugcacgagaaguucacccugaucgacggcaucagaguggccaccggcagcuacagcuucaccuggaccgacggcaagcugaacagcagcaaccuggugauccugagcggccaggugguggagcacuucgaccuggaguucagaauccuguacgcccagagcaagcccaucagccccaagcugcugagccacuuccagagcagcaacaaguucgaccaccugaccaacagaaagccccagagcaaggagcugacccugggcaaccugcugagaaugagacuggccagacugagcagcacccccagaaaggccgaccuggaccccgagaugcccgccgagggcaaggccgagagaaagccccacgacugcgagagcagcaccgugagcgaggaggacuacuucagcagccacagagacgagcugcagagcagaaaggccaucgacgccgccacccagaccgagcccggcgaggagaugcccggccugagcgugagcgaggugggcacccagaccagcaucaccaccgccugcgccggcacccagaccgccgugaucaccagaaucgccagcagccagaccaccaucuggagcagaagcaccaccacccagaccgacauggacgagaacauccuguuccccagaggcacccagagcaccgagggcagccccgugagcaagaugagcgugagcagaagcagcagccugaagagcagcagcagcgugagcagccagggcagcguggccagcagcaccggcagccccgccagcaucagaaccaccgacuuccacaaccccggcuaccccaaguaccugggcaccccccaccuggagcuguaccugagcgacagccugagaaaccugaacaaggagagacaguuccacuucgccggcaucagaagcagacugaaccacaugcuggccaugcugagcagaagaacccuguucaccgagaaccaccugggccugcacagcggcaacuucagcagagugaaccugcuggccgugagagacguggcccuguaccccagcuaccaguaa

SEQ ID NO: 16931 - RNA, 3558 nt, Artificial Sequence
  FAM83H__Homo_sapiens__XP_006725151
auggcccccggccccaacauggccagaagaagccagagcagcagccagggcgacaacccccuggcccccggcuaccugcccccccacuacaaggaguacuacagacuggccguggacgcccuggccgagggcggcagcgaggccuacagcagauuccuggccaccgagggcgcccccgacuuccugugccccgaggagcuggagcacgugagcagacaccugagacccccccaguacgugaccagagagccccccgagggcagccugcuggacguggacauggacggcagcagcggcaccuacuggcccgugaacagcgaccaggccgugcccgagcuggaccugggcuggccccugaccuucggcuuccagggcaccgaggugaccacccuggugcagccccccccccccgacagccccagcaucaaggacgaggccagaagaaugaucagaagcgcccagcaggugguggccguggugauggacauguucaccgacguggaccugcugagcgaggugcuggaggccgccgccagaagagugcccguguacauccugcuggacgagaugaacgcccagcacuuccuggacauggccgacaagugcagagugaaccugcagcacguggacuuccugagagugagaaccguggccggccccaccuacuacugcagaaccggcaagagcuucaagggccacgugaaggagaaguuccugcugguggacugcgccguggugaugagcggcagcuacagcuucauguggagcuucgagaagauccacagaagccuggcccacguguuccagggcgagcuggugagcagcuucgacgaggaguucagaauccuguucgcccagagcgagccccuggugcccagcgccgccgcccuggccagaauggacgccuacgcccuggcccccuacgccggcgccggcccccuggugggcgugcccggcgugggcgcccccacccccuucagcuuccccaagagagcccaccugcuguuccccccccccagagaggagggccugggcuuccccagcuuccuggaccccgacagacacuuccugagcgccuucagaagagaggagccccccagaaugcccggcggcgcccuggagccccacgccggccugagaccccugagcagaagacuggaggccgaggccggccccgccggcgagcuggccggcgccagaggcuucuuccaggccagacaccuggagauggacgccuucaagagacacagcuucgccaccgagggcgccggcgccguggagaacuucgccgccgccagacaggugagcagacagaccuuccugagccacggcgacgacuucagauuccagaccagccacuuccacagagaccagcuguaccagcagcaguaccagugggacccccagcugacccccgccagaccccagggccuguucgagaagcugagaggcggcagagccggcuucgccgaccccgacgacuucacccugggcgccggccccagauuccccgagcugggccccgacggccaccagagacuggacuacgugcccagcagcgccagcagagaggugagacacggcagcgaccccgccuucgcccccggccccagaggccuggagcccagcggcgcccccagacccaaccugacccagagauuccccugccaggccgccgccagacccggccccgaccccgcccccgaggccgagcccgagagaagaggcggccccgagggcagagccggccugagaagauggagacuggccagcuaccugagcggcugccacggcgaggacggcggcgacgacggccugcccgcccccauggaggccgaggccuacgaggacgacgugcuggcccccggcggcagagcccccgccggcgaccugcugcccagcgccuucagagugcccgccgccuuccccaccaaggugcccgugcccggccccggcagcggcggcaacggccccgagagagagggccccgaggagcccggccuggccaagcaggacagcuucagaagcagacugaacccccuggugcagagaagcagcagacugagaagcagccugaucuucagcaccagccaggccgagggcgccgccggcgccgccgccgccaccgagaaggugcagcugcugcacaaggagcagaccgugagcgagacccugggccccggcggcgaggccgugagaagcgccgccagcaccaagguggccgagcugcuggagaaguacaagggccccgccagagaccccggcggcggcgccggcgccaucaccguggccagccacagcaaggccguggugagccaggccuggagagaggagguggccgcccccggcgccgugggcggcgagagaagaagccuggagagcugccugcuggaccugagagacagcuucgcccagcagcugcaccaggaggccgagagacagcccggcgccgccagccugaccgccgcccagcugcuggacacccugggcagaagcggcagcgacagacugcccagcagauuccugagcgcccagagccacagcaccagcccccagggccuggacagcccccugccccuggagggcagcggcgcccaccaggugcugcacaacgagagcaagggcagccccaccagcgccuaccccgagagaaagggcagccccacccccggcuucagcaccagaagaggcagccccaccaccggcuucaucgagcagaagggcagccccaccagcgccuaccccgagagaagaggcagccccgugccccccgugcccgagagaagaagcagccccgugccccccgugcccgagagaagaggcagccugacccugaccaucagcggcgagagccccaaggccggccccgccgaggagggccccagcggccccauggaggugcugagaaagggcagccugagacugagacagcugcugagccccaagggcgagagaagaauggaggacgagggcggcuuccccgugccccaggagaacggccagcccgagagccccagaagacugagccugggccagggcgacagcaccgaggccgccaccgaggagagaggccccagagccagacugagcagcgccaccgccaacgcccuguacagcagcaaccugagagacgacaccaaggccauccuggagcagaucagcgcccacggccagaagcacagagccgugcccgcccccagccccggccccacccacaacagccccgagcugggcagaccccccgccgccggcgugcuggcccccgacaugagcgacaaggacaagugcagcgccaucuucagaagcgacagccugggcacccagggcagacugagcagaacccugcccgccagcgccgaggagagagacagacugcugagaagaauggagagcaugagaaaggagaagagaguguacagcagauucgagguguucugcaagaaggaggaggccagcagccccggcgccggcgagggccccgccgaggagggcaccagagacagcaaggugggcaaguucgugcccaagauccugggcaccuucaagagcaagaaguaa

SEQ ID NO: 16932 - RNA, 879 nt, Artificial Sequence
  FAM84A__Homo_sapiens__NP_660158
augggcaaccagcuggacagaaucacccaccugaacuacagcgagcugcccaccggcgaccccagcggcaucgagaaggacgagcugagagugggcguggccuacuucuucagcgacgacgaggaggaccuggacgagagaggccagcccgacaaguucggcgugaaggccccccccggcugcacccccugccccgagagccccagcagacaccaccaccaccugcugcaccagcuggugcugaacgagacccaguucagcgccuucagaggccaggagugcaucuucagcaaggugagcggcggcccccagggcgccgaccugagcguguacgccgugaccgcccugcccgcccugugcgagcccggcgaccugcuggagcugcuguggcugcagcccgcccccgagccccccgcccccgccccccacugggccguguacgugggcggcggccagaucauccaccugcaccagggcgagaucagacaggacagccuguacgaggccggcgccgccaacgugggcagaguggugaacagcugguacagauacagaccccugguggccgagcugguggugcagaacgccugcggccaccugggccugaagagcgaggagaucugcuggaccaacagcgagagcuucgccgccuggugcagauucggcaagagagaguucaaggccggcggcgaggugcccgccggcacccagcccccccagcagcaguacuaccugaaggugcaccugggcgagaacaaggugcacaccgccagauuccacagccuggaggaccugaucagagagaagagaagaaucgacgccagcggcagacugagagugcugcaggagcuggccgaccugguggacgacaaggaguaa

SEQ ID NO: 16933 - RNA, 933 nt, Artificial Sequence
  FAM84B__Homo_sapiens__NP_777571
augggcaaccagguggagaagcugacccaccugagcuacaaggaggugcccaccgccgaccccaccggcguggacagagacgacggccccagaaucggcgugagcuacaucuucagcaacgacgacgaggacguggagccccagccccccccccagggccccgacggcggcggccugcccgacggcggcgacggccccccccccccccagccccagcccuacgaccccagacugcacgagguggagugcagcguguucuacagagacgagugcaucuaccagaagagcuucgcccccggcagcgccgcccugagcaccuacacccccgagaaccugcugaacaagugcaagcccggcgaccugguggaguucgugagccaggcccaguacccccacugggccguguacgugggcaacuuccagguggugcaccugcacagacuggaggugaucaacagcuuccugaccgacgccagccagggcagaagaggcagaguggugaacgaccuguacagauacaagccccugagcagcagcgccguggugagaaacgcccuggcccacgugggcgccaaggagagagagcugagcuggagaaacagcgagagcuucgccgccuggugcagauacggcaagagagaguucaagaucggcggcgagcugagaaucggcaagcagcccuacagacugcagauccagcugagcgcccagagaagccacacccuggaguuccagagccuggaggaccugaucauggagaagagaagaaacgaccagaucggcagagccgccgugcugcaggagcuggccacccaccugcaccccgccgagcccgaggagggcgacagcaacguggccagaaccacccccccccccggcagaccccccgcccccagcagcgaggaggaggacggcgaggccguggcccacuaa

SEQ ID NO: 16934 - RNA, 555 nt, Artificial Sequence
  FAM89A__Homo_sapiens__NP_940954
augagcggcgccagagccgcccccggcgccgccggcaacggcgccgugagaggccugagaguggacggccugcccccccugcccaagagccugagcggccugcugcacagcgccagcggcggcggcgccagcggcggcuggagacaccuggagagacuguacgcccagaagagcagaauccaggacgagcugagcagaggcggccccggcggcggcggcgccagagccgccgcccugcccgccaagccccccaaccuggacgccgcccuggcccugcugagaaaggagauggugggccugagacagcuggacaugagccugcugugccagcuguacagccuguacgagagcauccaggaguacaagggcgccugccaggccgccagcagccccgacugcaccuacgcccuggagaacggcuucuucgacgaggaggaggaguacuuccaggagcagaacagccugcacgacagaagagacagaggcccccccagagaccugagccugcccgugagcagccugagcagcagcgacuggauccuggagagcaucuaa

SEQ ID NO: 16935 - RNA, 756 nt, Artificial Sequence
  FAM92A1__Homo_sapiens__NP_001269963
augaugagaagaacccuggagaacagaaacgcccagaccaagcagcugcagaccgccgugagcaacguggagaagcacuucggcgagcugugccagaucuucgccgccuacgugagaaagaccgccagacugagagacaaggccgaccugcuggugaacgagaucaacgccuacgccgccaccgagaccccccaccugaagcugggccugaugaacuucgccgacgaguucgccaagcugcaggacuacagacaggccgagguggagagacuggaggccaaggugguggagccccugaagaccuacggcaccaucgugaagaugaagagagacgaccugaaggccacccugaccgccagaaacagagaggccaagcagcugacccagcuggagagaaccagacagagaaaccccagcgacagacacgugaucagccaggccgagaccgagcugcagagagccgccauggacgccagcagaaccagcagacaccuggaggagaccaucaacaacuucgagagacagaagaugaaggacaucaagguguucagaaacagccuguacgcccccgacuacagcagcagacuggacaucgugagagccaacagcaagagcccccugcagagaagccugagcgccaagugcgugagcggcaccggccaggugagcaccugcagacugagaaaggaccagcaggccgaggacgacgaggacgacgagcuggacgugaccgaggaggagaacuuccugaaguaa

SEQ ID NO: 16936 - RNA, 915 nt, Artificial Sequence
  FAM92B__Homo_sapiens__NP_940893
augaacaucguguucagcagagacagccaggugagagugauggagaacaccguggccaacaccgagaaguacuucggccaguucugcagccugcuggccgccuacaccagaaagaccgccagacugagagacaaggccgaccagcuggugaagcagcugaucgacuucgccaacagcgagaaccccgagcugagagccaccaugagaggcuucgccgaggaccuggccaaggugcaggacuacagacaggcccagguggagagacuggagaccaagguggugaacccccugaagcuguacggcgcccagaucaagcagaccagagccgagaucaagaaguucaagcacgugcagaaccacgagaucaagcagcuggagaagcuggagaagcugagacagaagagccccagcgaccagcagaugaucagccaggccgagaccagagugcagagagccgccguggacagcagcagaaccacccugcagcuggaggagaccguggacggcuuccagagacagaagcugaaggaccugcagaaguucuucugcgacuucgugaccaucgagaugguguuccacgccaaggccguggagguguacagcagcgccuuccagacccuggagaaguacgaccuggagagagaccugcuggacuucagagccaagaugcagggcguguacggccacuacgacaccagacugcuggccaacaccagccccccccccagcgugcugcagagccuggccagccagggcacccugcaggugcagcugagcagagccaacgaggaccccgagcacccccacgccaaccacggcagauucagccugugcgaguggguggugaagggccagcccgcccacugcgugugcggccagggcggccaccugaugcugcccggccacagccuguaa

SEQ ID NO: 16937 - RNA, 561 nt, Artificial Sequence
  FAM9B__Homo_sapiens__NP_995321
auggccgccuggggcaagaagcacgccggcaaggaccccgugagagacgagugcgaggagagaaacagauucaccgagaccagagaggaggacgugaccgacgagcacggcgagagagagcccuucgccgagaccgacgagcacaccggcgccaacaccaagaagcccgaggacaccgccgaggaccugaccgccaagagaaagagaaugaagauggacaagaccugcagcaagaccaagaacaagagcaagcacgcccugagaaagaagcagcugaagagacagaagagagacuacauccacagccugaagcugcugaacgugcuggaggaguacaucaccgacgagcagaaggaggaggaggaggaggagggcgaggaggaggagcugaucagaaucuuccaggagcagcagaagaaguggcagcaguacagaagcgugagaagagagagacugaaggagaugaagcugcugagagaccaguucgugaaggcccuggaggacuucgaggaccugugcgacagaguguucagcgacgaggacagcgagcuggacaacuaa

SEQ ID NO: 16938 - RNA, 1602 nt, Artificial Sequence
  FAN1__Homo_sapiens__NP_001139568
augaugagcgagggcaagccccccgacaagaagagacccagaagaagccugagcaucagcaagaacaagaagaaggccagcaacagcaucaucagcugcuucaacaacgccccccccgccaagcuggccugccccgugugcagcaagauggugcccagauacgaccugaacagacaccuggacgagaugugcgccaacaacgacuucgugcagguggaccccggccaggugggccugaucaacagcaacgugagcaugguggaccugaccagcgugacccuggaggacgugacccccaagaagagccccccccccaagaccaaccugacccccggccagagcgacagcgccaagagagaggugaagcagaagaucagccccuacuucaagagcaacgacguggugugcaagaaccaggacgagcugagaaacagaagcgugaaggugaucugccugggcagccuggccagcaagcugagcagaaaguacgugaaggccaagaagagcaucgacaaggacgaggaguucgccggcagcagcccccagagcagcaagagcaccguggugaagagccugaucgacaacagcagcgagaucgaggacgaggaccagauccuggagaacagcagccagaaggagaacguguucaagugcgacagccugaaggaggagugcauccccgagcacauggugagaggcagcaagaucauggaggccgagagccagaaggccaccagagagugcgagaagagcgcccugacccccggcuucagcgacaacgccaucaugcuguucagccccgacuucacccugagaaacacccugaagagcaccagcgaggacagccuggugaagcaggagugcaucaaggaggugguggagaagagagaggccugccacugcgaggaggugaagaugaccguggccagcgaggccaagauccagcugagcgacagcgaggccaagagccacagcagcgccgacgacgccagcgccuggagcaacauccaggaggccccccugcaggacgacagcugccugaacaacgacaucccccacagcaucccccuggagcagggcagcagcugcaacggccccggccagaccaccggccaccccuacuaccugagaagcuuccugguggugcugaagaccgugcuggagaacgaggacgacaugcugcuguucgacgagcaggagaagggcaucgugaccaaguucuaccagcugagcgccaccggccagaagcuguacgugagacuguuccagagaaagcugagcuggaucaagaugaccaagcuggaguacgaggagaucgcccuggaccugacccccgugaucgaggagcugaccaacgccggcuuccugcagaccgagagcgagcugcaggagcugagcgaggugcuggagcugcugagcgcccccgagcugaagagccuggccaagaccuuccaccuggugaaccccaacggccagaagcagcagcugguggacgccuuccugaagcuggccaagcagagaagcgugugcaccuggggcaagaacaagcccggcaucggcgccgugauccugaagagauucugcuggcugcugcugcaguaa

SEQ ID NO: 16939 - RNA, 4368 nt, Artificial Sequence
  FANCA__Homo_sapiens__NP_000126
augagcgacagcugggugcccaacagcgccagcggccaggaccccggcggcagaagaagagccugggccgagcugcuggccggcagagugaagagagagaaguacaaccccgagagagcccagaagcugaaggagagcgccgugagacugcugagaagccaccaggaccugaacgcccugcugcuggagguggagggcccccugugcaagaagcugagccugagcaaggugaucgacugcgacagcagcgaggccuacgccaaccacagcagcagcuucaucggcagcgcccugcaggaccaggccagcagacugggcgugcccgugggcauccugagcgccggcaugguggccagcagcgugggccagaucugcaccgcccccgccgagaccagccaccccgugcugcugaccguggagcagagaaagaagcugagcagccugcuggaguucgcccaguaccugcuggcccacagcauguucagcagacugagcuucugccaggagcuguggaagauccagagcagccugcugcuggaggccguguggcaccugcacgugcagggcaucgugagccugcaggagcugcuggagagccaccccgacaugcacgccgugggcagcuggcuguucagaaaccugugcugccugugcgagcagauggaggccagcugccagcacgccgacguggccagagccaugcugagcgacuucgugcagauguucgugcugagaggcuuccagaagaacagcgaccugagaagaaccguggagcccgagaagaugccccaggugaccguggacgugcugcagagaaugcugaucuucgcccuggacgcccuggccgccggcgugcaggaggagagcagcacccacaagaucgugagaugcugguucggcguguucagcggccacacccugggcagcgugaucagcaccgacccccugaagagauucuucagccacacccugacccagauccugacccacagccccgugcugaaggccagcgacgccgugcagaugcagagagaguggagcuucgccagaacccacccccugcugaccagccuguacagaagacuguucgugaugcugagcgccgaggagcuggugggccaccugcaggaggugcuggagacccaggaggugcacuggcagagagugcugagcuucgugagcgcccugguggugugcuuccccgaggcccagcagcugcuggaggacuggguggccagacugauggcccaggccuucgagagcugccagcuggacagcauggugaccgccuuccugguggugagacaggccgcccuggagggccccagcgccuuccugagcuacgccgacugguucaaggccagcuucggcagcaccagaggcuaccacggcugcagcaagaaggcccugguguuccuguucaccuuccugagcgagcuggugcccuucgagagccccagauaccugcaggugcacauccugcaccccccccuggugcccggcaaguacagaagccugcugaccgacuacaucagccuggccaagaccagacuggccgaccugaaggugagcaucgagaacaugggccuguacgaggaccugagcagcgccggcgacaucaccgagccccacagccaggcccugcaggacguggagaaggccaucaugguguucgagcacaccggcaacauccccgugaccgugauggaggccagcaucuucagaagacccuacuacgugagccacuuccugcccgcccugcugacccccagagugcugcccaaggugcccgacagcagaguggccuucaucgagagccugaagagagccgacaagaucccccccagccuguacagcaccuacugccaggccugcagcgccgccgaggagaagcccgaggacgccgcccugggcgugagagccgagcccaacagcgccgaggagccccugggccagcugaccgccgcccugggcgagcugagagccagcaugaccgaccccagccagagagacgugaucagcgcccagguggccgugaucagcgagagacugagagccgugcugggccacaacgaggacgacagcagcguggagaucagcaagauccagcugagcaucaacacccccagacuggagcccagagagcacauggccguggaccugcugcugaccagcuucugccagaaccugauggccgccagcagcguggccccccccgagagacagggccccugggccgcccuguucgugagaaccaugugcggcagagugcugcccgccgugcugaccagacugugccagcugcugagacaccagggccccagccugagcgccccccacgugcugggccuggccgcccuggccgugcaccugggcgagagcagaagcgcccugcccgagguggacgugggcccccccgcccccggcgccggccugcccgugcccgcccuguucgacagccugcugaccugcagaaccagagacagccuguucuucugccugaaguucugcaccgccgccaucagcuacagccugugcaaguucagcagccagagcagagacacccugugcagcugccugagccccggccugaucaagaaguuccaguuccugauguucagacuguucagcgaggccagacagccccugagcgaggaggacguggccagccugagcuggagaccccugcaccugcccagcgccgacuggcagagagccgcccugagccuguggacccacagaaccuucagagaggugcugaaggaggaggacgugcaccugaccuaccaggacuggcugcaccuggagcuggagauccagcccgaggccgacgcccugagcgacaccgagagacaggacuuccaccagugggccauccacgagcacuuccugcccgagagcagcgccagcggcggcugcgacggcgaccugcaggccgccugcaccauccuggugaacgcccugauggacuuccaccagagcagcagaagcuacgaccacagcgagaacagcgaccugguguucggcggcagaaccggcaacgaggacaucaucagcagacugcaggagaugguggccgaccuggagcugcagcaggaccugaucgugccccugggccacacccccagccaggagcacuuccuguucgagaucuucagaagaagacugcaggcccugaccagcggcuggagcguggccgccagccugcagagacagagagagcugcugauguacaagagaauccugcugagacugcccagcagcgugcugugcggcagcagcuuccaggccgagcagcccaucaccgccagaugcgagcaguucuuccaccuggugaacagcgagaugagaaacuucugcagccacggcggcgcccugacccaggacaucaccgcccacuucuucagaggccugcugaacgccugccugagaagcagagaccccagccugaugguggacuucauccuggccaagugccagaccaagugcccccugauccugaccagcgcccuggugugguggcccagccuggagcccgugcugcugugcagauggagaagacacugccagagcccccugcccagagagcugcagaagcugcaggagggcagacaguucgccagcgacuuccugagccccgaggccgccagccccgcccccaaccccgacuggcugagcgccgccgcccugcacuucgccauccagcaggugagagaggagaacaucagaaagcagcugaagaagcuggacugcgagagagaggagcugcugguguuccuguucuucuucagccugaugggccugcugagcagccaccugaccagcaacagcaccaccgaccugcccaaggccuuccacgugugcgccgccauccuggagugccuggagaagagaaagaucagcuggcuggcccuguuccagcugaccgagagcgaccugagacugggcagacugcugcugagaguggcccccgaccagcacaccagacugcugcccuucgccuucuacagccugcugagcuacuuccacgaggacgccgccaucagagaggaggccuuccugcacguggccguggacauguaccugaagcuggugcagcuguucguggccggcgacaccagcaccgugagcccccccgccggcagaagccuggagcugaagggccagggcaaccccguggagcugaucaccaaggccagacuguuccugcugcagcugauccccagaugccccaagaagagcuucagccacguggccgagcugcuggccgacagaggcgacugcgaccccgaggugagcgccgcccugcagagcagacagcaggccgcccccgacgccgaccugagccaggagccccaccuguucuaa

SEQ ID NO: 16940 - RNA, 2580 nt, Artificial Sequence
  FANCB__Homo_sapiens__NP_001018123
augaccagcaagcaggccaugagcagcaacgagcaggagagacugcugugcuacaacggcgaggugcugguguuccagcugagcaagggcaacuucgccgacaaggagcccaccaagacccccauccugcacgugagaagaaugguguucgacagaggcaccaagguguucgugcagaagagcaccggcuucuucaccaucaaggaggagaacagccaccugaagaucaugugcugcaacugcgugagcgacuucagaaccggcaucaaccugcccuacaucgugaucgagaagaacaagaagaacaacguguucgaguacuuccugcugauccugcacagcaccaacaaguucgagaugagacugagcuucaagcugggcuacgagaugaaggacggccugagagugcugaacggcccccugauccuguggagacacgugaaggccuucuucuucaucagcagccagaccggcaagguggugagcgugagcggcaacuucagcagcauccagugggccggcgagaucgagaaccugggcauggugcugcugggccugaaggagugcugccugagcgaggaggagugcacccaggagcccagcaagagcgacuacgccaucuggaacaccaaguucugcguguacagccuggagagccaggaggugcugagcgacaucuacaucaucccccccgccuacagcagcguggugaccuacgugcacaucugcgccaccgagaucaucaagaaccagcugagaaucagccugaucgcccugaccagaaagaaccagcugaucagcuuccagaacggcacccccaagaacgugugccagcugcccuucggcgaccccugcgccgugcagcugauggacagcggcggcggcaaccuguucuucguggugagcuucaucagcaacaacgccugcgccguguggaaggagagcuuccagguggccgccaagugggagaagcugagccuggugcugaucgacgacuucaucggcagcggcaccgagcaggugcugcugcuguucaaggacagccugaacagcgacugccugaccagcuucaagaucaccgaccugggcaagaucaacuacagcagcgagcccagcgacugcaacgaggacgaccuguucgaggacaagcaggagaacagauaccugguggugcccccccuggagaccggccugaaggugugcuucagcagcuucagagagcugagacagcaccugcugcugaaggagaagaucaucagcaagagcuacaaggcccugaucaaccuggugcagggcaaggacgacaacaccagcagcgccgaggagaaggagugccuggugccccugugcggcgaggaggagaacagcgugcacauccuggacgagaagcugagcgacaacuuccaggacagcgagcagcugguggagaagaucugguacagagugaucgacgacagccugguggugggcgugaagaccaccagcagccugaagcugagccugaacgacgugacccugagccugcugauggaccaggcccacgacagcagauucagacugcugaagugccagaacagagugaucaagcugagcaccaaccccuuccccgcccccuaccugaugcccugcgagaucggccuggaggccaagagagugacccugacccccgacagcaagaaggaggagagcuucgugugcgagcaccccagcaagaaggagugcgugcagaucaucaccgccgugaccagccugagcccccugcugaccuucagcaaguucugcugcaccgugcugcugcagaucauggagagagagagcggcaacugccccaaggacagauacguggugugcggcagaguguuccugagccuggaggaccugagcaccggcaaguaccugcugaccuuccccaagaagaagcccaucgagcacauggaggaccuguucgcccugcuggccgccuuccacaagagcugcuuccagaucaccagccccggcuacgcccugaacagcaugaagguguggcugcuggagcacaugaagugcgagaucaucaaggaguuccccgagguguacuucugcgagagacccggcagcuucuacggcacccuguucaccuggaagcagagaacccccuucgagggcauccugaucaucuacagcagaaaccagaccgugauguuccagugccugcacaaccugaucagaauccugcccaucaacugcuuccugaagaaccugaagagcggcagcgagaacuuccugaucgacaacauggccuucacccuggagaaggagcuggugacccugagcagccugagcagcgccaucgccaagcacgagagcaacuucaugcagagaugcgaggugagcaagggcaagagcagcgugguggccgccgcccugagcgacagaagagagaacauccaccccuacagaaaggagcugcagagagagaagaagaagaugcugcagaccaaccugaaggugagcggcgcccuguacagagagaucacccugaagguggccgaggugcagcugaagagcgacuucgccgcccagaagcugagcaaccuguaa

SEQ ID NO: 16941 - RNA, 1677 nt, Artificial Sequence
  FANCC__Homo_sapiens__NP_001230672
auggcccaggacagcguggaccugagcugcgacuaccaguucuggaugcagaagcugagcgugugggaccaggccagcacccuggagacccagcaggacaccugccugcacguggcccaguuccaggaguuccugagaaagauguacgaggcccugaaggagauggacagcaacaccgugaucgagagauuccccaccaucggccagcugcuggccaaggccugcuggaaccccuucauccuggccuacgacgagagccagaagauccugaucuggugccugugcugccugaucaacaaggagccccagaacagcggccagagcaagcugaacagcuggauccagggcgugcugagccacauccugagcgcccugagauucgacaaggagguggcccuguucacccagggccugggcuacgcccccaucgacuacuaccccggccugcugaagaacauggugcugagccuggccagcgagcugagagagaaccaccugaacggcuucaacacccagagaagaauggcccccgagagaguggccagccugagcagagugugcgugccccugaucacccugaccgacguggacccccugguggaggcccugcugaucugccacggcagagagccccaggagauccugcagcccgaguucuucgaggccgugaacgaggccauccugcugaagaagaucagccugcccaugagcgccguggugugccuguggcugagacaccugcccagccuggagaaggccaugcugcaccuguucgagaagcugaucagcagcgagagaaacugccugagaagaaucgagugcuucaucaaggacagcagccugccccaggccgccugccaccccgccaucuucagagugguggacgagauguucagaugcgcccugcuggagaccgacggcgcccuggagaucaucgccaccauccagguguucacccagugcuucguggaggcccuggagaaggccagcaagcagcugagauucgcccugaagaccuacuuccccuacaccagccccagccuggccauggugcugcugcaggacccccaggacauccccagaggccacuggcugcagacccugaagcacaucagcgagcugcugagagaggccguggaggaccagacccacggcagcugcggcggccccuucgagagcugguuccuguucauccacuucggcggcugggccgagaugguggccgagcagcugcugaugagcgccgccgagccccccaccgcccugcuguggcugcuggccuucuacuacggccccagagacggcagacagcagagagcccagaccauggugcaggugaaggccgugcugggccaccugcuggccaugagcagaagcagcagccugagcgcccaggaccugcagaccguggccggccagggcaccgacaccgaccugagagcccccgcccagcagcugaucagacaccugcugcugaacuuccugcugugggcccccggcggccacaccaucgccugggacgugaucacccugauggcccacaccgccgagaucacccacgagaucaucggcuuccuggaccagacccuguacagauggaacagacugggcaucgagagccccagaagcgagaagcuggccagagagcugcugaaggagcugagaacccagguguaa

SEQ ID NO: 16942 - RNA, 4356 nt, Artificial Sequence
  FANCD2__Homo_sapiens__NP_001018125
auggugagcaagagaagacugagcaagagcgaggacaaggagagccugaccgaggacgccagcaagaccagaaagcagccccugagcaagaagaccaagaagagccacaucgccaacgagguggaggagaacgacagcaucuucgugaagcugcugaagaucagcggcaucauccugaagaccggcgagagccagaaccagcuggccguggaccagaucgccuuccagaagaagcuguuccagacccugagaagacaccccagcuaccccaagaucaucgaggaguucgugagcggccuggagagcuacaucgaggacgaggacagcuucagaaacugccugcugagcugcgagagacugcaggacgaggaggccagcaugggcgccagcuacagcaagagccugaucaagcugcugcugggcaucgacauccugcagcccgccaucaucaagacccuguucgagaagcugcccgaguacuucuucgagaacaagaacagcgacgagaucaacauccccagacugaucgugagccagcugaaguggcuggacagagugguggacggcaaggaccugaccaccaagaucaugcagcugaucagcaucgcccccgagaaccugcagcacgacaucaucaccagccugcccgagauccugggcgacagccagcacgccgacgugggcaaggagcugagcgaccugcugaucgagaacaccagccugaccgugcccauccuggacgugcugagcagccugagacuggaccccaacuuccugcugaaggugagacagcuggugauggacaagcugagcagcaucagacuggaggaccugcccgugaucaucaaguucauccugcacagcgugaccgccauggacacccuggaggugaucagcgagcugagagagaagcuggaccugcagcacugcgugcugcccagcagacugcaggccagccaggugaagcugaagagcaagggcagagccagcagcagcggcaaccaggagagcagcggccagagcugcaucauccugcuguucgacgugaucaagagcgccaucagauacgagaagaccaucagcgaggccuggaucaaggccaucgagaacaccgccagcgugagcgagcacaagguguucgaccuggugaugcuguucaucaucuacagcaccaacacccagaccaagaaguacaucgacagagugcugagaaacaagaucagaagcggcugcauccaggagcagcugcugcagagcaccuucagcgugcacuaccuggugcugaaggacaugugcagcagcauccugagccuggcccagagccugcugcacagccuggaccagagcaucaucagcuucggcagccugcuguacaaguacgccuucaaguucuucgacaccuacugccagcaggagguggugggcgcccuggugacccacaucugcagcggcaacgaggccgagguggacaccgcccuggacgugcugcuggagcugguggugcugaaccccagcgccaugaugaugaacgccguguucgugaagggcauccuggacuaccuggacaacaucagcccccagcagaucagaaagcuguucuacgugcugagcacccuggccuucagcaagcagaacgaggccagcagccacauccaggacgacaugcaccuggugaucagaaagcagcugagcagcaccguguucaaguacaagcugaucggcaucaucggcgccgugaccauggccggcaucauggccgccgacagaagcgagagccccagccugacccaggagagagccaaccugagcgacgagcagugcacccaggugaccagccugcugcagcuggugcacagcugcagcgagcagagcccccaggccagcgcccuguacuacgacgaguucgccaaccugauccagcacgagaagcuggaccccaaggcccuggagugggugggccacaccaucugcaacgacuuccaggacgccuucgugguggacagcugcguggugcccgagggcgacuuccccuuccccgugaaggcccuguacggccuggaggaguacgacacccaggacggcaucgccaucaaccugcugccccugcuguucagccaggacuucgccaaggacggcggccccgugaccagccaggagagcggccagaagcuggugagcccccugugccuggcccccuacuucagacugcugagacugugcguggagagacagcacaacggcaaccuggaggagaucgacggccugcuggacugccccaucuuccugaccgaccuggagcccggcgagaagcuggagagcaugagcgccaaggagagaagcuucaugugcagccugaucuuccugacccugaacugguucagagagaucgugaacgccuucugccaggagaccagccccgagaugaagggcaaggugcugaccagacugaagcacaucguggagcugcagaucauccuggagaaguaccuggccgugacccccgacuacgugcccccccugggcaacuucgacguggagacccuggacaucaccccccacaccgugaccgccaucagcgccaagaucagaaagaagggcaagaucgagagaaagcagaagaccgacggcagcaagaccagcagcagcgacacccugagcgaggagaagaacagcgagugcgaccccacccccagccacagaggccagcugaacaaggaguucaccggcaaggaggagaagaccagccugcugcugcacaacagccacgccuucuucagagagcuggacaucgagguguucagcauccugcacugcggccuggugaccaaguucauccuggacaccgagaugcacaccgaggccaccgagguggugcagcugggcccccccgagcugcuguuccugcuggaggaccugagccagaagcuggagagcaugcugaccccccccaucgccagaagagugcccuuccugaagaacaagggcagcagaaacaucggcuucagccaccugcagcagagaagcgcccaggagaucgugcacugcguguuccagcugcugacccccaugugcaaccaccuggagaacauccacaacuacuuccagugccuggccgccgagaaccacggcgugguggacggccccggcgugaaggugcaggaguaccacaucaugagcagcugcuaccagagacugcugcagaucuuccacggccuguucgccuggagcggcuucagccagcccgagaaccagaaccugcuguacagcgcccugcacgugcugagcagcagacugaagcagggcgagcacagccagccccuggaggagcugcugagccagagcgugcacuaccugcagaacuuccaccagagcauccccagcuuccagugcgcccuguaccugaucagacugcugauggugauccuggagaagagcaccgccagcgcccagaacaaggagaagaucgccagccuggccagacaguuccugugcagaguguggcccagcggcgacaaggagaagagcaacaucagcaacgaccagcugcacgcccugcugugcaucuaccuggagcacaccgagagcauccugaaggccaucgaggagaucgccggcgugggcgugcccgagcugaucaacagccccaaggacgccagcagcagcaccuuccccacccugaccagacacaccuucgugguguucuucagagugaugauggccgagcuggagaagaccgugaagaagaucgagcccggcaccgccgccgacagccagcagauccacgaggagaagcugcuguacuggaacauggccgugagagacuucagcauccugaucaaccugaucaagguguucgacagccaccccgugcugcacgugugccugaaguacggcagacuguucguggaggccuuccugaagcagugcaugccccugcuggacuucagcuucagaaagcacagagaggacgugcugagccugcuggagaccuuccagcuggacaccagacugcugcaccaccugugcggccacagcaagauccaccaggacaccagacugacccagcacgugccccugcugaagaagacccuggagcugcuggugugcagagugaaggccaugcugacccugaacaacugcagagaggccuucuggcugggcaaccugaagaacagagaccugcagggcgaggagaucaagagccagaacagccaggagagcaccgccgacgagagcgaggacgacaugagcagccaggccagcaagagcaaggccaccgaggacggcgaggaggacgaggugagcgccggcgagaaggagcaggacagcgacgagagcuacgacgacagcgacuaa

SEQ ID NO: 16943 - RNA, 1611 nt, Artificial Sequence
  FANCE__Homo_sapiens__NP_068741
auggccacccccgacgccggccugcccggcgccgagggcguggagcccgcccccugggcccagcuggaggcccccgccagacugcugcugcaggcccugcaggccggccccgagggcgccagaagaggccugggcgugcugagagcccugggcagcagaggcugggagcccuucgacuggggcagacugcuggaggcccugugcagagaggagcccguggugcagggccccgacggcagacuggagcugaagccccugcugcugagacugcccagaaucugccagagaaaccugaugagccugcugauggccgugagacccagccugcccgagagcggccugcugagcgugcugcagaucgcccagcaggaccuggcccccgaccccgacgccuggcugagagcccugggcgagcugcugagaagagaccugggcgugggcaccagcauggagggcgccagcccccugagcgagagaugccagagacagcugcagagccugugcagaggccugggccugggcggcagaagacugaagagcccccaggcccccgaccccgaggaggaggagaacagagacagccagcagcccggcaagagaagaaaggacagcgaggaggaggccgccagccccgagggcaagagagugcccaagagacugagaugcugggaggaggaggaggaccacgagaaggagagacccgagcacaagagccuggagagccuggccgacggcggcagcgccagccccaucaaggaccagcccgugauggccgugaagaccggcgaggacggcagcaaccuggacgacgccaagggccuggccgagagccuggagcugcccaaggccauccaggaccagcugcccagacugcagcagcugcugaagacccuggaggagggccuggagggccuggaggacgccccccccguggagcugcagcugcugcacgagugcagccccagccagauggaccugcugugcgcccagcugcagcugccccagcugagcgaccugggccugcugagacugugcaccuggcugcuggcccugagccccgaccugagccugagcaacgccaccgugcugaccagaagccuguuccugggcagaauccugagccugaccagcagcgccagcagacugcugaccaccgcccugaccagcuucugcgccaaguacaccuaccccgugugcagcgcccugcuggaccccgugcugcaggcccccggcaccggccccgcccagaccgagcugcugugcugccuggugaagauggagagccuggagcccgacgcccaggugcugaugcugggccagauccuggagcugcccuggaaggaggagaccuuccuggugcugcagagccugcuggagagacagguggagaugacccccgagaaguucagcgugcugauggagaagcugugcaagaagggccuggccgccaccaccagcauggccuacgccaagcugaugcugaccgugaugaccaaguaccaggccaacaucaccgagacccagagacugggccuggccauggcccuggagcccaacaccaccuuccugagaaagagccugaaggccgcccugaagcaccugggccccuaa

SEQ ID NO: 16944 - RNA, 1125 nt, Artificial Sequence
  FANCF__Homo_sapiens__NP_073562
auggagagccugcugcagcaccuggacagauucagcgagcugcuggccgugagcagcaccaccuacgugagcaccugggaccccgccaccgugagaagagcccugcagugggccagauaccugagacacauccacagaagauucggcagacacggccccaucagaaccgcccuggagagaagacugcacaaccaguggagacaggagggcggcuucggcagaggccccgugcccggccuggccaacuuccaggcccugggccacugcgacgugcugcugagccugagacugcuggagaacagagcccugggcgacgccgccagauaccaccuggugcagcagcuguuccccggccccggcgugagagacgccgacgaggagacccugcaggagagccuggccagacuggccagaagaagaagcgccgugcacaugcugagauucaacggcuacagagagaaccccaaccugcaggaggacagccugaugaagacccaggccgagcugcugcuggagagacugcaggaggugggcaaggccgaggccgagagacccgccagauuccugagcagccugugggagagacugccccagaacaacuuccugaaggugaucgccguggcccugcugcagcccccccugagcagaagaccccaggaggagcuggagcccggcauccacaagagccccggcgagggcagccaggugcuggugcacuggcugcugggcaacagcgagguguucgccgccuucugcagagcccugcccgccggccugcugacccuggugaccagcagacaccccgcccugagccccguguaccugggccugcugaccgacuggggccagagacugcacuacgaccugcagaagggcaucugggugggcaccgagagccaggacgugcccugggaggagcugcacaacagauuccagagccugugccaggccccccccccccugaaggacaaggugcugaccgcccuggagaccugcaaggcccaggacggcgacuucgaggugcccggccugagcaucuggaccgaccugcugcuggcccugagaagcggcgccuucagaaagagacaggugcugggccugagcgccggccugagcagcguguaa

SEQ ID NO: 16945 - RNA, 1869 nt, Artificial Sequence
  FANCG__Homo_sapiens__NP_004620
augagcagacagaccaccagcgugggcagcagcugccuggaccuguggagagagaagaacgacagacuggugagacaggccaagguggcccagaacagcggccugacccugagaagacagcagcuggcccaggacgcccuggagggccugagaggccugcugcacagccugcagggccugcccgccgccgugcccgugcugccccuggagcugaccgugaccugcaacuucaucauccugagagccagccuggcccagggcuucaccgaggaccaggcccaggacauccagagaagccuggagagagugcuggagacccaggagcagcagggccccagacuggagcagggccugagagagcugugggacagcgugcugagagccagcugccugcugcccgagcugcugagcgcccugcacagacuggugggccugcaggccgcccuguggcugagcgccgacagacugggcgaccuggcccugcugcuggagacccugaacggcagccagagcggcgccagcaaggaccugcugcugcugcugaagaccuggagcccccccgccgaggagcuggacgccccccugacccugcaggacgcccagggccugaaggacgugcugcugaccgccuucgccuacagacagggccugcaggagcugaucaccggcaaccccgacaaggcccugagcagccugcacgaggccgccagcggccugugccccagacccgugcuggugcagguguacaccgcccugggcagcugccacagaaagaugggcaacccccagagagcccugcuguaccugguggccgcccugaaggagggcagcgccuggggccccccccugcuggaggccagcagacuguaccagcagcugggcgacaccaccgccgagcuggagagccuggagcugcugguggaggcccugaacgugcccugcagcagcaaggccccccaguuccugaucgagguggagcugcugcugcccccccccgaccuggccagcccccugcacugcggcacccagagccagaccaagcacauccuggccagcagaugccugcagaccggcagagccggcgacgccgccgagcacuaccuggaccugcuggcccugcugcuggacagcagcgagcccagauucagccccccccccagcccccccggccccugcaugcccgagguguuccuggaggccgccguggcccugauccaggccggcagagcccaggacgcccugacccugugcgaggagcugcugagcagaaccagcagccugcugcccaagaugagcagacugugggaggacgccagaaagggcaccaaggagcugcccuacugcccccugugggugagcgccacccaccugcugcagggccaggccugggugcagcugggcgcccagaagguggccaucagcgaguucagcagaugccuggagcugcuguucagagccacccccgaggagaaggagcagggcgccgccuucaacugcgagcagggcugcaagagcgacgccgcccugcagcagcugagagccgccgcccugaucagcagaggccuggaguggguggccagcggccaggacaccaaggcccugcaggacuuccugcugagcgugcagaugugccccggcaacagagacaccuacuuccaccugcugcagacccugaagagacuggacagaagagacgaggccaccgcccugugguggagacuggaggcccagaccaagggcagccacgaggacgcccuguggagccugccccuguaccuggagagcuaccugagcuggaucagacccagcgacagagacgccuuccuggaggaguucagaaccagccugcccaagagcugcgaccuguaa

SEQ ID NO: 16946 - RNA, 3987 nt, Artificial Sequence
  FANCI__Homo_sapiens__NP_001106849
auggaccagaagauccugagccuggccgccgagaagaccgccgacaagcugcaggaguuccugcagacccugagagagggcgaccugaccaaccugcugcagaaccaggccgugaagggcaagguggccggcgcccugcugagagccaucuucaagggcagccccugcagcgaggaggccggcacccugagaagaagaaagaucuacaccugcugcauccagcugguggagagcggcgaccugcagaaggagaucgccagcgagaucaucggccugcugaugcuggaggcccaccacuuccccggcccccugcugguggagcuggccaacgaguucaucagcgccgugagagagggcagccuggugaacggcaagagccuggagcugcugcccaucauccugaccgcccuggccaccaagaaggagaaccuggccuacggcaagggcgugcugagcggcgaggagugcaagaagcagcugaucaacacccugugcagcggcagaugggaccagcaguacgugauccagcugaccagcauguucaaggacgugccccugaccgccgaggagguggaguucgugguggagaaggcccugagcauguucagcaagaugaaccugcaggagauccccccccugguguaccagcugcuggugcugagcagcaagggcagcagaaagagcgugcuggagggcaucaucgccuucuucagcgcccuggacaagcagcacaacgaggagcagagcggcgacgagcugcuggacguggugaccgugcccagcggcgagcugagacacguggagggcaccaucauccugcacaucguguucgccaucaagcuggacuacgagcugggcagagagcuggugaagcaccugaaggugggccagcagggcgacagcaacaacaaccugagccccuucagcaucgcccugcugcugagcgugaccagaauccagagauuccaggaccaggugcuggaccugcugaagaccagcguggugaagagcuucaaggaccugcagcugcugcagggcagcaaguuccugcagaaccuggugccccacagaagcuacgugagcaccaugauccuggagguggugaagaacagcgugcacagcugggaccacgugacccagggccugguggagcugggcuucauccugauggacagcuacggccccaagaaggugcuggacggcaagaccaucgagaccagccccagccugagcagaaugcccaaccagcacgccugcaagcugggcgccaacauccugcuggagaccuucaagauccacgagaugaucagacaggagauccuggagcaggugcugaacagaguggugaccagagccagcagccccaucagccacuuccuggaccugcugagcaacaucgugauguacgccccccuggugcugcagagcugcagcagcaaggugaccgaggccuucgacuaccugagcuuccugccccugcagaccgugcagagacugcugaaggccgugcagccccugcugaaggugagcaugagcaugagagacugccugauccuggugcugagaaaggccauguucgccaaccagcuggacgccagaaagagcgccguggccggcuuccugcugcugcugaagaacuucaaggugcugggcagccugagcagcagccagugcagccagagccugagcgugagccaggugcacguggacgugcacagccacuacaacagcguggccaacgagaccuucugccuggagaucauggacagccugagaagaugccugagccagcaggccgacgugagacugaugcuguacgagggcuucuacgacgugcugagaagaaacagccagcuggccaacagcgugaugcagacccugcugagccagcugaagcaguucuacgagcccaagcccgaccugcugcccccccugaagcuggaggccugcauccugacccagggcgacaagaucagccugcaggagccccuggacuaccugcugugcugcauccagcacugccuggccugguacaagaacaccgugaucccccugcagcagggcgaggaggaggaggaggaggaggaggccuucuacgaggaccuggacgacauccuggagagcaucaccaacagaaugaucaagagcgagcuggaggacuucgagcuggacaagagcgccgacuucagccagagcaccagcaucggcaucaagaacaacaucugcgccuuccuggugaugggcgugugcgaggugcugaucgaguacaacuucagcaucagcagcuucagcaagaacagauucgaggacauccugagccuguucaugugcuacaagaagcugagcgacauccugaacgagaaggccggcaaggccaagaccaagauggccaacaagaccagcgacagccugcugagcaugaaguucgugagcagccugcugaccgcccuguucagagacagcauccagagccaccaggagagccugagcgugcugagaagcagcaacgaguucaugagauacgccgugaacguggcccugcagaaggugcagcagcugaaggagaccggccacgugagcggccccgacggccagaaccccgagaagaucuuccagaaccugugcgacaucaccagagugcugcuguggagauacaccagcauccccaccagcguggaggagagcggcaagaaggagaagggcaagagcaucagccugcugugccuggagggccugcagaagaucuucagcgccgugcagcaguucuaccagcccaagauccagcaguuccugagagcccuggacgugaccgacaaggagggcgaggagagagaggacgccgacgugagcgugacccagagaaccgccuuccagaucagacaguuccagagaagccugcugaaccugcugagcagccaggaggaggacuucaacagcaaggaggcccugcugcuggugaccgugcugaccagccugagcaagcugcuggagcccagcagcccccaguucgugcagaugcugagcuggaccagcaagaucugcaaggagaacagcagagaggacgcccuguucugcaagagccugaugaaccugcuguucagccugcacgugagcuacaagagccccgugauccugcugagagaccugagccaggacauccacggccaccugggcgacaucgaccaggacguggagguggagaagaccaaccacuucgccaucgugaaccugagaaccgccgcccccaccgugugccugcuggugcugagccaggccgagaaggugcuggaggagguggacuggcugaucaccaagcugaagggccaggugagccaggagacccugagcgaggaggccagcagccaggccacccugcccaaccagcccguggagaaggccaucaucaugcagcugggcacccugcugaccuucuuccacgagcuggugcagaccgcccugcccagcggcagcugcguggacacccugcugaaggaccugugcaagauguacaccacccugaccgcccuggugagauacuaccugcaggugugccagagcagcggcggcauccccaagaacauggagaagcuggugaagcugagcggcagccaccugaccccccugugcuacagcuucaucagcuacgugcagaacaagagcaagagccugaacuacaccggcgagaagaaggagaagcccgccgccguggccaccgccauggccagagugcugagagagaccaagcccauccccaaccugaucuucgccaucgagcaguacgagaaguuccugauccaccugagcaagaagagcaaggugaaccugaugcagcacaugaagcugagcaccagcagagacuucaagaucaagggcaacauccuggacauggugcugagagaggacggcgaggacgagaacgaggagggcaccgccagcgagcacggcggccagaacaaggagcccgccaagaagaagagaaagaaguaa

SEQ ID NO: 16947 - RNA, 1143 nt, Artificial Sequence
  FANCL__Homo_sapiens__NP_001108108
auggccgugaccgaggccagccugcugagacagugcccccugcugcugccccagaacagaagcaagaccguguacgagggcuucaucagcgcccagggcagagacuuccaccugagaaucgugcugcccgaggaccugcagcugaagaacgccagacugcugugcagcuggcagcugagaaccauccugagcggcuaccacagaaucgugcagcagagaaugcagcacagccccgaccugaugagcuucaugauggagcugaagaugcugcuggagguggcccugaagaacagacaggagcuguacgcccugcccccccccccccaguucuacagcagccugaucgaggagaucggcacccugggcugggacaagcugguguacgccgacaccugcuucagcaccaucaagcugaaggccgaggacgccagcggcagagagcaccugaucacccugaagcugaaggccaaguaccccgccgagagccccgacuacuucguggacuuccccgugcccuucugcgccagcuggaccccccaggugaacagcccccagagcagccugaucagcaucuacagccaguuccuggccgccaucgagagccugaaggccuucugggacgugauggacgagaucgacgagaagaccugggugcuggagcccgagaagccccccagaagcgccaccgccagaagaaucgcccugggcaacaacgugagcaucaacaucgagguggaccccagacaccccaccaugcugcccgagugcuucuuccugggcgccgaccacguggugaagccccugggcaucaagcugagcagaaacauccaccugugggaccccgagaacagcgugcugcagaaccugaaggacgugcuggagaucgacuuccccgccagagccauccuggagaagagcgacuucaccauggacugcggcaucugcuacgccuaccagcuggacggcaccauccccgaccaggugugcgacaacagccagugcggccagcccuuccaccagaucugccuguacgaguggcugagaggccugcugaccagcagacagagcuucaacaucaucuucggcgagugccccuacugcagcaagcccaucacccugaagaugagcggcagaaagcacuaa

SEQ ID NO: 16948 - RNA, 6147 nt, Artificial Sequence
  FANCM__Homo_sapiens__NP_065988
augagcggcagacagagaacccuguuccagaccuggggcagcagcaucagcagaagcagcggcacccccggcugcagcagcggcaccgagagaccccagagccccggcagcagcaaggccccccugcccgccgccgccgaggcccagcuggagagcgacgacgacgugcugcugguggccgccuacgaggccgagagacagcugugccuggagaacggcggcuucugcaccagcgccggcgcccuguggaucuaccccaccaacugccccgugagagacuaccagcugcacaucagcagagccgcccuguucugcaacacccuggugugccugcccaccggccugggcaagaccuucaucgccgccguggugauguacaacuucuacagaugguuccccagcggcaaggugguguucauggcccccaccaagccccuggugacccagcagaucgaggccugcuaccaggugaugggcaucccccagagccacauggccgagaugaccggcagcacccaggccagcaccagaaaggagaucuggugcagcaagagagugcuguuccugaccccccaggugauggugaacgaccugagcagaggcgccugccccgccgccgagaucaagugccuggugaucgacgaggcccacaaggcccugggcaacuacgccuacugccagguggugagagagcuggugaaguacaccaaccacuucagaauccuggcccugagcgccacccccggcagcgacaucaaggccgugcagcaggugaucaccaaccugcugaucggccagaucgagcugagaagcgaggacagccccgacauccugaccuacagccacgagagaaagguggagaagcugaucgugccccugggcgaggagcuggccgccauccagaagaccuacauccagauccuggagagcuucgccagaagccugauccagagaaacgugcugaugagaagagacauccccaaccugaccaaguaccagaucauccuggccagagaccaguucagaaagaaccccagccccaacaucgugggcauccagcagggcaucaucgagggcgaguucgccaucugcaucagccuguaccacggcuacgagcugcugcagcagaugggcaugagaagccuguacuucuuccugugcggcaucauggacggcaccaagggcaugaccagaagcaagaacgagcugggcagaaacgaggacuucaugaagcuguacaaccaccuggagugcauguucgccagaaccagaagcaccagcgccaacggcaucagcgccauccagcagggcgacaagaacaagaaguucguguacagccaccccaagcugaagaagcuggaggagguggugaucgagcacuucaagagcuggaacgccgagaacaccaccgagaagaagagagacgagaccagagugaugaucuucagcagcuucagagacagcgugcaggagaucgccgagaugcugagccagcaccagcccaucaucagagugaugaccuucgugggccacgccagcggcaagagcaccaagggcuucacccagaaggagcagcuggagguggugaagcaguucagagacggcggcuacaacacccuggugagcaccugcgugggcgaggagggccuggacaucggcgagguggaccugaucaucugcuucgacagccagaagagccccaucagacuggugcagagaaugggcagaaccggcagaaagagacagggcagaaucgugaucauccugagcgagggcagagaggagagaaucuacaaccagagccagagcaacaagagaagcaucuacaaggccaucagcagcaacagacaggugcugcacuucuaccagagaagccccagaauggugcccgacggcaucaaccccaagcugcacaagauguucaucacccacggcguguacgagcccgagaagcccagcagaaaccugcagagaaagagcagcaucuucagcuacagagacggcaugagacagagcagccugaagaaggacugguuccugagcgaggaggaguucaagcuguggaacagacuguacagacugagagacagcgacgagaucaaggagaucacccugccccaggugcaguucagcagccugcagaacgaggagaacaagcccgcccaggagagcaccaccggcauccaccagcugagccugagcgaguggagacuguggcaggaccacccccugcccacccaccagguggaccacagcgacagaugcagacacuucaucggccugaugcagaugaucgagggcaugagacacgaggagggcgagugcagcuacgagcuggagguggagagcuaccugcagauggaggacgugaccagcaccuucaucgcccccagaaacgagagcaacaaccuggccagcgacaccuucaucacccacaagaagagcagcuucaucaagaacaucaaccagggcagcagcagcagcgugaucgagagcgacgaggagugcgccgagaucgugaagcagacccacaucaagcccaccaagaucgugagccugaagaagaaggugagcaaggagaucaagaaggaccagcugaagaaggagaacaaccacggcaucaucgacagcguggacaacgacagaaacagcaccguggagaacaucuuccaggaggaccugcccaacgacaagagaaccagcgacaccgacgagaucgccgccaccugcaccaucaacgagaacgugaucaaggagcccugcgugcugcugaccgagugccaguucaccaacaagagcaccagcagccuggccggcaacgugcuggacagcggcuacaacagcuucaacgacgagaagagcgugagcagcaaccuguuccugcccuucgaggaggagcuguacaucgugagaaccgacgaccaguucuacaacugccacagccugaccaaggaggugcuggccaacguggagagauuccugagcuacagcccccccccccugagcggccugagcgaccuggaguacgagaucgccaagggcaccgcccuggagaaccugcuguuccugcccugcgccgagcaccugagaagcgacaagugcaccugccugcugagccacagcgccgugaacagccagcagaaccuggagcugaacagccugaagugcaucaacuaccccagcgagaagagcugccuguacgacauccccaacgacaacaucagcgacgagcccagccugugcgacugcgacgugcacaagcacaaccagaacgagaaccuggugcccaacaacagagugcagauccacagaagccccgcccagaaccuggugggcgagaacaaccacgacguggacaacagcgaccugcccgugcugagcaccgaccaggacgagagccugcugcuguucgaggacgugaacaccgaguucgacgacgugagccugagcccccugaacagcaagagcgagagccugcccgugagcgacaagaccgccaucagcgagaccccccuggugagccaguuccugaucagcgacgagcugcugcuggacaacaacagcgagcugcaggaccagaucaccagagacgccaacagcuucaagagcagagaccagagaggcgugcaggaggagaaggugaagaaccacgaggacaucuucgacugcagcagagaccuguucagcgugaccuucgaccugggcuucugcagccccgacagcgacgacgagauccuggagcacaccagcgacagcaacagaccccuggacgaccuguacggcagauaccuggagaucaaggagaucagcgacgccaacuacgugagcaaccaggcccugauccccagagaccacagcaagaacuucaccagcggcaccgugaucauccccagcaacgaggacaugcagaaccccaacuacgugcaccugccccugagcgccgccaagaacgaggagcugcugagccccggcuacagccaguucagccugcccgugcagaagaaggugaugagcaccccccugagcaagagcaacacccugaacagcuucagcaagaucagaaaggagauccugaagacccccgacagcagcaaggagaaggugaaccugcagagauucaaggaggcccugaacagcaccuucgacuacagcgaguucagccuggagaagagcaagagcagcggccccauguaccugcacaagagcugccacagcguggaggacggccagcugcugaccagcaacgagagcgaggacgacgagaucuucagaagaaaggugaagagagccaagggcaacgugcugaacagccccgaggaccagaagaacagcgagguggacagcccccugcacgccgugaagaagagaagauuccccaucaacagaagcgagcugagcagcagcgacgagagcgagaacuuccccaagcccugcagccagcuggaggacuucaaggugugcaacggcaacgccagaagaggcaucaaggugcccaagagacagagccaccugaagcacguggccagaaaguuccuggacgacgaggccgagcugagcgaggaggacgccgaguacgugagcagcgacgagaacgacgagagcgagaacgagcaggacagcagccugcuggacuuccugaacgacgagacccagcugagccaggccaucaacgacagcgagaugagagccaucuacaugaagagccugagaagccccaugaugaacaacaaguacaagaugauccacaagacccacaagaacaucaacaucuucagccagauccccgagcaggacgagaccuaccuggaggacagcuucugcguggacgaggaggagagcugcaagggccagagcagcgaggaggaggugugcguggacuucaaccugaucaccgacgacugcuucgccaacagcaagaaguacaagaccagaagagccgugaugcugaaggagaugauggagcagaacugcgcccacagcaagaagaagcugagcagaaucauccugcccgacgacagcagcgaggaggagaacaacgugaacgacaagagagagagcaacaucgccgugaaccccagcaccgugaagaagaacaagcagcaggaccacugccugaacagcgugcccagcggcagcagcgcccagagcaaggugagaagcacccccagagugaacccccuggccaagcagagcaagcagaccagccugaaccugaaggacaccaucagcgaggugagcgacuucaagccccagaaccacaacgaggugcagagcaccaccccccccuucaccaccguggacagccagaaggacugcagaaaguuccccgugccccagaaggacggcagcgcccuggaggacagcagcaccagcggcgccagcugcagcaagagcagaccccaccuggccggcacccacaccagccugagacugccccaggagggcaagggcaccugcauccuggugggcggccacgagaucaccagcggccuggaggugaucagcagccugagagccauccacggccugcagguggaggugugcccccugaacggcugcgacuacaucgugagcaacagaauggugguggagagaagaagccagagcgagaugcugaacagcgugaacaagaacaaguucaucgagcagauccagcaccugcagagcauguucgagagaaucugcgugaucguggagaaggacagagagaagaccggcgacaccagcagaauguucagaagaaccaagagcuacgacagccugcugaccacccugaucggcgccggcaucagaauccuguucagcagcugccaggaggagaccgccgaccugcugaaggagcugagccugguggagcagagaaagaacgugggcauccacgugcccaccguggugaacagcaacaagagcgaggcccugcaguucuaccugagcauccccaacaucagcuacaucaccgcccugaacaugugccaccaguucagcagcgugaagagaauggccaacagcagccugcaggagaucagcauguacgcccaggugacccaccagaaggccgaggagaucuacagauacauccacuacguguucgacauccagaugcugcccaacgaccugaaccaggacagacugaagagcgacaucuaa

SEQ ID NO: 16949 - RNA, 1038 nt, Artificial Sequence
  FANK1__Homo_sapiens__NP_660278
auggagccccagaagaucaugccccccagcaagccccacccccccguggugggcaaggugacccaccacagcaucgagcuguacugggaccuggagaagaaggccaagagacagggcccccaggagcagugguucagauucagcaucgaggaggaggaccccaagaugcacaccuacggcaucaucuacaccggcuacgccaccaagcacgugguggagggccuggagcccagaacccuguacagauucagacugaaggugaccagccccagcggcgagugcgaguacagcccccuggugagcgugagcaccaccagagagcccaucagcagcgagcaccugcacagagccgugagcgugaacgacgaggaccugcuggugagaauccugcagggcggcagagugaagguggacgugcccaacaaguucggcuucaccgcccugaugguggccgcccagaagggcuacaccagacuggugaagauccuggugagcaacggcaccgacgugaaccugaagaacggcagcggcaaggacagccugaugcuggccugcuacgccggccaccuggacguggugaaguaccugagaagacacggcgccagcuggcaggccagagaccugggcggcugcaccgcccugcacugggccgccgacggcggccacugcagcgugaucgaguggaugaucaaggacggcugcgagguggacgugguggacaccggcagcggcuggaccccccugaugagagugagcgccgugagcggcaaccagagaguggccagccugcugaucgacgccggcgccaacgugaacgugaaggacagaaacggcaagaccccccugaugguggccgugcugaacaaccacgaggagcuggugcagcugcugcuggacaagggcgccgacgccagcgugaagaacgaguucggcaagggcgugcuggagauggccagaguguucgacagacagagcguggugagccugcuggaggagagaaagaagaagcagagacccaagaagagcugcgugugcuaa

SEQ ID NO: 16950 - RNA, 2208 nt, Artificial Sequence
  FAP__Homo_sapiens__NP_001278736
augaagaccugggugaagaucguguucggcguggccaccagcgccgugcuggcccugcuggugaugugcaucgugcugagacccagcagagugcacaacagcgaggagaacaccaugagagcccugacccugaaggacauccugaacggcaccuucagcuacaagaccuucuuccccaacuggaucagcggccaggaguaccugcaccagagcgccgacaacaacaucgugcuguacaacaucgagaccggccagagcuacaccauccugagcaacagaaccaugcuguggagauacagcuacaccgccaccuacuacaucuacgaccugagcaacggcgaguucgugagaggcaacgagcugcccagacccauccaguaccugugcuggagccccgugggcagcaagcuggccuacguguaccagaacaacaucuaccugaagcagagacccggcgacccccccuuccagaucaccuucaacggcagagagaacaagaucuucaacggcauccccgacuggguguacgaggaggagaugcuggccaccaaguacgcccugugguggagccccaacggcaaguuccuggccuacgccgaguucaacgacaccgacauccccgugaucgccuacagcuacuacggcgacgagcaguaccccagaaccaucaacauccccuaccccaaggccggcgccaagaaccccguggugagaaucuucaucaucgacaccaccuaccccgccuacgugggcccccaggaggugcccgugcccgccaugaucgccagcagcgacuacuacuucagcuggcugaccugggugaccgacgagagagugugccugcaguggcugaagagagugcagaacgugagcgugcugagcaucugcgacuucagagaggacuggcagaccugggacugccccaagacccaggagcacaucgaggagagcagaaccggcugggccggcggcuucuucgugagcacccccguguucagcuacgacgccaucagcuacuacaagaucuucagcgacaaggacggcuacaagcacauccacuacaucaaggacaccguggagaacgccauccagaucaccagcggcaagugggaggccaucaacaucuucagagugacccaggacagccuguucuacagcagcaacgaguucgaggaguaccccggcagaagaaacaucuacagaaucagcaucggcagcuacccccccagcaagaagugcgugaccugccaccugagaaaggagagaugccaguacuacaccgccagcuucagcgacuacgccaaguacuacgcccuggugugcuacggccccggcauccccaucagcacccugcacgacggcagaaccgaccaggagaucaagauccuggaggagaacaaggagcuggagaacgcccugaagaacauccagcugcccaaggaggagaucaagaagcuggagguggacgagaucacccugugguacaagaugauccugcccccccaguucgacagaagcaagaaguacccccugcugauccagguguacggcggccccugcagccagagcgugagaagcguguucgccgugaacuggaucagcuaccuggccagcaaggagggcauggugaucgcccugguggacggcagaggcaccgccuuccagggcgacaagcugcuguacgccguguacagaaagcugggcguguacgagguggaggaccagaucaccgccgugagaaaguucaucgagaugggcuucaucgacgagaagagaaucgccaucuggggcuggagcuacggcggcuacgugagcagccuggcccuggccagcggcaccggccuguucaagugcggcaucgccguggcccccgugagcagcugggaguacuacgccagcguguacaccgagagauucaugggccugcccaccaaggacgacaaccuggagcacuacaagaacagcaccgugauggccagagccgaguacuucagaaacguggacuaccugcugauccacggcaccgccgacgacaacgugcacuuccagaacagcgcccagaucgccaaggcccuggugaacgcccagguggacuuccaggccaugugguacagcgaccagaaccacggccugagcggccugagcaccaaccaccuguacacccacaugacccacuuccugaagcagugcuucagccugagcgacuaa

SEQ ID NO: 16951 - RNA, 1548 nt, Artificial Sequence
  FAR1__Homo_sapiens__NP_115604
auggugagcauccccgaguacuacgagggcaagaacgugcugcugaccggcgccaccggcuuccugggcaaggugcugcuggagaagcugcugagaagcugccccaaggugaacagcguguacgugcuggugagacagaaggccggccagaccccccaggagagaguggaggaggugcugagcggcaagcuguucgacagacugagagacgagaaccccgacuucagagagaagaucaucgccaucaacagcgagcugacccagcccaagcuggcccugagcgaggaggacaaggaggugaucaucgacagcaccaacaucaucuuccacugcgccgccaccgugagauucaacgagaaccugagagacgccgugcagcugaacgugaucgccaccagacagcugauccugcuggcccagcagaugaagaaccuggagguguucaugcacgugagcaccgccuacgccuacugcaacagaaagcacaucgacgaggugguguaccccccccccguggaccccaagaagcugaucgacagccuggaguggauggacgacggccuggugaacgacaucacccccaagcugaucggcgacagacccaacaccuacaucuacaccaaggcccuggccgaguacguggugcagcaggagggcgccaagcugaacguggccaucgugagacccagcaucgugggcgccagcuggaaggagcccuuccccggcuggaucgacaacuucaacggccccagcggccuguucaucgccgccggcaagggcauccugagaaccaucagagccagcaacaacgcccuggccgaccuggugcccguggacgugguggugaacaugagccuggccgccgccugguacagcggcgugaacagacccagaaacaucaugguguacaacugcaccaccggcagcaccaaccccuuccacuggggcgagguggaguaccacgugaucagcaccuucaagagaaacccccuggagcaggccuucagaagacccaacgugaaccugaccagcaaccaccugcuguaccacuacuggaucgccgugagccacaaggcccccgccuuccuguacgacaucuaccugagaaugaccggcagaagccccagaaugaugaagaccaucaccagacugcacaaggccaugguguuccuggaguacuucaccagcaacagcuggguguggaacaccgagaacgugaacaugcugaugaaccagcugaaccccgaggacaagaagaccuucaacaucgacgugagacagcugcacugggccgaguacaucgagaacuacugccugggcaccaagaaguacgugcugaacgaggagaugagcggccugcccgccgccagaaagcaccugaacaagcugagaaacaucagauacggcuucaacaccauccuggugauccugaucuggagaaucuucaucgccagaagccagauggccagaaacaucugguacuucguggugagccugugcuacaaguuccugagcuacuucagagccagcagcaccaugagauacuaa

SEQ ID NO: 16952 - RNA, 390 nt, Artificial Sequence
  FARP1__Homo_sapiens__NP_001001715
augggcgagaucgagcagagacccacccccggcagcagacugggcgcccccgagaacagcggcaucagcacccuggagagaggccagaagcccccccccacccccagcggcaagcuggugagcaucaagauccagaugcuggacgacacccaggaggccuucgaggugcccauggugagcagcagcagcuuccugaaggccaccggcagcagcuggaccggcugggugcugagaugcagcaugaagcccaagcaccacagccaccugaucgagaaguucggcgaggacagaauccugacccaccugaccggcagcaucagcuacaccaacugggccggcagcagaagccuggccgugaccgugaccgaggagcugcugaaccuguucuaa

SEQ ID NO: 16953 - RNA, 1944 nt, Artificial Sequence
  FARP2__Homo_sapiens__NP_001269912
augggcgagaucgagggcaccuacagagugcugcagaccgccggcaugagacugggcgcccagacccccgugggcgugagcacccuggagcccggccagacccugcugcccagaaugcaggagaagcaccugcaccugagagugaagcugcuggacaacaccauggagaucuucgacaucgagcccaagugcgacggccaggugcugcugacccagguguggaagagacugaaccugguggagugcgacuacuucggcauggaguuccagaacacccagagcuacuggaucuggcuggagcccaugaagcccaucaucagacagaucagaagacccaagaacguggugcugagacuggccgugaaguucuucccccccgaccccggccagcugcaggaggaguacaccagauaccuguucgcccugcagcugaagagagaccugcuggaggagagacugaccugcgccgacaccaccgccgcccugcugaccagccaccugcugcagagcgagaucggcgacuacgacgagacccuggacagagagcaccugaaggugaacgaguaccugcccggccagcagcacugccuggagaagauccuggaguuccaccagaagcacgugggccagacccccgccgagagcgacuuccaggugcuggagaucgccagaaagcuggagauguacggcaucagauuccacauggccagcgacagagagggcaccaagauccagcuggccgugagccacaugggcgugcugguguuccagggcaccaccaagaucaacaccuucaacuggagcaaggugagaaagcugagcuucaagagaaagagauuccugaucaagcugcaccccgaggugcacggccccuaccaggacacccuggaguuccugcugggcagcagagacgagugcaagaacuucuggaagaucugcguggaguaccacaccuucuucagacugcuggaccagcccaagcccaaggccaaggccguguucuucagcagaggcagcagcuucagauacagcggcagaacccagaagcagcugguggacuacuucaaggacagcggcaugaagagaauccccuacgagagaagacacagcaagacccacaccagcgugagagcccugaccgccgaccugcccaagcagagcaucagcuuccccgagggccugagaacccccgccagccccagcagcgccaacgccuucuacagccugagccccagcacccuggugcccagcggccugcccgaguucaaggacagcagcagcagccugaccgacccccaggugagcuacgugaagagccccgccgccgagagaagaagcggcgccguggccggcggccccgacacccccagcgcccagccccugggcccccccgcccugcagcccggccccggccugagcaccaagagcccccagcccagccccagcagcagaaagagcccccugagccugagccccgccuuccaggugccccugggccccgccgagcagggcagcagcccccugcugagccccgugcugagcgacgccggcggcgccggcauggacugcgaggagcccagacacaagagagugcccgccgacgaggccuacuucaucgugaaggagauccuggccaccgagagaaccuaccugaaggaccuggaggugaucaccgugugguucagaagcgccguggugaaggaggacgccaugcccgccacccugaugacccugcuguucagcaacaucgaccccaucuacgaguuccacagaggcuuccugagagagguggagcagagacuggcccugugggagggccccagcaaggcccacaccaagggcagccaccagagaaucggcgacauccugcugagaaacaugagacagcugaagguguuccagcugcacgagggccacguggccggcgugaccaagauggaguaa

SEQ ID NO: 16954 - RNA, 1356 nt, Artificial Sequence
  FARS2__Homo_sapiens__NP_001305801
auggugggcagcgcccugagaagaggcgcccacgccuacguguaccuggugagcaaggccagccacaucagcagaggccaccagcaccaggccuggggcagcagaccccccgccgccgagugcgccacccagagagcccccggcagcgugguggagcugcugggcaagagcuacccccaggacgaccacagcaaccugaccagaaaggugcugaccagagugggcagaaaccugcacaaccagcagcaccacccccuguggcugaucaaggagagagugaaggagcacuucuacaagcaguacgugggcagauucggcaccccccuguucagcguguacgacaaccugagccccguggugaccaccuggcagaacuucgacagccugcugauccccgccgaccaccccagcagaaagaagggcgacaacuacuaccugaacagaacccacaugcugagagcccacaccagcgcccaccagugggaccugcugcacgccggccuggacgccuuccugguggugggcgacguguacagaagagaccagaucgacagccagcacuaccccaucuuccaccagcuggaggccgugagacuguucagcaagcacgagcuguucgccggcaucaaggacggcgagagccugcagcuguucgagcagagcagcagaagcgcccacaagcaggagacccacaccauggaggccgugaagcugguggaguucgaccugaagcagacccugaccagacugauggcccaccuguucggcgacgagcuggagaucagauggguggacugcuacuuccccuucacccaccccagcuucgagauggagaucaacuuccacggcgaguggcuggaggugcugggcugcggcgugauggagcagcagcuggugaacagcgccggcgcccaggacagaaucggcugggccuucggccugggccuggagagacuggccaugauccuguacgacauccccgacaucagacuguucuggugcgaggacgagagauuccugaagcaguucugcgugagcaacaucaaccagaaggugaaguuccagccccugagcaaguaccccgccgugaucaacgacaucagcuucuggcugcccagcgagaacuacgccgagaacgacuucuacgaccuggugagaaccaucggcggcgaccugguggagaagguggaccugaucgacaaguucgugcaccccaagacccacaagaccagccacugcuacagaaucaccuacagacacauggagagaacccugagccagagagaggugagacacauccaccaggcccugcaggaggccgccgugcagcugcugggcguggagggcagauucuaa

SEQ ID NO: 16955 - RNA, 1527 nt, Artificial Sequence
  FARSA__Homo_sapiens__NP_004452
auggccgacggccagguggccgagcugcugcugagaagacuggaggccagcgacggcggccuggacagcgccgagcuggccgccgagcugggcauggagcaccaggccguggugggcgccgugaagagccugcaggcccugggcgaggugaucgaggccgagcugagaagcaccaagcacugggagcugaccgccgagggcgaggagaucgccagagagggcagccacgaggccagaguguucagaagcaucccccccgagggccuggcccagagcgagcugaugagacugcccagcggcaaggugggcuucagcaaggccaugagcaacaaguggaucagaguggacaagagcgccgccgacggccccagaguguucagagugguggacagcauggaggacgaggugcagagaagacugcagcuggugagaggcggccaggccgagaagcugggcgagaaggagagaagcgagcugagaaagagaaagcugcuggccgaggugacccugaagaccuacugggugagcaagggcagcgccuucagcaccagcaucagcaagcaggagaccgagcugagccccgagaugaucagcagcggcagcuggagagacagacccuucaagcccuacaacuuccuggcccacggcgugcugcccgacagcggccaccugcacccccugcugaaggugagaagccaguucagacagaucuuccuggagaugggcuucaccgagaugcccaccgacaacuucaucgagagcagcuucuggaacuucgacgcccuguuccagccccagcagcaccccgccagagaccagcacgacaccuucuuccugagagaccccgccgaggcccugcagcugcccauggacuacgugcagagagugaagagaacccacagccagggcggcuacggcagccagggcuacaaguacaacuggaagcuggacgaggccagaaagaaccugcugagaacccacaccaccagcgccagcgccagagcccuguacagacuggcccagaagaagcccuucacccccgugaaguacuucagcaucgacagaguguucagaaacgagacccuggacgccacccaccuggccgaguuccaccagaucgagggcgugguggccgaccacggccugacccugggccaccugaugggcgugcugagagaguucuucaccaagcugggcaucacccagcugagauucaagcccgccuacaaccccuacaccgagcccagcauggagguguucagcuaccaccagggccugaagaaguggguggaggugggcaacagcggcguguucagacccgagaugcugcugcccaugggccugcccgagaacgugagcgugaucgccuggggccugagccuggagagacccaccaugaucaaguacggcaucaacaacaucagagagcuggugggccacaaggugaaccugcagaugguguacgacagcccccugugcagacuggacgccgagcccagacccccccccacccaggaggccgccuaa

SEQ ID NO: 16956 - RNA, 1008 nt, Artificial Sequence
  FAS__Homo_sapiens__NP_000034
augcugggcaucuggacccugcugccccuggugcugaccagcguggccagacugagcagcaagagcgugaacgcccaggugaccgacaucaacagcaagggccuggagcugagaaagaccgugaccaccguggagacccagaaccuggagggccugcaccacgacggccaguucugccacaagcccugcccccccggcgagagaaaggccagagacugcaccgugaacggcgacgagcccgacugcgugcccugccaggagggcaaggaguacaccgacaaggcccacuucagcagcaagugcagaagaugcagacugugcgacgagggccacggccuggagguggagaucaacugcaccagaacccagaacaccaagugcagaugcaagcccaacuucuucugcaacagcaccgugugcgagcacugcgaccccugcaccaagugcgagcacggcaucaucaaggagugcacccugaccagcaacaccaagugcaaggaggagggcagcagaagcaaccugggcuggcugugccugcugcugcugcccaucccccugaucgugugggugaagagaaaggaggugcagaagaccugcagaaagcacagaaaggagaaccagggcagccacgagagccccacccugaaccccgagaccguggccaucaaccugagcgacguggaccugagcaaguacaucaccaccaucgccggcgugaugacccugagccaggugaagggcuucgugagaaagaacggcgugaacgaggccaagaucgacgagaucaagaacgacaacgugcaggacaccgccgagcagaaggugcagcugcugagaaacuggcaccagcugcacggcaagaaggaggccuacgacacccugaucaaggaccugaagaaggccaaccugugcacccuggccgagaagauccagaccaucauccugaaggacaucaccagcgacagcgagaacagcaacuucagaaacgagauccagagccugguguaa

SEQ ID NO: 16957 - RNA, 846 nt, Artificial Sequence
  FASLG__Homo_sapiens__NP_000630
augcagcagcccuucaacuaccccuacccccagaucuacuggguggacagcagcgccagcagccccugggccccccccggcaccgugcugcccugccccaccagcgugcccagaagacccggccagagaagaccccccccccccccccccccccccccccugcccccccccccccccccccccccccugcccccccugccccugcccccccugaagaagagaggcaaccacagcaccggccugugccugcuggugauguucuucauggugcugguggcccuggugggccugggccugggcauguuccagcuguuccaccugcagaaggagcuggccgagcugagagagagcaccagccagaugcacaccgccagcagccuggagaagcagaucggccaccccagccccccccccgagaagaaggagcugagaaagguggcccaccugaccggcaagagcaacagcagaagcaugccccuggagugggaggacaccuacggcaucgugcugcugagcggcgugaaguacaagaagggcggccuggugaucaacgagaccggccuguacuucguguacagcaagguguacuucagaggccagagcugcaacaaccugccccugagccacaagguguacaugagaaacagcaaguacccccaggaccuggugaugauggagggcaagaugaugagcuacugcaccaccggccagaugugggccagaagcagcuaccugggcgccguguucaaccugaccagcgccgaccaccuguacgugaacgugagcgagcugagccuggugaacuucgaggagagccagaccuucuucggccuguacaagcuguaa

SEQ ID NO: 16958 - RNA, 7536 nt, Artificial Sequence
  FASN__Homo_sapiens__NP_004095
auggaggagguggugaucgccggcaugagcggcaagcugcccgagagcgagaaccugcaggaguucugggacaaccugaucggcggcguggacauggugaccgacgacgacagaagauggaaggccggccuguacggccugcccagaagaagcggcaagcugaaggaccugagcagauucgacgccagcuucuucggcgugcaccccaagcaggcccacaccauggacccccagcugagacugcugcuggaggugaccuacgaggccaucguggacggcggcaucaaccccgacagccugagaggcacccacaccggcgugugggugggcgugagcggcagcgagaccagcgaggcccugagcagagaccccgagacccuggugggcuacagcauggugggcugccagagagccaugauggccaacagacugagcuucuucuucgacuucagaggccccagcaucgcccuggacaccgccugcagcagcagccugauggcccugcagaacgccuaccaggccauccacagcggccagugccccgccgccaucgugggcggcaucaacgugcugcugaagcccaacaccagcgugcaguuccugagacugggcaugcugagccccgagggcaccugcaaggccuucgacaccgccggcaacggcuacugcagaagcgagggcgugguggccgugcugcugaccaagaagagccuggccagaagaguguacgccaccauccugaacgccggcaccaacaccgacggcuucaaggagcagggcgugaccuuccccagcggcgacauccaggagcagcugaucagaagccuguaccagagcgccggcguggcccccgagagcuucgaguacaucgaggcccacggcaccggcaccaaggugggcgacccccaggagcugaacggcaucaccagagcccugugcgccaccagacaggagccccugcugaucggcagcaccaagagcaacaugggccaccccgagcccgccagcggccuggccgcccuggccaaggugcugcugagccuggagcacggccugugggcccccaaccugcacuuccacagccccaaccccgagauccccgcccugcuggacggcagacugcaggugguggaccagccccugcccgugagaggcggcaacgugggcaucaacagcuucggcuucggcggcagcaacgugcacaucauccugagacccaacacccagcccccccccgcccccgccccccacgccacccugcccagacugcugagagccagcggcagaacccccgaggccgugcagaagcugcuggagcagggccugagacacagccaggaccuggccuuccugagcaugcugaacgacaucgccgccgugcccgccaccgccaugcccuucagaggcuacgccgugcugggcggcgagagaggcggccccgaggugcagcaggugcccgccggcgagagaccccugugguucaucugcagcggcaugggcacccaguggagaggcaugggccugagccugaugagacuggacagauucagagacagcauccugagaagcgacgaggccgugaagcccuucggccugaaggugagccagcugcugcugagcaccgacgagagcaccuucgacgacaucgugcacagcuucgugagccugaccgccauccagaucggccugaucgaccugcugagcugcaugggccugagacccgacggcaucgugggccacagccugggcgagguggccugcggcuacgccgacggcugccugagccaggaggaggccgugcuggccgccuacuggagaggccagugcaucaaggaggcccaccugccccccggcgccauggccgccgugggccugagcugggaggagugcaagcagagaugcccccccggcguggugcccgccugccacaacagcaaggacaccgugaccaucagcggcccccaggcccccguguucgaguucguggagcagcugagaaaggagggcguguucgccaaggaggugagaaccggcggcauggccuuccacagcuacuucauggaggccaucgcccccccccugcugcaggagcugaagaaggugaucagagagcccaagcccagaagcgccagauggcugagcaccagcauccccgaggcccaguggcacagcagccuggccagaaccagcagcgccgaguacaacgugaacaaccuggugagccccgugcuguuccaggaggcccuguggcacgugcccgagcacgccguggugcuggagaucgccccccacgcccugcugcaggccgugcugaagagaggccugaagcccagcugcaccaucaucccccugaugaagaaggaccacagagacaaccuggaguucuuccuggccggcaucggcagacugcaccugagcggcaucgacgccaaccccaacgcccuguucccccccguggaguuccccgcccccagaggcaccccccugaucagcccccugaucaagugggaccacagccuggccugggacgugcccgccgccgaggacuuccccaacggcagcggcagccccagcgccgccaucuacaacaucgacaccagcagcgagagccccgaccacuaccugguggaccacacccuggacggcagagugcuguuccccgccaccggcuaccugagcaucguguggaagacccuggccagagcccugggccugggcguggagcagcugcccgugguguucgaggacguggugcugcaccaggccaccauccugcccaagaccggcaccgugagccuggaggugagacugcuggaggccagcagagccuucgaggugagcgagaacggcaaccugguggugagcggcaagguguaccagugggacgaccccgaccccagacuguucgaccaccccgagagccccacccccaaccccaccgagccccuguuccuggcccaggccgagguguacaaggagcugagacugagaggcuacgacuacggcccccacuuccagggcauccuggaggccagccuggagggcgacagcggcagacugcuguggaaggacaacugggugagcuucauggacaccaugcugcagaugagcauccugggcagcgccaagcacggccuguaccugcccaccagagugaccgccauccacaucgaccccgccacccacagacagaagcuguacacccugcaggacaaggcccagguggccgacgugguggugagcagauggcugagagugaccguggccggcggcgugcacaucagcggccugcacaccgagagcgcccccagaagacagcaggagcagcaggugcccauccuggagaaguucugcuucaccccccacaccgaggagggcugccugagcgagagagccgcccugcaggaggagcugcagcugugcaagggccuggugcaggcccugcagaccaaggugacccagcagggccugaagaugguggugcccggccuggacggcgcccagauccccagagaccccagccagcaggagcugcccagacugcugagcgccgccugcagacugcagcugaacggcaaccugcagcuggagcuggcccaggugcuggcccaggagagacccaagcugcccgaggacccccugcugagcggccugcuggacagccccgcccugaaggccugccuggacaccgccguggagaacaugcccagccugaagaugaaggugguggaggugcuggccggccacggccaccuguacagcagaauccccggccugcugagcccccacccccugcugcagcugagcuacaccgccaccgacagacacccccaggcccuggaggccgcccaggccgagcugcagcagcacgacguggcccagggccagugggaccccgccgaccccgcccccagcgcccugggcagcgccgaccugcuggugugcaacugcgccguggccgcccugggcgaccccgccagcgcccugagcaacaugguggccgcccugagagagggcggcuuccugcugcugcacacccugcugagaggccacccccugggcgacaucguggccuuccugaccagcaccgagccccaguacggccagggcauccugagccaggacgccugggagagccuguucagcagagugagccugagacuggugggccugaagaagagcuucuacggcagcacccuguuccugugcagaagacccaccccccaggacagccccaucuuccugcccguggacgacaccagcuucagauggguggagagccugaagggcauccuggccgacgaggacagcagcagacccguguggcugaaggccaucaacugcgccaccagcggcguggugggccuggugaacugccugagaagagagcccggcggcaacagacugagaugcgugcugcugagcaaccugagcagcaccagccacgugcccgagguggaccccggcagcgccgagcugcagaaggugcugcagggcgaccuggugaugaacguguacagagacggcgccuggggcgccuucagacacuuccugcuggaggaggacaagcccgaggagcccaccgcccacgccuucgugagcacccugaccagaggcgaccugagcagcaucagaugggugugcagcagccugagacacgcccagcccaccugccccggcgcccagcugugcaccguguacuacgccagccugaacuucagagacaucaugcuggccaccggcaagcugagccccgacgccauccccggcaaguggaccagccaggacagccugcugggcauggaguucagcggcagagacgccagcggcaagagagugaugggccuggugcccgccaagggccuggccaccagcgugcugcugagccccgacuuccugugggacgugcccagcaacuggacccuggaggaggccgccagcgugcccgugguguacagcaccgccuacuacgcccugguggugagaggcagagugagacccggcgagacccugcugauccacagcggcagcggcggcgugggccaggccgccaucgccaucgcccugagccugggcugcagaguguucaccaccgugggcagcgccgagaagagagccuaccugcaggccagauucccccagcuggacagcaccagcuucgccaacagcagagacaccagcuucgagcagcacgugcuguggcacaccggcggcaagggcguggaccuggugcugaacagccuggccgaggagaagcugcaggccagcgugagaugccuggccacccacggcagauuccuggagaucggcaaguucgaccugagccagaaccacccccugggcauggccaucuuccugaagaacgugaccuuccacggcgugcugcuggacgccuucuucaacgagagcagcgccgacuggagagaggugugggcccuggugcaggccggcaucagagacggcguggugagaccccugaagugcaccguguuccacggcgcccagguggaggacgccuucagauacauggcccagggcaagcacaucggcaaggugguggugcaggugcuggccgaggagcccgaggccgugcugaagggcgccaagcccaagcugaugagcgccaucagcaagaccuucugccccgcccacaagagcuacaucaucgccggcggccugggcggcuucggccuggagcuggcccaguggcugauccagagaggcgugcagaagcuggugcugaccagcagaagcggcaucagaaccggcuaccaggccaagcaggugagaagauggagaagacagggcgugcaggugcaggugagcaccagcaacaucagcagccuggagggcgccagaggccugaucgccgaggccgcccagcugggccccgugggcggcguguucaaccuggccguggugcugagagacggccugcuggagaaccagacccccgaguucuuccaggacgugugcaagcccaaguacagcggcacccugaaccuggacagagugaccagagaggccugccccgagcuggacuacuucgugguguucagcagcgugagcugcggcagaggcaacgccggccagagcaacuacggcuucgccaacagcgccauggagagaaucugcgagaagagaagacacgagggccugcccggccuggccgugcaguggggcgccaucggcgacgugggcauccugguggagaccaugagcaccaacgacaccaucgugagcggcacccugccccagagaauggccagcugccuggaggugcuggaccuguuccugaaccagccccacauggugcugagcagcuucgugcuggccgagaaggccgccgccuacagagacagagacagccagagagaccugguggaggccguggcccacauccugggcaucagagaccuggccgccgugaaccuggacagcagccuggccgaccugggccuggacagccugaugagcguggaggugagacagacccuggagagagagcugaaccuggugcugagcgugagagaggugagacagcugacccugagaaagcugcaggagcugagcagcaaggccgacgaggccagcgagcuggccugccccacccccaaggaggacggccuggcccagcagcagacccagcugaaccugagaagccugcuggugaaccccgagggccccacccugaugagacugaacagcgugcagagcagcgagagaccccuguuccuggugcaccccaucgagggcagcaccaccguguuccacagccuggccagcagacugagcauccccaccuacggccugcagugcaccagagccgccccccuggacagcauccacagccuggccgccuacuacaucgacugcaucagacaggugcagcccgagggccccuacagaguggccggcuacagcuacggcgccugcguggccuucgagaugugcagccagcugcaggcccagcagagccccgcccccacccacaacagccuguuccuguucgacggcagccccaccuacgugcuggccuacacccagagcuacagagccaagcugacccccggcugcgaggccgaggccgagaccgaggccaucugcuucuucgugcagcaguucaccgacauggagcacaacagagugcuggaggcccugcugccccugaagggccuggaggagagaguggccgccgccguggaccugaucaucaagagccaccagggccuggacagacaggagcugagcuucgccgccagaagcuucuacuacaagcugagagccgccgagcaguacacccccaaggccaaguaccacggcaacgugaugcugcugagagccaagaccggcggcgccuacggcgaggaccugggcgccgacuacaaccugagccaggugugcgacggcaaggugagcgugcacgugaucgagggcgaccacagaacccugcuggagggcagcggccuggagagcaucaucagcaucauccacagcagccuggccgagcccagagugagcgugagagagggcuaa

SEQ ID NO: 16959 - RNA, 2133 nt, Artificial Sequence
  FASTKD2__Homo_sapiens__NP_055744
augcugaccacccugaagcccuucggcagcgugagcguggagagcaagaugaacaacaaggccggcagcuucuucuggaaccugagacaguucagcacccuggugagcaccagcagaaccaugagacugugcugccugggccugugcaagcccaagaucgugcacagcaacuggaacauccugaacaacuuccacaacagaaugcagagcaccgacaucaucagauaccuguuccaggacgccuucaucuucaagagcgacgugggcuuccagaccaagggcaucagcacccugaccgcccugagaaucgagagacugcuguacgccaagagacuguucuucgacagcaagcagagccuggugcccguggacaagagcgacgacgagcugaagaaggugaaccugaaccacgaggugagcaacgaggacgugcugaccaaggagaccaagcccaacagaaucagcagcagaaagcugagcgaggagugcaacagccugagcgacgugcuggacgccuucagcaaggcccccaccuuccccagcagcaacuacuucaccgccauguggaccaucgccaagagacugagcgacgaccagaagagauucgagaagagacugauguucagccaccccgccuucaaccagcugugcgagcacaugaugagagaggccaagaucaugcaguacaaguaccugcuguucagccugcacgccaucgugaagcugggcaucccccagaacaccauccuggugcagacccugcugagagugacccaggagagaaucaacgagugcgacgagaucugccugagcgugcugagcaccgugcuggaggccauggagcccugcaagaacgugcacgugcugagaaccggcuucagaauccugguggaccagcagguguggaagaucgaggacguguucacccugcagguggugaugaagugcaucggcaaggacgcccccaucgcccugaagagaaagcuggagaugaaggcccugagagagcuggacagauucagcgugcugaacagccagcacauguucgaggugcuggccgccaugaaccacagaagccugauccugcuggacgagugcagcaagguggugcuggacaacauccacggcugcccccugagaaucaugaucaacauccugcagagcugcaaggaccugcaguaccacaaccuggaccuguucaagggccuggccgacuacguggccgccaccuucgacaucuggaaguucagaaaggugcuguucauccugauccuguucgagaaccugggcuucagacccgugggccugauggaccuguucaugaagagaaucguggaggaccccgagagccugaacaugaagaacauccugagcauccugcacaccuacagcagccugaaccacguguacaagugccagaacaaggagcaguucguggaggugauggccagcgcccugaccggcuaccugcacaccaucagcagcgagaaccugcuggacgccguguacagcuucugccugaugaacuacuucccccuggcccccuucaaccagcugcugcagaaggacaucaucagcgagcugcugaccagcgacgacaugaagaacgccuacaagcugcacacccuggacaccugccugaagcuggacgacaccguguaccugagagacaucgcccugagccugccccagcugcccagagagcugcccagcagccacaccaacgccaagguggccgaggugcugagcagccugcugggcggcgagggccacuucagcaaggacgugcaccugccccacaacuaccacaucgacuucgagaucagaauggacaccaacagaaaccaggugcugccccugagcgacguggacaccaccagcgccaccgacauccagagaguggccgugcugugcgugagcagaagcgccuacugccugggcagcagccaccccagaggcuuccuggccaugaagaugagacaccugaacgccaugggcuuccacgugauccuggugaacaacugggagauggacaagcuggagauggaggacgccgugaccuuccugaagaccaagaucuacagcguggaggcccugcccguggccgccgugaacgugcagagcacccaguaa

SEQ ID NO: 16960 - RNA, 1569 nt, Artificial Sequence
  FASTK__Homo_sapiens__NP_001245390
augagaagacccagaggcgagcccggccccagagcccccagacccaccgagggcgccaccugcgccggccccggcgagagcuggagccccagccccaacagcaugcugagagugcugcugagcgcccagaccagccccgccagacugagcggccugcugcugaucccccccgugcagcccugcugccugggccccagcaaguggggcgacagacccgugggcggcggccccagcgccggccccgugcagggccugcagagacugcuggagcaggccaagagccccggcgagcugcugagauggcugggccagaaccccagcaaggugagagcccaccacuacagcguggcccugagaagacugggccagcugcugggcagcagacccagacccccccccguggagcaggugacccugcaggaccugagccagcugaucaucagaaacugccccagcuucgacauccacaccauccacgugugccugcaccuggccgugcugcugggcuuccccagcgacggcccccuggugugcgcccuggagcaggagagaagacugagacugccccccaagcccccccccccccugcagccccugcugagagaggccagacccgaggagcugaccccccacgugauggugcugcuggcccagcaccuggccagacacagacugagagagccccagcugcuggaggccaucgcccacuuccugguggugcaggagacccagcugagcagcaagguggugcagaagcuggugcugcccuucggcagacugaacuaccugccccuggagcagcaguucaugcccugccuggagagaauccuggccagagaggccggcguggccccccuggccaccgugaacauccugaugagccugugccagcugagaugccugcccuucagagcccugcacuucguguucagccccggcuucaucaacuacaucagcggcaccccccacgcccugaucgugagaagauaccugagccugcuggacaccgccguggagcuggagcugcccggcuacagaggccccagacugcccagaagacagcaggugcccaucuucccccagccccugaucaccgacagagccagaugcaaguacagccacaaggacaucguggccgagggccugagacagcugcugggcgaggagaaguacagacaggaccugaccgugccccccggcuacugcaccgacuuccugcugugcgccagcagcagcggcgccgugcugcccgugagaacccaggaccccuuccugcccuacccccccagaagcugcccccagggccaggccgccagcagcgccaccaccagagaccccgcccagagaguggugcuggugcugagagagagauggcacuucugcagagacggcagagugcugcugggcagcagagcccugagagagagacaccugggccugaugggcuaccagcugcugccccugcccuucgaggagcuggagagccagagaggccugccccagcugaagagcuaccugagacagaagcugcaggcccugggccugagauggggccccgagggcggcuaa

SEQ ID NO: 16961 - RNA, 13767 nt, Artificial Sequence
  FAT1__Homo_sapiens__XP_006714202
augggcagacaccuggcccugcugcugcugcugcugcugcuguuccagcacuucggcgacagcgacggcagccagagacuggagcagaccccccugcaguucacccaccuggaguacaacgugaccgugcaggagaacagcgccgccaagaccuacgugggccaccccgugaagaugggcguguacaucacccaccccgccugggaggugagauacaagaucgugagcggcgacagcgagaaccuguucaaggccgaggaguacauccugggcgacuucugcuuccugagaaucagaaccaagggcggcaacaccgccauccugaacagagaggugaaggaccacuacacccugaucgugaaggcccuggagaagaacaccaacguggaggccagaaccaaggugagagugcaggugcuggacaccaacgaccugagaccccuguucagccccaccagcuacagcgugagccugcccgagaacaccgccaucagaaccagcaucgccagagugagcgccaccgacgccgacaucggcaccaacggcgaguucuacuacagcuucaaggacagaaccgacauguucgccauccaccccaccagcggcgugaucgugcugaccggcagacuggacuaccuggagaccaagcuguacgagauggagauccuggccgccgacagaggcaugaagcuguacggcagcagcggcaucagcagcauggccaagcugaccgugcacaucgagcaggccaacgagugcgcccccgugaucaccgccgugacccugagccccagcgagcuggacagagaccccgccuacgccaucgugaccguggacgacugcgaccagggcgccaacggcgacaucgccagccugagcaucguggccggcgaccugcugcagcaguucagaaccgugagaagcuuccccggcagcaaggaguacaaggugaaggccaucggcggcaucgacugggacagccaccccuucggcuacaaccugacccugcaggccaaggacaagggcacccccccccaguucagcagcgugaaggugauccacgugaccagcccccaguucaaggccggccccgugaaguucgagaaggacguguacagagccgagaucagcgaguucgccccccccaacacccccguggugauggugaaggccauccccgccuacagccaccugagauacguguucaagagcacccccggcaaggccaaguucagccugaacuacaacaccggccugaucagcauccuggagcccgugaagagacagcaggccgcccacuucgagcuggaggugaccaccagcgacagaaaggccagcaccaaggugcuggugaaggugcugggcgccaacagcaacccccccgaguucacccagaccgccuacaaggccgccuucgacgagaacgugcccaucggcaccaccgugaugagccugagcgccguggaccccgacgagggcgagaacggcuacgugaccuacagcaucgccaaccugaaccacgugcccuucgccaucgaccacuucaccggcgccgugagcaccagcgagaaccuggacuacgagcugaugcccagaguguacacccugagaaucagagccagcgacuggggccugcccuacagaagagagguggaggugcuggccaccaucacccugaacaaccugaacgacaacaccccccuguucgagaagaucaacugcgagggcaccauccccagagaccugggcgugggcgagcagaucaccaccgugagcgccaucgacgccgacgagcugcagcuggugcaguaccagaucgaggccggcaacgagcuggacuucuucagccugaaccccaacagcggcgugcugagccugaagagaagccugauggacggccugggcgccaaggugagcuuccacagccugagaaucaccgccaccgacggcgagaacuucgccaccccccuguacaucaacaucaccguggccgccagccacaagcuggugaaccugcagugcgaggagaccggcguggccaagaugcuggccgagaagcugcugcaggccaacaagcugcacaaccagggcgagguggaggacaucuucuucgacagccacagcgugaacgcccacaucccccaguucagaagcacccugcccaccggcauccaggugaaggagaaccagcccgugggcagcagcgugaucuucaugaacagcaccgaccuggacaccggcuucaacggcaagcugguguacgccgugagcggcggcaacgaggacagcugcuucaugaucgacauggagaccggcaugcugaagauccugagcccccuggacagagagaccaccgacaaguacacccugaacaucaccguguacgaccugggcaucccccagaaggccgccuggagacugcugcacgugguggugguggacgccaacgacaacccccccgaguuccugcaggagagcuacuucguggaggugagcgaggacaaggaggugcacagcgagaucauccagguggaggccaccgacaaggaccugggccccaacggccacgugaccuacagcaucgugaccgacaccgacaccuucagcaucgacagcgugaccggcguggugaacaucgccagaccccuggacagagagcugcagcacgagcacagccugaagaucgaggccagagaccaggccagagaggagccccagcuguucagcaccgugguggugaaggugagccuggaggacgugaacgacaacccccccaccuucaucccccccaacuacagagugaaggugagagaggaccugcccgagggcaccgugaucauguggcuggaggcccacgaccccgaccugggccagagcggccaggugagauacagccugcuggaccacggcgagggcaacuucgacguggacaagcugagcggcgccgugagaaucgugcagcagcuggacuucgagaagaagcagguguacaaccugaccgugagagccaaggacaagggcaagcccgugagccugagcagcaccugcuacguggagguggaggugguggacgugaacgagaaccugcacccccccguguucagcagcuucguggagaagggcaccgugaaggaggacgcccccgugggcagccuggugaugaccgugagcgcccacgacgaggacgccagaagagacggcgagaucagauacagcaucagagacggcagcggcgugggcguguucaagaucggcgaggagaccggcgugaucgagaccagcgacagacuggacagagagagcaccagccacuacuggcugaccguguucgccaccgaccagggcguggugccccugagcagcuucaucgagaucuacaucgagguggaggacgugaacgacaacgccccccagaccagcgagcccguguacuaccccgagaucauggagaacagccccaaggacgugagcguggugcagaucgaggccuucgaccccgacagcagcagcaacgacaagcugauguacaagaucaccagcggcaacccccagggcuucuucagcauccaccccaagaccggccugaucaccaccaccagcagaaagcuggacagagagcagcaggacgagcacauccuggaggugaccgugaccgacaacggcagcccccccaagagcaccaucgccagagugaucgugaagauccuggacgagaacgacaacaagccccaguuccugcagaaguucuacaagaucagacugcccgagagagagaagcccgacagagagagaaacgccagaagagagccccuguaccacgugaucgccaccgacaaggacgagggccccaacgccgagaucagcuacagcaucgaggacggcaacgagcacggcaaguucuucaucgagcccaagaccggcguggugagcagcaagagauucagcgccgccggcgaguacgacauccugagcaucaaggccguggacaacggcagaccccagaagagcagcaccaccagacugcacaucgaguggaucagcaagcccaagcccagccuggagcccaucagcuucgaggagagcuucuucaccuucaccgugauggagagcgaccccguggcccacaugaucggcgugaucagcguggagccccccggcaucccccugugguucgacaucaccggcggcaacuacgacagccacuucgacguggacaagggcaccggcaccaucaucguggccaagccccuggacgccgagcagaagagcaacuacaaccugaccguggaggccaccgacggcaccaccaccauccugacccagguguucaucaaggugaucgacaccaacgaccacagaccccaguucagcaccagcaaguacgagguggugauccccgaggacaccgcccccgagaccgagauccugcagaucagcgccguggaccaggacgagaagaacaagcugaucuacacccugcagagcagcagagacccccugagccugaagaaguucagacuggaccccgccaccggcagccuguacaccagcgagaagcuggaccacgaggccgugcaccagcacacccugaccgugauggugagagaccaggacgugcccgugaagagaaacuucgccagaaucguggugaacgugagcgacaccaacgaccacgcccccugguucaccgccagcagcuacaagggcagaguguacgagagcgccgccgugggcagcguggugcugcaggugaccgcccuggacaaggacaagggcaagaacgccgaggugcuguacagcaucgagagcggcaacaucggcaacagcuucaugaucgaccccgugcugggcagcaucaagaccgccaaggagcuggacagaagcaaccaggccgaguacgaccugauggugaaggccaccgacaagggcagcccccccaugagcgagaucaccagcgugagaaucuucgugaccaucgccgacaacgccagccccaaguucaccagcaaggaguacagcguggagcugagcgagaccgugagcaucggcagcuucgugggcauggugaccgcccacagccagagcagcgugguguacgagaucaaggacggcaacaccggcgacgccuucgacaucaacccccacagcggcaccaucaucacccagaaggcccuggacuucgagacccugcccaucuacacccugaucauccagggcaccaacauggccggccugagcaccaacaccaccgugcuggugcaccugcaggacgagaacgacaacgcccccguguucaugcaggccgaguacaccggccugaucagcgagagcgccagcaucaacagcguggugcugaccgacagaaacgugccccuggugaucagagccgccgacgccgacaaggacagcaacgcccugcugguguaccacaucguggagcccagcgugcacaccuacuucgccaucgacagcagcaccggcgccauccacaccgugcugagccuggacuacgaggagaccagcaucuuccacuucaccgugcaggugcacgacaugggcacccccagacuguucgccgaguacgccgccaacgugaccgugcacgugaucgacaucaacgacugcccccccguguucgccaagccccuguacgaggccagccugcugcugcccaccuacaagggcgugaaggugaucaccgugaacgccaccgacgccgacagcagcgccuucagccagcugaucuacagcaucaccgagggcaacaucggcgagaaguucagcauggacuacaagaccggcgcccugaccgugcagaacaccacccagcugagaagcagauacgagcugaccgugagagccagcgacggcagauucgccggccugaccagcgugaagaucaacgugaaggagagcaaggagagccaccugaaguucacccaggacguguacagcgccguggugaaggagaacagcaccgaggccgagacccuggccgugaucaccgccaucggcaaccccaucaacgagccccuguucuaccacauccugaaccccgacagaagauucaagaucagcagaaccagcggcgugcugagcaccaccggcacccccuucgacagagagcagcaggaggccuucgacguggugguggaggugaccgaggagcacaagcccagcgccguggcccacgugguggugaaggugaucguggaggaccagaacgacaacgcccccguguucgugaaccugcccuacuacgccguggugaagguggacaccgaggugggccacgugaucagauacgugaccgccguggacagagacagcggcagaaacggcgaggugcacuacuaccugaaggagcaccacgagcacuuccagaucggcccccugggcgagaucagccugaagaagcaguucgagcuggacacccugaacaaggaguaccuggugaccgugguggccaaggacggcggcaaccccgccuucagcgccgaggugaucgugcccaucaccgugaugaacaaggccaugcccguguucgagaagcccuucuacagcgccgagaucgccgagagcauccaggugcacagccccguggugcacgugcaggccaacagccccgagggccugaagguguucuacagcaucaccgacggcgaccccuucagccaguucaccaucaacuucaacaccggcgugaucaacgugaucgccccccuggacuucgaggcccaccccgccuacaagcugagcaucagagccaccgacagccugaccggcgcccacgccgagguguucguggacaucaucguggacgacaucaacgacaacccccccguguucgcccagcagagcuacgccgugacccugagcgaggccagcgugaucggcaccagcguggugcaggugagagccaccgacagcgacagcgagcccaacagaggcaucagcuaccagauguucggcaaccacagcaagagccacgaccacuuccacguggacagcagcaccggccugaucagccugcugagaacccuggacuacgagcagagcagacagcacaccaucuucgugagagccguggacggcggcaugcccacccugagcagcgacgugaucgugaccguggacgugaccgaccugaacgacaaccccccccuguucgagcagcagaucuacgaggccagaaucagcgagcacgccccccacggccacuucgugaccugcgugaaggccuacgacgccgacagcagcgacaucgacaagcugcaguacagcauccugagcggcaacgaccacaagcacuucgugaucgacagcgccaccggcaucaucacccugagcaaccugcacagacacgcccugaagcccuucuacagccugaaccugagcgugagcgacggcguguucagaagcagcacccaggugcacgugaccgugaucggcggcaaccugcacagccccgccuuccugcagaacgaguacgagguggagcuggccgagaacgccccccugcacacccuggugauggaggugaagaccaccgacggcgacagcggcaucuacggccacgugaccuaccacaucgugaacgacuucgccaaggacagauucuacaucaacgagagaggccagaucuucacccuggagaagcuggacagagagacccccgccgagaaggugaucagcgugagacugauggccaaggacgccggcggcaagguggccuucugcaccgugaacgugauccugaccgacgacaacgacaacgccccccaguucagagccaccaaguacgaggugaacaucggcagcagcgccgccaagggcaccagcguggugaaggugcuggccagcgacgccgacgagggcagcaacgccgacaucaccuacgccaucgaggccgacagcgagagcgugaaggagaaccuggagaucaacaagcugagcggcgugaucaccaccaaggagagccugaucggccuggagaacgaguucuucaccuucuucgugagagccguggacaacggcagccccagcaaggagagcguggugcugguguacgugaagauccugccccccgagaugcagcugcccaaguucagcgagcccuucuacaccuucaccgugagcgaggacgugcccaucggcaccgagaucgaccugaucagagccgagcacagcggcaccgugcuguacagccuggugaagggcaacacccccgagagcaacagagacgagagcuucgugaucgacagacagagcggcagacugaagcuggagaagagccuggaccacgagaccaccaagugguaccaguucagcauccuggccagaugcacccaggacgaccacgagaugguggccagcguggacgugagcauccaggugaaggacgccaacgacaacagccccguguucgagagcagccccuacgaggccuucaucguggagaaccugcccggcggcagcagagugauccagaucagagccagcgacgccgacagcggcaccaacggccaggugauguacagccuggaccagagccagagcguggaggugaucgagagcuucgccaucaacauggagaccggcuggaucaccacccugaaggagcuggaccacgagaagagagacaacuaccagaucaaggugguggccagcgaccacggcgagaagauccagcugagcagcaccgccaucguggacgugaccgugaccgacgugaacgacagcccccccagauucaccgccgagaucuacaagggcaccgugagcgaggacgacccccagggcggcgugaucgccauccugagcaccaccgacgccgacagcgaggagaucaacagacaggugaccuacuucaucaccggcggcgacccccugggccaguucgccguggagaccauccagaacgaguggaagguguacgugaagaagccccuggacagagagaagagagacaacuaccugcugaccaucaccgccaccgacggcaccuucagcagcaaggccaucguggaggugaaggugcuggacgccaacgacaacagccccgugugcgagaagacccuguacagcgacaccauccccgaggacgugcugcccggcaagcugaucaugcagaucagcgccaccgacgccgacaucagaagcaacgccgagaucaccuacacccugcugggcagcggcgccgagaaguucaagcugaaccccgacaccggcgagcugaagaccagcaccccccuggacagagaggagcaggccguguaccaccugcuggugagagccaccgacggcggcggcagauucugccaggccagcaucgugcugacccuggaggacgugaacgacaacgcccccgaguucagcgccgaccccuacgccaucaccguguucgagaacaccgagcccggcacccugcugaccagagugcaggccaccgacgccgacgccggccugaacagaaagauccuguacagccugaucgacagcgccgacggccaguucagcaucaacgagcugagcggcaucauccagcuggagaagccccuggacagagagcugcaggccguguacacccugagccugaaggccguggaccagggccugcccagaagacugaccgccaccggcaccgugaucgugagcgugcuggacaucaacgacaacccccccguguucgaguacagagaguacggcgccaccgugagcgaggacauccuggugggcaccgaggugcugcagguguacgccgccagcagagacaucgaggccaacgccgagaucaccuacagcaucaucagcggcaacgagcacggcaaguucagcaucgacagcaagaccggcgccguguucaucaucgagaaccuggacuacgagagcagccacgaguacuaccugaccguggaggccaccgacggcggcacccccagccugagcgacguggccaccgugaacgugaacgugaccgacaucaacgacaacacccccguguucagccaggacaccuacaccaccgugaucagcgaggacgccgugcuggagcagagcgugaucaccgugauggccgacgacgccgacggccccagcaacagccacauccacuacagcaucaucgacggcaaccagggcagcagcuucaccaucgaccccgugagaggcgaggugaaggugaccaagcugcuggacagagagaccaucagcggcuacacccugaccgugcaggccagcgacaacggcagcccccccagagugaacaccaccaccgugaacaucgacgugagcgacgugaacgacaacgcccccguguucagcagaggcaacuacagcgugaucauccaggagaacaagcccgugggcuucagcgugcugcagcugguggugaccgacgaggacagcagccacaacggcccccccuucuucuucaccaucgugaccggcaacgacgagaaggccuucgaggugaacccccagggcgugcugcugaccagcagcgccaucaagagaaaggagaaggaccacuaccugcugcaggugaagguggccgacaacggcaagccccagcugagcagccugaccuacaucgacaucagagugaucgaggagagcaucuacccccccgccauccugccccuggagaucuucaucaccagcagcggcgaggaguacagcggcggcgugaucggcaagauccacgccaccgaccaggacguguacgacacccugaccuacagccuggacccccagauggacaaccuguucagcgugagcagcaccggcggcaagcugaucgcccacaagaagcuggacaucggccaguaccugcugaacgugagcgugaccgacggcaaguucaccaccguggccgacaucaccgugcacaucagacaggugacccaggagaugcugaaccacaccaucgccaucagauucgccaaccugacccccgaggaguucgugggcgacuacuggagaaacuuccagagagcccugagaaacauccugggcgugagaagaaacgacauccagaucgugagccugcagagcagcgagccccacccccaccuggacgugcugcuguucguggagaagcccggcagcgcccagaucagcaccaagcagcugcugcacaagaucaacagcagcgugaccgacaucgaggagaucaucggcgugagaauccugaacguguuccagaagcugugcgccggccuggacugccccuggaaguucugcgacgagaaggugagcguggacgagagcgugaugagcacccacagcaccgccagacugagcuucgugacccccagacaccacagagccgccgugugccugugcaaggagggcagaugcccccccgugcaccacggcugcgaggacgaccccugccccgagggcagcgagugcgugagcgaccccugggaggagaagcacaccugcgugugccccagcggcagauucggccagugccccggcagcagcagcaugacccugaccggcaacagcuacgugaaguacagacugaccgagaacgagaacaagcuggagaugaagcugaccaugagacugagaaccuacagcacccacgccguggugauguacgccagaggcaccgacuacagcauccuggagauccaccacggcagacugcaguacaaguucgacugcggcagcggccccggcaucgugagcgugcagagcauccaggugaacgacggccaguggcacgccguggcccuggaggugaacggcaacuacgccagacuggugcuggaccaggugcacaccgccagcggcaccgcccccggcacccugaagacccugaaccuggacaacuacguguucuucggcggccacaucagacagcagggcaccagacacggcagaagcccccaggugggcaacggcuucagaggcugcauggacagcaucuaccugaacggccaggagcugccccugaacagcaagcccagaagcuacgcccacaucgaggagagcguggacgugagccccggcugcuuccugaccgccaccgaggacugcgccagcaaccccugccagaacggcggcgugugcaaccccagccccgccggcggcuacuacugcaagugcagcgcccuguacaucggcacccacugcgagaucagcgugaaccccugcagcagcaagcccugccuguacggcggcaccugcgugguggacaacggcggcuucgugugccagugcagaggccuguacaccggccagagaugccagcugagccccuacugcaaggacgagcccugcaagaacggcggcaccugcuucgacagccuggacggcgccgugugccagugcgacagcggcuucagaggcgagagaugccagagcgacaucgacgagugcagcggcaaccccugccugcacggcgcccugugcgagaacacccacggcagcuaccacugcaacugcagccacgaguacagaggcagacacugcgaggacgccgcccccaaccaguacgugagcacccccuggaacaucggccuggccgagggcaucggcaucgugguguucguggccggcaucuuccugcugguggugguguucgugcugugcagaaagaugaucagcagaaagaagaagcaccaggccgagcccaaggacaagcaccugggccccgccaccgccuuccugcagagacccuacuucgacagcaagcugaacaagaacaucuacagcgacauccccccccaggugcccgugagacccaucagcuacacccccagcauccccagcgacagcagaaacaaccuggacagaaacagcuucgagggcagcgccauccccgagcaccccgaguucagcaccuucaaccccgagagcgugcacggccacagaaaggccguggccgugugcagcguggcccccaaccugcccccccccccccccagcaacagccccagcgacagcgacagcauccagaagcccagcugggacuucgacuacgacaccaaggugguggaccuggaccccugccugagcaagaagccccuggaggagaagcccagccagcccuacagcgccagagagagccugagcgaggugcagagccugagcagcuuccagagcgagagcugcgacgacaacggcuaccacugggacaccagcgacuggaugcccagcgugccccugcccgacauccaggaguuccccaacuacgaggugaucgacgagcagaccccccuguacagcgccgaccccaacgccaucgacaccgacuacuaccccggcggcuacgacaucgagagcgacuucccccccccccccgaggacuuccccgccgccgacgagcugcccccccugccccccgaguucagcaaccaguucgagagcauccacccccccagagacaugcccgccgccggcagccugggcagcagcagcagaaacagacagagauucaaccugaaccaguaccugcccaacuucuacccccuggacaugagcgagccccagaccaagggcaccggcgagaacagcaccugcagagagccccacgcccccuacccccccggcuaccagagacacuucgaggcccccgccguggagagcaugcccaugagcguguacgccagcaccgccagcugcagcgacgugagcgccugcugcgagguggagagcgaggugaugaugagcgacuacgagagcggcgacgacggccacuucgaggaggugaccauccccccccuggacagccagcagcacaccgagguguaa

SEQ ID NO: 16962 - RNA, 13050 nt, Artificial Sequence
  FAT2__Homo_sapiens__XP_011535905
augaccaucgcccugcugggcuucgccaucuuccugcugcacugcgccaccugcgagaagccccuggagggcauccugagcagcagcgccuggcacuucacccacagccacuacaacgccaccaucuacgagaacagcagccccaagaccuacguggagagcuucgagaagaugggcaucuaccuggccgagccccagugggccgugagauacagaaucaucagcggcgacguggccaacguguucaagaccgaggaguacguggugggcaacuucugcuuccugagaaucagaaccaagagcagcaacaccgcccugcugaacagagaggugagagacagcuacacccugaucauccaggccaccgagaagacccuggagcuggaggcccugaccagagugguggugcacauccuggaccagaacgaccugaagccccuguucagcccccccagcuacagagugaccaucagcgaggacaugccccugaagagccccaucugcaaggugaccgccaccgacgccgaccugggccagaacgccgaguucuacuacgccuucaacaccagaagcgagauguucgccauccaccccaccagcggcguggugaccguggccggcaagcugaacgugaccuggagaggcaagcacgagcugcaggugcuggccguggacagaaugagaaagaucagcgagggcaacggcuucggcagccuggccgcccugguggugcacguggagcccgcccugagaaagccccccgccaucgccagcgugguggugaccccccccgacagcaacgacggcaccaccuacgccaccgugcugguggacgccaacagcagcggcgccgagguggagagcguggagguggugggcggcgaccccggcaagcacuucaaggccaucaagagcuacgccagaagcaacgaguucagccuggugagcgugaaggacaucaacuggauggaguaccugcacggcuucaaccugagccugcaggccagaagcggcagcggccccuacuucuacagccagaucagaggcuuccaccugccccccagcaagcugagcagccugaaguucgagaaggccguguacagagugcagcugagcgaguucagcccccccggcagcagaguggugauggugagagugacccccgccuuccccaaccugcaguacgugcugaagcccagcagcgagaacgugggcuucaagcugaacgccagaaccggccugaucaccaccaccaagcugauggacuuccacgacagagcccacuaccagcugcacaucagaaccagccccggccaggccagcaccgugguggugaucgacaucguggacugcaacaaccacgccccccuguucaacagaagcagcuacgacggcacccuggacgagaacaucccccccggcaccagcgugcuggccgugaccgccaccgacagagaccacggcgagaacggcuacgugaccuacagcaucgccggccccaaggcccugcccuucagcaucgaccccuaccugggcaucaucagcaccagcaagcccauggacuacgagcugaugaagagaaucuacaccuucagagugagagccagcgacuggggcagccccuucagaagagagaaggaggugagcaucuuccugcagcugagaaaccugaacgacaaccagcccauguucgaggaggugaacugcaccggcagcaucagacaggacuggcccgugggcaagagcaucaugaccaugagcgccaucgacguggacgagcugcagaaccugaaguacgagaucgugagcggcaacgagcuggaguacuucgaccugaaccacuucagcggcgugaucagccugaagagacccuucaucaaccugaccgccggccagcccaccagcuacagccugaagaucaccgccagcgacggcaagaacuacgccagccccaccacccugaacaucaccguggugaaggacccccacuucgaggugcccgugaccugcgacaagaccggcgugcugacccaguucaccaagaccauccugcacuucaucggccugcagaaccaggagagcagcgacgaggaguucaccagccugagcaccuaccagaucaaccacuacaccccccaguucgaggaccacuucccccagagcaucgacgugcuggagagcgugcccaucaacaccccccuggccagacuggccgccaccgaccccgacgccggcuucaacggcaagcugguguacgugaucgccgacggcaacgaggagggcugcuucgacaucgagcuggagaccggccugcugaccguggccgccccccuggacuacgaggccaccaacuucuacauccugaacgugaccguguacgaccugggcaccccccagaagagcagcuggaagcugcugaccgugaacgugaaggacuggaacgacaacgcccccagauucccccccggcggcuaccagcugaccaucagcgaggacaccgaggugggcaccaccaucgccgagcugaccaccaaggacgccgacagcgaggacaacggcagagugagauacacccugcugagccccaccgagaaguucagccugcacccccugaccggcgagcugguggugaccggccaccuggacagagagagcgagcccagauacauccugaagguggaggccagagaccagcccagcaagggccaccagcuguucagcgugaccgaccugaucaucacccuggaggacgugaacgacaacagcccccagugcaucaccgagcacaacagacugaaggugcccgaggaccugccccccggcaccgugcugaccuuccuggacgccagcgaccccgaccugggccccgccggcgaggugagauacgugcugauggacggcgcccacggcaccuucagaguggaccugaugaccggcgcccugauccuggagagagagcuggacuucgagagaagagccggcuacaaccugagccugugggccagcgacggcggcagaccccuggccagaagaacccugugccacguggaggugaucgugcuggacgugaacgagaaccugcaccccccccacuucgccagcuucgugcaccagggccaggugcaggagaacagccccagcggcacccaggugaucgugguggccgcccaggacgacgacagcggccuggacggcgagcugcaguacuuccugagagccggcaccggccuggccgccuucagcaucaaccaggacaccggcaugauccagacccuggccccccuggacagagaguucgccagcuacuacuggcugaccgugcuggccguggacagaggcagcgugccccugagcagcgugaccgagguguacaucgaggugaccgacgccaacgacaaccccccccagaugagccaggccguguucuaccccagcauccaggaggacgcccccgugggcaccagcgugcugcagcuggacgccugggaccccgacagcagcagcaagggcaagcugaccuucaacaucaccagcggcaacuacaugggcuucuucaugauccaccccgugaccggccugcugagcaccgcccagcagcuggacagagagaacaaggacgagcacauccuggaggugaccgugcuggacaacggcgagcccagccugaagagcaccagcagagugguggugggcauccuggacgugaacgacaacccccccaucuucagccacaagcuguucaacgugagacugcccgagagacugagccccgugagccccggccccguguacagacugguggccagcgaccuggacgagggccugaacggcagagugaccuacagcaucgaggacagcgacgaggaggccuucagcaucgaccuggugaccggcguggugagcagcagcagcaccuucaccgccggcgaguacaacauccugaccaucaaggccaccgacagcggccagcccccccugagcgccagcgugagacugcacaucgaguggauccccuggcccagacccagcagcaucccccuggccuucgacgagaccuacuacagcuucaccgugauggagaccgaccccgugaaccacauggugggcgugaucagcguggagggcagacccggccuguucugguucaacaucagcggcggcgacaaggacauggacuucgacaucgagaagaccaccggcagcaucgugaucgccagaccccuggacaccagaagaagaagcaacuacaaccugaccguggaggugaccgacggcagcagaaccaucgccacccaggugcacaucuucaugaucgccaacaucaaccaccacagaccccaguuccuggagaccagauacgaggugagagugccccaggacaccgugcccggcguggagcugcugagagugcaggccaucgaccaggacaagggcaagagccugaucuacaccauccacggcagccaggaccccggcagcgccagccuguuccagcuggaccccagcagcggcgugcuggugaccgugggcaagcuggaccugggcagcggccccagccagcacacccugaccgugauggugagagaccaggagauccccaucaagagaaacuucgugugggugaccauccacguggaggacggcaaccugcacccccccagauucacccagcugcacuacgaggccagcgugcccgacaccaucgcccccggcaccgagcugcugcaggugagagccauggacgccgacagaggcgugaacgccgaggugcacuacagccugcugaagggcaacagcgagggcuucuucaacaucaacgcccugcugggcaucaucacccuggcccagaagcuggaccaggccaaccacgccccccacacccugaccgugaaggccgaggaccagggcagcccccaguggcacgaccuggccaccgugaucauccacguguaccccagcgacagaagcgcccccaucuucagcaagagcgaguacuucguggagauccccgagagcauccccgugggcagccccauccugcuggugagcgccaugagccccagcgaggugaccuacgagcugagagagggcaacaaggacggcguguucagcaugaacagcuacagcggccugaucagcacccagaagaagcuggaccacgagaagaucagcagcuaccagcugaagaucagaggcagcaacauggccggcgccuucaccgacgugaugguggugguggacaucaucgacgagaacgacaacgcccccauguuccugaagagcaccuucgugggccagaucagcgaggccgccccccuguacagcaugaucauggacaagaacaacaaccccuucgugauccacgccagcgacagcgacaaggaggccaacagccugcugguguacaagauccuggagcccgaggcccugaaguucuucaagaucgaccccagcaugggcacccugaccaucgugagcgagauggacuacgagagcaugcccagcuuccaguucugcguguacgugcacgaccagggcagccccgugcuguucgcccccagacccgcccaggugaucauccacgugagagacgugaacgacagcccccccagauucagcgagcagaucuacgagguggccaucgugggccccauccaccccggcauggagcugcugauggugagagccagcgacgaggacagcgaggugaacuacagcaucaagaccggcaacgccgacgaggccgugaccauccaccccgugaccggcagcaucagcgugcugaaccccgccuuccugggccugagcagaaagcugaccaucagagccagcgacggccuguaccaggacaccgcccuggugaagaucagccugacccaggugcuggacaagagccugcaguucgaccaggacguguacugggccgccgugaaggagaaccugcaggacagaaaggcccuggugauccugggcgcccagggcaaccaccugaacgacacccugagcuacuuccugcugaacggcaccgacauguuccacauggugcagagcgccggcgugcugcagaccagaggcguggccuucgacagagagcagcaggacacccacgagcuggccguggaggugagagacaacagaaccccccagagaguggcccagggccuggugagagugagcaucgaggacgugaacgacaacccccccaaguucaagcaccugcccuacuacaccaucauccaggacggcaccgagcccggcgacgugcuguuccaggugagcgccaccgacgaggaccugggcaccaacggcgccgugaccuacgaguucgccgaggacuacaccuacuucagaaucgaccccuaccugggcgacaucagccugaagaagcccuucgacuaccaggcccugaacaaguaccaccugaaggugaucgccagagacggcggcacccccagccugcagagcgaggaggaggugcuggugaccgugagaaacaagagcaacccccuguuccagagccccuacuacaaggugagagugcccgagaacaucacccuguacacccccauccugcacacccaggccagaagccccgagggccugagacugaucuacaacaucguggaggaggagccccugaugcuguucaccaccgacuucaagaccggcgugcugaccgugaccggcccccuggacuacgagagcaagaccaagcacguguucaccgugagagccaccgacaccgcccugggcagcuucagcgaggccaccguggaggugcugguggaggacgugaacgacaacccccccaccuucagccagcugguguacaccaccagcaucagcgagggccugcccgcccagacccccgugauccagcugcuggccagcgaccaggacagcggcagaaacagagacgugagcuaccagaucguggaggacggcagcgacgugagcaaguucuuccagaucaacggcagcaccggcgagaugagcaccgugcaggagcuggacuacgaggcccagcagcacuuccacgugaaggugagagccauggacaagggcgaccccccccugaccggcgagacccuggugguggugaacgugagcgacaucaacgacaacccccccgaguucagacagccccaguacgaggccaacgugagcgagcuggccaccugcggccaccuggugcugaaggugcaggccaucgaccccgacagcagagacaccagcagacuggaguaccugauccugagcggcaaccaggacagacacuucuucaucaacagcagcagcggcaucaucagcauguucaaccugugcaagaagcaccuggacagcagcuacaaccugagagugggcgccagcgacggcguguucagagccaccgugcccguguacaucaacaccaccaacgccaacaaguacagccccgaguuccagcagcaccuguacgaggccgagcuggccgagaacgccauggugggcaccaaggugaucgaccugcuggccaucgacaaggacagcggccccuacggcaccaucgacuacaccaucaucaacaagcuggccagcgagaaguucagcaucaaccccaacggccagaucgccacccugcagaagcuggacagagagaacagcaccgagagagugaucgccaucaaggugauggccagagacggcggcggcagaguggccuucugcaccgugaagaucauccugaccgacgagaacgacaaccccccccaguucaaggccagcgaguacaccgugagcauccagagcaacgugagcaaggacagccccgugauccaggugcuggccuacgacgccgacgagggccagaacgccgacgugaccuacagcgugaaccccgaggaccuggugaaggacgugaucgagaucaaccccgugaccggcguggugaaggugaaggacagccuggugggccuggagaaccagacccuggacuucuucaucaaggcccaggacggcggccccccccacuggaacagccuggugcccgugagacugcagguggugcccaagaaggugagccugcccaaguucagcgagccccuguacaccuucagcgcccccgaggaccugcccgagggcagcgagaucggcaucgugaaggccguggccgcccaggaccccgugaucuacagccuggugagaggcaccacccccgagagcaacaaggacggcguguucagccuggaccccgacaccggcgugaucaaggugagaaagcccauggaccacgagagcaccaagcuguaccagaucgacgugauggcccacugccugcagaacaccgacguggugagccuggugagcgugaacauccaggugggcgacgugaacgacaacagacccguguucgaggccgaccccuacaaggccgugcugaccgagaacaugcccgugggcaccagcgugauccaggugaccgccaucgacaaggacaccggcagagacggccaggugagcuacagacugagcgccgaccccggcagcaacgugcacgagcuguucgccaucgacagcgagagcggcuggaucaccacccugcaggagcuggacugcgagaccugccagaccuaccacuuccacgugguggccuacgaccacggccagaccauccagcugagcagccaggcccuggugcaggugagcaucaccgacgagaacgacaacgcccccagauucgccagcgaggaguacagaggcagcgugguggagaacagcgagcccggcgagcugguggccacccugaagacccuggacgccgacaucagcgagcagaacagacaggugaccugcuacaucaccgagggcgacccccugggccaguucggcaucagccaggugggcgacgaguggagaaucagcagcagaaagacccuggacagagagcacaccgccaaguaccugcugagagugaccgccagcgacggcaaguuccaggccagcgugaccguggagaucuucgugcuggacgugaacgacaacagcccccagugcagccagcugcuguacaccggcaaggugcacgaggacguguuccccggccacuucauccugaaggugagcgccaccgaccuggacaccgacaccaacgcccagaucaccuacagccugcacggccccggcgcccacgaguucaagcuggacccccacaccggcgagcugaccacccugaccgcccuggacagagagagaaaggacguguucaaccugguggccaaggccaccgacggcggcggcagaagcugccaggccgacaucacccugcacguggaggacgugaacgacaacgcccccagauucuuccccagccacugcgccguggccguguucgacaacaccaccgugaagacccccguggccgugguguucgccagagaccccgaccagggcgccaacgcccaggugguguacagccugcccgacagcgccgagggccacuucagcaucgacgccaccaccggcgugaucagacuggagaagccccugcaggugagaccccaggccccccuggagcugaccgugagagccagcgaccugggcacccccaucccccugagcacccugggcaccgugaccgugagcguggugggccuggaggacuaccugcccguguuccugaacaccgagcacagcgugcaggugcccgaggacgccccccccggcaccgaggugcugcagcuggccacccugaccagacccggcgccgagaagaccggcuacagaguggugagcggcaacgagcagggcagauucagacuggacgccagaaccggcauccuguacgugaacgccagccuggacuucgagaccagccccaaguacuuccugagcaucgagugcagcagaaagagcagcagcagccugagcgacgugaccaccgugauggugaacaucaccgacgugaacgagcacagaccccaguucccccaggaccccuacagcaccagagugcuggagaacgcccuggugggcgacgugauccugaccgugagcgccaccgacgaggacggcccccugaacagcgacaucaccuacagccugaucggcggcaaccagcugggccacuucaccauccaccccaagaagggcgagcugcagguggccaaggcccuggacagagagcaggccagcagcuacagccugaagcugagagccaccgacagcggccagcccccccugcacgaggacaccgacaucgccauccagguggccgacgugaacgacaacccccccagauucuuccagcugaacuacagcaccaccgugcaggagaacagccccaucggcagcaaggugcugcagcugauccugagcgaccccgacagccccgagaacggcccccccuacagcuucagaaucaccaagggcaacaacggcagcgccuucagagugacccccgacggcuggcuggugaccgccgagggccugagcagaagagcccaggagugguaccagcugcagauccaggccagcgacagcggcauccccccccugagcagccugaccagcgugagagugcacgugaccgagcagagccacuacgcccccagcgcccugccccuggagaucuucaucaccgugggcgaggacgaguuccagggcggcauggugggcaagauccacgccaccgacagagacccccaggacacccugaccuacagccuggccgaggaggagacccugggcagacacuucagcgugggcgcccccgacggcaagaucaucgccgcccagggccugcccagaggccacuacagcuucaacgugaccgugagcgacggcaccuucaccaccaccgccggcgugcacguguacguguggcacgugggccaggaggcccugcagcaggccauguggaugggcuucuaccagcugacccccgaggagcuggugagcgaccacuggagaaaccugcagagauuccugagccacaagcuggacaucaagagagccaacauccaccuggccagccugcagcccgccgaggccguggccggcguggacgugcugcugguguucgagggccacagcggcaccuucuacgaguuccaggagcuggccagcaucaucacccacagcgccaaggagauggagcacagcgugggcgugcagaugagaagcgccaugcccauggugcccugccagggccccaccugccagggccagaucugccacaacaccgugcaccuggaccccaaggugggccccaccuacagcaccgccagacugagcauccugacccccagacaccaccugcagagaagcugcagcugcaacggcaccgccaccagauucagcggccagagcuacgugagauacagagcccccgccgccagaaacuggcacauccacuucuaccugaagacccugcagccccaggccauccugcuguucaccaacgagaccgccagcgugagccugaagcuggccagcggcgugccccagcuggaguaccacugccugggcggcuucuacggcaaccugagcagccagagacacgugaacgaccacgaguggcacagcauccugguggaggagauggacgccagcaucagacugaugguggacagcaugggcaacaccagccugguggugcccgagaacugcagaggccugagacccgagagacaccugcugcugggcggccugauccugcugcacagcagcagcaacgugagccagggcuucgagggcugccuggacgccgugguggugaacgaggaggcccuggaccugcuggcccccggcaagaccguggccggccugcuggagacccaggcccugacccagugcugccugcacagcgacuacugcagccagaacaccugccugaacggcggcaagugcagcuggacccacggcgccggcuacgugugcaagugccccccccaguucagcggcaagcacugcgagcagggcagagagaacugcaccuucgcccccugccuggagggcggcaccugcauccugagccccaagggcgccagcugcaacugcccccaccccuacaccggcgacagaugcgagauggaggccagaggcugcagcgagggccacugccuggugacccccgagauccagagaggcgacuggggccagcaggagcugcugaucaucaccguggccguggccuucaucaucaucagcaccgugggccugcuguucuacugcagaagaugcaagagccacaagcccguggccauggaggaccccgaccugcuggccagaagcgugggcguggacacccaggccaugcccgccaucgagcugaacccccugagcgccagcagcugcaacaaccugaaccagcccgagcccagcaaggccagcgugcccaacgagcuggugaccuucggccccaacagcaagcagagacccguggugugcagcgugccccccagacugccccccgccgccgugcccagccacagcgacaacgagcccgugaucaagagaaccuggagcagcgaggagaugguguaccccggcggcgccaugguguggccccccaccuacagcagaaacgagagaugggaguacccccacagcgaggugacccagggcccccugccccccagcgcccacagacacagcacccccguggugaugcccgagcccaacggccuguacggcggcuuccccuucccccuggagauggagaacaagagagccccccugccccccagauacagcaaccagaaccuggaggaccugaugcccagcagaccccccagccccagagagagacugguggcccccugccugaacgaguacaccgccaucagcuacuaccacagccaguucagacagggcggcggcggccccugccuggccgacggcggcuacaagggcgugggcaugagacugagcagagccggccccagcuacgccgugugcgagguggagggcgccccccuggccggccagggccagcccagagugccccccaacuacgagggcagcgacaugguggagagcgacuacggcagcugcgaggaggugauguucuaa

SEQ ID NO: 16963 - RNA, 13674 nt, Artificial Sequence
  FAT3__Homo_sapiens__NP_001008781
auggacaucaucaugggccacugcgugggcaccagaccccccgccugcugccugauccugcugcuguucaagcugcuggccaccgugagccagggccugcccggcaccggcccccugggcuuccacuucacccacagcaucuacaacgccaccguguacgagaacagcgccgccagaaccuacgugaacagccagagcagaaugggcaucacccugaucgaccugagcugggacaucaaguacagaaucgugagcggcgacgaggagggcuucuucaaggccgaggaggugaucaucgccgacuucugcuuccugagaaucagaaccaagggcggcaacagcgccauccugaacagagagauccaggacaacuaccugcugaucgugaagggcagcgugagaggcgaggaccuggaggccuggaccaaggugaacauccaggugcuggacaugaacgaccugagaccccuguucagccccaccaccuacagcgugaccaucgccgagagcaccccccugagaaccagcguggcccaggugaccgccaccgacgccgacaucggcagcaacggcgaguucuacuacuacuucaagaacaagguggaccuguucagcgugcaccccaccagcggcgugaucagccugagcggcagacugaacuacgacgagaagaacagauacgaccuggagauccuggccguggacagaggcaugaagcuguacggcaacaacggcgugagcagcaccgccaagcuguacgugcacaucgagagaaucaacgagcacgcccccaccauccacguggugacccacgugcccuucagccuggagaaggagcccaccuacgccguggugaccguggacgaccuggacgacggcgccaacggcgagaucgagagcgugagcaucguggccggcgacccccuggaccaguucuuccuggccaaggagggcaaguggcugaacgaguacaagaucaaggagagaaagcagaucgacugggagagcuuccccuacggcuacaaccugacccugcaggccaaggacaagggcagcccccagaagugcagcgcccugaaggccguguacaucggcaaccccaccagagacaccgugcccaucagauucgagaaggagguguacgacgugagcaucagcgaguucagcccccccggcguggugguggccaucgugaagcugagccccgagcccaucgacguggaguacaagcugagccccggcgaggacgccguguacuucaagaucaaccccagaagcggccugaucgugaccgccagaccccugaacaccgugaagaaggagguguacaagcuggaggugaccaacaaggagggcgaccugaaggcccaggugaccaucagcaucgaggacgccaacgaccacacccccgaguuccagcagccccuguacgacgccuacgugaacgagagcgugcccgugggcaccagcgugcugaccgugagcgccagcgacaaggacaagggcgagaacggcuacaucaccuacagcaucgccagccugaaccugcugcccuucgugaucaaccaguucaccggcgugaucagcaccaccgaggagcuggacuucgagagcagccccgagaucuacagauucaucgugagagccagcgacuggggcagccccuacagacacgagagcgaggugaacgugaccaucagaaucggcaacgugaacgacaacagcccccuguucgagaagguggccugccagggcgugaucagcuacgacuuccccgugggcggccacaucaccgccgugagcgccaucgacaucgacgagcuggagcuggugaaguacaagaucaucagcggcaacgagcugggcuucuucuaccugaaccccgacagcggcgugcugcagcugaagaagagccugaccaacagcggcaucaagaacggcaacuucgcccugagaaucaccgccaccgacggcgagaaccuggccgaccccaugagcaucaacaucagcgugcugcacggcaaggugagcagcaagagcuucagcugcagagagaccagaguggcccagaagcuggccgagaagcugcugaucaaggccaaggccaacggcaagcugaaccuggaggacggcuuccuggacuucuacagcaucaacagacagggccccuacuucgacaagagcuuccccagcgacguggccgugaaggaggaccugcccgugggcgccaacauccugaagaucaaggccuacgacgccgacagcggcuucaacggcaaggugcuguucaccaucagcgacggcaacaccgacagcugcuucaacaucgacauggagaccggccagcugaaggugcugaugcccauggacagagagcacaccgaccuguaccugcugaacaucaccaucuacgaccugggcaacccccagaagagcagcuggagacugcugaccaucaacguggaggacgccaacgacaacagccccguguucauccaggacagcuacagcgugaacauccuggagagcagcggcaucggcaccgagaucauccagguggaggccagagacaaggaccugggcagcaacggcgaggugaccuacagcgugcugaccgacacccagcaguucgccaucaacagcagcaccggcaucguguacguggccgaccagcuggacagagagagcaaggccaacuacagccugaagaucgaggccagagacaaggccgagagcggccagcagcuguucagcguggugacccugaagguguuccuggacgacgugaacgacugcagccccgccuucauccccagcagcuacagcgugaaggugcuggaggaccugcccgugggcaccgugaucgccuggcuggagacccacgaccccgaccugggccugggcggccaggugagauacagccuggugaacgacuacaacggcagauucgagaucgacaaggccagcggcgccaucagacugagcaaggagcuggacuacgagaagcagcaguucuacaaccugaccgugagagccaaggacaagggcagacccgugagccugagcagcgugagcuucguggagguggaggugguggacgugaacgagaaccugcacacccccuacuuccccgacuucgccguggugggcagcgugaaggagaacagcagaaucggcaccagcgugcugcaggugaccgccagagacgaggacagcggcagagacggcgagauccaguacagcaucagagacggcagcggccugggcagauucagcaucgacgacgagagcggcgugaucaccgccgccgacauccuggacagagagaccaugggcagcuacuggcugaccguguacgccaccgacagaggcguggugccccuguacagcaccaucgagguguacaucgagguggaggacgugaacgacaacgccccccugaccagcgagcccaucuacuaccccguggugauggagaacagccccaaggacgugagcgugauccagauccaggccgaggaccccgacagcagcagcaacgagaagcugaccuacagaaucaccagcggcaacccccagaacuucuucgccaucaacaucaagaccggccugaucaccaccaccagcagaaagcuggacagagagcagcaggccgagcacuuccuggaggugaccgugaccgacggcggccccagccccaagcagagcaccaucugggugguggugcaggugcuggacgagaacgacaacaagccccaguuccccgagaagguguaccagaucaagcugcccgagagagacagaaagaagagaggcgagcccaucuacagagccuucgccuucgacagagacgagggccccaacgccgagaucagcuacagcaucguggacggcaacgacgacggcaaguucuucaucgaccccaagaccggcauggugagcagcagaaagcaguucaccgccggcagcuacgacauccugaccaucaaggccguggacaacggcagaccccagaagagcagcaccgccagacugcacaucgaguggaucaagaagcccccccccagccccaucccccugaccuucgacgagcccuucuacaacuucaccgugauggagagcgacagagugaccgagaucgugggcguggugagcgugcagcccgccaacaccccccugugguucgacaucgugggcggcaacuucgacagcgccuucgacgccgagaagggcgugggcaccaucgugaucgccaagccccuggacgccgagcagagaagcaucuacaacaugagcguggaggugaccgacggcaccaacguggccgugacccagguguucaucaaggugcuggacaacaacgacaacggccccgaguucagccagcccaacuacgacgugaccaucagcgaggacgugcugcccgacaccgagauccugcagaucgaggccaccgacagagacgagaagcacaagcugagcuacaccgugcacagcagcaucgacagcaucagcaugagaaaguucagaaucgaccccagcaccggcgugcuguacaccgccgagagacuggaccacgaggcccaggacaagcacauccugaacaucauggugagagaccaggaguuccccuacagaagaaaccuggccagagugaucgugaacguggaggacgccaacgaccacagccccuacuucaccaacccccuguacgaggccagcguguucgagagcgccgcccugggcagcgccgugcugcaggugaccgcccuggacaaggacaagggcgagaacgccgagcugaucuacaccaucgaggccggcaacaccggcaacauguucaagaucgagcccgugcugggcaucaucaccaucugcaaggagcccgacaugaccaccaugggccaguucgugcugagcaucaaggugaccgaccagggcagcccccccaugagcgccaccgccaucgugagaaucagcgugaccaugagcgacaacagccaccccaaguucauccacaaggacuaccaggccgaggugaacgagaacguggacaucggcaccagcgugauccugaucagcgccaucagccagagcacccugaucuacgaggugaaggacggcgacaucaacggcaucuucaccaucaaccccuacagcggcgugaucaccacccagaaggcccuggacuacgagagaaccagcagcuaccagcugaucauccaggccaccaacauggccggcauggccagcaacgccaccgugaacauccagaucguggacgagaacgacaacgcccccguguuccuguucagccaguacagcggcagccugagcgaggccgcccccaucaacagcaucgugagaagccuggacaacagcccccuggugaucagagccaccgacgccgacagcaacagaaacgcccugcugguguaccagaucguggagagcaccgccaagaaguucuucaccguggacagcagcaccggcgccaucagaaccaucgccaaccuggaccacgagaccaucgcccacuuccacuuccacgugcacgugagagacagcggcagcccccagcugaccgccgagagccccguggaggugaacaucgaggugaccgacgugaacgacaacccccccguguucacccaggccguguucgagaccauccugcugcugcccaccuacgugggcguggaggugcugaaggugagcgccaccgaccccgacagcgaggugccccccgagcugaccuacagccugauggagggcagccuggaccacuuccugaucgacagcaacagcggcgugcugaccaucaagaacaacaaccugagcaaggaccacuacaugcugaucgugaaggugagcgacggcaaguucuacagcaccagcauggugaccaucauggugaaggaggccauggacagcggccugcacuucacccagagcuucuacagcaccagcaucagcgagaacaacaccaacaucaccaagguggccaucgugaacgccgugggcaacagacugaacgagccccugaaguacagcauccugaaccccggcaacaaguucaagaucaagagcaccagcggcgugauccagaccaccggcgugcccuucgacagagaggagcaggagcuguacgagcuggugguggaggccagcagagagcuggaccaccugagaguggccagagugguggugagagugaacaucgaggacaucaacgacaacagccccguguucgugggccugcccuacuacgccgccgugcagguggacgccgagcccggcacccugaucuaccaggugaccgccaucgacaaggacaagggccccaacggcgaggugaccuacgugcugcaggacgacuacggccacuucgagaucaaccccaacagcggcaacgugauccugaaggaggccuucaacagcgaccugagcaacaucgaguacggcgugaccauccuggccaaggacggcggcaagcccagccugagcaccagcguggagcugcccaucaccaucgugaacaaggccaugcccguguucgacaagcccuucuacaccgccagcgugaacgaggacaucagaaugaacacccccauccugagcaucaacgccaccagccccgagggccagggcaucaucuacaucaucaucgacggcgaccccuucaagcaguucaacaucgacuucgacaccggcgugcugaagguggugagcccccuggacuacgaggugaccagcgccuacaagcugaccaucagagccagcgacgcccugaccggcgccagagccgaggugaccguggaccugcuggugaacgacgugaacgacaacccccccaucuucgaccagcccaccuacaacaccacccugagcgaggccagccugaucggcacccccgugcugcagguggugagcaucgacgccgacagcgagaacaacaagauggugcacuaccagaucgugcaggacaccuacaacagcaccgacuacuuccacaucgacagcagcagcggccugauccugaccgccagaaugcuggaccacgagcuggugcagcacugcacccugaaggugagaagcaucgacagcggcuuccccagccugagcagcgaggugcuggugcacaucuacaucagcgacgugaacgacaacccccccguguucaaccagcugaucuacgagagcuacgugagcgagcuggcccccagaggccacuucgugaccugcgugcaggccagcgacgccgacagcagcgacuucgacagacuggaguacagcauccugagcggcaacgacagaaccagcuuccugauggacagcaagagcggcgugaucacccugagcaaccacagaaagcagagaauggagccccuguacagccugaacgugagcgugagcgacggccuguucaccagcaccgcccaggugcacaucagagugcugggcgccaaccuguacagccccgccuucagccagagcaccuacguggccgaggugagagagaacguggccgccggcaccaaggugauccacgugagagccaccgacggcgaccccggcaccuacggccagaucagcuacgccaucaucaacgacuucgccaaggacagauuccugaucgacagcaacggccaggugaucaccaccgagagacuggacagagagaacccccuggagggcgacgugagcaucuucgugagagcccuggacggcggcggcagaaccaccuucugcaccgugagagugaucgugguggacgagaacgacaacgccccccaguucaugaccguggaguacagagccagcgugagagccgacgugggcagaggccaccuggugacccaggugcaggccaucgaccccgacgacggcgccaacagcagaaucaccuacagccuguacagcgaggccagcgugagcguggccgaccugcuggagaucgaccccgacaacggcuggauggugaccaagggcaacuucaaccagcugaagaacaccgugcugagcuucuucgugaaggccguggacggcggcauccccgugaagcacagccugauccccguguacauccacgugcugccccccgagaccuuccugcccagcuucacccagagccaguacagcuucaccaucgccgaggacaccgccaucggcagcaccguggacacccugagaauccugcccagccagaacgugugguucagcaccgugaacggcgagagacccgagaacaacaagggcggcaucuucgugaucgagcaggagaccggcaccaucaagcuggacaagagacuggacagagagaccagccccgccuuccacuucaagguggccgccaccaucccccuggacaagguggacaucguguucaccguggacguggacaucaaggugcuggaccugaacgacaacaagcccguguucgagaccagcagcuacgacaccaucaucauggagggcaugcccgugggcaccaagcugacccaggugagagccaucgacauggacuggggcgccaacggccaggugaccuacagccugcacagcgacagccagcccgagaaggugauggaggccuucaacaucgacagcaacaccggcuggaucagcacccugaaggaccuggaccacgagaccgaccccaccuucaccuucagcgugguggccagcgaccugggcgaggccuucagccugagcagcaccgcccuggugagcgugagagugaccgacaucaacgacaacgcccccguguucgcccaggagguguacagaggcaacgugaaggagagcgacccccccggcgaggugguggccgugcugagcaccugggacagagacaccagcgacgugaacagacaggugagcuaccacaucaccggcggcaaccccagaggcagauucgcccugggccuggugcagagcgaguggaagguguacgugaagagaccccuggacagagaggagcaggacaucuacuuccugaacaucaccgccaccgacggccuguucgugacccaggccaugguggaggugagcgugagcgacgugaacgacaacagccccgugugcgaccagguggccuacaccgcccugcugcccgaggacauccccagcaacaagaucauccugaaggugagcgccaaggacgccgacaucggcagcaacggcuacaucagauacagccuguacggcagcggcaacagcgaguucuuccuggaccccgagagcggcgagcugaagacccuggcccugcuggacagagagagaauccccguguacagccugauggccaaggccaccgacggcggcggcagauucugccagagcaacauccaccugauccuggaggacgugaacgacaacccccccguguucagcagcgaccacuacaacaccugcguguacgagaacaccgccaccaaggcccugcugaccagagugcaggccguggaccccgacaucggcaucaacagaaaggugguguacagccuggccgacagcgccggcggcguguucagcaucgacagcagcagcggcaucaucauccuggagcagccccuggacagagagcagcagagcagcuacaacaucagcgugagagccaccgaccagagccccggccagagccugagcagccugaccaccgugaccaucaccgugcuggacaucaacgacaacccccccguguucgagagaagagacuaccuggugaccgugcccgaggacaccagccccggcacccaggugcuggccguguucgccaccagcaaggacaucggcaccaacgccgagaucaccuaccugaucagaagcggcaacgagcagggcaaguucaagaucaaccccaagaccggcggcaucagcgugagcgaggugcuggacuacgagcugugcaagagauucuaccuggugguggaggccaaggacggcggcacccccgcccugagcgccguggccaccgugaacaucaaccugaccgacgugaacgacaacccccccaaguucagccaggacguguacagcgccgugaucagcgaggacgcccuggugggcgacagcgugauccugcugaucgccgaggacguggacagccagcccaacggccagauccacuucagcaucgugaacggcgacagagacaacgaguucaccguggaccccgugcugggccuggugaaggugaagaagaagcuggacagagagagagugagcggcuacagccugcuggugcaggccguggacagcggcauccccgccaugagcagcaccgccaccgugaacaucgacaucagcgacgugaacgacaacagccccguguucacccccgccaacuacaccgccgugauccaggagaacaagcccgugggcaccagcauccugcagcugguggugaccgacagagacagcuuccacaacggcccccccuucagcuucagcauccugagcggcaacgaggaggaggaguucgugcuggacccccacggcauccugagaagcgccgugguguuccagcacaccgagagccuggaguacgugcugugcgugcaggccaaggacagcggcaagccccagcaggugagccacaccuacaucagagugagagugaucgaggagagcacccacaagcccaccgccaucccccuggagaucuucaucgugaccauggaggacgacuuccccggcggcgugaucggcaagauccacgccaccgaccaggacauguacgacgugcugaccuucgcccugaagagcgagcagaagagccuguucaaggugaacagccacgacggcaagaucaucgcccugggcggccuggacagcggcaaguacgugcugaacgugagcgugagcgacggcagauuccaggugcccaucgacgugguggugcacguggagcagcuggugcacgagaugcugcagaacaccgugaccaucagauucgagaacgugagccccgaggacuucgugggccugcacaugcacggcuucagaagaacccugagaaacgccgugcugacccagaagcaggacagccugagaaucaucagcauccagcccguggccggcaccaaccagcuggacaugcuguucgccguggagaugcacagcagcgaguucuacaagcccgccuaccugauccagaagcugagcaacgccagaagacaccuggagaacaucaugagaaucagcgccauccuggagaagaacugcagcggccuggacugccaggagcagcacugcgagcagggccugagccuggacagccacgcccugaugaccuacagcaccgccagaaucagcuucgugugccccagauucuacagaaacgugagaugcaccugcaacggcggccugugccccggcagcaacgaccccugcguggagaagcccugccccggcgacaugcagugcgugagcuacgaggccagcagaagacccuuccugugccagugcccccccggcaagcugggcgagugcagcggccacaccagccugagcuucgccggcaacagcuacaucaaguacagacugagcgagaacagcaaggaggaggacuucaagcuggcccugagacugagaacccugcagagcaacggcaucaucauguacaccagagccaaccccugcaucauccugaagaucguggacggcaagcugugguuccagcuggacugcggcagcggccccggcauccugggcaucagcggcagagccgugaacgacggcagcuggcacagcguguuccuggagcugaacagaaacuucaccagccugagccuggacgacagcuacguggagagaagaagagccccccuguacuuccagacccugagcaccgagagcagcaucuacuucggcgcccuggugcaggccgacaacaucagaagccugaccgacaccagagugacccaggugcugagcggcuuccagggcugccuggacagcgugauccugaacaacaacgagcugccccugcagaacaagagaagcagcuucgccgagguggugggccugaccgagcugaagcugggcugcgugcuguaccccgacgccugcaagagaagccccugccagcacggcggcagcugcaccggccugcccagcggcggcuaccagugcaccugccugagccaguucaccggcagaaacugcgagagcgagaucaccgccugcuuccccaaccccugcagaaacggcggcagcugcgaccccaucggcaacaccuucaucugcaacugcaaggccggccugaccggcgugaccugcgaggaggacaucaacgagugcgagagagaggagugcgagaacggcggcagcugcgugaacguguucggcagcuuccugugcaacugcacccccggcuacgugggccaguacugcggccugagacccgugguggugcccaacauccaggccggccacagcuacgugggcaaggaggagcugaucggcaucgccguggugcuguucgugaucuucauccugguggugcuguucaucguguucagaaagaagguguucagaaagaacuacagcagaaacaacaucacccuggugcaggaccccgccaccgccgcccugcugaacaagagcaacggcauccccuucagaaaccugagaggcagcggcgacggcagaaacguguaccaggaggugggccccccccaggugcccgugagacccauggccuacacccccugcuuccagagcgacagcagaagcaaccuggacaagaucguggacggccugggcggcgagcaccaggagaugaccaccuuccaccccgagagccccagaauccugaccgccagaagaggcgugguggugugcagcguggcccccaaccugcccgccgugagccccugcagaagcgacugcgacagcaucagaaagaacggcugggacgccggcaccgagaacaagggcguggacgaccccggcgaggugaccugcuucgccggcagcaacaagggcagcaacagcgaggugcagagccugagcagcuuccagagcgacagcggcgacgacaacgccuaccacugggacaccagcgacuggaugcccggcgccagacugagcgacaucgaggaggugcccaacuacgagaaccaggacggcggcagcgcccaccagggcagcaccagagagcuggagagcgacuacuaccugggcggcuacgacaucgacagcgaguacccccccccccacgaggaggaguuccugagccaggaccagcugccccccccccugcccgaggacuuccccgaccaguacgaggcccugccccccagccagcccgugagccuggccagcacccugagccccgacugcagaagaagaccccaguuccaccccagccaguaccugcccccccaccccuuccccaacgagaccgaccuggugggcccccccgccagcugcgaguucagcaccuucgccgugagcaugaaccagggcaccgagcccaccggccccgccgacagcgugagccugagccugcacaacagcagaggcaccagcagcagcgacgugagcgccaacugcggcuucgacgacagcgagguggccaugagcgacuacgagagcgugggcgagcugagccuggccagccugcacauccccuucguggagacccagcaccagacccagguguaa

SEQ ID NO: 16964 - RNA, 14946 nt, Artificial Sequence
  FAT4__Homo_sapiens__NP_078858
auggaccuggcccccgacagagccaccggcagacccuggcugccccugcacacccugagcgugagccagcugcugagaguguucuggcugcugagccugcugcccggccaggccugggugcacggcgccgagcccagacagguguuccaggugcuggaggagcagccccccggcacccuggugggcaccauccagaccagacccggcuucaccuacagacugagcgagagccacgcccuguucgccaucaacagcagcaccggcgcccuguacaccaccagcaccaucgacagagagagccugcccagcgacgugaucaaccugguggugcugagcagcgcccccaccuaccccaccgaggugagagugcuggugagagaccugaacgacaacgcccccguguuccccgaccccagcaucguggugaccuucaaggaggacagcagcagcggcagacaggugauccuggacaccgccaccgacagcgacaucggcagcaacggcguggaccacagaagcuacagaaucaucagaggcaacgaggccggcagauucagacuggacaucacccugaaccccagcggcgagggcgccuuccugcaccuggugagcaagggcggccuggacagagaggugaccccccaguaccagcugcugguggagguggaggacaagggcgagcccaagagaagaggcuaccugcaggugaacgugaccgugcaggacaucaacgacaacccccccguguucggcagcagccacuaccaggccggcgugcccgaggacgccguggugggcagcagcgugcugcagguggccgccgccgacgccgacgagggcaccaacgccgacaucagauacagacugcaggacgagggcacccccuuccagauggaccccgagaccggccugaucaccgugagagagccccuggacuucgaggccagaagacaguacagccugaccgugcaggccauggacagaggcgugcccagccugaccggcagagccgaggcccugauccagcugcuggacgugaacgacaacgaccccguggugaaguucagauacuuccccgccaccagcagauacgccagcguggacgagaacgcccaggugggcaccgugguggcccugcugaccgugaccgacgccgacagccccgccgccaacggcaacaucagcgugcagauccugggcggcaacgagcagagacacuucgaggugcagagcagcaaggugcccaaccugagccugaucaagguggccagcgcccuggacagagagagaauccccagcuacaaccugaccgugagcgugagcgacaacuacggcgccccccccggcgccgccgugcaggccagaagcagcguggccagccuggugaucuucgugaacgacaucaacgaccacccccccguguucagccagcagguguacagagugaaccugagcgaggaggccccccccggcagcuacgugagcggcaucagcgccaccgacggcgacagcggccugaacgccaaccugagauacagcaucgugagcggcaacggccugggcugguuccacaucagcgagcacagcggccuggugaccaccggcagcagcggcggccuggacagagagcuggccagccagaucgugcugaacaucagcgccagagaccagggcgugcaccccaaggugagcuacgcccagcugguggugacccugcuggacgugaacgacgagaagcccguguucagccagcccgagggcuacgacgugagcgugguggagaacgcccccaccggcaccgagcugcugaugcugagagccaccgacggcgaccugggcgacaacggcaccgugagauucagccugcaggaggccgagaccgacagaagaagcuucagacuggaccccgugagcggcagacugagcaccaucagcagccuggacagagaggagcaggccuucuacagccugcuggugcuggccaccgaccugggcagccccccccagagcagcauggccagaaucaacgugagccugcuggacaucaacgacaacagccccguguucuaccccgugcaguacuucgcccacaucaaggagaacgagcccggcggcagcuacaucaccaccgugagcgccaccgaccccgaccugggcaccaacggcaccgugaaguacagcaucagcgccggcgacagaagcagauuccaggugaacgcccagagcggcgugaucagcaccagaauggcccuggacagagaggagaagaccgccuaccagcugcagaucguggccaccgacggcggcaaccugcagagccccaaccaggccaucgugaccaucaccgugcuggacacccaggacaacccccccguguucagccagguggccuacagcuucgugguguucgagaacguggcccugggcuaccacgugggcagcgugagcgccagcaccauggaccugaacagcaacaucagcuaccugaucaccaccggcgaccagaagggcauguucgccaucaaccaggugaccggccagcugaccaccgccaacgugaucgacagagaggagcagagcuucuaccagcugaaggugguggccagcggcggcaccgugaccggcgacaccauggugaacaucaccgugaaggaccugaacgacaacagcccccacuuccugcaggccaucgagagcgugaacgugguggagaacuggcaggccggccacagcaucuuccaggccaaggccguggaccccgacgagggcgugaacggcauggugcuguacagccugaagcagaaccccaagaaccuguucgccaucaacgagaagaacggcaccaucagccugcugggcccccuggacgugcacgccggcagcuaccagaucgagauccuggccagcgacaugggcgugccccagcugagcagcagcgugauccugaccguguacgugcacgacgugaacgacaacagccccguguucgaccagcugagcuacgaggugacccugagcgagagcgagcccgugaacagcagauucuucaaggugcaggccagcgacaaggacagcggcgccaacggcgagaucgccuacaccaucgccgagggcaacaccggcgacgccuucggcaucuuccccgacggccagcuguacaucaagagcgagcuggacagagagcugcaggacagauacgugcugauggugguggccagcgacagagccguggagccccugagcgccaccgugaacgugaccgugauccuggaggacgugaacgacaacagaccccuguucaacagcaccaacuacaccuucuacuucgaggaggagcagagagccggcagcuucgugggcaaggugagcgccguggacaaggacuucggccccaacggcgaggugagauacagcuucgagauggugcagcccgacuucgagcugcacgccaucagcggcgagaucaccaacacccaccaguucgacagagagagccugaugagaagaagaggcaccgccguguucagcuucaccgugaucgccaccgaccagggcaucccccagccccugaaggaccaggccaccgugcacguguacaugaaggacaucaacgacaacgcccccaaguuccugaaggacuucuaccaggccaccaucagcgagagcgccgccaaccugacccaggugcugagagugagcgccagcgacguggacgagggcaacaacggccugauccacuacagcaucaucaagggcaacgaggagagacaguucgccaucgacagcaccagcggccaggugacccugaucggcaagcuggacuacgaggccacccccgccuacagccuggugauccaggccguggacagcggcaccaucccccugaacagcaccugcacccugaacaucgacauccuggacgagaacgacaacacccccagcuuccccaagagcacccuguucguggacgugcuggagaacaugagaaucggcgagcuggugagcagcgugaccgccaccgacagcgacagcggcgacaacgccgaccuguacuacagcaucaccggcaccaacaaccacggcaccuucagcaucagccccaacaccggcagcaucuuccuggccaagaagcuggacuucgagacccagagccuguacaagcugaacaucaccgccaaggaccagggcagaccccccagaagcagcaccaugagcguggugauccacgugagagacuucaacgacaacccccccagcuucccccccggcgacaucuucaagagcaucguggagaacauccccaucggcaccagcgugaucagcgugaccgcccacgaccccgacgccgacaucaacggccagcugagcuacaccaucauccagcagaugcccagaggcaaccacuucaccaucgacgaggugaagggcaccaucuacaccaacgccgagaucgacagagaguucgccaaccuguucgagcugaccgugaaggccaacgaccaggccgugcccaucgagaccagaagauacgcccugaagaacgugaccauccuggugaccgaccugaacgacaacgugcccauguucaucagccagaacgcccuggccgccgaccccagcgccgugaucggcagcgugcugaccaccaucauggccgccgaccccgacgagggcgccaacggcgagaucgaguacgagaucaucaacggcgacaccgacaccuucaucguggacagauacagcggcgaccugagaguggccagcgcccuggugcccagccagcugaucuacaaccugaucgugagcgccaccgaccugggccccgagagaagaaagagcaccaccgagcugaccaucauccugcagggccuggacggccccguguucacccagcccaaguacaucaccauccugaaggagggcgagcccaucggcaccaacgugaucagcaucgaggccgccagccccagaggcagcgaggcccccguggaguacuacaucgugagcgugagaugcgaggagaagaccgugggcagacuguucaccaucggcagacacaccggcaucauccagaccgccgccauccuggacagagagcagggcgccugccuguaccugguggacguguacgccaucgagaagagcaccgccuuccccagaacccagagagccgagguggagaucacccugcaggacaucaacgacaacccccccguguuccccaccgacaugcuggaccugaccguggaggagaacaucggcgacggcagcaagaucaugcagcugaccgccauggacgccgacgagggcgccaacgcccuggugaccuacaccaucaucagcggcgccgacgacagcuucagaaucgaccccgagagcggcgaccugaucgccaccagaagacuggacagagagagaagaagcaaguacagccugcuggugagagccgacgacggccugcagagcagcgacaugagaaucaacaucaccgugagcgacgugaacgaccacacccccaaguucagcagacccguguacagcuucgacauccccgaggacaccauccccggcagccugguggccgccauccuggccaccgacgacgacagcggcgugaacggcgagaucaccuacaucgugaacgaggacgacgaggacggcaucuucuuccugaaccccaucaccggcguguucaaccugaccagacugcuggacuacgaggugcagcaguacuacauccugaccgugagagccgaggacggcggcggccaguucaccaccaucagaguguacuucaacauccuggacgugaacgacaacccccccaucuucagccugaacagcuacagcaccagccugauggagaaccugcccgugggcagcaccgugcugguguucaacgugaccgacgccgacgacggcaucaacagccagcugaccuacagcaucgccagcggcgacagccugggccaguucaccguggacaagaacggcgugcugaaggugcugaaggcccuggacagagagagccagagcuucuacaaccugguggugcaggugcacgaccugccccagauccccgccagcagauucaccagcaccgcccaggugagcaucauccugcuggacgugaacgacaacccccccaccuuccugagccccaagcugaccuacauccccgagaacacccccaucgacaccgugguguucaaggcccaggccaccgaccccgacagcggccccaacagcuacaucgaguacacccugcugaacccccugggcaacaaguucagcaucggcaccaucgacggcgaggugagacugaccggcgagcuggacagagaggaggugagcaacuacacccugaccgugguggccaccgacaagggccagcccagccugagcagcagcaccgaggugguggugauggugcuggacaucaacgacaacaaccccaucuucgcccaggcccuguacaagguggagaucaacgagaacacccugaccggcaccgacaucauccagguguucgccgccgacggcgacgagggcaccaacggccaggugagauacggcaucgugaacggcaacaccaaccaggaguucagaaucgacagcgugaccggcgccaucaccguggccaagccccuggacagagagaagacccccaccuaccaccugaccgugcaggccaccgacagaggcagcacccccagaaccgacaccagcaccgugagcaucgugcugcuggacaucaacgacuucgugcccguguucgagcugagccccuacagcgugaacgugcccgagaaccugggcacccugcccagaaccauccugcaggugguggccagagacgacgacagaggcagcaacagcaagcugagcuacgugcuguucggcggcaacgaggacaacgccuucacccugagcgccagcggcgagcugggcgugacccagagccuggacagagagaccaaggagagauucgugcugaugaucaccgccaccgacagcggcagccccgcccugaccggcaccggcaccaucaacgugaucguggacgacgugaacgacaacgugcccaccuucgccagcaaggccuacuucaccaccauccccgaggacgcccccaccggcaccgacgugcugcuggugaacgccagcgacgccgacgccagcaagaacgccgugaucagaaucaucggcggcaacagccaguucaccaucaaccccagcaccggccagaucaucaccagcgcccugcuggacagagagaccaaggacaacuacacccuggugguggugugcagcgacgccggcagccccgagccccugagcagcagcaccagcgugcuggugaccgugaccgacgugaacgacaacccccccagauuccagcaccaccccuacgugacccacauccccagccccacccugcccggcagcuucguguucgccgugaccgugaccgacgccgacaucggccccaacagcgagcugcacuacagccugagcggcagaaacagcgagaaguuccacaucgacccccugagaggcgccaucauggccgccggcccccugaacggcgccagcgaggugaccuucagcgugcacgugaaggacggcggcagcuuccccaagaccgacagcaccaccgugaccgugagauucgugaacaaggccgacuuccccaaggugagagccaaggagcagaccuucauguuccccgagaaccagcccgugagcagccuggugaccaccaucaccggcagcagccugagaggcgagcccaugagcuacuacaucgccagcggcaaccugggcaacaccuuccagaucgaccagcugaccggccaggugagcaucagccagccccuggacuucgagaagauccagaaguacgugguguggaucgaggccagagacggcggcuucccccccuucagcagcuacgagaagcuggacaucaccgugcuggacgugaacgacaacgcccccaucuucaaggaggaccccuucaucagcgagauccuggagaaccugagccccagaaagauccugaccgugagcgccauggacaaggacagcggccccaacggccagcuggacuacgagaucgugaacggcaacauggagaacagcuucagcaucaaccacgccaccggcgagaucagaagcgugagaccccuggacagagagaaggugagccacuacgugcugaccaucaagagcagcgacaagggcagccccagccagagcaccagcgugaaggugaugaucaacauccuggacgagaacgacaacgcccccagauucagccagaucuucagcgcccacgugcccgagaacagcccccugggcuacaccgugaccagagugaccaccagcgacgaggacaucggcaucaacgccaucagcagauacagcaucauggacgccagccugcccuucaccaucaaccccagcaccggcgacaucgugaucagcagaccccugaacagagaggacaccgacagauacagaaucagagugagcgcccacgacagcggcuggaccgugagcaccgacgugaccaucuucgugaccgacaucaacgacaacgcccccagauucagcagaaccagcuacuaccuggacugccccgagcugaccgagaucggcagcaaggugacccagguguucgccaccgaccccgacgagggcagcaacggccagguguucuacuucaucaagagccagagcgaguacuucagaaucaacgccaccaccggcgagaucuucaacaagcagauccugaaguaccagaacgugaccggcuucagcaacgugaacaucaacagacacagcuucaucgugaccagcagcgacagaggcaagcccagccugaucagcgagaccaccgugaccaucaacaucguggacagcaacgacaacgccccccaguuccugaagagcaaguacuucacccccgugaccaagaacgugaaggugggcaccaagcugaucagagugaccgccaucgacgacaaggacuucggccugaacagcgagguggaguacuucaucagcaacgacaaccaccugggcaaguucaagcuggacaacgacaccggcuggaucagcguggccagcagccugaucagcgaccugaaccagaacuucuucaucaccgugaccgccaaggacaagggcaaccccccccugagcagccaggccaccgugcacaucaccgugaccgaggagaacuaccacacccccgaguucagccagagccacaugagcgccaccauccccgagagccacagcaucggcagcaucgugagaaccgugagcgccagagacagagacgccgccaugaacggccugaucaaguacagcaucagcagcggcaacgaggagggcaucuucgccaucaacagcagcaccggcauccugacccuggccaaggcccuggacuacgagcugugccagaagcacgagaugaccaucagcgccaucgacggcggcuggguggccagaaccggcuacugcagcgugaccgugaacgugaucgacgugaacgacaacagccccguguuccugagcgacgacuacuuccccaccgugcuggagaacgcccccagcggcaccaccgugauccaccugaacgccaccgacgccgacagcggcaccaacgccgugaucgccuacaccgugcagagcagcgacagcgaccuguucgugaucgaccccaacaccggcgugaucaccacccagggcuuccuggacuucgagaccaagcagagcuaccaccugaccgugaaggccuucaacgugcccgacgaggagagaugcagcuucgccaccgugaacauccagcugaagggcaccaacgaguacgugcccagauucgugagcaagcuguacuacuucgagaucagcgaggccgcccccaagggcaccaucgugggcgagguguucgccagcgacagagaccugggcaccgacggcgaggugcacuaccugaucuucggcaacagcagaaagaagggcuuccagaucaacaagaagaccggccagaucuacgugagcggcauccuggacagagagaaggaggagagagugagccugaaggugcuggccaagaacuucggcagcaucagaggcgccgacaucgacgaggugaccgugaacgugaccgugcuggacgccaacgacccccccaucuucacccugaacaucuacagcgugcagaucagcgagggcgugcccaucggcacccacgugaccuucgugagcgccuucgacagcgacagcauccccagcuggagcagauucagcuacuucaucggcagcggcaacgagaacggcgccuucagcaucaacccccagaccggccagaucaccgugaccgccgagcuggacagagagacccugcccaucuacaaccugagcgugcuggccguggacagcggcacccccagcgccaccggcagcgccagccugcuggugacccuggaggacaucaacgacaacggccccaugcugaccgugagcgagggcgaggugauggagaacaagagacccggcacccuggugaugacccugcagagcaccgaccccgaccugccccccaaccagggccccuucaccuacuaccugcugagcaccggccccgccaccagcuacuucagccugagcaccgccggcgugcugagcaccaccagagagaucgacagagagcagaucgccgacuucuaccugagcguggugaccaaggacagcggcgugccccagaugagcagcaccggcaccgugcacaucaccgugaucgaccagaacgacaaccccagccagagcagaaccguggagaucuucgugaacuacuacggcaaccuguuccccggcggcauccugggcagcgugaagccccaggaccccgacgugcuggacagcuuccacugcagccugaccagcggcgugaccagccuguucagcauccccggcggcaccugcgaccugaacagccagcccagaagcaccgacggcaccuucgaccugaccgugcugagcaacgacggcgugcacagcaccgugaccagcaacaucagaguguucuucgccggcuucagcaacgccaccguggacaacagcauccugcugagacugggcgugcccaccgugaaggacuuccugaccaaccacuaccugcacuuccugagaaucgccagcagccagcugaccggccugggcaccgccgugcagcuguacagcgccuacgaggagaacaacagaaccuuccugcuggccgccgugaagagaaaccacaaccaguacgugaaccccagcggcguggccaccuucuucgagagcaucaaggagauccugcugagacagagcggcgugaagguggagagcguggaccacgacagcugcgugcacggccccugccagaacggcggcagcugccugagaagacuggccgugagcagcgugcugaagagcagagagagccugcccgugaucaucguggccaacgagccccugcagcccuuccugugcaagugccugcccggcuacgccggcagcuggugcgagaucgacaucgacgagugccugcccagccccugccacagcggcggcaccugccacaaccuggugggcggcuucagcugcagcugccccgacggcuucaccggcagagccugcgagagagacaucaacgagugccugcagagccccugcaagaacggcgccaucugccagaacuuccccggcagcuucaacugcgugugcaagaccggcuacaccggcaagaugugcgagagcagcgugaacuacugcgagugcaaccccugcuucaacggcggcagcugccagagcggcguggacagcuacuacugccacugccccuucggcguguucggcaagcacugcgagcugaacagcuacggcuucgaggagcugagcuacauggaguuccccagccuggaccccaacaacaacuacaucuacgugaaguucgccaccaucaagagccacgcccugcugcuguacaacuacgacaaccagaccggcgacagagccgaguuccuggcccuggagaucgccgaggagagacugagauucagcuacaaccugggcagcggcaccuacaagcugaccaccaugaagaaggugagcgacggccacuuccacaccgugaucgccagaagagccggcauggccgccagccugaccguggacagcugcagcgagaaccaggagcccggcuacugcaccgugagcaacguggccgugagcgacgacuggacccuggacgugcagcccaacagagugaccgugggcggcaucagaagccuggagcccauccugcagagaagaggccacguggagagccacgacuucgugggcugcaucauggaguucgccgugaacggcagaccccuggagcccagccaggcccuggccgcccagggcauccuggaccagugccccagacuggagggcgccugcaccagaagccccugccagcacggcggcaccugcauggacuacuggagcuggcagcagugccacugcaaggagggccugaccggcaaguacugcgagaagagcgugacccccgacaccgcccugagccuggagggcaagggcagacuggacuaccacaugagccagaacgagaagagagaguaccugcugagacagagccugagaggcgccaugcuggagcccuucggcgugaacagccuggaggugaaguucagaaccagaagcgagaacggcgugcugauccacauccaggagagcagcaacuacaccaccgugaagaucaagaacggcaagguguacuucaccagcgacgccggcaucgccggcaagguggagagaaacauccccgagguguacguggccgacggccacuggcacaccuuccugaucggcaagaacggcaccgccaccgugcugagcguggacagaaucuacaacagagacaucauccaccccacccaggacuucggcggccuggacgugcugaccaucagccugggcggcaucccccccaaccaggcccacagagacgcccagaccgccggcuucgacggcugcaucgccagcaugugguacggcggcgagagccugcccuucagcggcaagcacagccuggccagcaucagcaagaccgaccccagcgugaagaucggcugcagaggccccaacaucugcgccagcaaccccugcuggggcgaccugcugugcaucaaccagugguacgccuacagaugcgugccccccggcgacugcgccagccaccccugccagaacggcggcagcugcgagcccggccugcacagcggcuucaccugcagcugccccgacagccacaccggcagaaccugcgagauggugguggccugccugggcgugcugugcccccagggcaaggugugcaaggccggcagccccgccggccacgugugcgugcugagccagggccccgaggagaucagccugccccugugggccgugcccgccaucgugggcagcugcgccaccgugcuggcccugcuggugcugagccugauccugugcaaccagugcagaggcaagaaggccaagaaccccaaggaggagaagaagcccaaggagaagaagaagaagggcagcgagaacguggccuucgacgaccccgacaacaucccccccuacggcgacgacaugaccgugagaaagcagcccgagggcaaccccaagcccgacaucaucgagagagagaaccccuaccugaucuacgacgagaccgacaucccccacaacagcgagaccauccccagcgccccccuggccagccccgagcaggagaucgagcacuacgacaucgacaacgccagcagcaucgcccccagcgacgccgacaucauccagcacuacaagcaguucagaagccacacccccaaguucagcauccagagacacagcccccugggcuucgccagacagagccccaugccccugggcgccagcagccugaccuaccagcccagcuacggccagggccugagaaccagcagccugagccacagcgccugccccacccccaacccccugagcagacacagccccgcccccuucagcaagagcagcaccuucuacagaaacagccccgccagagagcugcaccugcccaucagagacggcaacacccuggagaugcacggcgacaccugccagcccggcaucuucaacuacgccaccagacugggcagaagaagcaagagcccccaggccauggccagccacggcagcagacccggcagcagacugaagcagcccaucggccagaucccccuggagagcagcccccccgugggccugagcaucgaggagguggagagacugaacacccccagacccagaaaccccagcaucugcagcgccgaccacggcagaagcagcagcgaggaggacugcagaagaccccugagcagaaccagaaaccccgccgacggcauccccgcccccgagagcagcagcgacagcgacagccacgagagcuucaccugcagcgagauggaguacgacagagagaagcccaugguguacaccagcagaaugcccaagcugagccaggugaacgagagcgacgccgacgacgaggacaacuacggcgccagacugaagcccagaagauaccacggcagaagagccgagggcggccccgugggcacccaggccgccgcccccggcaccgccgacaacacccugcccaugaagcugggccagcaggccggcaccuucaacugggacaaccugcugaacuggggccccggcuucggccacuacguggacguguucaaggaccuggccagccugcccgagaaggccgccgccaacgaggagggcaaggccggcaccaccaagcccgugcccaaggacggcgaggccgagcaguacguguaa

SEQ ID NO: 16965 - RNA, 552 nt, Artificial Sequence
  FATE1__Homo_sapiens__NP_149076
auggccggcggcccccccaacaccaaggccgagauggagaugagccuggccgaggagcugaaccacggcagacagggcgagaaccaggagcaccuggugaucgccgagaugauggagcugggcagcagaagcagaggcgccagccagaagaagcagaagcuggagcagaaggccgccggcagcgccagcgccaagagaguguggaacaugaccgccaccagacccaagaagaugggcagccagcugcccaagcccagaaugcugagagagagcggccacggcgacgcccaccugcaggaguacgccggcaacuuccagggcaucagauuccacuacgacagaaaccccggcaccgacgccguggcccagaccagccuggaggaguucaacgugcuggagauggaggugaugagaagacagcuguacgccgugaacagaagacugagagcccuggaggagcagggcgccaccuggagacacagagagacccugaucaucgccgugcuggugagcgccagcaucgccaaccuguggcuguggaugaaccaguaa

SEQ ID NO: 16966 - RNA, 402 nt, Artificial Sequence
  FAU__Homo_sapiens__NP_001988
augcagcuguucgugagagcccaggagcugcacaccuucgaggugaccggccaggagaccguggcccagaucaaggcccacguggccagccuggagggcaucgcccccgaggaccagguggugcugcuggccggcgccccccuggaggacgaggccacccugggccagugcggcguggaggcccugaccacccuggagguggccggcagaaugcugggcggcaaggugcacggcagccuggccagagccggcaaggugagaggccagacccccaagguggccaagcaggagaagaagaagaagaagaccggcagagccaagagaagaaugcaguacaacagaagauucgugaacguggugcccaccuucggcaagaagaagggccccaacgccaacagcuaa

SEQ ID NO: 16967 - RNA, 3402 nt, Artificial Sequence
  FBF1__Homo_sapiens__NP_001074011
auggcccccaagaccaagaagggcugcaaggugacccugcccgagaagcccgugaagcuggccagccacaccagagacaccaccggcgugagccagauguuccccagcagcaaggccagaaccaagagccugcugggcgacgacguguucagcaccauggccggccuggaggaggccgacgccgaggugagcggcaucagcgaggccgacccccaggcccugcugcaggccaugaaggaccuggacggcauggacgccgacauccugggccugaagaagagcaacagcgcccccagcaagaaggccgccaaggaccccggcaagggcgagcugcccaaccaccccaagcccgccggcggcgccauccccaccaagaagagccugcccagccccagcagcagcggccaccagaacagaagauucagcagcgaggaccuggaggacccccugagaggccugcugagcuacgacgagggcggcaucaccaagcagccccccgugacccagagcaagaccgccagcgacaagagccccagcaccgugagagaccagggccccagcaucccccugacccccggcgacacccccaucagaaagaaggaggagcugcuguucgacgacggcgacgacaucauggccacccugggcuucggcgacagccccaaggccgagaagagacagaucggcgaccaggagggccccagacccgccagaagcacccuggacgagcugcugggcagaggcauggccaccaagcugcuggccagacccggcaccggcgagcacagagaguucaagcuggacaagaaguaccagagaccccaggacagcgaggacauguggggcgacgaggacuucaccuucggcgccuaccagcccaccguggugagcagcgagggcagacagagcagaagacagagcgugagauucuucgccgacagcggcgccgaccccaagggcgagcccggcagcaagcagagcccccccauggccagcagccccauccagcccagaaagggcggcgccgacuggcugggccugaaggacgaggaccuggaccuguuccccgccagccccaccagagaggcccacagagagagcagcgugcccgugacccccagcgugcccccccccgccagccagcacagcacccccgccggccugccccccagcagagccaagccccccaccgagggcgccggcagccccgccaaggccagccaggccagcaagcugagagccagcaaggaggagaaggaggacuggcugagccacgcccugagcagaaagaagagccagggccuggccagagagcagcacgccggcaccagcgagggccugcaccuggccggcaccgccggccacccccccagcggcagccagccccugaccagcacccagggccuggagcacgccgccgccggcggcagcagcggcaccaccgccagagagagacccugcgugagacccggcgugagcggcagccccgugacccagaaccacgccgccagcgcccugcccaccggcagccccaagagaggcaccgcccccggcgaccugagcgccaccgagcccgccaccugcuuccccagcacccagaagcccaccgagcccagcgugcccgugcagccccugcugcccgagagccuggccagaagccugcugcccagcaccgaguaccagaagcagcugcuggccgcccaggugcagcugcagugcagccccgccgagcugcaggccgagcugcugcacagccaggccagacuggccgagcuggaggcccaggugagaaagcuggagcuggagagagcccagcacgagcugcugcugggcagccugcagcagcagcaccaggccgaccuggagcugaucgagagcgcccacagaagcagaaucaaggugcuggagaccagcuaccagcagagagaggagagacugagaagagagaacgaggagcugagcgccagauaccugagccagugccaggaggccgagcaggccagagccgagcugaccgcccagcaccagagaagacuggccgccaucgcccaggagaaggaccaggagauggagagacugagagagcugcagagagccagcauccuggacaugagaagagaccacgaggagcagcugcagagacugaagcugcugaaggacagagagguggacgccgccaccagcgccaccagccacaccagaagccugaacagcaucauccaccagauggagaaguucagcagcagccugcacgagcugagcagcagaguggaggccagccaccugaccaccagccaggagagagagcugggcaucagacagagagacgagcagcugagagcccugcaggagagacugggccagcagcagagagacauggaggaggagagaagcagacagcaggaggugaucggcaagauggaggccagacugaacgagcagagcagacugcuggagcaggagagauggagagugaccgccgagcagagcaaggccgagagcaugcagagagcccuggaggagcagagaaaggugaccgcccagcagauggccauggagagagccgagcuggagagagccaagagcgcccugcuggaggagcagaagagcgugaugcugaagugcggcgaggagagaagaagacuggccgccgagugggccgaguucagcgcccagcagaagcugagcaaggagagagccgagagagaggccgagagagcccugcagguggacacccagagagagggcacccugaucagccuggccaaggagcaggccgagcugaagaucagagccagcgagcugagagccgaggagaagcagcuggccgccgagagagccgcccuggagcaggagagacaggagcugagacuggagaaggagagaaucaacgccaccgcccugagagugaagcugagagccgaggagguggagagcaugagcaagguggccagcgagaaguacgaggagggcgagagagcccugagagaggcccagcaggugcaggccgagcagcaggccagacugcaggccgugcagcagcagcaggagagacugagaaagcaggagcagcacaugcaccaggagcaccugagccuggcccagcagagacugcagcuggacagagccagacaggaccugcccagcagccuggugggccuguuccccagagcccagggccccgccgccagcagccagagcgcccugaugccccccgcccccaccaccagauggugcagccagccccccaccggccuggaccccagcccccugcaccugcacgccagacuggcccugcugagacacauggccgagcaggacagagacuuccuggagaacgagcaguucuuccuggagacccugaagaagggcagcuacaaccugaccagccacagcgccuaa

SEQ ID NO: 16968 - RNA, 966 nt, Artificial Sequence
  FBL__Homo_sapiens__NP_001427
augaagcccggcuucagccccagaggcggcggcuucggcggcagaggcggcuucggcgacagaggcggcagaggcggcagaggcggcuucggcggcggcagaggcagaggcggcggcuucagaggcagaggcagaggcggcggcggcggcggcggcggcggcggcggcggcggcagaggcggcggcggcuuccacagcggcggcaacagaggcagaggcagaggcggcaagagaggcaaccagagcggcaagaacgugaugguggagccccacagacacgagggcguguucaucugcagaggcaaggaggacgcccuggugaccaagaaccuggugcccggcgagagcguguacggcgagaagagagugagcaucagcgagggcgacgacaagaucgaguacagagccuggaaccccuucagaagcaagcuggccgccgccauccugggcggcguggaccagauccacaucaagcccggcgccaaggugcuguaccugggcgccgccagcggcaccaccgugagccacgugagcgacaucgugggccccgacggccugguguacgccguggaguucagccacagaagcggcagagaccugaucaaccuggccaagaagagaaccaacaucauccccgugaucgaggacgccagacacccccacaaguacagaaugcugaucgccaugguggacgugaucuucgccgacguggcccagcccgaccagaccagaaucguggcccugaacgcccacaccuuccugagaaacggcggccacuucgugaucagcaucaaggccaacugcaucgacagcaccgccagcgccgaggccguguucgccagcgaggugaagaagaugcagcaggagaacaugaagccccaggagcagcugacccuggagcccuacgagagagaccacgccgugguggugggcguguacagacccccccccaaggugaagaacuaa

SEQ ID NO: 16969 - RNA, 945 nt, Artificial Sequence
  FBLIM1__Homo_sapiens__XP_011539920
auggccagcaagcccgagaagagaguggccagcagcguguucaucacccuggccccccccagaagagacguggccguggccgaggaggugagacaggccgugugcgaggccagaagaggcagacccugggaggcccccgcccccaugaagacccccgaggccggccuggccggcagacccagccccuggaccacccccggcagagccgccgccaccgugcccgccgcccccaugcagcuguucaacggcggcugccccccccccccccccgugcuggacggcgaggacgugcugcccgaccuggaccugcugccccccccccccccccccccccccgugcugcugcccagcgaggaggaggcccccgcccccaugggcgccagccugaucgccgaccuggagcagcugcaccugagccccccccccccccccccccaggcccccgccgagggccccagcgugcagcccggcccccugagacccauggaggaggagcugccccccccccccgccgagcccguggagaagggcgccagcaccgacaucugcgccuucugccacaagaccgugagccccagagagcuggccguggaggccaugaagagacaguaccacgcccagugcuucaccugcagaaccugcagaagacagcuggccggccagagcuucuaccagaaggacggcagaccccugugcgagcccugcuaccaggacacccuggagagaugcggcaagugcggcgagguggugagagaccacaucaucagagcccugggccaggccuuccaccccagcugcuucaccugcgugaccugcgccagaugcaucggcgacgagagcuucgcccugggcagccagaacgagguguacugccuggacgacuucuacagaaccgccggcagcagcugccugagcagccccagaaccaaggccgccacccccuaa

SEQ ID NO: 16970 - RNA, 2052 nt, Artificial Sequence
  FBLN1__Homo_sapiens__NP_001987
auggagagagccgcccccagcagaagagugccccugccccugcugcugcugggcggccuggcccugcuggccgccggcguggacgccgacgugcugcuggaggccugcugcgccgacggccacagaauggccacccaccagaaggacugcagccugcccuacgccaccgagagcaaggagugcagaauggugcaggagcagugcugccacagccagcuggaggagcugcacugcgccaccggcaucagccuggccaacgagcaggacagaugcgccaccccccacggcgacaacgccagccuggaggccaccuucgugaagagaugcugccacugcugccugcugggcagagccgcccaggcccagggccagagcugcgaguacagccugauggugggcuaccagugcggccagguguucagagccugcugcgugaagagccaggagaccggcgaccuggacgugggcggccugcaggagaccgacaagaucaucgagguggaggaggagcaggaggaccccuaccugaacgacagaugcagaggcggcggccccugcaagcagcagugcagagacaccggcgacgagguggugugcagcugcuucgugggcuaccagcugcugagcgacggcgugagcugcgaggacgugaacgagugcaucaccggcagccacagcugcagacugggcgagagcugcaucaacaccgugggcagcuucagaugccagagagacagcagcugcggcaccggcuacgagcugaccgaggacaacagcugcaaggacaucgacgagugcgagagcggcauccacaacugccugcccgacuucaucugccagaacacccugggcagcuucagaugcagacccaagcugcagugcaagagcggcuucauccaggacgcccugggcaacugcaucgacaucaacgagugccugagcaucagcgcccccugccccaucggccacaccugcaucaacaccgagggcagcuacaccugccagaagaacgugcccaacugcggcagaggcuaccaccugaacgaggagggcaccagaugcguggacguggacgagugcgccccccccgccgagcccugcggcaagggccacagaugcgugaacagccccggcagcuucagaugcgagugcaagaccggcuacuacuucgacggcaucagcagaaugugcguggacgugaacgagugccagagauaccccggcagacugugcggccacaagugcgagaacacccugggcagcuaccugugcagcugcagcgugggcuucagacugagcguggacggcagaagcugcgaggacaucaacgagugcagcagcagccccugcagccaggagugcgccaacguguacggcagcuaccagugcuacugcagaagaggcuaccagcugagcgacguggacggcgugaccugcgaggacaucgacgagugcgcccugcccaccggcggccacaucugcagcuacagaugcaucaacauccccggcagcuuccagugcagcugccccagcagcggcuacagacuggcccccaacggcagaaacugccaggacaucgacgagugcgugaccggcauccacaacugcagcaucaacgagaccugcuucaacauccagggcggcuucagaugccuggccuucgagugccccgagaacuacagaagaagcgccgccaccagaugcgagagacugcccugccacgagaacagagagugcagcaagcugccccugagaaucaccuacuaccaccugagcuuccccaccaacauccaggcccccgccgugguguucagaaugggccccagcagcgccgugcccggcgacagcaugcagcuggccaucaccggcggcaacgaggagggcuucuucaccaccagaaaggugagcccccacagcggcgugguggcccugaccaagcccgugcccgagcccagagaccugcugcugaccgugaagauggaccugagcagacacggcaccgugagcagcuucguggccaagcuguucaucuucgugagcgccgagcuguaa

SEQ ID NO: 16971 - RNA, 3696 nt, Artificial Sequence
  FBLN2__Homo_sapiens__NP_001158507
auggugcugcugugggagcccgccggcgccuggcuggcccugggccuggcccuggcccugggccccagcguggccgccgccgcccccagacaggacugcaccggcguggagugccccccccuggagaacugcaucgaggaggcccuggagcccggcgccugcugcgccaccugcgugcagcagggcugcgccugcgagggcuaccaguacuacgacugccugcagggcggcuucgugagaggcagagugcccgccggccagagcuacuucguggacuucggcagcaccgagugcagcugcccccccggcggcggcaagaucagcugccaguucaugcugugccccgagcugccccccaacugcaucgaggccguggugguggccgacagcugcccccagugcggccaggugggcugcgugcacgccggccacaaguacgccgccggccacaccgugcaccugccccccugcagagccugccacugccccgacgccggcggcgagcugaucugcuaccagcugcccggcugccacggcaacuucagcgacgccgaggagggcgaccccgagagacacuacgaggaccccuacagcuacgaccaggagguggccgagguggaggccgccaccgcccugggcggcgaggugcaggccggcgccgugcaggccggcgccggcggcccccccgccgcccugggcggcggcagccagccccugagcaccauccaggccccccccuggcccgccgugcugcccagacccaccgccgccgccgcccugggcccccccgcccccgugcaggccaaggccagaagagugaccgaggacagcgaggaggaggaggaggaggaggaggagagagaggagauggccgugaccgagcagcuggccgccggcggccacagaggccuggacggccugcccaccaccgcccccgccggccccagccugcccauccaggaggagagagccgaggccggcgccagagccgaggccggcgccagacccgaggagaaccugauccuggacgcccaggccaccagcagaagcaccggccccgagggcgugacccacgcccccagccugggcaaggccgcccuggugcccacccaggccgugcccggcagccccagagaccccgugaagcccagcccccacaacauccugagcaccagccugcccgacgccgccuggaucccccccaccagagaggugcccagaaagccccaggugcugccccacagccacguggaggaggacaccgaccccaacagcgugcacagcauccccagaagcagccccgagggcagcaccaaggaccugaucgagaccugcugcgccgccggccagcagugggccaucgacaacgacgagugccuggagauccccgagagcggcaccgaggacaacgugugcagaaccgcccagagacacugcugcgugagcuaccugcaggagaagagcugcauggccggcgugcugggcgccaaggagggcgagaccugcggcgccgaggacaacgacagcugcggcaucagccuguacaagcagugcugcgacugcugcggccugggccugagagugagagccgagggccagagcugcgagagcaaccccaaccugggcuaccccugcaaccacgugaugcugagcugcugcgagggcgaggagccccugaucgugcccgaggugagaagaccccccgagcccgccgccgcccccagaagagugagcgaggccgagauggccggcagagaggcccugagccugggcaccgaggccgagcugcccaacagccugcccggcgacgaccaggacgagugccugcugcugcccggcgagcugugccagcaccugugcaucaacaccgugggcagcuaccacugcgccugcuuccccggcuucagccugcaggacgacggcagaaccugcagacccgagggccaccccccccagcccgaggccccccaggagcccgcccugaagagcgaguucagccagguggccagcaacaccaucccccugccccugccccagcccaacaccugcaaggacaacggccccugcaagcaggugugcagcaccgugggcggcagcgccaucugcagcugcuuccccggcuacgccaucauggccgacggcgugagcugcgaggaccaggacgagugccugaugggcgcccacgacugcagcagaagacaguucugcgugaacacccugggcagcuucuacugcgugaaccacaccgugcugugcgccgacggcuacauccugaacgcccacagaaagugcguggacaucaacgagugcgugaccgaccugcacaccugcagcagaggcgagcacugcgugaacacccugggcagcuuccacugcuacaaggcccugaccugcgagcccggcuacgcccugaaggacggcgagugcgaggacguggacgagugcgccaugggcacccacaccugccagcccggcuuccugugccagaacaccaagggcagcuucuacugccaggccagacagagaugcauggacggcuuccugcaggaccccgagggcaacugcguggacaucaacgagugcaccagccugagcgagcccugcagacccggcuucagcugcaucaacaccgugggcagcuacaccugccagagaaacccccugaucugcgccagaggcuaccacgccagcgacgacggcaccaagugcguggacgugaacgagugcgagaccggcgugcacagaugcggcgagggccaggugugccacaaccugcccggcagcuacagaugcgacugcaaggccggcuuccagagagacgccuucggcagaggcugcaucgacgugaacgagugcugggccagccccggcagacugugccagcacaccugcgagaacacccugggcagcuacagaugcagcugcgccagcggcuuccugcuggccgccgacggcaagagaugcgaggacgugaacgagugcgaggcccagagaugcagccaggagugcgccaacaucuacggcagcuaccagugcuacugcagacagggcuaccagcuggccgaggacggccacaccugcaccgacaucgacgagugcgcccagggcgccggcauccugugcaccuucagaugccugaacgugcccggcagcuaccagugcgccugccccgagcagggcuacaccaugaccgccaacggcagaagcugcaaggacguggacgagugcgcccugggcacccacaacugcagcgaggccgagaccugccacaacauccagggcagcuucagaugccugagauucgagugcccccccaacuacgugcaggugagcaagaccaagugcgagagaaccaccugccacgacuuccuggagugccagaacagccccgccagaaucacccacuaccagcugaacuuccagaccggccugcuggugcccgcccacaucuucagaaucggccccgcccccgccuucaccggcgacaccaucgcccugaacaucaucaagggcaacgaggagggcuacuucggcaccagaagacugaacgccuacaccggcgugguguaccugcagagagccgugcuggagcccagagacuucgcccuggacguggagaugaagcuguggagacagggcagcgugaccaccuuccuggccaagaugcacaucuucuucaccaccuucgcccuguaa

SEQ ID NO: 16972 - RNA, 1347 nt, Artificial Sequence
  FBLN5__Homo_sapiens__NP_006320
augcccggcaucaagagaauccugaccgugaccauccuggcccugugccugcccagccccggcaacgcccaggcccagugcaccaacggcuucgaccuggacagacagagcggccagugccuggacaucgacgagugcagaaccauccccgaggccugcagaggcgacaugaugugcgugaaccagaacggcggcuaccugugcauccccagaaccaaccccguguacagaggccccuacagcaaccccuacagcacccccuacagcggccccuaccccgccgccgcccccccccugagcgcccccaacuaccccaccaucagcagaccccugaucugcagauucggcuaccagauggacgagagcaaccagugcguggacguggacgagugcgccaccgacagccaccagugcaaccccacccagaucugcaucaacaccgagggcggcuacaccugcagcugcaccgacggcuacuggcugcuggagggccagugccuggacaucgacgagugcagauacggcuacugccagcagcugugcgccaacgugcccggcagcuacagcugcaccugcaaccccggcuucacccugaacgaggacggcagaagcugccaggacgugaacgagugcgccaccgagaaccccugcgugcagaccugcgugaacaccuacggcagcuucaucugcagaugcgaccccggcuacgagcuggaggaggacggcgugcacugcagcgacauggacgagugcagcuucagcgaguuccugugccagcacgagugcgugaaccagcccggcaccuacuucugcagcugcccccccggcuacauccugcuggacgacaacagaagcugccaggacaucaacgagugcgagcacagaaaccacaccugcaaccugcagcagaccugcuacaaccugcagggcggcuucaagugcaucgaccccaucagaugcgaggagcccuaccugagaaucagcgacaacagaugcaugugccccgccgagaaccccggcugcagagaccagcccuucaccauccuguacagagacauggacguggugagcggcagaagcgugcccgccgacaucuuccagaugcaggccaccaccagauaccccggcgccuacuacaucuuccagaucaagagcggcaacgagggcagagaguucuacaugagacagaccggccccaucagcgccacccuggugaugaccagacccaucaagggccccagagagauccagcuggaccuggagaugaucaccgugaacaccgugaucaacuucagaggcagcagcgugaucagacugagaaucuacgugagccaguaccccuucuaa

SEQ ID NO: 16973 - RNA, 8616 nt, Artificial Sequence
  FBN1__Homo_sapiens__NP_000129
augagaagaggcagacugcuggagaucgcccugggcuucaccgugcugcuggccagcuacaccagccacggcgccgacgccaaccuggaggccggcaacgugaaggagaccagagccagcagagccaagagaagaggcggcggcggccacgacgcccugaagggccccaacgugugcggcagcagauacaacgccuacugcugccccggcuggaagacccugcccggcggcaaccagugcaucgugcccaucugcagacacagcugcggcgacggcuucugcagcagacccaacaugugcaccugccccagcggccagaucgcccccagcugcggcagcagaagcauccagcacugcaacaucagaugcaugaacggcggcagcugcagcgacgaccacugccugugccagaagggcuacaucggcacccacugcggccagcccgugugcgagagcggcugccugaacggcggcagaugcguggcccccaacagaugcgccugcaccuacggcuucaccggcccccagugcgagagagacuacagaaccggccccugcuucaccgugaucagcaaccagaugugccagggccagcugagcggcaucgugugcaccaagacccugugcugcgccaccgugggcagagccuggggccaccccugcgagaugugccccgcccagccccaccccugcagaagaggcuucauccccaacaucagaaccggcgccugccaggacguggacgagugccaggccauccccggccugugccagggcggcaacugcaucaacaccgugggcagcuucgagugcaagugccccgccggccacaagcugaacgaggugagccagaagugcgaggacaucgacgagugcagcaccauccccggcaucugcgagggcggcgagugcaccaacaccgugagcagcuacuucugcaagugcccccccggcuucuacaccagccccgacggcaccagaugcaucgacgugagacccggcuacugcuacaccgcccugaccaacggcagaugcagcaaccagcugccccagagcaucaccaagaugcagugcugcugcgacgccggcagaugcuggagccccggcgugaccguggcccccgagaugugccccaucagagccaccgaggacuucaacaagcugugcagcgugcccauggugauccccggcagacccgaguaccccccccccccccugggccccaucccccccgugcugcccgugccccccggcuucccccccggcccccagauccccgugcccagaccccccguggaguaccuguaccccagcagagagccccccagagugcugcccgugaacgugaccgacuacugccagcuggugagauaccugugccagaacggcagaugcauccccacccccggcagcuacagaugcgagugcaacaagggcuuccagcuggaccugagaggcgagugcaucgacguggacgagugcgagaagaaccccugcgccggcggcgagugcaucaacaaccagggcagcuacaccugccagugcagagccggcuaccagagcacccugaccagaaccgagugcagagacaucgacgagugccugcagaacggcagaaucugcaacaacggcagaugcaucaacaccgacggcagcuuccacugcgugugcaacgccggcuuccacgugaccagagacggcaagaacugcgaggacauggacgagugcagcaucagaaacaugugccugaacggcaugugcaucaacgaggacggcagcuucaagugcaucugcaagcccggcuuccagcuggccagcgacggcagauacugcaaggacaucaacgagugcgagacccccggcaucugcaugaacggcagaugcgugaacaccgacggcagcuacagaugcgagugcuuccccggccuggccgugggccuggacggcagagugugcguggacacccacaugagaagcaccugcuacggcggcuacaagagaggccagugcaucaagccccuguucggcgccgugaccaagagcgagugcugcugcgccagcaccgaguacgccuucggcgagcccugccagcccugccccgcccagaacagcgccgaguaccaggcccugugcagcagcggccccggcaugaccagcgccggcagcgacaucaacgagugcgcccuggaccccgacaucugccccaacggcaucugcgagaaccugagaggcaccuacaagugcaucugcaacagcggcuacgagguggacagcaccggcaagaacugcguggacaucaacgagugcgugcugaacagccugcugugcgacaacggccagugcagaaacacccccggcagcuucgugugcaccugccccaagggcuucaucuacaagcccgaccugaagaccugcgaggacaucgacgagugcgagagcagccccugcaucaacggcgugugcaagaacagccccggcagcuucaucugcgagugcagcagcgagagcacccuggaccccaccaagaccaucugcaucgagaccaucaagggcaccugcuggcagaccgugaucgacggcagaugcgagaucaacaucaacggcgccacccugaagagccagugcugcagcagccugggcgccgccuggggcagccccugcacccugugccagguggaccccaucugcggcaagggcuacagcagaaucaagggcacccagugcgaggacaucgacgagugcgagguguuccccggcgugugcaagaacggccugugcgugaacaccagaggcagcuucaagugccagugccccagcggcaugacccuggacgccaccggcagaaucugccuggacaucagacuggagaccugcuuccugagauacgaggacgaggagugcacccugcccaucgccggcagacacagaauggacgccugcugcugcagcgugggcgccgccuggggcaccgaggagugcgaggagugccccaugagaaacacccccgaguacgaggagcugugccccagaggccccggcuucgccaccaaggagaucaccaacggcaagcccuucuucaaggacaucaacgagugcaagaugauccccagccugugcacccacggcaagugcagaaacaccaucggcagcuucaagugcagaugcgacagcggcuucgcccuggacagcgaggagagaaacugcaccgacaucgacgagugcagaaucagccccgaccugugcggcagaggccagugcgugaacacccccggcgacuucgagugcaagugcgacgagggcuacgagagcggcuucaugaugaugaagaacugcauggacaucgacgagugccagagagacccccugcugugcagaggcggcgugugccacaacaccgagggcagcuacagaugcgagugcccccccggccaccagcugagccccaacaucagcgccugcaucgacaucaacgagugcgagcugagcgcccaccugugccccaacggcagaugcgugaaccugaucggcaaguaccagugcgccugcaaccccggcuaccacagcacccccgacagacuguucugcguggacaucgacgagugcagcaucaugaacggcggcugcgagaccuucugcaccaacagcgagggcagcuacgagugcagcugccagcccggcuucgcccugaugcccgaccagagaagcugcaccgacaucgacgagugcgaggacaaccccaacaucugcgacggcggccagugcaccaacauccccggcgaguacagaugccugugcuacgacggcuucauggccagcgaggacaugaagaccugcguggacgugaacgagugcgaccugaaccccaacaucugccugagcggcaccugcgagaacaccaagggcagcuucaucugccacugcgacaugggcuacagcggcaagaagggcaagaccggcugcaccgacaucaacgagugcgagaucggcgcccacaacugcggcaagcacgccgugugcaccaacaccgccggcagcuucaagugcagcugcagccccggcuggaucggcgacggcaucaagugcaccgaccuggacgagugcagcaacggcacccacaugugcagccagcacgccgacugcaagaacaccaugggcagcuacagaugccugugcaaggagggcuacaccggcgacggcuucaccugcaccgaccuggacgagugcagcgagaaccugaaccugugcggcaacggccagugccugaacgcccccggcggcuacagaugcgagugcgacaugggcuucgugcccagcgccgacggcaaggccugcgaggacaucgacgagugcagccugcccaacaucugcguguucggcaccugccacaaccugcccggccuguucagaugcgagugcgagaucggcuacgagcuggacagaagcggcggcaacugcaccgacgugaacgagugccuggaccccaccaccugcaucagcggcaacugcgugaacacccccggcagcuacaucugcgacugcccccccgacuucgagcugaaccccaccagagugggcugcguggacaccagaagcggcaacugcuaccuggacaucagacccagaggcgacaacggcgacaccgccugcagcaacgagaucggcgugggcgugagcaaggccagcugcugcugcagccugggcaaggccuggggcacccccugcgagaugugccccgccgugaacaccagcgaguacaagauccugugccccggcggcgagggcuucagacccaaccccaucaccgugauccuggaggacaucgacgagugccaggagcugcccggccugugccagggcggcaagugcaucaacaccuucggcagcuuccagugcagaugccccaccggcuacuaccugaacgaggacaccagagugugcgacgacgugaacgagugcgagacccccggcaucugcggccccggcaccugcuacaacaccgugggcaacuacaccugcaucugcccccccgacuacaugcaggugaacggcggcaacaacugcauggacaugagaagaagccugugcuacagaaacuacuacgccgacaaccagaccugcgacggcgagcugcuguucaacaugaccaagaagaugugcugcugcagcuacaacaucggcagagccuggaacaagcccugcgagcagugccccauccccagcaccgacgaguucgccacccugugcggcagccagagacccggcuucgugaucgacaucuacaccggccugcccguggacaucgacgagugcagagagauccccggcgugugcgagaacggcgugugcaucaacauggugggcagcuucagaugcgagugccccgugggcuucuucuacaacgacaagcugcuggugugcgaggacaucgacgagugccagaacggccccgugugccagagaaacgccgagugcaucaacaccgccggcagcuacagaugcgacugcaagcccggcuacagauucaccagcaccggccagugcaacgacagaaacgagugccaggagauccccaacaucugcagccacggccagugcaucgacaccgugggcagcuucuacugccugugccacaccggcuucaagaccaacgacgaccagaccaugugccuggacaucaacgagugcgagagagacgccugcggcaacggcaccugcagaaacaccaucggcagcuucaacugcagaugcaaccacggcuucauccugagccacaacaacgacugcaucgacguggacgagugcgccagcggcaacggcaaccugugcagaaacggccagugcaucaacaccgugggcagcuuccagugccagugcaacgagggcuacgagguggcccccgacggcagaaccugcguggacaucaacgagugccugcuggagcccagaaagugcgcccccggcaccugccagaaccuggacggcagcuacagaugcaucugcccccccggcuacagccugcagaacgagaagugcgaggacaucgacgagugcguggaggagcccgagaucugcgcccugggcaccugcagcaacaccgagggcagcuucaagugccugugccccgagggcuucagccugagcagcagcggcagaagaugccaggaccugagaaugagcuacugcuacgccaaguucgagggcggcaagugcagcagccccaagagcagaaaccacagcaagcaggagugcugcugcgcccugaagggcgagggcuggggcgaccccugcgagcugugccccaccgagcccgacgaggccuucagacagaucugccccuacggcagcggcaucaucgugggccccgacgacagcgccguggacauggacgagugcaaggagcccgacgugugcaagcacggccagugcaucaacaccgacggcagcuacagaugcgagugccccuucggcuacauccuggccggcaacgagugcguggacaccgacgagugcagcgugggcaaccccugcggcaacggcaccugcaagaacgugaucggcggcuucgagugcaccugcgaggagggcuucgagcccggccccaugaugaccugcgaggacaucaacgagugcgcccagaacccccugcugugcgccuucagaugcgugaacaccuacggcagcuacgagugcaagugccccgugggcuacgugcugagagaggacagaagaaugugcaaggacgaggacgagugcgaggagggcaagcacgacugcaccgagaagcagauggagugcaagaaccugaucggcaccuacaugugcaucugcggccccggcuaccagagaagacccgacggcgagggcugcguggacgagaacgagugccagaccaagcccggcaucugcgagaacggcagaugccugaacaccagaggcagcuacaccugcgagugcaacgacggcuucaccgccagccccaaccaggacgagugccuggacaacagagagggcuacugcuucaccgaggugcugcagaacaugugccagaucggcagcagcaacagaaaccccgugaccaagagcgagugcugcugcgacggcggcagaggcuggggcccccacugcgagaucugccccuuccagggcaccguggccuucaagaagcugugcccccacggcagaggcuucaugaccaacggcgccgacaucgacgagugcaaggugauccacgacgugugcagaaacggcgagugcgugaacgacagaggcagcuaccacugcaucugcaagaccggcuacacccccgacaucaccggcaccagcugcguggaccugaacgagugcaaccaggcccccaagcccugcaacuucaucugcaagaacaccgagggcagcuaccagugcagcugccccaagggcuacauccugcaggaggacggcagaagcugcaaggaccuggacgagugcgccaccaagcagcacaacugccaguuccugugcgugaacaccaucggcggcuucaccugcaagugcccccccggcuucacccagcaccacaccagcugcaucgacaacaacgagugcaccagcgacaucaaccugugcggcagcaagggcaucugccagaacacccccggcagcuucaccugcgagugccagagaggcuucagccuggaccagaccggcagcagcugcgaggacguggacgagugcgagggcaaccacagaugccagcacggcugccagaacaucaucggcggcuacagaugcagcugcccccagggcuaccugcagcacuaccaguggaaccagugcguggacgagaacgagugccugagcgcccacaucugcggcggcgccagcugccacaacacccugggcagcuacaagugcaugugccccgccggcuuccaguacgagcaguucagcggcggcugccaggacaucaacgagugcggcagcgcccaggcccccugcagcuacggcugcagcaacaccgagggcggcuaccugugcggcugcccccccggcuacuucagaaucggccagggccacugcgugagcggcaugggcaugggcagaggcaaccccgagccccccgugagcggcgagauggacgacaacagccugagccccgaggccugcuacgagugcaagaucaacggcuaccccaagagaggcagaaagagaagaagcaccaacgagaccgacgccagcaacaucgaggaccagagcgagaccgaggccaacgugagccuggccagcugggacguggagaagaccgccaucuucgccuucaacaucagccacgugagcaacaaggugagaauccuggagcugcugcccgcccugaccacccugaccaaccacaacagauaccugaucgagagcggcaacgaggacggcuucuucaagaucaaccagaaggagggcaucagcuaccugcacuucaccaagaagaagcccguggccggcaccuacagccugcagaucagcagcaccccccuguacaagaagaaggagcugaaccagcuggaggacaaguacgacaaggacuaccugagcggcgagcugggcgacaaccugaagaugaagauccaggugcugcugcacuaa

SEQ ID NO: 16974 - RNA, 8739 nt, Artificial Sequence
  FBN2__Homo_sapiens__NP_001990
augggcagaagaagaagacugugccugcagcuguacuuccuguggcugggcugcguggugcugugggcccagggcaccgccggccagccccagccccccccccccaagccccccagaccccagccccccccccagcaggugagaagcgccaccgccggcagcgagggcggcuuccuggcccccgaguacagagaggagggcgccgccguggccagcagagugagaagaagaggccagcaggacgugcugagaggccccaacgugugcggcagcagauuccacagcuacugcugccccggcuggaagacccugcccggcggcaaccagugcaucgugcccaucugcagaaacagcugcggcgacggcuucugcagcagacccaacaugugcaccugcagcagcggccagaucagcagcaccugcggcagcaagagcauccagcagugcagcgugagaugcaugaacggcggcaccugcgccgacgaccacugccagugccagaagggcuacaucggcaccuacugcggccagcccgugugcgagaacggcugccagaacggcggcagaugcaucggccccaacagaugcgccugcguguacggcuucaccggcccccagugcgagagagacuacagaaccggccccugcuucacccaggugaacaaccagaugugccagggccagcugaccggcaucgugugcaccaagacccugugcugcgccaccaucggcagagccuggggccaccccugcgagaugugccccgcccagccccagcccugcagaagaggcuucauccccaacaucagaaccggcgccugccaggacguggacgagugccaggccauccccggcaucugccagggcggcaacugcaucaacaccgugggcagcuucgagugcagaugccccgccggccacaagcagagcgagaccacccagaagugcgaggacaucgacgagugcagcaucauccccggcaucugcgagaccggcgagugcagcaacaccgugggcagcuacuucugcgugugccccagaggcuacgugaccagcaccgacggcagcagaugcaucgaccagagaaccggcaugugcuucagcggccuggugaacggcagaugcgcccaggagcugcccggcagaaugaccaagaugcagugcugcugcgagcccggcagaugcuggggcaucggcaccauccccgaggccugccccgugagaggcagcgaggaguacagaagacugugcauggacggccugcccaugggcggcauccccggcagcgccggcagcagacccggcggcaccggcggcaacggcuucgcccccagcggcaacggcaacggcuacggccccggcggcaccggcuucauccccauccccggcggcaacggcuucagccccggcgugggcggcgccggcgugggcgccggcggccagggccccaucaucaccggccugaccauccugaaccagaccaucgacaucugcaagcaccacgccaaccugugccugaacggcagaugcauccccaccgugagcagcuacagaugcgagugcaacaugggcuacaagcaggacgccaacggcgacugcaucgacguggacgagugcaccagcaaccccugcaccaacggcgacugcgugaacacccccggcagcuacuacugcaagugccacgccggcuuccagagaacccccaccaagcaggccugcaucgacaucgacgagugcauccagaacggcgugcugugcaagaacggcagaugcgugaacaccgacggcagcuuccagugcaucugcaacgccggcuucgagcugaccaccgacggcaagaacugcguggaccacgacgagugcaccaccaccaacaugugccugaacggcaugugcaucaacgaggacggcagcuucaagugcaucugcaagcccggcuucgugcuggcccccaacggcagauacugcaccgacguggacgagugccagacccccggcaucugcaugaacggccacugcaucaacagcgagggcagcuucagaugcgacugcccccccggccuggccgugggcauggacggcagagugugcguggacacccacaugagaagcaccugcuacggcggcaucaagaagggcgugugcgugagacccuuccccggcgccgugaccaagagcgagugcugcugcgccaaccccgacuacggcuucggcgagcccugccagcccugccccgccaagaacagcgccgaguuccacggccugugcagcagcggcgugggcaucaccguggacggcagagacaucaacgagugcgcccuggaccccgacaucugcgccaacggcaucugcgagaaccugagaggcagcuacagaugcaacugcaacagcggcuacgagcccgacgccagcggcagaaacugcaucgacaucgacgagugccuggugaacagacugcugugcgacaacggccugugcagaaacacccccggcagcuacagcugcaccugcccccccggcuacguguucagaaccgagaccgagaccugcgaggacaucaacgagugcgagagcaaccccugcgugaacggcgccugcagaaacaaccugggcagcuucaacugcgagugcagccccggcagcaagcugagcagcaccggccugaucugcaucgacagccugaagggcaccugcuggcugaacauccaggacagcagaugcgaggugaacaucaacggcgccacccugaagagcgagugcugcgccacccugggcgccgccuggggcagccccugcgagagaugcgagcuggacaccgccugccccagaggccuggccagaaucaagggcgugaccugcgaggacgugaacgagugcgagguguuccccggcgugugccccaacggcagaugcgugaacagcaagggcagcuuccacugcgagugccccgagggccugacccuggacggcaccggcagagugugccuggacaucagaauggagcagugcuaccugaagugggacgaggacgagugcauccaccccgugcccggcaaguucagaauggacgccugcugcugcgccgugggcgccgccuggggcaccgagugcgaggagugccccaagcccggcaccaaggaguacgagacccugugccccagaggcgccggcuucgccaacagaggcgacgugcugaccggcagacccuucuacaaggacaucaacgagugcaaggccuuccccggcaugugcaccuacggcaagugcagaaacaccaucggcagcuucaagugcagaugcaacagcggcuucgcccuggacauggaggagagaaacugcaccgacaucgacgagugcagaaucagccccgaccugugcggcagcggcaucugcgugaacacccccggcagcuucgagugcgagugcuucgagggcuacgagagcggcuucaugaugaugaagaacugcauggacaucgacgagugcgagagaaacccccugcugugcagaggcggcaccugcgugaacaccgagggcagcuuccagugcgacugcccccugggccacgagcugagccccagcagagaggacugcguggacaucaacgagugcagccugagcgacaaccugugcagaaacggcaagugcgugaacaugaucggcaccuaccagugcagcugcaaccccggcuaccaggccacccccgacagacagggcugcaccgacaucgacgagugcaugaucaugaacggcggcugcgacacccagugcaccaacagcgagggcagcuacgagugcagcugcagcgagggcuacgcccugaugcccgacggcagaagcugcgccgacaucgacgagugcgagaacaaccccgacaucugcgacggcggccagugcaccaacauccccggcgaguacagaugccugugcuacgacggcuucauggccagcauggacaugaagaccugcaucgacgugaacgagugcgaccugaacagcaacaucugcauguucggcgagugcgagaacaccaagggcagcuucaucugccacugccagcugggcuacagcgugaagaagggcaccaccggcugcaccgacguggacgagugcgagaucggcgcccacaacugcgacaugcacgccagcugccugaacauccccggcagcuucaagugcagcugcagagagggcuggaucggcaacggcaucaagugcaucgaccuggacgagugcagcaacggcacccaccagugcagcaucaacgcccagugcgugaacacccccggcagcuacagaugcgccugcagcgagggcuucaccggcgacggcuucaccugcagcgacguggacgagugcgccgagaacaucaaccugugcgagaacggccagugccugaacgugcccggcgccuacagaugcgagugcgagaugggcuucacccccgccagcgacagcagaagcugccaggacaucgacgagugcagcuuccagaacaucugcguguucggcaccugcaacaaccugcccggcauguuccacugcaucugcgacgacggcuacgagcuggacagaaccggcggcaacugcaccgacaucgacgagugcgccgaccccaucaacugcgugaacggccugugcgugaacacccccggcagauacgagugcaacugcccccccgacuuccagcugaaccccaccggcgugggcugcguggacaacagagugggcaacugcuaccugaaguucggccccagaggcgacggcagccugagcugcaacaccgagaucggcgugggcgugagcagaagcagcugcugcugcagccugggcaaggccuggggcaaccccugcgagaccugcccccccgugaacagcaccgaguacuacacccugugccccggcggcgagggcuucagacccaaccccaucaccaucauccuggaggacaucgacgagugccaggagcugcccggccugugccagggcggcaacugcaucaacaccuucggcagcuuccagugcgagugcccccagggcuacuaccugagcgaggacaccagaaucugcgaggacaucgacgagugcuucgcccaccccggcgugugcggccccggcaccugcuacaacacccugggcaacuacaccugcaucugcccccccgaguacaugcaggugaacggcggccacaacugcauggacaugagaaagagcuucugcuacagaagcuacaacggcaccaccugcgagaacgagcugcccuucaacgugaccaagagaaugugcugcugcaccuacaacgugggcaaggccuggaacaagcccugcgagcccugccccacccccggcaccgccgacuucaagaccaucugcggcaacauccccggcuucaccuucgacauccacaccggcaaggccguggacaucgacgagugcaaggagauccccggcaucugcgccaacggcgugugcaucaaccagaucggcagcuucagaugcgagugccccaccggcuucagcuacaacgaccugcugcuggugugcgaggacaucgacgagugcagcaacggcgacaaccugugccagagaaacgccgacugcaucaacagccccggcagcuacagaugcgagugcgccgccggcuucaagcugagccccaacggcgccugcguggacagaaacgagugccuggagauccccaacgugugcagccacggccugugcguggaccugcagggcagcuaccagugcaucugccacaacggcuucaaggccagccaggaccagaccaugugcauggacguggacgagugcgagagacaccccugcggcaacggcaccugcaagaacaccgugggcagcuacaacugccugugcuaccccggcuucgagcugacccacaacaacgacugccuggacaucgacgagugcagcagcuucuucggccaggugugcagaaacggcagaugcuucaacgagaucggcagcuucaagugccugugcaacgagggcuacgagcugacccccgacggcaagaacugcaucgacaccaacgagugcguggcccugcccggcagcugcagccccggcaccugccagaaccuggagggcagcuucagaugcaucugcccccccggcuacgaggugaagagcgagaacugcaucgacaucaacgagugcgacgaggaccccaacaucugccuguucggcagcugcaccaacacccccggcggcuuccagugccugugcccccccggcuucgugcugagcgacaacggcagaagaugcuucgacaccagacagagcuucugcuucaccaacuucgagaacggcaagugcagcgugcccaaggccuucaacaccaccaaggccaagugcugcugcagcaagaugcccggcgagggcuggggcgaccccugcgagcugugccccaaggacgacgagguggccuuccaggaccugugccccuacggccacggcaccgugcccagccugcacgacaccagagaggacgugaacgagugccuggagagccccggcaucugcagcaacggccagugcaucaacaccgacggcagcuucagaugcgagugccccaugggcuacaaccuggacuacaccggcgugagaugcguggacaccgacgagugcagcaucggcaaccccugcggcaacggcaccugcaccaacgugaucggcagcuucgagugcaacugcaacgagggcuucgagcccggccccaugaugaacugcgaggacaucaacgagugcgcccagaacccccugcugugcgccuucagaugcaugaacaccuucggcagcuacgagugcaccugccccaucggcuacgcccugagagaggaccagaagaugugcaaggaccuggacgagugcgccgagggccugcacgacugcgagagcagaggcaugaugugcaagaaccugaucggcaccuucaugugcaucugcccccccggcauggccagaagacccgacggcgagggcugcguggacgagaacgagugcagaaccaagcccggcaucugcgagaacggcagaugcgugaacaucaucggcagcuacagaugcgagugcaacgagggcuuccagagcagcagcagcggcaccgagugccuggacaacagacagggccugugcuucgccgaggugcugcagaccaucugccagauggccagcagcagcagaaaccuggugaccaagagcgagugcugcugcgacggcggcagaggcuggggccaccagugcgagcugugcccccugcccggcaccgcccaguacaagaagaucugcccccacggccccggcuacaccaccgacggcagagacaucgacgagugcaaggugaugcccaaccugugcaccaacggccagugcaucaacaccaugggcagcuucagaugcuucugcaaggugggcuacaccaccgacaucagcggcaccagcugcaucgaccuggacgagugcagccagagccccaagcccugcaacuacaucugcaagaacaccgagggcagcuaccagugcagcugccccagaggcuacgugcugcaggaggacggcaagaccugcaaggaccuggacgagugccagaccaagcagcacaacugccaguuccugugcgugaacacccugggcggcuucaccugcaagugcccccccggcuucacccagcaccacaccgccugcaucgacaacaacgagugcggcagccagcccagccugugcggcgccaagggcaucugccagaacacccccggcagcuucagcugcgagugccagagaggcuucagccuggacgccaccggccugaacugcgaggacguggacgagugcgacggcaaccacagaugccagcacggcugccagaacauccugggcggcuacagaugcggcugcccccagggcuacauccagcacuaccaguggaaccagugcguggacgagaacgagugcagcaaccccaacgccugcggcagcgccagcugcuacaacacccugggcagcuacaagugcgccugccccagcggcuucagcuucgaccaguucagcagcgccugccacgacgugaacgagugcagcagcagcaagaaccccugcaacuacggcugcagcaacaccgagggcggcuaccugugcggcugcccccccggcuacuacagagugggccagggccacugcgugagcggcaugggcuucaacaagggccaguaccugagccuggacaccgagguggacgaggagaacgcccugagccccgaggccugcuacgagugcaagaucaacggcuacagcaagaaggacagcagacagaagagaagcauccacgagcccgaccccaccgccguggagcagaucagccuggagagcguggacauggacagccccgugaacaugaaguucaaccugagccaccugggcagcaaggagcacauccuggagcugagacccgccauccagccccugaacaaccacaucagauacgugaucagccagggcaacgacgacagcguguucagaauccaccagagaaacggccugagcuaccugcacaccgccaagaagaagcugaugcccggcaccuacacccuggagaucaccagcaucccccuguacaagaagaaggagcugaagaagcuggaggagagcaacgaggacgacuaccugcugggcgagcugggcgaggcccugagaaugagacugcagauccagcuguacuaa

SEQ ID NO: 16975 - RNA, 8430 nt, Artificial Sequence
  FBN3__Homo_sapiens__NP_115823
augacccuggagggccuguaccuggccagaggcccccuggccagacugcugcuggccuggagcgcccugcugugcauggccggcggccagggcagaugggacggcgcccuggaggccgccggccccggcagagugagaagaagaggcagccccggcauccugcagggccccaacgugugcggcagcagauuccacgccuacugcugccccggcuggagaaccuuccccggcagaagccagugcguggugcccaucugcagaagagccugcggcgagggcuucugcagccagcccaaccugugcaccugcgccgacggcacccuggcccccagcugcggcgugagcagaggcagcggcugcagcgugagcugcaugaacggcggcaccugcagaggcgccagcugccugugccagaagggcuacaccggcaccgugugcggccagcccaucugcgacagaggcugccacaacggcggcagaugcaucggccccaacagaugcgccugcguguacggcuucaugggcccccagugcgagagagacuacagaaccggccccugcuucggccaggugggccccgagggcugccagcaccagcugaccggccuggugugcaccaaggcccugugcugcgccaccgugggcagagccuggggccugcccugcgagcugugccccgcccagccccaccccugcagaagaggcuucauccccaacauccacaccggcgccugccaggacguggacgagugccaggccgugcccggccugugccagggcggcagcugcgugaacauggugggcagcuuccacugcagaugccccgugggccacagacugagcgacagcagcgccgccugcgaggacuacagagccggcgccugcuucagcgugcuguucggcggcagaugcgccggcgaccuggccggccacuacaccagaagacagugcugcugcgacagaggcagaugcugggccgccggccccgugcccgagcugugcccccccagaggcagcaacgaguuccagcagcugugcgcccagagacugccccugcugcccggccaccccggccuguuccccggccugcugggcuucggcagcaacggcaugggccccccccugggccccgccagacugaacccccacggcagcgacgccagaggcauccccagccugggccccggcaacagcaacaucggcaccgccacccugaaccagaccaucgacaucugcagacacuucaccaaccugugccugaacggcagaugccugcccacccccagcagcuacagaugcgagugcaacgugggcuacacccaggacgugagaggcgagugcaucgacguggacgagugcaccagcagccccugccaccacggcgacugcgugaacauccccggcaccuaccacugcagaugcuaccccggcuuccaggccacccccaccagacaggccugcguggacguggacgagugcaucgugagcggcggccugugccaccugggcagaugcgugaacaccgagggcagcuuccagugcgugugcaacgccggcuucgagcugagccccgacggcaagaacugcguggaccacaacgagugcgccaccagcaccaugugcgugaacggcgugugccugaacgaggacggcagcuucagcugccugugcaagcccggcuuccugcuggcccccggcggccacuacugcauggacaucgacgagugccagacccccggcaucugcgugaacggccacugcaccaacaccgagggcagcuucagaugccagugccugggcggccuggccgugggcaccgacggcagagugugcguggacacccacgugagaagcaccugcuacggcgccaucgagaagggcagcugcgccagacccuuccccggcaccgugaccaagagcgagugcugcugcgccaaccccgaccacggcuucggcgagcccugccagcugugccccgccaaggacagcgccgaguuccaggcccugugcagcagcggccugggcaucaccaccgacggcagagacaucaacgagugcgcccuggaccccgaggugugcgccaacggcgugugcgagaaccugagaggcagcuacagaugcgugugcaaccugggcuacgaggccggcgccagcggcaaggacugcaccgacguggacgagugcgcccugaacagccugcugugcgacaacggcuggugccagaacagccccggcagcuacagcugcagcugcccccccggcuuccacuucuggcaggacaccgagaucugcaaggacguggacgagugccugagcagccccugcgugagcggcgugugcagaaaccuggccggcagcuacaccugcaagugcggccccggcagcagacuggaccccagcggcaccuucugccuggacagcaccaagggcaccugcuggcugaagauccaggagagcagaugcgaggugaaccugcagggcgccagccugagaagcgagugcugcgccacccugggcgccgccuggggcagccccugcgagagaugcgagaucgaccccgccugcgccagaggcuucgccagaaugaccggcgugaccugcgacgacgugaacgagugcgagagcuuccccggcgugugccccaacggcagaugcgugaacaccgccggcagcuucagaugcgagugccccgagggccugaugcuggacgccagcggcagacugugcguggacgugagacuggagcccugcuuccugagaugggacgaggacgagugcggcgugacccugcccggcaaguacagaauggacgugugcugcugcagcaucggcgccguguggggcguggagugcgaggccugccccgaccccgagagccuggaguucgccagccugugccccagaggccugggcuucgccagcagagacuuccugagcggcagacccuucuacaaggacgugaacgagugcaagguguuccccggccugugcacccacggcaccugcagaaacaccgugggcagcuuccacugcgccugcgccggcggcuucgcccuggacgcccaggagagaaacugcaccgacaucgacgagugcagaaucagccccgaccugugcggccagggcaccugcgugaacacccccggcagcuucgagugcgagugcuuccccggcuacgagagcggcuucaugcugaugaagaacugcauggacguggacgagugcgccagagacccccugcugugcagaggcggcaccugcaccaacaccgacggcagcuacaagugccagugcccccccggccacgagcugaccgccaagggcaccgccugcgaggacaucgacgagugcagccugagcgacggccugugcccccacggccagugcgugaacgugaucggcgccuuccagugcagcugccacgccggcuuccagagcacccccgacagacagggcugcguggacaucaacgagugcagagugcagaacggcggcugcgacgugcacugcaucaacaccgagggcagcuacagaugcagcugcggccagggcuacagccugaugcccgacggcagagccugcgccgacguggacgagugcgaggagaaccccagagugugcgaccagggccacugcaccaacaugcccggcggccacagaugccugugcuacgacggcuucauggccacccccgacaugagaaccugcguggacguggacgagugcgaccugaacccccacaucugccugcacggcgacugcgagaacaccaagggcagcuucgugugccacugccagcugggcuacauggugagaaagggcgccaccggcugcagcgacguggacgagugcgaggugggcggccacaacugcgacagccacgccagcugccugaacauccccggcagcuucagcugcagaugccugcccggcugggugggcgacggcuucgagugccacgaccuggacgagugcgugagccaggagcacagaugcagccccagaggcgacugccugaacgugcccggcagcuacagaugcaccugcagacagggcuucgccggcgacggcuucuucugcgaggacagagacgagugcgccgagaacguggaccugugcgacaacggccagugccugaacgcccccggcggcuacagaugcgagugcgagaugggcuucgaccccaccgaggaccacagagccugccaggacguggacgagugcgcccagggcaaccugugcgccuucggcagcugcgagaaccugcccggcauguucagaugcaucugcaacggcggcuacgagcuggacagaggcggcggcaacugcaccgacaucaacgagugcgccgaccccgugaacugcaucaacggcgugugcaucaacacccccggcagcuaccugugcagcugcccccaggacuucgagcugaaccccagcggcgugggcugcguggacaccagagccggcaacugcuuccuggagacccacgacagaggcgacagcggcaucagcugcagcgccgagaucggcgugggcgugaccagagccagcugcugcugcagccugggcagagccuggggcaaccccugcgagcugugccccauggccaacaccaccgaguacagaacccugugccccggcggcgagggcuuccagcccaacagaaucaccgugauccuggaggacaucgacgagugccaggagcugcccggccugugccagggcggcgacugcgugaacaccuucggcagcuuccagugcgagugcccccccggcuaccaccugagcgagcacaccagaaucugcgaggacaucgacgagugcagcacccacagcggcaucugcggccccggcaccugcuacaacacccugggcaacuacaccugcgugugccccgccgaguaccugcaggugaacggcggcaacaacugcauggacaugagaaagagcgugugcuucagacacuacaacggcaccugccagaacgagcuggccuucaacgugaccagaaagaugugcugcugcagcuacaacaucggccaggccuggaacagacccugcgaggccugccccacccccaucagccccgacuaccagauccugugcggcaaccaggcccccggcuuccugaccgacauccacaccggcaagccccuggacaucgacgagugcggcgagauccccgccaucugcgccaacggcaucugcaucaaccagaucggcagcuucagaugcgagugccccgccggcuucaacuacaacagcauccugcuggccugcgaggacguggacgagugcggcagcagagagagccccugccagcagaacgccgacugcaucaacauccccggcagcuacagaugcaagugcaccagaggcuacaagcugagccccggcggcgccugcgugggcagaaacgagugcagagagauccccaacgugugcagccacggcgacugcauggacaccgagggcagcuacaugugccugugccacagaggcuuccaggccagcgccgaccagacccugugcauggacaucgacgagugcgacagacagcccugcggcaacggcaccugcaagaacaucaucggcagcuacaacugccugugcuuccccggcuucguggugacccacaacggcgacugcguggacuucgacgagugcaccacccuggugggccaggugugcagauucggccacugccugaacaccgccggcagcuuccacugccugugccaggacggcuucgagcugaccgccgacggcaagaacugcguggacaccaacgagugccugagccuggccggcaccugccugcccggcaccugccagaaccuggagggcagcuucagaugcaucugcccccccggcuuccaggugcagagcgaccacugcaucgacaucgacgagugcagcgaggagcccaaccugugccuguucggcaccugcaccaacagccccggcagcuuccagugccugugcccccccggcuucgugcugagcgacaacggccacagaugcuucgacaccagacagagcuucugcuucaccagauucgaggccggcaagugcagcgugcccaaggccuucaacaccaccaagaccagaugcugcugcagcaagagacccggcgagggcuggggcgaccccugcgagcugugcccccaggagggcagcgccgccuuccaggagcugugccccuucggccacggcgccgugcccggccccgacgacagcagagaggacgugaacgagugcgccgagaaccccggcgugugcaccaacggcgugugcgugaacaccgacggcagcuucagaugcgagugccccuucggcuacagccuggacuucaccggcaucaacugcguggacaccgacgagugcagcgugggccaccccugcggccagggcaccugcaccaacgugaucggcggcuucgagugcgccugcgccgacggcuucgagcccggccugaugaugaccugcgaggacaucgacgagugcagccugaacccccugcugugcgccuucagaugccacaacaccgagggcagcuaccugugcaccugccccgccggcuacacccugagagaggacggcgccaugugcagagacguggacgagugcgccgacggccagcaggacugccacgccagaggcauggagugcaagaaccugaucggcaccuucgccugcgugugcccccccggcaugagaccccugcccggcagcggcgagggcugcaccgacgacaacgagugccacgcccagcccgaccugugcgugaacggcagaugcgugaacaccgccggcagcuucagaugcgacugcgacgagggcuuccagcccagccccacccugaccgagugccacgacaucagacagggccccugcuucgccgaggugcugcagaccaugugcagaagccugagcagcagcagcgaggccgugaccagagccgagugcugcugcggcggcggcagaggcuggggccccagaugcgagcugugcccccugcccggcaccagcgccuacagaaagcugugcccccacggcagcggcuacaccgccgagggcagagacguggacgagugcagaaugcuggcccaccugugcgcccacggcgagugcaucaacagccugggcagcuucagaugccacugccaggccggcuacacccccgacgccaccgccaccaccugccuggacauggacgagugcagccaggugcccaagcccugcaccuuccugugcaagaacaccaagggcagcuuccugugcagcugccccagaggcuaccugcuggaggaggacggcagaaccugcaaggaccuggacgagugcaccagcagacagcacaacugccaguuccugugcgugaacaccgugggcgccuucaccugcagaugcccccccggcuucacccagcaccaccaggccugcuucgacaacgacgagugcagcgcccagcccggccccugcggcgcccacggccacugccacaacacccccggcagcuucagaugcgagugccaccagggcuucacccuggugagcagcggccacggcugcgaggacgugaacgagugcgacggcccccacagaugccagcacggcugccagaaccagcugggcggcuacagaugcagcugcccccagggcuucacccagcacagccagugggcccagugcguggacgagaacgagugcgcccugagcccccccaccugcggcagcgccagcugcagaaacacccugggcggcuucagaugcgugugccccagcggcuucgacuucgaccaggcccugggcggcugccaggagguggacgagugcgccggcagaagaggccccugcagcuacagcugcgccaacacccccggcggcuuccugugcggcugcccccagggcuacuucagagccggccagggccacugcgugagcggccugggcuucagccccggcccccaggacacccccgacaaggaggagcugcugagcagcgaggccugcuacgagugcaagaucaacggccugagccccagagacagacccagaagaagcgcccacagagaccaccaggugaaccuggccacccuggacagcgaggcccugcugacccugggccugaaccugagccaccugggcagagccgagagaauccuggagcugagacccgcccuggagggccuggagggcagaaucagauacgugaucgugagaggcaacgagcagggcuucuucagaaugcaccaccugagaggcgugagcagccugcagcugggcagaagaagacccggccccggcaccuacagacuggagguggugagccacauggccggccccuggggcgugcagcccgagggccagcccggccccuggggccaggcccugagacugaaggugcagcugcagcugcuguaa

SEQ ID NO: 16976 - RNA, 1017 nt, Artificial Sequence
  FBP1__Homo_sapiens__NP_000498
auggccgaccaggcccccuucgacaccgacgugaacacccugaccagauucgugauggaggagggcagaaaggccagaggcaccggcgagcugacccagcugcugaacagccugugcaccgccgugaaggccaucagcagcgccgugagaaaggccggcaucgcccaccuguacggcaucgccggcagcaccaacgugaccggcgaccaggugaagaagcuggacgugcugagcaacgaccuggugaugaacaugcugaagagcagcuucgccaccugcgugcuggugagcgaggaggacaagcacgccaucaucguggagcccgagaagagaggcaaguacguggugugcuucgacccccuggacggcagcagcaacaucgacugccuggugagcgugggcaccaucuucggcaucuacagaaagaagagcaccgacgagcccagcgagaaggacgcccugcagcccggcagaaaccugguggccgccggcuacgcccuguacggcagcgccaccaugcuggugcuggccauggacugcggcgugaacugcuucaugcuggaccccgccaucggcgaguucauccugguggacaaggacgugaagaucaagaagaagggcaagaucuacagccugaacgagggcuacgccagagacuucgaccccgccgugaccgaguacauccagagaaagaaguucccccccgacaacagcgcccccuacggcgccagauacgugggcagcaugguggccgacgugcacagaacccugguguacggcggcaucuuccuguaccccgccaacaagaagagccccaacggcaagcugagacugcuguacgagugcaaccccauggccuacgugauggagaaggccggcggcauggccaccaccggcaaggaggccgugcuggacgugauccccaccgacauccaccagagagcccccgugauccugggcagccccgacgacgugcuggaguuccugaagguguacgagaagcacagcgcccaguaa

SEQ ID NO: 16977 - RNA, 1020 nt, Artificial Sequence
  FBP2__Homo_sapiens__NP_003828
augaccgacagaagccccuucgagaccgacaugcugacccugaccagauacgugauggagaagggcagacaggccaagggcaccggcgagcugacccagcugcugaacagcaugcugaccgccaucaaggccaucagcagcgccgugagaaaggccggccuggcccaccuguacggcaucgccggcagcgugaacgugaccggcgacgaggugaagaagcuggacgugcugagcaacagccuggugaucaacauggugcagagcagcuacagcaccugcgugcuggugagcgaggagaacaaggacgccaucaucaccgccaaggagaagagaggcaaguacguggugugcuucgacccccuggacggcagcagcaacaucgacugccuggccagcaucggcaccaucuucgccaucuacagaaagaccagcgaggacgagcccagcgagaaggacgcccugcagugcggcagaaacaucguggccgccggcuacgcccuguacggcagcgccacccugguggcccugagcaccggccagggcguggaccuguucaugcuggaccccgcccugggcgaguucgugcugguggagaaggacgugaagaucaagaagaagggcaagaucuacagccugaacgagggcuacgccaaguacuucgacgccgccaccaccgaguacgugcagaagaagaaguuccccgaggacggcagcgcccccuacggcgccagauacgugggcagcaugguggccgacgugcacagaacccugguguacggcggcaucuuccuguaccccgccaaccagaagagccccaagggcaagcugagacugcuguacgagugcaaccccguggccuacaucaucgagcaggccggcggccuggccaccaccggcacccagcccgugcuggacgugaagcccgaggccauccaccagagagugccccugauccugggcagccccgaggacgugcaggaguaccugaccugcgugcagaagaaccaggccggcagcuaa

SEQ ID NO: 16978 - RNA, 2943 nt, Artificial Sequence
  FBRS__Homo_sapiens__NP_001098549
auggagaccgccgccgccgccgcccccggccccggcugggccgccgagggcgagagaagaagaagaagaugcagcagaagagacagagacagagagcagagaagaagaagaggccccggcggcgacgcccccagagcccugcuggccgcccccagaggcagcagcagcagcagcagcccccccccccccgccagacccuggagcagcgccagcagcggcgagagacccggcggccccagaagaagaagacccagacccagacccagaccccccagacccagagccagaaagagacccgccggcagcggcagcagaggcgaggaggaggaggaggaggaggaggagggcggcgccgacgacggcgaggccgaggaggagcccgaggaggaggaggaggaggaggaggaccugaucgacggcuucgccaucgccagcuucgccacccuggaggcccugcagaaggacgccagccugcagccccccgagagacuggagcacagacugaagcacagcggcaagagaaagagaggcggcagcagcggcgccaccggcgagcccggcgacagcagcgacagagagcccggcagaccccccggcgacagagccagaaaguggcccaacaagagaagaagaaaggaggccagcagcagacacagccuggaggccggcuacaucugcgacgccgagagcgaccuggacgagagagugagcgacgacgaccuggaccccagcuucaccgugagcaccagcaaggccagcggcccccacggcgccuucaacggcaacugcgaggccaagcugagcguggugcccaaggugagcggccuggagagaagccaggagcagccccccggccccgacccccugcuggugcccuucccccccaaggagcccccccccccccccgugcccagaccccccgugagcccccccgccccccugcccgccacccccagccugcccccccccccccagccccagcugcagcugagagugagccccuucggccugagaaccagccccuacggcagcagccuggaccugagcaccggcagcagcagcagacccccccccaaggcccccgccccccccguggcccagcccccccccagcagcagcagcagcagcagcagcagcagcagcgccagcagcagcagcgcccagcugacccacagaccccccacccccagccugccccugccccugagcacccacagcuuccccccccccggccugagaccccccccccccccccaccaccccagccuguucagccccggccccacccugccccccccccccccccugcugcaggugcccggccaccccggcgccagcgccgccaacgcccugagcgagcaggaccugaucggccaggaccugaacagcagauaccugaacgcccagggcggccccgagguggugggcgccggcggcagcgccagaccccuggccuuccaguuccaccagcacaaccaccagcaccagcacacccaccagcacacccaccagcacuucacccccuacccccccggccugcugcccccccacggcccccacauguucgagaaguaccccggcaagauggagggccuguucagacacaaccccuacaccgccuucccccccgccgugcccggccugccccccggccugccccccgccgugagcuucggcagccugcagggcgccuuccagcccaagagcaccaaccccgagcugccccccagacugggccccgugcccagcggccugagccagaagggcacccagauccccgaccacuucagacccccccugagaaagcccggcaaguggugcgccaugcacgugagaguggccuacaugauccugagacaccaggagaagaugaagggcgacagccacaagcuggacuucagaaacgaccugcugcccugccugcccggccccuacggcgcccugccccccggccaggagcugagccaccccgccagccuguucaccgccaccggcgccgugcacgccgccgccaaccccuucaccgccgcccccggcgcccacggccccuuccugagccccagcacccacaucgaccccuucggcagacccaccagcuucgccagccuggccgcccugagcaacggcgccuucggcggccugggcagccccaccuucaacagcggcgccguguucgcccagaaggagagccccggcgccccccccgccuucgccagcccccccgaccccuggggcagacugcacagaagcccccugaccuuccccgccugggugagaccccccgaggccgccagaacccccggcagcgacaaggagagacccguggagagaagagagcccagcaucaccaaggaggagaaggacagagaccugcccuucagcagaccccagcugagagugagccccgccacccccaaggccagagccggcgaggagggccccagacccaccaaggagagcgugagagugaaggaggagagaaaggaggaggccgccgccgccgccgccgccgccgccgccgccgccgccgccgccgccgccgccgccaccggcccccagggccugcaccugcuguucgagagacccagacccccccccuuccugggccccagcccccccgacagaugcgccggcuuccuggagcccaccuggcuggccgccccccccagacuggccagaccccccagauucuacgaggccggcgaggagcugaccggccccggcgccguggccgccgccagacuguacggccuggagcccgcccacccccugcuguacagcagacuggcccccccccccccccccgccgccgcccccggcaccccccaccugcugagcaagaccccccccggcgcccugcugggcgccccccccccccuggugcccgcccccagacccagcagcccccccagaggccccggccccgccagagccgacagauaa

SEQ ID NO: 16979 - RNA, 903 nt, Artificial Sequence
  FBXL15__Homo_sapiens__NP_077302
auggagccccccauggagcccagcggcggcgagcaggagcccggcgccgugagauuccuggaccugcccugggaggacgugcugcugccccacgugcugaacagagugccccugagacagcugcugagacugcagagagugagcagagccuucagaagccuggugcagcugcaccuggccggccugagaagauucgacgccgcccaggugggcccccagauccccagagccgcccuggccagacugcugagagacgccgagggccugcaggagcuggcccuggcccccugccacgaguggcugagcgacgaggaccuggugcccgugcuggccagaaacccccagcugagaagcguggcccugggcggcugcggccagcugagcagaagagcccugggcgcccuggccgagggcugccccagacugcagagacugagccuggcccacugcgacuggguggacggccuggcccugagaggccuggccgacagaugccccgcccuggaggagcuggaccugaccgccugcagacagcugaaggacgaggccaucguguaccuggcccagagaagaggcgccggccugagaagccugagccuggccgugaacgccaacgugggcgacgccgccgugcaggagcuggccagaaacugccccgagcugcaccaccuggaccugaccggcugccugagagugggcagcgacggcgugagaacccuggccgaguacugccccgugcugagaagccugagagugagacacugccaccacguggccgagagcagccugagcagacugagaaagagaggcguggacaucgacguggagcccccccugcaccaggcccuggugcugcugcaggacauggccggcuucgcccccuucgugaaccugcagguguaa

SEQ ID NO: 16980 - RNA, 2106 nt, Artificial Sequence
  FBXL17__Homo_sapiens__NP_001156787
augggccaccugcugagcaaggagcccagaaacagacccagccagaagagacccagaugcugcagcuggugcagaagaagaagaccccugcugagacugcccagaagaacccccgccaaggugcccccccagcccgccgcccccagaagcagagacugcuucuucagaggccccugcaugcugugcuucaucgugcacagccccggcgcccccgcccccgccggccccgaggaggagcccccccugagccccccccccagagacggcgccuacgccgccgccagcagcagccagcaccuggccagaagauacgccgcccuggccgccgaggacugcgccgccgccgccagaagauuccugcugagcagcgccgccgccgccgccgccgccgccgccagcgccagcagccccgccagcugcugcaaggagcugggccuggccgccgccgccgccugggagcagcagggcagaagccuguuccuggccagccugggccccgugagauuccugggcccccccgccgccgugcagcuguucagaggccccacccccagccccgccgagcugcccaccccccccgagauggugugcaagagaaagggcgccggcgugcccgccugcacccccugcaagcagcccagaugcggcggcggcggcugcggcggcggcggcggcggcggcggcggcggcggccccgccggcggcggcgccagcccccccagaccccccgacgccggcugcugccaggcccccgagcagcccccccagccccugugccccccccccagcagccccaccagcgagggcgcccccaccgaggccggcggcgacgccgugagagccggcggcaccgccccccugagcgcccagcagcagcacgagugcggcgacgccgacugcagagagagccccgagaaccccugcgacugccacagagagcccccccccgagacccccgacaucaaccagcugccccccagcauccugcugaagaucuucagcaaccugagccuggacgagagaugccugagcgccagccuggugugcaaguacuggagagaccugugccuggacuuccaguucuggaagcagcuggaccugagcagcagacagcaggugaccgacgagcugcuggagaagaucgccagcagaagccagaacaucaucgagaucaacaucagcgacugcagaagcaugagcgacaacggcgugugcgugcuggccuucaagugccccggccugcugagauacaccgccuacagaugcaagcagcugagcgacaccagcaucaucgccguggccagccacugcccccugcugcagaaggugcacgugggcaaccaggacaagcugaccgacgagggccugaagcagcugggcagcaagugcagagagcugaaggacauccacuucggccagugcuacaagaucagcgacgagggcaugaucgugaucgccaagggcugccugaagcugcagagaaucuacaugcaggagaacaagcuggugaccgaccagagcgugaaggccuucgccgagcacugccccgagcugcaguacgugggcuucaugggcugcagcgugaccagcaagggcgugauccaccugaccaagcugagaaaccugagcagccuggaccugagacacaucaccgagcuggacaacgagaccgugauggagaucgugaagagaugcaagaaccugagcagccugaaccugugccugaacuggaucaucaacgacagaugcguggaggugaucgccaaggagggccagaaccugaaggagcuguaccuggugagcugcaagaucaccgacuacgcccugaucgccaucggcagauacagcaugaccaucgagaccguggacgugggcuggugcaaggagaucaccgaccagggcgccacccugaucgcccagagcagcaagagccugagauaccugggccugaugagaugcgacaaggugaacgaggugaccguggagcagcuggugcagcaguacccccacaucaccuucagcaccgugcugcaggacugcaagagaacccuggagagagccuaccagaugggcuggacccccaacaugagcgccgccagcagcuaa

SEQ ID NO: 16981 - RNA, 2085 nt, Artificial Sequence
  FBXL19__Homo_sapiens__NP_001093254
augggcaugaaggugcccggcaagggcgagagcggccccagcgcccugcugaccccccccaugagcagcagcagcagaggccccggcgccggcgccagaagaagaagaaccagaugcagaagaugcagagccugcgugagaaccgagugcggcgacugccacuucugcagagacaugaagaaguucggcggccccggcagaaugaagcagagcugccugcugagacagugcaccgcccccgugcugccccacaccgccgugugccugcugugcggcgaggccggcaaggaggacaccguggagggcgaggaggagaaguucggccugagccugauggagugcaccaucugcaacgagaucgugcaccccggcugccugaagaugggcaaggccgagggcgugaucaacgccgagauccccaacugcugggagugccccagaugcacccaggagggcagaaccagcaaggacagcggcgagggccccggcagaagaagagccgacaacggcgaggagggcgccagccugggcagcggcuggaagcugaccgaggagcccccccugcccccccccccccccagaagaaagggcccccugcccgccggccccccccccgaggacgugcccggcccccccaagagaaaggagagagaggccggcaacgagccccccacccccagaaagaaggugaagggcggcagagagagacaccugaagaaggugggcggcgacgccugccugcugagaggcagcgaccccggcggccccggccugcugccccccagagugcugaaccccagccaggccuucagcagcugccaccccggccugccccccgagaacugggagaagcccaagcccccccuggccagcgccgagggccccgccgugcccagccccagcccccagagagagaagcuggagagauucaagagaaugugccagcugcuggagagagugcccgacaccagcagcagcagcagcgacagcgacagcgacagcgacagcagcggcaccagccugagcgaggacgaggcccccggcgaggccagaaacggcagaagacccgccagaggcagcagcggcgagaaggagaacagaggcggcagaagagccgugagacccggcagcggcggcccccugcugagcuggccccugggccccgcccccccccccagacccccccagcuggagagacacguggugagacccccccccagaagccccgagcccgacacccugccccuggccgccggcagcgaccacccccugcccagagccgccuggcugagaguguuccagcaccugggccccagagagcugugcaucugcaugagagugugcagaaccuggagcagauggugcuacgacaagagacuguggcccagaauggaccugagcagaagaaagagccugaccccccccaugcugagcggcguggugagaagacagcccagagcccuggaccugagcuggaccggcgugagcaagaagcagcugauguggcugcugaacagacugcagggccugcaggagcuggugcugagcggcugcagcuggcugagcgugagcgcccugggcagcgccccccugcccgcccugagacugcuggaccugagauggaucgaggacgugaaggacagccagcugagagagcugcugcugcccccccccgacaccaagcccggccagaccgagagcagaggcagacugcagggcguggccgagcugagacuggccggccuggagcugaccgacgccagccugagacugcugcugagacacgccccccagcugagcgcccuggaccugagccacugcgcccacgugggcgaccccagcgugcaccugcugaccgcccccaccagcccccugagagagacccuggugcaccugaaccuggccggcugccacagacugaccgaccacugccugccccuguucagaagaugccccagacugagaagacuggaccugagaagcugcagacagcugagccccgaggccugcgccagacuggccgccgccggcccccccggccccuucagaugccccgaggagaagcugcugcugaaggacagcuaa

SEQ ID NO: 16982 - RNA, 1215 nt, Artificial Sequence
  FBXL20__Homo_sapiens__NP_001171835
augagaagagacgugaacggcgugaccaagagcagauucgagauguucagcaacagcgacgaggccgugaucaacaagaagcugcccaaggagcugcugcugagaaucuucagcuuccuggacguggugacccugugcagaugcgcccaggugagcagagccuggaacgugcuggcccuggacggcagcaacuggcagagaaucgaccuguucgacuuccagagagacaucgagggcagagugguggagaacaucagcaagagaugcggcggcuuccugagaaagcugagccugagaggcugccugggcgugggcgacaacgcccugagaaccuucgcccagaacugcagaaacaucgaggugcugaaccugaacggcugcaccaagaccaccgacgccgagggcugcccccugcuggagcagcugaacaucagcuggugcgaccaggugaccaaggacggcauccaggcccuggugagaggcugcggcggccugaaggcccuguuccugaagggcugcacccagcuggaggacgaggcccugaaguacaucggcgcccacugccccgagcuggugacccugaaccugcagaccugccugcagaucaccgacgagggccugaucaccaucugcagaggcugccacaagcugcagagccugugcgccagcggcugcagcaacaucaccgacgccauccugaacgcccugggccagaacugccccagacugagaauccuggagguggccagaugcagccagcugaccgacgugggcuucaccacccuggccagaaacugccacgagcuggagaagauggaccuggaggagugcgugcagaucaccgacagcacccugauccagcugagcauccacugccccagacugcaggugcugagccugagccacugcgagcugaucaccgacgacggcaucagacaccugggcaacggcgccugcgcccacgaccagcuggaggugaucgagcuggacaacugcccccugaucaccgacgccagccuggagcaccugaagagcugccacagccuggagagaaucgagcuguacgacugccagcagaucaccagagccggcaucaagagacugagaacccaccugcccaacaucaaggugcacgccuacuucgcccccgugacccccccccccagcgugggcggcagcagacagagauucugcagaugcugcaucauccuguaa

SEQ ID NO: 16983 - RNA, 1068 nt, Artificial Sequence
  FBXL2__Homo_sapiens__NP_001165184
augguguucagcaacaacgacgagggccugaucaacaagaagcugcccaaggagcugcugcugagaaucuucagcuuccuggacaucgugacccugugcagaugcgcccagaucagcaaggccuggaacauccuggcccuggacggcagcaacuggcagagaaucgaccuguucaacuuccagaccgacguggagggcagagugguggagaacaucagcaagagaugcggcggcuuccugagaaagcugagccugagaggcugcaucggcgugggcgacagcagccugaagaccuucgcccagaacugcagaaacaucgagcaccugaaccugaacggcugcaccaagaucaccgacagcaccugcuacagccugagcagauucugcagcaagcugaagcacauccagaacuacugccacgagcuggugagccugaaccugcagagcugcagcagaaucaccgacgagggcguggugcagaucugcagaggcugccacagacugcaggcccugugccugagcggcugcagcaaccugaccgacgccagccugaccgcccugggccugaacugccccagacugcagauccuggaggccgccagaugcagccaccugaccgacgccggcuucacccugcuggccagaaacugccacgagcuggagaagauggaccuggaggagugcauccugaucaccgacagcacccugauccagcugagcauccacugccccaagcugcaggcccugagccugagccacugcgagcugaucaccgacgacggcauccugcaccugagcaacagcaccugcggccacgagagacugagagugcuggagcuggacaacugccugcugaucaccgacguggcccuggagcaccuggagaacugcagaggccuggagagacuggagcuguacgacugccagcaggugaccagagccggcaucaagagaaugagagcccagcugccccacgugaaggugcacgccuacuucgcccccgugaccccccccaccgccguggccggcagcggccagagacugugcagaugcugcgugauccuguaa

SEQ ID NO: 16984 - RNA, 1287 nt, Artificial Sequence
  FBXL3__Homo_sapiens__NP_036290
augaagagaggcggcagagacagcgacagaaacagcagcgaggagggcaccgccgagaagagcaagaagcugagaaccaccaacgagcacagccagaccugcgacuggggcaaccugcugcaggacaucauccugcagguguucaaguaccugccccugcuggacagagcccacgccagccaggugugcagaaacuggaaccagguguuccacaugcccgaccuguggagaugcuucgaguucgagcugaaccagcccgccaccagcuaccugaaggccacccaccccgagcugaucaagcagaucaucaagagacacagcaaccaccugcaguacgugagcuucaagguggacagcagcaaggagagcgccgaggccgccugcgacauccugagccagcuggugaacugcagccugaagacccugggccugaucagcaccgccagacccagcuucauggaccugcccaagagccacuucaucagcgcccugaccgugguguucgugaacagcaagagccugagcagccugaagaucgacgacacccccguggacgaccccagccugaaggugcugguggccaacaacagcgacacccugaagcugcugaagaugagcagcugcccccacgugagccccgccggcauccugugcguggccgaccagugccacggccugagagagcuggcccugaacuaccaccugcugagcgacgagcugcugcuggcccugagcagcgagaagcacgugagacuggagcaccugagaaucgacguggugagcgagaaccccggccagacccacuuccacaccauccagaagagcagcugggacgccuucaucagacacagccccaaggugaaccuggugauguacuucuuccuguacgaggaggaguucgaccccuucuucagauacgagauccccgccacccaccuguacuucggcagaagcgugagcaaggacgugcugggcagagugggcaugaccugccccagacugguggagcugguggugugcgccaacggccugagaccccuggacgaggagcugaucagaaucgccgagagaugcaagaaccugagcgccaucggccugggcgagugcgaggugagcugcagcgccuucguggaguucgugaagaugugcggcggcagacugagccagcugagcaucauggaggaggugcugauccccgaccagaaguacagccuggagcagauccacugggaggugagcaagcaccugggcagagugugguuccccgacaugaugcccaccugguaa

SEQ ID NO: 16985 - RNA, 1866 nt, Artificial Sequence
  FBXL4__Homo_sapiens__NP_001265645
augagccccguguuccccaugcugaccgugcugaccauguucuacuacaucugccugagaagaagagccagaaccgccaccagaggcgagaugaugaacacccacagagccaucgagagcaacagccagaccagcccccugaacgccgagguggugcaguacgccaaggaggugguggacuucagcagccacuacggcagcgagaacagcaugagcuacaccauguggaaccuggccggcgugcccaacguguuccccagcagcggcgacuucacccagaccgccguguucagaaccuacggcaccuggugggaccagugccccagcgccagccugcccuucaagagaaccccccccaacuuccagagccaggacuacguggagcugaccuucgagcagcagguguaccccaccgccgugcacgugcuggagaccuaccaccccggcgccgugaucagaauccuggccugcagcgccaaccccuacagccccaacccccccgccgaggugagaugggagauccuguggagcgagagacccaccaaggugaacgccagccaggccagacaguucaagcccugcaucaagcagaucaacuuccccaccaaccugaucagacuggaggugaacagcagccugcuggaguacuacaccgagcuggacgccguggugcugcacggcgugaaggacaagcccgugcugagccugaagaccagccugaucgacaugaacgacaucgaggacgacgccuacgccgagaaggacggcugcggcauggacagccugaacaagaaguucagcagcgccgugcugggcgagggccccaacaacggcuacuucgacaagcugcccuacgagcugauccagcugauccugaaccaccugacccugcccgaccugugcagacuggcccagaccugcaagcugcugagccagcacugcugcgacccccugcaguacauccaccugaaccugcagcccuacugggccaagcuggacgacaccagccuggaguuccugcagagcagaugcacccuggugcaguggcugaaccugagcuggaccggcaacagaggcuucaucagcguggccggcuucagcagauuccugaaggugugcggcagcgagcuggugagacuggagcugagcugcagccacuuccugaacgagaccugccuggaggugaucagcgagaugugccccaaccugcaggcccugaaccugagcagcugcgacaagcugcccccccaggccuucaaccacaucgccaagcugugcagccugaagagacuggugcuguacagaaccaagguggagcagaccgcccugcugagcauccugaacuucugcagcgagcugcagcaccugagccugggcagcugcgugaugaucgaggacuacgacgugaucgccagcaugaucggcgccaagugcaagaagcugagaacccuggaccuguggagaugcaagaacaucaccgagaacggcaucgccgagcuggccagcggcugcccccugcuggaggagcuggaccugggcuggugccccacccugcagagcagcaccggcugcuucaccagacuggcccaccagcugcccaaccugcagaagcuguuccugaccgccaacagaagcgugugcgacaccgacaucgacgagcuggccugcaacugcaccagacugcagcagcuggacauccugggcaccagaauggugagccccgccagccugagaaagcugcuggagagcugcaaggaccugagccugcuggacgugagcuucugcagccagaucgacaacagagccgugcuggagcugaacgccagcuuccccaagguguucaucaagaagagcuucacccaguaa

SEQ ID NO: 16986 - RNA, 2025 nt, Artificial Sequence
  FBXL5__Homo_sapiens__NP_001180464
auggcccccuuccccgaggagguggacguguucaccgccccccacuggagaaugaagcagcuggugggccuguacugcgacaagagccuguacgccaccuucaaggaguucaagaugcacgagcagaucgagaacgaguacaucaucggccugcugcagcagagaagccagaccaucuacaacgugcacagcgacaacaagcugagcgagaugcugagccuguucgagaagggccugaagaacgugaagaacgaguacgagcagcugaacuacgccaagcagcugaaggagagacuggaggccuucaccagagacuuccugccccacaugaaggaggaggaggagguguuccagcccaugcugauggaguacuucaccuacgaggagcugaaggacaucaagaagaaggugaucgcccagcacugcagccagaaggacaccgccgagcugcugagaggccugagccuguggaaccacgccgaggagagacagaaguucuucaaguacagcguggacgagaagagcgacaaggaggccgaggugagcgagcacagcaccggcaucacccaccugccccccgaggugaugcugagcaucuucagcuaccugaacccccaggagcugugcagaugcagccaggugagcaugaaguggagccagcugaccaagaccggcagccuguggaagcaccuguaccccgugcacugggccagaggcgacugguacagcggccccgccaccgagcuggacaccgagcccgacgacgagugggugaagaacagaaaggacgagagcagagccuuccacgagugggacgaggacgccgacaucgacgagagcgaggagagcgccgaggagagcaucgccaucagcaucgcccagauggagaagagacugcugcacggccugauccacaacgugcugcccuacgugggcaccagcgugaagacccuggugcuggccuacagcagcgccgugagcagcaagauggugagacagauccuggagcugugccccaaccuggagcaccuggaccugacccagaccgacaucagcgacagcgccuucgacagcuggagcuggcugggcugcugccagagccugagacaccuggaccugagcggcugcgagaagaucaccgacguggcccuggagaagaucagcagagcccugggcauccugaccagccaccagagcggcuuccugaagaccagcaccagcaagaucaccagcaccgccuggaagaacaaggacaucaccaugcagagcaccaagcaguacgccugccugcacgaccugaccaacaagggcaucggcgaggagaucgacaacgagcaccccuggaccaagcccgugagcagcgagaacuucaccagccccuacguguggaugcuggacgccgaggaccuggccgacaucgaggacaccguggaguggagacacagaaacguggagagccugugcgugauggagaccgccagcaacuucagcugcagcaccagcggcugcuucagcaaggacaucgugggccugagaaccagcgugugcuggcagcagcacugcgccagccccgccuucgccuacugcggccacagcuucugcugcaccggcaccgcccugagaaccaugagcagccugcccgagagcagcgccaugugcagaaaggccgccagaaccagacugcccagaggcaaggaccugaucuacuucggcagcgagaagagcgaccaggagaccggcagagugcugcuguuccugagccugagcggcugcuaccagaucaccgaccacggccugagagugcugacccugggcggcggccugcccuaccuggagcaccugaaccugagcggcugccugaccaucaccggcgccggccugcaggaccuggugagcgccugccccagccugaacgacgaguacuucuacuacugcgacaacaucaacggcccccacgccgacaccgccagcggcugccagaaccugcagugcggcuucagagccugcugcagaagcggcgaguaa

SEQ ID NO: 16987 - RNA, 1476 nt, Artificial Sequence
  FBXL7__Homo_sapiens__NP_036436
augggcgccaacaacggcaagcaguacggcagcgagggcaagggcagcagcagcaucagcagcgacgugagcagcagcaccgaccacacccccaccaaggcccagaagaacguggccaccagcgaggacagcgaccugagcaugagaacccugagcacccccagccccgcccugaucugcccccccaaccugcccggcuuccagaacggcagaggcagcagcaccagcagcagcagcaucaccggcgagaccguggccauggugcacagccccccccccaccagacugacccacccccugaucagacuggccagcagaccccagaaggagcaggccagcaucgacagacugcccgaccacagcauggugcagaucuucagcuuccugcccaccaaccagcugugcagaugcgccagagugugcagaagaugguacaaccuggccugggaccccagacuguggagaaccaucagacugaccggcgagaccaucaacguggacagagcccugaaggugcugaccagaagacugugccaggacacccccaacgugugccugaugcuggagaccgugaccgugagcggcugcagaagacugaccgacagaggccuguacaccaucgcccagugcugccccgagcugagaagacuggaggugagcggcugcuacaacaucagcaacgaggccguguucgacguggugagccugugccccaaccuggagcaccuggacgugagcggcugcagcaaggugaccugcaucagccugaccagagaggccagcaucaagcugagcccccugcacggcaagcagaucagcaucagauaccuggacaugaccgacugcuucgugcuggaggacgagggccugcacaccaucgccgcccacugcacccagcugacccaccuguaccugagaagaugcgugagacugaccgacgagggccugagauaccuggugaucuacugcgccagcaucaaggagcugagcgugagcgacugcagauucgugagcgacuucggccugagagagaucgccaagcuggagagcagacugagauaccugagcaucgcccacugcggcagagugaccgacgugggcaucagauacguggccaaguacugcagcaagcugagauaccugaacgccagaggcugcgagggcaucaccgaccacggcguggaguaccuggccaagaacugcaccaagcugaagagccuggacaucggcaagugcccccuggugagcgacaccggccuggagugccuggcccugaacugcuucaaccugaagagacugagccugaagagcugcgagagcaucaccggccagggccugcagaucguggccgccaacugcuucgaccugcagacccugaacgugcaggacugcgaggugagcguggaggcccugagauucgugaagagacacugcaagagaugcgugaucgagcacaccaaccccgccuucuucuaa

SEQ ID NO: 16988 - RNA, 1962 nt, Artificial Sequence
  FBXO10__Homo_sapiens__XP_005251496
auggaggccggcggccugccccuggagcuguggagaaugauccuggccuaccugcaccugcccgaccugggcagaugcagccuggugugcagagccugguacgagcugauccugagccuggacagcaccagauggagacagcugugccugggcugcaccgagugcagacaccccaacuggcccaaccagcccgacguggagcccgagagcuggagagaggccuucaagcagcacuaccuggccagcaagaccuggaccaagaacgcccuggaccuggagagcagcaucugcuucagccuguucagaagaagaagagagagaagaacccugagcgugggccccggcagagaguucgacagccugggcagcgcccuggccauggccagccuguacgacagaaucgugcuguuccccggcguguacgaggagcagggcgagaucauccugaaggugcccguggagaucgugggccagggcaagcugggcgagguggcccugcuggccagcaucgaccagcacugcagcaccaccagacugugcaaccugguguucacccccgccugguucagccccaucauguacaagaccaccagcggccacgugcaguucgacaacugcaacuucgagaacggccacauccaggugcacggccccggcaccugccaggugaaguucugcaccuucaagaacacccacaucuuccugcacaacgugccccugugcgugcuggagaacugcgaguucgugggcagcgagaacaacagcgugaccguggagggccaccccagcgccgacaagaacugggccuacaaguaccugcugggccugaucaagagcagccccaccuuccugcccaccgaggacagcgacuuccugaugagccuggaccuggagagcagagaccaggccuggagccccaagaccugcgacaucgugaucgagggcagccagagccccaccagccccgccagcagcagccccaagcccggcagcaaggccggcagccaggaggccgaggugggcagcgacggcgagagaguggcccagacccccgacagcagcgacggcggccugagccccagcggcgaggacgaggacgaggaccagcugauguacagacugagcuaccaggugcagggccccagacccgugcugggcggcagcuuccugggccccccccugcccggcgccagcauccagcugcccagcugccuggugcugaacagccugcagcaggagcugcagaaggacaaggaggccauggcccuggccaacagcgugcagggcugccugaucagaaagugccuguucagagacggcaagggcggcguguucgugugcagccacggcagagccaagauggagggcaacaucuucagaaaccugaccuacgccgugagaugcauccacaacagcaagaucaucaugcugagaaacgacaucuacagaugcagagccagcggcaucuuccugagacuggagggcggcggccugaucgccggcaacaacaucuaccacaacgccgaggccggcguggacaucagaaagaagagcaacccccugauccugugcaaccagauccaccacggccugagaagcggcaucguggugcugggcaacggcaagggcaucaucagaaacaaccagaucuucagcaacaaggaggccggcaucuacauccuguaccacggcaaccccguggugagcggcaaccacaucuucaagggcagagccgccggcaucgccgugaacgagaacggcaagggccugaucaccgagaacgugaucagagagaaccaguggggcggcguggacaucagaagaggcggcauccccgugcugagaagcaaccugaucugcuucggcuacagcgacggcgugguggugggcgacgagggcaagggccugaucgagggcaacaccaucuacgagaacggcaaguacaacggcaagaccagauaa

SEQ ID NO: 16989 - RNA, 2784 nt, Artificial Sequence
  FBXO11__Homo_sapiens__NP_001177203
augaacagcgugagagccgccaacagaagacccagaagagugagcagacccagacccgugcagcagcagcagcagcagcccccccagcagccccccccccagcccccccagcagcagcccccccagcagcagccccccccccccccccagcagcagcagcagcagcagcccccccccccccccccccccccccccccccugccccaggagagaaacaacgugggcgagagagacgacgacgugcccgccgacaugguggccgaggagagcggccccggcgcccagaacagccccuaccagcugagaagaaagacccugcugcccaagagaaccgccugccccaccaagaacagcauggagggcgccagcaccagcaccaccgagaacuucggccacagagccaagagagccagagugagcggcaagagccaggaccugagcgccgcccccgccgagcaguaccugcaggagaagcugcccgacgagguggugcugaagaucuucagcuaccugcuggagcaggaccugugcagagccgccugcgugugcaagagauucagcgagcuggccaacgaccccauccuguggaagagacuguacauggagguguucgaguacaccagacccaugaugcaccccgagcccggcaaguucuaccagaucaaccccgaggaguacgagcaccccaaccccuggaaggagagcuuccagcagcuguacaagggcgcccacgugaagcccggcuucgccgagcacuucuacagcaaccccgccagauacaagggcagagagaacaugcuguacuacgacaccaucgaggacgcccugggcggcgugcaggaggcccacuucgacggccugaucuucgugcacagcggcaucuacaccgacgaguggaucuacaucgagagccccaucaccaugaucggcgccgcccccggcaagguggccgacaaggugaucaucgagaacaccagagacagcaccuucguguucauggagggcagcgaggacgccuacgugggcuacaugaccaucagauucaaccccgacgacaagagcgcccagcaccacaacgcccaccacugccuggagaucaccgugaacugcagccccaucaucgaccacugcaucaucagaagcaccugcaccgugggcagcgccgugugcgugagcggccagggcgccugccccaccaucaagcacugcaacaucagcgacugcgagaacgugggccuguacaucaccgaccacgcccagggcaucuacgaggacaacgagaucagcaacaacgcccuggccggcaucugggugaagaaccacggcaaccccaucaucagaagaaaccacauccaccacggcagagacgugggcguguucaccuucgaccacggcaugggcuacuucgagagcugcaacauccacagaaacagaaucgccggcuucgaggugaaggccuacgccaaccccaccguggugagaugcgagauccaccacggccagaccggcggcaucuacgugcacgagaagggcagaggccaguucaucgagaacaagaucuacgccaacaacuucgccggcguguggaucaccagcaacagcgaccccaccaucagaggcaacagcaucuucaacggcaaccagggcggcguguacaucuucggcgacggcagaggccugaucgagggcaacgacaucuacggcaacgcccuggccggcauccagaucagaaccaacagcugccccaucgugagacacaacaagauccacgacggccagcacggcggcaucuacgugcacgagaagggccagggcgugaucgaggagaacgagguguacagcaacacccuggccggcgugugggugaccaccggcagcacccccgugcugagaagaaacagaauccacagcggcaagcaggugggcguguacuucuacgacaacggccacggcgugcuggaggacaacgacaucuacaaccacauguacagcggcgugcagaucagaaccggcagcaaccccaagaucagaagaaacaagaucuggggcggccagaacggcggcauccugguguacaacagcggccugggcugcaucgaggacaacgagaucuucgacaacgccauggccggcguguggaucaagaccgacagcaaccccacccugagaagaaacaagauccacgacggcagagacggcggcaucugcaucuucaacggcggcagaggccugcuggaggagaacgacaucuucagaaacgcccaggccggcgugcugaucagcaccaacagccaccccauccugagaaagaacagaaucuucgacggcuucgccgccggcaucgagaucaccaaccacgccaccgccacccuggagggcaaccagaucuucaacaacagauucggcggccuguuccuggccagcggcgugaacgugaccaugaaggacaacaagaucaugaacaaccaggacgccaucgagaaggccgugagcagaggccagugccuguacaagaucagcagcuacaccagcuaccccaugcacgacuucuacagaugccacaccugcaacaccaccgacagaaacgccaucugcgugaacugcaucaagaagugccaccagggccacgacguggaguucaucagacacgacagauucuucugcgacugcggcgccggcacccugagcaaccccugcacccuggccggcgagcccacccacgacaccgacacccuguacgacagcgccccccccaucgagagcaacacccugcagcacaacuaa

SEQ ID NO: 16990 - RNA, 1533 nt, Artificial Sequence
  FBXO15__Homo_sapiens__NP_001136430
auggccaccggcagaggcagaauccugcagcagcacuggcugggccugcagacccugagaggccccagcagaggcggcggcgccgccagaggcagagccagagccuucggcugcagaaagggccccggcgugaagcugagcgccggcagcgccgcccugagaugccacgccggcggcggccagcacugggagagcagcuucagcugcugcagcggcuuccuggacggcaugcccagcgagauccugcugaagaucuucagcuaccuggacgccgugagccugcugugcaccggcugcgugagcagaagauucuaccaccuggccaacgacaacuucaucuggaucggcaucuacagcaccgccuucagccccgccagaagcaacuggaaguucaacagcguggagaagaucgccaugagcaugagcuuccugagcgugcaggacaaggaggccggcuacuggaagaaggaguacaucaccaagcagaucgccagcgugaaggccgcccuggccgacauccugaagcccgugaaccccuacaccggccugcccgugaagaccaaggaggcccugagaaucuucggccugggcugggccaucauccugaaggagaagggcggcaaggaguacaucauggagcacguggaccugagcaucaacgacaccagcgugaccgugaucugguacggcaagaaguggcccugccuggccagccugagcacccuggaccugugcggcaugacccccguguucaccgacugguacaagacccccaccaagcacagacugagauggcacagccugaucgccaaguacaaccugagccaccugaccaucagcaccaugaucggcugcgacagacugaucagaaucuucugccugcaccccggccugcuggugggcguguggaagaaggaggaggagcuggccuucgugauggccaaccugcacuuccaccaccugguggagagaagcacccugggcagcgccaccauccccuacgagcugcccccccacagccccuuccuggacgacagccccgaguacggccugcacggcuaccagcugcacguggaccugcacagcggcggcguguucuaccugugcggcaccuucagaaaccuguucaccaagagaggcaacaucgagaacggccacgugaagcugaucgugauccaccugaagaacaacagagagcaccugccccugaucggcaaggugggccugagcuggaagaccgacaucuucgacggcugcaucaagagcugcagcaugauggacgugacccugcuggacgagcacggcaagcccuucuggugcuucagcagccccgugugccugagaagccccgccacccccagcgacagcagcagcuuccugggccagaccuacaacguggacuacguggacgccgagggcagagugcacguggagcugguguggaucagagagaccgaggaguaccugaucgugaaccuggugcuguaccugagcaucgccaagaucaaccacugguucggcaccgaguacuaa

SEQ ID NO: 16991 - RNA, 837 nt, Artificial Sequence
  FBXO17__Homo_sapiens__NP_079183
augggcgccagacugagcagaagaagacugcccgccgaccccagccuggcccuggacgcccugccccccgagcugcuggugcaggugcugagccacgugccccccagaagccuggugaccagaugcagacccgugugcagagccuggagagacaucguggacggccccaccguguggcugcugcagcuggccagagacagaagcgccgagggcagagcccuguacgccguggcccagagaugccugcccagcaacgaggacaaggaggaguucccccugugcgcccuggccagauacugccugagagcccccuucggcagaaaccugaucuucaacagcugcggcgagcagggcuucagaggcugggagguggagcacggcggcaacggcugggccaucgagaagaaccugacccccgugcccggcgcccccagccagaccugcuucgugaccagcuucgaguggugcagcaagagacagcugguggaccuggugauggagggcguguggcaggagcugcuggacagcgcccagaucgagaucugcguggccgacugguggggcgccagagagaacugcggcugcguguaccagcugagagugagacugcuggacguguacgagaaggagguggugaaguucagcgccagccccgaccccgugcugcaguggaccgagagaggcugcagacaggugagccacguguucaccaacuucggcaagggcaucagauacgugagcuucgagcaguacggcagagacgugagcagcugggugggccacuacggcgcccuggugacccacagcagcgugagagugagaaucagacugagcuaa

SEQ ID NO: 16992 - RNA, 2961 nt, Artificial Sequence
  FBXO18__Homo_sapiens__NP_001245381
auggccaagagcaacagcgugggccaggacagcugccaggacagcgagggcgacaugaucuuccccgccgagagcagcugcgcccugccccaggagggcagcgccggccccggcagccccggcagcgccccccccagcagaaagagaagcuggagcagcgaggaggagagcaaccaggccaccggcaccagcagaugggacggcgugagcaagaaggcccccagacaccaccugagcgugcccugcaccagacccagagaggccagacaggaggccgaggacagcaccagcagacugagcgccgagagcggcgagaccgaccaggacgccggcgacgugggccccgaccccauccccgacagcuacuacggccugcugggcacccugcccugccaggaggcccugagccacaucugcagccugcccagcgaggugcugagacacguguucgccuuccugcccguggaggaccuguacuggaaccugagccuggugugccaccuguggagagagaucaucagcgacccccuguucauccccuggaagaagcuguaccacagauaccugaugaacgaggagcaggccgugagcaagguggacggcauccugagcaacugcggcaucgagaaggagagcgaccugugcgugcugaaccugaucagauacaccgccaccaccaagugcagccccagcguggaccccgagagagugcuguggagccugagagaccacccccugcugcccgaggccgaggccugcgugagacagcaccugcccgaccuguacgccgccgccggcggcgugaacaucugggcccugguggccgccguggugcugcugagcagcagcgugaacgacauccagagacugcuguucugccugagaagacccagcagcaccgugaccaugcccgacgugaccgagacccuguacugcaucgccgugcugcuguacgccaugagagagaagggcaucaacaucagcaacagaauccacuacaacaucuucuacugccuguaccugcaggagaacagcugcacccaggccaccaaggugaaggaggagcccagcguguggcccggcaagaagaccauccagcugacccacgagcagcagcugauccugaaccacaagauggagccccugcagguggugaagaucauggccuucgccggcaccggcaagaccagcacccuggugaaguacgccgagaaguggagccagagcagauuccuguacgugaccuucaacaagagcaucgccaagcaggccgagagaguguuccccagcaacgugaucugcaagaccuuccacagcauggccuacggccacaucggcagaaaguaccagagcaagaagaagcugaaccuguucaagcugacccccuucauggugaacagcgugcuggccgagggcaagggcggcuucaucagagccaagcuggugugcaagacccuggagaacuucuucgccagcgccgacgaggagcugaccaucgaccacgugcccaucuggugcaagaacagccagggccagagagugaugguggagcagagcgagaagcugaacggcgugcuggaggccagcagacugugggacaacaugagaaagcugggcgagugcaccgaggaggcccaccagaugacccacgacggcuaccugaagcuguggcagcugagcaagcccagccuggccagcuucgacgccaucuucguggacgaggcccaggacugcacccccgccaucaugaacaucgugcugagccagcccugcggcaagaucuucgugggcgacccccaccagcagaucuacaccuucagaggcgccgugaacgcccuguucaccgugccccacacccacguguucuaccugacccagagcuucagauucggcguggagaucgccuacgugggcgccaccauccuggacgugugcaagagagugagaaagaagacccuggugggcggcaaccaccagagcggcaucagaggcgacgccaagggccagguggcccugcugagcagaaccaacgccaacguguucgacgaggccgugagagugaccgagggcgaguuccccagcagaauccaccugaucggcggcaucaagagcuucggccuggacagaaucaucgacaucuggauccugcugcagcccgaggaggagagaagaaagcagaaccuggugaucaaggacaaguucaucagaagaugggugcacaaggagggcuucagcggcuucaagagauacgugaccgccgccgaggacaaggagcuggaggccaagaucgccgugguggagaaguacaacaucagaauccccgagcuggugcagagaaucgagaagugccacaucgaggaccuggacuucgccgagauggagagccaccacgugggccaggccggccuggagcugcccaccagcgaguacauccugggcaccgugcacaaggccaagggccuggaguucgacaccgugcacgugcuggacgacuucgugaaggugcccugcgccagacacaaccugccccagcugccccacuucagaguggagagcuucagcgaggacgaguggaaccugcuguacguggccgugaccagagccaagaagagacugaucaugaccaagagccuggagaacauccugacccuggccggcgaguacuuccugcaggccgagcugaccagcaacgugcugaagaccggcguggugagaugcugcgugggccagugcaacaacgccauccccguggacaccgugcugaccaugaagaagcugcccaucaccuacagcaacagaaaggagaacaagggcggcuaccugugccacagcugcgccgagcagagaaucggcccccuggccuuccugaccgccagccccgagcaggugagagccauggagagaaccguggagaacaucgugcugcccagacacgaggcccugcuguuccugguguucuaa

SEQ ID NO: 16993 - RNA, 540 nt, Artificial Sequence
  FBXO28__Homo_sapiens__NP_001129587
auggccgccgccgccgaggagagaauggccgaggagggcggcggcggccagggcgacggcggcagcagccuggccagcggcagcacccagagacagccccccccccccgccccccagcacccccagcccggcagccaggcccugcccgcccccgcccuggcccccgaccagcugccccagaacaacacccugguggcccugcccaucguggccaucgagaacauccugagcuucaugagcuacgacgagaucagccagcugagacuggugugcaagagaauggaccuggugugccagagaaugcugaaccagggcuuccugaagguggagagauaccacaaccugugccagaagcaggugaaggcccagcugcccagaagagagagcgagagaagaaaccacagccuggccagacacgccgacauccuggccgccguggagaccagacugagccugcugaacaugaccuucaugaaguacguggacagcaaccugugcugcuucauccccggcaaguuccaggacagacugcagcccuaa

SEQ ID NO: 16994 - RNA, 2238 nt, Artificial Sequence
  FBXO30__Homo_sapiens__XP_005267216
auggaggaggagcugcagcacagccacugcgugaacugcgugagcagaagaugcaugaccagacccgagcccggcaucagcugcgaccugaucggcugcccccuggugugcggcgccguguuccacagcugcaaggccgacgagcacagacugcugugccccuucgagagagugcccugccugaacagcgacuucggcugccccuucaccauggccagaaacaagguggccgagcaccuggagaugugccccgccagcguggugugcugcaccauggaguggaacagauggcccgugagcuacgccgacagaaagagcuacgagaaccugagcagagacguggacgagguggcccagcuggacauggcccuggcccugcaggaccagagaaugcugcuggagagccugaagguggccaccaugaugagcaaggccaccgacaaggugagcaagcccagagagcagaucagcgugaagagcagcgugcccgagaucccccacgccaacggccuggugagcguggacgaggagagcuacggcgcccuguaccaggccaccguggagaccaccagaagccuggccgccgcccuggacauccugaacaccgccaccagagacaucggcaugcugaacaccagcgugcccaacgacauggacgagcagcagaacgccagagagagccuggaggaccagaaccugaaggaccaggaccaccuguacgaggaggagaucggcgccgugggcggcaucgacuacaacgacaccaaccagaacgcccagagcgagcagaacggcagcagcgaccugcugugcgaccugaacaccagcagcuacgacaccagcgcccugugcaacggcuucccccuggagaacaucugcacccaggugaucgaccagaaccagaaccugcacggcgacagcaagcagagcaaccugaccaacggcgacugcguggccagcagcgacggcaccagcaagcccagcagcagccuggccguggccgcccagcugagagagaucauccccagcagcgcccugcccaacggcaccgugcagcacauccugaugcccgacgacgagggcgagggcgagcugugcuggaagaagguggaccugggcgacgugaagaacguggacgugcugagcuucagccacgcccccagcuucaacuuccugagcaacagcugcuggagcaagcccaaggaggacaaggccguggacaccagcgaccuggagguggccgaggaccccaugggccugcagggcaucgaccugaucaccgccgcccugcuguucugccugggcgacagccccggcggcagaggcaucagcgacagcagaauggccgacaucuaccacaucgacgugggcacccagaccuucagccugcccagcgccauccuggccaccagcaccauggugggcgagaucgccagcgccagcgccugcgaccacgccaacccccagcugagcaaccccagccccuuccagacccugggccuggaccuggugcuggagugcguggccagauaccagcccaagcagagaagcauguucaccuucgugugcggccagcuguucagaagaaaggaguucagcagccacuucaagaacgugcacggcgacauccacgccggccugaacggcuggauggagcagagaugcccccuggccuacuacggcugcaccuacagccagagaagauucugccccagcauccagggcgccaagaucauccacgacagacaccugagaagcuucggcgugcagcccugcgugagcaccgugcugguggagcccgccagaaacugcgugcugggccugcacaacgaccaccugagcagccugcccuucgaggugcugcagcacaucgccggcuuccuggacggcuucagccugugccagcugagcugcgugagcaagcugaugagagacgugugcggcagccugcugcagagcagaggcauggugauccugcaguggggcaagagaaaguaccccgagggcaacagcagcuggcagaucaaggagaagguguggagauucagcaccgccuucugcagcgugaacgaguggaaguucgccgacauccugagcauggccgaccaccugaagaagugcagcuacaacgugguggagaagagagaggaggccaucccccugcccugcaugugcgugaccagagagcugaccaaggagggcagaagccugagaagcgugcugaagcccgugcuguaa

SEQ ID NO: 16995 - RNA, 1104 nt, Artificial Sequence
  FBXO31__Homo_sapiens__NP_001269612
auguaccugcccccccacgacccccacguggacgaccccaugagauucaagccccuguucagaauccaccugauggagagaaaggccgccaccguggagugcauguacggccacaagggcccccaccacggccacauccagaucgugaagaaggacgaguucagcaccaagugcaaccagaccgaccaccacagaaugagcggcggcagacaggaggaguucagaaccuggcugagagaggaguggggcagaacccuggaggacaucuuccacgagcacaugcaggagcugauccugaugaaguucaucuacaccagccaguacgacaacugccugaccuacagaagaaucuaccugccccccagcagacccgacgaccugaucaagcccggccuguucaagggcaccuacggcagccacggccuggagaucgugaugcugagcuuccacggcagaagagccagaggcaccaagaucaccggcgaccccaacauccccgccggccagcagaccguggagaucgaccugagacacagaauccagcugcccgaccuggagaaccagagaaacuucaacgagcugagcagaaucgugcuggaggugagagagagagugagacaggagcagcaggagggcggccacgaggccggcgagggcagaggcagacagggccccagagagagccagcccagccccgcccagcccagagccgaggcccccagcaagggccccgacggcacccccggcgaggacggcggcgagcccggcgacgccguggccgccgccgagcagcccgcccagugcggccagggccagcccuucgugcugcccgugggcgugagcagcagaaacgaggacuaccccagaaccugcagaaugugcuucuacggcaccggccugaucgccggccacggcuucaccagccccgagagaacccccggcguguucauccuguucgacgaggacagauucggcuucguguggcuggagcugaagagcuucagccuguacagcagagugcaggccaccuucagaaacgccgacgcccccagcccccaggccuucgacgagaugcugaagaacauccagagccugaccagcuaa

SEQ ID NO: 16996 - RNA, 789 nt, Artificial Sequence
  FBXO32__Homo_sapiens__NP_001229392
augcccuuccugggccaggacuggagaagccccggccagaacugggugaagaccgccgacggcuggaagagauuccuggacgagaagagcggcagcuucgugagcgaccugagcagcuacugcaacaaggagguguacaacaaggagaaccuguucaacagccugaacuacgacguggccgccaagaagagaaagaaggacaugcugaacagcaagaccaagacccaguacuuccaccaggagaaguggaucuacgugcacaagggcagcaccaaggagagacacggcuacugcacccugggcgaggccuucaacagacuggacuucagcaccgccauccuggacagcagaagauucaacuacguggugagacccgccuucaagggccugaccuucaccgaccugccccugugccugcagcugaacaucaugcagagacugagcgacggcagagaccuggugagccugggccaggccgcccccgaccugcacgugcugagcgaggacagacugcuguggaagaagcugugccaguaccacuucagcgagagacagaucagaaagagacugauccugagcgacaagggccagcuggacuggaagaagauguacuucaagcuggugagaugcuaccccagaaaggagcaguacggcgacacccugcagcugugcaagcacugccacauccugagcuggaagggcaccgaccaccccugcaccgccaacaaccccgagagcugcagcgugagccugagcccccaggacuucaucaaccuguucaaguucuaa

SEQ ID NO: 16997 - RNA, 1668 nt, Artificial Sequence
  FBXO33__Homo_sapiens__NP_976046
augcugcuguuccugagcgugccccagcccagaccccccggcgccagaaccagagccggcgccgccagaguggccagauggagaagacugagacugcagcagcugagaagacugagaggccugcugagagugcugagaggcagacccggcgccggcagcagaagaagaggcagaauggcccugugcggccaggccgccggcgccgccagccugcccagcgagcugaucgugcacaucuucagcuuccugcccgcccccgacagacugagagccagcgccagcugcagccacuggagagagugccuguucuaccccgcccuguggccccagcugagaaucugccugagagugagccccgccgagcagcccagacuggaguuccugaugagaaagugcggcugguucgugagagagcugagaguggaguucgccgccgagaacuaccugagcggcggcggccccggcgacggcggcggcgccgacaccggcaccggcggcgaggagguggaggcccugcagcugagcgccagauggcuggaggugcugagaaccuaccuggagcuggugcugugcgugcuggugagcaucagaaacaacagaaaccugcagaaguucagccuguucggcgacaucagcgugcugcagcagcagggcagccugagcaacaccuaccugagcaagguggaccccgacggcaagaagaucaagcagauccagcagcuguucgaggagauccugagcaacagcagacagcugaaguggcugagcugcggcuucaugcuggagaucgugacccccaccagccugagcagccugagcaacgccguggccaacaccauggagcaccugagccugcuggacaacaacauccccggcaacagcacccugaucaccgccguggagcuggagagauucgugaaccugcacagccuggcccuggacuucugcgacuucaccgccgagauggccagagugcugaccgacagcaaccacgugccccugcagagacugagccugcuggugcacaacgugagcgugaugcacaagagccuggacaacaugcccaacgacgagcacuggaaggcccugagcagaaagagcaccagcuucagaguguacaucauggccuucgacaucaagagcgaggacaugcugaagauccugaagcccagcaucccccuggagagaauccacuucgacagcuacaucaccugcgugagcggcgccaucguggaccugaucagcagacaguacgacaaguuccugacccacuucauccugaugaacgacgugaucgacaccagcggcuuccccgaccugagcgacaacagaaacgaggacccccuggugcugcuggccuggagaugcaccaagcugagccugcuggccauccacggcuacaccgugugggcccacaaccugaucgccaucgccagacugagaggcagcgaccugaaggugcuggaggugaccgaggagagcaucgacuucgaccagggcgagcuggccgaccaggacguggaccccgugcacaaccugaucgagcaggugagccugggccugggccagcccuggcacgccgugauggacaucgagagccugagcguguucaccgagcccaacagacacuucuacagagagaugcagagcuucagcgaggacaucuaa

SEQ ID NO: 16998 - RNA, 2832 nt, Artificial Sequence
  FBXO38__Homo_sapiens__NP_001258652
augggccccagaaagaagagcgugaagaccugcaucaugaacaacgagauccccgaggagaugaccgccgacgagaccaaggacuacaugaaccagcugagccacgaggugcugugccacaucuucagauaccugccccugcaggacaucaugugcauggagugccugagcagaaagcugaaggaggccgugacccuguaccugagaguggugagagugguggaccugugcgccggcagauggugggaguacaugcccagcggcuucaccgacgccagcuuccugacccugcugaagaagaugcccgacguggagcagcuguacggccugcaccccagauaccuggagagaagaagagugagaggccacgaggccuucagcauccccggcgugcuggaggcccugcaggccugccccaaccuggugggcguggagaccagccaccuggagcugguggagagcaucuggaccuacaugccccacgugcacauccugggcaaguucagaaacagaaacggcgccuuccccaucccccccgagaacaagcugaagauccccaucggcgccaagauccagacccugcaccuggugggcgugaacgugcccgagauccccugcauccccaugcugagacaccuguacaugaagugggugagacugaccaagccccagcccuucaaggacuuccugugcaucagccugagaaccuucgugaugagaaacugcgccggccccaccaacagccugaaguacgugccccuggugaccggccuggccagcgccagaaaccuggagcaccuggagauggugagagugcccuuccugggcggccugauccagcacgugguggaggacagcuggagaagcggcggcuucagaaaccugcacaccaucgugcugggcgccugcaagaacgcccuggagguggaccugggcuaccugaucaucaccgccgccagaagacugcacgaggugagaauccagcccagccugaccaaggacggcguguucagcgcccugaagauggccgagcuggaguucccccaguucgagacccugcaccugggcuacguggacgaguuccugcugcagagcagaauggccaacgccgaccuggugaaguacggccuggccgacgugguggagaaccccggcaucaucaccgacaucggcaugaaggccgugaacgagguguucagcugcaucaaguaccuggccaucuacaacugcccccaccugcacaaccccuacaacuggaucagcgaccacagcagauggaccagacugguggacaucaaccuggugagaugccacgcccugaagcuggacagcuucggccaguucaucgagcugcugcccagccuggaguucaucagccuggaccagauguucagagagccccccaagggcugcgccagagugggccugagcgccggcaccggcaucggcgugagcagcgcccuggugagcaaccagaacagcaacaacgacgacaacaacgcccagaacaacaacgccaacauccacgacaacaaccaccaccaccccgacgacagcgacgaggagaacgacuucagacaggaccugcagcccggcgagcagcaguucgccgccgacgcccugaacgagauggaggacaucgugcaggaggacggcgaggugguggccgagagcggcaacaacacccccgcccacagccaggccaucauccccguggacguggacgaggagcaggccggccccagcggccugcagagaguggugaagcccaccagcaucaccgugcacgacagcgagagcgacgacgaggaggacagccuggagcugcaggagguguggauccccaagaacggcaccagaagauacagcgagagagaggagaagaccggcgagagcgugcagagcagagagcugagcgagguggccaagaccaagcccagacacgccaugaagagaaagagaaccgccgacaagagcaccagcaccagcgaccccgugaucgaggacgaccacgugcaggugcuggugcugaagagcaagaaccuggugggcgugaccaugaccaacugcggcaucaccgaccuggugcugaaggacugccccaagaugauguucauccacgccaccagaugcagagugcugaagcaccugaagguggagaacgcccccaucgugaacagauucgacuacgcccagugcaagaagcugaacauggaccaggugcuggaccagauccugagaaugccccccgagagaaacagaaucaucuaccugagacccaugcagcagguggacacccugacccuggagcagaagcuguucagcggccccuaccccuaccacaucugcaucauccacgaguucagcaacccccccaacgugagaaacaaggugagaaucagaagcuggauggacaccaucgccaacaucaaccaggagcugaucaaguacgaguucuuccccgaggccaccagaagcgaggaggaccugaagaaguaccccaaguaccccuggggcagagagaucuacacccuggagggcgugguggacggcgcccccuacagcaugaucagcgacuuccccuggcugagaagccugagagccgccgagcccaacagcuucgccagauacgacuucgaggacgacgaggagagcaccaucuacgcccccagaagaaagggccagcugagcgccgacaucugcauggagaccaucggcgaggagaucagcgagaugagacagaugaagaagggcguguuccagagagugguggccaucuucauccacuacugcgacgugaacggcgagcccguggaggacgacuacaucuaa

SEQ ID NO: 16999 - RNA, 1416 nt, Artificial Sequence
  FBXO3__Homo_sapiens__NP_036307
auggccgccauggagaccgagaccgccccccugacccuggagagccugcccaccgacccccugcugcugauccugagcuuccuggacuacagagaccugaucaacugcugcuacgugagcagaagacugagccagcugagcagccacgacccccuguggagaagacacugcaagaaguacuggcugaucagcgaggaggagaagacccagaagaaccagugcuggaagagccuguucaucgacaccuacagcgacgugggcagauacaucgaccacuacgccgccaucaagaaggccugggacgaccugaagaaguaccuggagcccagaugccccagaauggugcugagccugaaggagggcgccagagaggaggaccuggacgccguggaggcccagaucggcugcaagcugcccgacgacuacagaugcagcuacagaauccacaacggccagaagcugguggugcccggccugcugggcagcauggcccugagcaaccacuacagaagcgaggaccugcuggacguggacaccgccgccggcggcuuccagcagagacagggccugaaguacugccugccccugaccuucugcauccacaccggccugagccaguacaucgccguggaggccgccgagggcagaaacaagaacgagguguucuaccagugccccgaccagauggccagaaaccccgccgccaucgacauguucaucaucggcgccaccuucaccgacugguucaccagcuacgugaagaacguggugagcggcggcuuccccaucaucagagaccagaucuucagauacgugcacgaccccgagugcguggccaccaccggcgacaucaccgugagcgugagcaccagcuuccugcccgagcugagcagcgugcaccccccccacuacuucuucaccuacagaaucagaaucgagaugagcaaggacgcccugcccgagaaggccugccagcuggacagcagauacuggagaaucaccaacgccaagggcgacguggaggaggugcagggccccggcguggugggcgaguuccccaucaucagccccggcagaguguacgaguacaccagcugcaccaccuucagcaccaccagcggcuacauggagggcuacuacaccuuccacuuccuguacuucaaggacaagaucuucaacguggccauccccagauuccacauggccugccccaccuucagagugagcaucgccagacuggagaugggccccgacgaguacgaggagauggaggaggaggaggaggaggaggaggaggaggacgaggacgacgacagcgccgacauggacgagagcgacgaggacgacgaggaggagagaagaagaagaguguucgacgugcccaucagaagaagaagaugcagcagacuguucuaa

SEQ ID NO: 17000 - RNA, 2130 nt, Artificial Sequence
  FBXO40__Homo_sapiens__NP_057382
augggcaaggccagaagaagcccccccggccaccacagacacugcgagggcugcuucaacagacacugccacauccccguggagcccaacaccagcugccuggugaucagcugccaccugcugugcggcgccaccuuccacaugugcaaggaggccgagcaccagcugcugugcccccuggagcaggugcccugccugaacagcgaguacggcugcccccugagcaugagcagacacaagcuggccaagcaccugcaggugugccccgccagcguggugugcugcagcauggaguggaacagauggcccaacguggacagcgagaccacccugcacgagaacaucaugaaggagacccccagcgaggagugccuggacaccgcccuggcccugcaggaccagaaggugcuguucagaagccugaagaugguggagcuguuccccgagaccagagaggccaccgaggaggagcccaccaugaacggcgagaccagcguggaggagaugggcggcgccgugggcggcguggacaucggccuggugccccacggccugagcgccaccaacggcgagauggccgagcugagccaggaggagagagaggugcuggccaagaccaaggagggcauggaccuggugaaguucggccagugggagaacaucuucagcaaggagcacgccgccagcgcccugaccaacagcagcgccagcugcgagagcaagaacaagaacgacagcgagaaggagcagaucagcagcggccacaacaugguggagggcgagggcgcccccaagaagaaggagccccaggagaaccagaagcagcaggacgugagaaccgccauggagaccaccggccuggcccccuggcaggacggcgugcuggagagacugaagaccgccguggacgccaaggacuacaacauguaccuggugcacaacggcagaaugcugauccacuucggccagaugcccgccugcacccccaaggagagagacuucguguacggcaagcuggaggcccaggaggugaagaccguguacaccuucaaggugcccgugagcuacugcggcaagagagccagacugggcgacgccaugcugagcugcaagcccagcgagcacaaggccguggacaccagcgaccugggcaucaccguggaggaccugcccaagagcgaccugaucaagaccacccugcagugcgcccuggagagagagcugaagggccacgugaucagcgagagcagaagcaucgacggccuguucauggacuucgccacccagaccuacaacuucgagcccgagcaguucagcagcggcaccgugcuggccgaccugaccgccgccacccccggcggccugcacguggagcugcacagcgagugcgugaccagaagacacaacaagagcagcagcgccuucaccuucaccugcaacaaguucuucagaagagacgaguucccccugcacuucaagaacgugcacaccgacauccagagcugccugaacggcugguuccagcacagaugcccccuggccuaccugggcugcaccuucgugcagaaccacuucagaccccccggccagaaggccaaggugaucuacagccaggagcugaagaccuucgccaucaagcccgagguggcccccgagcugagcgagggcagaaagaacaaccaccugcugggccacggcggcaagagccagaacagccugaccagccugccccuggagauccugaaguacaucgccggcuuccuggacagcgugagccuggcccagcugagccaggugagcgugcugaugagaaacaucugcgccacccugcugcaggagagaggcauggugcugcugcaguggaagaagaagagauacagccacggcggcaccagcuggagagugcacagagagaucuggcaguucagcagccuguucagcaagaucaagagcugggaguucaacgaggugaccagcaugagcgagcaccugaagagcugccccuucaacaucguggagcacaagaccgaccccauccugcugaccagcaugugccagcccagagagcaggccagagagagccuggugagcaccuucagaaucagacccagaggcagauacgugagcuaa

SEQ ID NO: 17001 - RNA, 1359 nt, Artificial Sequence
  FBXO47__Homo_sapiens__XP_011523166
auggccagcagaaucaacaccaacuucacccugauccccaaccagaagcugagaagaagcaacagacagaccagcugcuacagcaagacccugggcagcggcuuccagcccaucagcaccuucggcaacuucaaggcccugccccuggagaucuuccagaucauccugaaguaccugagcgugaaggacaucagcaugcugagcauggugagcaagaccgugagccagcacaucaucaacuacaucagcaccagcagcggcagcaagagacugcugcugcaggacuuccacaaccuggagcugcccgacagaagacaggacagcgccauccuggagcacuacagaagccugggccugcuguucaagagaugcacccugcugcugcccaccaaggagagacugaaguacauccacaagauccugaccgaggugagcugcuucaaguucaacggcugcgccgcccccaugcagugccugggccugaccugcuacggcauguuccugcagacccugaccgccggcugggacgagcuggagugccacagaguguacaacuuccugugcgagcugaccaaccugugcagaaagauccagauggccgugugcagcaagcccggcagcgcccagaagcuggagcugagaaucagacuguucugcagaaacgugcugcuggaccacuggacccacagaagcgacagcgccuucuggcugaccagaauccugaagcccuggcccauggugaaccaggccagacugcuguacaucaucuucggccccaucagcccccaggacggccaggugguguggcaggagaugaucgaggagcccaccgacgaguucagccugaagggccuggccgacgccaucaagcugcuguacgacgccagcaccaaggaguggaccgccgacgacgugaucagccugguggacgagcugagcguggugcccagagaguggcugcuggagaacaacgccagacugcugaugcugagcggcaacaacaucugcuucagcuucauggccagcaaggccgugaacggcagaaccaucgagcuggccagacuggugguguuccuggcccuggugugcgagaaggagcuguacugcauggacuggaccgugaagaugaugcagaaggugugcaagguguucagcacccccguggagagaaagaacuuccugcagaacguggccaacgccuucgccugcgugaucauggagaugcugcagagcaucaugagcggcgacagagacgaggacgacagaagcuuccugaaccuguuccaccuggugcacgcccaggccaacuuccacaaggaggugcuguaccugaccaugaacaccccccugagcaccuaa

SEQ ID NO: 17002 - RNA, 1164 nt, Artificial Sequence
  FBXO4__Homo_sapiens__NP_036308
auggccggcagcgagcccagaagcggcaccaacagcccccccccccccuucagcgacuggggcagacuggaggccgccauccugagcggcuggaagaccuucuggcagagcgugagcaaggagagaguggccagaaccaccagcagagaggagguggacgaggccgccagcacccugaccagacugcccaucgacgugcagcuguacauccugagcuuccugagcccccacgaccugugccagcugggcagcaccaaccacuacuggaacgagaccgugagagaccccauccuguggagauacuuccugcugagagaccugcccagcuggagcagcguggacuggaagagccugcccgaccuggagauccugaagaagcccaucagcgaggugaccgacggcgccuucuucgacuacauggccguguacagaaugugcugccccuacaccagaagagccagcaagagcagcagacccauguacggcgccgugaccagcuuccugcacagccugaucauccagaacgagcccagauucgccauguucggccccggccuggaggagcugaacaccagccuggugcugagccugaugagcagcgaggagcugugccccaccgccggccugccccagagacagaucgacggcaucggcagcggcgugaacuuccagcugaacaaccagcacaaguucaacauccugauccuguacagcaccaccagaaaggagagagacagagccagagaggagcacaccagcgccgugaacaagauguucagcagacacaacgagggcgacgaccagcagggcagcagauacagcgugaucccccagauccagaaggugugcgaggugguggacggcuucaucuacguggccaacgccgaggcccacaagagacacgaguggcaggacgaguucagccacaucauggccaugaccgaccccgccuucggcagcagcggcagaccccugcuggugcugagcugcaucagccagggcgacgugaagagaaugcccugcuucuaccuggcccacgagcugcaccugaaccugcugaaccaccccuggcuggugcaggacaccgaggccgagacccugaccggcuuccugaacggcaucgaguggauccuggaggagguggagagcaagagagccagauaa

SEQ ID NO: 17003 - RNA, 1206 nt, Artificial Sequence
  FBXO5__Homo_sapiens__NP_001135994
augaagugcgacuucaacugcaaccacgugcacagcggccugaagcuggugaagcccgacgacaucggcagacuggugagcuacacccccgccuaccuggagggcagcugcaaggacugcaucaaggacuacgagagacugagcugcaucggcagccccaucgugagccccagaaucgugcagcuggagaccgagagcaagagacugcacaacaaggagaaccagcacgugcagcagacccugaacagcaccaacgagaucgaggcccuggagaccagcagacuguacgaggacagcggcuacagcagcuucagccugcagagcggccugagcgagcacgaggagggcagccugcuggaggagaacuucggcgacagccugcagagcugccugcugcagauccagagccccgaccaguaccccaacaagaaccugcugcccgugcugcacuucgagaagguggugugcagcacccugaagaagaacgccaagagaaaccccaagguggacagagagaugcugaaggagaucaucgccagaggcaacuucagacugcagaacaucaucggcagaaagaugggccuggagugcguggacauccugagcgagcuguucagaagaggccugagacacgugcuggccaccauccuggcccagcugagcgacauggaccugaucaacgugagcaaggugagcaccaccuggaagaagauccuggaggacgacaagggcgccuuccagcuguacagcaaggccauccagagagugaccgagaacaacaacaaguucagcccccacgccagcaccagagaguacgugauguucagaaccccccuggccagcgugcagaagagcgccgcccagaccagccugaagaaggacgcccagaccaagcugagcaaccagggcgaccagaagggcagcaccuacagcagacacaacgaguucagcgagguggccaagacccugaagaagaacgagagccugaaggccugcaucagaugcaacagccccgccaaguacgacugcuaccugcagagagccaccugcaagagagagggcugcggcuucgacuacugcaccaagugccugugcaacuaccacaccaccaaggacugcagcgacggcaagcugcugaaggccagcugcaagaucggcccccugcccggcaccaagaagagcaagaagaaccugagaagacuguaa

SEQ ID NO: 17004 - RNA, 1332 nt, Artificial Sequence
  FBXO7__Homo_sapiens__NP_001028196
auggccagaccccccggcggcagcggcccccugcuggacagcgagcacagcagccugcagaacaacgagcagcccagccuggccaccagcagcaaccagaccagcaugcaggacgagcagcccagcgacagcuuccagggccaggccgcccagagcggcguguggaacgacgacagcaugcugggccccagccagaacuucgaggccgagagcauccaggacaacgcccacauggccgagggcaccggcuucuaccccagcgagcccaugcugugcagcgagagcguggagggccaggugccccacagccuggagacccuguaccagagcgccgacugcagcgacgccaacgacgcccugaucgugcugauccaccugcugaugcuggagagcggcuacaucccccagggcaccgaggccaaggcccugagcaugcccgagaaguggaagcugagcggcguguacaagcugcaguacaugcacccccugugcgagggcagcagcgccacccugaccugcgugccccugggcaaccugaucguggugaacgccacccugaagaucaacaacgagaucagaagcgugaagagacugcagcugcugcccgagagcuucaucugcaaggagaagcugggcgagaacguggccaacaucuacaaggaccugcagaagcugagcagacuguucaaggaccagcugguguacccccugcuggccuucaccagacaggcccugaaccugcccgacguguucggccugguggugcugccccuggagcugaagcugagaaucuucagacugcuggacgugagaagcgugcugagccugagcgccgugugcagagaccuguucaccgccagcaacgacccccugcuguggagauuccuguaccugagagacuucagagacaacaccgugagagugcaggacaccgacuggaaggagcuguacagaaagagacacauccagagaaaggagagccccaagggcagauucgugaugcugcugcccagcagcacccacaccauccccuucuaccccaacccccugcaccccagacccuuccccagcagcagacugccccccggcaucaucggcggcgaguacgaccagagacccacccugcccuacgugggcgaccccaucagcagccugauccccggccccggcgagacccccagccaguuccccccccugagacccagauucgaccccgugggcccccugcccggccccaaccccauccugcccggcagaggcggccccaacgacagauuccccuucagacccagcagaggcagacccaccgacggcagacugagcuucauguaa

SEQ ID NO: 17005 - RNA, 960 nt, Artificial Sequence
  FBXO8__Homo_sapiens__NP_036312
augggccagggccuguggagaguggugagaaaccagcagcugcagcaggagggcuacagcgagcagggcuaccugaccagagagcagagcagaagaauggccgccagcaacaucagcaacaccaaccacagaaagcaggugcagggcggcaucgacaucuaccaccugcugaaggccagaaagagcaaggagcaggagggcuucaucaaccuggagaugcugccccccgagcugagcuucaccauccugagcuaccugaacgccaccgaccugugccuggccagcugcguguggcaggaccuggccaacgacgagcugcuguggcagggccugugcaagagcaccuggggccacugcagcaucuacaacaagaaccccccccugggcuucagcuucagaaagcuguacaugcagcuggacgagggcagccugaccuucaacgccaaccccgacgagggcgugaacuacuucaugagcaagggcauccuggacgacagccccaaggagaucgccaaguucaucuucugcaccagaacccugaacuggaagaagcugagaaucuaccuggacgagagaagagacgugcuggacgaccuggugacccugcacaacuucagaaaccaguuccugcccaacgcccugagagaguucuucagacacauccacgcccccgaggagagaggcgaguaccuggagacccugaucaccaaguucagccacagauucugcgccugcaaccccgaccugaugagagagcugggccugagccccgacgccguguacgugcugugcuacagccugauccugcugagcaucgaccugaccagcccccacgugaagaacaagaugagcaagagagaguucaucagaaacaccagaagagccgcccagaacaucagcgaggacuucgugggccaccuguacgacaacaucuaccugaucggccacguggccgccuaa

SEQ ID NO: 17006 - RNA, 1344 nt, Artificial Sequence
  FBXO9__Homo_sapiens__NP_036479
augcccgacaucaucuggguguuccccccccaggccgaggccgaggaggacugccacagcgacaccgugagagccgacgacgacgaggagaacgagagccccgccgagaccgaccugcaggcccagcugcagauguucagagcccaguggauguucgagcuggcccccggcgugagcagcagcaaccuggagaacagacccugcagagccgccagaggcagccugcagaagaccagcgccgacaccaagggcaagcaggagcaggccaaggaggagaaggccagagagcuguuccugaaggccguggaggaggagcagaacggcgcccuguacgaggccaucaaguucuacagaagagccaugcagcuggugcccgacaucgaguucaagaucaccuacaccagaagccccgacggcgacggcgugggcaacagcuacaucgaggacaacgacgacgacagcaagauggccgaccugcugagcuacuuccagcagcagcugaccuuccaggagagcgugcugaagcugugccagcccgagcuggagagcagccagauccacaucagcgugcugcccauggaggugcugauguacaucuucagauggguggugagcagcgaccuggaccugagaagccuggagcagcugagccuggugugcagaggcuucuacaucugcgccagagaccccgagaucuggagacuggccugccugaagguguggggcagaagcugcaucaagcuggugcccuacaccagcuggagagagauguuccuggagagacccagagugagauucgacggcguguacaucagcaagaccaccuacaucagacagggcgagcagagccuggacggcuucuacagagccuggcaccagguggaguacuacagauacaucagauucuuccccgacggccacgugaugaugcugaccacccccgaggagccccagagcaucgugcccagacugagaaccagaaacaccagaaccgacgccauccugcugggccacuacagacugagccaggacaccgacaaccagaccaagguguucgccgugaucaccaagaagaaggaggagaagccccuggacuacaaguacagauacuucagaagagugcccgugcaggaggccgaccagagcuuccacgugggccugcagcugugcagcagcggccaccagagauucaacaagcugaucuggauccaccacagcugccacaucaccuacaagagcaccggcgagaccgccgugagcgccuucgagaucgacaagauguacaccccccuguucuucgccagagugagaagcuacaccgccuucagcgagagaccccuguaa

SEQ ID NO: 17007 - RNA, 1629 nt, Artificial Sequence
  FBXW11__Homo_sapiens__NP_036432
auggagcccgacagcgugaucgaggacaagaccaucgagcugaugugcagcgugcccagaagccuguggcugggcugcgccaaccugguggagagcaugugcgcccugagcugccugcagagcaugcccagcgugagaugccugcagaucagcaacggcaccagcagcgugaucgugagcagaaagagacccagcgagggcaacuaccagaaggagaaggaccugugcaucaaguacuucgaccaguggagcgagagcgaccagguggaguucguggagcaccugaucagcagaaugugccacuaccagcacggccacaucaacagcuaccugaagcccaugcugcagagagacuucaucaccgcccugcccgagcagggccuggaccacaucgccgagaacauccugagcuaccuggacgccagaagccugugcgccgccgagcuggugugcaaggaguggcagagagugaucagcgagggcaugcuguggaagaagcugaucgagagaauggugagaaccgacccccuguggaagggccugagcgagagaagaggcugggaccaguaccuguucaagaacagacccaccgacggcccccccaacagcuucuacagaagccuguaccccaagaucauccaggacaucgagaccaucgagagcaacuggagaugcggcagacacaaccugcagagaauccagugcagaagcgagaacagcaagggcguguacugccugcaguacgacgacgagaagaucaucagcggccugagagacaacagcaucaagaucugggacaagaccagccuggagugccugaaggugcugaccggccacaccggcagcgugcugugccugcaguacgacgagagagugaucgugaccggcagcagcgacagcaccgugagagugugggacgugaacaccggcgaggugcugaacacccugauccaccacaacgaggccgugcugcaccugagauucagcaacggccugauggugaccugcagcaaggacagaagcaucgccgugugggacauggccagcgccaccgacaucacccugagaagagugcuggugggccacagagccgccgugaacgugguggacuucgacgacaaguacaucgugagcgccagcggcgacagaaccaucaagguguggagcaccagcaccugcgaguucgugagaacccugaacggccacaagagaggcaucgccugccugcaguacagagacagacugguggugagcggcagcagcgacaacaccaucagacugugggacaucgagugcggcgccugccugagagugcuggagggccacgaggagcuggugagaugcaucagauucgacaacaagagaaucgugagcggcgccuacgacggcaagaucaaggugugggaccugcaggccgcccuggaccccagagcccccgccagcacccugugccugagaacccugguggagcacagcggcagaguguucagacugcaguucgacgaguuccagaucaucagcagcagccacgacgacaccauccugaucugggacuuccugaacgugccccccagcgcccagaacgagaccagaagccccagcagaaccuacaccuacaucagcagauaa

SEQ ID NO: 17008 - RNA, 1239 nt, Artificial Sequence
  FBXW4__Homo_sapiens__NP_071322
auggccgccgccgccggcgaggaggaggaggaggaggaggccgccagagagagcgccgccagacccgccgccggccccgcccuguggagacugcccgaggagcugcugcugcugaucugcagcuaccuggacaugagagcccugggcagacuggcccaggugugcagauggcugagaagauucaccagcugcgaccugcuguggagaagaaucgccagagccagccugaacagcggcuucaccagacugggcaccgaccugaugaccagcgugcccgugaaggagagagugaaggugagccagaacuggagacugggcagaugcagagagggcauccugcugaaguggagaugcagccagaugcccuggaugcagcuggaggacgacagccuguacaucagccaggccaacuucauccuggccuaccaguucagacccgacggcgccagccugaacagaagaccccugggcguguucgccggccacgacgaggacgugugccacuucgugcuggccaacagccacaucgugagcgccggcggcgacggcaagaucggcauccacaagauccacagcaccuucaccgugaaguacagcgcccacgagcaggaggugaacugcguggacugcaagggcggcaucaucgugagcggcagcagagacagaaccgccaagguguggccccuggccagcggcagacugggccagugccugcacaccauccagaccgaggacagaguguggagcaucgccaucagcccccugcugagcagcuucgugaccggcaccgccugcugcggccacuucagcccccugagaaucugggaccugaacagcggccagcugaugacccaccugggcagcgacuucccccccggcgccggcgugcuggacgugauguacgagagccccuucacccugcugagcugcggcuacgacaccuacgugagauacugggaccugagaaccagcgugagaaagugcgugauggagugggaggagccccacgacagcacccuguacugccugcagaccgacggcaaccaccugcuggccaccggcagcagcuacuacggcguggugagacugugggacagaagacagagagccugccugcacgccuucccccugaccagcaccccccugagcagccccguguacugccugagacugaccaccaagcaccuguacgccgcccugagcuacaaccugcacgugcuggacuuccagaaccccuaa

SEQ ID NO: 17009 - RNA, 1884 nt, Artificial Sequence
  FBXW7__Homo_sapiens__NP_060785
augugcgugcccagaagcggccugauccugagcugcaucugccuguacugcggcgugcugcugcccgugcugcugcccaaccugcccuuccugaccugccugagcaugagcacccuggagagcgugaccuaccugcccgagaagggccuguacugccagagacugcccagcagcagaacccacggcggcaccgagagccugaagggcaagaacaccgagaacaugggcuucuacggcacccugaagaugaucuucuacaagaugaagagaaagcuggaccacggcagcgaggugagaagcuucagccugggcaagaagcccugcaaggugagcgaguacaccagcaccaccggccuggugcccugcagcgccacccccaccaccuucggcgaccugagagccgccaacggccagggccagcagagaagaagaaucaccagcgugcagccccccaccggccugcaggaguggcugaagauguuccagagcuggagcggccccgagaagcugcuggcccuggacgagcugaucgacagcugcgagcccacccaggugaagcacaugaugcaggugaucgagccccaguuccagagagacuucaucagccugcugcccaaggagcuggcccuguacgugcugagcuuccuggagcccaaggaccugcugcaggccgcccagaccugcagauacuggagaauccuggccgaggacaaccugcuguggagagagaagugcaaggaggagggcaucgacgagccccugcacaucaagagaagaaaggugaucaagcccggcuucauccacagccccuggaagagcgccuacaucagacagcacagaaucgacaccaacuggagaagaggcgagcugaagagccccaaggugcugaagggccacgacgaccacgugaucaccugccugcaguucugcggcaacagaaucgugagcggcagcgacgacaacacccugaagguguggagcgccgugaccggcaagugccugagaacccuggugggccacaccggcggcguguggagcagccagaugagagacaacaucaucaucagcggcagcaccgacagaacccugaagguguggaacgccgagaccggcgagugcauccacacccuguacggccacaccagcaccgugagaugcaugcaccugcacgagaagagaguggugagcggcagcagagacgccacccugagagugugggacaucgagaccggccagugccugcacgugcugaugggccacguggccgccgugagaugcgugcaguacgacggcagaagaguggugagcggcgccuacgacuucauggugaaggugugggaccccgagaccgagaccugccugcacacccugcagggccacaccaacagaguguacagccugcaguucgacggcauccacguggugagcggcagccuggacaccagcaucagagugugggacguggagaccggcaacugcauccacacccugaccggccaccagagccugaccagcggcauggagcugaaggacaacauccuggugagcggcaacgccgacagcaccgugaagaucugggacaucaagaccggccagugccugcagacccugcagggccccaacaagcaccagagcgccgugaccugccugcaguucaacaagaacuucgugaucaccagcagcgacgacggcaccgugaagcugugggaccugaagaccggcgaguucaucagaaaccuggugacccuggagagcggcggcagcggcggcgugguguggagaaucagagccagcaacaccaagcuggugugcgccgugggcagcagaaacggcaccgaggagaccaagcugcuggugcuggacuucgacguggacaugaaguaa

SEQ ID NO: 17010 - RNA, 1599 nt, Artificial Sequence
  FBXW8__Homo_sapiens__NP_036306
auggacgacuacagccuggacgaguucagaagaagauggcaggaggagcuggcccaggcccaggcccccaagaagagaagaagacccgaggccgccgagagaagagccagaagacccgagaacgagaugaacgacgugcccuucuucgacauccagcugcccuacgagcuggccaucaacaucuuccaguaccuggacagaaaggagcugggcagaugcgcccaggugagcaagaccuggaaggugaucgccgaggacgaggugcugugguacagacugugccagcaggagggccaccugcccgacagcagcaucagcgacuacagcugcuggaagcugaucuuccaggagugcagagccaaggagcacaugcugagaaccaacuggaagaacagaaagggcgccgugagcgagcuggagcacgugcccgacaccgugcugugcgacgugcacagccacgacggcguggugaucgccggcuacaccagcggcgacgugagagugugggacaccagaaccugggacuacguggcccccuuccuggagagcgaggacgaggaggacgagcccggcaugcagcccaacgugagcuucgugagaaucaacagcagccuggccguggccgccuacgaggacggcuuccugaacaucugggaccugagaaccggcaaguaccccgugcacagauucgagcacgacgccagaauccaggcccuggcccugagccaggacgacgccaccguggccaccgccagcgccuucgacguggugaugcugagccccaacgaggagggcuacuggcagaucgccgccgaguucgaggugcccaagcuggugcaguaccuggagaucgugcccgagaccagaagauaccccguggccguggccgccgccggcgaccugauguaccugcugaaggccgaggacagcgccagaacccugcuguacgcccacggcccccccgugaccugccuggacgugagcgccaaccagguggccuucggcgugcagggccugggcuggguguacgagggcagcaagauccugguguacagccuggaggccggcagaagacugcugaagcugggcaacgugcugagagacuucaccugcgugaaccugagcgacagcccccccaaccugauggugagcggcaacauggacggcagagugagaauccacgaccugagaagcggcaacaucgcccugagccugagcgcccaccagcugagagugagcgccgugcagauggacgacuggaagaucgugagcggcggcgaggagggccuggugagcgugugggacuacagaaugaaccagaagcugugggagguguacagcggccaccccgugcagcacaucagcuucagcagccacagccugaucaccgccaacgugcccuaccagaccgugaugagaaacgccgaccuggacagcuucaccacccacagaagacacagaggccugaucagagccuacgaguucgccguggaccagcuggccuuccagagcccccugcccgugugcagaagcagcugcgacgccauggccacccacuacuacgaccuggcccuggccuuccccuacaaccacguguaa

SEQ ID NO: 17011 - RNA, 864 nt, Artificial Sequence
  FCAR__Homo_sapiens__NP_001991
auggaccccaagcagaccacccugcugugccuggugcugugccugggccagagaauccaggcccaggagggcgacuuccccaugcccuucaucagcgccaagagcagccccgugaucccccuggacggcagcgugaagauccagugccaggccaucagagaggccuaccugacccagcugaugaucaucaagaacagcaccuacagagagaucggcagaagacugaaguucuggaacgagaccgaccccgaguucgugaucgaccacauggacgccaacaaggccggcagauaccagugccaguacagaaucggccacuacagauucagauacagcgacacccuggagcugguggugaccggccuguacggcaagcccuuccugagcgccgacagaggccuggugcugaugcccggcgagaacaucagccugaccugcagcagcgcccacauccccuucgacagauucagccuggccaaggagggcgagcugagccugccccagcaccagagcggcgagcaccccgccaacuucagccugggccccguggaccugaacgugagcggcaucuacagaugcuacggcugguacaacagaagccccuaccuguggagcuuccccagcaacgcccuggagcugguggugaccgacagcauccaccaggacuacaccacccagaaccugaucagaauggccguggccggccuggugcugguggcccugcuggccauccugguggagaacuggcacagccacaccgcccugaacaaggaggccagcgccgacguggccgagcccagcuggagccagcagaugugccagcccggccugaccuucgccagaacccccagcgugugcaaguaa

SEQ ID NO: 17012 - RNA, 774 nt, Artificial Sequence
  FCER1A__Homo_sapiens__NP_001992
auggcccccgccauggagagccccacccugcugugcguggcccugcuguucuucgcccccgacggcgugcuggccgugccccagaagcccaaggugagccugaacccccccuggaacagaaucuucaagggcgagaacgugacccugaccugcaacggcaacaacuucuucgaggugagcagcaccaagugguuccacaacggcagccugagcgaggagaccaacagcagccugaacaucgugaacgccaaguucgaggacagcggcgaguacaagugccagcaccagcaggugaacgagagcgagcccguguaccuggagguguucagcgacuggcugcugcugcaggccagcgccgagguggugauggagggccagccccuguuccugagaugccacggcuggagaaacugggacguguacaaggugaucuacuacaaggacggcgaggcccugaaguacugguacgagaaccacaacaucagcaucaccaacgccaccguggaggacagcggcaccuacuacugcaccggcaagguguggcagcuggacuacgagagcgagccccugaacaucaccgugaucaaggcccccagagagaaguacuggcugcaguucuucaucccccugcugguggugauccuguucgccguggacaccggccuguucaucagcacccagcagcaggugaccuuccugcugaagaucaagagaaccagaaagggcuucagacugcugaacccccaccccaagcccaaccccaagaacaacuaa

SEQ ID NO: 17013 - RNA, 261 nt, Artificial Sequence
  FCER1G__Homo_sapiens__NP_004097
augauccccgccguggugcugcugcugcugcugcugguggagcaggccgccgcccugggcgagccccagcugugcuacauccuggacgccauccuguuccuguacggcaucgugcugacccugcuguacugcagacugaagauccaggugagaaaggccgccaucaccagcuacgagaagagcgacggcguguacaccggccugagcaccagaaaccaggagaccuacgagacccugaagcacgagaagcccccccaguaa

SEQ ID NO: 17014 - RNA, 963 nt, Artificial Sequence
  FCER2__Homo_sapiens__NP_001193948
augaacccccccagccaggagaucgaggagcugcccagaagaagaugcugcagaagaggcacccagaucgugcugcugggccuggugaccgccgcccugugggccggccugcugacccugcugcugcuguggcacugggacaccacccagagccugaagcagcuggaggagagagccgccagaaacgugagccaggugagcaagaaccuggagagccaccacggcgaccagauggcccagaagagccagagcacccagaucagccaggagcuggaggagcugagagccgagcagcagagacugaagagccaggaccuggagcugagcuggaaccugaacggccugcaggccgaccugagcagcuucaagagccaggagcugaacgagagaaacgaggccagcgaccugcuggagagacugagagaggaggugaccaagcugagaauggagcugcaggugagcagcggcuucgugugcaacaccugccccgagaaguggaucaacuuccagagaaagugcuacuacuucggcaagggcaccaagcagugggugcacgccagauacgccugcgacgacauggagggccagcuggugagcauccacagccccgaggagcaggacuuccugaccaagcacgccagccacaccggcagcuggaucggccugagaaaccuggaccugaagggcgaguucaucuggguggacggcagccacguggacuacagcaacugggcccccggcgagcccaccagcagaagccagggcgaggacugcgugaugaugagaggcagcggcagauggaacgacgccuucugcgacagaaagcugggcgccugggugugcgacagacuggccaccugcaccccccccgccagcgagggcagcgccgagagcaugggccccgacagcagacccgaccccgacggcagacugcccacccccagcgccccccugcacagcuaa

SEQ ID NO: 17015 - RNA, 16218 nt, Artificial Sequence
  FCGBP__Homo_sapiens__NP_003881
augggcgcccuguggagcugguggauccugugggccggcgccacccugcuguggggccugacccaggaggccagcguggaccugaagaacaccggcagagaggaguuccugaccgccuuccugcagaacuaccagcuggccuacagcaaggccuaccccagacugcugaucagcagccugagcgagagccccgccagcgugagcauccugagccaggccgacaacaccagcaagaaggugaccgugagacccggcgagagcgugauggugaacaucagcgccaaggccgagaugaucggcagcaagaucuuccagcacgccguggugauccacagcgacuacgccaucagcgugcaggcccugaacgccaagcccgacaccgccgagcugacccugcugagacccauccaggcccugggcaccgaguacuucgugcugaccccccccggcaccagcgccagaaacgugaaggaguucgccgugguggccggcgccgccggcgccagcgugagcgugacccugaagggcagcgugaccuucaacggcaaguucuaccccgccggcgacgugcugagagugacccugcagcccuacaacguggcccagcugcagagcagcguggaccugagcggcagcaaggugaccgccagcagccccguggccgugcugagcggccacagcugcgcccagaagcacaccaccugcaaccacgugguggagcagcugcugcccaccagcgccuggggcacccacuacguggugcccacccuggccagccagagcagauacgaccuggccuucgugguggccagccaggccaccaagcugaccuacaaccacggcggcaucaccggcagcagaggccugcaggccggcgacgugguggaguucgaggugagacccagcuggccccuguaccugagcgccaacgugggcauccaggugcugcuguucggcaccggcgccaucagaaacgaggugaccuacgaccccuaccuggugcugauccccgacguggccgccuacugccccgccuacguggugaagagcgugcccggcugcgagggcguggcccuggugguggcccagaccaaggccaucagcggccugaccaucgacggccacgccgugggcgccaagcugaccugggaggccgugcccggcagcgaguucagcuacgccgagguggagcugggcaccgccgacaugauccacaccgccgaggccaccaccaaccugggccugcugaccuucggccuggccaaggccaucggcuacgccaccgccgccgacugcggcagaaccgugcugagccccguggagcccagcugcgagggcaugcagugcgccgccggccagagaugccagguggugggcggcaaggccggcugcguggccgagagcaccgccgugugcagagcccagggcgacccccacuacaccaccuucgacggcagaagauacgacaugaugggcaccugcagcuacaccaugguggagcugugcagcgaggacgacacccugcccgccuucagcguggaggccaagaacgagcacagaggcagcagaagagugagcuacgugggccuggugaccgugagagccuacagccacagcgugagccugaccagaggcgaggugggcuucgugcugguggacaaccagagaagcagacugcccgugagccugagcgagggcagacugagaguguaccagagcggccccagagccgugguggagcugguguucggccugguggugaccuacgacugggacugccagcuggcccugagccugcccgccagauuccaggaccaggugugcggccugugcggcaacuacaacggcgaccccgccgacgacuuccugacccccgacggcgcccuggcccccgacgccguggaguucgccagcagcuggaagcuggacgacggcgacuaccugugcgaggacggcugccagaacaacugccccgccugcacccccggccaggcccagcacuacgagggcgacagacugugcggcaugcugaccaagcuggacggccccuucgccgugugccacgacacccuggaccccagacccuuccuggagcagugcguguacgaccugugcguggugggcggcgagagacugagccugugcagaggccugagcgccuacgcccaggccugccuggagcugggcaucagcgugggcgacuggagaagccccgccaacugcccccugagcugccccgccaacagcagauacgagcugugcggccccgccugccccaccagcugcaacggcgccgccgcccccagcaacugcagcggcagacccugcguggagggcugcgugugccugcccggcuucguggccagcggcggcgccugcgugcccgccagcagcugcggcugcaccuuccagggccugcagcuggcccccggccaggaggugugggccgacgagcugugccagagaagaugcaccugcaacggcgccacccaccaggugaccugcagagacaagcagagcugccccgccggcgagagaugcagcgugcagaacggccugcugggcugcuaccccgacagauucggcaccugccagggcagcggcgacccccacuacgugagcuucgacggcagaagauucgacuucaugggcaccugcaccuaccugcuggugggcagcugcggccagaacgccgcccugcccgccuucagagugcugguggagaacgagcacagaggcagccagaccgugagcuacaccagagccgugagaguggaggccagaggcgugaagguggccgugagaagagaguaccccggccaggugcugguggacgacgugcugcaguaccugcccuuccaggccgccgacggccaggugcagguguucagacagggcagagacgccguggugagaaccgacuucggccugaccgugaccuacgacuggaacgccagagugaccgccaaggugcccagcagcuacgccgaggcccugugcggccugugcggcaacuucaacggcgaccccgccgacgaccuggcccugagaggcggcggccaggccgccaacgcccuggccuucggcaacagcuggcaggaggagaccagacccggcugcggcgccaccgagcccggcgacugccccaagcuggacagccugguggcccagcagcugcagagcaagaacgagugcggcauccuggccgaccccaagggccccuucagagagugccacagcaagcuggacccccagggcgccgugagagacugcguguacgacagaugccugcugcccggccagagcggcccccugugcgacgcccuggccaccuacgccgccgccugccaggccgccggcgccaccgugcaccccuggagaagcgaggagcugugcccccugagcugccccccccacagccacuacgaggccugcagcuacggcugcccccugagcugcggcgaccugcccgugcccggcggcugcggcagcgagugccacgagggcugcgugugcgacgagggcuucgcccugagcggcgagagcugccugccccuggccagcugcggcugcgugcaccagggcaccuaccacccccccggccagaccuucuaccccggccccggcugcgacagccugugccacugccaggagggcggccuggugagcugcgagagcagcagcugcggcccccacgaggccugccagcccagcggcggcagccugggcugcguggccgugggcagcagcaccugccaggccagcggcgacccccacuacaccaccuucgacggcagaagauucgacuucaugggcaccugcguguacgugcuggcccagaccugcggcaccagacccggccugcacagauucgccgugcugcaggagaacguggccuggggcaacggcagagugagcgugaccagagugaucaccgugcagguggccaacuucacccugagacuggagcagagacaguggaaggugaccgugaacggcguggacaugaagcugcccguggugcuggccaacggccagaucagagccagccagcacggcagcgacguggugaucgagaccgacuucggccugagaguggccuacgaccugguguacuacgugagagugaccgugcccggcaacuacuaccagcagaugugcggccugugcggcaacuacaacggcgaccccaaggacgacuuccagaagcccaacggcagccaggccggcaacgccaacgaguucggcaacagcugggaggagguggugcccgacagccccugccugccccccacccccugcccccccggcagcgaggacugcauccccagccacaagugcccccccgagcuggagaagaaguaccagaaggaggaguucugcggccugcugagcagccccaccggcccccugagcagcugccacaagcugguggacccccagggcccccugaaggacugcaucuucgaccugugccugggcggcggcaaccugagcauccugugcagcaacauccacgccuacgugagcgccugccaggccgccggcggccacguggagcccuggagaaccgagaccuucugccccauggagugcccccccaacagccacuacgagcugugcgccgacaccugcagccugggcugcagcgcccugagcgcccccccccagugccaggacggcugcgccgagggcugccagugcgacagcggcuuccuguacaacggccaggccugcgugcccauccagcagugcggcugcuaccacaacggcguguacuacgagcccgagcagaccgugcugaucgacaacugcagacagcagugcaccugccacgccggcaagggcauggugugccaggagcacagcugcaagcccggccaggugugccagcccagcggcggcauccugagcugcgugaccaaggaccccugccacggcgugaccugcagaccccaggagaccugcaaggagcagggcggccagggcgugugccugcccaacuacgaggccaccugcuggcuguggggcgacccccacuaccacagcuucgacggcagaaaguucgacuuccagggcaccugcaacuacgugcuggccaccaccggcugccccggcgugagcacccagggccugacccccuucaccgugaccaccaagaaccagaacagaggcaaccccgccgugagcuacgugagaguggugaccguggccgcccugggcaccaacaucagcauccacaaggacgagaucggcaaggugagagugaacggcgugcugaccgcccugcccgugagcguggccgacggcagaaucagcgugacccagggcgccagcaaggcccugcugguggccgacuucggccugcaggugagcuacgacuggaacuggagaguggacgugacccugcccagcagcuaccacggcgccgugugcggccugugcggcaacauggacagaaaccccaacaacgaccagguguuccccaacggcacccuggcccccagcauccccaucuggggcggcagcuggagagcccccggcugggacccccugugcugggacgagugcagaggcagcugccccaccugccccgaggacagacuggagcaguacgagggccccggcuucugcggcccccuggcccccggcaccggcggccccuucaccaccugccacgcccacgugccccccgagagcuucuucaagggcugcgugcuggacgugugcaugggcggcggcgacagagacauccugugcaaggcccuggccagcuacguggccgccugccaggccgccggcguggugaucgaggacuggagagcccaggugggcugcgagaucaccugccccgagaacagccacuacgaggugugcggcagccccugccccgccagcugccccagccccgccccccugaccacccccgccgugugcgagggccccugcguggagggcugccagugcgacgccggcuucgugcugagcgccgacagaugcgugccccugaacaacggcugcggcugcugggccaacggcaccuaccacgaggccggcagcgaguucugggccgacggcaccugcagccaguggugcagaugcggccccggcggcggcagccuggugugcacccccgccagcugcggccugggcgaggugugcggccugcugcccagcggccagcacggcugccagcccgugagcaccgccgagugccaggccuggggcgacccccacuacgugacccuggacggccacagauucaacuuccagggcaccugcgaguaccugcugagcgcccccugccacggccccccccugggcgccgagaacuucaccgugaccguggccaacgagcacagaggcagccaggccgugagcuacaccagaagcgugacccugcagaucuacaaccacagccugacccugagcgccagauggcccagaaagcugcagguggacggcguguucgugacccugcccuuccagcuggacagccugcugcacgcccaccugagcggcgccgacgugguggugaccaccaccagcggccugagccuggccuucgacggcgacagcuucgugagacugagagugcccgccgccuacgccggcagccugugcggccugugcggcaacuacaaccaggaccccgccgacgaccugaaggccgugggcggcaagcccgccggcuggcaggugggcggcgcccagggcugcggcgagugcgugagcaagcccugccccagccccugcacccccgagcagcaggagagcuucggcggccccgacgccugcggcgugaucagcgccaccgacggcccccuggcccccugccacggccuggugccccccgcccaguacuuccagggcugccugcuggacgccugccaggugcagggccaccccggcggccugugccccgccguggccaccuacguggccgccugccaggccgccggcgcccagcugagagaguggagaagacccgacuucugccccuuccagugccccgcccacagccacuacgagcugugcggcgacagcugccccggcagcugccccagccugagcgcccccgagggcugcgagagcgccugcagagagggcugcgugugcgacgccggcuucgugcugagcggcgacaccugcgugcccgugggccagugcggcugccugcacgacgacagauacuacccccugggccagaccuucuaccccggccccggcugcgacagccugugcagaugcagagagggcggcgaggugagcugcgagcccagcagcugcggcccccacgagaccugcagacccagcggcggcagccugggcugcguggccgugggcagcaccaccugccaggccagcggcgacccccacuacaccaccuucgacggcagaagauucgacuucaugggcaccugcguguacgugcuggcccagaccugcggcaccagacccggccugcacagauucgccgugcugcaggagaacguggccuggggcaacggcagagugagcgugaccagagugaucaccgugcagguggccaacuucacccugagacuggagcagagacaguggaaggugaccgugaacggcguggacaugaagcugcccguggugcuggccaacggccagaucagagccagccagcacggcagcgacguggugaucgagaccgacuucggccugagaguggccuacgaccugguguacuacgugagagugaccgugcccggcaacuacuaccagcugaugugcggccugugcggcaacuacaacggcgaccccaaggacgacuuccagaagcccaacggcagccaggccggcaacgccaacgaguucggcaacagcugggaggagguggugcccgacagccccugccugcccccccccaccugcccccccggcagcgagggcugcauccccagcgaggagugcccccccgagcuggagaagaaguaccagaaggaggaguucugcggccugcugagcagccccaccggcccccugagcagcugccacaagcugguggacccccagggcccccugaaggacugcaucuucgaccugugccugggcggcggcaaccugagcauccugugcagcaacauccacgccuacgugagcgccugccaggccgccggcggccagguggagcccuggagaaacgagaccuucugccccauggagugcccccagaacagccacuacgagcugugcgccgacaccugcagccugggcugcagcgcccugagcgccccccugcagugccccgacggcugcgccgagggcugccagugcgacagcggcuuccuguacaacggccaggccugcgugcccauccagcagugcggcugcuaccacaacggcgccuacuacgagcccgagcagaccgugcugaucgacaacugcagacagcagugcaccugccacgugggcaaggugguggugugccaggagcacagcugcaagcccggccaggugugccagcccagcggcggcauccugagcugcgugaacaaggaccccugccacggcgugaccugcagaccccaggagaccugcaaggagcagggcggccagggcgugugccugcccaacuacgaggccaccugcuggcuguggggcgacccccacuaccacagcuucgacggcagaaaguucgacuuccagggcaccugcaacuacgugcuggccaccaccggcugccccggcgugagcacccagggccugacccccuucaccgugaccaccaagaaccagaacagaggcaaccccgccgugagcuacgugagaguggugaccguggccgcccugggcaccaacaucagcauccacaaggacgagaucggcaaggugagagugaacggcgugcugaccgcccugcccgugagcguggccgacggcagaaucagcgugacccagggcgccagcaaggcccugcugguggccgacuucggccugcaggugagcuacgacuggaacuggagaguggacgugacccugcccagcagcuaccacggcgccgugugcggccugugcggcaacauggacagaaaccccaacaacgaccagguguuccccaacggcacccuggcccccagcauccccaucuggggcggcagcuggagagcccccggcugggacccccugugcugggacgagugcagaggcagcugccccaccugccccgaggacagacuggagcaguacgagggccccggcuucugcggcccccuggcccccggcaccggcggccccuucaccaccugccacgcccacgugccccccgagagcuucuucaagggcugcgugcuggacgugugcaugggcggcggcgacagagacauccugugcaaggcccuggccagcuacguggccgccugccaggccgccggcguggugaucgaggacuggagagcccaggugggcugcgagaucaccugccccgagaacagccacuacgaggugugcggcccccccugccccgccagcugccccagccccgccccccugaccacccccgccgugugcgagggccccugcguggagggcugccagugcgacgccggcuucgugcugagcgccgacagaugcgugccccugaacaacggcugcggcugcugggccaacggcaccuaccacgaggccggcagcgaguucugggccgacggcaccugcagccaguggugcagaugcggccccggcggcggcagccuggugugcacccccgccagcugcggccugggcgaggugugcggccugcugcccagcggccagcacggcugccagcccgugagcaccgccgagugccaggccuggggcgacccccacuacgugacccuggacggccacagauucgacuuccagggcaccugcgaguaccugcugagcgcccccugccacggccccccccugggcgccgagaacuucaccgugaccguggccaacgagcacagaggcagccaggccgugagcuacaccagaagcgugacccugcagaucuacaaccacagccugacccugagcgccagauggcccagaaagcugcagguggacggcguguucgugacccugcccuuccagcuggacagccugcugcacgcccaccugagcggcgccgacgugguggugaccaccaccagcggccugagccuggccuucgacggcgacagcuucgugagacugagagugcccgccgccuacgccggcagccugugcggccugugcggcaacuacaaccaggaccccgccgacgaccugaaggccgugggcggcaagcccgccggcuggcaggugggcggcgcccagggcugcggcgagugcgugagcaagcccugccccagccccugcacccccgagcagcaggagagcuucggcggccccgacgccugcggcgugaucagcgccaccgacggcccccuggcccccugccacggccuggugccccccgcccaguacuuccagggcugccugcuggacgccugccaggugcagggccaccccggcggccugugccccgccguggccaccuacguggccgccugccaggccgccggcgcccagcugagagaguggagaagacccgacuucugccccuuccagugccccgcccacagccacuacgagcugugcggcgacagcugccccggcagcugccccagccugagcgcccccgagggcugcgagagcgccugcagagagggcugcgugugcgacgccggcuucgugcugagcggcgacaccugcgugcccgugggccagugcggcugccugcacgacgacagauacuacccccugggccagaccuucuaccccggccccggcugcgacagccugugcagaugcagagagggcggcgaggugagcugcgagcccagcagcugcggcccccacgagaccugcagacccagcggcggcagccugggcugcguggccgugggcagcaccaccugccaggccagcggcgacccccacuacaccaccuucgacggccacagauucgacuucaugggcaccugcguguacgugcuggcccagaccugcggcaccagacccggccugcacagauucgccgugcugcaggagaacguggccuggggcaacggcagagugagcgugaccagagugaucaccgugcagguggccaacuucacccugagacuggagcagagacaguggaaggugaccgugaacggcguggacaugaagcugcccguggugcuggccaacggccagaucagagccagccagcacggcagcgacguggugaucgagaccgacuucggccugagaguggccuacgaccugguguacuacgugagagugaccgugcccggcaacuacuaccagcugaugugcggccugugcggcaacuacaacggcgaccccaaggacgacuuccagaagcccaacggcagccaggccggcaacgccaacgaguucggcaacagcugggaggagguggugcccgacagccccugccugcccccccccaccugcccccccggcagcgccggcugcauccccagcgacaagugcccccccgagcuggagaagaaguaccagaaggaggaguucugcggccugcugagcagccccaccggcccccugagcagcugccacaagcugguggacccccagggcccccugaaggacugcaucuucgaccugugccugggcggcggcaaccugagcauccugugcagcaacauccacgccuacgugagcgccugccaggccgccggcggccacguggagcccuggagaaacgagaccuucugccccauggagugcccccagaacagccacuacgagcugugcgccgacaccugcagccugggcugcagcgcccugagcgccccccugcagugccccgacggcugcgccgagggcugccagugcgacagcggcuuccuguacaacggccaggccugcgugcccauccagcagugcggcugcuaccacaacggcguguacuacgagcccgagcagaccgugcugaucgacaacugcagacagcagugcaccugccacgugggcaaggugguggugugccaggagcacagcugcaagcccggccaggugugccagcccagcggcggcauccugagcugcgugaccaaggaccccugccacggcgugaccugcagaccccaggagaccugcaaggagcagggcggccagggcgugugccugcccaacuacgaggccaccugcuggcuguggggcgacccccacuaccacagcuucgacggcagaaaguucgacuuccagggcaccugcaacuacgugcuggccaccaccggcugccccggcgugagcacccagggccugacccccuucaccgugaccaccaagaaccagaacagaggcaaccccgccgugagcuacgugagaguggugaccguggccgcccugggcaccaacaucagcauccacaaggacgagaucggcaaggugagagugaacggcgugcugaccgcccugcccgugagcguggccgacggcagaaucagcguggcccagggcgccagcaaggcccugcugguggccgacuucggccugcaggugagcuacgacuggaacuggagaguggacgugacccugcccagcagcuaccacggcgccgugugcggccugugcggcaacauggacagaaaccccaacaacgaccagguguuccccaacggcacccuggcccccagcauccccaucuggggcggcagcuggagagcccccggcugggacccccugugcugggacgagugcagaggcagcugccccaccugccccgaggacagacuggagcaguacgagggccccggcuucugcggcccccugagcagcggcaccggcggccccuucaccaccugccacgcccacgugccccccgagagcuucuucaagggcugcgugcuggacgugugcaugggcggcggcgacagagacauccugugcaaggcccuggccagcuacguggccgccugccaggccgccggcguggugaucgaggacuggagagcccaggugggcugcgagaucaccugccccgagaacagccacuacgaggugugcggcccccccugccccgccagcugccccagccccgccccccugaccacccccgccgugugcgagggccccugcguggagggcugccagugcgacgccggcuucgugcugagcgccgacagaugcgugccccugaacaacggcugcggcugcugggccaacggcaccuaccacgaggccggcagcgaguucugggccgacggcaccugcagccaguggugcagaugcggccccggcggcggcagccuggugugcacccccgccagcugcggccugggcgaggugugcggccugcugcccagcggccagcacggcugccagcccgugagcaccgccgagugccaggccuggggcgacccccacuacgugacccuggacggccacagauucgacuuccagggcaccugcgaguaccugcugagcgcccccugccacggccccccccugggcgccgagaacuucaccgugaccguggccaacgagcacagaggcagccaggccgugagcuacaccagaagcgugacccugcagaucuacaaccacagccugacccugagcgccagauggcccagaaagcugcagguggacggcguguucguggcccugcccuuccagcuggacagccugcugcacgcccaccugagcggcgccgacgugguggugaccaccaccagcggccugagccuggccuucgacggcgacagcuucgugagacugagagugcccgccgccuacgccgccagccugugcggccugugcggcaacuacaaccaggaccccgccgacgaccugaaggccgugggcggcaagcccgccggcuggcaggugggcggcgcccagggcugcggcgagugcgugagcaagcccugccccagccccugcacccccgagcagcaggagagcuucggcggccccgacgccugcggcgugaucagcgccaccgacggcccccuggcccccugccacggccuggugccccccgcccaguacuuccagggcugccugcuggacgccugccaggugcagggccaccccggcggccugugccccgccguggccaccuacguggccgccugccaggccgccggcgcccagcugggcgaguggagaagacccgacuucugcccccugcagugccccgcccacagccacuacgagcugugcggcgacagcugccccgugagcugccccagccugagcgcccccgagggcugcgagagcgccugcagagagggcugcgugugcgacgccggcuucgugcugagcggcgacaccugcgugcccgugggccagugcggcugccugcacgacggcagauacuacccccugggcgagguguucuaccccggccccgagugcgagagaagaugcgagugcggccccggcggccacgugaccugccaggagggcgccgccugcggcccccacgaggagugcagacuggaggacggcgugcaggccugccacgccaccggcugcggcagaugccuggccaacggcggcauccacuacaucacccuggacggcagaguguacgaccugcacggcagcugcagcuacgugcuggcccaggugugccaccccaagcccggcgacgaggacuucagcaucgugcuggagaagaacgccgccggcgaccugcagagacugcuggugaccguggccggccagguggugagccuggcccagggccagcaggugaccguggacggcgaggccguggcccugcccguggccgugggcagagugagagugaccgccgagggcagaaacauggugcugcagaccaccaagggccugagacugcuguucgacggcgacgcccaccugcugaugagcauccccagccccuucagaggcagacugugcggccugugcggcaacuucaacggcaacuggagcgacgacuucgugcugcccaacggcagcgccgccagcagcguggagaccuucggcgccgccuggagagcccccggcagcagcaagggcugcggcgagggcugcggcccccagggcugccccgugugccuggccgaggagaccgcccccuacgagagcaacgaggccugcggccagcugagaaacccccagggccccuucgccaccugccaggccgugcugagccccagcgaguacuucagacagugcguguacgaccugugcgcccagaagggcgacaaggccuuccugugcagaagccuggccgccuacaccgccgccugccaggccgccggcguggccgugaagcccuggagaaccgacagcuucugcccccugcacugccccgcccacagccacuacagcaucugcaccagaaccugccagggcagcugcgccgcccugagcggccugaccggcugcaccaccagaugcuucgagggcugcgagugcgacgacagauuccugcugagccagggcgugugcauccccgugcaggacugcggcugcacccacaacggcagauaccugcccgugaacagcagccugcugaccagcgacugcagcgagagaugcagcugcagcagcagcagcggccugaccugccaggccgccggcugcccccccggcagagugugcgaggugaaggccgaggccagaaacugcugggccaccagaggccugugcgugcugagcgugggcgccaaccugaccaccuucgacggcgccagaggcgccaccaccagccccggcguguacgagcugagcagcagaugccccggccugcagaacaccauccccugguacagagugguggccgaggugcagaucugccacggcaagaccgaggccgugggccaggugcacaucuucuuccaggacggcauggugacccugacccccaacaagggcgugugggugaacggccugagaguggaccugcccgccgagaagcuggccagcgugagcgugagcagaacccccgacggcagccugcuggugagacagaaggccggcgugcagguguggcugggcgccaacggcaagguggccgugaucgugagcaacgaccacgccggcaagcugugcggcgccugcggcaacuucgacggcgaccagaccaacgacuggcacgacagccaggagaagcccgccauggagaaguggagagcccaggacuucagccccugcuacggcuaa

SEQ ID NO: 17016 - RNA, 954 nt, Artificial Sequence
  FCGR2A__Homo_sapiens__NP_001129691
augaccauggagacccagaugagccagaacgugugccccagaaaccuguggcugcugcagccccugaccgugcugcugcugcuggccagcgccgacagccaggccgccgccccccccaaggccgugcugaagcuggagccccccuggaucaacgugcugcaggaggacagcgugacccugaccugccagggcgccagaagccccgagagcgacagcauccagugguuccacaacggcaaccugauccccacccacacccagcccagcuacagauucaaggccaacaacaacgacagcggcgaguacaccugccagaccggccagaccagccugagcgaccccgugcaccugaccgugcugagcgaguggcuggugcugcagaccccccaccuggaguuccaggagggcgagaccaucaugcugagaugccacagcuggaaggacaagccccuggugaaggugaccuucuuccagaacggcaagagccagaaguucagccaccuggaccccaccuucagcaucccccaggccaaccacagccacagcggcgacuaccacugcaccggcaacaucggcuacacccuguucagcagcaagcccgugaccaucaccgugcaggugcccagcaugggcagcagcagccccaugggcaucaucguggccguggugaucgccaccgccguggccgccaucguggccgccgugguggcccugaucuacugcagaaagaagagaaucagcgccaacagcaccgaccccgugaaggccgcccaguucgagccccccggcagacagaugaucgccaucagaaagagacagcuggaggagaccaacaacgacuacgagaccgccgacggcggcuacaugacccugaaccccagagcccccaccgacgacgacaagaacaucuaccugacccugccccccaacgaccacgugaacagcaacaacuaa

SEQ ID NO: 17017 - RNA, 873 nt, Artificial Sequence
  FCGR2B__Homo_sapiens__NP_001002273
augggcauccugagcuuccugcccgugcuggccaccgagagcgacugggccgacugcaagagcccccagcccuggggccacaugcugcuguggaccgccgugcuguuccuggcccccguggccggcacccccgccccccccaaggccgugcugaagcuggagccccaguggaucaacgugcugcaggaggacagcgugacccugaccugcagaggcacccacagccccgagagcgacagcauccagugguuccacaacggcaaccugauccccacccacacccagcccagcuacagauucaaggccaacaacaacgacagcggcgaguacaccugccagaccggccagaccagccugagcgaccccgugcaccugaccgugcugagcgaguggcuggugcugcagaccccccaccuggaguuccaggagggcgagaccaucgugcugagaugccacagcuggaaggacaagccccuggugaaggugaccuucuuccagaacggcaagagcaagaaguucagcagaagcgaccccaacuucagcaucccccaggccaaccacagccacagcggcgacuaccacugcaccggcaacaucggcuacacccuguacagcagcaagcccgugaccaucaccgugcaggcccccagcagcagccccaugggcaucaucguggccguggugaccggcaucgccguggccgccaucguggccgccgugguggcccugaucuacugcagaaagaagagaaucagcgccaaccccaccaaccccgacgaggccgacaaggugggcgccgagaacaccaucaccuacagccugcugaugcaccccgacgcccuggaggagcccgacgaccagaacagaaucuaa

SEQ ID NO: 17018 - RNA, 873 nt, Artificial Sequence
  FCGR3A__Homo_sapiens__NP_000560
augggcggcggcgccggcgagagacuguucaccagcagcugccuggugggccuggugccccugggccugagaaucagccuggugaccugcccccugcagugcggcaucauguggcagcugcugcugcccaccgcccugcugcugcuggugagcgccggcaugagaaccgaggaccugcccaaggccgugguguuccuggagccccagugguacagagugcuggagaaggacagcgugacccugaagugccagggcgccuacagccccgaggacaacagcacccagugguuccacaacgagagccugaucagcagccaggccagcagcuacuucaucgacgccgccaccguggacgacagcggcgaguacagaugccagaccaaccugagcacccugagcgaccccgugcagcuggaggugcacaucggcuggcugcugcugcaggcccccagauggguguucaaggaggaggaccccauccaccugagaugccacagcuggaagaacaccgcccugcacaaggugaccuaccugcagaacggcaagggcagaaaguacuuccaccacaacagcgacuucuacauccccaaggccacccugaaggacagcggcagcuacuucugcagaggccuguucggcagcaagaacgugagcagcgagaccgugaacaucaccaucacccagggccuggccgugagcaccaucagcagcuucuucccccccggcuaccaggugagcuucugccuggugauggugcugcuguucgccguggacaccggccuguacuucagcgugaagaccaacaucagaagcagcaccagagacuggaaggaccacaaguucaaguggagaaaggacccccaggacaaguaa

SEQ ID NO: 17019 - RNA, 702 nt, Artificial Sequence
  FCGR3B__Homo_sapiens__NP_000561
auguggcagcugcugcugcccaccgcccugcugcugcuggugagcgccggcaugagaaccgaggaccugcccaaggccgugguguuccuggagccccagugguacagcgugcuggagaaggacagcgugacccugaagugccagggcgccuacagccccgaggacaacagcacccagugguuccacaacgagaaccugaucagcagccaggccagcagcuacuucaucgacgccgccaccgugaacgacagcggcgaguacagaugccagaccaaccugagcacccugagcgaccccgugcagcuggaggugcacaucggcuggcugcugcugcaggcccccagauggguguucaaggaggaggaccccauccaccugagaugccacagcuggaagaacaccgcccugcacaaggugaccuaccugcagaacggcaaggacagaaaguacuuccaccacaacagcgacuuccacauccccaaggccacccugaaggacagcggcagcuacuucugcagaggccuggugggcagcaagaacgugagcagcgagaccgugaacaucaccaucacccagggccuggccgugagcaccaucagcagcuucagcccccccggcuaccaggugagcuucugccuggugauggugcugcuguucgccguggacaccggccuguacuucagcgugaagaccaacaucuaa

SEQ ID NO: 17020 - RNA, 1098 nt, Artificial Sequence
  FCGRT__Homo_sapiens__NP_001129491
augggcgugcccagaccccagcccugggcccugggccugcugcuguuccugcugcccggcagccugggcgccgagagccaccugagccugcuguaccaccugaccgccgugagcagccccgcccccggcacccccgccuucugggugagcggcuggcugggcccccagcaguaccugagcuacaacagccugagaggcgaggccgagcccugcggcgccugggugugggagaaccaggugagcugguacugggagaaggagaccaccgaccugagaaucaaggagaagcuguuccuggaggccuucaaggcccugggcggcaagggccccuacacccugcagggccugcugggcugcgagcugggccccgacaacaccagcgugcccaccgccaaguucgcccugaacggcgaggaguucaugaacuucgaccugaagcagggcaccuggggcggcgacuggcccgaggcccuggccaucagccagagauggcagcagcaggacaaggccgccaacaaggagcugaccuuccugcuguucagcugcccccacagacugagagagcaccuggagagaggcagaggcaaccuggaguggaaggagccccccagcaugagacugaaggccagacccagcagccccggcuucagcgugcugaccugcagcgccuucagcuucuacccccccgagcugcagcugagauuccugagaaacggccuggccgccggcaccggccagggcgacuucggccccaacagcgacggcagcuuccacgccagcagcagccugaccgugaagagcggcgacgagcaccacuacugcugcaucgugcagcacgccggccuggcccagccccugagaguggagcuggagagccccgccaagagcagcgugcugguggugggcaucgugaucggcgugcugcugcugaccgccgccgccgugggcggcgcccugcuguggagaagaaugagaagcggccugcccgcccccuggaucagccugagaggcgacgacaccggcgugcugcugcccacccccggcgaggcccaggacgccgaccugaaggacgugaacgugauccccgccaccgccuaa

SEQ ID NO: 17021 - RNA, 2676 nt, Artificial Sequence
  FCHO1__Homo_sapiens__NP_001154829
augagcuacuucggcgagcacuucuggggcgagaagaaccacggcuucgaggugcuguaccacagcgugaagcagggccccaucagcaccaaggagcuggccgacuucaucagagagagagccaccaucgaggagaccuacagcaaggccauggccaagcugagcaagcuggccagcaacggcacccccaugggcaccuucgccccccugugggagguguucagagugagcagcgacaagcuggcccugugccaccuggagcugaccagaaagcugcaggaccugaucaaggacgugcugagauacggcgaggagcagcugaagacccacaagaagugcaaggaggagguggugagcacccuggacgccgugcaggugcugagcggcgugagccagcugcugcccaagagcagagagaacuaccugaacagaugcauggaccaggagagacugagaagagagagcaccagccagaaggagauggacaaggccgagaccaagaccaagaaggccgccgagagccugagaagaagcguggagaaguacaacagcgccagagccgacuucgagcagaagaugcuggacagcgcccugagauuccaggccauggaggagacccaccugagacacaugaaggcccugcugggcagcuacgcccacagcguggaggacacccacgugcagaucggccaggugcacgaggaguucaagcagaacaucgagaacgugagcguggagaugcugcugagaaaguucgccgagagcaagggcaccggcagagagaagcccggcccccuggacuucgaggccuacagcgccgccgcccugcaggaggccaugaagagacugagaggcgccaaggccuucagacugcccggccugagcagaagagagagagagcccgagccccccgccgccguggacuuccuggagcccgacagcggcaccugccccgagguggacgaggagggcuucaccgugagacccgacgugacccagaacagcaccgccgagcccagcagauucagcagcagcgacagcgacuucgacgacgaggagcccagaaaguucuacgugcacaucaagcccgcccccgccagagcccccgccugcagccccgaggccgccgccgcccagcugagagccaccgccggcagccugauccugccccccggccccggcggcaccaugaagagacacagcagcagagacgccgccggcaagccccagagacccagaagcgcccccagaaccagcagcugcgccgagagacugcagagcgaggagcaggugagcaagaaccuguucggccccccccuggagagcgccuucgaccacgaggacuucaccggcagcagcagccugggcuucaccagcagccccagccccuucagcagcagcagccccgagaacguggaggacagcggccuggacagccccagccacgccgcccccggccccagccccgacagcugggugcccagacccggcaccccccagagcccccccagcugcagagcccccccccccgaggccagaggcaucagagcccccccccugcccgacagcccccagccccuggccagcagccccggccccuggggccuggaggcccuggccggcggcgaccugaugcccgcccccgccgaccccaccgccagagagggccuggccgccccccccagaagacugagaagcagaaaggugagcugcccccugaccagaagcaacggcgaccugagcagaagccugagccccagcccccugggcagcagcgccgccagcaccgcccuggagagacccagcuuccugagccagaccggccacggcgugagcagaggccccagccccguggugcugggcagccaggacgcccugcccaucgccaccgccuucaccgaguacgugcacgccuacuucagaggccacagccccagcugccuggccagagugaccggcgagcugaccaugaccuuccccgccggcaucgugagaguguucagcggcaccccccccccccccgugcugagcuucagacuggugcacaccaccgccaucgagcacuuccagcccaacgccgaccugcuguucagcgaccccagccagagcgaccccgagaccaaggacuucuggcugaacauggccgcccugaccgaggcccugcagagacaggccgagcagaaccccaccgccagcuacuacaacguggugcugcugagauaccaguucagcagacccggcccccagagcgugccccugcagcugagcgcccacuggcagugcggcgccacccugacccaggugagcguggaguacggcuacagacccggcgccaccgccgugcccaccccccugaccaacgugcagauccugcugcccgugggcgagcccgugaccaacgugagacugcagcccgccgccaccuggaaccuggaggagaagagacugaccuggagacugcccgacgugagcgaggccggcggcagcggcagacugagcgccagcugggagccccugagcggccccagcacccccagccccguggccgcccaguucaccagcgagggcaccacccugagcggcguggaccuggagcuggugggcagcggcuacagaaugagccuggugaagagaagauucgccaccgccgcccccccccagggcugcaccugguaa

SEQ ID NO: 17022 - RNA, 2334 nt, Artificial Sequence
  FCHO2__Homo_sapiens__NP_001139504
auggugauggccuacuucguggagaacuucuggggcgagaagaacagcggcuucgacgugcuguaccacaacaugaagcacggccagaucagcaccaaggagcuggccgacuucgugagagagagagccaccaucgaggaggccuacagcagaagcaugaccaagcuggccaagagcgccagcaacuacagccagcugggcaccuucgcccccgugugggacguguucaagaccagcaccgagaagcuggccaacugccaccuggaccuggugagaaagcugcaggagcugaucaaggaggugcagaaguacggcgaggagcaggugaagagccacaagaagaccaaggaggagguggccggcacccuggaggccgugcagaccauccagagcaucacccaggcccugcagaagagcaaggagaacuacaacgccaagugcguggagcaggagagacugaagaaggagggcgccacccagagagagaucgagaaggccgccgugaagagcaagaaggccaccgacaccuacaagcuguacguggagaaguacgcccuggccaaggccgacuucgagcagaagaugaccgagaccgcccaggugcacgaggaguucaucaacaacauggccaacaccaccguggagagccugauccagaaguucgccgagagcaagggcaccggcaaggagagacccggccugaucgaguucgaggagugcgacaccgccagcgccguggagggcaucaagcccagaaagagaaagaccuucgcccugcccggcaucaucaagaaggagaaggacgccgagagcguggagugccccgacgccgacagccugaacauccccgacguggacgaggagggcuacagcaucaagcccgagaccaaccagaacgacaccaaggagaaccacuucuacagcagcagcgacagcgacagcgaggacgaggagcccaagaaguacagaaucgagaucaagcccaugcaccccaacaacagccaccacaccauggccagccuggacgagcugaaggugagcaucggcaacaucacccugagccccgccaucagcagacacagccccgugcagaugaacagaaaccugagcaacgaggagcugaccaagagcaagcccagcgccccccccaacgagaagggcaccagcgaccugcuggccugggacccccuguucggccccagccuggacagcagcagcagcagcagccugaccagcagcagcagcgccagacccaccaccccccugagcgugggcaccaucgugcccccccccagacccgccagcagacccaagcugaccagcggcaagcugagcggcaucaacgagauccccagacccuucagcccccccgugaccagcaacaccagccccccccccgccgccccccuggccagagccgagagcagcagcagcaucagcagcagcgccagccugagcgccgccaacacccccaccgugggcgugagcagaggccccagccccgugagccugggcaaccaggacacccugcccguggccguggcccugaccgagagcgugaacgccuacuucaagggcgccgaccccaccaagugcaucgugaagaucaccggcgacaugaccaugagcuuccccagcggcaucaucaagguguucaccagcaaccccacccccgccgugcugugcuucagagugaagaacaucagcagacuggagcagauccugcccaacgcccagcugguguucagcgaccccagccagugcgacagcaacaccaaggacuucuggaugaacaugcaggccgugaccguguaccugaagaagcugagcgagcagaaccccgccgccagcuacuacaacguggacgugcugaaguaccaggugagcagcaacggcauccagagcaccccccugaaccuggccaccuacuggaagugcagcgccagcaccaccgaccugagaguggacuacaaguacaaccccgaggccaugguggcccccagcgugcugagcaacauccaggugguggugcccguggacggcggcgugaccaacaugcagagccugccccccgccaucuggaacgccgagcagaugaaggccuucuggaagcugagcagcaucagcgagaagagcgagaacggcggcagcggcagccugagagccaaguucgaccugagcgagggccccagcaagcccaccacccuggccgugcaguuccugagcgagggcagcacccugagcggcguggacuucgagcuggugggcaccggcuacagacugagccugaucaagaagagauucgccaccggcagauaccuggccgacugcuaa

SEQ ID NO: 17023 - RNA, 2223 nt, Artificial Sequence
  FCHSD2__Homo_sapiens__NP_055639
augcagcccccccccagaaaggugaaggugacccaggagcugaagaacauccagguggagcagaugaccaagcugcaggccaagcaccaggccgagugcgaccugcuggaggacaugagaaccuucagccagaagaaggccgccaucgagagagaguacgcccagggcaugcagaagcuggccagccaguaccugaagagagacuggcccggcgugaaggccgacgacagaaacgacuacagaagcauguaccccguguggaagagcuuccuggagggcaccaugcagguggcccagagcagaaugaacaucugcgagaacuacaagaacuucaucagcgagcccgccagaaccgugagaagccugaaggagcagcagcugaagagaugcguggaccagcugaccaagauccagaccgagcugcaggagaccgugaaggaccuggccaagggcaagaagaaguacuucgagaccgagcagauggcccacgccgugagagagaaggccgacaucgaggccaagagcaagcugagccuguuccagagcagaaucagccugcagaaggccagcgugaagcugaaggccagaagaagcgagugcaacagcaaggccacccacgccagaaacgacuaccugcugacccuggccgccgccaacgcccaccaggacagauacuaccagaccgaccuggugaacaucaugaaggcccuggacggcaacguguacgaccaccugaaggacuaccugaucgccuucagcagaaccgagcuggagaccugccaggccgugcagaacaccuuccaguuccugcuggagaacagcagcaagguggugagagacuacaaccugcagcuguuccugcaggagaacgccguguuccacaagccccagcccuuccaguuccagcccugcgacagcgacaccagcagacagcuggagagcgagaccggcaccaccgaggagcacagccugaacaaggaggccagaaagugggccaccagaguggccagagagcacaagaacaucgugcaccagcagagagugcugaacgaccuggagugccacggcgccgccgugagcgagcagagcagagccgagcuggagcagaagaucgacgaggccagagagaacaucagaaaggccgagaucaucaagcugaaggccgaggccagacuggaccugcugaagcagaucggcgugagcguggacaccuggcugaagagcgccaugaaccaggugauggaggagcuggagaacgagagaugggccagaccccccgccgugaccagcaacggcacccugcacagccugaacgccgacaccgagagagaggagggcgaggaguucgaggacaacauggacguguucgacgacagcagcagcagccccagcggcacccugagaaacuacccccugaccugcaaggugguguacagcuacaaggccagccagcccgacgagcugaccaucgaggagcacgaggugcuggaggugaucgaggacggcgacauggaggacugggugaaggccagaaacaaggugggccaggugggcuacgugcccgagaaguaccugcaguuccccaccagcaacagccugcugagcaugcugcagagccuggccgcccuggacagcagaagccacaccagcagcaacagcaccgaggccgagcuggugagcggcagccugaacggcgacgccagcgugugcuucgugaaggcccuguacgacuacgagggccagaccgacgacgagcugagcuuccccgagggcgccaucaucagaauccugaacaaggagaaccaggacgacgacggcuucugggagggcgaguucaacggcagaaucggcguguuccccagcgugcugguggaggagcugagcgccagcgagaacggcgacacccccuggaugagagagauccagaucagccccagccccaagccccacgccagccugcccccccugccccuguacgaccagccccccagcagccccuaccccagccccgacaagagaagcagccuguacuuccccagaagccccagcgccaacgagaagagccugcacgccgagagccccggcuucagccaggccagcagacacacccccgagaccagcuacggcaagcugagacccgugagagccgccccccccccccccacccagaaccacagaagacccgccgagaagaucgaggacguggagaucacccugguguaa

SEQ ID NO: 17024 - RNA, 981 nt, Artificial Sequence
  FCN1__Homo_sapiens__NP_001994
auggagcugagcggcgccaccauggccagaggccuggccgugcugcuggugcuguuccugcacaucaagaaccugcccgcccaggccgccgacaccugccccgaggugaagguggugggccuggagggcagcgacaagcugaccauccugagaggcugccccggccugcccggcgcccccggccccaagggcgaggccggcgugaucggcgagagaggcgagagaggccugcccggcgcccccggcaaggccggccccgugggccccaagggcgacagaggcgagaagggcaugagaggcgagaagggcgacgccggccagagccagagcugcgccaccggccccagaaacugcaaggaccugcuggacagaggcuacuuccugagcggcuggcacaccaucuaccugcccgacugcagaccccugaccgugcugugcgacauggacaccgacggcggcggcuggaccguguuccagagaagaauggacggcagcguggacuucuacagagacugggccgccuacaagcagggcuucggcagccagcugggcgaguucuggcugggcaacgacaacauccacgcccugaccgcccagggcagcagcgagcugagaguggaccugguggacuucgagggcaaccaccaguucgccaaguacaagagcuucaagguggccgacgaggccgagaaguacaagcuggugcugggcgccuucgugggcggcagcgccggcaacagccugaccggccacaacaacaacuucuucagcaccaaggaccaggacaacgacgugagcagcagcaacugcgccgagaaguuccagggcgccuggugguacgccgacugccacgccagcaaccugaacggccuguaccugaugggcccccacgagagcuacgccaacggcaucaacuggagcgccgccaagggcuacaaguacagcuacaaggugagcgagaugaaggugagacccgccuaa

SEQ ID NO: 17025 - RNA, 942 nt, Artificial Sequence
  FCN2__Homo_sapiens__NP_004099
auggagcuggacagagccgugggcgugcugggcgccgccacccugcugcugagcuuccugggcauggccugggcccugcaggccgccgacaccugccccgaggugaagauggugggccuggagggcagcgacaagcugaccauccugagaggcugccccggccugcccggcgcccccggccccaagggcgaggccggcaccaacggcaagagaggcgagagaggcccccccggcccccccggcaaggccggcccccccggccccaacggcgcccccggcgagccccagcccugccugaccggccccagaaccugcaaggaccugcuggacagaggccacuuccugagcggcuggcacaccaucuaccugcccgacugcagaccccugaccgugcugugcgacauggacaccgacggcggcggcuggaccguguuccagagaagaguggacggcagcguggacuucuacagagacugggccaccuacaagcagggcuucggcagcagacugggcgaguucuggcugggcaacgacaacauccacgcccugaccgcccagggcaccagcgagcugagaguggaccugguggacuucgaggacaacuaccaguucgccaaguacagaagcuucaagguggccgacgaggccgagaaguacaaccuggugcugggcgccuucguggagggcagcgccggcgacagccugaccuuccacaacaaccagagcuucagcaccaaggaccaggacaacgaccugaacaccggcaacugcgccgugauguuccagggcgccuggugguacaagaacugccacgugagcaaccugaacggcagauaccugagaggcacccacggcagcuucgccaacggcaucaacuggaagagcggcaagggcuacaacuacagcuacaaggugagcgagaugaaggugagacccgccuaa

SEQ ID NO: 17026 - RNA, 1101 nt, Artificial Sequence
  FCRL1__Homo_sapiens__NP_001152869
augcugcccagacugcugcugcugaucugcgccccccugugcgagcccgccgagcuguuccugaucgccagccccagccaccccaccgagggcagccccgugacccugaccugcaagaugcccuuccugcagagcagcgacgcccaguuccaguucugcuucuucagagacaccagagcccugggccccggcuggagcagcagccccaagcugcagaucgccgccauguggaaggaggacaccggcagcuacuggugcgaggcccagaccauggccagcaaggugcugagaagcagaagaagccagaucaacgugcacagagugcccguggccgacgugagccuggagacccagccccccggcggccaggugauggagggcgacagacuggugcugaucugcagcguggccaugggcaccggcgacaucaccuuccugugguacaagggcgccgugggccugaaccugcagagcaagacccagagaagccugaccgccgaguacgagauccccagcgugagagagagcgacgccgagcaguacuacugcguggccgagaacggcuacggccccagccccagcggccuggugagcaucaccgugagaauccccgugagcagacccauccugaugcugagagcccccagagcccaggccgccguggaggacgugcuggagcugcacugcgaggcccugagaggcagcccccccauccuguacugguucuaccacgaggacaucacccugggcagcagaagcgcccccagcggcggcggcgccagcuucaaccugagccugaccgaggagcacagcggcaacuacagcugcgaggccaacaacggccugggcgcccagagaagcgaggccgugacccugaacuucaccggcagaagaagcgccagagacccccugagaagccugcccagcccccugccccaggaguucaccuaccugaacagccccacccccggccagcugcagcccaucuacgagaacgagcccagagagcagagcguggccgugcacggcagacagcagcacagcagcgagcagaaggcccagaagcccuggggccacaucuggagaaccagauuccccuaa

SEQ ID NO: 17027 - RNA, 1335 nt, Artificial Sequence
  FCRL2__Homo_sapiens__NP_001152960
augcugcuguggagccugcuggugaucuucgacgccgugaccgagcaggccgacagccugacccugguggcccccagcagcguguucgagggcgacagcaucgugcugaagugccagggcgagcagaacuggaagauccagaagauggccuaccacaaggacaacaaggagcugagcguguucaagaaguucagcgacuuccugauccagagcgccgugcugagcgacagcggcaacuacuucugcagcaccaagggccagcuguuccugugggacaagaccagcaacaucgugaagaucaaggugcaggagcuguuccagagacccgugcugaccgccagcagcuuccagcccaucgagggcggccccgugagccugaagugcgagaccagacugagcccccagagacuggacgugcagcugcaguucugcuucuucagagagaaccaggugcugggcagcggcuggagcagcagccccgagcugcagaucagcgccguguggagcgaggacaccggcagcuacuggugcaaggccgagaccgugacccacagaaucagaaagcagagccugcagagccagauccacgugcagagaauccccaucagcaacgugagccuggagaucagagcccccggcggccaggugaccgagggccagaagcugauccugcugugcagcguggccggcggcaccggcaacgugaccuucagcugguacagagaggccaccggcaccagcaugggcaagaagacccagagaagccugagcgccgagcuggagauccccgccgugaaggagagcgacgccggcaaguacuacugcagagccgacaacggccacgugcccauccagagcaagguggugaacauccccgugagaauccccgugagcagacccgugcugacccugagaagccccggcgcccaggccgccgugggcgaccugcuggagcugcacugcgaggcccugagaggcagcccccccauccuguaccaguucuaccacgaggacgugacccugggcaacagcagcgcccccagcggcggcggcgccagcuucaaccugagccugaccgccgagcacagcggcaacuacagcugcgaggccaacaacggccugggcgcccagugcagcgaggccgugcccgugagcaucagcggccccgacggcuacagaagagaccugaugaccgccggcgugcuguggggccuguucggcgugcugggcuucaccggcguggcccugcugcuguacgcccuguuccacaagaucagcggcgagagcagcgccaccaacgagcccagaacccccaagagcagcacccugcuguaa

SEQ ID NO: 17028 - RNA, 2205 nt, Artificial Sequence
  FCRL3__Homo_sapiens__XP_006711208
augcugcuguggcugcugcugcugauccugacccccggcagagagcagagcggcguggcccccaaggccgugcugcugcugaacccccccuggagcaccgccuucaagggcgagaagguggcccugaucugcagcagcaucagccacagccuggcccagggcgacaccuacugguaccacgacgagaagcugcugaagaucaagcacgacaagauccagaucaccgagcccggcaacuaccagugcaagaccagaggcagcagccugagcgacgccgugcacguggaguucagccccgacuggcugauccugcaggcccugcaccccguguucgagggcgacaacgugauccugagaugccagggcaaggacaacaagaacacccaccagaagguguacuacaaggacggcaagcagcugcccaacagcuacaaccuggagaagaucaccgugaacagcgugagcagagacaacagcaaguaccacugcaccgccuacagaaaguucuacauccuggacaucgaggugaccagcaagccccugaacauccaggugcaggagcuguuccugcaccccgugcugagagccagcagcagcacccccaucgagggcagccccaugacccugaccugcgagacccagcugagcccccagagacccgacgugcagcugcaguucagccuguucagagacagccagacccugggccugggcuggagcagaagccccagacugcagauccccgccauguggaccgaggacagcggcagcuacuggugcgagguggagaccgugacccacagcaucaagaagagaagccugagaagccagaucagagugcagagagugcccgugagcaacgugaaccuggagaucagacccaccggcggccagcugaucgagggcgagaacauggugcugaucugcagcguggcccagggcagcggcaccgugaccuucagcuggcacaaggagggcagagugagaagccugggcagaaagacccagagaagccugcuggccgagcugcacgugcugaccgugaaggagagcgacgccggcagauacuacugcgccgccgacaacgugcacagccccauccugagcaccuggaucagagugaccgugagaauccccgugagccaccccgugcugaccuucagagcccccagagcccacaccguggugggcgaccugcuggagcugcacugcgagagccugagaggcagcccccccauccuguacagauucuaccacgaggacgugacccugggcaacagcagcgcccccagcggcggcggcgccagcuucaaccugagccugaccgccgagcacagcggcaacuacagcugcgacgccgacaacggccugggcgcccagcacagccacggcgugagccugagagugaccgugcccgugagcagacccgugcugacccugagagcccccggcgcccaggccguggugggcgaccugcuggagcugcacugcgagagccugagaggcagcuuccccauccuguacugguucuaccacgaggacgacacccugggcaacaucagcgcccacagcggcggcggcgccagcuucaaccugagccugaccaccgagcacagcggcaacuacagcugcgaggccgacaacggccugggcgcccagcacagcaagguggugacccugaacgugaccggcaccagcagaaacagaaccggccugaccgccgccggcaucaccggccuggugcugagcauccuggugcuggccgccgccgccgcccugcugcacuacgccagagccagaagaaagcccggcggccugagcgccaccggcaccagcagccacagccccagcgagugccaggagcccagcagcagcagacccagcagaaucgacccccaggagcccacccacagcaagccccuggcccccauggagcuggagcccauguacagcaacgugaaccccggcgacagcaaccccaucuacagccagaucuggagcauccagcacaccaaggagaacagcgccaacugccccaugaugcaccaggagcacgaggagcugaccgugcuguacagcgagcugaagaagacccaccccgacgacagcgccggcgaggccagcagcagaggcagagcccacgaggaggacgacgaggagaacuacgagaacgugcccagagugcugcuggccagcgaccacuaa

SEQ ID NO: 17029 - RNA, 1548 nt, Artificial Sequence
  FCRL4__Homo_sapiens__NP_112572
augcugcugugggccagccugcuggccuucgcccccgugugcggccagagcgccgccgcccacaagcccgugaucagcgugcacccccccuggaccaccuucuucaagggcgagagagugacccugaccugcaacggcuuccaguucuacgccaccgagaagaccaccugguaccacagacacuacuggggcgagaagcugacccugacccccggcaacacccuggaggugagagagagcggccuguacagaugccaggccagaggcagccccagaagcaaccccgugagacugcuguucagcagcgacagccugauccugcaggcccccuacagcguguucgagggcgacacccuggugcugagaugccacagaagaagaaaggagaagcugaccgccgugaaguacaccuggaacggcaacauccugagcaucagcaacaagagcugggaccugcugaucccccaggccagcagcaacaacaacggcaacuacagaugcaucggcuacggcgacgagaacgacguguucagaagcaacuucaagaucaucaagauccaggagcuguucccccaccccgagcugaaggccaccgacagccagcccaccgagggcaacagcgugaaccugagcugcgagacccagcugccccccgagagaagcgacaccccccugcacuucaacuucuucagagacggcgaggugauccugagcgacuggagcaccuaccccgagcugcagcugcccaccguguggagagagaacagcggcagcuacuggugcggcgccgagaccgugagaggcaacauccacaagcacagccccagccugcagauccacgugcagagaauccccgugagcggcgugcugcuggagacccagcccagcggcggccaggccguggagggcgagaugcuggugcuggugugcagcguggccgagggcaccggcgacaccaccuucagcuggcacagagaggacaugcaggagagccugggcagaaagacccagagaagccugagagccgagcuggagcugcccgccaucagacagagccacgccggcggcuacuacugcaccgccgacaacagcuacggccccgugcagagcauggugcugaacgugaccgugagagagacccccggcaacagagacggccugguggccgccggcgccaccggcggccugcugagcgcccugcugcuggccguggcccugcuguuccacugcuggagaagaagaaagagcggcgugggcuuccugggcgacgagaccagacugccccccgcccccggccccggcgagagcagccacagcaucugccccgcccagguggagcugcagagccuguacguggacgugcaccccaagaagggcgaccugguguacagcgagauccagaccacccagcugggcgaggaggaggaggccaacaccagcagaacccugcuggaggacaaggacgugagcgugguguacagcgaggugaagacccagcaccccgacaacagcgccggcaagaucagcagcaaggacgaggagagcuaa

SEQ ID NO: 17030 - RNA, 2934 nt, Artificial Sequence
  FCRL5__Homo_sapiens__NP_112571
augcugcugugggugauccugcuggugcuggcccccgugagcggccaguucgccagaacccccagacccaucaucuuccugcagccccccuggaccaccguguuccagggcgagagagugacccugaccugcaagggcuucagauucuacagcccccagaagaccaagugguaccacagauaccugggcaaggagauccugagagagacccccgacaacauccuggaggugcaggagagcggcgaguacagaugccaggcccagggcagcccccugagcagccccgugcaccuggacuucagcagcgccagccugauccugcaggccccccugagcguguucgagggcgacagcguggugcugagaugcagagccaaggccgaggugacccugaacaacaccaucuacaagaacgacaacgugcuggccuuccugaacaagagaaccgacuuccacaucccccacgccugccugaaggacaacggcgccuacagaugcaccggcuacaaggagagcugcugccccgugagcagcaacaccgugaagauccaggugcaggagcccuucaccagacccgugcugagagccagcagcuuccagcccaucagcggcaaccccgugacccugaccugcgagacccagcugagccuggagagaagcgacgugccccugagauucagauucuucagagacgaccagacccugggccugggcuggagccugagccccaacuuccagaucaccgccauguggagcaaggacagcggcuucuacuggugcaaggccgccaccaugcccuacagcgugaucagcgacagccccagaagcuggauccaggugcagauccccgccagccaccccgugcugacccugagccccgagaaggcccugaacuucgagggcaccaaggugacccugcacugcgagacccaggaggacagccugagaacccuguacagauucuaccacgagggcgugccccugagacacaagagcgugagaugcgagagaggcgccagcaucagcuucagccugaccaccgagaacagcggcaacuacuacugcaccgccgacaacggccugggcgccaagcccagcaaggccgugagccugagcgugaccgugcccgugagccaccccgugcugaaccugagcagccccgaggaccugaucuucgagggcgccaaggugacccugcacugcgaggcccagagaggcagccugcccauccuguaccaguuccaccacgagggcgccgcccuggagagaagaagcgccaacagcgccggcggcguggccaucagcuucagccugaccgccgagcacagcggcaacuacuacugcaccgccgacaacggcuucggcccccagagaagcaaggccgugagccugagcgugaccgugcccgugagccaccccgugcugacccugagcagcgccgaggcccugaccuucgagggcgccaccgugacccugcacugcgaggugcagagaggcagcccccagauccuguaccaguucuaccacgaggacaugccccuguggagcagcagcacccccagcgugggcagagugagcuucagcuucagccugaccgagggccacagcggcaacuacuacugcaccgccgacaacggcuucggcccccagagaagcgagguggugagccuguucgugaccgugcccgugagcagacccauccugacccugagagugcccagagcccaggccguggugggcgaccugcuggagcugcacugcgaggcccccagaggcagcccccccauccuguacugguucuaccacgaggacgugacccugggcagcagcagcgcccccagcggcggcgaggccagcuucaaccugagccugaccgccgagcacagcggcaacuacagcugcgaggccaacaacggccugguggcccagcacagcgacaccaucagccugagcgugaucgugcccgugagcagacccauccugaccuucagagcccccagagcccaggccguggugggcgaccugcuggagcugcacugcgaggcccugagaggcagcagccccauccuguacugguucuaccacgaggacgugacccugggcaagaucagcgcccccagcggcggcggcgccagcuucaaccugagccugaccaccgagcacagcggcaucuacagcugcgaggccgacaacggccuggaggcccagagaagcgagauggugacccugaagguggccgugcccgugagcagacccgugcugacccugagagcccccggcacccacgccgccgugggcgaccugcuggagcugcacugcgaggcccugagaggcagcccccugauccuguacagauucuuccacgaggacgugacccugggcaacagaagcagccccagcggcggcgccagccugaaccugagccugaccgccgagcacagcggcaacuacagcugcgaggccgacaacggccugggcgcccagagaagcgagaccgugacccuguacaucaccggccugaccgccaacagaagcggccccuucgccaccggcguggccggcggccugcugagcaucgccggccuggccgccggcgcccugcugcuguacugcuggcugagcagaaaggccggcagaaagcccgccagcgaccccgccagaagccccagcgacagcgacagccaggagcccaccuaccacaacgugcccgccugggaggagcugcagcccguguacaccaacgccaaccccagaggcgagaacgugguguacagcgaggugagaaucauccaggagaagaagaagcacgccguggccagcgaccccagacaccugagaaacaagggcagccccaucaucuacagcgaggugaagguggccagcacccccgugagcggcagccuguuccuggccagcagcgccccccacagauaa

SEQ ID NO: 17031 - RNA, 1242 nt, Artificial Sequence
  FCRL6__Homo_sapiens__NP_001271146
augcugcccagccugggccccaugcugcuguggaccgccgugcugcuguucgugcccugcgugggcaagaccguguggcuguaccugcaggccuggcccaaccccguguucgagggcgacgcccugacccugagaugccagggcuggaagaacaccccccugagccaggugaaguucuacagagacggcaaguuccugcacuucagcaaggagaaccagacccugagcaugggcgccgccaccgugcagagcagaggccaguacagcugcagcggccaggugauguacaucccccagaccuucacccagaccagcgagaccgccauggugcaggugcaggagcuguuccccccccccgugcugagcgccauccccagccccgagcccagagagggcagccuggugacccugagaugccagaccaagcugcacccccugagaagcgcccugagacugcuguucagcuuccacaaggacggccacacccugcaggacagaggcccccaccccgagcugugcauccccggcgccaaggagggcgacagcggccuguacuggugcgagguggcccccgagggcggccaggugcagaagcagagcccccagcuggaggugagagugcaggcccccgugagcagacccgugcugacccugcaccacggccccgccgaccccgccgugggcgacauggugcagcugcugugcgaggcccagagaggcagcccccccauccuguacagcuucuaccuggacgagaagaucgugggcaaccacagcgcccccugcggcggcaccaccagccugcuguuccccgugaagagcgagcaggacgccggcaacuacagcugcgaggccgagaacagcgugagcagagagagaagcgagcccaagaagcugagccugaagggcagccaggugcuguucacccccgccagcaacuggcuggugcccuggcugcccgccagccugcugggccugauggugaucgccgccgcccugcugguguacgugagaagcuggagaaaggccggcccccugcccagccagaucccccccaccgcccccggcggcgagcagugcccccuguacgccaacgugcaccaccagaagggcaaggacgagggcgugguguacagcguggugcacagaaccagcaagagaagcgaggccagaagcgccgaguucaccgugggcagaaaguucuaccaccugugcggcggcgagaugcccgccgcccaguaa

SEQ ID NO: 17032 - RNA, 1149 nt, Artificial Sequence
  FCRLA__Homo_sapiens__NP_001171795
augcugaagaagaucagcgugggcguggccggcgaccugaacaccgugaccaugaagcugggcugcgugcugauggccugggcccuguaccugagccugggcgugcuguggguggcccagaugcugcuggccgccggcugccacgccgccgccagcuucgagacccugcagugcgagggccccgugugcaccgaggagagcagcugccacaccgaggacgaccugaccgacgccagagaggccggcuuccaggugaaggccuacaccuucagcgagcccuuccaccugaucgugagcuacgacuggcugauccugcagggccccgccaagcccguguucgagggcgaccugcuggugcugagaugccaggccuggcaggacuggccccugacccaggugaccuucuacagagacggcagcgcccugggcccccccggccccaacagagaguucagcaucaccguggugcagaaggccgacagcggccacuaccacugcagcggcaucuuccagagccccggccccggcauccccgagaccgccagcgugguggccaucaccgugcaggagcuguuccccgcccccauccugagagccgugcccagcgccgagccccaggccggcagccccaugacccugagcugccagaccaagcugccccugcagagaagcgccgccagacugcuguucagcuucuacaaggacggcagaaucgugcagagcagaggccugagcagcgaguuccagauccccaccgccagcgaggaccacagcggcagcuacuggugcgaggccgccaccgaggacaaccagguguggaagcagagcccccagcuggagaucagagugcagggcgccagcagcagcgccgccccccccacccugaaccccgccccccagaagagcgccgcccccggcaccgcccccgaggaggcccccggcccccugccccccccccccacccccagcagcgaggaccccggcuucagcagcccccugggcaugcccgacccccaccuguaccaccagaugggccugcugcugaagcacaugcaggacgugagagugcugcugggccaccugcugauggagcugagagagcugagcggccacagaaagcccggcaccaccaaggccaccgccgaguaa

SEQ ID NO: 17033 - RNA, 957 nt, Artificial Sequence
  FCRLB__Homo_sapiens__NP_001275758
auguggccccugaccgcccugcugcugcuggugcccagcagcggccaggccgccacccuggagaagcccauccugagccugcacccccccuggaccaccaucuucaagggcgagagagugacccugaagugcgacggcuaccacccccugcugcuggagcugcagcccaucagcacccugugguaccugggccaccugcugcugcccagccacaagaagagcaucgaggugcagacccccggcguguacagaugccagaccagaggcgcccccgugagcgaccccauccaccugagcgugagcaacgacuggcugauccugcaggugcccuacgcccccguguucgagggcgagccccuggugcugagaugcagaggcugguacgacaaggugguguacaagcugcacuacuaccacgacggccaggccgugagauacuuccacagcagcgccaacuacaccgugcugcaggccagagccagcgacagcggcagauaccagugcagcggcaccaugagaauccccguggagagcgcccccauguucagcgccaagguggccgugaccgugcaggccgccagaugcgccgccagcaccggcgcccccagcacccagagcagaagccccagaagcagaagcagcaacagaaccggcgccagaagacugcccccccccgccgugagcggcaacgccgugagaggcugcagcagcagaggcagagugcugcccuggaccagaccccccccccccccccagcugcacggcccccagcccuggcugcuggugaucggcagauuccccagcgagagccccagaugccccgacagaagcagauggagcccccccagcggcaccccccccccccccggcugcagcagcagaagagccgcccccagacugagaggccacccccccgcccugagaagaagacccuggaacaacagacuggagcccuaa

SEQ ID NO: 17034 - RNA, 1254 nt, Artificial Sequence
  FDFT1__Homo_sapiens__NP_001274672
auggaguucgugaagugccugggccaccccgaggaguucuacaaccuggugagauucagaaucggcggcaagagaaaggugaugcccaagauggaccaggacagccugagcagcagccugaagaccugcuacaaguaccugaaccagaccagcagaagcuucgccgccgugauccaggcccuggacggcgagaugagaaacgccgugugcaucuucuaccuggugcugagagcccuggacacccuggaggacgacaugaccaucagcguggagaagaaggugccccugcugcacaacuuccacagcuuccuguaccagcccgacuggagauucauggagagcaaggagaaggacagacaggugcuggaggacuuccccaccaucagccuggaguucagaaaccuggccgagaaguaccagaccgugaucgccgacaucugcagaagaaugggcaucggcauggccgaguuccuggacaagcacgugaccagcgagcaggagugggacaaguacugccacuacguggccggccuggugggcaucggccugagcagacuguucagcgccagcgaguucgaggacccccuggugggcgaggacaccgagagagccaacagcaugggccuguuccugcagaagaccaacaucaucagagacuaccuggaggaccagcagggcggcagagaguucuggccccaggagguguggagcagauacgugaagaagcugggcgacuucgccaagcccgagaacaucgaccuggccgugcagugccugaacgagcugaucaccaacgcccugcaccacauccccgacgugaucaccuaccugagcagacugagaaaccagagcguguucaacuucugcgccaucccccaggugauggccaucgccacccuggccgccugcuacaacaaccagcagguguucaagggcgccgugaagaucagaaagggccaggccgugacccugaugauggacgccaccaacaugcccgccgugaaggccaucaucuaccaguacauggaggagaucuaccacagaauccccgacagcgaccccagcagcagcaagaccagacagaucaucagcaccaucagaacccagaaccugcccaacugccagcugaucagcagaagccacuacagccccaucuaccugagcuucgugaugcugcuggccgcccugagcuggcaguaccugaccacccugagccaggugaccgaggacuacgugcagaccggcgagcacuaa

SEQ ID NO: 17035 - RNA, 1260 nt, Artificial Sequence
  FDPS__Homo_sapiens__NP_001129293
augccccugagcagauggcugagaagcgugggcguguuccugcugcccgcccccuacugggcccccagagagagauggcugggcagccugagaagacccagccuggugcacggcuaccccgugcuggccuggcacagcgccagaugcuggugccaggccuggaccgaggagcccagagcccugugcagcagccugagaaugaacggcgaccagaacagcgacguguacgcccaggagaagcaggacuucgugcagcacuucagccagaucgugagagugcugaccgaggacgagaugggccaccccgagaucggcgacgccaucgccagacugaaggaggugcuggaguacaacgccaucggcggcaaguacaacagaggccugaccguggugguggccuucagagagcugguggagcccagaaagcaggacgccgacagccugcagagagccuggaccgugggcuggugcguggagcugcugcaggccuucuuccugguggccgacgacaucauggacagcagccugaccagaagaggccagaucugcugguaccagaagcccggcgugggccuggacgccaucaacgacgccaaccugcuggaggccugcaucuacagacugcugaagcuguacugcagagagcagcccuacuaccugaaccugaucgagcuguuccugcagagcagcuaccagaccgagaucggccagacccuggaccugcugaccgccccccagggcaacguggaccuggugagauucaccgagaagagauacaagagcaucgugaaguacaagaccgccuucuacagcuucuaccugcccaucgccgccgccauguacauggccggcaucgacggcgagaaggagcacgccaacgccaagaagauccugcuggagaugggcgaguucuuccagauccaggacgacuaccuggaccuguucggcgaccccagcgugaccggcaagaucggcaccgacauccaggacaacaagugcagcuggcugguggugcagugccugcagagagccacccccgagcaguaccagauccugaaggagaacuacggccagaaggaggccgagaagguggccagagugaaggcccuguacgaggagcuggaccugcccgccguguuccugcaguacgaggaggacagcuacagccacaucauggcccugaucgagcaguacgccgccccccugccccccgccguguuccugggccuggccagaaagaucuacaagagaagaaaguaa

SEQ ID NO: 17036 - RNA, 555 nt, Artificial Sequence
  FDX1__Homo_sapiens__NP_004100
auggccgccgccggcggcgccagacugcugagagccgccagcgccgugcugggcggccccgccggcagauggcugcaccacgccggcagcagagccggcagcagcggccugcugagaaacagaggccccggcggcagcgccgaggccagcagaagccugagcgugagcgccagagccagaagcagcagcgaggacaagaucaccgugcacuucaucaacagagacggcgagacccugaccaccaagggcaaggugggcgacagccugcuggacguggugguggagaacaaccuggacaucgacggcuucggcgccugcgagggcacccuggccugcagcaccugccaccugaucuucgaggaccacaucuacgagaagcuggacgccaucaccgacgaggagaacgacaugcuggaccuggccuacggccugaccgacagaagcagacugggcugccagaucugccugaccaagagcauggacaacaugaccgugagagugcccgagaccguggccgacgccagacagagcaucgacgugggcaagaccagcuaa

SEQ ID NO: 17037 - RNA, 561 nt, Artificial Sequence
  FDX1L__Homo_sapiens__NP_001026904
augcacgugauggccgccagcauggccagaggcggcgugagcgccagagugcugcugcaggccgccagaggcaccugguggaacagacccggcggcaccagcggcagcggcgagggcguggcccugggcaccaccagaaaguuccaggccaccggcagcagacccgccggcgaggaggacgccggcggccccgagagacccggcgacguggugaacgugguguucguggacagaagcggccagagaauccccgugagcggcagagugggcgacaacgugcugcaccuggcccagagacacggcguggaccuggagggcgccugcgaggccagccuggccugcagcaccugccacguguacgugagcgaggaccaccuggaccugcugcccccccccgaggagagagaggacgacaugcuggacauggccccccugcugcaggagaacagcagacugggcugccagaucgugcugacccccgagcuggagggcgccgaguucacccugcccaagaucaccagaaacuucuacguggacggccacgugcccaagccccacuaa

SEQ ID NO: 17038 - RNA, 1605 nt, Artificial Sequence
  FDXR__Homo_sapiens__NP_001244941
auggccagcagaugcuggagaugguggggcuggagcgccuggcccagaaccagacugccccccgccggcagcacccccagcuucugccaccacuucagcacccaggagaagaccccccagaucugcguggugggcagcggccccgccggcuucuacaccgcccagcaccugcugaagagaguggaggcccugugcagccagcccagagugcugaacagccccgcccugagcggcgagggcgaggaccugggcgccagccagccccugagccugggccccaccagcugccaccccgugccccagcagcacccccaggcccacguggacaucuacgagaagcagcccgugcccuucggccuggugagauucggcguggcccccgaccaccccgaggugaagaacgugaucaacaccuucacccagaccgcccacagcggcagaugcgccuucuggggcaacguggaggugggcagagacgugaccgugcccgagcugcaggaggccuaccacgccguggugcugagcuacggcgccgaggaccacagagcccuggagauccccggcgaggagcugcccggcgugugcagcgccagagccuucgugggcugguacaacggccugcccgagaaccaggagcuggagcccgaccugagcugcgacaccgccgugauccugggccagggcaacguggcccuggacguggccagaauccugcugaccccccccgagcaccuggagagaaccgacaucaccaaggccgcccugggcgugcugagacagagcagagugaagaccguguggcuggugggcagaagaggcccccugcagguggccuucaccaucaaggagcugagagagaugauccagcugcccggcgccagacccauccuggaccccguggacuuccugggccugcaggacaagaucaaggaggugcccagacccagaaagagacugaccgagcugcugcugagaaccgccaccgagaagcccggccccgccgaggccgccagacaggccagcgccagcagagccuggggccugagauucuucagaagcccccagcaggugcugcccagccccgacggcagaagagccgccggcgugagacuggccgugaccagacuggagggcguggacgaggccaccagagccgugcccaccggcgacauggaggaccugcccugcggccuggugcugagcagcaucggcuacaagagcagacccguggaccccagcgugcccuucgacagcaagcugggcgugauccccaacguggagggcagagugauggacgugcccggccuguacugcagcggcugggugaagagaggccccaccggcgugaucgccaccaccaugaccgacagcuuccugaccggccagaugcugcugcaggaccugaaggccggccugcugcccagcggccccagacccggcuacgccgccauccaggcccugcugagcagcagaggcgugagacccgugagcuucagcgacugggagaagcuggacgccgaggagguggccagaggccagggcaccggcaagcccagagagaagcugguggacccccaggagaugcugagacugcugggccacuaa

SEQ ID NO: 17039 - RNA, 1272 nt, Artificial Sequence
  FECH__Homo_sapiens__NP_000131
augagaagccugggcgccaacauggccgccgcccugagagccgccggcgugcugcugagagacccccuggccagcagcagcuggagagugugccagcccuggagauggaagagcggcgccgccgccgccgccgugaccaccgagaccgcccagcacgcccagggcgccaagccccaggugcagccccagaagagaaagcccaagaccggcauccugaugcugaacaugggcggccccgagacccugggcgacgugcacgacuuccugcugagacuguuccuggacagagaccugaugacccugcccauccagaacaagcuggcccccuucaucgccaagagaagaacccccaagauccaggagcaguacagaagaaucggcggcggcagccccaucaagaucuggaccagcaagcagggcgagggcauggugaagcugcuggacgagcugagccccaacaccgccccccacaaguacuacaucggcuucagauacgugcacccccugaccgaggaggccaucgaggagauggagagagacggccuggagagagccaucgccuucacccaguacccccaguacagcugcagcaccaccggcagcagccugaacgccaucuacagauacuacaaccaggugggcagaaagcccaccaugaaguggagcaccaucgacagauggcccacccaccaccugcugauccagugcuucgccgaccacauccugaaggagcuggaccacuucccccuggagaagagaagcgagguggugauccuguucagcgcccacagccugcccaugagcguggugaacagaggcgaccccuacccccaggaggugagcgccaccgugcagaaggugauggagagacuggaguacugcaaccccuacagacugguguggcagagcaaggugggccccaugcccuggcugggcccccagaccgacgagagcaucaagggccugugcgagagaggcagaaagaacauccugcuggugcccaucgccuucaccagcgaccacaucgagacccuguacgagcuggacaucgaguacagccaggugcuggccaaggagugcggcguggagaacaucagaagagccgagagccugaacggcaacccccuguucagcaaggcccuggccgaccuggugcacagccacauccagagcaacgagcugugcagcaagcagcugacccugagcugcccccugugcgugaaccccgugugcagagagaccaagagcuucuucaccagccagcagcuguaa

SEQ ID NO: 17040 - RNA, 2010 nt, Artificial Sequence
  FEM1A__Homo_sapiens__NP_061178
auggaccugagaaccgccguguacaacgccgccagagacggcaagcugcagcugcugcagaagcugcugagcggcagaagcagagaggagcuggacgagcugaccggcgagguggccggcggcggcaccccccugcugaucgccgccagauacggccaccuggacgugguggaguaccugguggacagaugcggcgccagcguggaggccggcggcagcgugcacuucgacggcgagaccaucgagggcgcccccccccugugggccgccagcgccgccggccaccuggacguggugagaagccugcugagaagaggcgccagcgugaacagaaccaccagaaccaacagcaccccccugagagccgccugcuucgacggccaccuggagguggugagauaccuggugggcgagcaccaggccgaccuggagguggccaacagacacggccacaccugccugaugaucagcugcuacaagggccacagagagaucgccagauaccugcuggagcagggcgcccaggugaacagaagaagcgccaagggcaacaccgcccugcacgacugcgccgagagcggcagccuggagauccugcagcugcugcugggcugcaaggccagaauggagagagacggcuacggcaugaccccccugcuggccgccagcgugaccggccacaccaacaucguggaguaccugauccaggagcagcccggccaggagcagguggccggcggcgaggcccagcccggccugccccaggaggaccccagcaccagccagggcugcgcccagccccagggcgcccccugcugcagcagcagccccgaggagccccugaacggcgagagcuacgagagcugcugccccaccagcagagaggccgccguggaggcccuggagcugcugggcgccaccuacguggacaagaagagagaccugcugggcgcccugaagcacuggagaagagccauggagcugagacaccagggcggcgaguaccugcccaagcccgagcccccccagcuggugcuggccuacgacuacagcagagaggugaacaccaccgaggagcuggaggcccugaucaccgaccccgacgagaugagaaugcaggcccugcugaucagagagagaauccugggccccagccaccccgacaccagcuacuacaucagauacagaggcgccguguacgccgacagcggcaacuucgagagaugcaucagacuguggaaguacgcccuggacaugcagcagagcaaccuggagccccugagccccaugaccgccagcagcuuccugagcuucgccgagcuguucagcuacgugcugcaggacagagccgccaagggcagccugggcacccagaucggcuucgccgaccugaugggcgugcugaccaagggcgugagagagguggagagagcccugcagcugcccagagagcccggcgacagcgcccaguucaccaaggcccuggccaucauccugcaccugcuguaccugcuggagaagguggagugcacccccagccaggagcaccugaagcaccagaccguguacagacugcugaagugcgcccccagaggcaagaacggcuucaccccccugcacauggccguggacaaggacaccaccaacgugggcagauaccccgugggcagauuccccagccugcacguggugaaggugcugcuggacugcggcgccgaccccgacagcagagacuucgacaacaacaccccccugcacaucgccgcccagaacaacugccccgccaucaugaacgcccugaucgaggccggcgcccacauggacgccaccaacgccuucaagaagaccgccuacgagcugcuggacgagaagcugcuggccagaggcaccaugcagcccuucaacuacgugacccugcagugccuggccgccagagcccuggacaagaacaagauccccuacaagggcuucauccccgaggaccuggaggccuucaucgagcugcacuaa

SEQ ID NO: 17041 - RNA, 1884 nt, Artificial Sequence
  FEM1B__Homo_sapiens__NP_056137
auggagggccuggccggcuacguguacaaggccgccagcgagggcaaggugcugacccuggccgcccugcugcugaacagaagcgagagcgacaucagauaccugcugggcuacgugagccagcagggcggccagagaagcaccccccugaucaucgccgccagaaacggccacgccaagguggugagacugcugcuggagcacuacagagugcagacccagcagaccggcaccgugagauucgacggcuacgugaucgacggcgccaccgcccuguggugcgccgccggcgccggccacuucgagguggugaagcugcuggugagccacggcgccaacgugaaccacaccaccgugaccaacagcaccccccugagagccgccugcuucgacggcagacuggacaucgugaaguaccugguggagaacaacgccaacaucagcaucgccaacaaguacgacaacaccugccugaugaucgccgccuacaagggccacaccgacguggugagauaccugcuggagcagagagccgaccccaacgccaaggcccacugcggcgccaccgcccugcacuucgccgccgaggccggccacaucgacaucgugaaggagcugaucaaguggagagccgccaucguggugaacggccacggcaugaccccccugaagguggccgccgagagcugcaaggccgacgugguggagcugcugcugagccacgccgacugcgacagaagaagcagaaucgaggcccuggagcugcugggcgccagcuucgccaacgacagagagaacuacgacaucaucaagaccuaccacuaccuguaccuggccaugcuggagagauuccaggacggcgacaacauccuggagaaggaggugcugccccccauccacgccuacggcaacagaaccgagugcagaaacccccaggagcuggagagcaucagacaggacagagacgcccugcacauggagggccugaucgugagagagagaauccugggcgccgacaacaucgacgugagccaccccaucaucuacagaggcgccguguacgccgacaacauggaguucgagcagugcaucaagcuguggcugcacgcccugcaccugagacagaagggcaacagaaacacccacaaggaccugcugagauucgcccagguguucagccagaugauccaccugaacgagaccgugaaggcccccgacaucgagugcgugcugagaugcagcgugcuggagaucgagcagagcaugaacagagugaagaacaucagcgacgccgacgugcacaacgccauggacaacuacgagugcaaccuguacaccuuccuguaccuggugugcaucagcaccaagacccagugcagcgaggaggaccagugcaagaucaacaagcagaucuacaaccugauccaccuggaccccagaaccagagagggcuucacccugcugcaccuggccgugaacagcaacacccccguggacgacuuccacaccaacgacgugugcagcuuccccaacgcccuggugaccaagcugcugcuggacugcggcgccgaggugaacgccguggacaacgagggcaacagcgcccugcacaucaucgugcaguacaacagacccaucagcgacuuccugacccugcacagcaucaucaucagccugguggaggccggcgcccacaccgacaugaccaacaagcagaacaagaccccccuggacaagagcaccaccggcgugagcgagauccugcugaagacccagaugaagaugagccugaagugccuggccgccagagccgugagagccaacgacaucaacuaccaggaccagauccccagaacccuggaggaguucgugggcuuccacuaa

SEQ ID NO: 17042 - RNA, 1854 nt, Artificial Sequence
  FEM1C__Homo_sapiens__NP_064562
auggaccugaagaccgccguguucaacgccgccagagacggcaagcugagacugcugaccaagcugcuggccagcaagagcaaggaggaggugagcagccugaucagcgagaagaccaacggcgccaccccccugcugauggccgccagauacggccaccuggacaugguggaguuccugcuggagcagugcagcgccagcaucgaggugggcggcagcgugaacuucgacggcgagaccaucgagggcgcccccccccugugggccgccagcgccgccggccaccugaagguggugcagagccugcugaaccacggcgccagcgugaacaacaccacccugaccaacagcaccccccugagagccgccugcuucgacggccaccuggagaucgugaaguaccugguggagcacaaggccgaccuggaggugagcaacagacacggccacaccugccugaugaucagcugcuacaagggccacaaggagaucgcccaguaccugcuggagaagggcgccgacgugaacagaaagagcgugaagggcaacaccgcccugcacgacugcgccgagagcggcagccuggacaucaugaagaugcugcugauguacugcgccaagauggagaaggacggcuacggcaugaccccccugcugagcgccagcgugaccggccacaccaacaucguggacuuccugacccaccacgcccagaccagcaagaccgagagaaucaacgcccuggagcugcugggcgccaccuucguggacaagaagagagaccugcugggcgcccugaaguacuggaagaaggccaugaacaugagauacagcgacagaaccaacaucaucagcaagcccgugccccagacccugaucauggccuacgacuacgccaaggaggugaacagcgccgaggagcuggagggccugaucgccgaccccgacgagaugagaaugcaggcccugcugaucagagagagaauccugggccccagccaccccgacaccagcuacuacaucagauacagaggcgccguguacgccgacagcggcaacuucaagagaugcaucaaccuguggaaguacgcccuggacaugcagcagagcaaccuggacccccugagccccaugaccgccagcagccugcugagcuucgccgagcuguucagcuucaugcugcaggacagagccaagggccugcugggcaccaccgugaccuucgacgaccugaugggcauccugugcaagagcgugcuggagaucgagagagccaucaagcagacccagugccccgccgacccccugcagcugaacaaggcccugagcaucauccugcaccugaucugccugcuggagaaggugcccugcacccuggagcaggaccacuucaagaagcagaccaucuacagauuccugaagcugcaccccagaggcaagaacaacuucagcccccugcaccuggccguggacaagaacaccaccugcgugggcagauaccccgugugcaaguuccccagccugcaggugaccgccauccugaucgagugcggcgccgacgugaacgugagagacagcgacgacaacagcccccugcacaucgccgcccugaacaaccaccccgacaucaugaaccugcugaucaagagcggcgcccacuucgacgccaccaaccugcacaagcagaccgccagcgaccugcuggacgagaaggagaucgccaagaaccugauccagcccaucaaccacaccacccugcagugccuggccgccagagugaucgugaaccacagaaucuacuacaagggccacauccccgagaagcuggagaccuucgugagccugcacagauaa

SEQ ID NO: 17043 - RNA, 1143 nt, Artificial Sequence
  FEN1__Homo_sapiens__NP_004102
augggcauccagggccuggccaagcugaucgccgacguggcccccagcgccaucagagagaacgacaucaagagcuacuucggcagaaagguggccaucgacgccagcaugagcaucuaccaguuccugaucgccgugagacagggcggcgacgugcugcagaacgaggagggcgagaccaccagccaccugaugggcauguucuacagaaccaucagaaugauggagaacggcaucaagcccguguacguguucgacggcaagcccccccagcugaagagcggcgagcuggccaagagaagcgagagaagagccgaggccgagaagcagcugcagcaggcccaggccgccggcgccgagcaggagguggagaaguucaccaagagacuggugaaggugaccaagcagcacaacgacgagugcaagcaccugcugagccugaugggcauccccuaccuggacgcccccagcgaggccgaggccagcugcgccgcccuggugaaggccggcaagguguacgccgccgccaccgaggacauggacugccugaccuucggcagccccgugcugaugagacaccugaccgccagcgaggccaagaagcugcccauccaggaguuccaccugagcagaauccugcaggagcugggccugaaccaggagcaguucguggaccugugcauccugcugggcagcgacuacugcgagagcaucagaggcaucggccccaagagagccguggaccugauccagaagcacaagagcaucgaggagaucgugagaagacuggaccccaacaaguaccccgugcccgagaacuggcugcacaaggaggcccaccagcuguuccuggagcccgaggugcuggaccccgagagcguggagcugaaguggagcgagcccaacgaggaggagcugaucaaguucaugugcggcgagaagcaguucagcgaggagagaaucagaagcggcgugaagagacugagcaagagcagacagggcagcacccagggcagacuggacgacuucuucaaggugaccggcagccugagcagcgccaagagaaaggagcccgagcccaagggcagcaccaagaagaaggccaagaccggcgccgccggcaaguucaagagaggcaaguaa

SEQ ID NO: 17044 - RNA, 501 nt, Artificial Sequence
  FERD3L__Homo_sapiens__NP_690862
auggccgccuaccccgagagcugcguggacaccaccgugcuggacuucguggccgaccugagccuggccagccccagaagaccccugcugugcgacuucgcccccggcgugagccugggcgaccccgcccuggcccugagagagggcagacccagaagaauggccagauucgaggagggcgaccccgaggaggaggagugcgagguggaccagggcgacggcgaggaggaggaggaggaggagagaggcagaggcgugagccugcugggcagacccaagagaaagagagugaucaccuacgcccagagacaggccgccaacaucagagagagaaagagaauguucaaccugaacgaggccuucgaccagcugagaagaaaggugcccaccuucgccuacgagaagagacugagcagaaucgagacccugagacuggccaucguguacaucagcuucaugaccgagcugcuggagagcugcgagaagaaggagagcggcuaa

SEQ ID NO: 17045 - RNA, 2469 nt, Artificial Sequence
  FER__Homo_sapiens__NP_005237
augggcuucggcagcgaccugaagaacagccacgaggccgugcugaagcugcaggacugggagcugagacugcuggagaccgugaagaaguucauggcccugagaaucaagagcgacaaggaguacgccagcacccugcagaaccugugcaaccagguggacaaggagagcaccgugcagaugaacuacgugagcaacgugagcaagagcuggcugcugaugauccagcagaccgagcagcugagcagaaucaugaagacccacgccgaggaccugaacagcggcccccugcacagacugaccaugaugaucaaggacaagcagcaggugaagaagagcuacaucggcgugcaccagcagaucgaggccgagaugaucaaggugaccaagaccgagcuggagaagcugaagugcagcuacagacagcugaucaaggagaugaacagcgccaaggagaaguacaaggaggcccuggccaagggcaaggagaccgagaaggccaaggagagauacgacaaggccaccaugaagcugcacaugcugcacaaccaguacgugcuggcccugaagggcgcccagcugcaccagaaccaguacuacgacaucacccugccccugcugcuggacagccugcagaagaugcaggaggagaugaucaaggcccugaagggcaucuucgacgaguacagccagaucaccagccuggugaccgaggagaucgugaacgugcacaaggagauccagaugagcguggagcagaucgaccccagcaccgaguacaacaacuucaucgacgugcacagaaccaccgccgccaaggagcaggagaucgaguucgacaccagccugcuggaggagaacgagaaccugcaggccaacgagaucauguggaacaaccugaccgccgagagccugcaggugaugcugaagacccuggccgaggagcugaugcagacccagcagaugcugcugaacaaggaggaggccgugcuggagcuggagaagagaaucgaggagagcagcgagaccugcgagaagaagagcgacaucgugcugcugcugagccagaagcaggcccuggaggagcugaagcagagcgugcagcagcugagaugcaccgaggccaaguucagcgcccagaaggagcugcuggagcagaaggugcaggagaacgacggcaaggagcccccccccguggugaacuacgaggaggacgccagaagcgugaccagcauggagagaaaggagagacugagcaaguucgagagcaucagacacagcaucgccggcaucaucagaagccccaagagcgcccugggcagcagcgcccugagcgacaugaucagcaucagcgagaagccccuggccgagcaggacugguaccacggcgccauccccagaaucgaggcccaggagcugcugaagaagcagggcgacuuccuggugagagagagccacggcaagcccggcgaguacgugcugagcguguacagcgacggccagagaagacacuucaucauccaguacguggacaacauguacagauucgagggcaccggcuucagcaacaucccccagcugaucgaccaccacuacaccaccaagcaggugaucaccaagaagagcggcguggugcugcugaaccccauccccaaggacaagaaguggauccugagccacgaggacgugauccugggcgagcugcugggcaagggcaacuucggcgagguguacaagggcacccugaaggacaagaccagcguggccgugaagaccugcaaggaggaccugccccaggagcugaagaucaaguuccugcaggaggccaagauccugaagcaguacgaccaccccaacaucgugaagcugaucggcgugugcacccagagacagcccguguacaucaucauggagcuggugagcggcggcgacuuccugaccuuccugagaagaaagaaggacgagcugaagcugaagcagcuggugaaguucagccuggacgccgccgccggcaugcuguaccuggagagcaagaacugcauccacagagaccuggccgccagaaacugccuggugggcgagaacaacgugcugaagaucagcgacuucggcaugagcagacaggaggacggcggcguguacagcagcagcggccugaagcagauccccaucaaguggaccgcccccgaggcccugaacuacggcagauacagcagcgagagcgacguguggagcuucggcauccugcugugggagaccuucagccugggcgugugccccuaccccggcaugaccaaccagcaggccagagagcagguggagagaggcuacagaaugagcgccccccagcacugccccgaggacaucagcaagaucaugaugaagugcugggacuacaagcccgagaacagacccaaguucagcgagcugcagaaggagcugaccaucaucaagagaaagcugaccuaa

SEQ ID NO: 17046 - RNA, 2034 nt, Artificial Sequence
  FERMT1__Homo_sapiens__NP_060141
augcugagcagcaccgacuucaccuucgccagcugggagcugguggugagaguggaccaccccaacgaggagcagcagaaggacgugacccugagagugagcggcgaccugcacgugggcggcgugaugcugaagcugguggagcagaucaacaucagccaggacuggagcgacuucgcccuguggugggagcagaagcacugcuggcugcugaagacccacuggacccuggacaaguacggcgugcaggccgacgccaagcugcuguucaccccccagcacaagaugcugagacugagacugcccaaccugaagauggugagacugagagugagcuucagcgccgugguguucaaggccgugagcgacaucugcaagauccugaacaucagaagaagcgaggagcugagccugcugaagcccagcggcgacuacuucaagaagaagaagaagaaggacaagaacaacaaggagcccaucaucgaggacauccugaaccuggagagcagccccaccgccagcggcagcagcgugagccccggccuguacagcaagaccaugacccccaucuacgaccccaucaacggcacccccgccagcagcaccaugaccugguucagcgacagcccccugaccgagcagaacugcagcauccuggccuucagccagcccccccagagccccgaggcccuggccgacauguaccagcccagaagccugguggacaaggccaagcugaacgccggcuggcuggacagcagcagaagccugauggagcagggcauccaggaggacgagcagcugcugcugagauucaaguacuacagcuucuucgaccugaaccccaaguacgacgccgugagaaucaaccagcuguacgagcaggccagaugggccauccugcuggaggagaucgacugcaccgaggaggagaugcugaucuucgccgcccugcaguaccacaucagcaagcugagccugagcgccgagacccaggacuucgccggcgagagcgagguggacgagaucgaggccgcccugagcaaccuggaggugacccuggagggcggcaaggccgacagccugcuggaggacaucaccgacauccccaagcuggccgacaaccugaagcuguucagacccaagaagcugcugcccaaggccuucaagcaguacugguucaucuucaaggacaccagcaucgccuacuucaagaacaaggagcuggagcagggcgagccccuggagaagcugaaccugagaggcugcgagguggugcccgacgugaacguggccggcagaaaguucggcaucaagcugcugauccccguggccgacggcaugaacgagauguaccugagaugcgaccacgagaaccaguacgcccaguggauggccgccugcaugcuggccagcaagggcaagaccauggccgacagcagcuaccagcccgaggugcugaacauccugagcuuccugagaaugaagaacagaaacagcgccagccagguggccagcagccuggagaacauggacaugaaccccgagugcuucgugagccccagaugcgccaagagacacaagagcaagcagcuggccgccagaauccuggaggcccaccagaacguggcccagaugccccugguggaggccaagcugagauucauccaggccuggcagagccugcccgaguucggccugaccuacuaccuggugagauucaagggcagcaagaaggacgacauccugggcgugagcuacaacagacugaucaagaucgacgccgccaccggcauccccgugaccaccuggagauucaccaacaucaagcaguggaacgugaacugggagaccagacagguggugaucgaguucgaccagaacguguucaccgccuucaccugccugagcgccgacugcaagaucgugcacgaguacaucggcggcuacaucuuccugagcaccagaagcaaggaccagaacgagacccuggacgaggaccuguuccacaagcugaccggcggccaggacuaa

SEQ ID NO: 17047 - RNA, 2064 nt, Artificial Sequence
  FERMT2__Homo_sapiens__NP_001128471
auggcccuggacggcaucagaaugcccgacggcugcuacgccgacggcaccugggagcugagcgugcacgugaccgaccugaacagagacgugacccugagagugaccggcgaggugcacaucggcggcgugaugcugaagcugguggagaagcuggacgugaagaaggacuggagcgaccacgcccuguggugggagaagaagagaaccuggcugcugaagacccacuggacccuggacaaguacggcauccaggccgacgccaagcugcaguucaccccccagcacaagcugcugagacugcagcugcccaacaugaaguacgugaaggugaaggugaacuucagcgacagaguguucaaggccgugagcgacaucugcaagaccuucaacaucagacaccccgaggagcugagccugcugaagaagcccagagaccccaccaagaagaagaagaagaagcuggacgaccagagcgaggacgaggcccuggagcuggagggcccccugaucacccccggcagcggcagcaucuacagcagccccggccuguacagcaagaccaugacccccaccuacgacgcccacgacggcagcccccugagccccaccagcgccugguucggcgacagcgcccugagcgagggcaaccccggcauccuggccgugagccagcccaucaccagccccgagauccuggccaagauguucaagccccaggcccugcuggacaaggccaagaucaaccagggcuggcuggacagcagcagaagccugauggagcaggacgugaaggagaacgaggcccugcugcugagauucaaguacuacagcuucuucgaccugaaccccaaguacgacgccaucagaaucaaccagcuguacgagcaggccaagugggccauccugcuggaggagaucgagugcaccgaggaggagaugaugauguucgccgcccugcaguaccacaucaacaagcugagcaucaugaccagcgagaaccaccugaacaacagcgacaaggagguggacgagguggacgccgcccugagcgaccuggagaucacccuggagggcggcaagaccagcaccauccugggcgacaucaccagcauccccgagcuggccgacuacaucaagguguucaagcccaagaagcugacccugaagggcuacaagcaguacuggugcaccuucaaggacaccagcaucagcugcuacaagagcaaggaggagagcagcggcacccccgcccaccagaugaaccugagaggcugcgaggugacccccgacgugaacaucagcggccagaaguucaacaucaagcugcugauccccguggccgagggcaugaacgagaucuggcugagaugcgacaacgagaagcaguacgcccacuggauggccgccugcagacuggccagcaagggcaagaccauggccgacagcagcuacaaccuggaggugcagaacauccugagcuuccugaagaugcagcaccugaaccccgacccccagcugauccccgagcagaucaccaccgacaucacccccgagugccuggugagccccagauaccugaagaaguacaagaacaagcagcccggcuacaucagagaccugaucaccgccagaauccuggaggcccaccagaacguggcccagaugagccugaucgaggccaagaugagauucauccaggccuggcagagccugcccgaguucggcaucacccacuucaucgccagauuccagggcggcaagaaggaggagcugaucggcaucgccuacaacagacugaucagaauggacgccagcaccggcgacgccaucaagaccuggagauucagcaacaugaagcaguggaacgugaacugggagaucaagauggugaccguggaguucgccgacgaggugagacugagcuucaucugcaccgagguggacugcaagguggugcacgaguucaucggcggcuacaucuuccugagcaccagagccaaggaccagaacgagagccuggacgaggagauguucuacaagcugaccagcggcuggguguaa

SEQ ID NO: 17048 - RNA, 1992 nt, Artificial Sequence
  FERMT3__Homo_sapiens__NP_113659
auggccggcaugaagaccgccagcggcgacuacaucgacagcagcugggagcugagaguguucgugggcgaggaggaccccgaggccgagagcgugacccugagagugaccggcgagagccacaucggcggcgugcugcugaagaucguggagcagaucaacagaaagcaggacuggagcgaccacgccaucuggugggagcagaagagacaguggcugcugcagacccacuggacccuggacaaguacggcauccuggccgacgccagacuguucuucggcccccagcacagacccgugauccugagacugcccaacagaagagcccugagacugagagccagcuucagccagccccuguuccaggccguggccgccaucugcagacugcugagcaucagacaccccgaggagcugagccugcugagagcccccgagaagaaggagaagaagaagaaggagaaggagcccgaggaggagcuguacgaccugagcaagguggugcuggccggcggcguggcccccgcccuguucagaggcaugcccgcccacuucagcgacagcgcccagaccgaggccugcuaccacaugcugagcagaccccagcccccccccgacccccugcugcugcagagacugcccagacccagcagccugagcgacaagacccagcugcacagcagauggcuggacagcagcagaugccugaugcagcagggcaucaaggccggcgacgcccuguggcugagauucaaguacuacagcuucuucgaccuggaccccaagaccgaccccgugagacugacccagcuguacgagcaggccagaugggaccugcugcuggaggagaucgacugcaccgaggaggagaugaugguguucgccgcccugcaguaccacaucaacaagcugagccagagcggcgaggugggcgagcccgccggcaccgaccccggccuggacgaccuggacguggcccugagcaaccuggaggugaagcuggagggcagcgcccccaccgacgugcuggacagccugaccaccauccccgagcugaaggaccaccugagaaucuucagacccagaaagcugacccugaagggcuacagacagcacugggugguguucaaggagaccacccugagcuacuacaagagccaggacgaggcccccggcgaccccauccagcagcugaaccugaagggcugcgagguggugcccgacgugaacgugagcggccagaaguucugcaucaagcugcuggugcccagccccgagggcaugagcgagaucuaccugagaugccaggacgagcagcaguacgccagauggauggccggcugcagacuggccagcaagggcagaaccauggccgacagcagcuacaccagcgaggugcaggccauccuggccuuccugagccugcagagaaccggcagcggcggccccggcaaccacccccacggccccgacgccagcgccgagggccugaaccccuacggccugguggcccccagauuccagagaaaguucaaggccaagcagcugacccccagaauccuggaggcccaccagaacguggcccagcugagccuggccgaggcccagcugagauucauccaggccuggcagagccugcccgacuucggcaucagcuacgugauggugagauucaagggcagcagaaaggacgagauccugggcaucgccaacaacagacugaucagaaucgaccuggccgugggcgacguggugaagaccuggagauucagcaacaugagacaguggaacgugaacugggacaucagacagguggccaucgaguucgacgagcacaucaacguggccuucagcugcgugagcgccagcugcagaaucgugcacgaguacaucggcggcuacaucuuccugagcaccagagagagagccagaggcgaggagcuggacgaggaccuguuccugcagcugaccggcggccacgaggccuucuaa

SEQ ID NO: 17049 - RNA, 2085 nt, Artificial Sequence
  FES__Homo_sapiens__NP_001137257
augggcuucagcagcgagcugugcagcccccagggccacggcgugcugcagcagaugcaggaggccgagcugagacugcuggagggcaugagaaaguggauggcccagagagugaagagcgacagagaguacgccggccugcugcaccacaugagccugcaggacagcggcggccagagcagagccaucagccccgacagccccaucagccagacccacagccaggacaucgagaagcugaagagccaguacagagcccuggccagagacagcgcccaggccaagagaaaguaccaggaggccagcaaggacaaggacagagacaaggccaaggacaaguacgugagaagccuguggaagcuguucgcccaccacaacagauacgugcugggcgugagagccgcccagcugcaccaccagcaccaccaccagcugcugcugcccggccugcugagaagccugcaggaccugcacgaggagauggccugcauccugaaggagauccugcaggaguaccuggagaucagcagccuggugcaggacgaggugguggccauccacagagagauggccgccgccgccgccagaauccagcccgaggccgaguaccagggcuuccugagacaguacggcagcgcccccgacgugccccccugcgugaccuucgacgagagccugcuggaggagggcgagccccuggagcccggcgagcugcagcugaacgagcugaccguggagagcgugcagcacacccugaccagcgugaccgacgagcuggccguggccaccgagaugguguucagaagacaggagauggugacccagcugcagcaggagcugagaaacgaggaggagaacacccaccccagagagagagugcagcugcugggcaagagacaggugcugcaggaggcccugcagggccugcagguggcccugugcagccaggccaagcugcaggcccagcaggagcugcugcagaccaagcuggagcaccugggccccggcgagcccccccccgugcugcugcugcaggacgacagacacagcaccagcagcagcgagcaggagagagagggcggcagaacccccacccuggagauccugaagagccacaucagcggcaucuucagacccaaguucagcaaccuguacagacuggagggcgagggcuuccccagcaucccccugcugaucgaccaccugcugagcacccagcagccccugaccaagaagagcggcguggugcugcacagagccgugcccaaggacaagugggugcugaaccacgaggaccuggugcugggcgagcagaucggcagaggcaacuucggcgagguguucagcggcagacugagagccgacaacacccugguggccgugaagagcugcagagagacccugccccccgaccugaaggccaaguuccugcaggaggccagaauccugaagcaguacagccaccccaacaucgugagacugaucggcgugugcacccagaagcagcccaucuacaucgugauggagcuggugcagggcggcgacuuccugaccuuccugagaaccgagggcgccagacugagagugaagacccugcugcagauggugggcgacgccgccgccggcauggaguaccuggagagcaagugcugcauccacagagaccuggccgccagaaacugccuggugaccgagaagaacgugcugaagaucagcgacuucggcaugagcagagaggaggccgacggcguguacgccgccagcggcggccugagacaggugcccgugaaguggaccgcccccgaggcccugaacuacggcagauacagcagcgagagcgacguguggagcuucggcauccugcugugggagaccuucagccugggcgccagccccuaccccaaccugagcaaccagcagaccagagaguucguggagaagggcggcagacugcccugccccgagcugugccccgacgccguguucagacugauggagcagugcugggccuacgagcccggccagagacccagcuucagcaccaucuaccaggagcugcagagcaucagaaagagacacagauaa

SEQ ID NO: 17050 - RNA, 717 nt, Artificial Sequence
  FEV__Homo_sapiens__NP_059991
augagacagagcggcgccagccagccccugcugaucaacauguaccugcccgaccccgugggcgacggccuguucaaggacggcaagaaccccagcuggggcccccugagccccgccgugcagaagggcagcggccagauccagcuguggcaguuccugcuggagcugcuggccgacagagccaacgccggcugcaucgccugggagggcggccacggcgaguucaagcugaccgaccccgacgagguggccagaagauggggcgagagaaagagcaagcccaacaugaacuacgacaagcugagcagagcccugagauacuacuacgacaagaacaucaugagcaaggugcacggcaagagauacgccuacagauucgacuuccagggccuggcccaggccugccagcccccccccgcccacgcccacgccgccgccgccgccgccgccgccgccgccgccgcccaggacggcgcccuguacaagcugcccgccggccuggccccccugcccuuccccggccugagcaagcugaaccugauggccgccagcgccggcguggcccccgccggcuucagcuacuggcccggccccggccccgccgccaccgccgccgccgccaccgccgcccuguaccccagccccagccugcagcccccccccggccccuucggcgccguggccgccgccagccaccugggcggccacuaccacuaa

SEQ ID NO: 17051 - RNA, 1179 nt, Artificial Sequence
  FEZ1__Homo_sapiens__NP_005094
auggaggccccccuggugagccuggacgaggaguucgaggaccugagacccagcugcagcgaggaccccgaggagaagccccagugcuucuacggcagcagcccccaccaccuggaggaccccagccugagcgagcuggagaacuucagcagcgagaucaucagcuucaagagcauggaggaccuggugaacgaguucgacgagaagcugaacgugugcuucagaaacuacaacgccaagaccgagaaccuggcccccgugaagaaccagcugcagauccaggaggaggaggagacccugcaggacgaggaggugugggacgcccugaccgacaacuacauccccagccugagcgaggacuggagagaccccaacaucgaggcccugaacggcaacugcagcgacaccgagauccacgagaaggaggaggaggaguucaacgagaagagcgagaacgacagcggcaucaacgaggagccccugcugaccgccgaccaggugaucgaggagaucgaggagaugaugcagaacagccccgaccccgaggaggaggaggaggugcuggaggaggaggacggcggcgagaccagcagccaggccgacagcgugcugcugcaggagaugcaggcccugacccagaccuucaacaacaacuggagcuacgagggccugagacacaugagcggcagcgagcugaccgagcugcuggaccagguggagggcgccaucagagacuucagcgaggagcuggugcagcagcuggccagaagagacgagcuggaguucgagaaggaggugaagaacagcuucaucaccgugcugaucgaggugcagaacaagcagaaggagcagagagagcugaugaagaagagaagaaaggagaagggccugagccugcagagcagcagaaucgagaagggcaaccagaugccccugaagagauucagcauggagggcaucagcaacauccugcagagcggcaucagacagaccuucggcagcagcggcaccgacaagcaguaccugaacaccgugauccccuacgagaagaaggccagcccccccagcguggaggaccugcagaugcugaccaacauccuguucgccaugaaggaggacaacgagaaggugcccacccugcugaccgacuacauccugaaggugcugugccccaccuaa

SEQ ID NO: 17052 - RNA, 1143 nt, Artificial Sequence
  FEZ2__Homo_sapiens__NP_001036013
auggccgccgacggcgacuggcaggacuucuacgaguuccaggagcccgccagaagccugcuggaccaggagaacugcaacgccagccccgagcccggcgccgaggccggcgccgaggccggcggcggcgccgacggcuuccccgcccccgccugcagccuggaggagaagcugagccugugcuucagacccagcgaccccggcgccgagccccccagaaccgccgugagacccaucaccgagagaagccugcugcagggcgacgagaucuggaacgcccugaccgacaacuacggcaacgugaugcccguggacuggaagagcagccacaccagaacccugcaccugcugacccugaaccugagcgagaagggcgugagcgacagccugcuguucgacaccagcgacgacgaggagcugagagagcagcuggacaugcacagcaucaucgugagcugcgugaacgacgagccccuguucaccgccgaccaggugaucgaggagaucgaggagaugaugcaggagagccccgaccccgaggacgacgagacccccacccagagcgacagacugagcaugcugagccaggagauccagacccugaagagaagcagcaccggcagcuacgaggagagagugaagagacugagcgugagcgagcugaacgagauccuggaggagaucgagaccgccaucaaggaguacagcgaggagcuggugcagcagcuggcccugagagacgagcuggaguucgagaaggaggugaagaacagcuucaucagcgugcugaucgaggugcagaacaagcagaaggagcacaaggagaccgccaagaagaagaagaagcugaagaacggcagcagccagaacggcaagaacgagagaagccacaugcccggcaccagauucagcauggagggcaucagcaacgugauccagaacggccugagacacaccuucggcaacagcggcggcgagaagcaguaccugaccaccgugauccccuacgagaagaagaacggcccccccagcguggaggaccugcagauccugaccaagauccugagagccaugaaggaggacagcgagaaggugcccagccugcugaccgacuacauccugaaggugcugugccccaccuaa

SEQ ID NO: 17053 - RNA, 1428 nt, Artificial Sequence
  FEZF1__Homo_sapiens__NP_001019784
auggacagcagcugccacaacgccaccaccaagaugcuggccaccgcccccgccagaggcaacaugaugagcaccagcaagccccuggccuucagcaucgagagaaucauggccagaacccccgagcccaaggcccugcccgugccccacuuccugcagggcgcccugcccaagggcgagcccaagcacagccugcaccugaacagcagcauccccugcaugauccccuucgugcccguggccuacgacaccagccccaaggccggcgugaccggcagcgagcccagaaaggccagccuggaggcccccgccgcccccgccgccgugcccagcgcccccgccuucagcugcagcgaccugcugaacugcgcccugagccugaagggcgaccuggccagagacgcccugccccugcagcaguacaagcuggugagacccagaguggugaaccacagcagcuuccacgccaugggcgcccugugcuaccugaacagaggcgacggccccugccaccccgccgccggcgugaacauccaccccguggccagcuacuuccugagcagcccccugcacccccagcccaagaccuaccuggccgagagaaacaagcugguggugcccgccguggagaaguaccccagcggcguggccuucaaggaccugagccaggcccagcugcagcacuacaugaaggagagcgcccagcugcugagcgagaagaucgccuucaagaccagcgacuucagcagaggcagccccaacgccaagcccaagguguucaccugcgaggugugcggcaagguguucaacgcccacuacaaccugaccagacacaugcccgugcacaccggcgccagacccuucgugugcaaggugugcggcaagggcuucagacaggccagcacccugugcagacacaagaucauccacacccaggagaagccccacaagugcaaccagugcggcaaggccuucaacagaagcagcacccugaacacccacaccagaauccacgccggcuacaagcccuucgugugcgaguucugcggcaagggcuuccaccagaagggcaacuacaagaaccacaagcugacccacagcggcgagaagcaguucaagugcaacaucugcaacaaggccuuccaccagguguacaaccugaccuuccacaugcacacccacaacgacaagaagcccuucaccugccccaccugcggcaagggcuucugcagaaacuucgaccugaagaagcacgugagaaagcugcacgacagcagccugggccuggccagaacccccgccggcgagcccggcaccgagcccccccccccccugccccagcagccccccaugacccugcccccccugcagcccccccugcccacccccggcccccugcagcccggccugcaccagggccaccaguaa

SEQ ID NO: 17054 - RNA, 1380 nt, Artificial Sequence
  FEZF2__Homo_sapiens__NP_060478
auggccagcagcgccagccuggagaccauggugccccccgccugccccagagccggcgccagccccgccaccagcaagacccuggccuucagcaucgagagaaucauggccaagaccagcgagcccagagcccccuucgagcccagacccggcgcccuggaggccgacggcagccagggcaagaagcugcugaaccugugcagcccccugcccugcaugaucccccugcagccccugggcuacgaggugcccagcaagacccugcugagcuacagcgagcuguggaagagcagccugagagccggcggcggcggcggcggcggcggcggcggcggcggcggcggcggcggcgcccccgugugcggcgccagcggccugugcaagaccaacugcggcgugugcugcaaggccgagcugggccuggcccccagcgcccugcccgccggcagagugaucaagccccaggugaucaaccaggccgugggccugcccgccagcggcagccuguacuacuucaacuaccuggacagcaccgccuacccccccagcgagcugcugagcggccaccuguuccccagcggccugcugaacgcccaggcccccgccgcccuggccgcccaccccaagcuguuccugcuggagaacgccaagcuggccggccuggccgccgacaaguucccccaccccgcccccuacccccacaaggagagacugcccgccccccuggagcaggugcugaaggagaacagcgcccugaccgccgagagaggcggcgugaagggccacagcaagcugcccggcggcagcgccgacggcaagcccaagaacuucaccugcgaggugugcggcaagguguucaacgcccacuacaaccugaccagacacaugcccgugcacaccggcgccagacccuucgugugcaaggugugcggcaagggcuucagacaggccagcacccugugcagacacaagaucauccacacccaggagaagccccacaagugcaaccagugcggcaaggccuucaacagaagcagcacccugaacacccacaucagaauccacgccggcuacaagcccuucgugugcgaguucugcggcaagggcuuccaccagaagggcaacuacaagaaccacaagcugacccacagcggcgagaagcaguacaagugcaccaucugcaacaaggccuuccaccagguguacaaccugaccuuccacaugcacacccacaacgacaagaagcccuucaccugcgccaccugcggcaagggcuucugcagaaacuucgaccugaagaagcacgugagaaagcugcacgacagcgugggccccgccgcccccagcgccaaggaccugaccagaaccgugcagagcuaa

SEQ ID NO: 17055 - RNA, 903 nt, Artificial Sequence
  FFAR1__Homo_sapiens__NP_005294
auggaccugcccccccagcugagcuucggccuguacguggccgccuucgcccugggcuucccccugaacgugcuggccaucagaggcgccaccgcccacgccagacugagacugacccccagccugguguacgcccugaaccugggcugcagcgaccugcugcugaccgugagccugccccugaaggccguggaggcccuggccagcggcgccuggccccugcccgccagccugugccccguguucgccguggcccacuucuucccccuguacgccggcggcggcuuccuggccgcccugagcgccggcagauaccugggcgccgccuucccccugggcuaccaggccuucagaagacccugcuacagcuggggcgugugcgccgccaucugggcccuggugcugugccaccugggccugguguucggccuggaggcccccggcggcuggcuggaccacagcaacaccagccugggcaucaacacccccgugaacggcagccccgugugccuggaggccugggaccccgccagcgccggccccgccagauucagccugagccugcugcuguucuuccugccccuggccaucaccgccuucugcuacgugggcugccugagagcccuggccagaagcggccugacccacagaagaaagcugagagccgccuggguggccggcggcgcccugcugacccugcugcugugcgugggccccuacaacgccagcaacguggccagcuuccuguaccccaaccugggcggcagcuggagaaagcugggccugaucaccggcgccuggagcguggugcugaacccccuggugaccggcuaccugggcagaggccccggccugaagaccgugugcgccgccagaacccagggcggcaagagccagaaguaa

SEQ ID NO: 17056 - RNA, 993 nt, Artificial Sequence
  FFAR2__Homo_sapiens__NP_005297
augcugcccgacuggaagagcagccugauccugauggccuacaucaucaucuuccugaccggccugcccgccaaccugcuggcccugagagccuucgugggcagaaucagacagccccagcccgcccccgugcacauccugcugcugagccugacccuggccgaccugcugcugcugcugcugcugcccuucaagaucaucgaggccgccagcaacuucagaugguaccugcccaagguggugugcgcccugaccagcuucggcuucuacagcagcaucuacugcagcaccuggcugcuggccggcaucagcaucgagagauaccugggcguggccuuccccgugcaguacaagcugagcagaagaccccuguacggcgugaucgccgcccugguggccugggugaugagcuucggccacugcaccaucgugaucaucgugcaguaccugaacaccaccgagcaggugagaagcggcaacgagaucaccugcuacgagaacuucaccgacaaccagcuggacguggugcugcccgugagacuggagcugugccuggugcuguucuucauccccauggccgugaccaucuucugcuacuggagauucguguggaucaugcugagccagccccuggugggcgcccagagaagaagaagagccgugggccuggccguggugacccugcugaacuuccuggugugcuucggccccuacaacgugagccaccuggugggcuaccaccagagaaagagccccugguggagaagcaucgccgugguguucagcagccugaacgccagccuggacccccugcuguucuacuucagcagcagcguggugagaagagccuucggcagaggccugcaggugcugagaaaccagggcagcagccugcugggcagaagaggcaaggacaccgccgagggcaccaacgaggacagaggcgugggccagggcgagggcaugcccagcagcgacuucaccaccgaguaa

SEQ ID NO: 17057 - RNA, 1041 nt, Artificial Sequence
  FFAR3__Homo_sapiens__NP_005295
auggacaccggccccgaccagagcuacuucagcggcaaccacugguucguguucagcguguaccugcugaccuuccuggugggccugccccugaaccugcuggcccuggugguguucgugggcaagcugcagagaagacccguggccguggacgugcugcugcugaaccugaccgccagcgaccugcugcugcugcuguuccugcccuucagaaugguggaggccgccaacggcaugcacuggccccugcccuucauccugugcccccugagcggcuucaucuucuucaccaccaucuaccugaccgcccuguuccuggccgccgugagcaucgagagauuccugagcguggcccacccccugugguacaagaccagacccagacugggccaggccggccuggugagcguggccugcuggcugcuggccagcgcccacugcagcgugguguacgugaucgaguucagcggcgacaucagccacagccagggcaccaacggcaccugcuaccuggaguucagaaaggaccagcuggccauccugcugcccgugagacuggagauggccguggugcuguucguggugccccugaucaucaccagcuacugcuacagcagacugguguggauccugggcagaggcggcagccacagaagacagagaagaguggccggccugcuggccgccacccugcugaacuuccuggugugcuucggccccuacaacgugagccacguggugggcuacaucugcggcgagagccccgccuggagaaucuacgugacccugcugagcacccugaacagcugcguggaccccuucguguacuacuucagcagcagcggcuuccaggccgacuuccacgagcugcugagaagacugugcggccuguggggccaguggcagcaggagagcagcauggagcugaaggagcagaagggcggcgaggagcagagagccgacagacccgccgagagaaagaccagcgagcacagccagggcugcggcaccggcggccagguggccugcgccgagagcuaa

SEQ ID NO: 17058 - RNA, 1086 nt, Artificial Sequence
  FFAR4__Homo_sapiens__NP_001182684
augagccccgagugcgccagagccgccggcgacgccccccugagaagccuggagcaggccaacagaaccagauuccccuucuucagcgacgugaagggcgaccacagacuggugcuggccgccguggagaccaccgugcuggugcugaucuucgccgugagccugcugggcaacgugugcgcccuggugcugguggccagaagaagaagaagaggcgccaccgccugccuggugcugaaccuguucugcgccgaccugcuguucaucagcgccaucccccuggugcuggccgugagauggaccgaggccuggcugcugggccccguggccugccaccugcuguucuacgugaugacccugagcggcagcgugaccauccugacccuggccgccgugagccuggagagaauggugugcaucgugcaccugcagagaggcgugagaggccccggcagaagagccagagccgugcugcuggcccugaucuggggcuacagcgccguggccgcccugccccugugcguguucuucagaguggugccccagagacugcccggcgccgaccaggagaucagcaucugcacccugaucuggcccaccauccccggcgagaucagcugggacgugagcuucgugacccugaacuuccuggugcccggccuggugaucgugaucagcuacagcaagauccugcagaucaccaaggccagcagaaagagacugaccgugagccuggccuacagcgagagccaccagaucagagugagccagcaggacuucagacuguucagaacccuguuccugcugauggugagcuucuucaucauguggagccccaucaucaucaccauccugcugauccugauccagaacuucaagcaggaccuggugaucuggcccagccuguucuucugggugguggccuucaccuucgccaacagcgcccugaaccccauccuguacaacaugacccugugcagaaacgaguggaagaagaucuucugcugcuucugguuccccgagaagggcgccauccugaccgacaccagcgugaagagaaacgaccugagcaucaucagcggcuaa

SEQ ID NO: 17059 - RNA, 2601 nt, Artificial Sequence
  FGA__Homo_sapiens__NP_000499
auguucagcaugagaaucgugugccuggugcugagcguggugggcaccgccuggaccgccgacagcggcgagggcgacuuccuggccgagggcggcggcgugagaggccccagagugguggagagacaccagagcgccugcaaggacagcgacuggcccuucugcagcgacgaggacuggaacuacaagugccccagcggcugcagaaugaagggccugaucgacgaggugaaccaggacuucaccaacagaaucaacaagcugaagaacagccuguucgaguaccagaagaacaacaaggacagccacagccugaccaccaacaucauggagauccugagaggcgacuucagcagcgccaacaacagagacaacaccuacaacagagugagcgaggaccugagaagcagaaucgaggugcugaagagaaaggugaucgagaaggugcagcacauccagcugcugcagaagaacgugagagcccagcugguggacaugaagagacuggagguggacaucgacaucaagaucagaagcugcagaggcagcugcagcagagcccuggccagagagguggaccugaaggacuacgaggaccagcagaagcagcuggagcaggugaucgccaaggaccugcugcccagcagagacagacagcaccugccccugaucaagaugaagcccgugcccgaccuggugcccggcaacuucaagagccagcugcagaaggugccccccgaguggaaggcccugaccgacaugccccagaugagaauggagcuggagagacccggcggcaacgagaucaccagaggcggcagcaccagcuacggcaccggcagcgagaccgagagccccagaaaccccagcagcgccggcagcuggaacagcggcagcagcggccccggcagcaccggcaacagaaaccccggcagcagcggcaccggcggcaccgccaccuggaagcccggcagcagcggccccggcagcaccggcagcuggaacagcggcagcagcggcaccggcagcaccggcaaccagaaccccggcagccccagacccggcagcaccggcaccuggaaccccggcagcagcgagagaggcagcgccggccacuggaccagcgagagcagcgugagcggcagcaccggccaguggcacagcgagagcggcagcuucagacccgacagccccggcagcggcaacgccagacccaacaaccccgacuggggcaccuucgaggaggugagcggcaacgugagccccggcaccagaagagaguaccacaccgagaagcuggugaccagcaagggcgacaaggagcugagaaccggcaaggagaaggugaccagcggcagcaccaccaccaccagaagaagcugcagcaagaccgugaccaagaccgugaucggccccgacggccacaaggaggugaccaaggagguggugaccagcgaggacggcagcgacugccccgaggccauggaccugggcacccugagcggcaucggcacccuggacggcuucagacacagacaccccgacgaggccgccuucuucgacaccgccagcaccggcaagaccuuccccggcuucuucagccccaugcugggcgaguucgugagcgagaccgagagcagaggcagcgagagcggcaucuucaccaacaccaaggagagcagcagccaccaccccggcaucgccgaguuccccagcagaggcaagagcagcagcuacagcaagcaguucaccagcagcaccagcuacaacagaggcgacagcaccuucgagagcaagagcuacaagauggccgacgaggccggcagcgaggccgaccacgagggcacccacagcaccaagagaggccacgccaagagcagacccgugagagacugcgacgacgugcugcagacccaccccagcggcacccagagcggcaucuucaacaucaagcugcccggcagcagcaagaucuucagcguguacugcgaccaggagaccagccugggcggcuggcugcugauccagcagagaauggacggcagccugaacuucaacagaaccuggcaggacuacaagagaggcuucggcagccugaacgacgagggcgagggcgaguucuggcugggcaacgacuaccugcaccugcugacccagagaggcagcgugcugagaguggagcuggaggacugggccggcaacgaggccuacgccgaguaccacuucagagugggcagcgaggccgagggcuacgcccugcaggugagcagcuacgagggcaccgccggcgacgcccugaucgagggcagcguggaggagggcgccgaguacaccagccacaacaacaugcaguucagcaccuucgacagagacgccgaccagugggaggagaacugcgccgagguguacggcggcggcuggugguacaacaacugccaggccgccaaccugaacggcaucuacuaccccggcggcagcuacgaccccagaaacaacagccccuacgagaucgagaacggcguggugugggugagcuucagaggcgccgacuacagccugagagccgugagaaugaagaucagaccccuggugacccaguaa

SEQ ID NO: 17060 - RNA, 1476 nt, Artificial Sequence
  FGB__Homo_sapiens__NP_005132
augaagagaauggugagcuggagcuuccacaagcugaagaccaugaagcaccugcugcugcugcugcugugcguguuccuggugaagagccagggcgugaacgacaacgaggagggcuucuucagcgccagaggccacagaccccuggacaagaagagagaggaggcccccagccugagacccgcccccccccccaucagcggcggcggcuacagagccagacccgccaaggccgccgccacccagaagaagguggagagaaaggcccccgacgccggcggcugccugcacgccgaccccgaccugggcgugcugugccccaccggcugccagcugcaggaggcccugcugcagcaggagagacccaucagaaacagcguggacgagcugaacaacaacguggaggccgugagccagaccagcagcagcagcuuccaguacauguaccugcugaaggaccuguggcagaagagacagaagcaggugaaggacaacgagaacguggugaacgaguacagcagcgagcuggagaagcaccagcuguacaucgacgagaccgugaacagcaacauccccaccaaccugagagugcugagaagcauccuggagaaccugagaagcaagauccagaagcuggagagcgacgugagcgcccagauggaguacugcagaacccccugcaccgugagcugcaacauccccguggugagcggcaaggagugcgaggagaucaucagaaagggcggcgagaccagcgagauguaccugauccagcccgacagcagcgugaagcccuacagaguguacugcgacaugaacaccgagaacggcggcuggaccgugauccagaacagacaggacggcagcguggacuucggcagaaagugggaccccuacaagcagggcuucggcaacguggccaccaacaccgacggcaagaacuacugcggccugcccggcgaguacuggcugggcaacgacaagaucagccagcugaccagaaugggccccaccgagcugcugaucgagauggaggacuggaagggcgacaaggugaaggcccacuacggcggcuucaccgugcagaacgaggccaacaaguaccagaucagcgugaacaaguacagaggcaccgccggcaacgcccugauggacggcgccagccagcugaugggcgagaacagaaccaugaccauccacaacggcauguucuucagcaccuacgacagagacaacgacggcuggcugaccagcgaccccagaaagcagugcagcaaggaggacggcggcggcuggugguacaacagaugccacgccgccaaccccaacggcagauacuacuggggcggccaguacaccugggacauggccaagcacggcaccgacgacggcgugguguggaugaacuggaagggcagcugguacagcaugagaaagaugagcaugaagaucagacccuucuucccccagcaguaa

SEQ ID NO: 17061 - RNA, 2886 nt, Artificial Sequence
  FGD1__Homo_sapiens__NP_004454
augcacggccacagagcccccggcggcgccggccccagcgagcccgagcaccccgccaccaacccccccggcgccgccccccccgccugcgccgacagcgaccccggcgccagcgagcccggccugcuggccagaagaggcagcggcagcgcccugggcggcccccuggacccccaguucgugggccccagcgacaccagccugggcgccgcccccggccacagagugcugcccugcggccccagcccccagcaccacagagcccugagauucagcuaccaccuggagggcagccagcccagacccggccugcaccagggcaacagaauccuggugaagagccugagccuggaccccggccagagccuggagccccaccccgagggcccccagagacugagaagcgaccccggcccccccaccgagacccccagccagagacccagcccccugaagagagcccccggccccaagccccaggugccccccaagcccagcuaccugcagaugcccagaaugccccccccccuggagcccaucccccccccccccagcagaccccugcccgccgaccccagaguggccaagggccuggcccccagagccgaggccagccccagcagcgccgccgugagcagccugaucgagaaguucgagagagagcccgugaucguggccagcgacagacccgugcccggccccagccccggcccccccgagcccgugaugcugccccagcccaccagccagccccccgugccccagcugcccgagggcgaggccagcagaugccuguuccugcuggcccccggccccagagacggcgagaaggugcccaacagagacagcggcaucgacagcaucagcagccccagcaacagcgaggagaccugcuucgugagcgacgacggcccccccagccacagccugugccccggcccccccgcccuggccagcgugcccguggcccuggccgacccccacagacccggcagccaggagguggacagcgaccuggaggaggaggacgacgaggaggaggaggaggagaaggacagagagauccccgugccccugauggagagacaggagagcguggagcugaccgugcagcagaagguguuccacaucgccaacgagcugcugcagaccgagaaggccuacgugagcagacugcaccugcuggaccagguguucugcgccagacugcuggaggaggccagaaacagaagcagcuuccccgccgacguggugcacggcaucuucagcaacaucugcagcaucuacugcuuccaccagcaguuccugcugcccgagcuggagaagagaauggaggagugggacagauaccccagaaucggcgacauccugcagaagcuggcccccuuccugaagauguacggcgaguacgugaagaacuucgacagagccguggagcuggugaacaccuggaccgagagaagcacccaguucaaggugaucauccacgaggugcagaaggaggaggccugcggcaaccugacccugcagcaccacaugcuggagcccgugcagagaauccccagauacgagcugcugcugaaggacuaccugcugaagcugccccacggcagccccgacagcaaggacgcccagaagagccuggagcugaucgccaccgccgccgagcacagcaacgccgccaucagaaagauggagagaaugcacaagcugcugaagguguacgagcugcugggcggcgaggaggacaucgugagccccaccaaggagcugaucaaggagggccacauccugaagcugagcgccaagaacggcaccacccaggacagauaccugauccuguucaacgacagacugcuguacugcgugcccagacugagacugcugggccagaaguucagcgugagagccagaaucgacguggacggcauggagcugaaggagagcagcaaccugaaccugcccagaaccuuccuggugagcggcaagcagagaagccuggagcugcaggccagaaccgaggaggagaagaaggacugggugcaggccaucaacagcacccugcugaagcacgagcagacccuggagaccuucaagcugcugaacagcaccaacagagaggacgaggacaccccccccaacagccccaacguggaccugggcaagagagcccccacccccaucagagagaaggaggugaccaugugcaugagaugccaggagcccuucaacagcaucaccaagagaagacaccacugcaaggccugcggccacguggugugcggcaagugcagcgaguucagagccagacugguguacgacaacaacagaagcaacagagugugcaccgacugcuacguggcccugcacggcgugcccggcagcagccccgccugcagccagcacaccccccagagaagaagaagcauccuggagaagcaggccagcguggccgccgagaacagcgugaucugcagcuuccugcacuacauggagaagggcggcaagggcuggcacaaggccugguucguggugcccgagaacgagccccuggugcuguacaucuacggcgccccccaggacgugaaggcccagagaagccugccccugaucggcuucgaggugggcccccccgaggccggcgagagacccgacagaagacacguguucaagaucacccagagccaccugagcugguacuucagccccgagaccgaggagcugcagagaagauggauggccgugcugggcagagccggcagaggcgacaccuucugccccggccccacccugagcgaggacagagagauggaggaggcccccguggccgcccugggcgccaccgccgagccccccgagagcccccagaccagagacaagaccuaa

SEQ ID NO: 17062 - RNA, 1968 nt, Artificial Sequence
  FGD2__Homo_sapiens__NP_775829
augaagggcgccagcgaggagaagcuggccagcgugagcaaccuggugaccguguucgagaacagcagaacccccgaggccgcccccagaggccagagacuggaggacgugcaccacagacccgagugcagaccccccgagagccccggccccagagagaagaccaacgugggcgaggccgugggcagcgagcccagaaccgugagcagaagauaccugaacagccugaagaacaagcugagcagcgaggccuggagaaagagcugccagcccgugacccugagcggcagcggcacccaggagcccgagaagaagaucgugcaggagcugcuggagaccgagcaggccuacguggccagacugcaccugcuggaccagguguucuuccaggagcugcugaagaccgccagaagcagcaaggccuuccccgaggacguggugagagugaucuucagcaacaucagcagcaucuaccaguuccacagccaguucuuccugcccgagcugcagagaagacuggacgacuggaccgccaaccccagaaucggcgacgugauccagaagcuggcccccuuccugaagauguacagcgaguacgugaagaacuucgagagagccgccgagcugcuggccaccuggaccgacaagagcccccuguuccaggaggugcugaccagaauccagagcagcgaggccagcggcagccugacccugcagcaccacaugcuggagcccgugcagagaauccccagauacgagcugcugcugaaggaguacauccagaagcugcccgcccaggcccccgaccaggccgacgcccagaaggcccuggacaugaucuucagcgccgcccagcacagcaacgccgccaucaccgagauggagagacugcaggaccugugggagguguaccagagacugggccuggaggacgacaucguggaccccagcaacacccugcugagagagggccccgugcugaagaucagcuucagaagaaacgaccccauggagagauaccuguuccuguucaacaacaugcugcuguacugcgugcccagagugauccaggugggcgcccaguuccaggugagaaccagaaucgacguggccggcaugaaggugagagagcugauggacgccgaguucccccacagcuuccuggugagcggcaagcagagaacccuggagcugcaggccagaagccaggaggagaugaucagcuggaugcaggccuuccaggccgccaucgaccagaucgagaagagaaacgagaccuucaaggccgccgcccagggccccgagggcgacauccaggagcaggagcugcagagcgaggagcugggccugagagccccccagugggugagagacaagauggugaccaugugcaugagaugccaggagcccuucaacgcccugaccagaagaagacaccacugcagagccugcggcuacguggugugcgccagaugcagcgacuacagagccgagcugaaguacgacgacaacagacccaacagagugugccugcacugcuacgccuuccugaccggcaacgugcugcccgaggccaaggaggacaagagaagaggcauccuggagaagggcagcagcgccacccccgaccagagccugaugugcagcuuccugcagcugaucggcgacaaguggggcaagagcggccccagaggcuggugcgugauccccagagacgacccccuggugcuguacguguacgccgccccccaggacaugagagcccacaccagcaucccccugcugggcuaccaggugaccgugggcccccagggcgaccccagaguguuccagcugcagcagagcggccagcuguacaccuucaaggccgagaccgaggagcugaagggcagaugggugaaggccauggagagagccgccagcggcuggagccccagcuggcccaacgacggcgaccugagcgacuaa

SEQ ID NO: 17063 - RNA, 2178 nt, Artificial Sequence
  FGD3__Homo_sapiens__NP_001077005
auggagagcggcagaggcagcagcaccccccccggccccaucgccgcccugggcaugcccgacaccggccccggcagcagcagccugggcaagcugcaggcccugcccgugggccccagagcccacugcggcgaccccgugagccuggccgccgccggcgacggcagccccgacaucggccccaccggcgagcugagcggcagccugaagauccccaacagagacagcggcaucgacagccccagcagcagcguggccggcgagaacuuccccugcgaggagggccuggaggccggccccagccccaccgugcugggcgcccacgccgagauggcccuggacagccaggugcccaaggugaccccccaggaggaggccgacagcgacgugggcgaggagcccgacagcgagaacaccccccagaaggccgacaaggacgccggccuggcccagcacagcggcccccagaagcugcugcacaucgcccaggagcugcugcacaccgaggagaccuacgugaagagacugcaccugcuggaccagguguucugcaccagacugaccgacgccggcaucccccccgaggugaucaugggcaucuucagcaacaucagcagcauccacagauuccacggccaguuccugcugcccgagcugaagaccagaaucaccgaggagugggacaccaaccccagacugggcgacauccugcagaagcuggcccccuuccugaagauguacggcgaguacgugaagaacuucgacagagccgugggccuggugagcaccuggacccagagaagcccccuguucaaggacguggugcacagcauccagaagcaggaggugugcggcaaccugacccugcagcaccacaugcuggagcccgugcagagagugcccagauacgagcugcugcugaaggacuaccugaagagacugccccaggacgcccccgacagaaaggacgccgagagaagccuggagcugaucagcaccgccgccaaccacagcaacgccgccaucagaaagguggagaagaugcacaagcugcuggagguguacgagcagcugggcggcgaggaggacaucgugaaccccgccaacgagcugaucaaggagggccagauccagaagcugagcgccaagaacggcaccccccaggacagacaccuguuccuguucaacagcaugauccuguacugcgugcccaagcugagacugaugggccagaaguucagcgugagagagaagauggacaucagcggccugcaggugcaggacaucgugaagcccaacaccgcccacaccuucaucaucaccggcagaaagagaagccuggagcugcagaccagaaccgaggaggagaagaaggaguggauccagaucauccaggccaccaucgagaagcacaagcagaacagcgagaccuucaaggccuucggcggcgccuucagccaggacgaggaccccagccugagccccgacaugcccaucaccagcaccagccccguggagcccguggugaccaccgagggcagcagcggcgccgccggccuggagcccagaaagcugagcagcaagaccagaagagacaaggagaagcagagcugcaagagcugcggcgagaccuucaacagcaucaccaagagaagacaccacugcaagcugugcggcgccgugaucugcggcaagugcagcgaguucaaggccgagaacagcagacagagcagagugugcagagacugcuuccugacccagcccguggcccccgagagcaccgagaagacccccaccgccgacccccagcccagccugcugugcggcccccugagacugagcgagagcggcgagaccuggagcgaggugugggccgccauccccaugagcgacccccaggugcugcaccugcagggcggcagccaggacggcagacugcccagaaccaucccccugcccagcugcaagcugagcgugcccgaccccgaggagagacuggacagcggccacguguggaagcugcagugggccaagcagagcugguaccugagcgccagcagcgccgagcugcagcagcaguggcuggagacccugagcaccgccgcccacggcgacaccgcccaggacagccccggcgcccugcagcugcaggugcccaugggcgccgccgcccccuaa

SEQ ID NO: 17064 - RNA, 2637 nt, Artificial Sequence
  FGD4__Homo_sapiens__NP_001291409
augaacuucaagagagugaagcccaacaucuuccugcugaaccagagcagacugaucaucagcaucugcgagaucaugagcaccgaccagggcagcagcaccugccccaagaucgcccuggugccccccugcagcaccagcagcaccaccacccuggugggcgagaacgugagcgaggaggaggcccagggcaucaacggcaacagacccgccaagcacagcgccgccagccccaagccccaggugccccccaagccccugcaccugcagaacagccccagcagcaacauccaccagacccccagacacaaggcccugcccagcgccaagcccagaauggaggagaucaagcccgccagcgccagcugcgugagcaaggagaagcccagcaaggugagcgaccugaucagcagauucgagggcggcagcagccugagcaacuacagcgaccugaagaaggagagcgccgugaaccugaacgcccccagaacccccggcagacacggccugaccaccaccccccagcagaagcugcugagccagcaccugccccagagacagggcaacgacaccgacaagacccagggcgcccagaccugcguggccaacggcgugauggccgcccagaaccagauggagugcgaggaggagaaggccgccacccugagcagcgacaccagcauccaggccagcgagccccugcuggacacccacaucgugaacggcgagagagacgagaccgccaccgcccccgccagccccaccaccgacagcugcgacggcaacgccagcgacagcagcuacagaacccccggcaucggccccgugcugccccuggaggagagaggcgccgagaccgagaccaaggugcaggagagagagaacggcgagagcccccuggagcuggagcagcuggaccagcaccacgagaugaaggagaccaacgagcagaagcugcacaagaucgccaacgagcugcugcugaccgagagagccuacgugaacagacuggaccugcuggaccagguguucuacugcaagcugcuggaggaggccaacagaggcagcuuccccgccgagauggugaacaagaucuucagcaacaucagcagcaucaacgccuuccacagcaaguuccugcugcccgagcuggagaagagaaugcaggagugggagaccacccccagaaucggcgacauccugcagaagcuggcccccuuccugaagauguacggcgaguacgugaagggcuucgacaacgccauggagcuggugaagaacaugaccgagagaaucccccaguucaagagcgugguggaggagauccagaagcagaagaucugcggcagccugacccugcagcaccacaugcuggagcccgugcagagaauccccagauacgagaugcugcugaaggacuaccugagaaagcugccccccgacagccuggacuggaacgacgccaagaagagccuggagaucaucagcaccgccgccagccacagcaacagcgccaucagaaagauggagaaccugaagaagcugcuggagaucuacgagaugcugggcgaggaggaggacaucgugaaccccagcaacgagcugaucaaggagggccagauccugaagcuggccgccagaaacaccagcgcccaggagagauaccuguuccuguucaacaacaugcugcuguacugcgugcccaaguucagccuggugggcagcaaguucaccgugagaaccagagugggcaucgacggcaugaagaucguggagacccagaacgaggaguacccccacaccuuccaggugagcggcaaggagagaacccuggagcugcaggccagcagcgcccaggacaaggaggaguggaucaaggcccugcaggagaccaucgacgccuuccaccagagacacgagaccuucagaaacgccaucgccaaggacaacgacauccacagcgaggugagcaccgccgagcugggcaagagagcccccagauggaucagagacaacgaggugaccaugugcaugaagugcaaggagcccuucaacgcccugaccagaagaagacaccacugcagagccugcggcuacguggugugcuggaagugcagcgacuacaaggcccagcuggaguacgacggcggcaagcugagcaaggugugcaaggacugcuaccagaucaucagcggcuucaccgacagcgaggagaagaagagaaagggcauccuggagaucgagagcgccgaggugagcggcaacagcguggugugcagcuuccugcaguacauggagaagagcaagcccuggcagaaggccuggugcgugauccccaagcaggacccccuggugcuguacauguacggcgccccccaggacgugagagcccaggccaccaucccccugcugggcuacgugguggacgagaugcccagaagcgccgaccugccccacagcuucaagcugacccagagcaagagcgugcacagcuucgccgccgacagcgaggagcugaagcagaaguggcugaaggugauccugcuggccgugaccggcgagacccccggcggccccaacgagcaccccgccacccuggacgaccaccccgagcccaagaagaagagcgagugcuaa

SEQ ID NO: 17065 - RNA, 4389 nt, Artificial Sequence
  FGD5__Homo_sapiens__NP_689749
auguucagaggccccaagccccccaucgcccccaagcccagacugaccgcccccaacgaguggagagccagcguguaccugaacgacagccugaacaagugcagcaacggcagacugcccugcguggacagaggccuggacgagggccccagaagcauccccaagugcagcgagagcgagaccgacgaggacuacaucguggugcccagagugccccugagagaggacgagcccaaggacgagggcagcgugggcaacaaggcccuggugagccccgagagcagcgccgaggaggaggaggagagagaggagggcggcgaggccugcggccuggagggcaccggcgccggcgaggacagcguggcccccgccgcccccggcgccggcgcccugagcagagagggcgaggagggcaccgaccuggcccuggaggacgagggcgagggcugcgccgacgagcccggcacccuggagcaggugagcagaagcgaggaggaggagaagcuggugcagccccacagagagugcagccuggaggacagcggccccugggccggcgagggcguguuccagagcgaccugcugcugccccacauccacggcgaggaccaggagccccccgacacccccggcgaggccgaggaggacgacgaggagggcugcgccagcaccgaccccgccggcgccgacgagggcagcggccccgacagacccaccgaggacaugggccaggacgccgaggacaccagcgaggagccccccgagaaggaggagcuggccggcgugcaggaggccgagaccgccaccgacugccccgaggugcuggaggagggcugcgaggaggccaccggcgugaccggcggcgagcagguggaccugagcgagccccccgaccacgagaagaagaccaaccaggagguggccgccgccacccuggaggaccacgcccaggacgagagcgccgaggagagcugccagaucgugcccuucgagaacgacugcauggaggacuucgugaccagccugaccggcagccccuacgaguucuuccccaccgagagcaccagcuucugcagcgagagcugcagcccccugagcgagagcgccaagggccuggagagcgagcaggcccccaagcugggccugagagccgaggagaaccccauggugggcgcccugugcggccagugcggcagccugcagggcggcgccgccgagggccccgccgcccccgacguggugguggugcuggaggaggaggcccuggacgacgcccuggccaaccccuacgugaugggcgugggccugcccggccaggccgcccccggcgagggcggccaggccgccagcgacgcccugggcggcuacggcagcaaggaggagcugaacugcgaggccgagggcggccuggugcccgccgacagaaagaacaccagcaccagagugagaccccacagcggcaagguggccggcuacgugcccgagaccgugcccgaggagaccggccccgaggccggcagcagcgcccccggcaucggcggcgccgccgaggaggugggcaagacccugcugagccuggagggcaagccccuggaggccagcagagcccugcccgccaagcccagagccuucacccuguaccccagaagcuucagcguggagggcagagagauccccgugagcguguaccaggagcccgagggcagcggccuggacgaccacagaaucaagagaaaggaggacaaccugagccugagcugcgugaucggcagcagcggcagcuucagccagagaaaccaccugcccagcagcggcaccagcacccccagcagcaugguggacauccccccccccuucgaccuggccugcaucaccaagaagcccaucaccaagagcagccccagccugcugaucgagagcgacagccccgacaaguacaagaagaagaagagcagcuucaagagauuccuggcccugaccuucaagaagaagaccgagaacaagcugcacguggacgugaacgugagcagcagcagaagcagcagcgagagcagcuaccacggccccagcagaauccuggagguggacagaagaagccugagcaacagcccccagcugaagagcagaaccggcaagcugagagccagcgagagccccagcagccugaucuucuacagagacggcaagagaaagggcgugcccuucagcagaaccgugagcagaguggagagcuucgaggacagaagcagaccccccuuccugccccugccccugaccaagcccagaagcaucagcuuccccagcgccgacaccagcgacuacgagaacauccccgccaugaacagcgacuacgagaacauccagaucccccccagaagacccgccagagccggcgccuucaccaagcuguucgaggaccagagcagagcccugagcaccgccaacgagaacgacggcuacguggacaugagcagcuucaacgccuucgagagcaagcagcagagcgccgaccaggacgccgagagcgccuacaccgagcccuacaaggugugccccaucagcagcgccgcccccaaggaggaccugaccagcgacgaggagcagagaagcagcgaggaggaggacagcgccagcagagaccccagcgugacccacaagguggagggccagagcagagcccuggugaucgcccaggagcugcugagcagcgagaaggccuacguggagaugcugcagcaccugaaccuggacuuccacggcgccgugaugagagcccuggacgacauggaccacgagggcagagacacccuggccagagaggagcugagacagggccugagcgagcugcccgccauccacgaccugcaccagggcauccuggaggagcuggaggagagacugagcaacugggagagccagcagaagguggccgacguguuccuggccagagagcagggcuucgaccaccacgccacccacauccugcaguucgacagauaccugggccugcugagcgagaacugccugcacagccccagacuggccgccgccgugagagaguucgagcagagcgugcagggcggcagccagaccgccaagcacagacugcugagaguggugcagagacuguuccaguaccaggugcugcugaccgacuaccugaacaaccugugccccgacagcgccgaguacgacaacacccagggcgcccugagccugaucagcaaggugaccgacagagccaacgacagcauggagcagggcgagaaccugcagaagcuggugcacaucgagcacagcgugagaggccagggcgaccugcugcagcccggcagagaguuccugaaggagggcacccugaugaaggugaccggcaagaacagaagacccagacaccuguuccugaugaacgacgugcugcuguacaccuacccccagaaggacggcaaguacagacugaagaacacccuggccguggccaacaugaaggugagcagacccgugauggagaaggugcccuacgcccugaagaucgagaccagcgagagcugccugaugcugagcgccagcagcugcgccgagagagacgagugguacggcugccugagcagagcccugcccgaggacuacaaggcccaggcccuggccgccuuccaccacagcguggagaucagagagagacugggcgugagccugggcgagagaccccccacccuggugcccgugacccacgugaugaugugcaugaacugcggcugcgacuucagccugacccugagaagacaccacugccacgccugcggcaagaucgugugcagaaacugcagcagaaacaaguacccccugaaguaccugaaggacagaauggccaaggugugcgacggcugcuucggcgagcugaagaagagaggcagagccgugcccggccugaugagagagagacccgugagcaugagcuucccccugagcagccccagauucagcggcagcgccuucagcagcguguuccagagcaucaaccccagcaccuucaagaagcagaagaaggugcccagcgcccugaccgagguggccgccagcggcgagggcagcgccaucagcggcuaccugagcagaugcaagagaggcaagagacacuggaagaagcugugguucgugaucaagggcaaggugcuguacaccuacauggccagcgaggacaagguggcccuggagagcaugccccugcugggcuucaccaucgcccccgagaaggaggagggcagcagcgaggugggccccaucuuccaccuguaccacaagaagacccuguucuacagcuucaaggccgaggacaccaacagcgcccagagauggaucgaggccauggaggacgccagcgugcuguaa

SEQ ID NO: 17066 - RNA, 4293 nt, Artificial Sequence
  FGD6__Homo_sapiens__NP_060821
augaccagcgccgccgagaucaagaagccccccguggcccccaagcccaaguucgugguggccaacaacaagcccgcccccccccccaucgcccccaagcccgacaucgugaucagcagcgugccccagagcaccaagaagaugaagcccgccaucgcccccaagcccaaggugcugaagaccagccccgugagagagaucggccagagccccagcagaaagaucaugcugaaccuggagggccacaagcaggagcuggccgagagcaccgacaacuucaacugcaaguacgagggcaaccagagcaacgacuacaucagccccaugugcagcugcagcagcgagugcauccacaagcugggccacagagagaaccugugcgugaagcagcuggugcuggagccccuggagaugaacgagaaccuggagaacagcaagaucgacgagacccugaccaucaagaccagaagcaagugcgaccuguacggcgagaaggccaagaaccagggcggcguggugcugaaggccagcgugcuggaggaggagcugaaggacgcccugauccaccagaugccccccuucaucagcgcccagaagcacagacccaccgacagccccgagaugaacggcggcugcaacagcaacggccaguucagaaucgaguucgccgaccugagccccagccccagcagcuucgagaaggugcccgaccaccacagcugccaccugcagcugcccagcgacgagugcgagcacuucgagaccugccaggacgacagcgagaagagcaacaacugcuuccagagcagcgagcuggaggcccuggagaacggcaagagaagcacccugaucagcagcgacggcgugagcaagaagagcgaggugaaggaccugggcccccuggagauccaccuggugcccuacacccccaaguuccccacccccaagcccagaaagaccagaaccgccagacugcugagacagaagugcguggacacccccagcgagagcaccgaggagcccggcaacagcgacagcagcagcagcugccugaccgagaacagccugaagaucaacaagaucagcgugcugcaccagaacgugcugugcaagcaggagcagguggacaagaugaagcugggcaacaagagcgagcugaacauggagagcaacagcgacgcccaggaccuggugaacagccagaaggccaugugcaacgagaccaccagcuucgagaagauggcccccagcuucgacaaggacagcaaccugagcagcgacagcaccaccguggacggcagcagcaugagccuggccguggacgagggcaccggcuucaucagaugcaccgugagcaugagccugcccaagcagcugaagcugaccugcaacgagcaccugcagagcggcagaaaccugggcgugagcgccccccagaugcagaaggagagcgugaucaaggaggagaacagccugagaaucgugcccaagaagccccagagacacagccugcccgccaccggcgugcugaagaaggccgccagcgaggagcugcuggagaagagcagcuaccccagcagcgaggagaagagcagcgagaagagccuggagagaaaccaccugcagcaccugugcgcccagaacagaggcgugagcagcagcuucgacaugcccaagagagccagcgagaagcccguguggaagcugccccaccccauccugcccuucagcggcaaccccgaguuccugaagagcgugaccgugagcagcaacagcgagcccagcaccgcccugaccaagcccagagccaagagccugagcgccauggacguggagaagugcaccaagcccugcaaggacagcaccaagaagaacagcuucaagaagcugcugagcaugaagcugagcaucugcuucaugaagagcgacuuccagaaguucuggagcaagagcagccagcugggcgacaccaccaccggccaccugagcagcggcgagcagaagggcaucgagagcgacuggcagggccugcuggugggcgaggagaagagaagcaagcccaucaaggccuacagcaccgagaacuacagccuggagagccagaagaagagaaagaagagcagaggccagaccagcgccgccaacggccugagagccgagagccuggacgaccagaugcugagcagagagagcagcagccaggcccccuacaagagcgugaccagccugugcgcccccgaguacgagaacaucagacacuacgaggagauccccgaguacgagaaccugcccuucaucauggccaucagaaagacccaggagcuggaguggcagaacagcagcagcauggaggacgccgacgccaacguguacgagguggaggagcccuacgaggcccccgacggccagcugcagcugggccccagacaccagcacagcagcagcggcgccagccaggaggagcagaacgaccugggccugggcgaccugcccagcgacgaggaggagaucaucaacagcagcgacgaggacgacgugagcagcgagagcagcaagggcgagcccgacccccuggaggacaagcaggacgaggacaacggcaugaagagcaaggugcaccacaucgccaaggagaucaugagcagcgagaagguguucguggacgugcugaagcugcugcacaucgacuucagagacgccguggcccacgccagcagacagcugggcaagcccgugaucgaggacagaauccugaaccagauccuguacuaccugccccagcuguacgagcugaacagagaccugcugaaggagcuggaggagagaaugcugcacuggaccgagcagcagagaaucgccgacaucuucgugaagaagggccccuaccugaagauguacagcaccuacaucaaggaguucgacaagaacaucgcccugcuggacgagcagugcaagaagaaccccggcuucgccgccguggugagagaguucgagaugagccccagaugcgccaaccuggcccugaagcacuaccugcugaagcccgugcagagaaucccccaguacagacugcugcugaccgacuaccugaagaaccugaucgaggacgccggcgacuacagagacacccaggacgcccuggccguggugaucgagguggccaaccacgccaacgacaccaugaagcagggcgacaacuuccagaagcugaugcagauccaguacagccugaacggccaccacgagaucgugcagcccggcagaguguuccugaaggagggcauccugaugaagcugagcagaaaggugaugcagcccagaauguucuuccuguucaacgacgcccugcuguacaccacccccgugcagagcggcauguacaagcugaacaacaugcugagccuggccggcaugaaggugagaaagcccacccaggaggccuaccagaacgagcugaagaucgagagcguggagagaagcuucauccugagcgccagcagcgccaccgagagagacgaguggcuggaggccaucagcagagccaucgaggaguacgccaagaagagaaucaccuucugccccagcagaagccuggacgaggccgacagcgagaacaaggaggaggugagcccccugggcagcaaggcccccaucuggauccccgacaccagagccaccaugugcaugaucugcaccagcgaguucacccugaccuggagaagacaccacugcagagccugcggcaagaucgugugccaggccugcagcagcaacaaguacggccuggacuaccugaagaaccagcccgccagagugugcgagcacugcuuccaggagcugcagaagcuggaccaccagcacagccccagaaucggcagccccggcaaccacaagagccccagcagcgcccugagcagcgugcugcacagcauccccagcggcagaaagcagaagaagauccccgccgcccugaaggaggugagcgccaacaccgaggacagcagcaugagcggcuaccuguacagaagcaagggcaacaagaagcccuggaagcacuucugguucgugaucaagaacaaggugcuguacaccuacgccgccagcgaggacguggccgcccuggagagccagccccugcugggcuucaccgugauccaggugaaggacgagaacagcgagagcaagguguuccagcugcugcacaagaacaugcuguucuacguguucaaggccgaggacgcccacagcgcccagaaguggaucgaggccuuccaggagggcaccauccuguaa

SEQ ID NO: 17067 - RNA, 627 nt, Artificial Sequence
  FGF10__Homo_sapiens__XP_005248321
auguggaaguggauccugacccacugcgccagcgccuucccccaccugcccggcugcugcugcugcugcuuccugcugcuguuccuggugagcagcgugcccgugaccugccaggcccugggccaggacauggugagccccgaggccaccaacagcagcagcagcagcuucagcagccccagcagcgccggcagacacgugagaagcuacaaccaccugcagggcgacgugagauggagaaagcuguucagcuucaccaaguacuuccugaagaucgagaagaacggcaaggugagcggcaccaagaaggagaacugccccuacagcauccuggagaucaccagcguggagaucggcgugguggccgugaaggccaucaacagcaacuacuaccuggccaugaacaagaagggcaagcuguacggcagcaaggaguucaacaacgacugcaagcugaaggagagaaucgaggagaacggcuacaacaccuacgccagcuucaacuggcagcacaacggcagacagauguacguggcccugaacggcaagggcgcccccagaagaggccagaagaccagaagaaagaacaccagcgcccacuuccugcccaugguggugcacagcuaa

SEQ ID NO: 17068 - RNA, 678 nt, Artificial Sequence
  FGF11__Homo_sapiens__NP_004103
auggccgcccuggccagcagccugaucagacagaagagagaggugagagagcccggcggcagcagacccgugagcgcccagagaagagugugccccagaggcaccaagagccugugccagaagcagcugcugauccugcugagcaaggugagacugugcggcggcagacccgccagacccgacagaggccccgagccccagcugaagggcaucgugaccaagcuguucugcagacagggcuucuaccugcaggccaaccccgacggcagcauccagggcacccccgaggacaccagcagcuucacccacuucaaccugauccccgugggccugagaguggugaccauccagagcgccaagcugggccacuacauggccaugaacgccgagggccugcuguacagcagcccccacuucaccgccgagugcagauucaaggagugcguguucgagaacuacuacgugcuguacgccagcgcccuguacagacagagaagaagcggcagagccugguaccugggccuggacaaggagggccaggugaugaagggcaacagagugaagaagaccaaggccgccgcccacuuccugcccaagcugcuggagguggccauguaccaggagcccagccugcacagcgugcccgaggccagccccagcagcccccccgcccccuaa

SEQ ID NO: 17069 - RNA, 546 nt, Artificial Sequence
  FGF12__Homo_sapiens__NP_004104
auggagagcaaggagccccagcugaagggcaucgugaccagacuguucagccagcagggcuacuuccugcagaugcaccccgacggcaccaucgacggcaccaaggacgagaacagcgacuacacccuguucaaccugauccccgugggccugagagugguggccauccagggcgugaaggccagccuguacguggccaugaacggcgagggcuaccuguacagcagcgacguguucacccccgagugcaaguucaaggagagcguguucgagaacuacuacgugaucuacagcagcacccuguacagacagcaggagagcggcagagccugguuccugggccugaacaaggagggccagaucaugaagggcaacagagugaagaagaccaagcccagcagccacuucgugcccaagcccaucgaggugugcauguacagagagcccagccugcacgagaucggcgagaagcagggcagaagcagaaagagcagcggcacccccaccaugaacggcggcaagguggugaaccaggacagcaccuaa

SEQ ID NO: 17070 - RNA, 600 nt, Artificial Sequence
  FGF13__Homo_sapiens__NP_001132970
augagcggcaaggugaccaagcccaaggaggagaaggacgccagcaaggagccccagcugaagggcaucgugaccaagcuguacagcagacagggcuaccaccugcagcugcaggccgacggcaccaucgacggcaccaaggacgaggacagcaccuacacccuguucaaccugauccccgugggccugagagugguggccauccagggcgugcagaccaagcuguaccuggccaugaacagcgagggcuaccuguacaccagcgagcuguucacccccgagugcaaguucaaggagagcguguucgagaacuacuacgugaccuacagcagcaugaucuacagacagcagcagagcggcagaggcugguaccugggccugaacaaggagggcgagaucaugaagggcaaccacgugaagaagaacaagcccgccgcccacuuccugcccaagccccugaagguggccauguacaaggagcccagccugcacgaccugaccgaguucagcagaagcggcagcggcacccccaccaagagcagaagcgugagcggcgugcugaacggcggcaagagcaugagccacaacgagagcaccuaa

SEQ ID NO: 17071 - RNA, 744 nt, Artificial Sequence
  FGF14__Homo_sapiens__NP_004106
auggccgccgccaucgccagcggccugaucagacagaagagacaggccagagagcagcacugggacagacccagcgccagcagaagaagaagcagccccagcaagaacagaggccugugcaacggcaaccugguggacaucuucagcaaggugagaaucuucggccugaagaagagaagacugagaagacaggacccccagcugaagggcaucgugaccagacuguacugcagacagggcuacuaccugcagaugcaccccgacggcgcccuggacggcaccaaggacgacagcaccaacagcacccuguucaaccugauccccgugggccugagagugguggccauccagggcgugaagaccggccuguacaucgccaugaacggcgagggcuaccuguaccccagcgagcuguucacccccgagugcaaguucaaggagagcguguucgagaacuacuacgugaucuacagcagcaugcuguacagacagcaggagagcggcagagccugguuccugggccugaacaaggagggccaggccaugaagggcaacagagugaagaagaccaagcccgccgcccacuuccugcccaagccccuggagguggccauguacagagagcccagccugcacgacgugggcgagaccgugcccaagcccggcgugacccccagcaagagcaccagcgccagcgccaucaugaacggcggcaagcccgugaacaagagcaagaccaccuaa

SEQ ID NO: 17072 - RNA, 624 nt, Artificial Sequence
  FGF16__Homo_sapiens__NP_003859
auggccgaggugggcggcguguucgccagccuggacugggaccugcacggcuucagcagcagccugggcaacgugccccuggccgacagccccggcuuccugaacgagagacugggccagaucgagggcaagcugcagagaggcagccccaccgacuucgcccaccugaagggcauccugagaagaagacagcuguacugcagaaccggcuuccaccuggagaucuuccccaacggcaccgugcacggcaccagacacgaccacagcagauucggcauccuggaguucaucagccuggccgugggccugaucagcaucagaggcguggacagcggccuguaccugggcaugaacgagagaggcgagcuguacggcagcaagaagcugaccagagagugcguguucagagagcaguucgaggagaacugguacaacaccuacgccagcacccuguacaagcacagcgacagcgagagacaguacuacguggcccugaacaaggacggcagccccagagagggcuacagaaccaagagacaccagaaguucacccacuuccugcccagacccguggaccccagcaagcugcccagcaugagcagagaccuguuccacuacagauaa

SEQ ID NO: 17073 - RNA, 618 nt, Artificial Sequence
  FGF17__Homo_sapiens__NP_001291407
augggcgccgccagacugcugcccaaccugacccugugccugcagcugcugauccugugcugccagacccaguacgugagagaccagggcgccaugaccgaccagcugagcagaagacagaucagagaguaccagcuguacagcagaaccagcggcaagcacgugcaggugaccggcagaagaaucagcgccaccgccgaggacggcaacaaguucgccaagcugaucguggagaccgacaccuucggcagcagagugagaaucaagggcgccgagagcgagaaguacaucugcaugaacaagagaggcaagcugaucggcaagcccagcggcaagagcaaggacugcguguucaccgagaucgugcuggagaacaacuacaccgccuuccagaacgccagacacgagggcugguucauggccuucaccagacagggcagacccagacaggccagcagaagcagacagaaccagagagaggcccacuucaucaagagacuguaccagggccagcugcccuuccccaaccacgccgagaagcagaagcaguucgaguucgugggcagcgcccccaccagaagaaccaagagaaccagaagaccccagccccugaccuaa

SEQ ID NO: 17074 - RNA, 624 nt, Artificial Sequence
  FGF18__Homo_sapiens__NP_003853
auguacagcgcccccagcgccugcaccugccugugccugcacuuccugcugcugugcuuccaggugcaggugcugguggccgaggagaacguggacuucagaauccacguggagaaccagaccagagccagagacgacgugagcagaaagcagcugagacuguaccagcuguacagcagaaccagcggcaagcacauccaggugcugggcagaagaaucagcgccagaggcgaggacggcgacaaguacgcccagcugcugguggagaccgacaccuucggcagccaggugagaaucaagggcaaggagaccgaguucuaccugugcaugaacagaaagggcaagcuggugggcaagcccgacggcaccagcaaggagugcguguucaucgagaaggugcuggagaacaacuacaccgcccugaugagcgccaaguacagcggcugguacgugggcuucaccaagaagggcagacccagaaagggccccaagaccagagagaaccagcaggacgugcacuucaugaagagauaccccaagggccagcccgagcugcagaagcccuucaaguacaccaccgugaccaagagaagcagaagaaucagacccacccaccccgccuaa

SEQ ID NO: 17075 - RNA, 651 nt, Artificial Sequence
  FGF19__Homo_sapiens__NP_005108
augagaagcggcugcgugguggugcacguguggauccuggccggccuguggcuggccguggccggcagaccccuggccuucagcgacgccggcccccacgugcacuacggcuggggcgaccccaucagacugagacaccuguacaccagcggcccccacggccugagcagcugcuuccugagaaucagagccgacggcgugguggacugcgccagaggccagagcgcccacagccugcuggagaucaaggccguggcccugagaaccguggccaucaagggcgugcacagcgugagauaccugugcaugggcgccgacggcaagaugcagggccugcugcaguacagcgaggaggacugcgccuucgaggaggagaucagacccgacggcuacaacguguacagaagcgagaagcacagacugcccgugagccugagcagcgccaagcagagacagcuguacaagaacagaggcuuccugccccugagccacuuccugcccaugcugcccauggugcccgaggagcccgaggaccugagaggccaccuggagagcgacauguucagcagcccccuggagaccgacagcauggaccccuucggccuggugaccggccuggaggccgugagaagccccagcuucgagaaguaa

SEQ ID NO: 17076 - RNA, 468 nt, Artificial Sequence
  FGF1__Homo_sapiens__NP_001244139
auggccgagggcgagaucaccaccuucaccgcccugaccgagaaguucaaccugccccccggcaacuacaagaagcccaagcugcuguacugcagcaacggcggccacuuccugagaauccugcccgacggcaccguggacggcaccagagacagaagcgaccagcacauccagcugcagcugagcgccgagagcgugggcgagguguacaucaagagcaccgagaccggccaguaccuggccauggacaccgacggccugcuguacggcagccagacccccaacgaggagugccuguuccuggagagacuggaggagaaccacuacaacaccuacaucagcaagaagcacgccgagaagaacugguucgugggccugaagaagaacggcagcugcaagagaggccccagaacccacuacggccagaaggccauccuguuccugccccugcccgugagcagcgacuaa

SEQ ID NO: 17077 - RNA, 636 nt, Artificial Sequence
  FGF20__Homo_sapiens__NP_062825
auggccccccuggccgaggugggcggcuuccugggcggccuggagggccugggccagcaggugggcagccacuuccugcugccccccgccggcgagagacccccccugcugggcgagagaagaagcgccgccgagagaagcgccagaggcggccccggcgccgcccagcuggcccaccugcacggcauccugagaagaagacagcuguacugcagaaccggcuuccaccugcagauccugcccgacggcagcgugcagggcaccagacaggaccacagccuguucggcauccuggaguucaucagcguggccgugggccuggugagcaucagaggcguggacagcggccuguaccugggcaugaacgacaagggcgagcuguacggcagcgagaagcugaccagcgagugcaucuucagagagcaguucgaggagaacugguacaacaccuacagcagcaacaucuacaagcacggcgacaccggcagaagauacuucguggcccugaacaaggacggcacccccagagacggcgccagaagcaagagacaccagaaguucacccacuuccugcccagacccguggaccccgagagagugcccgagcuguacaaggaccugcugauguacaccuaa

SEQ ID NO: 17078 - RNA, 630 nt, Artificial Sequence
  FGF21__Homo_sapiens__XP_005258788
auggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcuaa

SEQ ID NO: 17079 - RNA, 756 nt, Artificial Sequence
  FGF23__Homo_sapiens__NP_065689
augcugggcgccagacugagacugugggugugcgcccugugcagcgugugcagcaugagcgugcugagagccuaccccaacgccagcccccugcugggcagcagcuggggcggccugauccaccuguacaccgccaccgccagaaacagcuaccaccugcagauccacaagaacggccacguggacggcgccccccaccagaccaucuacagcgcccugaugaucagaagcgaggacgccggcuucguggugaucaccggcgugaugagcagaagauaccugugcauggacuucagaggcaacaucuucggcagccacuacuucgaccccgagaacugcagauuccagcaccagacccuggagaacggcuacgacguguaccacagcccccaguaccacuuccuggugagccugggcagagccaagagagccuuccugcccggcaugaaccccccccccuacagccaguuccugagcagaagaaacgagaucccccugauccacuucaacacccccauccccagaagacacaccagaagcgccgaggacgacagcgagagagacccccugaacgugcugaagcccagagccagaaugacccccgcccccgccagcugcagccaggagcugcccagcgccgaggacaacagccccauggccagcgacccccugggcguggugagaggcggcagagugaacacccacgccggcggcaccggccccgagggcugcagacccuucgccaaguucaucuaa

SEQ ID NO: 17080 - RNA, 867 nt, Artificial Sequence
  FGF2__Homo_sapiens__NP_001997
auggugggcgugggcggcggcgacguggaggacgugacccccagacccggcggcugccagaucagcggcagaggcgccagaggcugcaacggcauccccggcgccgccgccugggaggccgcccugcccagaagaagacccagaagacaccccagcgugaaccccagaagcagagccgccggcagccccagaaccagaggcagaagaaccgaggagagacccagcggcagcagacugggcgacagaggcagaggcagagcccugcccggcggcagacugggcggcagaggcagaggcagagcccccgagagagugggcggcagaggcagaggcagaggcaccgccgcccccagagccgcccccgccgccagaggcagcagacccggccccgccggcaccauggccgccggcagcaucaccacccugcccgcccugcccgaggacggcggcagcggcgccuucccccccggccacuucaaggaccccaagagacuguacugcaagaacggcggcuucuuccugagaauccaccccgacggcagaguggacggcgugagagagaagagcgacccccacaucaagcugcagcugcaggccgaggagagaggcguggugagcaucaagggcgugugcgccaacagauaccuggccaugaaggaggacggcagacugcuggccagcaagugcgugaccgacgagugcuucuucuucgagagacuggagagcaacaacuacaacaccuacagaagcagaaaguacaccagcugguacguggcccugaagagaaccggccaguacaagcugggcagcaagaccggccccggccagaaggccauccuguuccugcccaugagcgccaagagcuaa

SEQ ID NO: 17081 - RNA, 720 nt, Artificial Sequence
  FGF3__Homo_sapiens__NP_005238
augggccugaucuggcugcugcugcugagccugcuggagcccggcuggcccgccgccggccccggcgccagacugagaagagacgccggcggcagaggcggcguguacgagcaccugggcggcgcccccagaagaagaaagcuguacugcgccaccaaguaccaccugcagcugcaccccagcggcagagugaacggcagccuggagaacagcgccuacagcauccuggagaucaccgccguggaggugggcaucguggccaucagaggccuguucagcggcagauaccuggccaugaacaagagaggcagacuguacgccagcgagcacuacagcgccgagugcgaguucguggagagaauccacgagcugggcuacaacaccuacgccagcagacuguacagaaccgugagcagcacccccggcgccagaagacagcccagcgccgagagacugugguacgugagcgugaacggcaagggcagacccagaagaggcuucaagaccagaagaacccagaagagcagccuguuccugcccagagugcuggaccacagagaccacgagauggugagacagcugcagagcggccugcccagaccccccggcaagggcgugcagcccagaagaagaagacagaagcagagccccgacaaccuggagcccagccacgugcaggccagcagacugggcagccagcuggaggccagcgcccacuaa

SEQ ID NO: 17082 - RNA, 621 nt, Artificial Sequence
  FGF4__Homo_sapiens__XP_006718538
augagcggccccggcaccgccgccguggcccugcugcccgccgugcugcuggcccugcuggcccccugggccggcagaggcggcgccgccgcccccaccgcccccaacggcacccuggaggccgagcuggagagaagaugggagagccugguggcccugagccuggccagacugcccguggccgcccagcccaaggaggccgccgugcagagcggcgccggcgacuaccugcugggcaucaagagacugagaagacuguacugcaacgugggcaucggcuuccaccugcaggcccugcccgacggcagaaucggcggcgcccacgccgacaccagagacagccugcuggagcugagccccguggagagaggcguggugagcaucuucggcguggccagcagauucuucguggccaugagcagcaagggcaagcuguacggcagccccuucuucaccgacgagugcaccuucaaggagauccugcugcccaacaacuacaacgccuacgagagcuacaaguaccccggcauguucaucgcccugagcaagaacggcaagaccaagaagggcaacagagugagccccaccaugaaggugacccacuuccugcccagacuguaa

SEQ ID NO: 17083 - RNA, 807 nt, Artificial Sequence
  FGF5__Homo_sapiens__NP_004455
augagccugagcuuccugcugcugcuguucuucagccaccugauccugagcgccugggcccacggcgagaagagacuggcccccaagggccagcccggccccgccgccaccgacagaaaccccagaggcagcagcagcagacagagcagcagcagcgccaugagcagcagcagcgccagcagcagccccgccgccagccugggcagccagggcagcggccuggagcagagcagcuuccaguggagccccagcggcagaagaaccggcagccuguacugcagagugggcaucggcuuccaccugcagaucuaccccgacggcaaggugaacggcagccacgaggccaacaugcugagcgugcuggagaucuucgccgugagccagggcaucgugggcaucagaggcguguucagcaacaaguuccuggccaugagcaagaagggcaagcugcacgccagcgccaaguucaccgacgacugcaaguucagagagagauuccaggagaacagcuacaacaccuacgccagcgccauccacagaaccgagaagaccggcagagagugguacguggcccugaacaagagaggcaaggccaagagaggcugcagccccagagugaagccccagcacaucagcacccacuuccugcccagauucaagcagagcgagcagcccgagcugagcuucaccgugaccgugcccgagaagaagaagccccccagccccaucaagcccaagaucccccugagcgcccccagaaagaacaccaacagcgugaaguacagacugaaguucagauucggcuaa

SEQ ID NO: 17084 - RNA, 627 nt, Artificial Sequence
  FGF6__Homo_sapiens__NP_066276
auggcccugggccagaagcuguucaucaccaugagcagaggcgccggcagacugcagggcacccugugggcccugguguuccugggcauccuggugggcaugguggugcccagccccgccggcaccagagccaacaacacccugcuggacagcagaggcuggggcacccugcugagcagaagcagagccggccuggccggcgagaucgccggcgugaacugggagagcggcuaccuggugggcaucaagagacagagaagacuguacugcaacgugggcaucggcuuccaccugcaggugcugcccgacggcagaaucagcggcacccacgaggagaaccccuacagccugcuggagaucagcaccguggagagaggcguggugagccuguucggcgugagaagcgcccuguucguggccaugaacagcaagggcagacuguacgccacccccagcuuccaggaggagugcaaguucagagagacccugcugcccaacaacuacaacgccuacgagagcgaccuguaccagggcaccuacaucgcccugagcaaguacggcagagugaagagaggcagcaaggugagccccaucaugaccgugacccacuuccugcccagaaucuaa

SEQ ID NO: 17085 - RNA, 585 nt, Artificial Sequence
  FGF7__Homo_sapiens__NP_002000
augcacaaguggauccugaccuggauccugcccacccugcuguacagaagcugcuuccacaucaucugccuggugggcaccaucagccuggccugcaacgacaugacccccgagcagauggccaccaacgugaacugcagcagccccgagagacacaccagaagcuacgacuacauggagggcggcgacaucagagugagaagacuguucugcagaacccagugguaccugagaaucgacaagagaggcaaggugaagggcacccaggagaugaagaacaacuacaacaucauggagaucagaaccguggccgugggcaucguggccaucaagggcguggagagcgaguucuaccuggccaugaacaaggagggcaagcuguacgccaagaaggagugcaacgaggacugcaacuucaaggagcugauccuggagaaccacuacaacaccuacgccagcgccaaguggacccacaacggcggcgagauguucguggcccugaaccagaagggcauccccgugagaggcaagaagaccaagaaggagcagaagaccgcccacuuccugcccauggccaucaccuaa

SEQ ID NO: 17086 - RNA, 648 nt, Artificial Sequence
  FGF8__Homo_sapiens__NP_006110
augggcagccccagaagcgcccugagcugccugcugcugcaccugcuggugcugugccugcaggcccaggugaccgugcagagcagccccaacuucacccagcacgugagagagcagagccuggugaccgaccagcugagcagaagacugaucagaaccuaccagcuguacagcagaaccagcggcaagcacgugcaggugcuggccaacaagagaaucaacgccauggccgaggacggcgaccccuucgccaagcugaucguggagaccgacaccuucggcagcagagugagagugagaggcgccgagaccggccuguacaucugcaugaacaagaagggcaagcugaucgccaagagcaacggcaagggcaaggacugcguguucaccgagaucgugcuggagaacaacuacaccgcccugcagaacgccaaguacgagggcugguacauggccuucaccagaaagggcagacccagaaagggcagcaagaccagacagcaccagagagaggugcacuucaugaagagacugcccagaggccaccacaccaccgagcagagccugagauucgaguuccugaacuacccccccuucaccagaagccugagaggcagccagagaaccugggcccccgagcccagauaa

SEQ ID NO: 17087 - RNA, 627 nt, Artificial Sequence
  FGF9__Homo_sapiens__NP_002001
auggccccccugggcgaggugggcaacuacuucggcgugcaggacgccgugcccuucggcaacgugcccgugcugcccguggacagccccgugcugcugagcgaccaccugggccagagcgaggccggcggccugcccagaggccccgccgugaccgaccuggaccaccugaagggcauccugagaagaagacagcuguacugcagaaccggcuuccaccuggagaucuuccccaacggcaccauccagggcaccagaaaggaccacagcagauucggcauccuggaguucaucagcaucgccgugggccuggugagcaucagaggcguggacagcggccuguaccugggcaugaacgagaagggcgagcuguacggcagcgagaagcugacccaggagugcguguucagagagcaguucgaggagaacugguacaacaccuacagcagcaaccuguacaagcacguggacaccggcagaagauacuacguggcccugaacaaggacggcacccccagagagggcaccagaaccaagagacaccagaaguucacccacuuccugcccagacccguggaccccgacaaggugcccgagcuguacaaggacauccugagccagagcuaa

SEQ ID NO: 17088 - RNA, 705 nt, Artificial Sequence
  FGFBP1__Homo_sapiens__NP_005121
augaagaucugcagccugacccugcugagcuuccugcugcuggccgcccaggugcugcugguggagggcaagaagaaggugaagaacggccugcacagcaagguggugagcgagcagaaggacacccugggcaacacccagaucaagcagaagagcagacccggcaacaagggcaaguucgugaccaaggaccaggccaacugcagaugggccgccaccgagcaggaggagggcaucagccugaagguggagugcacccagcuggaccacgaguucagcugcguguucgccggcaaccccaccagcugccugaagcugaaggacgagagaguguacuggaagcagguggccagaaaccugagaagccagaaggacaucugcagauacagcaagaccgccgugaagaccagagugugcagaaaggacuuccccgagagcagccugaagcuggugagcagcacccuguucggcaacaccaagcccagaaaggagaagaccgagaugagccccagagagcacaucaagggcaaggagaccacccccagcagccuggccgugacccagaccauggccaccaaggcccccgagugcguggaggaccccgacauggccaaccagagaaagaccgcccuggaguucugcggcgagaccuggagcagccugugcaccuucuuccugagcaucgugcaggacaccagcugcuaa

SEQ ID NO: 17089 - RNA, 672 nt, Artificial Sequence
  FGFBP2__Homo_sapiens__NP_114156
augaaguucgugcccugccugcugcuggugacccugagcugccugggcacccugggccaggcccccagacagaagcagggcagcaccggcgaggaguuccacuuccagaccggcggcagagacagcugcaccaugagacccagcagccugggccagggcgccggcgagguguggcugagaguggacugcagaaacaccgaccagaccuacuggugcgaguacagaggccagcccagcaugugccaggccuucgccgccgaccccaagcccuacuggaaccaggcccugcaggagcugagaagacugcaccacgccugccagggcgcccccgugcugagacccagcgugugcagagaggccggcccccaggcccacaugcagcaggugaccagcagccugaagggcagccccgagcccaaccagcagcccgaggccggcacccccagccugagacccaaggccaccgugaagcugaccgaggccacccagcugggcaaggacagcauggaggagcugggcaaggccaagcccaccaccagacccaccgccaagcccacccagcccggccccagacccggcggcaacgaggaggccaagaagaaggccugggagcacugcuggaagcccuuccaggcccugugcgccuuccugaucagcuucuucagaggcuaa

SEQ ID NO: 17090 - RNA, 777 nt, Artificial Sequence
  FGFBP3__Homo_sapiens__NP_689642
augaccccccccaagcugagagccagccugagccccagccugcugcugcugcugagcggcugccugcuggccgccgccagaagagagaagggcgccgccagcaacguggccgagcccgugcccggccccaccggcggcagcagcggcagauuccugagccccgagcagcacgccugcagcuggcagcugcugcugcccgcccccgaggccgccgccggcagcgagcuggcccugagaugccagagccccgacggcgccagacaccagugcgccuacagaggccaccccgagagaugcgccgccuacgccgccagaagagcccacuucuggaagcaggugcugggcggccugagaaagaagagaagacccugccacgaccccgccccccugcaggccagacugugcgccggcaagaagggccacggcgccgagcugagacuggugcccagagccagcccccccgccagacccaccguggccggcuucgccggcgagagcaagcccagagccagaaacagaggcagaaccagagagagagccagcggccccgccgccggcaccccccccccccagagcgccccccccaaggagaaccccagcgagagaaagaccaacgagggcaagagaaaggccgcccuggugcccaacgaggagagacccaugggcaccggccccgaccccgacggccuggacggcaacgccgagcugaccgagaccuacugcgccgagaaguggcacagccugugcaacuucuucgugaacuucuggaacggcuaa

SEQ ID NO: 17091 - RNA, 2439 nt, Artificial Sequence
  FGFR1__Homo_sapiens__NP_001167535
auggccgccgugaccagagacuucggcgagaugcugcugcacagcggcagagugcugcccgccgaggcccagcccuggggcgcccccguggagguggagagcuuccuggugcaccccggcgaccugcugcagcugagaugcagacugagagacgacgugcagagcaucaacuggcugagagacggcgugcagcuggccgagagcaacagaaccagaaucaccggcgaggagguggaggugcaggacagcgugcccgccgacagcggccuguacgccugcgugaccagcagccccagcggcagcgacaccaccuacuucagcgugaacgugagcgacgcccugcccagcagcgaggacgacgacgacgacgacgacagcagcagcgaggagaaggagaccgacaacaccaagcccaacagaaugcccguggcccccuacuggaccagccccgagaagauggagaagaagcugcacgccgugcccgccgccaagaccgugaaguucaagugccccagcagcggcacccccaaccccacccugagauggcugaagaacggcaaggaguucaagcccgaccacagaaucggcggcuacaaggugagauacgccaccuggagcaucaucauggacagcguggugcccagcgacaagggcaacuacaccugcaucguggagaacgaguacggcagcaucaaccacaccuaccagcuggacgugguggagagaagcccccacagacccauccugcaggccggccugcccgccaacaagaccguggcccugggcagcaacguggaguucaugugcaagguguacagcgacccccagccccacauccaguggcugaagcacaucgaggugaacggcagcaagaucggccccgacaaccugcccuacgugcagauccugaagaccgccggcgugaacaccaccgacaaggagauggaggugcugcaccugagaaacgugagcuucgaggacgccggcgaguacaccugccuggccggcaacagcaucggccugagccaccacagcgccuggcugaccgugcuggaggcccuggaggagagacccgccgugaugaccagcccccuguaccuggagaucaucaucuacugcaccggcgccuuccugaucagcugcauggugggcagcgugaucguguacaagaugaagagcggcaccaagaagagcgacuuccacagccagauggccgugcacaagcuggccaagagcaucccccugagaagacaggugagcgccgacagcagcgccagcaugaacagcggcgugcugcuggugagacccagcagacugagcagcagcggcacccccaugcuggccggcgugagcgaguacgagcugcccgaggaccccagaugggagcugcccagagacagacuggugcugggcaagccccugggcgagggcugcuucggccagguggugcuggccgaggccaucggccuggacaaggacaagcccaacagagugaccaagguggccgugaagaugcugaagagcgacgccaccgagaaggaccugagcgaccugaucagcgagauggagaugaugaagaugaucggcaagcacaagaacaucaucaaccugcugggcgccugcacccaggacggcccccuguacgugaucguggaguacgccagcaagggcaaccugagagaguaccugcaggccagaagaccccccggccuggaguacugcuacaaccccagccacaaccccgaggagcagcugagcagcaaggaccuggugagcugcgccuaccagguggccagaggcauggaguaccuggccagcaagaagugcauccacagagaccuggccgccagaaacgugcuggugaccgaggacaacgugaugaagaucgccgacuucggccuggccagagacauccaccacaucgacuacuacaagaagaccaccaacggcagacugcccgugaaguggauggcccccgaggcccuguucgacagaaucuacacccaccagagcgacguguggagcuucggcgugcugcugugggagaucuucacccugggcggcagccccuaccccggcgugcccguggaggagcuguucaagcugcugaaggagggccacagaauggacaagcccagcaacugcaccaacgagcuguacaugaugaugagagacugcuggcacgccgugcccagccagagacccaccuucaagcagcugguggaggaccuggacagaaucguggcccugaccagcaaccaggaguaccuggaccugagcaugccccuggaccaguacagccccagcuuccccgacaccagaagcagcaccugcagcagcggcgaggacagcguguucagccacgagccccugcccgaggagcccugccugcccagacaccccgcccagcuggccaacggcggccugaagagaagauaa

SEQ ID NO: 17092 - RNA, 648 nt, Artificial Sequence
  FGFR1OP2__Homo_sapiens__NP_001165358
augagcugcaccaucgagaaggcccuggccgacgccaaggcccugguggagagacugagagaccacgacgacgccgccgagagccugaucgagcagaccaccgcccugaacaagagaguggaggccaugaagcaguaccaggaggagauccaggagcugaacgagguggccagacacagacccagaagcacccuggugaugggcauccagcaggagaacagacagaucagagagcugcagcaggagaacaaggagcugagaaccagccuggaggagcaccagagcgcccuggagcugaucaugagcaaguacagagagcagauguucagacugcugauggccagcaagaaggacgaccccggcaucaucaugaagcugaaggagcagcacagcaaggagcugcaggcccacguggaccagaucaccgagauggccgccgugaugagaaaggccaucgagaucgacgagcagcagggcugcaaggagcaggagagaaucuuccagcuggagcaggagaacaagggccugagagagauccugcagaucaccagagagagcuuccugaaccugagaaaggacgacgccagcgagagcaccagccugagcgcccuggugaccaacagcgaccugagccugagaaagagcuaa

SEQ ID NO: 17093 - RNA, 1056 nt, Artificial Sequence
  FGFR1OP__Homo_sapiens__NP_001265619
auggccgccaccgccgccgccgugguggccgaggaggacaccgagcugagagaccugcuggugcagacccuggagaacagcggcgugcugaacagaaucaaggccgagcugagagccgccguguuccuggcccuggaggagcaggagaagguggagaacaagaccccccuggugaacgagagccugaagaaguuccugaacaccaaggacggcagacugguggccagccugguggccgaguuccugcaguucuucaaccuggacuucacccuggccguguuccagcccgagaccagcacccugcagggccuggagggcagagagaaccuggccagagaccugggcaucaucgaggccgagggcaccgugggcggcccccugcugcuggaggugaucagaagaugccagcagaaggagaagggccccaccaccggcgagaaggccaacgacgaggccaaccagagcgacaccagcgugagccugagcgagcccaagagcaagagcagccugcaccugcugagccacgagaccaagaucggcagcuuccugagcaacagaacccuggacggcaaggacaaggccggccugugccccgacgaggacgacauggagggcgacagcuucuucgacgaccccauccccaagcccgagaagaccuacggccugagaaaggagcccagaaagcaggccggcagccuggccagccugagcgacgcccccccccugaagagcggccugagcagccuggccggcgcccccagccugaaggacagcgagagcaagagaggcaacaccgugcugaaggaccugaagcugaucagcgacaagaucggcagccugggccugggcaccggcgaggacgacgacuacguggacgacuucaacagcaccagccacagaagcgagaagagcgagaucagcaucggcgaggagaucgaggaggaccugagcguggagaucgacgacaucaacaccagcgacaagaccaucacccagcuggagugccugcugagcaucggcgcccugcacuucaagaacaccgccgacaucuucuaa

SEQ ID NO: 17094 - RNA, 2466 nt, Artificial Sequence
  FGFR2__Homo_sapiens__NP_000132
auggugagcuggggcagauucaucugccuggugguggugaccauggccacccugagccuggccagacccagcuucagccugguggaggacaccacccuggagcccgaggagccccccaccaaguaccagaucagccagcccgagguguacguggccgcccccggcgagagccuggaggugagaugccugcugaaggacgccgccgugaucagcuggaccaaggacggcgugcaccugggccccaacaacagaaccgugcugaucggcgaguaccugcagaucaagggcgccacccccagagacagcggccuguacgccugcaccgccagcagaaccguggacagcgagaccugguacuucauggugaacgugaccgacgccaucagcagcggcgacgacgaggacgacaccgacggcgccgaggacuucgugagcgagaacagcaacaacaagagagcccccuacuggaccaacaccgagaagauggagaagagacugcacgccgugcccgccgccaacaccgugaaguucagaugccccgccggcggcaaccccaugcccaccaugagauggcugaagaacggcaaggaguucaagcaggagcacagaaucggcggcuacaaggugagaaaccagcacuggagccugaucauggagagcguggugcccagcgacaagggcaacuacaccugcgugguggagaacgaguacggcagcaucaaccacaccuaccaccuggacgugguggagagaagcccccacagacccauccugcaggccggccugcccgccaacgccagcaccguggugggcggcgacguggaguucgugugcaagguguacagcgacgcccagccccacauccaguggaucaagcacguggagaagaacggcagcaaguacggccccgacggccugcccuaccugaaggugcugaaggccgccggcgugaacaccaccgacaaggagaucgaggugcuguacaucagaaacgugaccuucgaggacgccggcgaguacaccugccuggccggcaacagcaucggcaucagcuuccacagcgccuggcugaccgugcugcccgcccccggcagagagaaggagaucaccgccagccccgacuaccuggagaucgccaucuacugcaucggcguguuccugaucgccugcaugguggugaccgugauccugugcagaaugaagaacaccaccaagaagcccgacuucagcagccagcccgccgugcacaagcugaccaagagaaucccccugagaagacaggugaccgugagcgccgagagcagcagcagcaugaacagcaacaccccccuggugagaaucaccaccagacugagcagcaccgccgacacccccaugcuggccggcgugagcgaguacgagcugcccgaggaccccaagugggaguuccccagagacaagcugacccugggcaagccccugggcgagggcugcuucggccagguggugauggccgaggccgugggcaucgacaaggacaagcccaaggaggccgugaccguggccgugaagaugcugaaggacgacgccaccgagaaggaccugagcgaccuggugagcgagauggagaugaugaagaugaucggcaagcacaagaacaucaucaaccugcugggcgccugcacccaggacggcccccuguacgugaucguggaguacgccagcaagggcaaccugagagaguaccugagagccagaagaccccccggcauggaguacagcuacgacaucaacagagugcccgaggagcagaugaccuucaaggaccuggugagcugcaccuaccagcuggccagaggcauggaguaccuggccagccagaagugcauccacagagaccuggccgccagaaacgugcuggugaccgagaacaacgugaugaagaucgccgacuucggccuggccagagacaucaacaacaucgacuacuacaagaagaccaccaacggcagacugcccgugaaguggauggcccccgaggcccuguucgacagaguguacacccaccagagcgacguguggagcuucggcgugcugaugugggagaucuucacccugggcggcagccccuaccccggcauccccguggaggagcuguucaagcugcugaaggagggccacagaauggacaagcccgccaacugcaccaacgagcuguacaugaugaugagagacugcuggcacgccgugcccagccagagacccaccuucaagcagcugguggaggaccuggacagaauccugacccugaccaccaacgaggaguaccuggaccugagccagccccuggagcaguacagccccagcuaccccgacaccagaagcagcugcagcagcggcgacgacagcguguucagccccgaccccaugcccuacgagcccugccugccccaguacccccacaucaacggcagcgugaagaccuaa

SEQ ID NO: 17095 - RNA, 2421 nt, Artificial Sequence
  FGFR3__Homo_sapiens__NP_000133
augggcgcccccgccugcgcccuggcccugugcguggccguggccaucguggccggcgccagcagcgagagccugggcaccgagcagagaguggugggcagagccgccgaggugcccggccccgagcccggccagcaggagcagcugguguucggcagcggcgacgccguggagcugagcugccccccccccggcggcggccccaugggccccaccgugugggugaaggacggcaccggccuggugcccagcgagagagugcuggugggcccccagagacugcaggugcugaacgccagccacgaggacagcggcgccuacagcugcagacagagacugacccagagagugcugugccacuucagcgugagagugaccgacgcccccagcagcggcgacgacgaggacggcgaggacgaggccgaggacaccggcguggacaccggcgcccccuacuggaccagacccgagagaauggacaagaagcugcuggccgugcccgccgccaacaccgugagauucagaugccccgccgccggcaaccccacccccagcaucagcuggcugaagaacggcagagaguucagaggcgagcacagaaucggcggcaucaagcugagacaccagcaguggagccuggugauggagagcguggugcccagcgacagaggcaacuacaccugcgugguggagaacaaguucggcagcaucagacagaccuacacccuggacgugcuggagagaagcccccacagacccauccugcaggccggccugcccgccaaccagaccgccgugcugggcagcgacguggaguuccacugcaagguguacagcgacgcccagccccacauccaguggcugaagcacguggaggugaacggcagcaaggugggccccgacggcacccccuacgugaccgugcugaagaccgccggcgccaacaccaccgacaaggagcuggaggugcugagccugcacaacgugaccuucgaggacgccggcgaguacaccugccuggccggcaacagcaucggcuucagccaccacagcgccuggcugguggugcugcccgccgaggaggagcugguggaggccgacgaggccggcagcguguacgccggcauccugagcuacggcgugggcuucuuccuguucauccuggugguggccgccgugacccugugcagacugagaagcccccccaagaagggccugggcagccccaccgugcacaagaucagcagauucccccugaagagacaggugagccuggagagcaacgccagcaugagcagcaacaccccccuggugagaaucgccagacugagcagcggcgagggccccacccuggccaacgugagcgagcuggagcugcccgccgaccccaagugggagcugagcagagccagacugacccugggcaagccccugggcgagggcugcuucggccagguggugauggccgaggccaucggcaucgacaaggacagagccgccaagcccgugaccguggccgugaagaugcugaaggacgacgccaccgacaaggaccugagcgaccuggugagcgagauggagaugaugaagaugaucggcaagcacaagaacaucaucaaccugcugggcgccugcacccagggcggcccccuguacgugcugguggaguacgccgccaagggcaaccugagagaguuccugagagccagaagaccccccggccuggacuacagcuucgacaccugcaagccccccgaggagcagcugaccuucaaggaccuggugagcugcgccuaccagguggccagaggcauggaguaccuggccagccagaagugcauccacagagaccuggccgccagaaacgugcuggugaccgaggacaacgugaugaagaucgccgacuucggccuggccagagacgugcacaaccuggacuacuacaagaagaccaccaacggcagacugcccgugaaguggauggcccccgaggcccuguucgacagaguguacacccaccagagcgacguguggagcuucggcgugcugcugugggagaucuucacccugggcggcagccccuaccccggcauccccguggaggagcuguucaagcugcugaaggagggccacagaauggacaagcccgccaacugcacccacgaccuguacaugaucaugagagagugcuggcacgccgcccccagccagagacccaccuucaagcagcugguggaggaccuggacagagugcugaccgugaccagcaccgacgaguaccuggaccugagcgcccccuucgagcaguacagccccggcggccaggacacccccagcagcagcagcagcggcgacgacagcguguucgcccacgaccugcugccccccgccccccccagcagcggcggcagcagaaccuaa

SEQ ID NO: 17096 - RNA, 2205 nt, Artificial Sequence
  FGFR4__Homo_sapiens__NP_001278909
augagacugcugcuggcccugcugggcgugcugcugagcgugcccggcccccccgugcugagccuggaggccagcgaggagguggagcuggagcccugccuggcccccagccuggagcagcaggagcaggagcugaccguggcccugggccagcccgugagacugugcugcggcagagccgagagaggcggccacugguacaaggagggcagcagacuggcccccgccggcagagugagaggcuggagaggcagacuggagaucgccagcuuccugcccgaggacgccggcagauaccugugccuggccagaggcagcaugaucgugcugcagaaccugacccugaucaccggcgacagccugaccagcagcaacgacgacgaggaccccaagagccacagagaccccagcaacagacacagcuacccccagcaggcccccuacuggacccacccccagagaauggagaagaagcugcacgccgugcccgccggcaacaccgugaaguucagaugccccgccgccggcaaccccacccccaccaucagauggcugaaggacggccaggccuuccacggcgagaacagaaucggcggcaucagacugagacaccagcacuggagccuggugauggagagcguggugcccagcgacagaggcaccuacaccugccugguggagaacgccgugggcagcaucagauacaacuaccugcuggacgugcuggagagaagcccccacagacccauccugcaggccggccugcccgccaacaccaccgccguggugggcagcgacguggagcugcugugcaagguguacagcgacgcccagccccacauccaguggcugaagcacaucgugaucaacggcagcagcuucggcgccgacggcuuccccuacgugcaggugcugaagaccgccgacaucaacagcagcgagguggaggugcuguaccugagaaacgugagcgccgaggacgccggcgaguacaccugccuggccggcaacagcaucggccugagcuaccagagcgccuggcugaccgugcugcccgaggaggaccccaccuggaccgccgccgcccccgaggccagcagccccuggagccaggcccugcccgccagccaggcccaccccugguacgaggccugcgugagcccccccgccgccccccccugcagccccgccagccuggugcugggcaagccccugggcgagggcugcuucggccagguggugagagccgaggccuucggcauggaccccgccagacccgaccaggccagcaccguggccgugaagaugcugaaggacaacgccagcgacaaggaccuggccgaccuggugagcgagauggaggugaugaagcugaucggcagacacaagaacaucaucaaccugcugggcgugugcacccaggagggcccccuguacgugaucguggagugcgccgccaagggcaaccugagagaguuccugagagccagaagaccccccggccccgaccugagccccgacggccccagaagcagcgagggcccccugagcuuccccgugcuggugagcugcgccuaccagguggccagaggcaugcaguaccuggagagcagaaagugcauccacagagaccuggccgccagaaacgugcuggugaccgaggacaacgugaugaagaucgccgacuucggccuggccagaggcgugcaccacaucgacuacuacaagaagaccagcaacggcagacugcccgugaaguggauggcccccgaggcccuguucgacagaguguacacccaccagagcgacguguggagcuucggcauccugcugugggagaucuucacccugggcggcagccccuaccccggcauccccguggaggagcuguucagccugcugagagagggccacagaauggacagacccccccacugcccccccgagcuguacggccugaugagagagugcuggcacgccgcccccagccagagacccaccuucaagcagcugguggaggcccuggacaaggugcugcuggccgugagcgaggaguaccuggaccugagacugaccuucggccccuacagccccagcggcggcgacgccagcagcaccugcagcagcagcgacagcguguucagccacgacccccugccccugggcagcagcagcuuccccuucggcagcggcgugcagaccuaa

SEQ ID NO: 17097 - RNA, 1515 nt, Artificial Sequence
  FGFRL1__Homo_sapiens__NP_001004358
augacccccagcccccugcugcugcugcugcugcccccccugcugcugggcgccuucccccccgccgccgccgccagaggcccccccaagauggccgacaagguggugcccagacagguggccagacugggcagaaccgugagacugcagugccccguggagggcgacccccccccccugaccauguggaccaaggacggcagaaccauccacagcggcuggagcagauucagagugcugccccagggccugaaggugaagcagguggagagagaggacgccggcguguacgugugcaaggccaccaacggcuucggcagccugagcgugaacuacacccugguggugcuggacgacaucagccccggcaaggagagccugggccccgacagcagcagcggcggccaggaggaccccgccagccagcagugggccagacccagauucacccagcccagcaagaugagaagaagagugaucgccagacccgugggcagcagcgugagacugaagugcguggccagcggccaccccagacccgacaucaccuggaugaaggacgaccaggcccugaccagacccgaggccgccgagcccagaaagaagaaguggacccugagccugaagaaccugagacccgaggacagcggcaaguacaccugcagagugagcaacagagccggcgccaucaacgccaccuacaagguggacgugauccagagaaccagaagcaagcccgugcugaccggcacccaccccgugaacaccaccguggacuucggcggcaccaccagcuuccagugcaaggugagaagcgacgugaagcccgugauccaguggcugaagagaguggaguacggcgccgagggcagacacaacagcaccaucgacgugggcggccagaaguucguggugcugcccaccggcgacguguggagcagacccgacggcagcuaccugaacaagcugcugaucaccagagccagacaggacgacgccggcauguacaucugccugggcgccaacaccaugggcuacagcuucagaagcgccuuccugaccgugcugcccgaccccaagccccccggcccccccguggccagcagcagcagcgccaccagccugcccuggcccguggugaucggcauccccgccggcgccguguucauccugggcacccugcugcuguggcugugccaggcccagaagaagcccugcacccccgcccccgcccccccccugcccggccacagaccccccggcaccgccagagacagaagcggcgacaaggaccugcccagccuggccgcccugagcgccggccccggcgugggccugugcgaggagcacggcagccccgccgccccccagcaccugcugggccccggccccguggccggccccaagcuguaccccaagcuguacaccgacauccacacccacacccacacccacagccacacccacagccacguggagggcaaggugcaccagcacauccacuaccagugcuaa

SEQ ID NO: 17098 - RNA, 1314 nt, Artificial Sequence
  FGG__Homo_sapiens__NP_000500
augagcuggagccugcaccccagaaaccugauccuguacuucuacgcccugcuguuccugagcagcaccugcguggccuacguggccaccagagacaacugcugcauccuggacgagagauucggcagcuacugccccaccaccugcggcaucgccgacuuccugagcaccuaccagaccaagguggacaaggaccugcagagccuggaggacauccugcaccagguggagaacaagaccagcgaggugaagcagcugaucaaggccauccagcugaccuacaaccccgacgagagcagcaagcccaacaugaucgacgccgccacccugaagagcagaaagaugcuggaggagaucaugaaguacgaggccagcauccugacccacgacagcagcaucagauaccugcaggagaucuacaacagcaacaaccagaagaucgugaaccugaaggagaagguggcccagcuggaggcccagugccaggagcccugcaaggacaccgugcagauccacgacaucaccggcaaggacugccaggacaucgccaacaagggcgccaagcagagcggccuguacuucaucaagccccugaaggccaaccagcaguuccugguguacugcgagaucgacggcagcggcaacggcuggaccguguuccagaagagacuggacggcagcguggacuucaagaagaacuggauccaguacaaggagggcuucggccaccugagccccaccggcaccaccgaguucuggcugggcaacgagaagauccaccugaucagcacccagagcgccauccccuacgcccugagaguggagcuggaggacuggaacggcagaaccagcaccgccgacuacgccauguucaaggugggccccgaggccgacaaguacagacugaccuacgccuacuucgccggcggcgacgccggcgacgccuucgacggcuucgacuucggcgacgaccccagcgacaaguucuucaccagccacaacggcaugcaguucagcaccugggacaacgacaacgacaaguucgagggcaacugcgccgagcaggacggcagcggcugguggaugaacaagugccacgccggccaccugaacggcguguacuaccagggcggcaccuacagcaaggccagcacccccaacggcuacgacaacggcaucaucugggccaccuggaagaccagaugguacagcaugaagaagaccaccaugaagaucauccccuucaacagacugaccaucggcgagggccagcagcaccaccugggcggcgccaagcaggccggcgacguguaa

SEQ ID NO: 17099 - RNA, 1086 nt, Artificial Sequence
  FGGY__Homo_sapiens__XP_011540039
augagcggcggcgagcagaagcccgagagauacuacgugggcguggacgugggcaccggcagcgugagagccgcccugguggaccagagcggcgugcugcuggccuucgccgaccagcccaucaagaacugggagccccaguucaaccaccacgagcagagcagcgaggacaucugggccgccugcugcguggugaccaagaagguggugcagggcaucgaccugaaccagaucagaggccugggcuucgacgccaccugcagccugguggugcuggacaagcaguuccacccccugcccgugaaccaggagggcgacagccacagaaacgugaucauguggcuggaccacagagccgugagccaggugaacagaaucaacgagaccaagcacagcgugcugcaguacgugggcggcgugaugagcguggagaugcaggcccccaagcugcuguggcugaaggagaaccugagagagaucugcugggacaaggccggccacuucuucgaccugcccgacuuccugagcuggaaggccaccggcgugaccgccagaagccugugcagccuggugugcaaguggaccuacagcgccgagaagggcugggacgacagcuucuggaagaugaucggccuggaggacuucguggccgacaacuacagcaagaucggcaaccaggugcugccccccggcgccagccugggcaacggccugacccccgaggccgccagagaccugggccugcugcccggcaucgccguggccgccagccugaucgacgcccacgccggcggccugggcgugaucggcgccgacgugagaggccacggccugaucugcgagggccagcccgugaccagcagacuggccgugaucugcggcaccagcagcugccacaugggcaucagcaaggaccccaucuucgugcccggcguguggggccccuacuucagcgccauggugcccggcuucuggcugaacgagggcggccagagcgugaccggcaagcugaucgaccacauggugcagggccacgccgccuuccccgagcugcaggugaaggccaccgccagaagccccgacuaa

SEQ ID NO: 17100 - RNA, 939 nt, Artificial Sequence
  FGL1__Homo_sapiens__NP_004458
auggccaagguguucagcuucauccuggugaccaccgcccugaccaugggcagagagaucagcgcccuggaggacugcgcccaggagcagaugagacugagagcccaggugagacugcuggagaccagagugaagcagcagcaggugaagaucaagcagcugcugcaggagaacgaggugcaguuccuggacaagggcgacgagaacaccgugaucgaccugggcagcaagagacaguacgccgacugcagcgagaucuucaacgacggcuacaagcugagcggcuucuacaagaucaagccccugcagagccccgccgaguucagcguguacugcgacaugagcgacggcggcggcuggaccgugauccagagaagaagcgacggcagcgagaacuucaacagaggcuggaaggacuacgagaacggcuucggcaacuucgugcagaagcacggcgaguacuggcugggcaacaagaaccugcacuuccugaccacccaggaggacuacacccugaagaucgaccuggccgacuucgagaagaacagcagauacgcccaguacaagaacuucaaggugggcgacgagaagaacuucuacgagcugaacaucggcgaguacagcggcaccgccggcgacagccuggccggcaacuuccaccccgaggugcaguggugggccagccaccagagaaugaaguucagcaccugggacagagaccacgacaacuacgagggcaacugcgccgaggaggaccagagcggcuggugguucaacagaugccacagcgccaaccugaacggcguguacuacagcggccccuacaccgccaagaccgacaacggcaucgugugguacaccuggcacggcuggugguacagccugaagagcguggugaugaagaucagacccaacgacuucauccccaacgugaucuaa

SEQ ID NO: 17101 - RNA, 1320 nt, Artificial Sequence
  FGL2__Homo_sapiens__NP_006673
augaagcuggccaacugguacuggcugagcagcgccgugcuggccaccuacggcuuccuggugguggccaacaacgagaccgaggagaucaaggacgagagagccaaggacgugugccccgugagacuggagagcagaggcaagugcgaggaggccggcgagugccccuaccaggugagccugcccccccugaccauccagcugcccaagcaguucagcagaaucgaggagguguucaaggaggugcagaaccugaaggagaucgugaacagccugaagaagagcugccaggacugcaagcugcaggccgacgacaacggcgaccccggcagaaacggccugcugcugcccagcaccggcgcccccggcgaggugggcgacaacagagugagagagcuggagagcgaggugaacaagcugagcagcgagcugaagaacgccaaggaggagaucaacgugcugcacggcagacuggagaagcugaaccuggugaacaugaacaacaucgagaacuacguggacagcaagguggccaaccugaccuucguggugaacagccuggacggcaagugcagcaagugccccagccaggagcagauccagagcagacccgugcagcaccugaucuacaaggacugcagcgacuacuacgccaucggcaagagaagcagcgagaccuacagagugacccccgaccccaagaacagcagcuucgagguguacugcgacauggagaccaugggcggcggcuggaccgugcugcaggccagacuggacggcagcaccaacuucaccagaaccuggcaggacuacaaggccggcuucggcaaccugagaagagaguucuggcugggcaacgacaagauccaccugcugaccaagagcaaggagaugauccugagaaucgaccuggaggacuucaacggcguggagcuguacgcccuguacgaccaguucuacguggccaacgaguuccugaaguacagacugcacgugggcaacuacaacggcaccgccggcgacgcccugagauucaacaagcacuacaaccacgaccugaaguucuucaccacccccgacaaggacaacgacagauaccccagcggcaacugcggccuguacuacagcagcggcuggugguucgacgccugccugagcgccaaccugaacggcaaguacuaccaccagaaguacagaggcgugagaaacggcaucuucuggggcaccuggcccggcgugagcgaggcccaccccggcggcuacaagagcagcuucaaggaggccaagaugaugaucagacccaagcacuucaagcccuaa

SEQ ID NO: 17102 - RNA, 1383 nt, Artificial Sequence
  FGR__Homo_sapiens__XP_011539313
augggcugcguguucugcaagaagcuggagcccguggccaccgccaaggaggacgccggccuggagggcgacuucagaagcuacggcgccgccgaccacuacggccccgaccccaccaaggccagacccgccagcagcuucgcccacauccccaacuacagcaacuucagcagccaggccaucaaccccggcuuccuggacagcggcaccaucagaggcgugagcgugaaggugaccggcggcagacugggccugagcgcccccgagaagcuggccgccuuccccgccaccaccuggccccugcugacccagagcaagcugaagagcgccuacagccugagcaucagagacugggaccagaccagaggcgaccacgugaagcacuacaagaucagaaagcuggacaugggcggcuacuacaucaccaccagagugcaguucaacagcgugcaggagcuggugcagcacuacauggaggugaacgacggccugugcaaccugcugaucgcccccugcaccaucaugaagccccagacccugggccuggccaaggacgccugggagaucagcagaagcagcaucacccuggagagaagacugggcaccggcugcuucggcgacguguggcugggcaccuggaacggcagcaccaagguggccgugaagacccugaagcccggcaccaugagccccaaggccuuccuggaggaggcccaggugaugaagcugcugagacacgacaagcuggugcagcuguacgccguggugagcgaggagcccaucuacaucgugaccgaguucaugugccacggcagccugcuggacuuccugaagaaccccgagggccaggaccugagacugccccagcugguggacauggccgcccagguggccgagggcauggccuacauggagagaaugaacuacauccacagagaccugagagccgccaacauccuggugggcgagagacuggccugcaagaucgccgacuucggccuggccagacugaucaaggacgacgaguacaaccccugccagggcagcaaguuccccaucaaguggaccgcccccgaggccgcccuguucggcagauucaccaucaagagcgacguguggagcuucggcauccugcugaccgagcugaucaccaagggcagaauccccuaccccggcaugaacaagagagaggugcuggagcagguggagcagggcuaccacaugcccugcccccccggcugccccgccagccuguacgaggccauggagcagaccuggagacuggaccccgaggagagacccaccuucgaguaccugcagagcuuccuggaggacuacuucaccagcgccgagccccaguaccagcccggcgaccagaccuaa

SEQ ID NO: 17103 - RNA, 3432 nt, Artificial Sequence
  FHDC1__Homo_sapiens__NP_203751
augcacgugaugaacugcgugagccuggugagcgacaaggagaacggcaacaucgccaccgcccccggcuucaugaucggccagacccccccccccgccccccccccccccccccccccccccccccccagcccccccugcagcugcagcagagaggagugccccagcagccccccccccccccccccccccccccugcccggcgagccccccauccccccccccccccccggccugccccccaccacccacaugaacggcuacagccaccugggcaagaagaagagaaugagaagcuucuucuggaagaccauccccgaggagcaggugagaggcaagaccaacaucuggacccuggccgccagacaggagcaccacuaccagaucgacaccaagaccaucgaggagcuguucggccagcaggaggacaccaccaagagcagccugcccagaagaggcagaacccugaacagcagcuucagagaggccagagaggagaucaccauccuggacgccaagagaagcaugaacaucggcaucuuccugaagcaguucaagaagagccccagaagcaucguggaggacauccaccagggcaagagcgagcacuacggcagcgagacccugagagaguuccugaaguuccugcccgagagcgaggaggugaagaagcugaaggccuucagcggcgacgugagcaagcugagccuggccgacagcuuccuguacggccugauccaggugcccaacuacagccugagaaucgaggccauggugcugaagaaggaguuccugcccagcugcagcagccuguacaccgacaucaccgugcugagaaccgccaucaaggagcugaugagcugcgaggagcugcacagcauccugcaccuggugcugcaggccggcaacaucaugaacgccggcggcuacgccggcaacgccgugggcuucaagcugagcagccugcugaagcuggccgacaccaaggccaacaagcccggcaugaaccugcugcacuucguggcccaggaggcccagaagaaggacaccauccugcugaacuucagcgagaagcugcaccacgugcagaagaccgccagacugagccuggagaacaccgaggccgagcugcaccugcuguucgugagaaccaagagccugaaggagaacauccagagagacggcgagcugugccagcagauggaggacuuccugcaguucgccaucgagaagcugagagagcuggagugcuggaagcaggagcugcaggacgaggccuacacccugaucgacuucuucugcgaggacaagaagaccaugaagcuggacgagugcuuccagaucuucagagacuucugcaccaaguucaacaaggccgugaaggacaaccacgacagagaggcccaggagcugagacagcugcagagacugaaggagcaggagcagaagcagagaagcugggccaccggcgagcugggcgccuucggcagaagcagcagcgagaacgacguggagcugcugaccaagaagggcgccgagggccugcugcccuuccugcaccccagacccaucagccccagcagccccagcuacagaccccccaacaccagaagaagcagacugagccugggccccagcgccgacagagagcugcugaccuuccuggagagcagcaccggcagccccgaggagcccaacaaguuccacagccugcccagaagcagccccagacaggccagacccaccaucgccugccuggagcccgccgaggugagacaccaggacagcagcuucgcccacaagccccaggccagcggcggccaggaggaggcccccaacccccccagcgcccaggcccaccagcuggccgccgcccagcccgagaaccacgccagcgccuuccccagagccagaagacagggcgugagcgugcugagaaagagauacagcgagcccgugagccugggcagcgcccagagccccccccugagcccccuggcccugggcaucaaggagcacgagcuggugaccggccuggcccaguucaaccugcagggcagccagggcauggaggagaccagccagcugacccugagcgacuucagccccauggagcuggagagcgugggccacagaggcccccagagccugagcgccagcagcagcagccugacccccaugggcagagacgcccugggcagccugagccccgcccuggaggacggcaaggccgcccccgacgagcccggcagcgccgcccugggcagcgugggcagcagcgaccccgagaacaaggaccccagaccccuguucugcaucagcgacaccaccgacugcagccugacccuggacugcagcgagggcaccgacagcagacccagaggcggcgaccccgaggagggcggcgagggcgacggcagcaugagcagcggcgugggcgagaugggcgacagccaggugagcagcaaccccaccagcagcccccccggcgaggcccccgcccccgugagcguggacagcgagcccagcugcaagggcggccugcccagagacaagcccaccaagagaaaggacgugguggcccccaagagaggcagccugaaggaggccagccccggcgccagcaagcccggcagcgccagaagaagccagggcgccguggccaagagcgugagaacccugaccgccagcgagaacgagagcaugagaaaggugaugcccaucaccaagagcagcagaggcgccggcuggagaagacccgagcugagcagcagaggccccagccagaacccccccagcagcaccgacaccguguggagcagacagaacagcgugagaagagccagcaccggcgccgaggagcagagacugcccagaggcagcagcggcagcagcagcaccagacccggcagagacgugccccugcagcccagaggcagcuucaagaagcccagcgccaagccccugagaaaccugcccagacagaagcccgaggagaacaagaccugcagagcccacagcgagggccccgagagccccaaggaggagcccaagacccccagcgugcccagcgugccccacgagcugcccagagugcccagcuucgccagaaacaccguggccagcagcagcagaagcaugagaaccgaccugccccccguggccaaggcccccggcaucaccagaaccgugagccagagacagcugagagugaagggcgaccccgaggacgccgcccccaaggacagcagcacccugagaagagccagcagcgccagagcccccaagaagagacccgagagcgccgagggccccagcgccaacaccgaggccccccugaaggccagaggcgccggcgagagagccagccugagaagaaaggacagcagcagaaccacccugggcagaauccugaacccccugagaaaguaa

SEQ ID NO: 17104 - RNA, 1533 nt, Artificial Sequence
  FH__Homo_sapiens__NP_000134
auguacagagcccugagacugcuggccagaagcagaccccuggugagagcccccgccgccgcccuggccagcgcccccggccugggcggcgccgccgugcccagcuucuggccccccaacgccgccagaauggccagccagaacagcuucagaaucgaguacgacaccuucggcgagcugaaggugcccaacgacaaguacuacggcgcccagaccgugagaagcaccaugaacuucaagaucggcggcgugaccgagagaaugcccacccccgugaucaaggccuucggcauccugaagagagccgccgccgaggugaaccaggacuacggccuggaccccaagaucgccaacgccaucaugaaggccgccgacgagguggccgagggcaagcugaacgaccacuucccccuggugguguggcagaccggcagcggcacccagaccaacaugaacgugaacgaggugaucagcaacagagccaucgagaugcugggcggcgagcugggcagcaagauccccgugcaccccaacgaccacgugaacaagagccagagcagcaacgacaccuuccccaccgccaugcacaucgccgccgccaucgaggugcacgaggugcugcugcccggccugcagaagcugcacgacgcccuggacgccaagagcaaggaguucgcccagaucaucaagaucggcagaacccacacccaggacgccgugccccugacccugggccaggaguucagcggcuacgugcagcaggugaaguacgccaugaccagaaucaaggccgccaugcccagaaucuacgagcuggccgccggcggcaccgccgugggcaccggccugaacaccagaaucggcuucgccgagaagguggccgccaagguggccgcccugaccggccugcccuucgugaccgcccccaacaaguucgaggcccuggccgcccacgacgcccugguggagcugagcggcgccaugaacaccaccgccugcagccugaugaagaucgccaacgacaucagauuccugggcagcggccccagaagcggccugggcgagcugauccugcccgagaacgagcccggcagcagcaucaugcccggcaaggugaaccccacccagugcgaggccaugaccaugguggccgcccaggugaugggcaaccacguggccgugaccgugggcggcagcaacggccacuucgagcugaacguguucaagcccaugaugaucaagaacgugcugcacagcgccagacugcugggcgacgccagcgugagcuucaccgagaacugcguggugggcauccaggccaacaccgagagaaucaacaagcugaugaacgagagccugaugcuggugaccgcccugaacccccacaucggcuacgacaaggccgccaagaucgccaagaccgcccacaagaacggcagcacccugaaggagaccgccaucgagcugggcuaccugaccgccgagcaguucgacgagugggugaagcccaaggacaugcugggccccaaguaa

SEQ ID NO: 17105 - RNA, 444 nt, Artificial Sequence
  FHIT__Homo_sapiens__NP_002003
augagcuucagauucggccagcaccugaucaagcccagcgugguguuccugaagaccgagcugagcuucgcccuggugaacagaaagcccguggugcccggccacgugcuggugugcccccugagacccguggagagauuccacgaccugagacccgacgagguggccgaccuguuccagaccacccagagagugggcaccgugguggagaagcacuuccacggcaccagccugaccuucagcaugcaggacggccccgaggccggccagaccgugaagcacgugcacgugcacgugcugcccagaaaggccggcgacuuccacagaaacgacagcaucuacgaggagcugcagaagcacgacaaggaggacuuccccgccagcuggagaagcgaggaggagauggccgccgaggccgccgcccugagaguguacuuccaguaa

SEQ ID NO: 17106 - RNA, 891 nt, Artificial Sequence
  FHL1__Homo_sapiens__NP_001153171
auggccagccacagacacagcggccccagcagcuacaaggugggcaccauggccgagaaguucgacugccacuacugcagagacccccugcagggcaagaaguacgugcagaaggacggccaccacugcugccugaagugcuucgacaaguucugcgccaacaccugcguggagugcagaaagcccaucggcgccgacagcaaggaggugcacuacaagaacagauucuggcacgacaccugcuucagaugcgccaagugccugcacccccuggccaacgagaccuucguggccaaggacaacaagauccugugcaacaagugcaccaccagagaggacagccccaagugcaagggcugcuucaaggccaucguggccggcgaccagaacguggaguacaagggcaccguguggcacaaggacugcuucaccugcagcaacugcaagcaggugaucggcaccggcagcuucuuccccaagggcgaggacuucuacugcgugaccugccacgagaccaaguucgccaagcacugcgugaagugcaacaaggccaucaccagcggcggcaucaccuaccaggaccagcccuggcacgccgacugcuucgugugcgugaccugcagcaagaagcuggccggccagagauucaccgccguggaggaccaguacuacugcguggacugcuacaagaacuucguggccaagaagugcgccggcugcaagaaccccaucaccggcuucggcaagggcagcagcgugguggccuacgagggccagagcuggcacgacuacugcuuccacugcaagaagugcagcgugaaccuggccaacaagagauucguguuccaccaggagcagguguacugccccgacugcgccaagaagcuguaa

SEQ ID NO: 17107 - RNA, 1170 nt, Artificial Sequence
  FHL2__Homo_sapiens__XP_005263959
augaccagaagaggcuucagcagagccggcgccgcccagagaagcaccagacccgccgccgagccccagccccccgccgccagagcccugcagcccagacccggcgugcccggcccccugagaugcagagaguaccugcagccccccgcccccagaagagaggccgagggccugagccaccagggcagcgaggugggcgccgagagcggcgccagacccaaggagagaggcgccgagcccgagcugggcagacuguggcugagaaccgugagcagcuggagacugggcuggcacuucgacuucggcguggccgagaagcccggcgugaagaugaccgagagauucgacugccaccacugcaacgagagccuguucggcaagaaguacauccugagagaggagagccccuacugcguggugugcuucgagacccuguucgccaacaccugcgaggagugcggcaagcccaucggcugcgacugcaaggaccugagcuacaaggacagacacuggcacgaggccugcuuccacugcagccagugcagaaacagccugguggacaagcccuucgccgccaaggaggaccagcugcugugcaccgacugcuacagcaacgaguacagcagcaagugccaggagugcaagaagaccaucaugcccggcaccagaaagauggaguacaagggcagcagcuggcacgagaccugcuucaucugccacagaugccagcagcccaucggcaccaagagcuucauccccaaggacaaccagaacuucugcgugcccugcuacgagaagcagcacgccaugcagugcgugcagugcaagaagcccaucaccaccggcggcgugaccuacagagagcagcccuggcacaaggagugcuucgugugcaccgccugcagaaagcagcugagcggccagagauucaccgccagagacgacuucgccuacugccugaacugcuucugcgaccuguacgccaagaagugcgccggcugcaccaaccccaucagcggccugggcggcaccaaguacaucagcuucgaggagagacaguggcacaacgacugcuucaacugcaagaagugcagccugagccuggugggcagaggcuuccugaccgagagagacgacauccugugccccgacugcggcaaggacaucuaa

SEQ ID NO: 17108 - RNA, 855 nt, Artificial Sequence
  FHL5__Homo_sapiens__XP_006715676
augaccaccgcccacuucuacugccaguacugcaccgccagccugcugggcaagaaguacgugcugaaggacgacagccccuacugcgugaccugcuacgacagaguguucagcaacuacugcgaggagugcaagaagcccaucgagagcgacagcaaggaccugugcuacaaggacagacacuggcacgagggcugcuucaagugcaccaagugcaaccacagccugguggagaagcccuucgccgccaaggacgagagacugcugugcaccgagugcuacagcaacgagugcagcagcaagugcuuccacugcaagagaaccaucaugcccggcagcagaaagauggaguucaagggcaacuacuggcacgagaccugcuucgugugcgagaacugcagacagcccaucggcaccaagccccugaucagcaaggagagcggcaacuacugcgugcccugcuucgagaaggaguucgcccacuacugcaacuucugcaagaaggugaucaccagcggcggcaucaccuucugcgaccagcuguggcacaaggagugcuuccugugcagcggcugcagaaaggaccugugcgaggagcaguucaugagcagagacgacuaccccuucugcguggacugcuacaaccaccuguacgccaacaagugcguggccugcagcaagcccaucagcggccugaccggcgccaaguucaucugcuuccaggacagccaguggcacagcgagugcuucaacugcggcaagugcagcgugagccuggugggcaagggcuuccugacccagaacaaggagaucuucugccagaagugcggcagcggcauggacaccgacaucuaa

SEQ ID NO: 17109 - RNA, 3495 nt, Artificial Sequence
  FHOD1__Homo_sapiens__NP_037373
auggccggcggcgaggacagaggcgacggcgagcccgugagcguggugaccgugagagugcaguaccuggaggacaccgaccccuucgccugcgccaacuuccccgagcccagaagagcccccaccugcagccuggacggcgcccugccccugggcgcccagauccccgccgugcacagacugcugggcgccccccugaagcuggaggacugcgcccugcaggugagccccagcggcuacuaccuggacaccgagcugagccuggaggagcagagagagaugcuggagggcuucuacgaggagaucagcaagggcagaaagcccacccugauccugagaacccagcugagcgugagagugaacgccauccuggagaagcuguacagcagcagcggccccgagcugagaagaagccuguucagccugaagcagaucuuccaggaggacaaggaccuggugcccgaguucgugcacagcgagggccugagcugccugaucagagugggcgccgccgccgaccacaacuaccagagcuacauccugagagcccugggccagcugaugcuguucguggacggcaugcugggcgugguggcccacagcgacaccauccaguggcuguacacccugugcgccagccugagcagacugguggugaagaccgcccugaagcugcugcugguguucguggaguacagcgagaacaacgccccccuguucaucagagccgugaacagcguggccagcaccaccggcgccccccccugggccaaccuggugagcauccuggaggagaagaacggcgccgaccccgagcugcugguguacaccgugacccugaucaacaagacccuggccgcccugcccgaccaggacagcuucuacgacgugaccgacgcccuggagcagcagggcauggaggcccuggugcagagacaccugggcaccgccggcaccgacguggaccugagaacccagcuggugcuguacgagaacgcccugaagcuggaggacggcgacaucgaggaggcccccggcgccggcggcagaagagagagaagaaagcccagcagcgaggagggcaagagaagcagaagaagccuggagggcggcggcugccccgccagagcccccgagcccggccccaccggccccgccagccccgugggccccaccagcagcaccggccccgcccugcugaccggccccgccagcagccccgugggcccccccagcggccugcaggccagcgugaaccuguuccccaccaucagcguggcccccagcgccgacaccagcagcgagagaagcaucuacaaggccagauuccuggagaacguggccgccgccgagaccgagaagcagguggcccuggcccagggcagagccgagacccuggccggcgccaugcccaacgaggccggcggccaccccgacgccagacagcugugggacagccccgagaccgcccccgccgccagaaccccccagagccccgcccccugcgugcugcugagagcccagagaagccuggcccccgagcccaaggagccccugauccccgccagccccaaggccgagcccaucugggagcugcccaccagagcccccagacugagcaucggcgaccuggacuucagcgaccugggcgaggacgaggaccaggacaugcugaacguggagagcguggaggccggcaaggacauccccgcccccagccccccccugccccugcugagcggcgugccccccccccccccccugcccccccccccccccaucaagggccccuucccccccccccccccccugccccuggccgccccccugccccacagcgugcccgacagcagcgcccugcccaccaagagaaagaccgugaagcuguucuggagagagcugaagcuggccggcggccacggcgugagcgccagcagauucggccccugcgccacccugugggccagccuggaccccgugagcguggacaccgccagacuggagcaccuguucgagagcagagccaaggaggugcugcccagcaagaaggccggcgagggcagaagaaccaugaccaccgugcuggaccccaagagaagcaacgccaucaacaucggccugaccacccugccccccgugcacgugaucaaggccgcccugcugaacuucgacgaguucgccgugagcaaggacggcaucgagaagcugcugaccaugaugcccaccgaggaggagagacagaagaucgaggaggcccagcuggccaaccccgacaucccccugggccccgccgagaacuuccugaugacccuggccagcaucggcggccuggccgccagacugcagcugugggccuucaagcuggacuacgacagcauggagagagagaucgccgagccccuguucgaccugaaggugggcauggagcagcuggugcagaacgccaccuucagaugcauccuggccacccugcuggccgugggcaacuuccugaacggcagccagagcagcggcuucgagcugagcuaccuggagaaggugagcgaggugaaggacaccgugagaagacagagccugcugcaccaccugugcagccuggugcugcagaccagacccgagagcagcgaccuguacagcgagauccccgcccugaccagaugcgccaagguggacuucgagcagcugaccgagaaccugggccagcuggagagaagaagcagagccgccgaggagagccugagaagccuggccaagcacgagcuggcccccgcccugagagccagacugacccacuuccuggaccagugcgccagaagaguggccaugcugagaaucgugcacagaagagugugcaacagauuccacgccuuccugcuguaccugggcuacaccccccaggccgccagagaggugagaaucaugcaguucugccacacccugagagaguucgcccuggaguacagaaccugcagagagagagugcugcagcagcagcagaagcaggccaccuacagagagagaaacaagaccagaggcagaaugaucaccgagaccgagaaguucagcggcguggccggcgaggcccccagcaaccccagcgugcccguggccgugagcagcggccccggcagaggcgacgccgacagccacgccagcaugaagagccugcugaccagcagacccgaggacaccacccacaacagaagaagcagaggcauggugcagagcagcagccccaucaugcccaccgugggccccagcaccgccagccccgaggagccccccggcagcagccugcccagcgacaccagcgacgagaucauggaccugcuggugcagagcgugaccaagagcagccccagagcccuggccgccagagagagaaagagaagcagaggcaacagaaagagccugagaagaacccugaagagcggccugggcgacgaccuggugcaggcccugggccugagcaagggccccggccuggagguguaa

SEQ ID NO: 17110 - RNA, 4269 nt, Artificial Sequence
  FHOD3__Homo_sapiens__NP_001268668
auggccacccuggccugcagagugcaguuccuggacgacaccgaccccuucaacagcaccaacuuccccgagcccagcagacccccccuguucaccuucagagaggaccuggcccugggcacccagcuggccggcgugcacagacugcugcaggccccccacaagcuggacgacugcacccugcagcugagccacaacggcgccuaccuggaccuggaggccacccuggccgagcagagagacgagcuggagggcuuccaggacgacgccggcagaggcaagaagcacagcaucauccugagaacccagcugagcgugagagugcacgccugcaucgagaagcuguacaacagcagcggcagagaccugagaagagcccuguucagccugaagcagaucuuccaggacgacaaggaccuggugcacgaguucgugguggccgagggccugaccugccugaucaaggugggcgccgaggccgaccagaacuaccagaacuacauccugagagcccugggccagaucaugcuguacguggacggcaugaacggcgugaucaacagaaacgagaccauccaguggcuguacacccugaucggcagcaaguucagacugguggugaagaccgcccugaagcugcugcugguguucguggaguacagcgagagcaacgccccccugcugauccaggccgugaccgccguggacaccaagagaggcgugaagcccuggagcaacaucauggagauccuggaggagaaggacggcguggacaccgagcugcugguguacgccaugacccuggugaacaagacccugagcggccugcccgaccaggacaccuucuacgacgugguggacugccuggaggagcugggcaucgccgccgugagccagagacaccugaacaagaagggcaccgaccuggaccugguggagcagcugaacaucuacgagguggcccugagacacgaggacggcgacgagaccaccgagcccccccccagcggcugcagagacagaagaagagccagcgugugcagcagcggcggcggcgagcacagaggccuggacagaagaagaagcagaagacacagcgugcagagcaucaagagcacccugagcgcccccaccagccccugcagccagagcgcccccagcuucaagcccaaccaggugagagaccugagagagaaguacagcaacuucggcaacaacagcuaccacagcagcagacccagcagcggcagcagcgugcccaccacccccaccagcagcgugagccccccccaggaggccagacuggagagaagcagccccagcggccugcugaccagcagcuucagacagcaccaggagagccuggccgccgagagagagagaagaagacaggagagagaggagagacugcagagaaucgagagagaggagagaaacaaguucagauacaaguaccuggagcagcuggccgccgaggagcacgagaaggagcugagaagcagaagcgugagcagaggcagagccgaccugagccuggaccugaccagccccgccgcccccgccugccuggccccccugagccacagccccagcagcagcgacagccaggaggcccugaccgugagcgccagcagccccggcaccccccaccacccccaggccagcgccggcgaccccgagcccgagagcgaggccgagcccgaggccgaggccggcgccggccagguggccgacgaggccggccaggacaucgccagcgcccacgagggcgccgagaccgagguggagcaggcccuggagcaggagcccgaggagagagccagccugagcgagaaggagagacagaacgagggcgugaacgagagagacaacugcagcgccagcagcgugagcagcagcagcagcacccuggagagagaggagaaggaggacaagcugagcagagacagaaccaccggccuguggcccgccggcgugcaggacgccggcgugaacggccagugcggcgacauccugaccaacaagagauucaugcuggacaugcuguacgcccacaacagaaagagccccgacgacgaggagaagggcgacggcgaggccggcagaacccagcaggaggccgaggccguggccagccuggccaccagaaucagcacccugcaggccaacagccagacccaggacgagagcgugagaagaguggacgugggcugccuggacaacagaggcagcgugaaggccuucgccgagaaguucaacagcggcgaccugggcagaggcagcaucagccccgacgccgagcccaacgacaaggugcccgagaccgcccccgugcagcccaagaccgagagcgacuacaucugggaccagcugauggccaaccccagagagcugagaauccaggacauggacuucaccgaccugggcgaggaggacgacaucgacgugcuggacguggaccugggccacagagaggcccccggccccccccccccccccccccccaccuuccugggccugccccccccccccccccccccccugcuggacagcaucccccccccccccgugcccggcaaccugcuggugccccccccccccguguucaacgccccccagggccugggcuggagccaggugcccagaggccagcccaccuucaccaagaagaagaagaccaucagacuguucuggaacgaggugagacccuucgacuggcccugcaagaacaacagaagaugcagagaguuccuguggagcaagcuggagcccaucaagguggacaccagcagacuggagcaccuguucgagagcaagagcaaggagcugagcgugagcaagaagaccgccgccgacggcaagagacaggagaucaucgugcuggacagcaagagaagcaacgccaucaacaucggccugaccgugcugcccccccccagaaccaucaagaucgccauccugaacuucgacgaguacgcccugaacaaggagggcaucgagaagauccugaccaugauccccaccgacgaggagaagcagaagauccaggaggcccagcuggccaaccccgagaucccccugggcagcgccgagcaguuccugcugacccugagcagcaucagcgagcugagcgccagacugcaccugugggccuucaagauggacuacgagaccaccgagaaggagguggccgagccccugcuggaccugaaggagggcaucgaccagcuggagaacaacaagacccugggcuucauccugagcacccugcuggccaucggcaacuuccugaacggcaccaacgccaaggccuucgagcugagcuaccuggagaaggugcccgaggugaaggacaccgugcacaagcagagccugcugcaccacgugugcaccauggugguggagaacuuccccgacagcagcgaccuguacagcgagaucggcgccaucaccagaagcgccaagguggacuucgaccagcugcaggacaaccugugccagauggagagaagaugcaaggccagcugggaccaccugaaggccaucgccaagcacgagaugaagcccgugcugaagcagagaaugagcgaguuccugaaggacugcgccgagagaaucaucauccugaagaucgugcacagaagaaucaucaacagauuccacagcuuccugcuguucaugggccacccccccuacgccaucagagaggugaacaucaacaaguucugcagaaucaucagcgaguucgcccuggaguacagaaccaccagagagagagugcugcagcagaagcagaagagagccaaccacagagagagaaacaagaccagaggcaagaugaucaccgacagcggcaaguucagcggcagcagccccgccccccccagccagccccagggccugagcuacgccgaggacgccgccgagcacgagaacaugaaggccgugcugaagaccagcagccccagcguggaggacgccacccccgcccugggcgugagaaccagaagcagagccagcagaggcagcaccagcagcuggaccaugggcaccgacgacagccccaacgugaccgacgacgccgccgacgagaucauggacagaaucgugaagagcgccacccaggugcccagccagagaguggugcccagagagagaaagagaagcagagccaacagaaagagccugagaagaacccugaagagcggccugacccccgaggaggccagagcccugggccuggugggcaccagcgagcugcagcuguaa

SEQ ID NO: 17111 - RNA, 1074 nt, Artificial Sequence
  FIBP__Homo_sapiens__NP_004205
augaccagcgagcuggacaucuucgugggcaacaccacccugaucgacgaggacguguacagacuguggcuggacggcuacagcgugaccgacgccguggcccugagagugagaagcggcauccuggagcagaccggcgccaccgccgccgugcugcagagcgacaccauggaccacuacagaaccuuccacaugcuggagagacugcugcacgccccccccaagcugcugcaccagcugaucuuccagaucccccccagcagacaggcccugcugaucgagagauacuacgccuucgacgaggccuucgugagagaggugcugggcaagaagcugagcaagggcaccaagaaggaccuggacgacaucagcaccaagaccggcaucacccugaagagcugcagaagacaguucgacaacuucaagagaguguucaaggugguggaggagaugagaggcagccugguggacaacauccagcagcacuuccugcugagcgacagacuggccagagacuacgccgccaucguguucuucgccaacaacagauucgagaccggcaagaagaagcugcaguaccugagcuucggcgacuucgccuucugcgccgagcugaugauccagaacuggacccugggcgccguggacagccagauggacgacauggacauggaccuggacaaggaguuccugcaggaccugaaggagcugaaggugcugguggccgacaaggaccugcuggaccugcacaagagccuggugugcaccgcccugagaggcaagcugggcguguucagcgagauggaggccaacuucaagaaccugagcagaggccuggugaacguggccgccaagcugacccacaacaaggacgugagagaccuguucguggaccugguggagaaguucguggagcccugcagaagcgaccacuggccccugagcgacgugagauucuuccugaaccaguacagcgccagcgugcacagccuggacggcuucagacaccaggcccugugggacagauacaugggcacccugagaggcugccugcugagacuguaccacgacuaa

SEQ ID NO: 17112 - RNA, 2724 nt, Artificial Sequence
  FIG4__Homo_sapiens__NP_055660
augcccaccgccgccgcccccaucaucagcagcgugcagaagcuggugcuguacgagaccagagccagauacuuccuggugggcagcaacaacgccgagaccaaguacagagugcugaagaucgacagaaccgagcccaaggaccuggugaucaucgacgacagacacguguacacccagcaggaggugagagagcugcugggcagacuggaccugggcaacagaaccaagaugggccagaagggcagcagcggccuguucagagccgugagcgccuucggcguggugggcuucgugagauuccuggagggcuacuacaucgugcugaucaccaagagaagaaagauggccgacaucggcggccacgccaucuacaagguggaggacaccaacaugaucuacauccccaacgacagcgugagagugacccaccccgacgaggccagauaccugagaaucuuccagaacguggaccugagcagcaacuucuacuucagcuacagcuacgaccugagccacagccugcaguacaaccugaccgugcugagaaugccccuggagaugcugaagagcgagaugacccagaacagacaggagagcuucgacaucuucgaggacgagggccugaucacccagggcggcagcggcguguucggcaucugcagcgagcccuacaugaaguacguguggaacggcgagcugcuggacaucaucaagagcaccgugcacagagacuggcugcuguacaucauccacggcuucugcggccagagcaagcugcugaucuacggcagacccguguacgugacccugaucgccagaagaagcagcaaguucgccggcaccagauuccugaagagaggcgccaacugcgagggcgacguggccaacgagguggagaccgagcagauccugugcgacgccagcgugaugagcuucaccgccggcagcuacagcagcuacgugcaggugagaggcagcgugccccuguacuggagccaggacaucagcaccaugaugcccaagccccccaucacccuggaccaggccgaccccuucgcccacguggccgcccugcacuucgaccagauguuccagagauucggcagccccaucaucauccugaaccuggugaaggagagagagaagagaaagcacgagagaauccugagcgaggagcugguggccgccgugaccuaccugaaccaguuccugccccccgagcacaccaucguguacauccccugggacauggccaaguacaccaagagcaagcugugcaacgugcuggacagacugaacgugaucgccgagagcguggugaagaagaccggcuucuucgugaacagacccgacagcuacugcagcauccugagacccgacgagaaguggaacgagcugggcggcugcgugauccccaccggcagacugcagaccggcauccugagaaccaacugcguggacugccuggacagaaccaacaccgcccaguucauggugggcaagugcgcccuggccuaccagcuguacagccugggccugaucgacaagcccaaccugcaguucgacaccgacgccgugagacuguucgaggagcuguacgaggaccacggcgacacccugagccugcaguacggcggcagccagcuggugcacagagugaagaccuacagaaagaucgcccccuggacccagcacagcaaggacaucaugcagacccugagcagauacuacagcaacgccuucagcgacgccgacagacaggacagcaucaaccuguuccugggcguguuccaccccaccgagggcaagccccaccugugggagcugcccaccgacuucuaccugcaccacaagaacaccaugagacugcugcccaccagaagaagcuacaccuacugguggacccccgaggugaucaagcaccugccccugcccuacgacgaggugaucugcgccgugaaccugaagaagcugaucgugaagaaguuccacaaguacgaggaggagaucgacauccacaacgaguucuucagacccuacgagcugagcagcuucgacgacaccuucugccuggccaugaccagcagcgccagagacuucaugcccaagaccgugggcaucgaccccagccccuucaccgugagaaagcccgacgagaccggcaagagcgugcugggcaacaagagcaacagagaggaggccgugcugcagagaaagaccgccgccagcgccccccccccccccagcgaggaggccgugagcagcagcagcgaggacgacagcggcaccgacagagaggaggagggcagcgugagccagagaagcacccccgugaagaugaccgacgccggcgacagcgccaaggugaccgagaacguggugcagcccaugaaggagcuguacggcaucaaccugagcgacggccugagcgaggaggacuucagcaucuacagcagauucgugcagcugggccagagccagcacaagcaggacaagaacagccagcagcccugcagcagaugcagcgacggcgugaucaagcugacccccaucagcgccuucagccaggacaacaucuacgaggugcagccccccagaguggacagaaagagcaccgagaucuuccaggcccacauccaggccagccagggcaucaugcagccccugggcaaggaggacagcagcauguacagagaguacaucagaaacagauaccuguaa

SEQ ID NO: 17113 - RNA, 1065 nt, Artificial Sequence
  FIGF__Homo_sapiens__NP_004460
auguacagagagugggugguggugaacguguucaugaugcuguacgugcagcuggugcagggcagcagcaacgagcacggccccgugaagagaagcagccagagcacccuggagagaagcgagcagcagaucagagccgccagcagccuggaggagcugcugagaaucacccacagcgaggacuggaagcuguggagaugcagacugagacugaagagcuucaccagcauggacagcagaagcgccagccacagaagcaccagauucgccgccaccuucuacgacaucgagacccugaaggugaucgacgaggaguggcagagaacccagugcagccccagagagaccugcguggagguggccagcgagcugggcaagagcaccaacaccuucuucaagccccccugcgugaacguguucagaugcggcggcugcugcaacgaggagagccugaucugcaugaacaccagcaccagcuacaucagcaagcagcuguucgagaucagcgugccccugaccagcgugcccgagcuggugcccgugaagguggccaaccacaccggcugcaagugccugcccaccgcccccagacaccccuacagcaucaucagaagaagcauccagauccccgaggaggacagaugcagccacagcaagaagcugugccccaucgacaugcugugggacagcaacaagugcaagugcgugcugcaggaggagaacccccuggccggcaccgaggaccacagccaccugcaggagcccgcccugugcggcccccacaugauguucgacgaggacagaugcgagugcgugugcaagacccccugccccaaggaccugauccagcaccccaagaacugcagcugcuucgagugcaaggagagccuggagaccugcugccagaagcacaagcuguuccaccccgacaccugcagcugcgaggacagaugccccuuccacaccagacccugcgccagcggcaagaccgccugcgccaagcacugcagauuccccaaggagaagagagccgcccagggcccccacagcagaaagaaccccuaa

SEQ ID NO: 17114 - RNA, 660 nt, Artificial Sequence
  FIGLA__Homo_sapiens__NP_001004311
auggaccccgcccccggcgugcuggaccccagagccgccccccccgcccugcugggcaccccccaggccgaggugcuggaggacgugcugagagagcaguucggcccccugccccagcuggccgccgugugcagacugaagagacugcccagcggcggcuacagcagcaccgagaaccugcagcuggugcuggagagaagaagaguggccaacgccaaggagagagagagaaucaagaaccugaacagaggcuucgccagacugaaggcccuggugcccuuccugccccagagcagaaagcccagcaagguggacauccugaagggcgccaccgaguacauccaggugcugagcgaccugcuggagggcgccaaggacagcaagaagcaggaccccgacgagcagagcuacagcaacaacagcagcgagagccacaccagcagcgccagacagcugagcagaaacaucacccagcacaucagcugcgccuucggccugaagaacgaggaggagggccccugggccgacggcggcagcggcgagcccgcccacgccugcagacacagcgugaugagcaccaccgagaucaucagccccaccagaagccuggacagauuccccgagguggagcugcugagccacagacugccccagguguaa

SEQ ID NO: 17115 - RNA, 2280 nt, Artificial Sequence
  FIGN__Homo_sapiens__NP_060556
augaucagcagcaccagcguguacggccugaagaugcaguggacccccgagcacgcccaguggcccgagcagcacuucgacaucaccagcaccaccagaagccccgcccacaagguggaggccuacagaggccaccugcagagaaccuaccaguacgccugggccaacgacgacaucagcgcccugaccgccagcaaccugcugaagaaguacgccgagaaguacagcggcauccuggagggccccguggacagacccgugcugagcaacuacagcgacacccccagcggccuggugaacggcagaaagaacgagagcgagcccuggcagcccagccugaacagcgaggccguguaccccaugaacugcgugcccgacgugaucaccgccagcaaggccggcgugagcagcgcccugccccccgccgacgugagcgccagcaucggcagcagccccggcguggccagcaaccugaccgagcccagcuacagcagcagcaccugcggcagccacaccgugcccagccugcacgccggccugcccagccaggaguacgcccccggcuacaacggcagcuaccugcacagcaccuacagcagccagcccgcccccgcccugcccagcccccaccccagcccccugcacagcagcggccugcugcagcccccccccccccccccccccccccccgcccuggugcccggcuacaacggcaccagcaaccugagcagcuacagcuaccccagcgccagcuaccccccccagaccgccgugggcagcggcuacagccccggcggcgccccccccccccccagcgccuaccugcccagcggcauccccgcccccaccccccugccccccaccaccgugcccggcuacaccuaccagggccacggccugacccccaucgcccccagcgcccugaccaacagcagcgccagcagccugaagagaaaggccuucuacauggccggccagggcgacauggacagcagcuacggcaacuacagcuacggccagcagagaagcacccagagccccauguacagaaugcccgacaacagcaucagcaacaccaacagaggcaacggcuucgacagaagcgccgagaccagcagccuggccuucaagcccaccaagcagcugaugagcagcgagcagcagagaaaguucagcagccagagcagcagagcccugaccccccccagcuacagcaccgccaagaacagccugggcagcagaagcagcgagagcuucggcaaguacaccagccccgugaugagcgagcacggcgacgagcacagacagcugcugagccaccccaugcagggccccggccugagagccgccaccagcagcaaccacagcguggacgagcagcugaagaacaccgacacccaccugaucgaccuggugaccaacgagaucaucacccagggcccccccguggacuggaacgacaucgccggccuggaccuggugaaggccgugaucaaggaggaggugcuguggcccgugcugagaagcgacgccuucagcggccugaccgcccugcccagaagcauccugcuguucggccccagaggcaccggcaagacccugcugggcagaugcaucgccagccagcugggcgccaccuucuucaagaucgccggcagcggccugguggccaaguggcugggcgaggccgagaagaucauccacgccagcuuccugguggccagaugcagacagcccagcgugaucuucgugagcgacaucgacaugcugcugagcagccaggugaacgaggagcacagccccgugagcagaaugagaaccgaguuccugaugcagcuggacaccgugcugaccagcgccgaggaccagaucguggugaucugcgccaccagcaagcccgaggagaucgacgagagccugagaagauacuucaugaagagacugcugaucccccugcccgacagcaccgccagacaccagaucaucgugcagcugcugagccagcacaacuacugccugaacgacaaggaguucgcccugcuggugcagagaaccgagggcuucagcggccuggacguggcccaccugugccaggaggccguggugggcccccugcacgccaugcccgccaccgaccugagcgccaucaugcccagccagcugagacccgugaccuaccaggacuucgagaacgccuucugcaagauccagcccagcaucagccagaaggagcuggacauguacguggaguggaacaagauguucggcugcagccaguaa

SEQ ID NO: 17116 - RNA, 3651 nt, Artificial Sequence
  FILIP1__Homo_sapiens__NP_001276916
auggugggcaugagaagcagaaaccagggcggcgagagcgccagcgacggccacaucagcugccccaagcccagcaucaucggcaacgccggcgagaagagccugagcgaggacgccaagaagaagaagaagagcaacagaaaggaggacgacgugauggccagcggcaccgugaagagacaccugaagaccagcggcgagugcgagagaaagaccaagaagagccuggagcugagcaaggaggaccugauccagcugcugagcaucauggagggcgagcugcaggccagagaggacgugauccacaugcugaagaccgagaagaccaagcccgaggugcuggaggcccacuacggcagcgccgagcccgagaaggugcugagagugcugcacagagacgccauccuggcccaggagaagagcaucggcgaggacguguacgagaagcccaucagcgagcuggacagacuggaggagaagcagaaggagaccuacagaagaaugcuggagcagcugcugcuggccgagaagugccacagaagaaccguguacgagcuggagaacgagaagcacaagcacaccgacuacaugaacaagagcgacgacuucaccaaccugcuggagcaggagagagagagacugaagaagcugcuggagcaggagaaggccuaccaggccagaaaggagaaggagaacgccaagagacugaacaagcugagagacgagcuggugaagcugaagagcuucgcccugaugcugguggacgagagacagaugcacaucgagcagcugggccugcagagccagaaggugcaggaccugacccagaagcugagagaggaggaggagaagcugaaggccaucaccagcaagagcaaggaggacagacagaagcugcugaagcuggagguggacuucgagcacaaggccagcagauucagccaggagcacgaggagaugaacgccaagcuggccaaccaggagagccacaacagacagcugagacugaagcuggugggccugacccagagaaucgaggagcuggaggagaccaacaagaaccugcagaaggccgaggaggagcugcaggagcugagagacaagaucgccaagggcgagugcggcaacagcagccugauggccgagguggagaaccugagaaagagagugcuggagauggagggcaaggacgaggagaucaccaagaccgagagccagugcagagagcugagaaagaagcugcaggaggaggagcaccacagcaaggagcugagacuggagguggagaagcugcagaagagaaugagcgagcuggagaagcuggaggaggccuucagcaagagcaagagcgagugcacccagcugcaccugaaccuggagaaggagaagaaccugaccaaggaccugcugaacgagcuggagguggugaagagcagagugaaggagcuggagugcagcgagagcagacuggagaaggccgagcugagccugaaggacgaccugaccaagcugaagagcuucaccgugaugcugguggacgagagaaagaacaugauggagaagaucaagcaggaggagagaaagguggacggccugaacaagaacuucaagguggagcagggcaaggugauggacgugaccgagaagcugaucgaggagagcaagaagcugcugaagcugaagagcgagauggaggagaagguguacaaccugaccagagagagagacgagcugaucggcaagcugaagagcgaggaggagaagagcagcgagcugagcugcagcguggaccugcugaagaagagacuggacggcaucgaggagguggagagagagaucaccagaggcagaagcagaaagggcagcgagcugaccugccccgaggacaacaagaucaaggagcugacccuggagaucgagagacugaagaagagacugcagcagcuggaggugguggagggcgaccugaugaagaccgaggacgaguacgaccagcuggagcagaaguucagaaccgagcaggacaaggccaacuuccugagccagcagcuggaggagaucaagcaccagaucgccaagaacaaggccaucgagaagggcgagguggugagccaggaggccgagcugagacacagauucagacuggaggaggccaagagcagagaccugaaggccgaggugcaggcccugaaggagaagauccacgagcugaugaacaaggaggaccagcugagccagcugcagguggacuacagcgugcugcagcagagauucauggaggaggagaacaagaacaagaacaugggccaggaggugcugaaccugaccaaggagcuggagcugagcaagagauacagcagagcccugagacccagcgugaacggcagaagaaugguggacgugcccgugaccagcaccggcgugcagaccgacgccgugagcggcgaggccgccgaggaggagacccccgccguguucaucagaaagagcuuccaggaggagaaccacaucaugagcaaccugagacaggugggccugaagaagcccguggagagaagcagcgugcuggacagauacccccccgccgccaacgagcugaccaugagaaagagcuggauccccuggaugagaaagagagagaacggccccagcaucacccaggagaagggccccagaaccaacagcagccccggccaccccggcgagguggugcugagccccaagcagggccagccccugcacaucagagugacccccgaccacgagaacagcaccgccacccuggagaucaccagccccaccagcgaggaguucuucagcagcaccaccgugauccccacccugggcaaccagaagcccagaaucaccaucauccccagccccaacgugaugccccagaagcagaagagcggcgacaccacccugggccccgagagagccaugagccccgugaccaucaccaccuucagcagagagaagacccccgagagcggcagaggcgccuucgccgacagacccaccagccccauccagaucaugaccgugagcaccagcgccgcccccgccgagaucgccgugagccccgagagccaggagaugcccaugggcagaaccauccugaaggugacccccgagaagcagaccgugcccacccccgugagaaaguacaacagcaacgccaacaucaucaccaccgaggacaacaagauccacauccaccugggcagccaguucaagagaagccccggcaccagcggcgagggcgugagccccgugaucaccgugagacccgugaacgugaccgccgagaaggaggugagcaccggcaccgugcugagaagccccagaaaccaccugagcagcagacccggcgccagcaaggugaccagcaccaucaccaucacccccgugaccaccagcagcgccagaggcacccagagcgugagcggccaggacggcagcagccagagacccacccccaccagaauccccaugagcaagggcaugaaggccggcaagcccgugguggccgcccccggcgccggcaaccugaccaaguucgagcccagagccgagacccagagcaugaagaucgagcugaagaagagcgccgccagcagcaccaccagccugggcggcggcaagggcuaa

SEQ ID NO: 17117 - RNA, 3402 nt, Artificial Sequence
  FILIP1L__Homo_sapiens__NP_001035924
augagaagcagaggcagcgacaccgagggcagcgcccagaagaaguuccccagacacaccaagggccacagcuuccagggccccaagaacaugaagcacagacagcaggacaaggacagccccagcgagagcgacgugauccugcccugccccaaggccgagaagccccacagcggcaacggccaccaggccgaggaccugagcagagacgaccugcuguuccugcugagcauccuggagggcgagcugcaggccagagacgaggugaucggcauccugaaggccgagaagauggaccuggcccugcuggaggcccaguacggcuucgugacccccaagaaggugcuggaggcccugcagagagacgccuuccaggccaagagcacccccuggcaggaggacaucuacgagaagcccaugaacgagcuggacaaggugguggagaagcacaaggagagcuacagaagaauccugggccagcugcugguggccgagaagagcagaagacagaccauccuggagcuggaggaggagaagagaaagcacaaggaguacauggagaagagcgacgaguucaucugccugcuggagcaggagugcgagagacugaagaagcugaucgaccaggagaucaagagccaggaggagaaggagcaggagaaggagaagagagugaccacccugaaggaggagcugaccaagcugaagagcuucgcccugauggugguggacgagcagcagagacugaccgcccagcugacccugcagagacagaagauccaggagcugaccaccaacgccaaggagacccacaccaagcuggcccuggccgaggccagagugcaggaggaggagcagaaggccaccagacuggagaaggagcugcagacccagaccaccaaguuccaccaggaccaggacaccaucauggccaagcugaccaacgaggacagccagaacagacagcugcagcagaagcuggccgcccugagcagacagaucgacgagcuggaggagaccaacagaagccugagaaaggccgaggaggagcugcaggacaucaaggagaagaucagcaagggcgaguacggcaacgccggcaucauggccgagguggaggagcugagaaagagagugcuggacauggagggcaaggacgaggagcugaucaagauggaggagcagugcagagaccugaacaagagacuggagagagagacccugcagagcaaggacuucaagcuggagguggagaagcugagcaagagaaucauggcccuggagaagcuggaggacgccuucaacaagagcaagcaggagugcuacagccugaagugcaaccuggagaaggagagaaugaccaccaagcagcugagccaggagcuggagagccugaaggugagaaucaaggagcuggaggccaucgagagcagacuggagaagaccgaguucacccugaaggaggaccugaccaagcugaagacccugaccgugauguucguggacgagagaaagaccaugagcgagaagcugaagaagaccgaggacaagcugcaggccgccagcagccagcugcagguggagcagaacaaggugaccaccgugaccgagaagcugaucgaggagaccaagagagcccugaagagcaagaccgacguggaggagaagauguacagcgugaccaaggagagagacgaccugaagaacaagcugaaggccgaggaggagaagggcaacgaccugcugagcagagugaacaugcugaagaacagacugcagagccuggaggccaucgagaaggacuuccugaagaacaagcugaaccaggacagcggcaagagcaccaccgcccugcaccaggagaacaacaagaucaaggagcugagccaggagguggagagacugaagcugaagcugaaggacaugaaggccaucgaggacgaccugaugaagaccgaggacgaguacgagacccuggagagaagauacgccaacgagagagacaaggcccaguuccugagcaaggagcuggagcacgugaagauggagcuggccaaguacaagcuggccgagaagaccgagaccagccacgagcaguggcuguucaagagacugcaggaggaggaggccaagagcggccaccugagcagagagguggacgcccugaaggagaagauccacgaguacauggccaccgaggaccugaucugccaccugcagggcgaccacagcgugcugcagaagaagcugaaccagcaggagaacagaaacagagaccugggcagagagaucgagaaccugaccaaggagcuggagagauacagacacuucagcaagagccugagacccagccugaacggcagaagaaucagcgacccccagguguucagcaaggaggugcagaccgaggccguggacaacgagccccccgacuacaagagccugaucccccuggagagagccgugaucaacggccagcuguacgaggagagcgagaaccaggacgaggaccccaacgacgagggcagcgugcugagcuucaagugcagccagagcacccccugccccgugaacagaaagcuguggauccccuggaugaagagcaaggagggccaccugcagaacggcaagaugcagaccaagcccaacgccaacuucgugcagcccggcgaccuggugcugagccacacccccggccagccccugcacaucaaggugacccccgaccacgugcagaacaccgccacccuggagaucaccagccccaccaccgagagcccccacagcuacaccagcaccgccgugauccccaacugcggcacccccaagcagagaaucaccauccugcagaacgccagcaucacccccgugaagagcaagaccagcaccgaggaccugaugaaccuggagcagggcaugagccccaucaccauggccaccuucgccagagcccagacccccgagagcugcggcagccugacccccgagagaaccaugagccccauccaggugcuggccgugaccggcagcgccagcagccccgagcagggcagaagccccgagcccaccgagaucagcgccaagcacgccaucuucagagugagccccgacagacagagcagcuggcaguuccagagaagcaacagcaacagcagcagcgugaucaccaccgaggacaacaagauccacauccaccugggcagccccuacaugcaggccguggccagccccgugagacccgccagccccagcgccccccugcaggacaacagaacccagggccugaucaacggcgcccugaacaagaccaccaacaaggugaccagcagcaucaccaucacccccaccgccaccccccugcccagacagagccagaucaccgugagcaacaucuacaacuaa

SEQ ID NO: 17118 - RNA, 1767 nt, Artificial Sequence
  FIP1L1__Homo_sapiens__NP_001128409
augagcgccggcgagguggagagacuggugagcgagcugagcggcggcaccggcggcgacgaggaggaggaguggcuguacggcgacgagaacgagguggagagacccgaggaggagaacgccagcgccaacccccccagcggcaucgaggacgagaccgccgagaacggcgugcccaagcccaaggugaccgagaccgaggacgacagcgacagcgacagcgacgacgacgaggacgacgugcacgugaccaucggcgacaucaagaccggcgccccccaguacggcagcuacggcaccgcccccgugaaccugaacaucaagaccggcggcagaguguacggcaccaccggcaccaaggugaagggcguggaccuggacgcccccggcagcaucaacggcgugccccugcuggagguggaccuggacagcuucgaggacaagcccuggagaaagcccggcgccgaccugagcgacuacuucaacuacggcuucaacgaggacaccuggaaggccuacugcgagaagcagaagagaaucagaaugggccuggaggugauccccgugaccagcaccaccaacaagaucaccgccgaggacugcaccauggaggugacccccggcgccgagauccaggacggcagauucaaccuguucaaggugcagcagggcagaaccggcaacagcgagaaggagaccgcccugcccagcaccaaggccgaguucaccagcccccccagccuguucaagaccggccugccccccagcagaaacagcaccagcagccagagccagaccagcaccgccagcagaaaggccaacagcagcgugggcaaguggcaggacagauacggcagagccgagagccccgaccugagaagacugcccggcgccaucgacgugaucggccagaccaucaccaucagcagaguggagggcagaagaagagccaacgagaacagcaacauccaggugcugagcgagagaagcgccaccgagguggacaacaacuucagcaagcccccccccuucuucccccccggcgccccccccacccaccugccccccccccccuuccugccccccccccccaccgugagcaccgcccccccccugauccccccccccggcauccccaucaccgugcccccccccggcuucccccccccccccggcgcccccccccccagccugauccccaccaucgagagcggccacagcagcggcuacgacagcagaagcgccagagccuuccccuacggcaacguggccuucccccaccugcccggcagcgcccccagcuggcccagccugguggacaccagcaagcagugggacuacuacgccagaagagagaaggacagagacagagagagagacagagacagagagagagacagagacagagacagagagagagagagaaccagagagagagagagagagagagaccacagccccacccccagcguguucaacagcgacgaggagagauacagauacagagaguacgccgagagaggcuacgagagacacagagccagcagagagaaggaggagagacacagagagagaagacacagagagaaggaggagaccagacacaagagcagcagaagcaacagcagaagaagacacgagagcgaggagggcgacagccacagaagacacaagcacaagaagagcaagagaagcaaggagggcaaggaggccggcagcgagcccgcccccgagcaggagagcaccgaggccacccccgccgaguaa

SEQ ID NO: 17119 - RNA, 459 nt, Artificial Sequence
  FIS1__Homo_sapiens__NP_057152
auggaggccgugcugaacgagcuggugagcguggaggaccugcugaaguucgagaagaaguuccagagcgagaaggccgccggcagcgugagcaagagcacccaguucgaguacgccuggugccuggugagaagcaaguacaacgacgacaucagaaagggcaucgugcugcuggaggagcugcugcccaagggcagcaaggaggagcagagagacuacguguucuaccuggccgugggcaacuacagacugaaggaguacgagaaggcccugaaguacgugagaggccugcugcagaccgagccccagaacaaccaggccaaggagcuggagagacugaucgacaaggccaugaagaaggacggccuggugggcauggccaucgugggcggcauggcccugggcguggccggccuggccggccugaucggccuggccgugagcaagagcaagagcuaa

SEQ ID NO: 17120 - RNA, 879 nt, Artificial Sequence
  FITM1__Homo_sapiens__NP_981947
auggagagaggccccguggugggcgccggccugggcgccggcgccagaauccaggcccugcugggcugccugcugaaggugcugcuguggguggccagcgcccugcuguacuucggcagcgagcaggccgccagacugcugggcagccccugccugagaagacuguaccacgccuggcuggccgccguggugaucuucggcccccugcugcaguuccacgugaaccccagaaccaucuucgccagccacggcaacuucuucaacaucaaguucgugaacagcgccuggggcuggaccugcaccuuccugggcggcuucgugcugcuggugguguuccuggccaccagaagaguggccgugaccgccagacaccugagcagacugguggugggcgccgccguguggagaggcgccggcagagccuuccugcugaucgaggaccugaccggcagcugcuucgagccccugccccagggccugcugcugcacgagcugcccgacagaagaagcugccuggccgccggccaccaguggagaggcuacaccgugagcagccacaccuuccugcugaccuucugcugccugcugauggccgaggaggccgccguguucgccaaguaccuggcccacggccugcccgccggcgccccccugagacugguguuccugcugaacgugcugcugcugggccuguggaacuuccugcugcugugcaccgugaucuacuuccaccaguacacccacaagguggugggcgccgccgugggcaccuucgccugguaccugaccuacggcagcugguaccaccagcccuggagccccggcagccccggccacggccuguuccccagaccccacagcagcagaaagcacaacuaa

SEQ ID NO: 17121 - RNA, 789 nt, Artificial Sequence
  FITM2__Homo_sapiens__NP_001073941
auggagcaccuggagagaugcgaguggcugcugagaggcacccuggugagagccgccgugagaagauaccugcccugggcccugguggccagcaugcuggccggcagccugcugaaggagcugagcccccugcccgagagcuaccugagcaacaagagaaacgugcugaacguguacuucgugaagguggccugggccuggaccuucugccugcugcugcccuucaucgcccugaccaacuaccaccugaccggcaaggccggccuggugcugagaagacugagcacccugcuggugggcaccgccaucugguacaucugcaccagcaucuucagcaacaucgagcacuacaccggcagcugcuaccagagccccgcccuggagggcgugagaaaggagcaccagagcaagcagcagugccaccaggagggcggcuucuggcacggcuucgacaucagcggccacagcuuccugcugaccuucugcgcccugaugaucguggaggagaugagcgugcugcacgaggugaagaccgacagaagccacugccugcacaccgccaucaccacccuggugguggcccugggcauccugaccuucaucugggugcugauguuccugugcaccgccguguacuuccacaaccugagccagaagguguucggcacccuguucggccugcugagcugguacggcaccuacggcuucugguaccccaaggccuucagccccggccugcccccccagagcugcagccugaaccugaagcaggacagcuacaagaaguaa

SEQ ID NO: 17122 - RNA, 1314 nt, Artificial Sequence
  FJX1__Homo_sapiens__NP_055159
augggcagaagaaugagaggcgccgccgccaccgccggccuguggcugcuggcccugggcagccugcuggcccuguggggcggccugcugccccccagaaccgagcugcccgccagcagaccccccgaggacagacugcccagaagacccgccagaagcggcggccccgcccccgcccccagauucccccugccccccccccuggccugggacgccagaggcggcagccugaagaccuucagagcccugcugacccuggccgccggcgccgacggcccccccagacagagcagaagcgagcccagauggcacgugagcgccagacagcccagacccgaggagagcgccgccgugcacggcggcguguucuggagcagaggccuggaggagcaggugccccccggcuucagcgaggcccaggccgccgccuggcuggaggccgccagaggcgccagaaugguggcccuggagagaggcggcugcggcagaagcagcaacagacuggccagauucgccgacggcaccagagccugcgugagauacggcaucaaccccgagcagauccagggcgaggcccugagcuacuaccuggccagacugcugggccugcagagacacgugcccccccuggcccuggccagaguggaggccagaggcgcccagugggcccaggugcaggaggagcugagagccgcccacuggaccgagggcagcguggugagccugaccagauggcugcccaaccugaccgacgugguggugcccgcccccuggagaagcgaggacggcagacugagaccccugagagacgccggcggcgagcuggccaaccugagccaggccgagcugguggaccuggugcaguggaccgaccugauccuguucgacuaccugaccgccaacuucgacagacuggugagcaaccuguucagccugcagugggaccccagagugaugcagagagccaccagcaaccugcacagaggccccggcggcgcccugguguuccuggacaacgaggccggccuggugcacggcuacagaguggccggcaugugggacaaguacaacgagccccugcugcagagcgugugcguguucagagagagaaccgccagaagagugcuggagcugcacagaggccaggacgccgccgccagacugcugagacuguacagaagacacgagcccagauuccccgagcuggccgcccuggccgacccccacgcccagcugcugcagagaagacuggacuuccuggccaagcacauccugcacugcaaggccaaguacggcagaagaagcggcaccuaa

SEQ ID NO: 17123 - RNA, 1749 nt, Artificial Sequence
  FKBP10__Homo_sapiens__NP_068758
auguuccccgccggcccccccagccacagccugcugagacugccccugcugcagcugcugcugcugguggugcaggccgugggcagaggccugggcagagccagccccgccggcggcccccuggaggacguggugaucgagagauaccacauccccagagccugccccagagaggugcagaugggcgacuucgugagauaccacuacaacggcaccuucgaggacggcaagaaguucgacagcagcuacgacagaaacacccugguggccaucguggugggcgugggcagacugaucaccggcauggacagaggccugaugggcaugugcgugaacgagagaagaagacugaucgugcccccccaccugggcuacggcagcaucggccuggccggccugaucccccccgacgccacccuguacuucgacguggugcugcuggacguguggaacaaggaggacaccgugcaggugagcacccugcugagacccccccacugccccagaauggugcaggacggcgacuucgugagauaccacuacaacggcacccugcuggacggcaccagcuucgacaccagcuacagcaagggcggcaccuacgacaccuacgugggcagcggcuggcugaucaagggcauggaccagggccugcugggcaugugccccggcgagagaagaaagaucaucaucccccccuuccuggccuacggcgagaagggcuacggcaccgugauccccccccaggccagccugguguuccacgugcugcugaucgacgugcacaaccccaaggacgccgugcagcuggagacccuggagcugccccccggcugcgugagaagagccggcgccggcgacuucaugagauaccacuacaacggcagccugauggacggcacccuguucgacagcagcuacagcagaaaccacaccuacaacaccuacaucggccagggcuacaucauccccggcauggaccagggccugcagggcgccugcaugggcgagagaagaagaaucaccauccccccccaccuggccuacggcgagaacggcaccggcgacaagauccccggcagcgccgugcugaucuucaacgugcacgugaucgacuuccacaaccccgccgacgugguggagaucagaacccugagcagacccagcgagaccugcaacgagaccaccaagcugggcgacuucgugagauaccacuacaacugcagccugcuggacggcacccagcuguucaccagccacgacuacggcgccccccaggaggccacccugggcgccaacaaggugaucgagggccuggacaccggccugcagggcaugugcgugggcgagagaagacagcugaucgugcccccccaccuggcccacggcgagagcggcgccagaggcgugcccggcagcgccgugcugcuguucgagguggagcuggugagcagagaggacggccugcccaccggcuaccuguucguguggcacaaggacccccccgccaaccuguucgaggacauggaccugaacaaggacggcgaggugccccccgaggaguucagcaccuucaucaaggcccaggugagcgagggcaagggcagacugaugcccggccaggaccccgagaagaccaucggcgacauguuccagaaccaggacagaaaccaggacggcaagaucaccguggacgagcugaagcugaagagcgacgaggacgaggagagagugcacgaggagcuguaa

SEQ ID NO: 17124 - RNA, 300 nt, Artificial Sequence
  FKBP11__Homo_sapiens__NP_001137253
augugcgugggcgagaagagaagagccaucauccccagccaccuggccuacggcaagagaggcuucccccccagcgugcccgccgacgccguggugcaguacgacguggagcugaucgcccugaucagagccaacuacuggcugaagcuggugaagggcauccugccccuggugggcauggccauggugcccgcccugcugggccugaucggcuaccaccuguacagaaaggccaacagacccaaggugagcaagaagaagcugaaggaggagaagagaaacaagagcaagaagaaguaa

SEQ ID NO: 17125 - RNA, 636 nt, Artificial Sequence
  FKBP14__Homo_sapiens__NP_060416
augagacuguuccuguggaacgccgugcugacccuguucgugaccagccugaucggcgcccugauccccgagcccgaggugaagaucgaggugcugcagaagcccuucaucugccacagaaagaccaagggcggcgaccugaugcuggugcacuacgagggcuaccuggagaaggacggcagccuguuccacagcacccacaagcacaacaacggccagcccaucugguucacccugggcauccuggaggcccugaagggcugggaccagggccugaagggcaugugcgugggcgagaagagaaagcugaucaucccccccgcccugggcuacggcaaggagggcaagggcaagaucccccccgagagcacccugaucuucaacaucgaccugcuggagaucagaaacggccccagaagccacgagagcuuccaggagauggaccugaacgacgacuggaagcugagcaaggacgaggugaaggccuaccugaagaaggaguucgagaagcacggcgccguggugaacgagagccaccacgacgcccugguggaggacaucuucgacaaggaggacgaggacaaggacggcuucaucagcgccagagaguucaccuacaagcacgacgagcuguaa

SEQ ID NO: 17126 - RNA, 3660 nt, Artificial Sequence
  FKBP15__Homo_sapiens__NP_056073
auguucggcgccggcgacgaggacgacaccgacuuccugagccccagcggcggcgccagacuggccagccuguucggccuggaccaggccgccgccggccacggcaacgaguucuuccaguacaccgcccccaagcagcccaagaagggccagggcaccgccgccaccggcaaccaggccacccccaagaccgcccccgccaccaugagcacccccaccauccugguggccaccgccgugcacgccuacagauacaccaacggccaguacgugaagcagggcaaguucggcgccgccgugcugggcaaccacaccgccagagaguacagaauccugcuguacaucagccagcagcagcccgugaccguggccagaauccacgugaacuucgagcugauggugagacccaacaacuacagcaccuucuacgacgaccagagacagaacuggagcaucauguucgagagcgagaaggccgccguggaguucaacaagcaggugugcaucgccaagugcaacagcaccagcagccuggacgccgugcugagccaggaccugaucguggccgacggccccgccguggaggugggcgacagccuggagguggccuacaccggcuggcuguuccagaaccacgugcugggccagguguucgacagcaccgccaacaaggacaagcugcugagacugaagcugggcagcggcaaggugaucaagggcugggaggacggcaugcugggcaugaagaagggcggcaagagacugcugaucgugccccccgccugcgccgugggcagcgagggcgugaucggcuggacccaggccaccgacagcauccugguguucgagguggaggugagaagagugaaguucgccagagacagcggcagcgacggccacagcgugagcagcagagacagcgccgcccccagccccauccccggcgccgacaaccugagcgccgaccccguggugagcccccccaccagcauccccuucaagagcggcgagcccgcccugagaaccaagagcaacagccugagcgagcagcuggccaucaacaccagccccgacgccgugaaggccaagcugaucagcagaauggccaagaugggccagcccaugcugcccauccugcccccccagcuggacagcaacgacagcgagaucgaggacgugaacacccugcagggcggcggccagcccguggugacccccagcgugcagcccagccugcaccccgcccaccccgcccugccccagaugaccagccaggccccccagcccagcgugaccggccugcaggcccccagcgccgcccugaugcaggugagcagccuggacagccacagcgccgugagcggcaacgcccagagcuuccagcccuacgccggcaugcaggccuacgccuacccccaggccagcgccgugaccagccagcugcagcccgugagaccccuguaccccgccccccugagccagcccccccacuuccagggcagcggcgacauggccagcuuccugaugaccgaggccagacagcacaacaccgagaucagaauggccgugagcaagguggccgacaagauggaccaccugaugaccaagguggaggagcugcagaagcacagcgccggcaacagcaugcugauccccagcaugagcgugaccauggagaccagcaugaucaugagcaacauccagagaaucauccaggagaacgagagacugaagcaggagauccuggagaagagcaacagaaucgaggagcagaacgacaagaucagcgagcugaucgagagaaaccagagauacguggagcagagcaaccugaugauggagaagagaaacaacagccugcagaccgccaccgagaacacccaggccagagugcugcacgccgagcaggagaaggccaaggugaccgaggagcuggccgccgccaccgcccaggugagccaccugcagcugaagaugaccgcccaccagaagaaggagaccgagcugcagaugcagcugaccgagagccugaaggagaccgaccugcugagaggccagcugaccaaggugcaggccaagcugagcgagcugcaggagaccagcgagcaggcccagagcaaguucaagagcgagaagcagaacagaaagcagcuggagcugaaggugaccagccuggaggaggagcugaccgaccugagaguggagaaggagagccuggagaagaaccugagcgagagaaagaagaagagcgcccaggagagaagccaggccgaggaggagaucgacgagaucagaaagagcuaccaggaggagcuggacaagcugagacagcugcugaagaagaccagagugagcaccgaccaggccgccgccgagcagcugagccuggugcaggccgagcugcagacccagugggaggccaagugcgagcaccugcuggccagcgccaaggacgagcaccugcagcaguaccaggaggugugcgcccagagagacgccuaccagcagaagcuggugcagcugcaggagaagugccuggcccugcaggcccagaucaccgcccugaccaagcagaacgagcagcacaucaaggagcuggagaagaacaagagccagaugagcggcguggaggccgccgccagcgaccccagcgagaaggugaagaagaucaugaaccagguguuccagagccugagaagagaguucgagcuggaggagagcuacaacggcagaaccauccugggcaccaucaugaacaccaucaagauggugacccugcagcugcugaaccagcaggagcaggagaaggaggagagcagcagcgaggaggaggaggagaaggccgaggagagacccagaagacccagccaggagcagagcgccagcgccagcagcggccagccccaggccccccugaacagagagagacccgagagccccauggugcccagcgagcaggugguggaggaggccgugccccugcccccccaggcccugaccaccagccaggacggccacagaagaaagggcgacagcgaggccgaggcccugagcgagaucaaggacggcagccugccccccgagcugagcugcauccccagccacagagugcugggcccccccaccagcaucccccccgagccccugggccccgugagcauggacagcgagugcgaggagagccuggccgccagccccauggccgccaagcccgacaaccccagcggcaaggugugcgugagagagguggcccccgacggcccccugcaggagagcagcaccagacugagccugaccagcgaccccgaggagggcgacccccuggcccugggccccgagagccccggcgagccccagcccccccagcugaagaaggacgacgugaccagcagcaccggcccccacaaggagcugagcagcaccgaggccggcagcaccguggccggcgccgcccugagacccagccaccacagccagagaagcagccugagcggcgacgaggaggacgagcuguucaagggcgccacccugaaggcccugagacccaaggcccagcccgaggaggaggacgaggacgaggugagcaugaagggcagacccccccccaccccccuguucggcgacgacgacgacgacgacgacaucgacuggcugggcuaa

SEQ ID NO: 17127 - RNA, 327 nt, Artificial Sequence
  FKBP1A__Homo_sapiens__NP_000792
augggcgugcagguggagaccaucagccccggcgacggcagaaccuuccccaagagaggccagaccugcguggugcacuacaccggcaugcuggaggacggcaagaaguucgacagcagcagagacagaaacaagcccuucaaguucaugcugggcaagcaggaggugaucagaggcugggaggagggcguggcccagaugagcgugggccagagagccaagcugaccaucagccccgacuacgccuacggcgccaccggccaccccggcaucauccccccccacgccacccugguguucgacguggagcugcugaagcuggaguaa

SEQ ID NO: 17128 - RNA, 327 nt, Artificial Sequence
  FKBP1B__Homo_sapiens__NP_004107
augggcguggagaucgagaccaucagccccggcgacggcagaaccuuccccaagaagggccagaccugcguggugcacuacaccggcaugcugcagaacggcaagaaguucgacagcagcagagacagaaacaagcccuucaaguucagaaucggcaagcaggaggugaucaagggcuucgaggagggcgccgcccagaugagccugggccagagagccaagcugaccugcacccccgacguggccuacggcgccaccggccaccccggcgugaucccccccaacgccacccugaucuucgacguggagcugcugaaccuggaguaa

SEQ ID NO: 17129 - RNA, 429 nt, Artificial Sequence
  FKBP2__Homo_sapiens__NP_004461
augagacugagcugguucagagugcugaccgugcugagcaucugccugagcgccguggccaccgccaccggcgccgagggcaagagaaagcugcagaucggcgugaagaagagaguggaccacugccccaucaagagcagaaagggcgacgugcugcacaugcacuacaccggcaagcuggaggacggcaccgaguucgacagcagccugccccagaaccagcccuucguguucagccugggcaccggccaggugaucaagggcugggaccagggccugcugggcaugugcgagggcgagaagagaaagcuggugauccccagcgagcugggcuacggcgagagaggcgccccccccaagauccccggcggcgccacccugguguucgagguggagcugcugaagaucgagagaagaaccgagcuguaa

SEQ ID NO: 17130 - RNA, 675 nt, Artificial Sequence
  FKBP3__Homo_sapiens__NP_002004
auggccgccgccgugccccagagagccuggaccguggagcagcugagaagcgagcagcugcccaagaaggacaucaucaaguuccugcaggagcacggcagcgacagcuuccuggccgagcacaagcugcugggcaacaucaagaacguggccaagaccgccaacaaggaccaccuggugaccgccuacaaccaccuguucgagaccaagagauucaagggcaccgagagcaucagcaaggugagcgagcaggugaagaacgugaagcugaacgaggacaagcccaaggagaccaagagcgaggagacccuggacgagggcccccccaaguacaccaagagcgugcugaagaagggcgacaagaccaacuuccccaagaagggcgacguggugcacugcugguacaccggcacccugcaggacggcaccguguucgacaccaacauccagaccagcgccaagaagaagaagaacgccaagccccugagcuucaaggugggcgugggcaaggugaucagaggcugggacgaggcccugcugaccaugagcaagggcgagaaggccagacuggagaucgagcccgagugggccuacggcaagaagggccagcccgacgccaagaucccccccaacgccaagcugaccuucgagguggagcugguggacaucgacuaa

SEQ ID NO: 17131 - RNA, 1380 nt, Artificial Sequence
  FKBP4__Homo_sapiens__NP_002005
augaccgccgaggagaugaaggccaccgagagcggcgcccagagcgccccccugcccauggagggcguggacaucagccccaagcaggacgagggcgugcugaaggugaucaagagagagggcaccggcaccgagaugcccaugaucggcgacagaguguucgugcacuacaccggcuggcugcuggacggcaccaaguucgacagcagccuggacagaaaggacaaguucagcuucgaccugggcaagggcgaggugaucaaggccugggacaucgccaucgccaccaugaaggugggcgaggugugccacaucaccugcaagcccgaguacgccuacggcagcgccggcagcccccccaagaucccccccaacgccacccugguguucgagguggagcuguucgaguucaagggcgaggaccugaccgaggaggaggacggcggcaucaucagaagaauccagaccagaggcgagggcuacgccaagcccaacgagggcgccaucguggagguggcccuggagggcuacuacaaggacaagcuguucgaccagagagagcugagauucgagaucggcgagggcgagaaccuggaccugcccuacggccuggagagagccauccagagaauggagaagggcgagcacagcaucguguaccugaagcccagcuacgccuucggcagcgugggcaaggagaaguuccagaucccccccaacgccgagcugaaguacgagcugcaccugaagagcuucgagaaggccaaggagagcugggagaugaacagcgaggagaagcuggagcagagcaccaucgugaaggagagaggcaccguguacuucaaggagggcaaguacaagcaggcccugcugcaguacaagaagaucgugagcuggcuggaguacgagagcagcuucagcaacgaggaggcccagaaggcccaggcccugagacuggccagccaccugaaccuggccaugugccaccugaagcugcaggccuucagcgccgccaucgagagcugcaacaaggcccuggagcuggacagcaacaacgagaagggccuguucagaagaggcgaggcccaccuggccgugaacgacuucgagcuggccagagccgacuuccagaaggugcugcagcuguaccccaacaacaaggccgccaagacccagcuggccgugugccagcagagaaucagaagacagcuggccagagagaagaagcuguacgccaacauguucgagagacuggccgaggaggagaacaaggccaaggccgaggccagcagcggcgaccaccccaccgacaccgagaugaaggaggagcagaagagcaacaccgccggcagccagagccagguggagaccgaggccuaa

SEQ ID NO: 17132 - RNA, 1374 nt, Artificial Sequence
  FKBP5__Homo_sapiens__NP_001139247
augaccaccgacgagggcgccaagaacaacgaggagagccccaccgccaccguggccgagcagggcgaggacaucaccagcaagaaggacagaggcgugcugaagaucgugaagagagugggcaacggcgaggagacccccaugaucggcgacaagguguacgugcacuacaagggcaagcugagcaacggcaagaaguucgacagcagccacgacagaaacgagcccuucguguucagccugggcaagggccaggugaucaaggccugggacaucggcguggccaccaugaagaagggcgagaucugccaccugcugugcaagcccgaguacgccuacggcagcgccggcagccugcccaagauccccagcaacgccacccuguucuucgagaucgagcugcuggacuucaagggcgaggaccuguucgaggacggcggcaucaucagaagaaccaagagaaagggcgagggcuacagcaaccccaacgagggcgccaccguggagauccaccuggagggcagaugcggcggcagaauguucgacugcagagacguggccuucaccgugggcgagggcgaggaccacgacauccccaucggcaucgacaaggcccuggagaagaugcagagagaggagcagugcauccuguaccugggccccagauacggcuucggcgaggccggcaagcccaaguucggcaucgagcccaacgccgagcugaucuacgaggugacccugaagagcuucgagaaggccaaggagagcugggagauggacaccaaggagaagcuggagcaggccgccaucgugaaggagaagggcaccguguacuucaagggcggcaaguacaugcaggccgugauccaguacggcaagaucgugagcuggcuggagauggaguacggccugagcgagaaggagagcaaggccagcgagagcuuccugcuggccgccuuccugaaccuggccaugugcuaccugaagcugagagaguacaccaaggccguggagugcugcgacaaggcccugggccuggacagcgccaacgagaagggccuguacagaagaggcgaggcccagcugcugaugaacgaguucgagagcgccaagggcgacuucgagaaggugcuggaggugaacccccagaacaaggccgccagacugcagaucagcaugugccagaagaaggccaaggagcacaacgagagagacagaagaaucuacgccaacauguucaagaaguucgccgagcaggacgccaaggaggaggccaacaaggccaugggcaagaagaccagcgagggcgugaccaacgagaagggcaccgacagccaggccauggaggaggagaagcccgagggccacguguaa

SEQ ID NO: 17133 - RNA, 969 nt, Artificial Sequence
  FKBP6__Homo_sapiens__NP_001128683
augagcgccagcagcuggccccagaacggcaugccccccagcagccuguacgagagacugagccagagaaugcuggacaucagcggcgacagaggcgugcugaaggacgugaucagagagggcgccggcgaccugguggcccccgacgccagcgugcuggugaaguacagcggcuaccuggagcacauggacagacccuucgacagcaacuacuucagaaagacccccagacugaugaagcugggcgaggacaucacccuguggggcauggagcugggccugcugagcaugagaagaggcgagcuggccagauuccuguucaagcccaacuacgccuacggcacccugggcugccccccccugaucccccccaacaccaccgugcuguucgagaucgagcugcuggacuuccuggacugcgccgagagcgacaaguucugcgcccugagcgccgagcagcaggaccaguucccccugcagaaggugcugaagguggccgccaccgagagagaguucggcaacuaccuguucagacagaacagauucuacgacgccaaggugagauacaagagagcccugcugcugcugagaagaagaagcgccccccccgaggagcagcaccugguggaggccgccaagcugcccgugcugcugaaccugagcuucaccuaccugaagcuggacagacccaccaucgcccugugcuacggcgagcaggcccugaucaucgaccagaagaacgccaaggcccuguucagaugcggccaggccugccugcugcugaccgaguaccagaaggccagagacuuccuggugagagcccagaaggagcagcccuucaaccacgacaucaacaacgagcugaagaagcuggccagcugcuacagagacuacguggacaaggagaaggagauguggcacagaauguucgcccccugcggcgacggcagcaccgccggcgagagcuaa

SEQ ID NO: 17134 - RNA, 666 nt, Artificial Sequence
  FKBP7__Homo_sapiens__NP_001128684
augcccaagaccaugcacuuccuguucagauucaucguguucuucuaccuguggggccuguucaccgcccagagacagaagaaggaggagagcaccgaggaggugaagaucgaggugcugcacagacccgagaacugcagcaagaccagcaagaagggcgaccugcugaacgcccacuacgacggcuaccuggccaaggacggcagcaaguucuacugcagcagaacccagaacgagggccaccccaagugguucgugcugggcgugggccaggugaucaagggccuggacaucgccaugaccgacaugugccccggcgagaagagaaagguggugaucccccccagcuucgccuacggcaaggagggcuacgagggcaagaucccccccgacgccacccugaucuucgagaucgagcuguacgccgugaccaagggccccagaagcaucgagaccuucaagcagaucgacauggacaacgacagacagcugagcaaggccgagaucaaccuguaccugcagagagaguucgagaaggacgagaagcccagagacaagagcuaccaggacgccgugcuggaggacaucuucaagaagaacgaccacgacggcgacggcuucaucagccccaaggaguacaacguguaccagcacgacgagcuguaa

SEQ ID NO: 17135 - RNA, 1242 nt, Artificial Sequence
  FKBP8__Homo_sapiens__NP_036313
auggccagcugcgccgagcccagcgagcccagcgccccccugcccgccggcgugcccccccuggaggacuucgaggugcuggacggcguggaggacgccgagggcgaggaggaggaggaggaggaggaggaggaggaggacgaccugagcgagcugcccccccuggaggacaugggccagccccccgccgaggaggccgagcagcccggcgcccuggccagagaguuccuggccgccauggagcccgagcccgcccccgcccccgcccccgaggaguggcuggacauccugggcaacggccugcugagaaagaagacccuggugcccggcccccccggcagcagcagacccgugaagggccagguggugaccgugcaccugcagaccagccuggagaacggcaccagagugcaggaggagcccgagcugguguucacccugggcgacugcgacgugauccaggcccuggaccugagcgugccccugauggacgugggcgagaccgccauggugaccgccgacagcaaguacugcuacggcccccagggcagcagaagccccuacauccccccccacgccgcccugugccuggaggugacccugaagaccgccguggacggccccgaccuggagaugcugaccggccaggagagaguggcccuggccaacagaaagagagagugcggcaacgcccacuaccagagagccgacuucgugcuggccgccaacagcuacgaccuggccaucaaggccaucaccagcagcgccaagguggacaugaccuucgaggaggaggcccagcugcugcagcugaaggugaagugccugaacaaccuggccgccagccagcugaagcuggaccacuacagagccgcccugagaagcugcagccuggugcuggagcaccagcccgacaacaucaaggcccuguucagaaagggcaaggugcuggcccagcagggcgaguacagcgaggccauccccauccugagagccgcccugaagcuggagcccagcaacaagaccauccacgccgagcugagcaagcuggugaagaagcacgccgcccagagaagcaccgagaccgcccuguacagaaagaugcugggcaaccccagcagacugcccgccaagugccccggcaagggcgccuggagcauccccuggaaguggcuguucggcgccaccgccguggcccugggcggcguggcccugagcguggugaucgccgccagaaacuaa

SEQ ID NO: 17136 - RNA, 1872 nt, Artificial Sequence
  FKBP9__Homo_sapiens__NP_001271270
auggccuucagaggcuggagaccccccccccccccccugcugcugcugcugcugugggugaccggccaggccgcccccguggccggccugggcagcgacgccgagcugcagaucgagagaagauucgugcccgacgagugccccagaaccgugagaagcggcgacuucgugagauaccacuacgugggcaccuuccccgacggccagaaguucgacagcagauacugggacaccgccgaggacaaggccgacaagagccccugcccccaggugagagugggcgugaacaccagccccagcugcagacugaagcagaagggcgugggcaucuacuggaaggaccugcaguuccuggugagagugcagaaccacggccugagcuacgacagagacagcaccuucaacguguucgugggcaagggccagcugaucaccggcauggaccaggcccuggugggcaugugcgugaacgagagaagauucgugaagaucccccccaagcuggccuacggcaacgagggcgugagcggcgugaucccccccaacagcgugcugcacuucgacgugcugcugauggacaucuggaacagcgaggaccaggugcagauccacaccuacuucaagccccccagcugccccagaaccauccaggugagcgacuucgugagauaccacuacaacggcaccuuccuggacggcacccuguucgacagcagccacaacagaaugaagaccuacgacaccuacgugggcaucggcuggcugauccccggcauggacaagggccugcugggcaugugcgugggcgagaagagaaucaucaccaucccccccuuccuggccuacggcgaggacggcgacggcaaggacauccccggccaggccagccugguguucgacguggcccugcuggaccugcacaaccccaaggacagcaucagcaucgagaacaagguggugcccgagaacugcgagagaaucagccagagcggcgacuuccugagauaccacuacaacggcacccugcuggacggcacccuguucgacagcagcuacagcagaaacagaaccuucgacaccuacaucggccagggcuacgugauccccggcauggacgagggccugcugggcgugugcaucggcgagaagagaagaaucguggugcccccccaccugggcuacggcgaggagggcagaggcaacauccccggcagcgccgugcugguguucgacauccacgugaucgacuuccacaaccccagcgacagcaucagcaucaccagccacuacaagccccccgacugcagcgugcugagcaagaagggcgacuaccugaaguaccacuacaacgccagccugcuggacggcacccugcuggacagcaccuggaaccugggcaagaccuacaacaucgugcugggcagcggccagguggugcugggcauggacaugggccugagagagaugugcgugggcgagaagagaaccgugaucauccccccccaccugggcuacggcgaggccggcguggacggcgaggugcccggcagcgccgugcugguguucgacaucgagcugcuggagcugguggccggccugcccgagggcuacauguucaucuggaacggcgaggugagccccaaccuguucgaggagaucgacaaggacggcaacggcgaggugcugcuggaggaguucagcgaguacauccacgcccagguggccagcggcaagggcaagcuggcccccggcuucgacgccgagcugaucgugaagaacauguucaccaaccaggacagaaacggcgacggcaaggugaccgccgaggaguucaagcugaaggaccaggaggccaagcacgacgagcuguaa

SEQ ID NO: 17137 - RNA, 1050 nt, Artificial Sequence
  FKBPL__Homo_sapiens__NP_071393
auggagaccccccccgugaacaccaucggcgagaaggacaccagccagccccagcaggagugggagaagaaccugagagagaaccuggacagcgugauccagaucagacagcagcccagagacccccccaccgagacccuggagcuggaggugagccccgaccccgccagccagauccuggagcacacccagggcgccgagaagcugguggccgagcuggagggcgacagccacaagagccacggcagcaccagccagaugcccgaggcccugcaggccagcgaccugugguacugccccgacggcagcuucgugaagaagaucgugaucagaggccacggccuggacaagcccaagcugggcagcugcugcagagugcuggcccugggcuuccccuucggcagcggcccccccgagggcuggaccgagcugaccaugggcgugggccccuggagagaggagaccuggggcgagcugaucgagaagugccuggagagcaugugccagggcgaggaggccgagcugcagcugcccggccacagcggcccccccgugagacugacccuggccagcuucacccagggcagagacagcugggagcuggagaccagcgagaaggaggcccuggccagagaggagagagccagaggcaccgagcuguucagagccggcaaccccgagggcgccgccagaugcuacggcagagcccugagacugcugcugacccugcccccccccggcccccccgagagaaccgugcugcacgccaaccuggccgccugccagcugcugcugggccagccccagcuggccgcccagagcugcgacagagugcuggagagagagcccggccaccugaaggcccuguacagaagaggcguggcccaggccgcccugggcaaccuggagaaggccaccgccgaccugaagaaggugcuggccaucgaccccaagaacagagccgcccaggaggagcugggcaagguggugauccagggcaagaaccaggacgccggccuggcccagggccugagaaagauguucggcuaa

SEQ ID NO: 17138 - RNA, 1488 nt, Artificial Sequence
  FKRP__Homo_sapiens__XP_011525609
augagacugaccagaugccaggccgcccuggccgccgccaucacccugaaccugcuggugcuguucuacgugagcuggcugcagcaccagcccagaaacagcagagccagaggccccagaagagccagcgccgccggccccagagugaccgugcuggugagagaguucgaggccuucgacaacgccgugcccgagcugguggacagcuuccugcagcaggaccccgcccagcccguggugguggccgccgacacccugcccuaccccccccuggcccugcccagaauccccaacgugagacuggcccugcugcagcccgcccuggacagacccgccgccgccagcagacccgagaccuacguggccaccgaguucguggcccuggugcccgacggcgccagagccgaggcccccggccugcuggagagaaugguggaggcccugagagccggcagcgccagacugguggccgcccccguggccaccgccaaccccgccagaugccuggcccugaacgugagccugagagaguggaccgccagauacggcgccgcccccgccgcccccagaugcgacgcccuggacggcgacgccguggugcugcugagagccagagaccuguucaaccugagcgccccccuggccagacccgugggcaccagccuguuccugcagaccgcccugagaggcugggccgugcagcugcuggaccugaccuucgccgccgccagacagcccccccuggccaccgcccacgccagauggaaggccgagagagagggcagagccagaagagccgcccugcugagagcccugggcaucagacuggugagcugggagggcggcagacuggagugguucggcugcaacaaggagaccaccagaugcuucggcaccguggugggcgacacccccgccuaccuguacgaggagagauggaccccccccugcugccugagagcccugagagagaccgccagauacguggugggcgugcuggaggccgccggcgugagauacuggcuggagggcggcagccugcugggcgccgccagacacggcgacaucauccccugggacuacgacguggaccugggcaucuaccuggaggacgugggcaacugcgagcagcugagaggcgccgaggccggcagcgugguggacgagagaggcuucgugugggagaaggccguggagggcgacuucuucagagugcaguacagcgagagcaaccaccugcacguggaccuguggcccuucuaccccagaaacggcgugaugaccaaggacaccuggcuggaccacagacaggacguggaguuccccgagcacuuccugcagccccuggugccccugcccuucgccggcuucguggcccaggcccccaacaacuacagaagauuccuggagcugaaguucggccccggcgugaucgagaacccccaguaccccaaccccgcccugcugagccugaccggcagcggcuaa

SEQ ID NO: 17139 - RNA, 1386 nt, Artificial Sequence
  FKTN__Homo_sapiens__NP_001073270
augagcagaaucaacaagaacguggugcuggcccugcugacccugaccagcagcgccuuccugcuguuccagcuguacuacuacaagcacuaccugagcaccaagaacggcgccggccugagcaagagcaagggcagcagaaucggcuucgacagcacccaguggagagccgugaagaaguucaucaugcugaccagcaaccagaacgugcccguguuccugaucgacccccugauccuggagcugaucaacaagaacuucgagcaggugaagaacaccagccacggcagcaccagccagugcaaguucuucugcgugcccagagacuucaccgccuucgcccugcaguaccaccuguggaagaacgaggagggcugguucagaaucgccgagaacaugggcuuccagugccugaagaucgagagcaaggaccccagacuggacggcaucgacagccugagcggcaccgagaucccccugcacuacaucugcaagcuggccacccacgccauccaccuggugguguuccacgagagaagcggcaacuaccuguggcacggccaccugagacugaaggagcacaucgacagaaaguucgugcccuucagaaagcugcaguucggcagauaccccggcgccuucgacagacccgagcugcagcaggugaccguggacggccuggaggugcugauccccaaggaccccaugcacuucguggaggaggugccccacagcagauucaucgagugcagauacaaggaggccagagccuucuuccagcaguaccuggacgacaacaccguggaggccguggccuucagaaagagcgccaaggagcugcugcagcuggccgccaagacccugaacaagcugggcgugcccuucuggcugagcagcggcaccugccugggcugguacagacagugcaacaucauccccuacagcaaggacguggaccugggcaucuucauccaggacuacaagagcgacaucauccuggccuuccaggacgccggccugccccugaagcacaaguucggcaagguggaggacagccuggagcugagcuuccagggcaaggacgacgugaagcuggacguguucuucuucuacgaggagaccgaccacauguggaacggcggcacccaggccaagaccggcaagaaguucaaguaccuguuccccaaguucacccugugcuggaccgaguucguggacaugaaggugcacgugcccugcgagacccuggaguacaucgaggccaacuacggcaagaccuggaagauccccgugaagaccugggacuggaagagaagcccccccaacgugcagcccaacggcaucuggcccaucagcgagugggacgaggugauccagcuguacuaa

SEQ ID NO: 17140 - RNA, 1341 nt, Artificial Sequence
  FLAD1__Homo_sapiens__NP_001171820
augaccagcagagccagcgagcugagccccggcagaagcgugaccgccggcaucaucaucgugggcgacgagauccugaagggccacacccaggacaccaacaccuucuuccugugcagaacccugagaagccugggcgugcaggugugcagagugagcguggugcccgacgagguggccaccaucgccgccgaggugaccagcuucagcaacagauucacccacgugcugaccgccggcggcaucggccccacccacgacgacgugaccuucgaggccguggcccaggccuucggcgacgagcugaagccccaccccaagcuggaggccgccaccaaggcccugggcggcgagggcugggagaagcugagccuggugcccagcagcgccagacugcacuacggcaccgaccccugcaccggccagcccuucagauucccccuggugagcgugagaaacguguaccuguuccccggcauccccgagcugcugagaagagugcuggagggcaugaagggccuguuccagaaccccgccgugcaguuccacagcaaggagcuguacguggccgccgacgaggccagcaucgcccccauccuggccgaggcccaggcccacuucggcagaagacugggccugggcagcuaccccgacuggggcagcaacuacuaccaggugaagcugacccuggacagcgaggaggagggcccccuggaggagugccuggccuaccugaccgccagacugccccagggcagccuggugcccuacaugcccaacgccguggagcaggccagcgaggccguguacaagcuggccgagagcggcagcagccugggcaagaagguggccggcgcccugcagaccaucgagaccagccuggcccaguacagccugacccagcugugcgugggcuucaacggcggcaaggacugcaccgcccugcugcaccuguuccacgccgccgugcagagaaagcugcccgacgugcccaacccccugcagauccuguacaucagaagcaucagccccuuccccgagcuggagcaguuccugcaggacaccaucaagagauacaaccugcagaugcuggaggccgagggcagcaugaagcaggcccugggcgagcugcaggccagacacccccagcuggaggccgugcugaugggcaccagaagaaccgaccccuacagcugcagccugugccccuucagccccaccgaccccggcuggcccgccuucaugagaaucaacccccugcuggacuggaccuacagagacaucugggacuuccugagacagcuguucgugcccuacugcauccuguacgacagaggcuaa

SEQ ID NO: 17141 - RNA, 1029 nt, Artificial Sequence
  FLCN__Homo_sapiens__NP_653207
augaacgccaucguggcccugugccacuucugcgagcugcacggccccagaacccuguucugcaccgaggugcugcacgccccccugccccagggcgacggcaacgaggacagccccggccagggcgagcaggccgaggaggaggagggcggcauccagaugaacagcagaaugagagcccacagccccgccgagggcgccagcguggagagcagcagccccggccccaagaagagcgacaugugcgagggcugcagaagccuggccgccggccaccccggcuacaucagccacgacaaggagaccagcaucaaguacgugagccaccagcaccccagccacccccagcuguucagcaucgugagacaggccugcgugagaagccugagcugcgaggugugccccggcagagagggccccaucuucuucggcgacgagcagcacggcuucguguucagccacaccuucuucaucaaggacagccuggccagaggcuuccagagaugguacagcaucaucaccaucaugauggacagaaucuaccugaucaacagcuggcccuuccugcugggcaaggugagaggcaucaucgacgagcugcagggcaaggcccugaagguguucgaggccgagcaguucggcugcccccagagagcccagagaaugaacaccgccuucacccccuuccugcaccagagaaacggcaacgccgccagaagccugaccagccugaccagcgacgacaaccugugggccugccugcacaccagcuucgccuggcugcugaaggccugcggcagcagacugaccgagaagcugcuggagggcgcccccaccgaggacacccuggugcagauggagaagcuggccggcgaggccggcgugcugcugcccggccccuggcccggcuggcccuggggcggcaccagcugccugcugagcuggcaggagagccugagagagggcaacgccgcccugaaccagcccagaaccagccugagagaggcccacccccccaucagcguguaa

SEQ ID NO: 17142 - RNA, 7176 nt, Artificial Sequence
  FLG2__Homo_sapiens__NP_001014364
augaccgaccugcugagaagcguggugaccgugaucgacguguucuacaaguacaccaagcaggacggcgagugcggcacccugagcaagggcgagcugaaggagcugcuggagaaggagcugcaccccgugcugaagaaccccgacgaccccgacaccguggacgugaucaugcacaugcuggacagagaccacgacagaagacuggacuucaccgaguuccugcugaugaucuucaagcugaccauggccugcaacaaggugcugagcaaggaguacugcaaggccagcggcagcaagaagcacagaagaggccacagacaccaggaggaggagagcgagaccgaggaggacgaggaggacacccccggccacaagagcggcuacagacacagcagcuggagcgagggcgaggagcacggcuacagcagcggccacagcagaggcaccgugaagugcagacacggcagcaacagcagaagacugggcagacagggcaaccugagcagcagcggcaaccaggagggcagccagaagagauaccacagaagcagcugcggccacagcuggagcggcggcaaggacagacacggcagcagcagcguggagcugagagagagaaucaacaagagccacaucagccccagcagagagagcggcgaggaguacgagagcggcagcggcagcaacagcugggagagaaagggccacggcggccugagcugcggccuggagaccagcggccacgagagcaacagcacccagagcagaaucagagagcagaagcugggcagcagcugcagcggcagcggcgacagcggcagaagaagccacgccugcggcuacagcaacagcagcggcugcggcagaccccagaacgccagcagcagcugccagagccacagauucggcggccagggcaaccaguucagcuacauccagagcggcugccagagcggcaucaagggcggccagggccacggcugcgugagcggcggccagcccagcggcugcggccagcccgagagcaaccccugcagccagagcuacagccagagaggcuacggcgccagagagaacggccagccccagaacugcggcggccaguggagaaccggcagcagccagagcagcugcugcggccaguacggcagcggcggcagccagagcugcagcaacggccagcacgaguacggcagcugcggcagauucagcaacagcagcagcagcaacgaguucagcaagugcgaccaguacggcagcggcagcagccagagcaccagcuucgagcagcacggcaccggccugagccagagcagcggcuucgagcagcacgugugcggcagcggccagaccugcggccagcacgagagcaccagcagccagagccugggcuacgaccagcacggcagcagcagcggcaagaccagcggcuucggccagcacggcagcggcagcggccagagcagcggcuucggccagugcggcagcggcagcggccagagcagcggcuucggccagcacggcagcgugagcggccagagcagcggcuucggccagcacggcagcgugagcggccagagcagcggcuucggccagcacgagagcagaagcagacagagcagcuacggccagcacggcagcggcagcagccagagcagcggcuacggccaguacggcagcagagagaccagcggcuucggccagcacggccugggcagcggccagagcaccggcuucggccaguacggcagcggcagcggccagagcagcggcuucggccagcacggcagcggcagcggccagagcagcggcuucggccagcacgagagcagaagcggccagagcagcuacggccagcacagcagcggcagcagccagagcagcggcuacggccagcacggcagcagacagaccagcggcuucggccagcacggcagcggcagcagccagagcaccggcuucggccaguacggcagcggcagcggccagagcagcggcuucggccagcacgugagcggcagcggccagagcagcggcuucggccagcacgagagcagaagcggccacagcagcuacggccagcacggcuucggcagcagccagagcagcggcuacggccagcacggcagcagcagcggccagaccagcggcuucggccagcacgagcugagcagcggccagagcagcagcuucggccagcacggcagcggcagcggccagagcagcggcuucggccagcacggcagcggcagcggccagagcagcggcuucggccagcacgagagcagaagcggccagagcagcuacggccagcacagcagcggcagcagccagagcagcggcuacggccagcacggcagcagacagaccagcggcuucggccagcacggcagcggcagcagccagagcaccggcuucggccaguacggcagcggcagcggccagagcgccggcuucggccagcacggcagcggcagcggccagagcagcggcuucggccagcacgagagcagaagccaccagagcagcuacggccagcacggcagcggcagcagccagagcagcggcuacggccagcacggcagcagcagcggccagaccagcggcuucggccagcacagaagcagcagcggccaguacagcggcuucggccagcacggcagcggcagcggccagagcagcggcuucggccagcacggcaccggcagcggccaguacagcggcuucggccagcacgagagcagaagccaccagagcagcuacggccagcacggcagcggcagcagccagagcagcggcuacggccagcacggcagcagcagcggccagaccuucggcuucggccagcacagaagcggcagcggccagagcagcggcuucggccagcacggcagcggcagcggccagagcagcggcuucggccagcacgagagcggcagcggcaagagcagcggcuucggccagcacgagagcagaagcagccagagcaacuacggccagcacggcagcggcagcagccagagcagcggcuacggccagcacggcagcagcagcggccagaccaccggcuucggccagcacagaagcagcagcggccaguacagcggcuucggccagcacggcagcggcagcgaccagagcagcggcuucggccagcacggcaccggcagcggccagagcagcggcuucggccaguacgagagcagaagcagacagagcagcuacggccagcacggcagcggcagcagccagagcagcggcuacggccagcacggcagcaacagcggccagaccagcggcuucggccagcacagacccggcagcggccagagcagcggcuucggccaguacggcagcggcagcggccagagcagcggcuucggccagcacggcagcggcaccggcaagagcagcggcuucgcccagcacgaguacagaagcggccagagcagcuacggccagcacggcaccggcagcagccagagcagcggcugcggccagcacgagagcggcagcggccccaccaccagcuucggccagcacgugagcggcagcgacaacuucagcagcagcggccagcacaucagcgacagcggccagagcaccggcuucggccaguacggcagcggcagcggccagagcaccggccugggccagggcgagagccagcagguggagagcggcagcaccgugcacggcagacaggagaccacccacggccagaccaucaacaccaccagacacagccagagcggccagggccagagcacccagaccggcagcagagugaccagaagaagaagaagcagccagagcgagaacagcgacagcgaggugcacagcaaggugagccacagacacagcgagcacauccacacccaggccggcagccacuaccccaagagcggcagcaccgugagaagaagacagggcaccacccacggccagagaggcgacaccaccagacacggccacagcggccacggccagagcacccagaccggcagcagaaccagcggcagacagagauucagccacagcgacgccaccgacagcgaggugcacagcggcgugagccacagaccccacagccaggagcagacccacagccaggccggcagccagcacggcgagagcgagagcaccgugcacgagagacacgagaccaccuacggccagaccggcgaggccaccggccacggccacagcggccacggccagagcacccagagaggcagcagaaccaccggcagaagaggcagcggccacagcgagagcagcgacagcgaggugcacagcggcggcagccacagaccccagagccaggagcagacccacggccaggccggcagccagcacggcgagagcggcagcaccgugcacggcagacacggcaccacccacggccagaccggcgacaccaccagacacgcccacuaccaccacggcaagagcacccagagaggcagcagcaccaccggcagaagaggcagcggccacagcgagagcagcgacagcgaggugcacagcggcggcagccacacccacagcggccacacccacggccagagcggcagccagcacggcgagagcgagagcaucauccacgacagacacagaaucacccacggccagaccggcgacaccaccagacacagcuacagcggccacgagcagaccacccagaccggcagcagaaccaccggcagacagagaaccagccacagcgagagcaccgacagcgaggugcacagcggcggcagccacagaccccacagcagagagcacaccuacggccaggccggcagccagcacgaggagcccgaguucaccgugcacgagagacacggcaccacccacggccagaucggcgacaccaccggccacagccacagcggccacggccagagcacccagagaggcagcagaaccaccggcagacagagaagcagccacagcgagagcagcgacagcgaggugcacagcggcgugagccacacccacaccggccacacccacggccaggccggcagccagcacggccagagcgagagcaucgugcccgagagacacggcaccacccacggccagaccggcgacaccaccagacacgcccacuaccaccacggccugaccacccagaccggcagcagaaccaccggcagaagaggcagcggccacagcgaguacagcgacagcgagggcuacagcggcgugagccacacccacagcggccacacccacggccaggccagaagccagcacggcgagagcgagagcaucgugcacgagagacacggcaccauccacggccagaccggcgacaccaccagacacgcccacagcggccacggccagagcacccagaccggcagcagaaccaccggcagaagaagcagcggccacagcgaguacagcgacagcgagggccacagcggcuucagccagagaccccacagcagaggccacacccacggccaggccggcagccagcacggcgagagcgagagcaucguggacgagagacacggcaccacccacggccagaccggcgacaccagcggccacagccagagcggccacggccagagcacccagagcggcagcagcaccaccggcagaagaagaagcggccacagcgagagcagcgacagcgaggugcacagcggcggcagccacacccacagcggccacacccacagccaggccagaagccagcacggcgagagcgagagcaccgugcacaagagacaccagaccacccacggccagaccggcgacaccaccgagcacggccaccccagccacggccagaccauccagaccggcagcagaaccaccggcagaagaggcagcggccacagcgaguacagcgacagcgagggccccagcggcgugagccacacccacagcggccacacccacggccaggccggcagccacuaccccgagagcggcagcagcgugcacgagagacacggcaccacccacggccagaccgccgacaccaccagacacggccacagcggccacggccagagcacccagagaggcagcagaaccaccggcagaagagccagcggccacagcgaguacagcgacagcgagggccacagcggcgugagccacacccacagcggccacgcccacggccaggccggcagccagcacggcgagagcggcagcagcgugcacgagagacacggcaccacccacggccagaccggcgacaccaccagacacgcccacagcggccacggccagagcacccagagaggcagcagaaccgccggcagaagaggcagcggccacagcgagagcagcgacagcgaggugcacagcggcgugagccacacccacagcggccacaccuacggccaggccagaagccagcacggcgagagcggcagcgccauccacggcagacagggcaccauccacggccagaccggcgacaccaccagacacggccagagcggccacggccagagcacccagaccggcagcagaaccaccggcagacagagaagcagccacagcgagagcagcgacagcgaggugcacagcgaggccagccccacccacagcggccacacccacagccaggccggcagcagacacggccagagcggcagcagcggccacggcagacagggcaccacccacggccagaccggcgacaccaccagacacgcccacuacggcuacggccagagcacccagagaggcagcagaaccaccggcagaagaggcagcggccacagcgagagcagcgacagcgaggugcacagcuggggcagccacacccacagcggccacauccagggccaggccggcagccagcagagacagcccggcagcaccgugcacggcagacuggagaccacccacggccagaccggcgacaccaccagacacggccacagcggcuacggccagagcacccagaccggcagcagaagcagcagagccagccacuuccagagccacagcagcgagagacagagacacggcagcagccagguguggaagcacggcagcuacggccccgccgaguacgacuacggccacaccggcuacggccccagcggcggcagcagaaagagcaucagcaacagccaccugagcuggagcaccgacagcaccgccaacaagcagcugagcagacacuaa

SEQ ID NO: 17143 - RNA, 12186 nt, Artificial Sequence
  FLG__Homo_sapiens__NP_002007
augagcacccugcuggagaacaucuucgccaucaucaaccuguucaagcaguacagcaagaaggacaagaacaccgacacccugagcaagaaggagcugaaggagcugcuggagaaggaguucagacagauccugaagaaccccgacgaccccgacaugguggacguguucauggaccaccuggacaucgaccacaacaagaagaucgacuucaccgaguuccugcugaugguguucaagcuggcccaggccuacuacgagagcaccagaaaggagaaccugcccaucagcggccacaagcacagaaagcacagccaccacgacaagcacgaggacaacaagcaggaggagaacaaggagaacagaaagagacccagcagccuggagagaagaaacaacagaaagggcaacaagggcagaagcaagagccccagagagaccggcggcaagagacacgagagcagcagcgagaagaaggagagaaagggcuacagccccacccacagagaggaggaguacggcaagaaccaccacaacagcagcaagaaggagaagaacaagaccgagaacaccagacugggcgacaacagaaagagacugagcgagagacuggaggagaaggaggacaacgaggagggcguguacgacuacgagaacaccggcagaaugacccagaaguggauccagagcggccacaucgccaccuacuacaccauccaggacgaggccuacgacaccaccgacagccugcuggaggagaacaagaucuacgagagaagcagaagcagcgacggcaagagcagcagccaggugaacagaagcagacacgagaacaccagccaggugccccugcaggagagcagaaccagaaagagaagaggcagcagagugagccaggacagagacagcgagggccacagcgaggacagcgagagacacagcggcagcgccagcagaaaccaccacggcagcgccugggagcagagcagagacggcagcagacaccccagaagccacgacgaggacagagccagccacggccacagcgccgacagcagcagacagagcggcaccagacacgccgagaccagcagcagaggccagaccgccagcagccacgagcaggccagaagcagccccggcgagagacacggcagcggccaccagcagagcgccgacagcagcagacacagcgccaccggcagaggccaggccagcagcgccgugagcgacagaggccacagaggcagcagcggcagccaggccagcgacagcgagggccacagcgagaacagcgacacccagagcgugagcggccacggcaaggccggccugagacagcagagccaccaggagagcaccagaggcagaagcggcgagagaagcggcagaagcggcagcagccuguaccaggugagcacccacgagcagcccgacagcgcccacggcagaaccggcaccagcaccggcggcagacagggcagccaccacgagcaggccagagacagcagcagacacagcgccagccaggagggccaggacaccaucagaggccaccccggcagcagcagaggcggcagacagggcagccaccacgagcagagcgugaacagaagcggccacagcggcagccaccacagccacaccaccagccagggcagaagcgacgccagccacggccagagcggcagcagaagcgccagcagacagaccagaaacgaggagcagagcggcgacggcaccagacacagcggcagcagacaccacgaggccagcagccaggccgacagcagcagacacagccaggugggccagggccagagcagcggccccagaaccagcagaaaccagggcagcagcgugagccaggacagcgacagccagggccacagcgaggacagcgagagauggagcggcagcgccagcagaaaccaccacggcagcgcccaggagcagagcagagacggcagcagacaccccagaagccaccacgaggacagagccggccacggccacagcgccgacagcagcagaaagagcggcaccagacacacccagaacagcagcagcggccaggccgccagcagccacgagcaggccagaagcagcgccggcgagagacacggcagcagacaccagcugcagagcgccgacagcagcagacacagcggcaccggccacggccaggccagcagcgccgugagagacagcggccacagaggcagcagcggcagccaggccaccgacagcgagggccacagcgaggacagcgacacccagagcgugagcggccacggccaggccggccaccaccagcagagccaccaggagagcgccagagacagaagcggcgagagaagcagaagaagcggcagcuuccuguaccaggugagcacccacaagcagagcgagagcagccacggcuggaccggccccagcaccggcgugagacagggcagccaccacgagcaggccagagacaacagcagacacagcgccagccaggacggccaggacaccaucagaggccaccccggcagcagcagaagaggcagacagggcagccaccacgagcagagcguggacagaagcggccacagcggcagccaccacagccacaccaccagccagggcagaagcgacgccagcagaggccagagcggcagcagaagcgccagcagaaccaccagaaacgaggagcagagcagagacggcagcagacacagcggcagcagacaccacgaggccagcagccacgccgacaucagcagacacagccaggccggccagggccagagcgagggcagcagaaccagcagaagacagggcagcagcgugagccaggacagcgacagcgagggccacagcgaggacagcgagagauggagcggcagcgccagcagaaaccacagaggcagcgcccaggagcagagcagacacggcagcagacaccccagaagccaccacgaggacagagccggccacggccacagcgccgacagcagcagacagagcggcaccccccacgccgagaccagcagcggcggccaggccgccagcagccacgagcaggccagaagcagccccggcgagagacacggcagcagacaccagcagagcgccgacagcagcagacacagcggcauccccagaagacaggccagcagcgccgugagagacagcggccacuggggcagcagcggcagccaggccagcgacagcgagggccacagcgaggagagcgacacccagagcgugagcggccacggccaggacggcccccaccagcagagccaccaggagagcgccagagacuggagcggcggcagaagcggcagaagcggcagcuucaucuaccaggugagcacccacgagcagagcgagagcgcccacggcagaaccagaaccagcaccggcagaagacagggcagccaccacgagcaggccagagacagcagcagacacagcgccagccaggagggccaggacaccaucagagcccaccccggcagcagaagaggcggcagacagggcagccaccacgagcagagcguggacagaagcggccacagcggcagccaccacagccacaccaccagccagggcagaagcgacgccagccacggccagagcggcagcagaagcgccagcagacagaccagaaaggacaagcagagcggcgacggcagcagacacagcggcagcagacaccacgaggccgccagcugggccgacagcagcagacacagccaggugggccaggagcagagcagcggcagcagaaccagcagacaccagggcagcagcgugagccaggacagcgacagcgagagacacagcgacgacagcgagagacugagcggcagcgccagcagaaaccaccacggcagcagcagagagcagagcagagacggcagcagacaccccggcuuccaccaggaggacagagccagccacggccacagcgccgacagcagcagacagagcggcacccaccacaccgagagcagcagccacggccaggccgugagcagccacgagcaggccagaagcagccccggcgagagacacggcagcagacaccagcagagcgccgacagcagcagacacagcggcaucggccacagacaggccagcagcgccgugagagacagcggccacagaggcagcagcggcagccaggugaccaacagcgagggccacagcgaggacagcgacacccagagcgugagcgcccacggccaggccggcccccaccagcagagccacaaggagagcgccagaggccagagcggcgagagcagcggcagaagcagaagcuuccuguaccaggugagcagccacgagcagagcgagagcacccacggccagaccgcccccagcaccggcggcagacagggcagcagacacgagcaggccagaaacagcagcagacacagcgccagccaggacggccaggacaccaucagaggccaccccggcagcagcagaggcggcagacagggcagcuaccacgagcagagcguggacagaagcggccacagcggcuaccaccacagccacaccaccccccagggcagaagcgacgccagccacggccagagcggccccagaagcgccagcagacagaccagaaacgaggagcagagcggcgacggcagcagacacagcggcagcagacaccacgagcccagcaccagagccggcagcagcagacacagccaggugggccagggcgagagcgccggcagcaagaccagcagaagacagggcagcagcgugagccaggacagagacagcgagggccacagcgaggacagcgagagaagaagcgagagcgccagcagaaaccacuacggcagcgccagagagcagagcagacacggcagcagaaaccccagaagccaccaggaggacagagccagccacggccacagcgccgagagcagcagacagagcggcaccagacacgccgagaccagcagcggcggccaggccgccagcagccaggagcaggccagaagcagccccggcgagagacacggcagcagacaccagcagagcgccgacagcagcaccgacagcggcaccggcagaagacaggacagcagcguggugggcgacagcggcaacagaggcagcagcggcagccaggccagcgacagcgagggccacagcgaggagagcgacacccagagcgugagcgcccacggccaggccggcccccaccagcagagccaccaggagagcaccagaggccagagcggcgagagaagcggcagaagcggcagcuuccuguaccaggugagcacccacgagcagagcgagagcgcccacggcagaaccggccccagcaccggcggcagacagagaagcagacacgagcaggccagagacagcagcagacacagcgccagccaggagggccaggacaccaucagaggccaccccggcagcagcagaggcggcagacagggcagccacuacgagcagagcguggacagcagcggccacagcggcagccaccacagccacaccaccagccaggagagaagcgacgugagcagaggccagagcggcagcagaagcgugagcagacagaccagaaacgagaagcagagcggcgacggcagcagacacagcggcagcagacaccacgaggccagcagcagagccgacagcagcagacacagccaggugggccagggccagagcagcggccccagaaccagcagaaaccagggcagcagcgugagccaggacagcgacagccagggccacagcgaggacagcgagagauggagcggcagcgccagcagaaaccaccugggcagcgccugggagcagagcagagacggcagcagacaccccggcagccaccacgaggacagagccggccacggccacagcgccgacagcagcagacagagcggcaccagacacaccgagagcagcagcagaggccaggccgccagcagccacgagcaggccagaagcagcgccggcgagagacacggcagccaccaccagcugcagagcgccgacagcagcagacacagcggcaucggccacggccaggccagcagcgccgugagagacagcggccacagaggcuacagcggcagccaggccagcgacagcgagggccacagcgaggacagcgacacccagagcgugagcgcccagggcaaggccggcccccaccagcagagccacaaggagagcgccagaggccagagcggcgagagcagcggcagaagcggcagcuuccuguaccaggugagcacccacgagcagagcgagagcacccacggccagagcgcccccagcaccggcggcagacagggcagccacuacgaccaggcccaggacagcagcagacacagcgccagccaggagggccaggacaccaucagaggccaccccggccccagcagaggcggcagacagggcagccaccaggagcagagcguggacagaagcggccacagcggcagccaccacagccacaccaccagccagggcagaagcgacgccagcagaggccagagcggcagcagaagcgccagcagaaagaccuacgacaaggagcagagcggcgacggcagcagacacagcggcagccaccaccacgaggccagcagcugggccgacagcagcagacacagccuggugggccagggccagagcagcggccccagaaccagcagacccagaggcagcagcgugagccaggacagcgacagcgagggccacagcgaggacagcgagagaagaagcggcagcgccagcagaaaccaccacggcagcgcccaggagcagagcagagacggcagcagacaccccagaagccaccacgaggacagagccggccacggccacagcgccgagagcagcagacagagcggcacccaccacgccgagaacagcagcggcggccaggccgccagcagccacgagcaggccagaagcagcgccggcgagagacacggcagccaccaccagcagagcgccgacagcagcagacacagcggcaucggccacggccaggccagcagcgccgugagagacagcggccacagaggcagcagcggcagccaggccagcgacagcgagggccacagcgaggacagcgacacccagagcgugagcgcccacggccaggccggcccccaccagcagagccaccaggagagcaccagaggcagaagcgccggcagaagcggcagaagcggcagcuuccuguaccaggugagcacccacgagcagagcgagagcgcccacggcagaaccggcaccagcaccggcggcagacagggcagccaccacaagcaggccagagacagcagcagacacagcaccagccaggagggccaggacaccauccacggccaccccggcagcagcagcggcggcagacagggcagccacuacgagcagcugguggacagaagcggccacagcggcagccaccacagccacaccaccagccagggcagaagcgacgccagccacggccacagcggcagcagaagcgccagcagacagaccagaaacgacgagcagagcggcgacggcagcagacacagcggcagcagacaccacgaggccagcagcagagccgacagcagcggccacagccaggugggccagggccagagcgagggccccagaaccagcagaaacuggggcagcagcuucagccaggacagcgacagccagggccacagcgaggacagcgagagauggagcggcagcgccagcagaaaccaccacggcagcgcccaggagcagcugagagacggcagcagacaccccagaagccaccaggaggacagagccggccacggccacagcgccgacagcagcagacagagcggcaccagacacacccagaccagcagcggcggccaggccgccagcagccacgagcaggccagaagcagcgccggcgagagacacggcagccaccaccagcagagcgccgacagcagcagacacagcggcaucggccacggccaggccagcagcgccgugagagacagcggccacagaggcuacagcggcagccaggccagcgacaacgagggccacagcgaggacagcgacacccagagcgugagcgcccacggccaggccggcagccaccagcagagccaccaggagagcgccagaggcagaagcggcgagaccagcggccacagcggcagcuuccuguaccaggugagcacccacgagcagagcgagagcagccacggcuggaccggccccagcaccagaggcagacagggcagcagacacgagcaggcccaggacagcagcagacacagcgccagccaggacggccaggacaccaucagaggccaccccggcagcagcagaggcggcagacagggcuaccaccacgagcacagcguggacagcagcggccacagcggcagccaccacagccacaccaccagccagggcagaagcgacgccagcagaggccagagcggcagcagaagcgccagcagaaccaccagaaacgaggagcagagcggcgacggcagcagacacagcggcagcagacaccacgaggccagcacccacgccgacaucagcagacacagccaggccgugcagggccagagcgagggcagcagaagaagcagaagacagggcagcagcgugagccaggacagcgacagcgagggccacagcgaggacagcgagagauggagcggcagcgccagcagaaaccaccacggcagcgcccaggagcagcugagagacggcagcagacaccccagaagccaccaggaggacagagccggccacggccacagcgccgacagcagcagacagagcggcaccagacacacccagaccagcagcggcggccaggccgccagcagccacgagcaggccagaagcagcgccggcgagagacacggcagccaccaccagcagagcgccgacagcagcagacacagcggcaucggccacggccaggccagcagcgccgugagagacagcggccacagaggcuacagcggcagccaggccagcgacaacgagggccacagcgaggacagcgacacccagagcgugagcgcccacggccaggccggcagccaccagcagagccaccaggagagcgccagaggcagaagcggcgagaccagcggccacagcggcagcuuccuguaccaggugagcacccacgagcagagcgagagcagccacggcuggaccggccccagcaccagaggcagacagggcagcagacacgagcaggcccaggacagcagcagacacagcgccagccaguacggccaggacaccaucagaggccaccccggcagcagcagaggcggcagacagggcuaccaccacgagcacagcguggacagcagcggccacagcggcagccaccacagccacaccaccagccagggcagaagcgacgccagcagaggccagagcggcagcagaagcgccagcagaaccaccagaaacgaggagcagagcggcgacagcagcagacacagcgugagcagacaccacgaggccagcacccacgccgacaucagcagacacagccaggccgugcagggccagagcgagggcagcagaagaagcagaagacagggcagcagcgugagccaggacagcgacagcgagggccacagcgaggacagcgagagauggagcggcagcgccagcagaaaccacagaggcagcgugcaggagcagagcagacacggcagcagacaccccagaagccaccacgaggacagagccggccacggccacagcgccgacagaagcagacagagcggcaccagacacgccgagaccagcagcggcggccaggccgccagcagccacgagcaggccagaagcagccccggcgagagacacggcagcagacaccagcagagcgccgacagcagcagacacagcggcauccccagaggccaggccagcagcgccgugagagacagcagacacuggggcagcagcggcagccaggccagcgacagcgagggccacagcgaggagagcgacacccagagcgugagcggccacggccaggccggcccccaccagcagagccaccaggagagcgccagagacagaagcggcggcagaagcggcagaagcggcagcuuccuguaccaggugagcacccacgagcagagcgagagcgcccacggcagaaccagaaccagcaccggcagaagacagggcagccaccacgagcaggccagagacagcagcagacacagcgccagccaggagggccaggacaccaucagaggccaccccggcagcagcagaagaggcagacagggcagccacuacgagcagagcguggacagaagcggccacagcggcagccaccacagccacaccaccagccagggcagaagcgacgccagcagaggccagagcggcagcagaagcgccagcagacagaccagaaacgacgagcagagcggcgacggcagcagacacagcuggagccaccaccacgaggccagcacccaggccgacagcagcagacacagccagagcggccagggccagagcgccggccccagaaccagcagaaaccagggcagcagcgugagccaggacagcgacagccagggccacagcgaggacagcgagagauggagcggcagcgccagcagaaaccacagaggcagcgcccaggagcagagcagagacggcagcagacaccccaccagccaccacgaggacagagccggccacggccacagcgccgagagcagcagacagagcggcacccaccacgccgagaacagcagcggcggccaggccgccagcagccacgagcaggccagaagcagcgccggcgagagacacggcagccaccaccagcagagcgccgacagcagcagacacagcggcaucggccacggccaggccagcagcgccgugagagacagcggccacagaggcagcagcggcagccaggccagcgacagcgagggccacagcgaggacagcgacacccagagcgugagcgcccacggccaggccggcccccaccagcagagccaccaggagagcaccagaggcagaagcgccggcagaagcggcagaagcggcagcuuccuguaccaggugagcacccacgagcagagcgagagcgcccacggcagagccggccccagcaccggcggcagacagggcagcagacacgagcaggccagagacagcagcagacacagcgccagccaggagggccaggacaccaucagaggccaccccggcagcagaagaggcggcagacagggcagcuaccacgagcagagcguggacagaagcggccacagcggcagccaccacagccacaccaccagccagggcagaagcgacgccagccacggccagagcggcagcagaagcgccagcagagagaccagaaacgaggagcagagcggcgacggcagcagacacagcggcagcagacaccacgaggccagcacccaggccgacagcagcagacacagccagagcggccagggcgagagcgccggcagcagaagaagcagaagacagggcagcagcgugagccaggacagcgacagcgaggccuaccccgaggacagcgagagaagaagcgagagcgccagcagaaaccaccacggcagcagcagagagcagagcagagacggcagcagacaccccggcagcagccacagagacaccgccagccacgugcagagcagccccgugcagagcgacagcagcaccgccaaggagcacggccacuucagcagccugagccaggacagcgccuaccacagcggcauccagagcagaggcagcccccacagcagcagcagcuaccacuaccagagcgagggcaccgagagacagaagggccagagcggccugguguggagacacggcagcuacggcagcgccgacuacgacuacggcgagagcggcuucagacacagccagcacggcagcgugagcuacaacagcaaccccgugguguucaaggagagaagcgacaucugcaaggccagcgccuucggcaaggaccaccccagauacuacgccaccuacaucaacaaggaccccggccugugcggccacagcagcgacaucagcaagcagcugggcuucagccagagccagagauacuacuacuacgaguaa

SEQ ID NO: 17144 - RNA, 1161 nt, Artificial Sequence
  FLI1__Homo_sapiens__NP_001257939
auggagggcggccuggccggcgagagagccagagagagccccguggacugcagcgugagcaagugcagcaagcuggugggcggcggcgagagcaaccccaugaacuacaacagcuacauggacgagaagaacggcccccccccccccaacaugaccaccaacgagagaagagugaucgugcccgccgaccccacccuguggacccaggagcacgugagacaguggcuggagugggccaucaaggaguacagccugauggagaucgacaccagcuucuuccagaacauggacggcaaggagcugugcaagaugaacaaggaggacuuccugagagccaccacccuguacaacaccgaggugcugcugagccaccugagcuaccugagagagagcagccugcuggccuacaacaccaccagccacaccgaccagagcagcagacugagcgugaaggaggaccccagcuacgacagcgugagaagaggcgccuggggcaacaacaugaacagcggccugaacaagagccccccccugggcggcgcccagaccaucagcaagaacaccgagcagagaccccagcccgaccccuaccagauccugggccccaccagcagcagacuggccaaccccggcagcggccagauccagcuguggcaguuccugcuggagcugcugagcgacagcgccaacgccagcugcaucaccugggagggcaccaacggcgaguucaagaugaccgaccccgacgagguggccagaagauggggcgagagaaagagcaagcccaacaugaacuacgacaagcugagcagagcccugagauacuacuacgacaagaacaucaugaccaaggugcacggcaagagauacgccuacaaguucgacuuccacggcaucgcccaggcccugcagccccaccccaccgagagcagcauguacaaguaccccagcgacaucagcuacaugcccagcuaccacgcccaccagcagaaggugaacuucgugcccccccaccccagcagcaugcccgugaccagcagcagcuucuucggcgccgccagccaguacuggaccagccccaccggcggcaucuaccccaaccccaacgugcccagacaccccaacacccacgugcccagccaccugggcagcuacuacuaa

SEQ ID NO: 17145 - RNA, 3645 nt, Artificial Sequence
  FLII__Homo_sapiens__NP_001243194
auggaggccaccggcgugcugcccuucgugagaggcguggaccugagcggcaacgacuucaagggcggcuacuuccccgagaacgugaaggccaugaccagccugagauggcugaagcugaacagaaccggccugugcuaccugcccgaggagcuggccgcccugcagaagcuggagcaccugagcgugagccacaacaaccugaccacccugcacggcgagcugagcagccugcccagccugagagccaucguggccagagccaacagccugaagaacagcggcgugcccgacgacaucuucaagcuggacgaccugagcgugcuggaccugagccacaaccagcugaccgagugccccagagagcuggagaacgccaagaacaugcuggugcugaaccugagccacaacagacagcugcccgccaugaccgcccugcagacccugcaccugagaagcacccagagaacccagagcaaccugcccaccagccuggagggccugagcaaccuggccgacguggaccugagcugcaacgaccugaccagagugcccgagugccuguacacccugcccagccugagaagacugaaccugagcagcaaccagaucaccgagcugagccugugcaucgaccagugggugcacguggagacccugaaccugagcagaaaccagcugaccagccugcccagcgccaucugcaagcugagcaagcugaagaagcuguaccugaacagcaacaagcuggacuucgacggccugcccagcggcaucggcaagcugaccaaccuggaggaguucauggccgccaacaacaaccuggagcuggugcccgagagccugugcagaugccccaagcugagaaagcuggugcugaacaagaaccaccuggugacccugcccgaggccauccacuuccugaccgagaucgaggugcuggacgugagagagaaccccaaccuggugaugccccccaagcccgccgacagagccgccgagugguacaacaucgacuucagccugcagaaccagcugagacuggccggcgccagccccgccaccguggccgccgccgccgccggcagcggccccaaggaccccauggccagaaagaugagacugagaagaagaaaggacagcgcccaggacgaccaggccaagcaggugcugaagggcaugagcgacguggcccaggagaagaacaagaagcaggaggagagcgccgacgccagagcccccagcggcaaggugagaagaugggaccagggccuggagaagcccagacuggacuacagcgaguucuucaccgaggacgugggccagcugcccggccugaccaucuggcagaucgagaacuucgugcccgugcugguggaggaggccuuccacggcaaguucuacgaggccgacugcuacaucgugcugaagaccuuccuggacgacagcggcagccugaacugggagaucuacuacuggaucggcggcgaggccacccuggacaagaaggccugcagcgccauccacgccgugaaccugagaaacuaccugggcgccgagugcagaaccgugagagaggagaugggcgacgagagcgaggaguuccugcagguguucgacaacgacaucagcuacaucgagggcggcaccgccagcggcuucuacaccguggaggacacccacuacgugaccagaauguacagaguguacggcaagaagaacaucaagcuggagcccgugccccugaagggcaccagccuggaccccagauucguguuccugcuggacagaggccuggacaucuacguguggagaggcgcccaggccacccugagcagcaccaccaaggccagacuguucgccgagaagaucaacaagaacgagagaaagggcaaggccgagaucacccugcuggugcagggccaggagcugcccgaguucugggaggcccugggcggcgagcccagcgagaucaagaagcacgugcccgaggacuucuggcccccccagcccaagcuguacaaggugggccugggccugggcuaccuggagcugccccagaucaacuacaagcugagcguggagcacaagcagagacccaagguggagcugaugcccagaaugagacugcugcagagccugcuggacaccagaugcguguacauccuggacugcuggagcgacguguucaucuggcugggcagaaagagccccagacuggugagagccgccgcccugaagcugggccaggagcugugcggcaugcugcacagacccagacacgccaccgugagcagaagccuggagggcaccgaggcccagguguucaaggccaaguucaagaacugggacgacgugcugaccguggacuacaccagaaacgccgaggccgugcugcagagccccggccugagcggcaaggugaagagagacgccgagaagaaggaccagaugaaggccgaccugaccgcccuguuccugcccagacagccccccaugagccuggccgaggccgagcagcugauggaggaguggaacgaggaccuggacggcauggagggcuucgugcuggagggcaagaaguucgccagacugcccgaggaggaguucggccacuucuacacccaggacugcuacguguuccugugcagauacugggugcccguggaguacgaggaggaggagaagaaggaggacaaggaggagaaggccgagggcaaggagggcgaggaggccaccgccgaggccgaggagaagcagcccgaggaggacuuccagugcaucguguacuucuggcagggcagagaggccagcaacaugggcuggcugaccuucaccuucagccugcagaagaaguucgagagccuguuccccggcaagcuggagguggugagaaugacccagcagcaggagaaccccaaguuccugagccacuucaagagaaaguucaucauccacagaggcaagagaaaggccgugcagggcgcccagcagcccagccuguaccagaucagaaccaacggcagcgcccugugcaccagaugcauccagaucaacaccgacagcagccugcugaacagcgaguucugcuucauccugaaggugcccuucgagagcgaggacaaccagggcaucguguacgccugggugggcagagccagcgaccccgacgaggccaagcuggccgaggacauccugaacaccauguucgacaccagcuacagcaagcaggugaucaacgagggcgaggagcccgagaacuucuucugggugggcaucggcgcccagaagcccuacgacgacgacgccgaguacaugaagcacaccagacuguucagaugcagcaacgagaagggcuacuucgccgugaccgagaagugcagcgacuucugccaggacgaccuggccgacgacgacaucaugcugcuggacaacggccaggagguguacaugugggugggcacccagaccagccagguggagaucaagcugagccugaaggccugccagguguacauccagcacaugagaagcaaggagcacgagagacccagaagacugagacuggugagaaagggcaacgagcagcacgccuucaccagaugcuuccacgccuggagcgccuucugcaaggcccuggccuaa

SEQ ID NO: 17146 - RNA, 7944 nt, Artificial Sequence
  FLNA__Homo_sapiens__NP_001104026
augagcagcagccacagcagagccggccagagcgccgccggcgccgcccccggcggcggcguggacaccagagacgccgagaugcccgccaccgagaaggaccuggccgaggacgcccccuggaagaagauccagcagaacaccuucaccagauggugcaacgagcaccugaagugcgugagcaagagaaucgccaaccugcagaccgaccugagcgacggccugagacugaucgcccugcuggaggugcugagccagaagaagaugcacagaaagcacaaccagagacccaccuucagacagaugcagcuggagaacgugagcguggcccuggaguuccuggacagagagagcaucaagcuggugagcaucgacagcaaggccaucguggacggcaaccugaagcugauccugggccugaucuggacccugauccugcacuacagcaucagcaugcccaugugggacgaggaggaggacgaggaggccaagaagcagacccccaagcagagacugcugggcuggauccagaacaagcugccccagcugcccaucaccaacuucagcagagacuggcagagcggcagagcccugggcgcccugguggacagcugcgcccccggccugugccccgacugggacagcugggacgccagcaagcccgugaccaacgccagagaggccaugcagcaggccgacgacuggcugggcaucccccaggugaucacccccgaggagaucguggaccccaacguggacgagcacagcgugaugaccuaccugagccaguuccccaaggccaagcugaagcccggcgccccccugagacccaagcugaaccccaagaaggccagagccuacggccccggcaucgagcccaccggcaacauggugaagaagagagccgaguucaccguggagaccagaagcgccggccagggcgaggugcugguguacguggaggaccccgccggccaccaggaggaggccaaggugaccgccaacaacgacaagaacagaaccuucagcgugugguacgugcccgaggugaccggcacccacaaggugaccgugcuguucgccggccagcacaucgccaagagccccuucgagguguacguggacaagagccagggcgacgccagcaaggugaccgcccagggccccggccuggagcccagcggcaacaucgccaacaagaccaccuacuucgagaucuucaccgccggcgccggcaccggcgagguggagguggugauccaggaccccaugggccagaagggcaccguggagccccagcuggaggccagaggcgacagcaccuacagaugcagcuaccagcccaccauggagggcgugcacaccgugcacgugaccuucgccggcgugcccauccccagaagccccuacaccgugaccgugggccaggccugcaaccccagcgccugcagagccgugggcagaggccugcagcccaagggcgugagagugaaggagaccgccgacuucaagguguacaccaagggcgccggcagcggcgagcugaaggugaccgugaagggccccaagggcgaggagagagugaagcagaaggaccugggcgacggcguguacggcuucgaguacuaccccauggugcccggcaccuacaucgugaccaucaccuggggcggccagaacaucggcagaagccccuucgaggugaaggugggcaccgagugcggcaaccagaaggugagagccuggggccccggccuggagggcggcguggugggcaagagcgccgacuucgugguggaggccaucggcgacgacgugggcacccugggcuucagcguggagggccccagccaggccaagaucgagugcgacgacaagggcgacggcagcugcgacgugagauacuggccccaggaggccggcgaguacgccgugcacgugcugugcaacagcgaggacaucagacugagccccuucauggccgacaucagagacgccccccaggacuuccaccccgacagagugaaggccagaggccccggccuggagaagaccggcguggccgugaacaagcccgccgaguucaccguggacgccaagcacggcggcaaggccccccugagagugcaggugcaggacaacgagggcugccccguggaggcccuggugaaggacaacggcaacggcaccuacagcugcagcuacgugcccagaaagcccgugaagcacaccgccauggugagcuggggcggcgugagcauccccaacagccccuucagagugaacgugggcgccggcagccaccccaacaaggugaagguguacggccccggcguggccaagaccggccugaaggcccacgagcccaccuacuucaccguggacugcgccgaggccggccagggcgacgugagcaucggcaucaagugcgcccccggcguggugggccccgccgaggccgacaucgacuucgacaucaucagaaacgacaacgacaccuucaccgugaaguacacccccagaggcgccggcagcuacaccaucauggugcuguucgccgaccaggccacccccaccagccccaucagagugaagguggagcccagccacgacgccagcaaggugaaggccgagggccccggccugagcagaaccggcguggagcugggcaagcccacccacuucaccgugaacgccaaggccgccggcaagggcaagcuggacgugcaguucagcggccugaccaagggcgacgccgugagagacguggacaucaucgaccaccacgacaacaccuacaccgugaaguacacccccgugcagcagggccccgugggcgugaacgugaccuacggcggcgaccccauccccaagagccccuucagcguggccgugagccccagccuggaccugagcaagaucaaggugagcggccugggcgagaagguggacgugggcaaggaccaggaguucaccgugaagagcaagggcgccggcggccagggcaagguggccagcaagaucgugggccccagcggcgccgccgugcccugcaagguggagcccggccugggcgccgacaacagcguggugagauuccugcccagagaggagggccccuacgagguggaggugaccuacgacggcgugcccgugcccggcagccccuucccccuggaggccguggcccccaccaagcccagcaaggugaaggccuucggccccggccugcagggcggcagcgccggcagccccgccagauucaccaucgacaccaagggcgccggcaccggcggccugggccugaccguggagggccccugcgaggcccagcuggagugccuggacaacggcgacggcaccugcagcgugagcuacgugcccaccgagcccggcgacuacaacaucaacauccuguucgccgacacccacauccccggcagccccuucaaggcccacguggugcccugcuucgacgccagcaaggugaagugcagcggccccggccuggagagagccaccgccggcgaggugggccaguuccagguggacugcagcagcgccggcagcgccgagcugaccaucgagaucugcagcgaggccggccugcccgccgagguguacauccaggaccacggcgacggcacccacaccaucaccuacaucccccugugccccggcgccuacaccgugaccaucaaguacggcggccagcccgugcccaacuuccccagcaagcugcagguggagcccgccguggacaccagcggcgugcagugcuacggccccggcaucgagggccagggcguguucagagaggccaccaccgaguucagcguggacgccagagcccugacccagaccggcggcccccacgugaaggccagaguggccaaccccagcggcaaccugaccgagaccuacgugcaggacagaggcgacggcauguacaagguggaguacacccccuacgaggagggccugcacagcguggacgugaccuacgacggcagccccgugcccagcagccccuuccaggugcccgugaccgagggcugcgaccccagcagagugagagugcacggccccggcauccagagcggcaccaccaacaagcccaacaaguucaccguggagaccagaggcgccggcaccggcggccugggccuggccguggagggccccagcgaggccaagaugagcugcauggacaacaaggacggcagcugcagcguggaguacauccccuacgaggccggcaccuacagccugaacgugaccuacggcggccaccaggugcccggcagccccuucaaggugcccgugcacgacgugaccgacgccagcaaggugaagugcagcggccccggccugagccccggcauggugagagccaaccugccccagagcuuccagguggacaccagcaaggccggcguggccccccugcaggugaaggugcagggccccaagggccugguggagcccguggacgugguggacaacgccgacggcacccagaccgugaacuacgugcccagcagagagggccccuacagcaucagcgugcuguacggcgacgaggaggugcccagaagccccuucaaggugaaggugcugcccacccacgacgccagcaaggugaaggccagcggccccggccugaacaccaccggcgugcccgccagccugcccguggaguucaccaucgacgccaaggacgccggcgagggccugcuggccgugcagaucaccgaccccgagggcaagcccaagaagacccacauccaggacaaccacgacggcaccuacaccguggccuacgugcccgacgugaccggcagauacaccauccugaucaaguacggcggcgacgagauccccuucagccccuacagagugagagccgugcccaccggcgacgccagcaagugcaccgugaccgugagcaucggcggccacggccugggcgccggcaucggccccaccauccagaucggcgaggagaccgugaucaccguggacaccaaggccgccggcaagggcaaggugaccugcaccgugugcacccccgacggcagcgagguggacguggacgugguggagaacgaggacggcaccuucgacaucuucuacaccgccccccagcccggcaaguacgugaucugcgugagauucggcggcgagcacgugcccaacagccccuuccaggugaccgcccuggccggcgaccagcccagcgugcagcccccccugagaagccagcagcuggccccccaguacaccuacgcccagggcggccagcagaccugggcccccgagagaccccuggugggcgugaacggccuggacgugaccagccugagacccuucgaccuggugauccccuucaccaucaagaagggcgagaucaccggcgaggugagaaugcccagcggcaagguggcccagcccaccaucaccgacaacaaggacggcaccgugaccgugagauacgcccccagcgaggccggccugcacgagauggacaucagauacgacaacaugcacauccccggcagcccccugcaguucuacguggacuacgugaacugcggccacgugaccgccuacggccccggccugacccacggcguggugaacaagcccgccaccuucaccgugaacaccaaggacgccggcgagggcggccugagccuggccaucgagggccccagcaaggccgagaucagcugcaccgacaaccaggacggcaccugcagcgugagcuaccugcccgugcugcccggcgacuacagcauccuggugaaguacaacgagcagcacgugcccggcagccccuucaccgccagagugaccggcgacgacagcaugagaaugagccaccugaaggugggcagcgccgccgacauccccaucaacaucagcgagaccgaccugagccugcugaccgccaccguggugccccccagcggcagagaggagcccugccugcugaagagacugagaaacggccacgugggcaucagcuucgugcccaaggagaccggcgagcaccuggugcacgugaagaagaacggccagcacguggccagcagccccauccccguggugaucagccagagcgagaucggcgacgccagcagagugagagugagcggccagggccugcacgagggccacaccuucgagcccgccgaguucaucaucgacaccagagacgccggcuacggcggccugagccugagcaucgagggccccagcaagguggacaucaacaccgaggaccuggaggacggcaccugcagagugaccuacugccccaccgagcccggcaacuacaucaucaacaucaaguucgccgaccagcacgugcccggcagccccuucagcgugaaggugaccggcgagggcagagugaaggagagcaucaccagaagaagaagagcccccagcguggccaacgugggcagccacugcgaccugagccugaagauccccgagaucagcauccaggacaugaccgcccaggugaccagccccagcggcaagacccacgaggccgagaucguggagggcgagaaccacaccuacugcaucagauucgugcccgccgagaugggcacccacaccgugagcgugaaguacaagggccagcacgugcccggcagccccuuccaguucaccgugggcccccugggcgagggcggcgcccacaaggugagagccggcggccccggccuggagagagccgaggccggcgugcccgccgaguucagcaucuggaccagagaggccggcgccggcggccuggccaucgccguggagggccccagcaaggccgagaucagcuucgaggacagaaaggacggcagcugcggcguggccuacguggugcaggagcccggcgacuacgaggugagcgugaaguucaacgaggagcacauccccgacagccccuucguggugcccguggccagccccagcggcgacgccagaagacugaccgugagcagccugcaggagagcggccugaaggugaaccagcccgccagcuucgccgugagccugaacggcgccaagggcgccaucgacgccaaggugcacagccccagcggcgcccuggaggagugcuacgugaccgagaucgaccaggacaaguacgccgugagauucauccccagagagaacggcguguaccugaucgacgugaaguucaacggcacccacauccccggcagccccuucaagaucagagugggcgagcccggccacggcggcgaccccggccuggugagcgccuacggcgccggccuggagggcggcgugaccggcaaccccgccgaguucguggugaacaccagcaacgccggcgccggcgcccugagcgugaccaucgacggccccagcaaggugaagauggacugccaggagugccccgagggcuacagagugaccuacacccccauggcccccggcagcuaccugaucagcaucaaguacggcggccccuaccacaucggcggcagccccuucaaggccaaggugaccggccccagacuggugagcaaccacagccugcacgagaccagcagcguguucguggacagccugaccaaggccaccugcgccccccagcacggcgcccccggccccggccccgccgacgccagcaaggugguggccaagggccugggccugagcaaggccuacgugggccagaagagcagcuucaccguggacugcagcaaggccggcaacaacaugcugcuggugggcgugcacggccccagaacccccugcgaggagauccuggugaagcacgugggcagcagacuguacagcgugagcuaccugcugaaggacaagggcgaguacacccugguggugaaguggggcgacgagcacauccccggcagccccuacagagugguggugcccuaa

SEQ ID NO: 17147 - RNA, 7902 nt, Artificial Sequence
  FLNB__Homo_sapiens__NP_001157789
augcccgugaccgagaaggaccuggccgaggacgcccccuggaagaagauccagcagaacaccuucaccagauggugcaacgagcaccugaagugcgugaacaagagaaucggcaaccugcagaccgaccugagcgacggccugagacugaucgcccugcuggaggugcugagccagaagagaauguacagaaaguaccaccagagacccaccuucagacagaugcagcuggagaacgugagcguggcccuggaguuccuggacagagagagcaucaagcuggugagcaucgacagcaaggccaucguggacggcaaccugaagcugauccugggccugguguggacccugauccugcacuacagcaucagcaugcccgugugggaggacgagggcgacgacgacgccaagaagcagacccccaagcagagacugcugggcuggauccagaacaagauccccuaccugcccaucaccaacuucaaccagaacuggcaggacggcaaggcccugggcgcccugguggacagcugcgcccccggccugugccccgacugggagagcugggacccccagaagcccguggacaacgccagagaggccaugcagcaggccgacgacuggcugggcgugccccaggugaucacccccgaggagaucauccaccccgacguggacgagcacagcgugaugaccuaccugagccaguuccccaaggccaagcugaagcccggcgccccccugaagcccaagcugaaccccaagaaggccagagccuacggcagaggcaucgagcccaccggcaacauggugaagcagcccgccaaguucaccguggacaccaucagcgccggccagggcgacgugaugguguucguggaggaccccgagggcaacaaggaggaggcccaggugacccccgacagcgacaagaacaagaccuacagcguggaguaccugcccaaggugaccggccugcacaaggugaccgugcuguucgccggccagcacaucagcaagagccccuucgaggugagcguggacaaggcccagggcgacgccagcaaggugaccgccaagggccccggccuggaggccgugggcaacaucgccaacaagcccaccuacuucgacaucuacaccgccggcgccggcgugggcgacaucggcguggagguggaggacccccagggcaagaacaccguggagcugcugguggaggacaagggcaaccagguguacagaugcguguacaagcccaugcagcccggcccccacguggugaagaucuucuucgccggcgacaccauccccaagagccccuucguggugcaggugggcgaggccugcaaccccaacgccugcagagccagcggcagaggccugcagcccaagggcgugagaaucagagagaccaccgacuucaagguggacaccaaggccgccggcagcggcgagcugggcgugaccaugaagggccccaagggccuggaggagcuggugaagcagaaggacuuccuggacggcguguacgccuucgaguacuaccccagcacccccggcagauacagcaucgccaucaccuggggcggccaccacauccccaagagccccuucgaggugcaggugggccccgaggccggcaugcagaaggugagagccuggggccccggccugcacggcggcaucgugggcagaagcgccgacuucgugguggagagcaucggcagcgaggugggcagccugggcuucgccaucgagggccccagccaggccaagaucgaguacaacgaccagaacgacggcagcugcgacgugaaguacuggcccaaggagcccggcgaguacgccgugcacaucaugugcgacgacgaggacaucaaggacagccccuacauggccuucauccaccccgccaccggcggcuacaaccccgaccuggugagagccuacggccccggccuggagaagagcggcugcaucgugaacaaccuggccgaguucaccguggaccccaaggacgccggcaaggccccccugaagaucuucgcccaggacggcgagggccagagaaucgacauccagaugaagaacagaauggacggcaccuacgccugcagcuacacccccgugaaggccaucaagcacaccaucgccgugguguggggcggcgugaacaucccccacagccccuacagagugaacaucggccagggcagccacccccagaaggugaagguguucggccccggcguggagagaagcggccugaaggccaacgagcccacccacuucaccguggacugcaccgaggccggcgagggcgacgugagcgugggcaucaagugcgacgccagagugcugagcgaggacgaggaggacguggacuucgacaucauccacaacgccaacgacaccuucaccgugaaguacgugccccccgccgccggcagauacaccaucaaggugcuguucgccagccaggagauccccgccagccccuucagagugaagguggaccccagccacgacgccagcaaggugaaggccgagggccccggccugagcaaggccggcguggagaacggcaagcccacccacuucaccguguacaccaagggcgccggcaaggccccccugaacgugcaguucaacagcccccugcccggcgacgccgugaaggaccuggacaucaucgacaacuacgacuacagccacaccgugaaguacacccccacccagcagggcaacaugcaggugcuggugaccuacggcggcgaccccauccccaagagccccuucaccgugggcguggccgccccccuggaccugagcaagaucaagcugaacggccuggagaacagaguggaggugggcaaggaccaggaguucaccguggacaccagaggcgccggcggccagggcaagcuggacgugaccauccugagccccagcagaaagguggugcccugccuggugacccccgugaccggcagagagaacagcaccgccaaguucauccccagagaggagggccuguacgccguggacgugaccuacgacggccaccccgugcccggcagccccuacaccguggaggccagccugccccccgaccccagcaaggugaaggcccacggccccggccuggagggcggccuggugggcaagcccgccgaguucaccaucgacaccaagggcgccggcaccggcggccugggccugaccguggagggccccugcgaggccaagaucgagugcagcgacaacggcgacggcaccugcagcgugagcuaccugcccaccaagcccggcgaguacuucgugaacauccuguucgaggaggugcacauccccggcagccccuucaaggccgacaucgagaugcccuucgaccccagcaaggugguggccagcggccccggccuggagcacggcaaggugggcgaggccggccugcugagcguggacugcagcgaggccggccccggcgcccugggccuggaggccgugagcgacagcggcaccaaggccgaggugagcauccagaacaacaaggacggcaccuacgccgugaccuacgugccccugaccgccggcauguacacccugaccaugaaguacggcggcgagcuggugccccacuuccccgccagagugaagguggagcccgccguggacaccagcagaaucaagguguucggccccggcaucgagggcaaggacguguucagagaggccaccaccgacuucaccguggacagcagaccccugacccaggugggcggcgaccacaucaaggcccacaucgccaaccccagcggcgccagcaccgagugcuucgugaccgacaacgccgacggcaccuaccagguggaguacacccccuucgagaagggccugcacgugguggaggugaccuacgacgacgugcccauccccaacagccccuucaagguggccgugaccgagggcugccagcccagcagagugcaggcccagggccccggccugaaggaggccuucaccaacaagcccaacguguucaccguggugaccagaggcgccggcaucggcggccugggcaucaccguggagggccccagcgagagcaagaucaacugcagagacaacaaggacggcagcugcagcgccgaguacauccccuucgcccccggcgacuacgacgugaacaucaccuacggcggcgcccacauccccggcagccccuucagagugcccgugaaggacgugguggaccccagcaaggugaagaucgccggccccggccugggcagcggcgugagagccagagugcugcagagcuucaccguggacagcagcaaggccggccuggccccccuggaggugagagugcugggccccagagccgacgacaccgacagccagagcuggagaagcccccugaaggcccugagcgaguucuucaagggcgaccccaagggcgacuucaacaagaccggccugguggagcccgugaacgugguggacaacggcgacggcacccacaccgugaccuacacccccagccaggagggccccuacauggugagcgugaaguacgccgacgaggagauccccagaagccccuucaaggugaaggugcugcccaccuacgacgccagcaaggugaccgccagcggccccggccugagcagcuacggcgugcccgccagccugcccguggacuucgccaucgacgccagagacgccggcgagggccugcuggccgugcagaucaccgaccaggagggcaagcccaagagagccaucgugcacgacaacaaggacggcaccuacgccgugaccuacauccccgacaagaccggcagauacaugaucggcgugaccuacggcggcgacgacaucccccugagccccuacagaaucagagccacccagaccggcgacgccagcaagugccuggccaccggccccggcaucgccagcaccgugaagaccggcgaggaggugggcuucgugguggacgccaagaccgccggcaagggcaaggugaccugcaccgugcugacccccgacggcaccgaggccgaggccgacgugaucgagaacgaggacggcaccuacgacaucuucuacaccgccgccaagcccggcaccuacgugaucuacgugagauucggcggcguggacauccccaacagccccuucaccgugauggccaccgacggcgaggugaccgccguggaggaggcccccgugaacgccugcccccccggcuucagacccugggugaccgaggaggccuacgugcccgugagcgacaugaacggccugggcuucaagcccuucgaccuggugauccccuucgccgugagaaagggcgagaucaccggcgaggugcacaugcccagcggcaagaccgccacccccgagaucguggacaacaaggacggcaccgugaccgugagauacgcccccaccgaggugggccugcacgagaugcacaucaaguacaugggcagccacauccccgagagcccccugcaguucuacgugaacuaccccaacagcggcagcgugagcgccuacggccccggccugguguacggcguggccaacaagaccgccaccuucaccaucgugaccgaggacgccggcgagggcggccuggaccuggccaucgagggccccagcaaggccgagaucagcugcaucgacaacaaggacggcaccugcaccgugaccuaccugcccacccugcccggcgacuacagcauccuggugaaguacaacgacaagcacauccccggcagccccuucaccgccaagaucaccgacgacagcagaagaugcagccaggugaagcugggcagcgccgccgacuuccugcuggacaucagcgagaccgaccugagcagccugaccgccagcaucaaggcccccagcggcagagacgagcccugccugcugaagagacugcccaacaaccacaucggcaucagcuucauccccagagaggugggcgagcaccuggugagcaucaagaagaacggcaaccacguggccaacagccccgugagcaucaugguggugcagagcgagaucggcgacgccagaagagccaagguguacggcagaggccugagcgagggcagaaccuucgagaugagcgacuucaucguggacaccagagacgccggcuacggcggcaucagccuggccguggagggccccagcaagguggacauccagaccgaggaccuggaggacggcaccugcaaggugagcuacuuccccaccgugcccggcguguacaucgugagcaccaaguucgccgacgagcacgugcccggcagccccuucaccgugaagaucagcggcgagggcagagugaaggagagcaucaccagaaccagcagagcccccagcguggccaccgugggcagcaucugcgaccugaaccugaagauccccgagaucaacagcagcgacaugagcgcccacgugaccagccccagcggcagagugaccgaggccgagaucgugcccaugggcaagaacagccacugcgugagauucgugccccaggagaugggcgugcacaccgugagcgugaaguacagaggccagcacgugaccggcagccccuuccaguucaccgugggcccccugggcgagggcggcgcccacaaggugagagccggcggccccggccuggagagaggcgaggccggcgugcccgccgaguucagcaucuggaccagagaggccggcgccggcggccugagcaucgccguggagggccccagcaaggccgagaucaccuucgacgaccacaagaacggcagcugcggcgugagcuacaucgcccaggagcccggcaacuacgaggugagcaucaaguucaacgacgagcacauccccgagagccccuaccuggugcccgugaucgcccccagcgacgacgccagaagacugaccgugaugagccugcaggagagcggccugaaggugaaccagcccgccagcuucgccaucagacugaacggcgccaagggcaagaucgacgccaaggugcacagccccagcggcgccguggaggagugccacgugagcgagcuggagcccgacaaguacgccgugagauucaucccccacgagaacggcgugcacaccaucgacgugaaguucaacggcagccacguggugggcagccccuucaaggugagagugggcgagcccggccaggccggcaaccccgcccuggugagcgccuacggcaccggccuggagggcggcaccaccggcauccagagcgaguucuucaucaacaccaccagagccggccccggcacccugagcgugaccaucgagggccccagcaaggugaagauggacugccaggagacccccgagggcuacaaggugauguacacccccauggcccccggcaacuaccugaucagcgugaaguacggcggccccaaccacaucgugggcagccccuucaaggccaaggugaccggccagagacuggugagccccggcagcgccaacgagaccagcagcauccugguggagagcgugaccagaagcagcaccgagaccugcuacagcgccauccccaaggccagcagcgacgccagcaaggugaccagcaagggcgccggccugagcaaggccuucgugggccagaagagcagcuuccugguggacugcagcaaggccggcagcaacaugcugcugaucggcgugcacggccccaccacccccugcgaggaggugagcaugaagcacgugggcaaccagcaguacaacgugaccuacguggugaaggagagaggcgacuacgugcuggccgugaaguggggcgaggagcacauccccggcagccccuuccacgugaccgugcccuaa

SEQ ID NO: 17148 - RNA, 8079 nt, Artificial Sequence
  FLNC__Homo_sapiens__NP_001120959
augaugaacaacagcggcuacagcgacgccggccugggccugggcgacgagaccgacgagaugcccagcaccgagaaggaccuggccgaggacgcccccuggaagaagauccagcagaacaccuucaccagauggugcaacgagcaccugaagugcgugggcaagagacugaccgaccugcagagagaccugagcgacggccugagacugaucgcccugcuggaggugcugagccagaagagaauguacagaaaguuccaccccagacccaacuucagacagaugaagcuggagaacgugagcguggcccuggaguuccuggagagagagcacaucaagcuggugagcaucgacagcaaggccaucguggacggcaaccugaagcugauccugggccugaucuggacccugauccugcacuacagcaucagcaugcccaugugggaggacgaggacgacgaggacgccagaaagcagacccccaagcagagacugcugggcuggauccagaacaaggugccccagcugcccaucaccaacuucaacagagacuggcaggacggcaaggcccugggcgcccugguggacaacugcgcccccggccugugccccgacugggaggccugggaccccaaccagcccguggagaacgccagagaggccaugcagcaggccgacgacuggcugggcgugccccaggugaucgcccccgaggagaucguggaccccaacguggacgagcacagcgugaugaccuaccugagccaguuccccaaggccaagcugaagcccggcgcccccgugagaagcaagcagcugaaccccaagaaggccaucgccuacggccccggcaucgagccccagggcaacaccgugcugcagcccgcccacuucaccgugcagaccguggacgccggcgugggcgaggugcugguguacaucgaggaccccgagggccacaccgaggaggccaagguggugcccaacaacgacaaggacagaaccuacgccgugagcuacgugcccaagguggccggccugcacaaggugaccgugcuguucgccggccagaacaucgagagaagccccuucgaggugaacgugggcauggcccugggcgacgccaacaaggugagcgccagaggccccggccuggagcccgugggcaacguggccaacaagcccaccuacuucgacaucuacaccgccggcgccggcaccggcgacguggccguggugaucguggacccccagggcagaagagacaccguggagguggcccuggaggacaagggcgacagcaccuucagaugcaccuacagacccgccauggagggcccccacaccgugcacguggccuucgccggcgcccccaucaccagaagccccuuccccgugcacgugagcgaggccugcaaccccaacgccugcagagccagcggcagaggccugcagcccaagggcgugagagugaaggagguggccgacuucaagguguucaccaagggcgccggcagcggcgagcugaaggugaccgugaagggccccaagggcaccgaggagcccgugaaggugagagaggccggcgacggcguguucgagugcgaguacuaccccguggugcccggcaaguacguggugaccaucaccuggggcggcuacgccauccccagaagccccuucgaggugcaggugagccccgaggccggcgugcagaaggugagagccuggggccccggccuggagaccggccaggugggcaagagcgccgacuucgugguggaggccaucggcaccgaggugggcacccugggcuucagcaucgagggccccagccaggccaagaucgagugcgacgacaagggcgacggcagcugcgacgugagauacuggcccaccgagcccggcgaguacgccgugcacgugaucugcgacgacgaggacaucagagacagccccuucaucgcccacauccugcccgccccccccgacugcuuccccgacaaggugaaggccuucggccccggccuggagcccaccggcugcaucguggacaagcccgccgaguucaccaucgacgccagagccgccggcaagggcgaccugaagcuguacgcccaggacgccgacggcugccccaucgacaucaaggugauccccaacggcgacggcaccuucagaugcagcuacgugcccaccaagcccaucaagcacaccaucaucaucagcuggggcggcgugaacgugcccaagagccccuucagagugaacgugggcgagggcagccaccccgagagagugaagguguacggccccggcguggagaagaccggccugaaggccaacgagcccaccuacuucaccguggacugcagcgaggccggccagggcgacgugagcaucggcaucaagugcgcccccggcguggugggccccgccgaggccgacaucgacuucgacaucaucaagaacgacaacgacaccuucaccgugaaguacaccccccccggcgccggcagauacaccaucauggugcuguucgccaaccaggagauccccgccagccccuuccacaucaagguggaccccagccacgacgccagcaaggugaaggccgagggccccggccugaacagaaccggcguggaggugggcaagcccacccacuucaccgugcugaccaagggcgccggcaaggccaagcuggacgugcaguucgccggcaccgccaagggcgagguggugagagacuucgagaucaucgacaaccacgacuacagcuacaccgugaaguacaccgccgugcagcagggcaacauggccgugaccgugaccuacggcggcgaccccgugcccaagagccccuucguggugaacguggcccccccccuggaccugagcaagaucaaggugcagggccugaacagcaagguggccgugggccaggagcaggccuucagcgugaacaccagaggcgccggcggccagggccagcuggacgugagaaugaccagccccagcagaagacccauccccugcaagcuggagcccggcggcggcgccgaggcccaggccgugagauacaugccccccgaggagggccccuacaagguggacaucaccuacgacggccaccccgugcccggcagccccuucgccguggagggcgugcugccccccgaccccagcaaggugugcgccuacggccccggccugaagggcggccuggugggcacccccgcccccuucagcaucgacaccaagggcgccggcaccggcggccugggccugaccguggagggccccugcgaggccaagaucgagugccaggacaacggcgacggcagcugcgccgugagcuaccugcccaccgagcccggcgaguacaccaucaacauccuguucgccgaggcccacauccccggcagccccuucaaggccaccaucagacccguguucgaccccagcaaggugagagccagcggccccggccuggagagaggcaaggugggcgaggccgccaccuucaccguggacugcagcgaggccggcgaggccgagcugaccaucgagauccugagcgacgccggcgugaaggccgaggugcugauccacaacaacgccgacggcaccuaccacaucaccuacagccccgccuuccccggcaccuacaccaucaccaucaaguacggcggccaccccgugcccaaguuccccaccagagugcacgugcagcccgccguggacaccagcggcgugaaggugagcggccccggcguggagccccacggcgugcugagagaggugaccaccgaguucaccguggacgccagaagccugaccgccaccggcggcaaccacgugaccgccagagugcugaaccccagcggcgccaagaccgacaccuacgugaccgacaacggcgacggcaccuacagagugcaguacaccgccuacgaggagggcgugcaccugguggaggugcuguacgacgagguggccgugcccaagagccccuucagagugggcgugaccgagggcugcgaccccaccagagugagagccuucggccccggccuggagggcggccuggugaacaaggccaacagauucaccguggagaccagaggcgccggcaccggcggccugggccuggccaucgagggccccagcgaggccaagaugagcugcaaggacaacaaggacggcagcugcaccguggaguacauccccuucacccccggcgacuacgacgugaacaucaccuucggcggcagacccauccccggcagccccuucagagugcccgugaaggacgugguggaccccggcaaggugaagugcagcggccccggccugggcgccggcgugagagccagagugccccagaccuucaccguggacugcagccaggccggcagagccccccugcagguggccgugcugggccccaccggcguggccgagcccguggaggugagagacaacggcgacggcacccacaccgugcacuacacccccgccaccgacggccccuacaccguggccgugaaguacgccgaccaggaggugcccagaagccccuucaagaucaaggugcugcccgcccacgacgccagcaaggugagagccagcggccccggccugaacgccagcggcauccccgccagccugcccguggaguucaccaucgacgccagagacgccggcgagggccugcugaccgugcagauccuggaccccgagggcaagcccaagaaggccaacaucagagacaacggcgacggcaccuacaccgugagcuaccugcccgacaugagcggcagauacaccaucaccaucaaguacggcggcgacgagauccccuacagccccuucagaauccacgcccugcccaccggcgacgccagcaagugccuggugaccgugagcaucggcggccacggccugggcgccugccugggccccagaauccagaucggccaggagaccgugaucaccguggacgccaaggccgccggcgagggcaaggugaccugcaccgugagcacccccgacggcgccgagcuggacguggacgugguggagaaccacgacggcaccuucgacaucuacuacaccgcccccgagcccggcaaguacgugaucaccaucagauucggcggcgagcacauccccaacagccccuuccacgugcuggccaccgaggagcccguggugcccguggagcccauggagagcaugcugagacccuucaaccuggugauccccuucgccgugcagaagggcgagcugaccggcgaggugagaaugcccagcggcaagaccgccagacccaacaucaccgacaacaaggacggcaccaucaccgugagauacgcccccaccgagaagggccugcaccagaugggcaucaaguacgacggcaaccacauccccggcagcccccugcaguucuacguggacgccaucaacagcagacacgugagcgccuacggccccggccugagccacggcauggugaacaagcccgccaccuucaccaucgugaccaaggacgccggcgagggcggccugagccuggccguggagggccccagcaaggccgagaucaccugcaaggacaacaaggacggcaccugcaccgugagcuaccugcccaccgcccccggcgacuacagcaucaucgugagauucgacgacaagcacauccccggcagccccuucaccgccaagaucaccggcgacgacagcaugagaaccagccagcugaacgugggcaccagcaccgacgugagccugaagaucaccgagagcgaccugagccagcugaccgccagcaucagagcccccagcggcaacgaggagcccugccugcugaagagacugcccaacagacacaucggcaucagcuucacccccaaggaggugggcgagcacguggugagcgugagaaagagcggcaagcacgugaccaacagccccuucaagauccuggugggccccagcgagaucggcgacgccagcaaggugagaguguggggcaagggccugagcgagggccacaccuuccagguggccgaguucaucguggacaccagaaacgccggcuacggcggccugggccugagcaucgagggccccagcaagguggacaucaacugcgaggacauggaggacggcaccugcaaggugaccuacugccccaccgagcccggcaccuacaucaucaacaucaaguucgccgacaagcacgugcccggcagccccuucaccgugaaggugaccggcgagggcagaaugaaggagagcaucaccagaagaagacaggcccccagcaucgccaccaucggcagcaccugcgaccugaaccugaagauccccggcaacugguuccagauggugagcgcccaggagagacugaccagaaccuucaccagaagcagccacaccuacaccagaaccgagagaaccgagaucagcaagaccagaggcggcgagaccaagagagaggugagaguggaggagagcacccaggugggcggcgaccccuuccccgccguguucggcgacuuccugggcagagagagacugggcagcuucggcagcaucaccagacagcaggagggcgaggccagcagccaggacaugaccgcccaggugaccagccccagcggcaagguggaggccgccgagaucguggagggcgaggacagcgccuacagcgugagauucgugccccaggagaugggcccccacaccguggccgugaaguacagaggccagcacgugcccggcagccccuuccaguucaccgugggcccccugggcgagggcggcgcccacaaggugagagccggcggcaccggccuggagagaggcguggccggcgugcccgccgaguucagcaucuggaccagagaggccggcgccggcggccugagcaucgccguggagggccccagcaaggccgagaucgccuucgaggacagaaaggacggcagcugcggcgugagcuacguggugcaggagcccggcgacuacgaggugagcaucaaguucaacgacgagcacauccccgacagccccuucguggugcccguggccagccugagcgacgacgccagaagacugaccgugaccagccugcaggagaccggccugaaggugaaccagcccgccagcuucgccgugcagcugaacggcgccagaggcgugaucgacgccagagugcacacccccagcggcgccguggaggagugcuacgugagcgagcuggacagcgacaagcacaccaucagauucaucccccacgagaacggcgugcacagcaucgacgugaaguucaacggcgcccacauccccggcagccccuucaagaucagagugggcgagcagagccaggccggcgaccccggccuggugagcgccuacggccccggccuggagggcggcaccaccggcgugagcagcgaguucaucgugaacacccugaacgccggcagcggcgcccugagcgugaccaucgacggccccagcaaggugcagcuggacugcagagagugccccgagggccacguggugaccuacacccccauggcccccggcaacuaccugaucgccaucaaguacggcggcccccagcacaucgugggcagccccuucaaggccaaggugaccggccccagacugagcggcggccacagccugcacgagaccagcaccgugcugguggagaccgugaccaagagcagcagcagcagaggcagcagcuacagcagcauccccaaguucagcagcgacgccagcaagguggugaccagaggccccggccugagccaggccuucgugggccagaagaacagcuucaccguggacugcagcaaggccggcaccaacaugaugauggugggcgugcacggccccaagacccccugcgaggagguguacgugaagcacaugggcaacagaguguacaacgugaccuacaccgugaaggagaagggcgacuacauccugaucgugaaguggggcgacgagagcgugcccggcagccccuucaaggugaaggugcccuaa

SEQ ID NO: 17149 - RNA, 1284 nt, Artificial Sequence
  FLOT1__Homo_sapiens__NP_005794
auguucuucaccugcggccccaacgaggccaugguggugagcggcuucugcagaagcccccccgugaugguggccggcggcagaguguucgugcugcccugcauccagcagauccagagaaucagccugaacacccugacccugaacgugaagagcgagaagguguacaccagacacggcgugcccaucagcgugaccggcaucgcccaggugaagauccagggccagaacaaggagaugcuggccgccgccugccagauguuccugggcaagaccgaggccgagaucgcccacaucgcccuggagacccuggagggccaccagagagccaucauggcccacaugaccguggaggagaucuacaaggacagacagaaguucagcgagcagguguucaagguggccagcagcgaccuggugaacaugggcaucagcguggugagcuacacccugaaggacauccacgacgaccaggacuaccugcacagccugggcaaggccagaaccgcccaggugcagaaggacgccagaaucggcgaggccgaggccaagagagacgccggcaucagagaggccaaggccaagcaggagaaggugagcgcccaguaccugagcgagaucgagauggccaaggcccagagagacuacgagcugaagaaggccgccuacgacaucgaggugaacaccagaagagcccaggccgaccuggccuaccagcugcagguggccaagaccaagcagcagaucgaggagcagagagugcaggugcaggugguggagagagcccagcagguggccgugcaggagcaggagaucgccagaagagagaaggagcuggaggccagagugagaaagcccgccgaggccgagagauacaagcuggagagacuggccgaggccgagaagagccagcugaucaugcaggccgaggccgaggccgccagcgugagaaugagaggcgaggccgaggccuucgccaucggcgccagagccagagccgaggccgagcagauggccaagaaggccgaggccuuccagcuguaccaggaggccgcccagcuggacaugcugcuggagaagcugccccagguggccgaggagaucagcggcccccugaccagcgccaacaagaucacccuggugagcagcggcagcggcaccaugggcgccgccaaggugaccggcgaggugcuggacauccugaccagacugcccgagagcguggagagacugaccggcgugagcaucagccaggugaaccacaagccccugagaaccgccuaa

SEQ ID NO: 17150 - RNA, 1287 nt, Artificial Sequence
  FLOT2__Homo_sapiens__NP_004466
augggcaacugccacaccgugggccccaacgaggcccugguggugagcggcggcugcugcggcagcgacuacaagcaguacguguucggcggcugggccugggccugguggugcaucagcgacacccagagaaucagccuggagaucaugacccugcagcccagaugcgaggacguggagaccgccgagggcguggcccugaccgugaccggcguggcccaggugaagaucaugaccgagaaggagcugcuggccguggccugcgagcaguuccugggcaagaacgugcaggacaucaagaacguggugcugcagacccuggagggccaccugagaagcauccugggcacccugaccguggagcagaucuaccaggacagagaccaguucgccaagcuggugagagagguggccgcccccgacgugggcagaaugggcaucgagauccugagcuucaccaucaaggacguguacgacaagguggacuaccugagcagccugggcaagacccagaccgccguggugcagagagacgccgacaucggcguggccgaggccgagagagacgccggcaucagagaggccgagugcaagaaggagaugcuggacgugaaguucauggccgacaccaagaucgccgacagcaagagagccuucgagcugcagaagagcgccuucagcgaggaggugaacaucaagaccgccgaggcccagcuggccuacgagcugcagggcgccagagagcagcagaagaucagacaggaggagaucgagaucgagguggugcagagaaagaagcagaucgccguggaggcccaggagauccugagaaccgacaaggagcugaucgccaccgugagaagacccgccgaggccgaggcccacagaauccagcagaucgccgagggcgagaaggugaagcaggugcugcuggcccaggccgaggccgagaagaucagaaagaucggcgaggccgaggccgccgugaucgaggccaugggcaaggccgaggccgagagaaugaagcugaaggccgaggccuaccagaaguacggcgacgccgccaagauggcccuggugcuggaggcccugccccagaucgccgccaagaucgccgccccccugaccaagguggacgagaucguggugcugagcggcgacaacagcaaggugaccagcgaggugaacagacugcuggccgagcugcccgccagcgugcacgcccugaccggcguggaccugagcaagaucccccugaucaagaaggccaccggcgugcagguguaa

SEQ ID NO: 17151 - RNA, 1983 nt, Artificial Sequence
  FLRT2__Homo_sapiens__NP_037363
augggccugcagaccaccaaguggcccagccacggcgccuucuuccugaagagcuggcugaucaucagccugggccuguacagccaggugagcaagcugcuggccugccccagcgugugcagaugcgacagaaacuucguguacugcaacgagagaagccugaccagcgugccccugggcauccccgagggcgugaccgugcuguaccugcacaacaaccagaucaacaacgccggcuuccccgccgagcugcacaacgugcagagcgugcacaccguguaccuguacggcaaccagcuggacgaguuccccaugaaccugcccaagaacgugagagugcugcaccugcaggagaacaacauccagaccaucagcagagccgcccuggcccagcugcugaagcuggaggagcugcaccuggacgacaacagcaucagcaccgugggcguggaggacggcgccuucagagaggccaucagccugaagcugcuguuccugagcaagaaccaccugagcagcgugcccgugggccugcccguggaccugcaggagcugagaguggacgagaacagaaucgccgugaucagcgacauggccuuccagaaccugaccagccuggagagacugaucguggacggcaaccugcugaccaacaagggcaucgccgagggcaccuucagccaccugaccaagcugaaggaguucagcaucgugagaaacagccugagccaccccccccccgaccugcccggcacccaccugaucagacuguaccugcaggacaaccagaucaaccacaucccccugaccgccuucagcaaccugagaaagcuggagagacuggacaucagcaacaaccagcugagaaugcugacccagggcguguucgacaaccugagcaaccugaagcagcugaccgccagaaacaaccccugguucugcgacugcagcaucaagugggugaccgaguggcugaaguacauccccagcagccugaacgugagaggcuucaugugccagggccccgagcaggugagaggcauggccgugagagagcugaacaugaaccugcugagcugccccaccaccacccccggccugccccuguucacccccgcccccagcaccgccagccccaccacccagccccccacccugagcauccccaaccccagcagaagcuacaccccccccacccccaccaccagcaagcugcccaccauccccgacugggacggcagagagagagugaccccccccaucagcgagagaauccagcugagcauccacuucgugaacgacaccagcauccaggugagcuggcugagccuguucaccgugauggccuacaagcugaccugggugaagaugggccacagccuggugggcggcaucgugcaggagagaaucgugagcggcgagaagcagcaccugagccuggugaaccuggagcccagaagcaccuacagaaucugccuggugccccuggacgccuucaacuacagagccguggaggacaccaucugcagcgaggccaccacccacgccagcuaccugaacaacggcagcaacaccgccagcagccacgagcagaccaccagccacagcaugggcagccccuuccugcuggccggccugaucggcggcgccgugaucuucgugcugguggugcugcugagcguguucugcuggcacaugcacaagaagggcagauacaccagccagaaguggaaguacaacagaggcagaagaaaggacgacuacugcgaggccggcaccaagaaggacaacagcauccuggagaugaccgagaccagcuuccagaucgugagccugaacaacgaccagcugcugaagggcgacuucagacugcagcccaucuacacccccaacggcggcaucaacuacaccgacugccacauccccaacaacaugagauacugcaacagcagcgugcccgaccuggagcacugccacaccuaa

SEQ ID NO: 17152 - RNA, 1950 nt, Artificial Sequence
  FLRT3__Homo_sapiens__NP_938205
augaucagcgccgccuggagcaucuuccugaucggcaccaagaucggccuguuccugcagguggccccccugagcgugauggccaagagcugccccagcgugugcagaugcgacgccggcuucaucuacugcaacgacagauuccugaccagcauccccaccggcauccccgaggacgccaccacccuguaccugcagaacaaccagaucaacaacgccggcauccccagcgaccugaagaaccugcugaagguggagagaaucuaccuguaccacaacagccuggacgaguuccccaccaaccugcccaaguacgugaaggagcugcaccugcaggagaacaacaucagaaccaucaccuacgacagccugagcaagauccccuaccuggaggagcugcaccuggacgacaacagcgugagcgccgugagcaucgaggagggcgccuucagagacagcaacuaccugagacugcuguuccugagcagaaaccaccugagcaccauccccuggggccugcccagaaccaucgaggagcugagacuggacgacaacagaaucagcaccaucagcagccccagccugcagggccugaccagccugaagagacuggugcuggacggcaaccugcugaacaaccacggccugggcgacaagguguucuucaaccuggugaaccugaccgagcugagccuggugagaaacagccugaccgccgcccccgugaaccugcccggcaccaaccugagaaagcuguaccugcaggacaaccacaucaacagagugccccccaacgccuucagcuaccugagacagcuguacagacuggacaugagcaacaacaaccugagcaaccugccccagggcaucuucgacgaccuggacaacaucacccagcugauccugagaaacaaccccugguacugcggcugcaagaugaagugggugagagacuggcugcagagccugcccgugaaggugaacgugagaggccugaugugccaggcccccgagaaggugagaggcauggccaucaaggaccugaacgccgagcuguucgacugcaaggacagcggcaucgugagcaccauccagaucaccaccgccauccccaacaccguguaccccgcccagggccaguggcccgcccccgugaccaagcagcccgacaucaagaaccccaagcugaccaaggaccaccagaccaccggcagccccagcagaaagaccaucaccaucaccgugaagagcgugaccagcgacaccauccacaucagcuggaagcuggcccugcccaugaccgcccugagacugagcuggcugaagcugggccacagccccgccuucggcagcaucaccgagaccaucgugaccggcgagagaagcgaguaccuggugaccgcccuggagcccgacagccccuacaaggugugcauggugcccauggagaccagcaaccuguaccuguucgacgagacccccgugugcaucgagaccgagaccgccccccugagaauguacaaccccaccaccacccugaacagagagcaggagaaggagcccuacaagaaccccaaccugccccuggccgccaucaucggcggcgccguggcccuggugaccaucgcccugcuggcccuggugugcugguacgugcacagaaacggcagccuguucagcagaaacugcgccuacagcaagggcagaagaagaaaggacgacuacgccgaggccggcaccaagaaggacaacagcauccuggagaucagagagaccagcuuccagaugcugcccaucagcaacgagcccaucagcaaggaggaguucgugauccacaccaucuucccccccaacggcaugaaccuguacaagaacaaccacagcgagagcagcagcaacagaagcuacagagacagcggcauccccgacagcgaccacagccacagcuaa

SEQ ID NO: 17153 - RNA, 2064 nt, Artificial Sequence
  FLT1__Homo_sapiens__NP_001153392
auggugagcuacugggacaccggcgugcugcugugcgcccugcugagcugccugcugcugaccggcagcagcagcggcagcaagcugaaggaccccgagcugagccugaagggcacccagcacaucaugcaggccggccagacccugcaccugcagugcagaggcgaggccgcccacaaguggagccugcccgagauggugagcaaggagagcgagagacugagcaucaccaagagcgccugcggcagaaacggcaagcaguucugcagcacccugacccugaacaccgcccaggccaaccacaccggcuucuacagcugcaaguaccuggccgugcccaccagcaagaagaaggagaccgagagcgccaucuacaucuucaucagcgacaccggcagacccuucguggagauguacagcgagauccccgagaucauccacaugaccgagggcagagagcuggugauccccugcagagugaccagccccaacaucaccgugacccugaagaaguucccccuggacacccugauccccgacggcaagagaaucaucugggacagcagaaagggcuucaucaucagcaacgccaccuacaaggagaucggccugcugaccugcgaggccaccgugaacggccaccuguacaagaccaacuaccugacccacagacagaccaacaccaucaucgacgugcagaucagcacccccagacccgugaagcugcugagaggccacacccuggugcugaacugcaccgccaccaccccccugaacaccagagugcagaugaccuggagcuaccccgacgagaagaacaagagagccagcgugagaagaagaaucgaccagagcaacagccacgccaacaucuucuacagcgugcugaccaucgacaagaugcagaacaaggacaagggccuguacaccugcagagugagaagcggccccagcuucaagagcgugaacaccagcgugcacaucuacgacaaggccuucaucaccgugaagcacagaaagcagcaggugcuggagaccguggccggcaagagaagcuacagacugagcaugaaggugaaggccuuccccagccccgaggugguguggcugaaggacggccugcccgccaccgagaagagcgccagauaccugaccagaggcuacagccugaucaucaaggacgugaccgaggaggacgccggcaacuacaccauccugcugagcaucaagcagagcaacguguucaagaaccugaccgccacccugaucgugaacgugaagccccagaucuacgagaaggccgugagcagcuuccccgaccccgcccuguacccccugggcagcagacagauccugaccugcaccgccuacggcaucccccagcccaccaucaagugguucuggcaccccugcaaccacaaccacagcgaggccagaugcgacuucugcagcaacaacgaggagagcuucauccuggacgccgacagcaacaugggcaacagaaucgagagcaucacccagagaauggccaucaucgagggcaagaacaagauggccagcacccuggugguggccgacagcagaaucagcggcaucuacaucugcaucgccagcaacaaggugggcaccgugggcagaaacaucagcuucuacaucaccgacgugcccaacggcuuccacgugaaccuggagaagaugcccaccgagggcgaggaccugaagcugagcugcaccgugaacaaguuccuguacagagacgugaccuggauccugcugagaaccgugaacaacagaaccaugcacuacagcaucagcaagcagaagauggccaucaccaaggagcacagcaucacccugaaccugaccaucaugaacgugagccugcaggacagcggcaccuacgccugcagagccagaaacguguacaccggcgaggagauccugcagaagaaggagaucaccaucagaggcgagcacugcaacaagaaggccguguucagcagaaucagcaaguucaagagcaccagaaacgacugcaccacccagagcaacgugaagcacuaa

SEQ ID NO: 17154 - RNA, 2982 nt, Artificial Sequence
  FLT3__Homo_sapiens__NP_004110
augcccgcccuggccagagacggcggccagcugccccugcuggugguguucagcgccaugaucuucggcaccaucaccaaccaggaccugcccgugaucaagugcgugcugaucaaccacaagaacaacgacagcagcgugggcaagagcagcagcuaccccauggugagcgagagccccgaggaccugggcugcgcccugagaccccagagcagcggcaccguguacgaggccgccgccguggagguggacgugagcgccagcaucacccugcaggugcugguggacgcccccggcaacaucagcugccuguggguguucaagcacagcagccugaacugccagccccacuucgaccugcagaacagaggcguggugagcauggugauccugaagaugaccgagacccaggccggcgaguaccugcuguucauccagagcgaggccaccaacuacaccauccuguucaccgugagcaucagaaacacccugcuguacacccugagaagacccuacuucagaaagauggagaaccaggacgcccuggugugcaucagcgagagcgugcccgagcccaucguggagugggugcugugcgacagccagggcgagagcugcaaggaggagagccccgccguggugaagaaggaggagaaggugcugcacgagcuguucggcaccgacaucagaugcugcgccagaaacgagcugggcagagagugcaccagacuguucaccaucgaccugaaccagaccccccagaccacccugccccagcuguuccugaaggugggcgagccccuguggaucagaugcaaggccgugcacgugaaccacggcuucggccugaccugggagcuggagaacaaggcccuggaggagggcaacuacuucgagaugagcaccuacagcaccaacagaaccaugaucagaauccuguucgccuucgugagcagcguggccagaaacgacaccggcuacuacaccugcagcagcagcaagcaccccagccagagcgcccuggugaccaucguggagaagggcuucaucaacgccaccaacagcagcgaggacuacgagaucgaccaguacgaggaguucugcuucagcgugagauucaaggccuacccccagaucagaugcaccuggaccuucagcagaaagagcuuccccugcgagcagaagggccuggacaacggcuacagcaucagcaaguucugcaaccacaagcaccagcccggcgaguacaucuuccacgccgagaacgacgacgcccaguucaccaagauguucacccugaacaucagaagaaagccccaggugcuggccgaggccagcgccagccaggccagcugcuucagcgacggcuacccccugcccagcuggaccuggaagaagugcagcgacaagagccccaacugcaccgaggagaucaccgagggcguguggaacagaaaggccaacagaaagguguucggccagugggugagcagcagcacccugaacaugagcgaggccaucaagggcuuccuggugaagugcugcgccuacaacagccugggcaccagcugcgagaccauccugcugaacagccccggccccuuccccuucauccaggacaacaucagcuucuacgccaccaucggcgugugccugcuguucaucguggugcugacccugcugaucugccacaaguacaagaagcaguucagauacgagagccagcugcagauggugcaggugaccggcagcagcgacaacgaguacuucuacguggacuucagagaguacgaguacgaccugaagugggaguuccccagagagaaccuggaguucggcaaggugcugggcagcggcgccuucggcaaggugaugaacgccaccgccuacggcaucagcaagaccggcgugagcauccagguggccgugaagaugcugaaggagaaggccgacagcagcgagagagaggcccugaugagcgagcugaagaugaugacccagcugggcagccacgagaacaucgugaaccugcugggcgccugcacccugagcggccccaucuaccugaucuucgaguacugcugcuacggcgaccugcugaacuaccugagaagcaagagagagaaguuccacagaaccuggaccgagaucuucaaggagcacaacuucagcuucuaccccaccuuccagagccaccccaacagcagcaugcccggcagcagagaggugcagauccaccccgacagcgaccagaucagcggccugcacggcaacagcuuccacagcgaggacgagaucgaguacgagaaccagaagagacuggaggaggaggaggaccugaacgugcugaccuucgaggaccugcugugcuucgccuaccagguggccaagggcauggaguuccuggaguucaagagcugcgugcacagagaccuggccgccagaaacgugcuggugacccacggcaagguggugaagaucugcgacuucggccuggccagagacaucaugagcgacagcaacuacguggugagaggcaacgccagacugcccgugaaguggauggcccccgagagccuguucgagggcaucuacaccaucaagagcgacguguggagcuacggcauccugcugugggagaucuucagccugggcgugaaccccuaccccggcauccccguggacgccaacuucuacaagcugauccagaacggcuucaagauggaccagcccuucuacgccaccgaggagaucuacaucaucaugcagagcugcugggccuucgacagcagaaagagacccagcuuccccaaccugaccagcuuccugggcugccagcuggccgacgccgaggaggccauguaccagaacguggacggcagagugagcgagugcccccacaccuaccagaacagaagacccuucagcagagagauggaccugggccugcugagcccccaggcccagguggaggacagcuaa

SEQ ID NO: 17155 - RNA, 708 nt, Artificial Sequence
  FLT3LG__Homo_sapiens__NP_001450
augaccgugcuggcccccgccuggagccccaccaccuaccugcugcugcugcugcugcugagcagcggccugagcggcacccaggacugcagcuuccagcacagccccaucagcagcgacuucgccgugaagaucagagagcugagcgacuaccugcugcaggacuaccccgugaccguggccagcaaccugcaggacgaggagcugugcggcggccuguggagacuggugcuggcccagagauggauggagagacugaagaccguggccggcagcaagaugcagggccugcuggagagagugaacaccgagauccacuucgugaccaagugcgccuuccagcccccccccagcugccugagauucgugcagaccaacaucagcagacugcugcaggagaccagcgagcagcugguggcccugaagcccuggaucaccagacagaacuucagcagaugccuggagcugcagugccagcccgacagcagcacccugcccccccccuggagccccagaccccuggaggccaccgcccccaccgccccccagcccccccugcugcugcugcugcugcugcccgugggccugcugcugcuggccgccgccuggugccugcacuggcagagaaccagaagaagaacccccagacccggcgagcaggugccccccgugcccagcccccaggaccugcugcugguggagcacuaa

SEQ ID NO: 17156 - RNA, 3897 nt, Artificial Sequence
  FLT4__Homo_sapiens__NP_002011
augcagagaggcgccgcccugugccugagacuguggcugugccugggccugcuggacggccuggugagcggcuacagcaugaccccccccacccugaacaucaccgaggagagccacgugaucgacaccggcgacagccugagcaucagcugcagaggccagcacccccuggagugggccuggcccggcgcccaggaggcccccgccaccggcgacaaggacagcgaggacaccggcguggugagagacugcgagggcaccgacgccagacccuacugcaaggugcugcugcugcacgaggugcacgccaacgacaccggcagcuacgugugcuacuacaaguacaucaaggccagaaucgagggcaccaccgccgccagcagcuacguguucgugagagacuucgagcagcccuucaucaacaagcccgacacccugcuggugaacagaaaggacgccaugugggugcccugccuggugagcauccccggccugaacgugacccugagaagccagagcagcgugcuguggcccgacggccaggagguggugugggacgacagaagaggcaugcuggugagcaccccccugcugcacgacgcccuguaccugcagugcgagaccaccuggggcgaccaggacuuccugagcaaccccuuccuggugcacaucaccggcaacgagcuguacgacauccagcugcugcccagaaagagccuggagcugcuggugggcgagaagcuggugcugaacugcaccgugugggccgaguucaacagcggcgugaccuucgacugggacuaccccggcaagcaggccgagagaggcaagugggugcccgagagaagaagccagcagacccacaccgagcugagcagcauccugaccauccacaacgugagccagcacgaccugggcagcuacgugugcaaggccaacaacggcauccagagauucagagagagcaccgaggugaucgugcacgagaaccccuucaucagcguggaguggcugaagggccccauccuggaggccaccgccggcgacgagcuggugaagcugcccgugaagcuggccgccuaccccccccccgaguuccagugguacaaggacggcaaggcccugagcggcagacacagcccccacgcccuggugcugaaggaggugaccgaggccagcaccggcaccuacacccuggcccuguggaacagcgccgccggccugagaagaaacaucagccuggagcugguggugaacgugcccccccagauccacgagaaggaggccagcagccccagcaucuacagcagacacagcagacaggcccugaccugcaccgccuacggcgugccccugccccugagcauccaguggcacuggagacccuggacccccugcaagauguucgcccagagaagccugagaagaagacagcagcaggaccugaugccccagugcagagacuggagagccgugaccacccaggacgccgugaaccccaucgagagccuggacaccuggaccgaguucguggagggcaagaacaagaccgugagcaagcuggugauccagaacgccaacgugagcgccauguacaagugcguggugagcaacaaggugggccaggacgagagacugaucuacuucuacgugaccaccauccccgacggcuucaccaucgagagcaagcccagcgaggagcugcuggagggccagcccgugcugcugagcugccaggccgacagcuacaaguacgagcaccugagaugguacagacugaaccugagcacccugcacgacgcccacggcaacccccugcugcuggacugcaagaacgugcaccuguucgccaccccccuggccgccagccuggaggagguggcccccggcgccagacacgccacccugagccugagcauccccagaguggcccccgagcacgagggccacuacgugugcgaggugcaggacagaagaagccacgacaagcacugccacaagaaguaccugagcgugcaggcccuggaggcccccagacugacccagaaccugaccgaccugcuggugaacgugagcgacagccuggagaugcagugccugguggccggcgcccacgcccccagcaucgugugguacaaggacgagagacugcuggaggagaagagcggcguggaccuggccgacagcaaccagaagcugagcauccagagagugagagaggaggacgccggcagauaccugugcagcgugugcaacgccaagggcugcgugaacagcagcgccagcguggccguggagggcagcgaggacaagggcagcauggagaucgugauccuggugggcaccggcgugaucgccguguucuucugggugcugcugcugcugaucuucugcaacaugagaagacccgcccacgccgacaucaagaccggcuaccugagcaucaucauggaccccggcgaggugccccuggaggagcagugcgaguaccugagcuacgacgccagccagugggaguuccccagagagagacugcaccugggcagagugcugggcuacggcgccuucggcaaggugguggaggccagcgccuucggcauccacaagggcagcagcugcgacaccguggccgugaagaugcugaaggagggcgccaccgccagcgagcacagagcccugaugagcgagcugaagauccugauccacaucggcaaccaccugaacguggugaaccugcugggcgccugcaccaagccccagggcccccugauggugaucguggaguucugcaaguacggcaaccugagcaacuuccugagagccaagagagacgccuucagccccugcgccgagaagagccccgagcagagaggcagauucagagccaugguggagcuggccagacuggacagaagaagacccggcagcagcgacagagugcuguucgccagauucagcaagaccgagggcggcgccagaagagccagccccgaccaggaggccgaggaccuguggcugagcccccugaccauggaggaccuggugugcuacagcuuccagguggccagaggcauggaguuccuggccagcagaaagugcauccacagagaccuggccgccagaaacauccugcugagcgagagcgacguggugaagaucugcgacuucggccuggccagagacaucuacaaggaccccgacuacgugagaaagggcagcgccagacugccccugaaguggauggcccccgagagcaucuucgacaagguguacaccacccagagcgacguguggagcuucggcgugcugcugugggagaucuucagccugggcgccagccccuaccccggcgugcagaucaacgaggaguucugccagagacugagagacggcaccagaaugagagcccccgagcuggccacccccgccaucagaagaaucaugcugaacugcuggagcggcgaccccaaggccagacccgccuucagcgagcugguggagauccugggcgaccugcugcagggcagaggccugcaggaggaggaggaggugugcauggcccccagaagcagccagagcagcgaggagggcagcuucagccaggugagcaccauggcccugcacaucgcccaggccgacgccgaggacagcccccccagccugcagagacacagccuggccgccagauacuacaacugggugagcuuccccggcugccuggccagaggcgccgagaccagaggcagcagcagaaugaagaccuucgaggaguuccccaugacccccaccaccuacaagggcagcguggacaaccagaccgacagcggcauggugcuggccagcgaggaguucgagcagaucgagagcagacacagacaggagagcggcuucagauaa

SEQ ID NO: 17157 - RNA, 1668 nt, Artificial Sequence
  FLVCR1__Homo_sapiens__NP_054772
auggccagacccgacgacgaggagggcgccgccguggcccccggccacccccuggccaagggcuaccugccccugcccagaggcgcccccgugggcaaggagagcguggagcugcagaacggccccaaggccggcaccuuccccgugaacggcgcccccagagacagccuggccgccgccagcggcgugcugggcggcccccagaccccccuggcccccgaggaggagacccaggccagacugcugcccgccggcgccggcgccgagacccccggcgccgagagcagcccccugccccugaccgcccugagccccagaagauucguggugcugcugaucuucagccuguacagccuggugaacgccuuccaguggauccaguacagcaucaucagcaacguguucgagggcuucuacggcgugacccugcugcacaucgacuggcugagcaugguguacaugcuggccuacgugccccugaucuuccccgccaccuggcugcuggacaccagaggccugagacugaccgcccugcugggcagcggccugaacugccugggcgccuggaucaagugcggcagcgugcagcagcaccuguucugggugaccaugcugggccagugccugugcagcguggcccagguguucauccugggccugcccagcagaaucgccagcgugugguucggccccaaggaggugagcaccgccugcgccaccgccgugcugggcaaccagcugggcaccgccgugggcuuccugcugccccccgugcuggugcccaacacccagaacgacaccaaccugcuggccugcaacaucagcaccauguucuacggcaccagcgccguggccacccugcuguucauccugaccgccaucgccuucaaggagaagcccagauacccccccagccaggcccaggccgcccugcaggacagcccccccgaggaguacagcuacaagaagagcaucagaaaccuguucaagaacauccccuucgugcugcugcugaucaccuacggcaucaugaccggcgccuucuacagcgugagcacccugcugaaccagaugauccugaccuacuacgagggcgaggaggugaacgccggcagaaucggccugacccuggugguggccggcauggugggcagcauccugugcggccuguggcuggacuacaccaagaccuacaagcagaccacccugaucguguacauccugagcuucaucggcauggugaucuucaccuucacccuggaccugagauacaucaucaucguguucgugaccggcggcgugcugggcuucuucaugaccggcuaccugccccugggcuucgaguucgccguggagaucaccuaccccgagagcgagggcaccagcagcggccugcugaacgccagcgcccagaucuucggcauccuguucacccuggcccagggcaagcugaccagcgacuacggccccaaggccggcaacaucuuccugugcguguggauguucaucggcaucauccugaccgcccugaucaagagcgaccugagaagacacaacaucaacaucggcaucaccaacguggacgugaaggccauccccgccgacagccccaccgaccaggagcccaagaccgugaugcugagcaagcagagcgagagcgccaucuaa

SEQ ID NO: 17158 - RNA, 966 nt, Artificial Sequence
  FLVCR2__Homo_sapiens__NP_001182212
augagcgccgacaacagcagcaccaucugcgugugcagaagcgugagacaggagcugggcaucgccaucggcuuccuggugccccccgugcuggugcccaacaucgaggacagagacgagcuggccuaccacaucagcaucauguucuacaucaucggcggcguggccacccugcugcugauccuggugaucaucguguucaaggagaagcccaaguacccccccagcagagcccagagccugagcuacgcccugaccagccccgacgccagcuaccugggcagcaucgccagacuguucaagaaccugaacuucgugcugcuggugaucaccuacggccugaacgccggcgccuucuacgcccugagcacccugcugaacagaauggugaucuggcacuaccccggcgaggaggugaacgccggcagaaucggccugaccaucgugaucgccggcaugcugggcgccgugaucagcggcaucuggcuggacagaagcaagaccuacaaggagaccacccuggugguguacaucaugacccuggugggcauggugguguacaccuucacccugaaccugggccaccugugggugguguucaucaccgccggcaccaugggcuucuucaugaccggcuaccugccccugggcuucgaguucgccguggagcugaccuaccccgagagcgagggcaucagcagcggccugcugaacaucagcgcccagguguucggcaucaucuucaccaucagccagggccagaucaucgacaacuacggcaccaagcccggcaacaucuuccugugcguguuccugacccugggcgccgcccugaccgccuucaucaaggccgaccugagaagacagaaggccaacaaggagacccuggagaacaagcugcaggaggaggaggaggagagcaacaccagcaaggugcccaccgccgugagcgaggaccaccuguaa

SEQ ID NO: 17159 - RNA, 3591 nt, Artificial Sequence
  FMN1__Homo_sapiens__NP_001096654
auggagaacguggacaacagccuggacggcagcgacgugagcgagcccgccaagcccgaggccggccuggagguggcccagagcauccugagcaaguucagcaugaagagccuguucggcuucaccagcaagcuggagagcgugaaccccgaggaggaggacgccgugcugaaggccuuccacagccuggacgugaaccccaccagccagcaggacgacagcagcaacggccuggacccccaggaggccggcagcagagugagccccgaccugggcaacgacgagaagaucgccagcguggagaccgagagcgagggcagccagagaaaggaggccggcaccagccugcuggcccaggagcugcugccccugagcacccugaagggcaccaaggacgacgugaucugcgugagaggcacccuggugcacaccaccagcgacagcgacagcgacgacggcggccaggagcccgaggagggcagcagcaccaacggccccaagagccccagcggcgugcugagcgagcccagccaggagagcaaggagaaccccggcggcuucagagagaacaccgugaccggcgagaugaacggcgccgagcugugcgccgaggacccccagagaaucccccccgagaugagcagcaagcuggaggccggcaacggcggccugcagaccgagagaagacccagccaggaccaggugggcgaggagggcagccaggaccugcccgccgugaccaaccagaacagcagcgugggcaucaccgagagcgccagcagcaagaaggaggugagcggcgagaagagcuuccagcugcccgccuucuucagcggccugagagugcugaagaagggcgccaccgccgagggcggcgagaccaucaccgagaucaagcccaaggacggcgaccuggcccugcugaagcugacccagcccgugcagaagagccuggugcaggccggccugcagaccgugaagagcgagaagaaggccaccgaccccaaggccacccccacccugcuggagcagcugagccugcugcugaacaucgacaugcccaagaccgagcccaagggcgccgaccccgagagccccagaagagaggagaugggcugcaacgccgaccaggagagccagagcggccccggcgugccccagacccagggcggcgaggugaagcccaagagccccgagaccgcccuggaggccuucaaggcccuguucaucagaccccccagaaagggcaccaccgccgacaccagcgagcuggaggcccugaagagaaagaugagacacgagaaggagagccugagagccguguucgagagaagcaacagcaagcccgccgacggccccagcgacagcaagagccccgaccacagccugaccgagcaggacgacagaacccccggcagacugcaggccguguggcccccccccaagaccaaggacaccgaggagaaggugggccugaaguacaccgaggccgaguaccaggccgccauccugcaccugaagagagagcacaaggaggagaucgagaaccugcaggcccaguucgagcugagagccuuccacaucagaggcgagcacgccaugaucaccgccagacuggaggagaccaucgagaaccugaagcacgagcuggagcacagauggagaggcggcugcgaggagagaaaggacgugugcaucagcaccgacgacgacugcccccccaagaccuucagaaacgugugcgugcagaccgacagagagaccuuccugaagcccugcgagagcgagagcaagaccaccagaagcaaccagcuggugcccaagaagcugaacaucagcagccugagccagcugagcccccccaacgaccacaaggacauccacgccgcccugcagcccauggagggcauggccagcaaccagcagaaggcccugccccccccccccgccagcaucccccccccccccccccugcccagcggccugggcagccugagccccgccccccccaugccccccgugagcgccggccccccccugccccccccccccccccccccccccccccugcccccccccagcagcgccggcccccccccccccccccccccccccccccugcccaacagccccgccccccccaaccccggcggccccccccccgccccccccccccccggccuggcccccccccccccccccggccuguucuucggccugggcagcagcagcagccagugccccagaaagcccgccaucgagcccagcugccccaugaagccccuguacuggaccagaauccagaucagcgacagaagccagaacgccacccccacccugugggacagccuggaggagcccgacaucagagaccccagcgaguucgaguaccuguucagcaaggacaccacccagcagaagaagaagccccugagcgagaccuacgagaagaagaacaaggugaagaagaucaucaagcugcuggacggcaagagaagccagaccgugggcauccugaucagcagccugcaccuggagaugaaggacauccagcaggccaucuucaacguggacgacagcgugguggaccuggagacccuggccgcccuguacgagaacagagcccaggaggacgagcuggugaagaucagaaaguacuacgagaccagcaaggaggaggagcugaagcugcuggacaagcccgagcaguuccugcacgagcuggcccagauccccaacuucgccgagagagcccagugcaucaucuucagaagcguguucagcgagggcaucaccagccugcacagaaagguggagaucaucaccagagccagcaaggaccugcugcacgugaagagcgugaaggacauccuggcccugauccuggccuucggcaacuacaugaacggcggcaacagaaccagaggccaggccgacggcuacagccuggagauccugcccaagcugaaggacgugaagagcagagacaacggcaucaaccugguggacuacguggugaaguacuaccugagauacuacgaccaggaggccggcaccgagaagagcguguucccccugcccgagccccaggacuucuuccuggccagccaggugaaguucgaggaccugaucaaggaccugagaaagcugaagagacagcuggaggccagcgagaagcagauggugguggugugcaaggagagccccaaggaguaccugcagcccuucaaggacaagcuggaggaguucuuccagaaggccaagaaggagcacaagauggaggagagccaccuggagaacgcccagaagagcuucgagaccaccgugagauacuucggcaugaagcccaagagcggcgagaaggagaucacccccagcuacguguucauggugugguacgaguucugcagcgacuucaagaccaucuggaagagagagagcaagaacaucagcaaggagagacugaagauggcccaggagagcgugagcaagcugaccagcgagaagaagguggagaccaagaagaucaaccccaccgccagccugaaggagagacugagacagaaggaggccagcgugaccaccaacuaa

SEQ ID NO: 17160 - RNA, 5169 nt, Artificial Sequence
  FMN2__Homo_sapiens__NP_064450
augggcaaccaggacggcaagcugaagagaagcgccggcgacgcccugcacgagggcggcggcggcgccgaggacgcccugggccccagagacguggaggccaccaagaagggcagcggcggcaagaaggcccugggcaagcacggcaagggcggcggcggcggcggcggcggcggcgagagcggcaagaagaagagcaagagcgacagcagagccagcguguucagcaaccugagaaucagaaagaaccugagcaagggcaagggcgccggcggcagcagagaggacgugcuggacagccaggcccugcagaccggcgagcuggacagcgcccacagccugcugaccaagacccccgaccugagccugagcgccgacgaggccggccugagcgacaccgagugcgccgaccccuucgaggugaccggccccggcggccccggccccgccgaggccagagugggcggcagacccaucgccgaggacguggagaccgccgccggcgcccaggacggccagagaaccagcagcggcagcgacaccgacaucuacagcuuccacagcgccaccgagcaggaggaccugcugagcgacauccagcaggccaucagacugcagcagcagcagcagcagcagcugcagcugcagcugcagcagcagcagcagcagcagcagcugcagggcgccgaggagcccgccgccccccccaccgccgugagcccccagcccggcgccuuccugggccuggacagauuccugcugggccccagcggcggcgccggcgaggcccccggcagccccgacaccgagcaggcccugagcgcccugagcgaccugcccgagagccuggccgccgagcccagagagccccagcagccccccagccccggcggccugcccgugagcgaggcccccagccugcccgccgcccagcccgccgccaaggacagccccagcagcaccgccuuccccuuccccgaggccggccccggcgaggaggccgccggcgcccccgugagaggcgccggcgacaccgacgaggagggcgaggaggacgccuucgaggacgcccccagaggcagccccggcgaggagugggcccccgaggugggcgaggacgccccccagagacugggcgaggagcccgaggaggaggcccagggccccgacgcccccgccgccgccagccugcccggcagccccgcccccagccagagaugcuucaagcccuacccccugaucacccccugcuacaucaagaccaccaccagacagcugagcagccccaaccacagccccagccagagccccaaccagagccccagaaucaagagaagacccgagcccagccugagcagaggcagcagaaccgcccuggccagcguggccgcccccgccaagaagcacagagccgacggcggccuggccgccggccugagcagaagcgccgacuggaccgaggagcugggcgccagaacccccagagugggcggcagcgcccaccugcuggagagaggcguggccagcgacagcggcggcggcgugagccccgcccuggccgccaaggccagcggcgcccccgccgccgccgacggcuuccagaacguguucaccggcagaacccugcuggagaagcuguucagccagcaggagaacggcccccccgaggaggccgagaaguucugcagcagaaucaucgccaugggccugcugcugcccuucagcgacugcuucagagagcccugcaaccagaacgcccagaccaacgccgccagcuucgaccaggaccagcuguacaccugggccgccgugagccagcccacccacagccuggacuacagcgagggccaguuccccagaagagugcccagcaugggcccccccagcaagccccccgacgaggagcacagacuggaggacgccgagaccgagagccagagcgccgugagcgagaccccccagaagagaagcgacgccgugcagaaggaggugguggacaugaagagcgagggccaggccaccgugauccagcagcuggagcagaccaucgaggaccugagaaccaagaucgccgagcuggagagacaguaccccgcccuggacaccgagguggccagcggccaccagggccuggagaacggcgugaccgccagcggcgacgugugccuggaggcccugagacuggaggagaaggaggugagacaccacagaauccuggaggccaagagcauccagaccagccccaccgaggagggcggcgugcugacccugccccccguggacggccugcccggcagaccccccugcccccccggcgccgagagcggcccccagaccaaguucugcagcgagaucagccugaucgugagccccagaagaaucagcgugcagcuggacagccaccagcccacccagagcaucagccagcccccccccccccccagccugcuguggagcgccggccagggccagcccggcagccagcccccccacagcaucagcaccgaguuccagaccagccacgagcacagcgugagcagcgccuucaagaacagcugcaacauccccagcccccccccccugcccugcaccgagagcagcagcagcaugcccggccugggcauggugcccccccccccccccccccugcccggcaugaccgugcccacccugcccagcaccgccaucccccagccccccccccugcagggcaccgagaugcugcccccccccccccccccccugcccggcgccggcaucccccccccccccccccugcccggcgccggcauccugccccugcccccccugcccggcgccggcaucccccccccccccccccugcccggcgccgccaucccccccccccccccccugcccggcgccggcaucccccugccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgccggcaucccccccccccccccccugcccggcgugggcaucccccccccccccccccugcccggcgccggcaucccccccccccccccccugcccggcgccggcaucccccccccccccccccugcccggcgccggcaucccccccccccccccccugcccagagugggcaucccccccccccccccccugcccggcgccggcaucccccccccccccccccugcccggcgccggcaucccccccccccccccccugcccggcgugggcaucccccccccccccccccugcccggcgugggcaucccccccccccccccccugcccggcgccggcaucccccccccccccccccugcccggcaugggcaucccccccgcccccgcccccccccugcccccccccggcaccggcauccccccccccccccugcugcccgugagcggccccccccugcugccccaggugggcagcagcacccugcccaccccccaggugugcggcuuccugccccccccccugcccagcggccuguucggccugggcaugaaccaggacaagggcagcagaaagcagcccaucgagcccugcagacccaugaagccccuguacuggaccagaauccagcugcacagcaagagagacagcagcaccagccugaucugggagaagaucgaggagcccagcaucgacugccacgaguucgaggagcuguucagcaagaccgccgugaaggagagaaagaagcccaucagcgacaccaucagcaagaccaaggccaagcagguggugaagcugcugagcaacaagagaagccaggccgugggcauccugaugagcagccugcaccuggacaugaaggacauccagcacgccguggugaaccuggacaacagcgugguggaccuggagacccugcaggcccuguacgagaacagagcccagagcgacgagcuggagaagaucgagaagcacggcagaagcagcaaggacaaggagaacgccaagagccuggacaagcccgagcaguuccuguacgagcugagccugauccccaacuucagcgagagaguguucugcauccuguuccagagcaccuucagcgagagcaucugcagcaucagaagaaagcuggagcugcugcagaagcugugcgagacccugaagaacggccccggcgugaugcaggugcugggccuggugcuggccuucggcaacuacaugaacggcggcaacaagaccagaggccaggccgacggcuucggccuggacauccugcccaagcugaaggacgugaagagcagcgacaacagcagaagccugcugagcuacaucgugagcuacuaccugagaaacuucgacgaggacgccggcaaggagcagugccuguucccccugcccgagccccaggaccuguuccaggccagccagaugaaguucgaggacuuccagaaggaccugagaaagcugaagaaggaccugaaggccugcgagguggaggccggcaagguguaccaggugagcagcaaggagcacaugcagcccuucaaggagaacauggagcaguucaucauccaggccaagaucgaccaggaggccgaggagaacagccugaccgagacccacaagugcuuccuggagaccaccgccuacuucuucaugaagcccaagcugggcgagaaggaggugagccccaacgccuucuucagcaucuggcacgaguucagcagcgacuucaaggacuucuggaagaaggagaacaagcugcugcugcaggagagagugaaggaggccgaggaggugugcagacagaagaagggcaagagccuguacaagaucaagcccagacacgacagcggcaucaaggccaagaucagcaugaagaccuaa

SEQ ID NO: 17161 - RNA, 3303 nt, Artificial Sequence
  FMNL1__Homo_sapiens__NP_005883
augggcaacgccgccggcagcgccgagcagcccgccggccccgccgcccccccccccaagcagcccgccccccccaagcagcccaugcccgccgccggcgagcuggaggagagauucaacagagcccugaacugcaugaaccugccccccgacaaggugcagcugcugagccaguacgacaacgagaagaagugggagcugaucugcgaccaggagagauuccaggugaagaacccccccgccgccuacauccagaagcugaagagcuacguggacaccggcggcgugagcagaaagguggccgccgacuggaugagcaaccugggcuucaagagaagagugcaggagagcacccaggugcugagagagcuggagaccagccugagaaccaaccacaucggcugggugcaggaguuccugaacgaggagaacagaggccuggacgugcugcuggaguaccuggccuucgcccagugcagcgugaccuacgacauggagagcaccgacaacggcgccagcaacagcgagaagaacaagccccuggagcagagcguggaggaccugagcaagggcccccccagcagcgugcccaagagcagacaccugaccaucaagcugacccccgcccacagcagaaaggcccugagaaacagcagaaucgugagccagaaggacgacgugcacgugugcaucaugugccugagagccaucaugaacuaccagagcggcuucagccuggugaugaaccaccccgccugcgugaacgagaucgcccugagccugaacaacaagaaccccagaaccaaggcccuggugcuggagcugcuggccgccgugugccuggugagaggcggccacgacaucauccuggccgccuucgacaacuucaaggaggugugcggcgagcagcacagauucgagaagcugauggaguacuucagaaacgaggacagcaacaucgacuucaugguggccugcaugcaguucaucaacaucguggugcacagcguggagaacaugaacuucagaguguuccugcaguacgaguucacccaccugggccuggaccuguaccuggagagacugagacugaccgagagcgacaagcugcaggugcagauccaggccuaccuggacaacaucuucgacgugggcgcccugcuggaggacaccgagaccaagaacgccgugcuggagcacauggaggagcugcaggagcagguggcccugcugaccgagagacugagagacgccgagaacgagagcauggccaagaucgccgagcuggagaagcagcugagccaggccagaaaggagcuggagacccugagagagagauucagcgagagcaccgccaugggcgccagcagaagaccccccgagcccgagaaggccccccccgccgcccccaccagacccagcgcccuggagcugaagguggaggagcuggaggagaagggccugaucagaauccugagaggccccggcgacgccgugagcaucgagauccugcccguggccguggccacccccagcggcggcgacgcccccacccccggcgugcccaccggcagccccagccccgaccuggcccccgccgccgagcccgcccccggcgccgcccccccccccccccccccccugcccggccugcccagcccccaggaggccccccccagcgcccccccccaggcccccccccugcccggcagccccgagcccccccccgcccccccccugcccggcgaccugcccccccccccccccccccccccccccccccccggcaccgacggccccgugcccccccccccccccccccccccccccccccccggcggcccccccgacgcccugggcagaagagacagcgagcugggccccggcgugaaggccaagaagcccauccagaccaaguucagaaugccccugcugaacuggguggcccugaagcccagccagaucaccggcaccguguucaccgagcugaacgacgagaaggugcugcaggagcuggacaugagcgacuucgaggagcaguucaagaccaagagccagggccccagccuggaccugagcgcccugaagagcaaggccgcccagaaggcccccagcaaggccacccugaucgaggccaacagagccaagaaccuggccaucacccugagaaagggcaaccugggcgccgagagaaucugccaggccaucgaggccuacgaccugcaggcccugggccuggacuuccuggagcugcugaugagauuccugcccaccgaguacgagagaagccugaucaccagauucgagagagagcagagacccauggaggagcugagcgaggaggacagauucaugcugugcuucagcagaauccccagacugcccgagagaaugaccacccugaccuuccugggcaacuuccccgacaccgcccagcugcugaugccccagcugaacgccaucaucgccgccagcaugagcaucaagagcagcgacaagcugagacagauccuggagaucgugcuggccuucggcaacuacaugaacagcagcaagagaggcgccgccuacggcuucagacugcagagccuggacgcccugcuggagaugaagagcaccgacagaaagcagacccugcugcacuaccuggugaaggugaucgccgagaaguacccccagcugaccggcuuccacagcgaccugcacuuccuggacaaggccggcagcgugagccuggacagcgugcuggccgacgugagaagccugcagagaggccuggagcugacccagagagaguucgugagacaggacgacugcauggugcugaaggaguuccugagagccaacagccccaccauggacaagcugcuggccgacagcaagaccgcccaggaggccuucgagagcgugguggaguacuucggcgagaaccccaagaccaccagccccggccuguucuucagccuguucagcagauucaucaaggccuacaagaaggccgagcaggagguggagcaguggaagaaggaggccgccgcccaggaggccggcgccgacacccccggcaagggcgagccccccgcccccaagagcccccccaaggccagaagaccccagauggaccugaucagcgagcugaagagaagacagcagaaggagccccugaucuacgagagcgacagagacggcgccaucgaggacaucaucaccgugaucaagaccgugcccuucaccgccagaaccggcaagagaaccagcagacugcugugcgaggccagccugggcgaggagaugccccuguaa

SEQ ID NO: 17162 - RNA, 3279 nt, Artificial Sequence
  FMNL2__Homo_sapiens__NP_443137
augggcaacgccggcagcauggacagccagcagaccgacuucagagcccacaacgugccccugaagcugcccaugcccgagcccggcgagcuggaggagagauucgccaucgugcugaacgccaugaaccugccccccgacaaggccagacugcugagacaguacgacaacgagaagaagugggagcugaucugcgaccaggagagauuccaggugaagaaccccccccacaccuacauccagaagcugaagggcuaccuggaccccgccgugaccagaaagaaguucagaagaagagugcaggagagcacccaggugcugagagagcuggagaucagccugagaaccaaccacaucggcugggugagagaguuccugaacgaggagaacaagggccuggacgugcugguggaguaccugagcuucgcccaguacgccgugaccuucgacuucgagagcguggagagcaccguggagagcagcguggacaagagcaagcccuggagcagaagcaucgaggaccugcacagaggcagcaaccugcccagccccgugggcaacagcgugagcagaagcggcagacacagcgcccugagauacaacacccugcccagcagaagaacccugaagaacagcagacuggugagcaagaaggacgacgugcacgugugcaucaugugccugagagccaucaugaacuaccaguacggcuucaacauggugaugagccacccccacgccgugaacgagaucgcccugagccugaacaacaagaaccccagaaccaaggcccuggugcuggagcugcuggccgccgugugccuggugagaggcggccacgagaucauccugagcgccuucgacaacuucaaggaggugugcggcgagaagcagagauucgagaagcugauggagcacuucagaaacgaggacaacaacaucgacuucaugguggccagcaugcaguucaucaacaucguggugcacagcguggaggacaugaacuucagagugcaccugcaguacgaguucaccaagcugggccuggacgaguaccuggacaagcugaagcacaccgagagcgacaagcugcaggugcagauccaggccuaccuggacaacguguucgacgugggcgcccugcuggaggacgccgagaccaagaacgccgcccuggagagaguggaggagcuggaggagaacaucagccaccugagcgagaagcugcaggacaccgagaacgaggccaugagcaagaucguggagcuggagaagcagcugaugcagagaaacaaggagcuggacguggugagagagaucuacaaggacgccaacacccaggugcacacccugagaaagauggugaaggagaaggaggaggccauccagagacagagcacccuggagaagaagauccacgagcuggagaagcagggcaccaucaagauccagaagaagggcgacggcgacaucgccauccugcccgugguggccagcggcacccugagcaugggcagcgaggugguggccggcaacagcgugggccccaccaugggcgccgccagcagcggcccccugcccccccccccccccccccugccccccagcagcgacacccccgagaccgugcagaacggccccgugaccccccccaugccccccccccccccccccccccccccccccccccccccccccccccccccccccccccccccccugcccggccccgccgccgagaccgugcccgcccccccccuggcccccccccugcccagcgcccccccccugcccggcaccagcagccccaccgugguguucaacagcggccuggccgccgugaagaucaagaagcccaucaagaccaaguucagaaugcccguguucaacuggguggcccugaagcccaaccagaucaacggcaccguguucaacgagaucgacgacgagagaauccuggaggaccugaacguggacgaguucgaggagaucuucaagaccaaggcccagggccccgccaucgaccugagcagcagcaagcagaagaucccccagaagggcagcaacaaggugacccugcuggaggccaacagagccaagaaccuggccaucacccugagaaaggccggcaagaccgccgacgagaucugcaaggccauccacguguucgaccugaagacccugcccguggacuucguggagugccugaugagauuccugcccaccgagaacgaggugaaggugcugagacuguacgagagagagagaaagccccuggagaaccugagcgacgaggacagauucaugaugcaguucagcaagaucgagagacugaugcagaagaugaccaucauggccuucaucggcaacuucgccgagagcauccagaugcugaccccccagcugcacgccaucaucgccgccagcgugagcaucaagagcagccagaagcugaagaagauccuggagaucauccuggcccugggcaacuacaugaacagcagcaagagaggcgccguguacggcuucaagcugcagagccuggaccugcugcuggacaccaagagcaccgacagaaagcagacccugcugcacuacaucagcaacguggugaaggagaaguaccaccaggugagccuguucuacaacgagcugcacuacguggagaaggccgccgccgugagccuggagaacgugcugcuggacgugaaggagcugcagagaggcauggaccugaccaagagagaguacaccaugcacgaccacaacacccugcugaaggaguucauccugaacaacgagggcaagcugaagaagcugcaggacgacgccaagaucgcccaggacgccuucgacgacguggugaaguacuucggcgagaaccccaagaccaccccccccagcguguucuuccccguguucgugagauucgugaaggccuacaagcaggccgaggaggagaacgagcugagaaagaagcaggagcaggcccugauggagaagcugcuggagcaggaggcccugauggagcagcaggaccccaagagccccagccacaagagcaagagacagcagcaggagcugaucgccgagcugagaagaagacaggugaaggacaacagacacguguacgagggcaaggacggcgccaucgaggacaucaucaccgaccugagaaaccagcccuacagaagagccgacgccgugagaagaagcgugagaagaagauucgacgaccagaaccugagaagcgugaacggcgccgagaucaccauguaa

SEQ ID NO: 17163 - RNA, 3084 nt, Artificial Sequence
  FMNL3__Homo_sapiens__NP_783863
augggcaaccuggagagcgccgagggcgugcccggcgagccccccagcgugccccugcugcugccccccggcaagaugcccaugcccgagcccugcgagcuggaggagagauucgcccuggugcugagcagcaugaaccugccccccgacaaggccagacugcugagacaguacgacaacgagaagaagugggaccugaucugcgaccaggagagauuccaggugaagaaccccccccacaccuacauccagaagcugcagagcuuccuggaccccagcgugaccagaaagaaguucagaagaagagugcaggagagcaccaaggugcugagagagcuggagaucagccugagaaccaaccacaucggcugggugagagaguuccugaacgacgagaacaagggccuggacgugcugguggacuaccugagcuucgcccagugcagcgugauguucgacuucgagggccuggagagcggcgacgacggcgccuucgacaagcugagaagcuggagcagaagcaucgaggaccugcagccccccagcgcccugagcgcccccuucaccaacagccuggccagaagcgccagacagagcgugcugagauacagcacccugcccggcagaagagcccugaagaacagcagacuggugagccagaaggacgacgugcacgugugcauccugugccugagagccaucaugaacuaccaguacggcuucaaccuggugaugagccacccccacgccgugaacgagaucgcccugagccugaacaacaagaaccccagaaccaaggcccuggugcuggagcugcuggccgccgugugccuggugagaggcggccacgagaucauccuggccgccuucgacaacuucaaggaggugugcaaggagcugcacagauucgagaagcugauggaguacuucagaaacgaggacagcaacaucgacuucaugguggccugcaugcaguucaucaacaucguggugcacagcguggaggacaugaacuucagagugcaccugcaguacgaguucaccaagcugggccuggaggaguuccugcagaagagcagacacaccgagagcgagaagcugcaggugcagauccaggccuaccuggacaacguguucgacgugggcggccugcuggaggacgccgagaccaagaacguggcccuggagaagguggaggagcuggaggagcacgugagccaccugaccgagaagcugcuggaccuggagaacgagaacaugaugagaguggccgagcuggagaagcagcugcugcagagagagaaggagcuggagagcaucaaggagaccuacgagaacaccagccaccaggugcacacccugagaagacugaucaaggagaaggaggaggccuuccagagaagaugccaccuggagcccaacgugagaggccuggagagcguggacagcgaggcccuggccagagugggccccgccgagcugagcgagggcaugccccccagcgaccuggaccugcuggcccccgcccccccccccgaggaggugcugccccugccccccccccccgcccccccccugcccccccccccccccccccugcccgacaagugcccccccgcccccccccugcccggcgccgcccccagcguggugcugaccgugggccugagcgccaucagaaucaagaagcccaucaagaccaaguucagacugcccguguucaacuggaccgcccugaagcccaaccagaucagcggcaccguguucagcgagcuggacgacgagaagauccuggaggaccuggaccuggacaaguucgaggagcuguucaagaccaaggcccagggccccgcccuggaccugaucugcagcaagaacaagaccgcccagaaggccgccagcaaggugacccugcuggaggccaacagagccaagaaccuggccaucacccugagaaaggccggcagaagcgccgaggagaucugcagagccauccacaccuucgaccugcagacccugcccguggacuucguggagugccugaugagauuccugcccaccgaggccgaggugaagcugcugagacaguacgagagagagagacagccccuggaggagcuggccgccgaggacagauucaugcugcuguucagcaagguggagagacugacccagagaauggccggcauggccuuccugggcaacuuccaggacaaccugcagaugcugaccccccagcugaacgccaucaucgccgccagcgccagcgugaagagcagccagaagcugaagcagaugcuggagaucauccuggcccugggcaacuacaugaacagcagcaagagaggcgccguguacggcuucaagcugcagagccuggaccugcugcuggacaccaagagcaccgacagaaagaugacccugcugcacuucaucgcccugaccgugaaggagaaguaccccgaccuggccaacuucuggcacgagcugcacuucguggagaaggccgccgccgugagccuggagaacgugcugcuggacgugaaggagcugggcagaggcauggagcugaucagaagagagugcagcauccacgacaacagcgugcugagaaacuuccugagcaccaacgagggcaagcuggacaagcugcagagagacgccaagaccgccgaggaggccuacaacgccguggugagauacuucggcgagagccccaagaccaccccccccagcguguucuuccccguguucgugagauucaucagaagcuacaaggaggccgagcaggagaacgaggccagaaagaagcaggaggaggugaugagagagaagcagcuggcccaggaggccaagaagcuggacgccaagacccccagccagagaaacaaguggcagcagcaggagcugaucgccgagcugagaagaagacaggccaaggagcacagacccguguacgagggcaaggacggcaccaucgaggacaucaucaccggccugcacugccagcccaugguggugagacaccaggccagaagcgccgccccccccagcggcccccccagagcccccggcccccacuaa

SEQ ID NO: 17164 - RNA, 1611 nt, Artificial Sequence
  FMO1__Homo_sapiens__NP_001269621
augcaggagaacauggccaagagaguggccaucgugggcgccggcgugagcggccuggccagcaucaagugcugccuggaggagggccuggagcccaccugcuucgagagaagcgacgaccugggcggccuguggagauucaccgagcacguggaggagggcagagccagccuguacaagagcguggugagcaacagcugcaaggagaugagcugcuacagcgacuuccccuuccccgaggacuaccccaacuacgugcccaacagccaguuccuggaguaccugaagauguacgccaaccacuucgaccugcugaagcacauccaguucaagaccaaggugugcagcgugaccaagugcagcgacagcgccgugagcggccagugggagguggugaccaugcacgaggagaagcaggagagcgccaucuucgacgccgugauggugugcaccggcuuccugaccaaccccuaccugccccuggacagcuuccccggcaucaacgccuucaagggccaguacuuccacagcagacaguacaagcaccccgacaucuucaaggacaagagagugcuggugaucggcaugggcaacagcggcaccgacaucgccguggaggccagccaccuggccgagaagguguuccugagcaccaccggcggcggcugggugaucagcagaaucuucgacagcggcuaccccugggacaugguguucaugaccagauuccagaacaugcugagaaacagccugcccacccccaucgugaccuggcugauggagagaaagaucaacaacuggcugaaccacgccaacuacggccugauccccgaggacagaacccagcugaaggaguucgugcugaacgacgagcugcccggcagaaucaucaccggcaagguguucaucagacccagcaucaaggaggugaaggagaacagcgugaucuucaacaacaccagcaaggaggagcccaucgacaucaucguguucgccaccggcuacaccuucgccuuccccuuccuggacgagagcguggugaagguggaggacggccaggccagccuguacaaguacaucuuccccgcccaccugcagaagcccacccuggccaucaucggccugaucaagccccugggcagcaugauccccaccggcgagacccaggccagaugggccgugagagugcugaagggcgugaacaagcugcccccccccagcgugaugaucgaggagaucaacgccagaaaggagaacaagcccagcugguucggccugugcuacugcaaggcccugcagagcgacuacaucaccuacaucgacgagcugcugaccuacaucaacgccaagcccaaccuguucagcaugcugcugaccgacccccaccuggcccugaccguguucuucggccccugcagccccuaccaguucagacugaccggccccggcaagugggagggcgccagaaacgccaucaugacccagugggacagaaccuucaaggugaucaaggccagaguggugcaggagagccccagccccuucgagagcuuccugaagguguucagcuuccuggcccugcugguggccaucuuccugaucuuccuguaa

SEQ ID NO: 17165 - RNA, 1608 nt, Artificial Sequence
  FMO2__Homo_sapiens__NP_001451
auggccaagaagguggccgugaucggcgccggcgugagcggccugaucagccugaagugcugcguggacgagggccuggagcccaccugcuucgagagaaccgaggacaucggcggcguguggagauucaaggagaacguggaggacggcagagccagcaucuaccagagcguggugaccaacaccagcaaggagaugagcugcuucagcgacuuccccaugcccgaggacuuccccaacuuccugcacaacagcaagcugcuggaguacuucagaaucuucgccaagaaguucgaccugcugaaguacauccaguuccagaccaccgugcugagcgugagaaagugccccgacuucagcagcagcggccaguggaagguggugacccagagcaacggcaaggagcagagcgccguguucgacgccgugauggugugcagcggccaccacauccugccccacaucccccugaagagcuuccccggcauggagagauucaagggccaguacuuccacagcagacaguacaagcaccccgacggcuucgagggcaagagaauccuggugaucggcaugggcaacagcggcagcgacaucgccguggagcugagcaagaacgccgcccagguguucaucagcaccagacacggcaccugggugaugagcagaaucagcgaggacggcuaccccugggacagcguguuccacaccagauucagaagcaugcugagaaacgugcugcccagaaccgccgugaaguggaugaucgagcagcagaugaacagaugguucaaccacgagaacuacggccuggagccccagaacaaguacaucaugaaggagcccgugcugaacgacgacgugcccagcagacugcugugcggcgccaucaaggugaagagcaccgugaaggagcugaccgagaccagcgccaucuucgaggacggcaccguggaggagaacaucgacgugaucaucuucgccaccggcuacagcuucagcuuccccuuccuggaggacagccuggugaagguggagaacaacauggugagccuguacaaguacaucuuccccgcccaccuggacaagagcacccuggccugcaucggccugauccagccccugggcagcaucuuccccaccgccgagcugcaggccagaugggugaccagaguguucaagggccugugcagccugcccagcgagagaaccaugaugauggacaucaucaagagaaacgagaagagaaucgaccuguucggcgagagccagagccagacccugcagaccaacuacguggacuaccuggacgagcuggcccuggagaucggcgccaagcccgacuucugcagccugcuguucaaggaccccaagcuggccgugagacuguacuucggccccugcaacagcuaccaguacagacuggugggccccggccagugggagggcgccagaaacgccaucuucacccagaagcagagaauccugaagccccugaagaccagagcccugaaggacagcagcaacuucagcgugagcuuccugcugaagauccugggccugcuggccguggugguggccuucuucugccagcugcaguggagcuaa

SEQ ID NO: 17166 - RNA, 1599 nt, Artificial Sequence
  FMO3__Homo_sapiens__NP_008825
augggcaagaagguggccaucaucggcgccggcgugagcggccuggccagcaucagaagcugccuggaggagggccuggagcccaccugcuucgagaagagcaacgacaucggcggccuguggaaguucagcgaccacgccgaggagggcagagccagcaucuacaagagcguguucagcaacagcagcaaggagaugaugugcuuccccgacuuccccuuccccgacgacuuccccaacuucaugcacaacagcaagauccaggaguacaucaucgccuucgccaaggagaagaaccugcugaaguacauccaguucaagaccuucgugagcagcgugaacaagcaccccgacuucgccaccaccggccagugggacgugaccaccgagagagacggcaagaaggagagcgccguguucgacgccgugauggugugcagcggccaccacguguaccccaaccugcccaaggagagcuuccccggccugaaccacuucaagggcaagugcuuccacagcagagacuacaaggagcccggcguguucaacggcaagagagugcugguggugggccugggcaacagcggcugcgacaucgccaccgagcugagcagaaccgccgagcaggugaugaucagcagcagaagcggcagcugggugaugagcagagugugggacaacggcuaccccugggacaugcugcuggugaccagauucggcaccuuccugaagaacaaccugcccaccgccaucagcgacuggcuguacgugaagcagaugaacgccagauucaagcacgagaacuacggccugaugccccugaacggcgugcugagaaaggagcccguguucaacgacgagcugcccgccagcauccugugcggcaucgugagcgugaagcccaacgugaaggaguucaccgagaccagcgccaucuucgaggacggcaccaucuucgagggcaucgacugcgugaucuucgccaccggcuacagcuucgccuaccccuuccuggacgagagcaucaucaagagcagaaacaacgagaucauccuguucaagggcguguuccccccccugcuggagaagagcaccaucgccgugaucggcuucgugcagagccugggcgccgccauccccaccguggaccugcagagcagaugggccgcccaggugaucaagggcaccugcacccugcccagcauggaggacaugaugaacgacaucaacgagaagauggagaagaagagaaagugguucggcaagagcgagaccauccagaccgacuacaucguguacauggacgagcugagcagcuucaucggcgccaagcccaacauccccuggcuguuccugaccgaccccaagcuggccauggagguguacuucggccccugcagccccuaccaguucagacuggugggccccggccaguggcccggcgccagaaacgccauccugacccagugggacagaagccugaagcccaugcagaccagaguggugggcagacugcagaagcccugcuucuucuuccacuggcugaagcuguucgccauccccauccugcugaucgccguguuccuggugcugaccuaa

SEQ ID NO: 17167 - RNA, 1677 nt, Artificial Sequence
  FMO4__Homo_sapiens__NP_002013
auggccaagaagguggccgugaucggcgccggcgugagcggccugagcagcaucaagugcugcguggacgaggaccuggagcccaccugcuucgagagaagcgacgacaucggcggccuguggaaguucaccgagagcagcaaggacggcaugaccagaguguacaagagccuggugaccaacgugugcaaggagaugagcugcuacagcgacuuccccuuccacgaggacuaccccaacuucaugaaccacgagaaguucugggacuaccugcaggaguucgccgagcacuucgaccugcugaaguacauccaguucaagaccaccgugugcagcaucaccaagagacccgacuucagcgagaccggccagugggacguggugaccgagaccgagggcaagcagaacagagccguguucgacgccgugauggugugcaccggccacuuccugaacccccaccugccccuggaggccuuccccggcauccacaaguucaagggccagauccugcacagccaggaguacaagauccccgagggcuuccagggcaagagagugcuggugaucggccugggcaacaccggcggcgacaucgccguggagcugagcagaaccgccgcccaggugcugcugagcaccagaaccggcaccugggugcugggcagaagcagcgacuggggcuaccccuacaacaugauggugaccagaagaugcugcagcuucaucgcccaggugcugcccagcagauuccugaacuggauccaggagagaaagcugaacaagagauucaaccacgaggacuacggccugagcaucaccaagggcaagaaggccaaguucaucgugaacgacgagcugcccaacugcauccugugcggcgccaucaccaugaagaccagcgugaucgaguucaccgagaccagcgccguguucgaggacggcaccguggaggagaacaucgacguggugaucuucaccaccggcuacaccuucagcuuccccuucuucgaggagccccugaagagccugugcaccaagaagaucuuccuguacaagcagguguucccccugaaccuggagagagccacccuggccaucaucggccugaucggccugaagggcagcauccugagcggcaccgagcugcaggccagaugggugaccagaguguucaagggccugugcaagaucccccccagccagaagcugaugauggaggccaccgagaaggagcagcugaucaagagaggcguguucaaggacaccagcaaggacaaguucgacuacaucgccuacauggacgacaucgccgccugcaucggcaccaagcccagcaucccccugcuguuccugaaggaccccagacuggccugggagguguucuucggccccugcacccccuaccaguacagacugaugggccccggcaagugggacggcgccagaaacgccauccugacccagugggacagaacccugaagccccugaagaccagaaucgugcccgacagcagcaagcccgccagcaugagccacuaccugaaggccuggggcgcccccgugcugcuggccagccugcugcugaucugcaagagcagccuguuccugaagcuggugagagacaagcugcaggacagaaugagccccuaccuggugagccuguggagaggcuaa

SEQ ID NO: 17168 - RNA, 1131 nt, Artificial Sequence
  FMOD__Homo_sapiens__NP_002014
augcaguggaccagccugcugcugcuggccggccuguucagccugagccaggcccaguacgaggacgacccccacuggugguuccacuaccugagaagccagcagagcaccuacuacgaccccuacgaccccuaccccuacgagaccuacgagcccuaccccuacggcguggacgagggccccgccuacaccuacggcagccccagcccccccgaccccagagacugcccccaggagugcgacugcccccccaacuuccccaccgccauguacugcgacaacagaaaccugaaguaccugcccuucgugcccagcagaaugaaguacguguacuuccagaacaaccagaucaccagcauccaggagggcguguucgacaacgccaccggccugcuguggaucgcccugcacggcaaccagaucaccagcgacaaggugggcagaaagguguucagcaagcugagacaccuggagagacuguaccuggaccacaacaaccugaccagaaugcccggcccccugcccagaagccugagagagcugcaccuggaccacaaccagaucagcagagugcccaacaacgcccuggagggccuggagaaccugaccgcccuguaccugcagcacaacgagauccaggaggugggcagcagcaugagaggccugagaagccugauccugcuggaccugagcuacaaccaccugagaaaggugcccgacggccugcccagcgcccuggagcagcuguacauggagcacaacaacguguacaccgugcccgacagcuacuucagaggcgcccccaagcugcuguacgugagacugagccacaacagccugaccaacaacggccuggccagcaacaccuucaacagcagcagccugcuggagcuggaccugagcuacaaccagcugcagaagaucccccccgugaacaccaaccuggagaaccuguaccugcagggcaacagaaucaacgaguucagcaucagcagcuucugcaccgugguggacguggugaacuucagcaagcugcaggugcugagacuggacggcaacgagaucaagagaagcgccaugcccgccgacgccccccugugccugagacuggccagccugaucgagaucuaa

SEQ ID NO: 17169 - RNA, 1614 nt, Artificial Sequence
  FMR1__Homo_sapiens__NP_001172004
auggaggagcuggugguggaggugagaggcagcaacggcgccuucuacaaggccuucgugaaggacgugcacgaggacagcaucaccguggccuucgagaacaacuggcagcccgacagacagauccccuuccacgacgugagauuccccccccccgugggcuacaacaaggacaucaacgagagcgacgagguggagguguacagcagagccaacgagaaggagcccugcugcugguggcuggccaaggugagaaugaucaagggcgaguucuacgugaucgaguacgccgccugcgacgccaccuacaacgagaucgugaccaucgagagacugagaagcgugaaccccaacaagcccgccaccaaggacaccuuccacaagaucaagcuggacgugcccgaggaccugagacagaugugcgccaaggaggccgcccacaaggacuucaagaaggccgugggcgccuucagcgugaccuacgaccccgagaacuaccagcuggugauccugagcaucaacgaggugaccagcaagagagcccacaugcugaucgacaugcacuucagaagccugagaaccaagcugagccugaucaugagaaacgaggaggccagcaagcagcuggagagcagcagacagcuggccagcagauuccacgagcaguucaucgugagagaggaccugaugggccuggccaucggcacccacggcgccaacauccagcaggccagaaaggugcccggcgugaccgccaucgaccuggacgaggacaccugcaccuuccacaucuacggcgaggaccaggacgccgugaagaaggccagaagcuuccuggaguucgccgaggacgugauccaggugcccagaaaccuggugggcaaggugaucggcaagaacggcaagcugauccaggagaucguggacaagagcggcguggugagagugagaaucgaggccgagaacgagaagaacgugccccaggaggaggagaucaugccccccaacagccugcccagcaacaacagcagagugggccccaacgcccccgaggagaagaagcaccuggacaucaaggagaacagcacccacuucagccagcccaacagcaccaaggugcagagagugcugguggccagcagcgugguggccggcgagagccagaagcccgagcugaaggccuggcagggcauggugcccuucguguucgugggcaccaaggacagcaucgccaacgccaccgugcugcuggacuaccaccugaacuaccugaagcugcagcagagaaagagaggcagagccagcugcgccgaggagaccgacggcggcguggagggcgaggaggaggacaaggaggaggaggacguggaggaggccagcaaggagaccaccaucacccccgagcagaucaucgugcacgugauccaggagagacugaaggaggagcagcagauggaccccuucagaagcgagcugaccgccaucaugaagggcgugagcacccugaagcacuacagaaucccccccgugaagguggugggcugcgccagagugaagaucgugaccagaagaaagagaagccagaccgccuggauggugagcaaccacagcuaa

SEQ ID NO: 17170 - RNA, 7068 nt, Artificial Sequence
  FN1__Homo_sapiens__NP_002017
augcugagaggccccggccccggccugcugcugcuggccgugcagugccugggcaccgccgugcccagcaccggcgccagcaagagcaagagacaggcccagcagauggugcagccccagagccccguggccgugagccagagcaagcccggcugcuacgacaacggcaagcacuaccagaucaaccagcagugggagagaaccuaccugggcaacgcccuggugugcaccugcuacggcggcagcagaggcuucaacugcgagagcaagcccgaggccgaggagaccugcuucgacaaguacaccggcaacaccuacagagugggcgacaccuacgagagacccaaggacagcaugaucugggacugcaccugcaucggcgccggcagaggcagaaucagcugcaccaucgccaacagaugccacgagggcggccagagcuacaagaucggcgacaccuggagaagaccccacgagaccggcggcuacaugcuggagugcgugugccugggcaacggcaagggcgaguggaccugcaagcccaucgccgagaagugcuucgaccacgccgccggcaccagcuacguggugggcgagaccugggagaagcccuaccagggcuggaugaugguggacugcaccugccugggcgagggcagcggcagaaucaccugcaccagcagaaacagaugcaacgaccaggacaccagaaccagcuacagaaucggcgacaccuggagcaagaaggacaacagaggcaaccugcugcagugcaucugcaccggcaacggcagaggcgaguggaagugcgagagacacaccagcgugcagaccaccagcagcggcagcggccccuucaccgacgugagagccgccguguaccagccccagccccacccccagcccccccccuacggccacugcgugaccgacagcggcgugguguacagcgugggcaugcaguggcugaagacccagggcaacaagcagaugcugugcaccugccugggcaacggcgugagcugccaggagaccgccgugacccagaccuacggcggcaacagcaacggcgagcccugcgugcugcccuucaccuacaacggcagaaccuucuacagcugcaccaccgagggcagacaggacggccaccuguggugcagcaccaccagcaacuacgagcaggaccagaaguacagcuucugcaccgaccacaccgugcuggugcagaccagaggcggcaacagcaacggcgcccugugccacuuccccuuccuguacaacaaccacaacuacaccgacugcaccagcgagggcagaagagacaacaugaaguggugcggcaccacccagaacuacgacgccgaccagaaguucggcuucugccccauggccgcccacgaggagaucugcaccaccaacgagggcgugauguacagaaucggcgaccagugggacaagcagcacgacaugggccacaugaugagaugcaccugcgugggcaacggcagaggcgaguggaccugcaucgccuacagccagcugagagaccagugcaucguggacgacaucaccuacaacgugaacgacaccuuccacaagagacacgaggagggccacaugcugaacugcaccugcuucggccagggcagaggcagauggaagugcgaccccguggaccagugccaggacagcgagaccggcaccuucuaccagaucggcgacagcugggagaaguacgugcacggcgugagauaccagugcuacugcuacggcagaggcaucggcgaguggcacugccagccccugcagaccuaccccagcagcagcggccccguggagguguucaucaccgagacccccagccagcccaacagccaccccauccaguggaacgccccccagcccagccacaucagcaaguacauccugagauggagacccaagaacagcgugggcagauggaaggaggccaccauccccggccaccugaacagcuacaccaucaagggccugaagcccggcgugguguacgagggccagcugaucagcauccagcaguacggccaccaggaggugaccagauucgacuucaccaccaccagcaccagcacccccgugaccagcaacaccgugaccggcgagaccacccccuucagcccccugguggccaccagcgagagcgugaccgagaucaccgccagcagcuucguggugagcugggugagcgccagcgacaccgugagcggcuucagaguggaguacgagcugagcgaggagggcgacgagccccaguaccuggaccugcccagcaccgccaccagcgugaacauccccgaccugcugcccggcagaaaguacaucgugaacguguaccagaucagcgaggacggcgagcagagccugauccugagcaccagccagaccaccgcccccgacgccccccccgaccccaccguggaccagguggacgacaccagcaucguggugagauggagcagaccccaggcccccaucaccggcuacagaaucguguacagccccagcguggagggcagcagcaccgagcugaaccugcccgagaccgccaacagcgugacccugagcgaccugcagcccggcgugcaguacaacaucaccaucuacgccguggaggagaaccaggagagcacccccguggugauccagcaggagaccaccggcacccccagaagcgacaccgugcccagccccagagaccugcaguucguggaggugaccgacgugaaggugaccaucauguggaccccccccgagagcgccgugaccggcuacagaguggacgugauccccgugaaccugcccggcgagcacggccagagacugcccaucagcagaaacaccuucgccgaggugaccggccugagccccggcgugaccuacuacuucaagguguucgccgugagccacggcagagagagcaagccccugaccgcccagcagaccaccaagcuggacgcccccaccaaccugcaguucgugaacgagaccgacagcaccgugcuggugagauggaccccccccagagcccagaucaccggcuacagacugaccgugggccugaccagaagaggccagcccagacaguacaacgugggccccagcgugagcaaguacccccugagaaaccugcagcccgccagcgaguacaccgugagccugguggccaucaagggcaaccaggagagccccaaggccaccggcguguucaccacccugcagcccggcagcagcaucccccccuacaacaccgaggugaccgagaccaccaucgugaucaccuggacccccgcccccagaaucggcuucaagcugggcgugagacccagccagggcggcgaggcccccagagaggugaccagcgacagcggcagcaucguggugagcggccugacccccggcguggaguacguguacaccauccaggugcugagagacggccaggagagagacgcccccaucgugaacaagguggugaccccccugagcccccccaccaaccugcaccuggaggccaaccccgacaccggcgugcugaccgugagcugggagagaagcaccacccccgacaucaccggcuacagaaucaccaccacccccaccaacggccagcagggcaacagccuggaggagguggugcacgccgaccagagcagcugcaccuucgacaaccugagccccggccuggaguacaacgugagcguguacaccgugaaggacgacaaggagagcgugcccaucagcgacaccaucauccccgccgugcccccccccaccgaccugagauucaccaacaucggccccgacaccaugagagugaccugggcccccccccccagcaucgaccugaccaacuuccuggugagauacagccccgugaagaacgaggaggacguggccgagcugagcaucagccccagcgacaacgccguggugcugaccaaccugcugcccggcaccgaguacguggugagcgugagcagcguguacgagcagcacgagagcaccccccugagaggcagacagaagaccggccuggacagccccaccggcaucgacuucagcgacaucaccgccaacagcuucaccgugcacuggaucgcccccagagccaccaucaccggcuacagaaucagacaccaccccgagcacuucagcggcagacccagagaggacagagugccccacagcagaaacagcaucacccugaccaaccugacccccggcaccgaguacguggugagcaucguggcccugaacggcagagaggagagcccccugcugaucggccagcagagcaccgugagcgacgugcccagagaccuggaggugguggccgccacccccaccagccugcugaucagcugggacgcccccgccgugaccgugagauacuacagaaucaccuacggcgagaccggcggcaacagccccgugcaggaguucaccgugcccggcagcaagagcaccgccaccaucagcggccugaagcccggcguggacuacaccaucaccguguacgccgugaccggcagaggcgacagccccgccagcagcaagcccaucagcaucaacuacagaaccgagaucgacaagcccagccagaugcaggugaccgacgugcaggacaacagcaucagcgugaaguggcugcccagcagcagccccgugaccggcuacagagugaccaccacccccaagaacggccccggccccaccaagaccaagaccgccggccccgaccagaccgagaugaccaucgagggccugcagcccaccguggaguacguggugagcguguacgcccagaaccccagcggcgagagccagccccuggugcagaccgccgugaccaacaucgacagacccaagggccuggccuucaccgacguggacguggacagcaucaagaucgccugggagagcccccagggccaggugagcagauacagagugaccuacagcagccccgaggacggcauccacgagcuguuccccgcccccgacggcgaggaggacaccgccgagcugcagggccugagacccggcagcgaguacaccgugagcgugguggcccugcacgacgacauggagagccagccccugaucggcacccagagcaccgccauccccgcccccaccgaccugaaguucacccaggugacccccaccagccugagcgcccaguggaccccccccaacgugcagcugaccggcuacagagugagagugacccccaaggagaagaccggccccaugaaggagaucaaccuggcccccgacagcagcagcgugguggugagcggccugaugguggccaccaaguacgaggugagcguguacgcccugaaggacacccugaccagcagacccgcccagggcguggugaccacccuggagaacgugagcccccccagaagagccagagugaccgacgccaccgagaccaccaucaccaucagcuggagaaccaagaccgagaccaucaccggcuuccagguggacgccgugcccgccaacggccagacccccauccagagaaccaucaagcccgacgugagaagcuacaccaucaccggccugcagcccggcaccgacuacaagaucuaccuguacacccugaacgacaacgccagaagcagccccguggugaucgacgccagcaccgccaucgacgcccccagcaaccugagauuccuggccaccacccccaacagccugcuggugagcuggcagccccccagagccagaaucaccggcuacaucaucaaguacgagaagcccggcagcccccccagagagguggugcccagacccagacccggcgugaccgaggccaccaucaccggccuggagcccggcaccgaguacaccaucuacgugaucgcccugaagaacaaccagaagagcgagccccugaucggcagaaagaagaccgacgagcugccccagcuggugacccugccccaccccaaccugcacggccccgagauccuggacgugcccagcaccgugcagaagacccccuucgugacccaccccggcuacgacaccggcaacggcauccagcugcccggcaccagcggccagcagcccagcgugggccagcagaugaucuucgaggagcacggcuucagaagaaccaccccccccaccaccgccacccccaucagacacagacccagacccuacccccccaacgugggccaggaggcccugagccagaccaccaucagcugggcccccuuccaggacaccagcgaguacaucaucagcugccaccccgugggcaccgacgaggagccccugcaguucagagugcccggcaccagcaccagcgccacccugaccggccugaccagaggcgccaccuacaacaucaucguggaggcccugaaggaccagcagagacacaaggugagagaggagguggugaccgugggcaacagcgugaacgagggccugaaccagcccaccgacgacagcugcuucgaccccuacaccgugagccacuacgccgugggcgacgagugggagagaaugagcgagagcggcuucaagcugcugugccagugccugggcuucggcagcggccacuucagaugcgacagcagcagauggugccacgacaacggcgugaacuacaagaucggcgagaagugggacagacagggcgagaacggccagaugaugagcugcaccugccugggcaacggcaagggcgaguucaagugcgacccccacgaggccaccugcuacgacgacggcaagaccuaccacgugggcgagcaguggcagaaggaguaccugggcgccaucugcagcugcaccugcuucggcggccagagaggcuggagaugcgacaacugcagaagacccggcggcgagcccagccccgagggcaccaccggccagagcuacaaccaguacagccagagauaccaccagagaaccaacaccaacgugaacugccccaucgagugcuucaugccccuggacgugcaggccgacagagaggacagcagagaguaa

SEQ ID NO: 17171 - RNA, 930 nt, Artificial Sequence
  FN3K__Homo_sapiens__NP_071441
auggagcagcugcugagagccgagcugagaaccgccacccugagagccuucggcggccccggcgccggcugcaucagcgagggcagagccuacgacaccgacgccggccccguguucgugaaggugaacagaagaacccaggccagacagauguucgagggcgagguggccagccuggaggcccugagaagcaccggccuggugagagugcccagacccaugaaggugaucgaccugcccggcggcggcgccgccuucgugauggagcaccugaagaugaagagccugagcagccaggccagcaagcugggcgagcagauggccgaccugcaccuguacaaccagaagcugagagagaagcugaaggaggaggagaacaccgugggcagaagaggcgagggcgccgagccccaguacguggacaaguucggcuuccacaccgugaccugcugcggcuucaucccccaggugaacgaguggcaggacgacuggcccaccuucuucgccagacacagacugcaggcccagcuggaccugaucgagaaggacuacgccgacagagaggccagagagcuguggagcagacugcaggugaagauccccgaccuguucugcggccuggagaucgugcccgcccugcugcacggcgaccuguggagcggcaacguggccgaggacgacgugggccccaucaucuacgaccccgccagcuucuacggccacagcgaguucgagcuggccaucgcccugauguucggcggcuuccccagaagcuucuucaccgccuaccacagaaagauccccaaggcccccggcuucgaccagagacugcugcuguaccagcuguucaacuaccugaaccacuggaaccacuucggcagagaguacagaagccccagccugggcaccaugagaagacugcugaaguaa

SEQ ID NO: 17172 - RNA, 930 nt, Artificial Sequence
  FN3KRP__Homo_sapiens__NP_078895
auggaggagcugcugagaagagagcugggcugcagcagcgugagagccaccggccacagcggcggcggcugcaucagccagggcagaagcuacgacaccgaccagggcagaguguucgugaaggugaaccccaaggccgaggccagaagaauguucgagggcgagauggccagccugaccgccauccugaagaccaacaccgugaaggugcccaagcccaucaaggugcuggacgcccccggcggcggcagcgugcuggugauggagcacauggacaugagacaccugagcagccacgccgccaagcugggcgcccagcuggccgaccugcaccuggacaacaagaagcugggcgagaugagacugaaggaggccggcaccgugggcagaggcggcggccaggaggagagacccuucguggccagauucggcuucgacguggugaccugcugcggcuaccugccccaggugaacgacuggcaggaggacugggugguguucuacgccagacagagaauccagccccagauggacaugguggagaaggagagcggcgacagagaggcccugcagcuguggagcgcccugcagcugaagauccccgaccuguucagagaccuggagaucauccccgcccugcugcacggcgaccuguggggcggcaacguggccgaggacagcagcggccccgugaucuucgaccccgccagcuucuacggccacagcgaguacgagcuggccaucgccggcauguucggcggcuucagcagcagcuucuacagcgccuaccacggcaagauccccaaggcccccggcuucgagaagagacugcagcuguaccagcuguuccacuaccugaaccacuggaaccacuucggcagcggcuacagaggcagcagccugaacaucaugagaaaccuggugaaguaa

SEQ ID NO: 17173 - RNA, 1854 nt, Artificial Sequence
  FNBP1__Homo_sapiens__NP_055848
augagcuggggcaccgagcugugggaccaguucgacaaccuggagaagcacacccaguggggcaucgacauccuggagaaguacaucaaguucgugaaggagagaaccgagaucgagcugagcuacgccaagcagcugagaaaccugagcaagaaguaccagcccaagaagaacagcaaggaggaggaggaguacaaguacaccagcugcaaggccuucaucagcaaccugaacgagaugaacgacuacgccggccagcacgaggugaucagcgagaacauggccagccagaucaucguggaccuggccagauacgugcaggagcugaagcaggagagaaagagcaacuuccacgacggcagaaaggcccagcagcacaucgagaccugcuggaagcagcuggagagcagcaagagaagauucgagagagacugcaaggaggccgacagagcccagcaguacuucgagaagauggacgccgacaucaacgugaccaaggccgacguggagaaggccagacagcaggcccagaucagacaccagauggccgaggacagcaaggccgacuacagcagcauccugcagaaguucaaccacgagcagcacgaguacuaccacacccacauccccaacaucuuccagaagauccaggagauggaggagagaagaaucgugagaaugggcgagagcaugaagaccuacgccgagguggacagacaggugauccccaucaucggcaagugccuggacggcaucgugaaggccgccgagagcaucgaccagaagaacgacagccagcuggugaucgaggccuacaagagcggcuucgagccccccggcgacaucgaguucgaggacuacacccagcccaugaagagaaccgugagcgacaacagccugagcaacagcagaggcgagggcaagcccgaccugaaguucggcggcaagagcaagggcaagcuguggcccuucaucaagaagaacaagcugaugagccugcugaccagcccccaccagccccccccccccccccccgccagcgccagccccagcgccgugcccaacggcccccagagccccaagcagcagaaggagccccugagccacagauucaacgaguucaugaccagcaagcccaagauccacugcuucagaagccugaagagaggccugagccugaagcugggcgccacccccgaggacuucagcaaccugccccccgagcagagaagaaagaagcugcagcagaagguggacgagcugaacaaggagauccagaaggagauggaccagagagacgccaucaccaagaugaaggacguguaccugaagaacccccagaugggcgaccccgccagccuggaccacaagcuggccgaggugagccagaacaucgagaagcugagaguggagacccagaaguucgaggccuggcuggccgagguggagggcagacugcccgccagaagcgagcaggccagaagacagagcggccuguacgacagccagaacccccccaccgugaacaacugcgcccaggacagagagagccccgacggcagcuacaccgaggagcagagccaggagagcgagaugaaggugcuggccaccgacuucgacgacgaguucgacgacgaggagccccugcccgccaucggcaccugcaaggcccuguacaccuucgagggccagaacgagggcaccaucagcgugguggagggcgagacccuguacgugaucgaggaggacaagggcgacggcuggaccagaaucagaagaaacgaggacgaggagggcuacgugcccaccagcuacguggaggugugccuggacaagaacgccaaggacagcuaa

SEQ ID NO: 17174 - RNA, 5685 nt, Artificial Sequence
  FNDC1__Homo_sapiens__NP_115921
auggcccccgaggccggcgccacccugagagcccccagaagacugagcugggccgcccugcugcugcuggccgcccugcugcccguggccagcagcgccgccgccagcguggaccacccccugaagcccagacacgugaagcugcugagcaccaagaugggccugaaggugaccugggacccccccaaggacgccaccagcagacccguggagcacuacaacaucgccuacggcaagagccugaagagccugaaguacaucaaggugaacgccgagaccuacagcuuccugaucgaggacguggagcccggcgugguguacuucgugcugcugaccgccgagaaccacagcggcgugagcagacccguguacagagccgagagcccccccggcggcgaguggaucgagaucgacggcuuccccaucaagggccccggccccuucaacgagaccgugaccgagaaggaggugcccaacaagccccugagagugagagugagaagcagcgacgacagacugagcguggccuggaaggcccccagacugagcggcgccaagagccccagaagaagcagaggcuuccugcugggcuacggcgagagcggcagaaagaugaacuacgugccccugaccagagacgagagaacccacgagaucaagaagcuggccagcgagagcguguacguggugagccugcagagcaugaacagccagggcagaagccagcccguguacagagccgcccugaccaagagaaagaucagcgaggaggacgagcuggacgugcccgacgacaucagcgugagagugaugagcagccagagcgugcuggugagcuggguggaccccgugcuggagaagcagaagaaggugguggccagcagacaguacaccgugagauacagagagaagggcgagcuggccagaugggacuacaagcagaucgccaacagaagagugcugaucgagaaccugauccccgacaccguguacgaguucgccgugagaaucagccagggcgagagagacggcaaguggagcaccagcguguuccagagaacccccgagagcgcccccaccaccgcccccgagaaccugaacguguggcccgugaacggcaagcccaccgugguggccgccagcugggacgcccugcccgagaccgagggcaaggugaaggaguacauccugagcuacgcccccgcccugaagcccuucggcgccaagagccugaccuaccccggcgacaccaccagcgcccugguggacggccugcagcccggcgagagauaccuguucaagaucagagccaccaacagaagaggccugggcccccacagcaaggccuucaucguggccaugcccaccaccagcaaggccgacguggagcagaacaccgaggacaacggcaagcccgagaagcccgagcccagcagccccagccccagagcccccgccagcagccagcaccccagcgugcccgccagcccccagggcagaaacgccaaggaccugcugcuggaccugaagaacaagauccuggccaacggcggcgcccccagaaagccccagcugagagccaagaaggccgaggagcuggaccugcagagcaccgagaucaccggcgaggaggagcugggcagcagagaggacagccccaugagccccagcgacacccaggaccagaagagaacccugagaccccccagcagacacggccacagcgugguggcccccggcagaaccgccgugagagccagaaugcccgcccugcccagaagagagggcguggacaagcccggcuucagccuggccacccagcccagacccggcgccccccccagcgccagcgccagccccgcccaccacgccagcacccagggcaccagccacagacccagccugcccgccagccugaacgacaacgaccugguggacagcgacgaggacgagagagccgugggcagccugcaccccaagggcgccuucgcccagcccagacccgcccugagccccagcagacagagccccagcagcgugcugagagacagaagcagcgugcaccccggcgccaagcccgccagccccgccagaagaaccccccacagcggcgccgccgaggaggacagcagcgccagcgccccccccagcagacugagccccccccacggcggcagcagcagacugcugcccacccagccccaccugagcagcccccugagcaagggcggcaaggacggcgaggacgcccccgccaccaacagcaacgcccccagcagaagcaccaugagcagcagcgugagcagccaccugagcagcagaacccaggugagcgagggcgccgaggccagcgacggcgagagccacggcgacggcgacagagaggacggcggcagacaggccgaggccaccgcccagacccugagagccagacccgccagcggccacuuccaccugcugagacacaagcccuucgccgccaacggcagaagccccagcagauucagcaucggcagaggccccagacugcagcccagcagcagcccccagagcaccgugcccagcagagcccaccccagagugcccagccacagcgacagccaccccaagcugagcagcggcauccacggcgacgaggaggacgagaagccccugcccgccaccguggugaacgaccacgugcccagcagcagcagacagcccaucagcagaggcugggaggaccugagaagaagcccccagagaggcgccagccugcacagaaaggagcccauccccgagaaccccaagagcaccggcgccgacacccacccccagggcaaguacagcagccuggccagcaaggcccaggacgugcagcagagcaccgacgccgacaccgagggccacagccccaaggcccagcccggcagcaccgacagacacgccagccccgccagaccccccgccgccagaagccagcagcaccccagcgugcccagaagaaugacccccggcagagccccccagcagcagccccccccccccguggccaccagccagcaccaccccggcccccagagcagagacgccggcagaagccccagccagcccagacugagccugacccaggccggcagacccagacccaccagccagggcagaagccacagcagcagcgaccccuacaccgccagcagcagaggcaugcugcccaccgcccugcagaaccaggacgaggacgcccagggcagcuacgacgacgacagcaccgagguggaggcccaggacgugagagcccccgcccacgccgccagagccaaggaggccgccgccagccugcccaagcaccagcagguggagagccccaccggcgccggcgccggcggcgaccacagaagccagagaggccacgccgccagccccgccagacccagcagacccggcggcccccagagcagagccagagugcccagcagagccgcccccggcaagagcgagccccccagcaagagaccccugagcagcaagagccagcagagcgugagcgccgaggacgacgaggaggaggacgccggcuucuucaagggcggcaaggaggaccugcugagcagcagcgugcccaaguggcccagcagcagcacccccagaggcggcaaggacgccgacggcagccuggccaaggaggagagagagcccgccaucgcccuggcccccagaggcggcagccuggcccccgugaagagaccccugccccccccccccggcagcagccccagagccagccacgugcccagcagacugccccccagaagcgccgccaccgugagccccguggccggcacccaccccuggccccaguacaccaccagagccccccccggccacuucagcaccacccccaugcugagccugagacagagaaugaugcacgccagauucagaaacccccugagcagacagcccgccagacccagcuacagacagggcuacaacggcagacccaacguggagggcaaggugcugcccggcagcaacggcaagcccaacggccagagaaucaucaacggcccccagggcaccaagugggugguggaccuggacagaggccuggugcugaacgccgagggcagauaccugcaggacagccacggcaacccccugagaaucaagcugggcggcgacggcagaaccaucguggaccuggagggcacccccguggugagccccgacggccugccccuguucggccagggcagacacggcaccccccuggccaacgcccaggacaagcccauccugagccugggcggcaagccccuggugggccuggaggugaucaagaagaccacccacccccccaccaccaccaugcagcccaccaccaccaccaccccccugcccaccaccaccacccccagacccaccaccgccaccaccagaagaaccaccaccaccagaagaaccaccaccagaagacccaccaccaccgugagaaccaccaccagaaccaccaccaccaccacccccacccccaccacccccauccccaccugcccccccggcacccuggagagacacgacgacgacggcaaccugaucaugagcagcaacggcauccccgagugcuacgccgaggaggacgaguucagcggccuggagaccgacaccgccgugcccaccgaggaggccuacgugaucuacgacgaggacuacgaguucgagaccagcagaccccccaccaccaccgagcccagcaccaccgccaccacccccagagugauccccgaggagggcgccaucagcagcuuccccgaggaggaguucgaccuggccggcagaaagagauucguggcccccuacgugaccuaccugaacaaggaccccagcgcccccugcagccugaccgacgcccuggaccacuuccagguggacagccuggacgagaucauccccaacgaccugaagaagagcgaccugcccccccagcacgcccccagaaacaucaccgugguggccguggagggcugccacagcuucgugaucguggacugggacaaggccacccccggcgacguggugaccggcuaccugguguacagcgccagcuacgaggacuucaucagaaacaaguggagcacccaggccagcagcgugacccaccugcccaucgagaaccugaagcccaacaccagauacuacuucaaggugcaggcccagaacccccacggcuacggccccaucagccccagcgugagcuucgugaccgagagcgacaacccccugcugguggugagaccccccggcggcgagcccaucuggauccccuucgccuucaagcacgaccccagcuacaccgacugccacggcagacaguacgugaagagaaccugguacagaaaguucgugggcguggugcugugcaacagccugagauacaagaucuaccugagcgacaaccugaaggacaccuucuacagcaucggcgacagcuggggcagaggcgaggaccacugccaguucguggacagccaccuggacggcagaaccggcccccagagcuacguggaggcccugcccaccauccagggcuacuacagacaguacagacaggagcccgugagauucggcaacaucggcuucggcacccccuacuacuacgugggcugguacgagugcggcgugagcauccccggcaagugguaa

SEQ ID NO: 17175 - RNA, 3597 nt, Artificial Sequence
  FNDC3A__Homo_sapiens__NP_001073141
auggccgagcaccccccccugcuggacaccacccagauccugagcagcgacaucagccugcugagcgcccccaucgugagcgccgacggcacccagcaggugauccuggugcaggugaaccccggcgaggccuucaccaucagaagagaggacggccaguuccagugcaucaccggccccgcccaggugcccaugaugagccccaacggcagcgugccccccaucuacgugccccccggcuacgccccccaggugaucgaggacaacggcgugagaagaguggugguggugccccaggcccccgaguuccaccccggcagccacaccgugcugcacagaagcccccaccccccccugcccggcuucauccccgugcccaccaugaugccccccccccccagacacauguacagccccgugaccggcgccggcgacaugaccacccaguacaugccccaguaccagagcagccagguguacggcgacguggacgcccacagcacccacggcagaagcaacuucagagacgagagaagcagcaagaccuacgagagacugcagaagaagcugaaggacagacagggcacccagaaggacaagaugagcagcccccccagcagcccccagaagugccccagccccaucaacgagcacaacggccugaucaagggccagaucgccggcggcaucaacaccggcagcgccaagaucaagagcggcaagggcaagggcggcacccagguggacaccgagaucgaggagaaggacgaggagaccaaggccuucgaggcccugcugagcaacaucgugaagcccguggccagcgacauccaggccagaaccguggugcugaccuggagcccccccagcagccugaucaacggcgagaccgacgagagcagcgugcccgagcuguacggcuacgaggugcugaucagcagcaccggcaaggacggcaaguacaagagcguguacgugggcgaggagaccaacaucacccugaacgaccugaagcccgccauggacuaccacgccaaggugcaggccgaguacaacagcaucaagggcacccccagcgaggccgagaucuucaccacccugagcugcgagcccgacauccccaacccccccagaaucgccaacagaaccaagaacagccugacccugcaguggaaggcccccagcgacaacggcagcaagauccagaacuucgugcuggagugggacgagggcaagggcaacggcgaguucugccagugcuacaugggcagccagaagcaguucaagaucaccaagcugagccccgccaugggcugcaaguucagacugagcgccagaaacgacuacggcaccagcggcuucagcgaggaggugcuguacuacaccagcggcugcgcccccagcaugcccgccagccccgugcugaccaaggccggcaucaccuggcugagccugcaguggagcaagcccagcggcacccccagcgacgagggcaucagcuacauccuggagauggaggaggagaccagcggcuacggcuucaagcccaaguacgacggcgaggaccuggccuacaccgugaagaaccugagaagaagcaccaaguacaaguucaaggugaucgccuacaacagcgagggcaagagcaaccccagcgaggugguggaguucaccaccugccccgacaagcccggcauccccgugaagcccagcgugaagggcaagauccacagccacagcuucaagaucaccugggacccccccaaggacaacggcggcgccaccaucaacaaguacgugguggagauggccgagggcagcaacggcaacaagugggagaugaucuacagcggcgccaccagagagcaccugugcgacagacugaaccccggcugcuucuacagacugagaguguacugcaucagcgacggcggccagagcgccgugagcgagagccugcuggugcagacccccgccgugccccccggccccugccugccccccagacugcagggcagacccaaggccaaggagauccagcugagauggggccccccccugguggacggcggcagccccaucagcugcuacagcguggagaugagccccaucgagaaggacgagcccagagagguguaccagggcagcgagguggagugcaccgugagcagccugcugcccggcaagaccuacagcuucagacugagagccgccaacaagaugggcuucggccccuucagcgagaagugcgacaucaccaccgcccccggcccccccgaccagugcaagcccccccaggugaccugcagaagcgccaccugcgcccaggugaacugggaggugccccugagcaacggcaccgacgugaccgaguacagacuggaguggggcggcguggagggcagcaugcagaucugcuacugcggccccggccugagcuacgagaucaagggccugagccccgccaccaccuacuacugcagagugcaggcccugagcguggugggcgccggccccuucagcgaggugguggccugcgugaccccccccagcgugcccggcaucgugaccugccugcaggagaucagcgacgacgagaucgagaacccccacuacagccccagcaccugccuggccaucagcugggagaagcccugcgaccacggcagcgagauccuggccuacagcaucgacuucggcgacaagcagagccugaccgugggcaaggugaccagcuacaucaucaacaaccugcagcccgacaccaccuacagaaucagaauccaggcccugaacagccugggcgccggccccuucagccacaugaucaagcugaagaccaagccccugccccccgacccccccagacuggagugcguggccuucagccaccagaaccugaagcugaaguggggcgagggcacccccaagacccugagcaccgacagcauccaguaccaccugcagauggaggacaagaacggcagauucgugagccuguacagaggccccugccacaccuacaaggugcagagacugaacgagagcaccagcuacaaguucugcauccaggccugcaacgaggccggcgagggcccccugagccaggaguacaucuucaccacccccaagagcgugcccgccgcccugaaggcccccaagaucgagaaggugaacgaccacaucugcgagaucaccugggagugccugcagcccaugaagggcgaccccgugaucuacagccugcaggugaugcugggcaaggacagcgaguucaagcagaucuacaagggccccgacagcagcuucagauacagcagccugcagcugaacugcgaguacagauucagagugugcgccaucagacagugccaggacagccugggccaccaggaccuggugggccccuacagcaccaccgugcuguucaucagccagagaaccgagccccccgccagcaccaacagagacaccguggagagcaccagaaccagaagagcccugagcgacgagcagugcgccgccgugauccuggugcuguucgccuucuucagcauccugaucgccuucaucauccaguacuucgugaucaaguaa

SEQ ID NO: 17176 - RNA, 3615 nt, Artificial Sequence
  FNDC3B__Homo_sapiens__NP_001128567
auguacgugaccaugaugaugaccgaccagaucccccuggagcugcccccccugcugaacggcgagguggccaugaugccccaccuggugaacggcgacgccgcccagcaggugauccuggugcaggugaaccccggcgagaccuucaccaucagagccgaggacggcacccugcagugcauccagggccccgccgaggugcccaugaugagccccaacggcagcaucccccccauccacgugccccccggcuacaucagccaggugaucgaggacagcaccggcgugagaagagugguggugaccccccagagccccgagugcuacccccccagcuaccccagcgccaugagccccacccaccaccugccccccuaccugacccaccacccccacuucauccacaacagccacaccgccuacuacccccccgugaccggccccggcgacaugcccccccaguucuucccccagcaccaccugccccacaccaucuacggcgagcaggagaucauccccuucuacggcaugagcaccuacaucaccagagaggaccaguacagcaagcccccccacaagaagcugaaggacagacagaucgacagacagaacagacugaacagcccccccagcagcaucuacaagagcagcugcaccaccguguacaacggcuacggcaagggccacagcggcggcagcggcggcggcggcagcggcagcggccccggcaucaagaagaccgagagaagagccagaagcagccccaagagcaacgacagcgaccugcaggaguacgagcuggaggugaagagagugcaggacauccugagcggcaucgagaagccccaggugagcaacauccaggccagagccguggugcugagcugggccccccccgugggccugagcugcggcccccacagcggccugagcuuccccuacagcuacgagguggcccugagcgacaagggcagagacggcaaguacaagaucaucuacagcggcgaggagcuggagugcaaccugaaggaccugagacccgccaccgacuaccacgugagaguguacgccauguacaacagcgugaagggcagcugcagcgagcccgugagcuucaccacccacagcugcgcccccgagugccccuucccccccaagcuggcccacagaagcaagagcagccugacccugcaguggaaggcccccaucgacaacggcagcaagaucaccaacuaccugcuggagugggacgagggcaagagaaacagcggcuucagacagugcuucuucggcagccagaagcacugcaagcugaccaagcugugccccgccaugggcuacaccuucagacuggccgccagaaacgacaucggcaccagcggcuacagccaggagguggugugcuacacccugggcaacaucccccagaugcccagcgcccccagacuggugagagccggcaucaccugggugacccugcaguggagcaagcccgagggcugcagccccgaggaggugaucaccuacacccuggagauccaggaggacgagaacgacaaccuguuccaccccaaguacaccggcgaggaccugaccugcaccgugaagaaccugaagagaagcacccaguacaaguucagacugaccgccagcaacaccgagggcaagagcugccccagcgaggugcuggugugcaccaccagccccgacagacccggcccccccaccagaccccuggugaagggccccgugaccagccacggcuucagcgugaagugggacccccccaaggacaacggcggcagcgagauccugaaguaccugcuggagaucaccgacggcaacagcgaggccaaccagugggagguggccuacagcggcagcgccaccgaguacaccuucacccaccugaagcccggcacccuguacaagcugagagccugcugcaucagcaccggcggccacagccagugcagcgagagccugcccgugagaacccugagcaucgcccccggccagugcagaccccccagagugcugggcagacccaagcacaaggaggugcaccuggagugggacgugcccgccagcgagagcggcugcgaggugagcgaguacagcguggagaugaccgagcccgaggacguggccagcgagguguaccacggccccgagcuggagugcaccgugggcaaccugcugcccggcaccguguacagauucagagugagagcccugaacgacggcggcuacggccccuacagcgacgugagcgagaucaccaccgccgccggcccccccggccagugcaaggcccccugcaucagcugcacccccgacggcugcgugcuggugggcugggagagccccgacagcagcggcgccgacaucagcgaguacagacuggaguggggcgaggacgaggagagccuggagcugaucuaccacggcaccgacaccagauucgagaucagagaccugcugcccgccgcccaguacugcugcagacugcaggccuucaaccaggccggcgccggccccuacagcgagcuggugcugugccagacccccgccagcgcccccgaccccgugagcacccugugcgugcuggaggaggagccccuggacgccuaccccgacagccccagcgccugccuggugcugaacugggaggagcccugcaacaacggcagcgagauccuggccuacaccaucgaccugggcgacaccagcaucaccgugggcaacaccaccaugcacgugaugaaggaccugcugcccgagaccaccuacagaaucagaauccaggccaucaacgagaucggcgccggccccuucagccaguucaucaaggccaagaccagaccccugcccccccugccccccagacuggagugcgccgccgccggcccccagagccugaagcugaaguggggcgacagcaacagcaagacccacgccgccgaggacaucguguacacccugcagcuggaggacagaaacaagagauucaucagcaucuacagaggccccagccacaccuacaaggugcagagacugaccgaguucaccugcuacagcuucagaauccaggccgccagcgaggccggcgagggccccuucagcgagaccuacaccuucagcaccaccaagagcgugccccccaccaucaaggcccccagagugacccagcuggagggcaacagcugcgagauccugugggagaccgugcccagcaugaagggcgaccccgugaacuacauccugcaggugcuggugggcagagagagcgaguacaagcagguguacaagggcgaggaggccaccuuccagaucagcggccugcagaccaacaccgacuacagauucagagugugcgccugcagaagaugccuggacaccagccaggagcugagcggcgccuucagccccagcgccgccuucgugcugcagagaagcgaggugaugcugaccggcgacaugggcagccuggacgaccccaagaugaagagcaugaugcccaccgacgagcaguucgccgccaucaucgugcugggcuucgccacccugagcauccuguucgccuucauccugcaguacuuccugaugaaguaa

SEQ ID NO: 17177 - RNA, 705 nt, Artificial Sequence
  FNDC4__Homo_sapiens__NP_073734
augcccagcggcugccacagcagcccccccagcggccugagaggcgacauggccagccuggugccccugagccccuaccugagccccaccgugcugcugcuggugagcugcgaccugggcuucgugagagccgacagaccccccagccccgugaacgugaccgugacccaccugagagccaacagcgccaccgugagcugggacgugcccgagggcaacaucgugaucggcuacagcaucagccagcagagacagaacggccccggccagagagugaucagagaggugaacaccaccaccagagccugcgcccuguggggccuggccgaggacagcgacuacaccgugcaggugagaagcaucggccugagaggcgagagcccccccggccccagagugcacuucagaacccugaagggcagcgacagacugcccagcaacagcagcagccccggcgacaucaccguggagggccuggacggcgagagaccccugcagaccggcgagguggugaucaucgugguggugcugcugaugugggccgccgugaucggccuguucugcagacaguacgacaucaucaaggacaacgacagcaacaacaaccccaaggagaagggcaagggccccgagcagagcccccagggcagacccgugggcaccagacagaagaagagccccagcaucaacaccaucgacguguaa

SEQ ID NO: 17178 - RNA, 1140 nt, Artificial Sequence
  FNTA__Homo_sapiens__NP_002018
auggccgccaccgagggcgugggcgaggccgcccagggcggcgagcccggccagcccgcccagccccccccccagccccaccccccccccccccagcagcagcacaaggaggagauggccgccgaggccggcgaggccguggccagccccauggacgacggcuucgugagccuggacagccccagcuacgugcuguacagagacagagccgagugggccgacaucgaccccgugccccagaacgacggccccaaccccguggugcagaucaucuacagcgacaaguucagagacguguacgacuacuucagagccgugcugcagagagacgagagaagcgagagagccuucaagcugaccagagacgccaucgagcugaacgccgccaacuacaccguguggcacuucagaagagugcugcugaagagccugcagaaggaccugcacgaggagaugaacuacaucaccgccaucaucgaggagcagcccaagaacuaccagguguggcaccacagaagagugcugguggaguggcugagagaccccagccaggagcuggaguucaucgccgacauccugaaccaggacgccaagaacuaccacgccuggcagcacagacagugggugauccaggaguucaagcugugggacaacgagcugcaguacguggaccagcugcugaaggaggacgugagaaacaacagcguguggaaccagagauacuucgugaucagcaacaccaccggcuacaacgacagagccgugcuggagagagaggugcaguacacccuggagaugaucaagcuggugccccacaacgagagcgccuggaacuaccugaagggcauccugcaggacagaggccugagcaaguaccccaaccugcugaaccagcugcuggaccugcagcccagccacagcagccccuaccugaucgccuuccugguggacaucuacgaggacaugcuggagaaccagugcgacaacaaggaggacauccugaacaaggcccuggagcugugcgagauccuggccaaggagaaggacaccaucagaaaggaguacuggagauacaucggcagaagccugcagagcaagcacagcaccgagaacgacagccccaccaacgugcagcaguaa

SEQ ID NO: 17179 - RNA, 1314 nt, Artificial Sequence
  FNTB__Homo_sapiens__NP_002019
auggccagccccagcagcuucaccuacuacugcccccccagcagcagccccguguggagcgagccccuguacagccugagacccgagcacgccagagagagacugcaggacgacagcguggagaccgugaccagcaucgagcaggccaagguggaggagaagauccaggagguguucagcagcuacaaguucaaccaccuggugcccagacuggugcugcagagagagaagcacuuccacuaccugaagagaggccugagacagcugaccgacgccuacgagugccuggacgccagcagacccuggcugugcuacuggauccugcacagccuggagcugcuggacgagcccaucccccagaucguggccaccgacgugugccaguuccuggagcugugccagagccccgagggcggcuucggcggcggccccggccaguacccccaccuggcccccaccuacgccgccgugaacgcccugugcaucaucggcaccgaggaggccuacgacaucaucaacagagagaagcugcugcaguaccuguacagccugaagcagcccgacggcagcuuccugaugcacgugggcggcgagguggacgugagaagcgccuacugcgccgccagcguggccagccugaccaacaucaucacccccgaccuguucgagggcaccgccgaguggaucgccagaugccagaacugggagggcggcaucggcggcgugcccggcauggaggcccacggcggcuacaccuucugcggccuggccgcccuggugauccugaagagagagagaagccugaaccugaagagccugcugcagugggugaccagcagacagaugagauucgagggcggcuuccagggcagaugcaacaagcugguggacggcugcuacagcuucuggcaggccggccugcugccccugcugcacagagcccugcacgcccagggcgaccccgcccugagcaugagccacuggauguuccaccagcaggcccugcaggaguacauccugaugugcugccagugccccgccggcggccugcuggacaagcccggcaagagcagagacuucuaccacaccugcuacugccugagcggccugagcaucgcccagcacuucggcagcggcgccaugcugcacgacguggugcugggcgugcccgagaacgcccugcagcccacccaccccguguacaacaucggccccgacaaggugauccaggccaccaccuacuuccugcagaagcccgugcccggcuucgaggagcugaaggacgagaccagcgccgagcccgccaccgacuaa

SEQ ID NO: 17180 - RNA, 5406 nt, Artificial Sequence
  FOCAD__Homo_sapiens__NP_060264
augagcgacgacaucagaaagagauucgaguuccccaacagccugauccagagccaggccgugggccaccugaucgccgccgugcugaaggagaacggcuucagcgagaagauccaccagagcaccaaccagacccccgcccugaaccugcugugggagaagugcugcagcgacaacgugguggugagaaccgccugcugcgagggccugguggcccugguggcccaggaccacgccgaguucagcuacgugcugaacggcauccugaaccugauccccagcaccagaaacacccacggccugaucaaggccaucaugcaccugcugcagaugcaggcccugaaggagggccagggcggcgagaagaacauccagagcaucuacaccaucagaaaccacccccacccccugaucaccgugcuggagcacagacccgacugcuggcccguguuccugcagcagcugaccgccuucuuccagcagugccccgagagacuggaggugagcugcauccagaucauggcccccuuccugugguaccuguacugcgagcccagccagcugcaggaguacgccaagcugagacuggcccugcugaaggugcugcugcagccccaggugcugugcgacaaggaccagcccagcauccuggagcagcagauccugcagcugugcugcgacaucgugcccugccugcaggugaaggaccugauccagaccaccgaggccaugauguucaucgaggaggugugccugagccugcugagacaccccguguucuggaagauccagcugacccagaugagccugcagcugcugugcgugagcgaggugagccugaagaucaccggcgagugcagcagcagcauccaccugcuggagcacagcguggagcugcugaaggaggacuuccccguggagcuggugaucaucggcaucgcccugcugcugcugcagacccccgccagccagcagaagcccauccugaaccuggcccugaagcugcugagcgugaccgaggaccagaagauccccaagagcagccugcugcuggugaugcccauccugcagauccugagcagcaccgcccuggaggacugcaucagcguggacgaggagggccccagcagacagcagcuggcccugaaccugcuggagaugauccagcaggagugcuacagagacgaccaccagaagcugagcuacaagcuggugugccccgugaccagcauguacggcaccaucuucaccgccuggagaauccuggaggugaugaccgacagcagcgccgccagcgacuggcuggccagcguggagagccugcugcccaucaccgccgugauccccgcccccgccuuccugcugcuggcccaccugcugguggaggacaagggccagaaccugcaccagauccugaaggugaccaccgagcuggcccaggccgacagcagccaggugcccaaccugauccccgugcugauguucaagcugggcagaccccuggagcccauccuguacaacgacauccuguacacccugcccaagcugggcgugcacaaggugugcaucggccagauccugagaaucauccagcugcugggcaccacccccagacugagagccgugacccugagacugcugaccagccugugggagaagcaggacagaguguaccccgagcugcagagauucauggccgugagcgacgugcccagccugagcgugggcaaggaggugcagugggagaagcugaucgccaaggccgccagcaucagagacaucugcaagcagagacccuaccagcacggcgccgacaugcuggccgccaucagccaggugcugaacgagugcaccaagcccgaccaggccacccccgccgcccuggugcugcagggccugcacgcccugugccaggccgagguggugugcaucagaagcaccuggaacgcccugagccccaagcugagcugcgacaccagaccccugauccugaagacccugagcgagcuguucagccuggugcccagccugaccgugaacaccaccgaguacgagaacuucaaggugcaggugcugagcuuccuguggacccacacccagaacaaggaccccaucguggccaacgccgccuacagaagccuggccaacuucagcgccggcgagcacaccauccugcaccugcccgagaagaucagacccgagauccccauccccgaggagcuggacgacgacgaggacguggaggacguggaccugagcgugcccggcagcugcuaccugaagcugcugagccugacccccccccuggugcugcccgcccuggaggaguucuucaccagccuggugaagcaggagauggugaacaugcccagaggcaucuaccacagcgcccugaagggcggcgccagaagcgaccagggcaagaccguggccggcauccccaacuucauccugaagauguacgagaccaacaagcagcccggccugaagcccggccuggccggcggcaugcuguucugcuacgacgugagcauguaccagagcaaggacggcaagccccugaacagacugauggccagcagaggcagaagcuucaagcagaccagccuggcccuggugcacgaggugcacauccagcugagcgaguggcacagagccaucuuccugccccaggccuggcuggccuacaugaacagagccuaccacgccauccugcagggcagacugggcgagcuggagcugcagcugaagcacggcaaggaggagcccgaggaggugcaguacaagaagagcaccgccuggcugugggugagagacaugcugaccgacgagaucaccaaggccgccgccaaggagagccccguggugaagggcaacgcccugcuggcccugagcagccuggccgugguggugagcagacacgaggccagccugagcagcgacagcgacggccugcuggaggugcagcccaacuuccugagcaugaaggagugggugagcauggugcuggacacccugcuggugaucguggacagccacuaccagcccagaggccagcugcugagcugguucuacuacaagagcuacagcggcgagaacaccgccagcgccaucgccagaagcgccgccgccaccgcccugagccugcuggugcccguguucaucaucagcugcaaggagaagguggaggagauccugaacaugcugaccgccagacugcccggcaagcccagcgccgacgagagccaggccgugcagauccacaugggccuggcccugggcauguuccugagcagacugugcgaggagaagcugagcgacaucagcggccaggagaugaaccugcugcugaugaagagccuggacgcccuggagaacugcugcuucgacaccagccuggaguacaacaccggcugcauccugggcgugggccuggugcugagccugaugagccacagcagccagaugcagagcagagugcacguggccgcccugcugagaaagcugagcgcccacguggacgacagcggcagccagagcagaaccuuccaggaggugcuggccuacacccugagcugcgugugcaccagcgccuucagcgccggcaucaucgaggccaccgaggccgaggacgugaugaacaagcugagacugcugguggagaacagccagcagaccagcggcuucgcccuggcccugggcaacaucgugcacggccugagcgugugcggccacggcaaggccgaggaccugggcagcaagcugcugcccgccuggaucagaaucgugcugaccgagggcacccccaccaugcugugccuggccgcccugcacggcaugguggcccuggugggcagcgagggcgacgugaugcagcugaagagcgaggccauccagaccagccacuuccagggcagacugaacgaggugaucagaacccugacccaggugaucagcgugagcggcgugaucggccugcagagcaacgccguguggcugcugggccaccugcaccugagcacccugagcagcagccagagcagagccagcgugcccaccgacuacagcuaccugcccgagagcagcuucaucggcgccgccaucggcuucuucaucaccggcggcaagaagggccccgagagcgugccccccagccugcugaagguggugaugaagcccaucgccaccgugggcgagagcuaccaguacccccccgugaacugggccgcccugcugagcccccugaugagacugaacuucggcgaggagauccagcagcugugccuggagaucauggugacccaggcccagagcagccagaacgccgccgcccugcugggccugugggugacccccccccugauccacagccugagccugaacaccaagagauaccugcugaucagcgccccccuguggaucaagcacaucagcgacgagcagauccugggcuucguggagaaccugaugguggccguguucaaggccgccagcccccugggcagccccgagcugugccccagcgcccugcacggccugagccaggccaugaagcugcccagccccgcccaccaccuguggagccugcugagcgaggccaccggcaagaucuucgaccugcugcccaacaagaucagaagaaaggaccuggagcuguacaucagcaucgccaagugccugcuggagaugaccgacgacgacgccaacagaaucgcccaggugaccaagagcaacaucgagaaggccgccuucgugaagcuguaccuggugagccagggcagauucccccuggugaaccugaccgacaugcugagcguggccgugcagcacagagagaaggaggugcuggccuggaugauccugcacagccuguaccaggccagaaucgugagccacgccaacaccggcgugcugaagagaauggaguggcugcuggagcugaugggcuacaucagaaacguggccuaccagagcaccagcuuccacaacaccgcccuggacaaggcccuggacuucuuccugcugaucuucgccaccgccgugguggccugggccgaccacaccgccccccugcugcugggccugagcgccagcuggcugcccuggcaccaggagaacggccccgccggccccgugcccagcuuccugggcagaagccccaugcacagagugacccugcaggaggugcugacccugcugcccaacagcauggcccugcugcugcagaaggagcccuggaaggagcagacccagaaguucaucgacuggcuguucagcaucauggagagccccaaggaggcccugagcgcccagagcagagaccugcugaaggccacccugcugagccugagagugcugcccgaguucaagaagaaggccguguggaccagagccuacggcugguaa

SEQ ID NO: 17181 - RNA, 2160 nt, Artificial Sequence
  FOLH1__Homo_sapiens__NP_001014986
auguggaaccugcugcacgagaccgacagcgccguggccaccgccagaagacccagauggcugugcgccggcgcccuggugcuggccggcggcuucuuccugcugggcuuccuguucggcugguucaucaagagcagcaacgaggccaccaacaucacccccaagcacaacaugaaggccuuccuggacgagcugaaggccgagaacaucaagaaguuccuguacaacuucacccagaucccccaccuggccggcaccgagcagaacuuccagcuggccaagcagauccagagccaguggaaggaguucggccuggacagcguggagcuggcccacuacgacgugcugcugagcuaccccaacaagacccaccccaacuacaucagcaucaucaacgaggacggcaacgagaucuucaacaccagccuguucgagccccccccccccggcuacgagaacgugagcgacaucgugccccccuucagcgccuucagcccccagggcaugcccgagggcgaccugguguacgugaacuacgccagaaccgaggacuucuucaagcuggagagagacaugaagaucaacugcagcggcaagaucgugaucgccagauacggcaagguguucagaggcaacaaggugaagaacgcccagcuggccggcgccaagggcgugauccuguacagcgaccccgccgacuacuucgcccccggcgugaagagcuaccccgacggcuggaaccugcccggcggcggcgugcagagaggcaacauccugaaccugaacggcgccggcgacccccugacccccggcuaccccgccaacgaguacgccuacagaagaggcaucgccgaggccgugggccugcccagcauccccgugcaccccaucggcuacuacgacgcccagaagcugcuggagaagaugggcggcagcgccccccccgacagcagcuggagaggcagccugaaggugcccuacaacgugggccccggcuucaccggcaacuucagcacccagaaggugaagaugcacauccacagcaccaacgaggugaccagaaucuacaacgugaucggcacccugagaggcgccguggagcccgacagauacgugauccugggcggccacagagacagcuggguguucggcggcaucgacccccagagcggcgccgccguggugcacgagaucgugagaagcuucggcacccugaagaaggagggcuggagacccagaagaaccauccuguucgccagcugggacgccgaggaguucggccugcugggcagcaccgagugggccgaggagaacagcagacugcugcaggagagaggcguggccuacaucaacgccgacagcagcaucgagggcaacuacacccugagaguggacugcaccccccugauguacagccuggugcacaaccugaccaaggagcugaagagccccgacgagggcuucgagggcaagagccuguacgagagcuggaccaagaagagccccagccccgaguucagcggcaugcccagaaucagcaagcugggcagcggcaacgacuucgagguguucuuccagagacugggcaucgccagcggcagagccagauacaccaagaacugggagaccaacaaguucagcggcuacccccuguaccacagcguguacgagaccuacgagcugguggagaaguucuacgaccccauguucaaguaccaccugaccguggcccaggugagaggcggcaugguguucgagcuggccaacagcaucgugcugcccuucgacugcagagacuacgccguggugcugagaaaguacgccgacaagaucuacagcaucagcaugaagcacccccaggagaugaagaccuacagcgugagcuucgacagccuguucagcgccgugaagaacuucaccgagaucgccagcaaguucagcgagagacugcaggacuucgacaagagcaagcacgugaucuacgcccccagcagccacaacaaguacgccggcgagagcuuccccggcaucuacgacgcccuguucgacaucgagagcaagguggaccccagcaaggccuggggcgaggugaagagacagaucuacguggccgccuucaccgugcaggccgccgccgagacccugagcgagguggccuaa

SEQ ID NO: 17182 - RNA, 774 nt, Artificial Sequence
  FOLR1__Homo_sapiens__NP_000793
auggcccagagaaugaccacccagcugcugcugcugcugguguggguggccguggugggcgaggcccagaccagaaucgccugggccagaaccgagcugcugaacgugugcaugaacgccaagcaccacaaggagaagcccggccccgaggacaagcugcacgagcagugcagacccuggagaaagaacgccugcugcagcaccaacaccagccaggaggcccacaaggacgugagcuaccuguacagauucaacuggaaccacugcggcgagauggcccccgccugcaagagacacuucauccaggacaccugccuguacgagugcagccccaaccugggccccuggauccagcagguggaccagagcuggagaaaggagagagugcugaacgugccccugugcaaggaggacugcgagcaguggugggaggacugcagaaccagcuacaccugcaagagcaacuggcacaagggcuggaacuggaccagcggcuucaacaagugcgccgugggcgccgccugccagcccuuccacuucuacuuccccacccccaccgugcugugcaacgagaucuggacccacagcuacaaggugagcaacuacagcagaggcagcggcagaugcauccagaugugguucgaccccgcccagggcaaccccaacgaggagguggccagauucuacgccgccgccaugagcggcgccggccccugggccgccuggcccuuccugcugagccuggcccugaugcugcuguggcugcugagcuaa

SEQ ID NO: 17183 - RNA, 768 nt, Artificial Sequence
  FOLR2__Homo_sapiens__NP_001107008
augguguggaaguggaugccccugcugcugcugcuggugugcguggccaccaugugcagcgcccaggacagaaccgaccugcugaacgugugcauggacgccaagcaccacaagaccaagcccggccccgaggacaagcugcacgaccagugcagccccuggaagaagaacgccugcugcaccgccagcaccagccaggagcugcacaaggacaccagcagacuguacaacuucaacugggaccacugcggcaagauggagcccgccugcaagagacacuucauccaggacaccugccuguacgagugcagccccaaccugggccccuggauccagcaggugaaccagagcuggagaaaggagagauuccuggacgugccccugugcaaggaggacugccagagauggugggaggacugccacaccagccacaccugcaagagcaacuggcacagaggcugggacuggaccagcggcgugaacaagugccccgccggcgcccugugcagaaccuucgagagcuacuuccccacccccgccgcccugugcgagggccuguggagccacagcuacaaggugagcaacuacagcagaggcagcggcagaugcauccagaugugguucgacagcgcccagggcaaccccaacgaggagguggccagauucuacgccgccgccaugcacgugaacgccggcgagaugcugcacggcaccggcggccugcugcugagccuggcccugaugcugcagcuguggcugcugggcuaa

SEQ ID NO: 17184 - RNA, 738 nt, Artificial Sequence
  FOLR3__Homo_sapiens__NP_000795
auggacauggccuggcagaugaugcagcugcugcugcuggcccuggugaccgccgccggcagcgcccagcccagaagcgccagagccagaaccgaccugcugaacgugugcaugaacgccaagcaccacaagacccagcccagccccgaggacgagcuguacggccagugcagccccuggaagaagaacgccugcugcaccgccagcaccagccaggagcugcacaaggacaccagcagacuguacaacuucaacugggaccacugcggcaagauggagcccaccugcaagagacacuucauccaggacagcugccuguacgagugcagccccaaccugggccccuggaucagacaggugaaccagagcuggagaaaggagagaauccugaacgugccccugugcaaggaggacugcgagagauggugggaggacugcagaaccagcuacaccugcaagagcaacuggcacaagggcuggaacuggaccagcggcaucaacgagugccccgccggcgcccugugcagcaccuucgagagcuacuuccccacccccgccgcccugugcgagggccuguggagccacagcuucaaggugagcaacuacagcagaggcagcggcagaugcauccagaugugguucgacagcgcccagggcaaccccaacgaggagguggccaaguucuacgccgccgccaugaacgccggcgcccccagcagaggcaucaucgacagcuaa

SEQ ID NO: 17185 - RNA, 525 nt, Artificial Sequence
  FOPNL__Homo_sapiens__NP_653201
auggccaccguggccgagcugaaggccgugcugaaggacacccuggagaagaagggcgugcugggccaccugaaggccagaaucagagccgagguguucaacgcccuggacgacgacagagagcccagacccagccugagccacgagaaccugcugaucaacgagcugaucagagaguaccuggaguucaacaaguacaaguacaccgccagcgugcugaucgccgagagcggccagcccguggugccccuggacagacaguuccugauccacgagcugaacgccuucgaggagagcaaggacaacaccaucccccugcuguacggcauccuggcccacuuccugagaggcaccaaggacggcauccagaacgccuuccugaagggccccagccugcagcccagcgaccccagccugggcagacagcccagcagaagaaagcccauggacgaccaccugagaaaggaggagcagaagagcaccaacaucgaggaccugcacgugagccaggccgugaacagauaa

SEQ ID NO: 17186 - RNA, 909 nt, Artificial Sequence
  FOSB__Homo_sapiens__NP_001107643
auguuccaggccuuccccggcgacuacgacagcggcagcagaugcagcagcagccccagcgccgagagccaguaccugagcagcguggacagcuucggcagcccccccaccgccgccgccagccaggagugcgccggccugggcgagaugcccggcagcuucgugcccaccgugaccgccaucaccaccagccaggaccugcaguggcuggugcagcccacccugaucagcagcauggcccagagccagggccagccccuggccagccagccccccgugguggaccccuacgacaugcccggcaccagcuacagcacccccggcaugagcggcuacagcagcggcggcgccagcggcagcggcggccccagcaccagcggcaccaccagcggccccggccccgccagacccgccagagccagacccagaagacccagagaggagaccgagaccgaccagcuggaggaggagaaggccgagcuggagagcgagaucgccgagcugcagaaggagaaggagagacuggaguucgugcugguggcccacaagcccggcugcaagauccccuacgaggagggccccggccccggcccccuggccgaggugagagaccugcccggcagcgcccccgccaaggaggacggcuucagcuggcugcugccccccccccccccccccccccugcccuuccagaccagccaggacgccccccccaaccugaccgccagccuguucacccacagcgaggugcaggugcugggcgaccccuuccccguggugaaccccagcuacaccagcagcuucgugcugaccugccccgaggugagcgccuucgccggcgcccagagaaccagcggcagcgaccagcccagcgacccccugaacagccccagccugcuggcccuguaa

SEQ ID NO: 17187 - RNA, 1143 nt, Artificial Sequence
  FOS__Homo_sapiens__NP_005243
augauguucagcggcuucaacgccgacuacgaggccagcagcagcagaugcagcagcgccagccccgccggcgacagccugagcuacuaccacagccccgccgacagcuucagcagcaugggcagccccgugaacgcccaggacuucugcaccgaccuggccgugagcagcgccaacuucauccccaccgugaccgccaucagcaccagccccgaccugcaguggcuggugcagcccgcccuggugagcagcguggcccccagccagaccagagccccccaccccuucggcgugcccgcccccagcgccggcgccuacagcagagccggcguggugaagaccaugaccggcggcagagcccagagcaucggcagaagaggcaagguggagcagcugagccccgaggaggaggagaagagaagaaucagaagagagagaaacaagauggccgccgccaagugcagaaacagaagaagagagcugaccgacacccugcaggccgagaccgaccagcuggaggacgagaagagcgcccugcagaccgagaucgccaaccugcugaaggagaaggagaagcuggaguucauccuggccgcccacagacccgccugcaagauccccgacgaccugggcuuccccgaggagaugagcguggccagccuggaccugaccggcggccugcccgagguggccacccccgagagcgaggaggccuucacccugccccugcugaacgaccccgagcccaagcccagcguggagcccgugaagagcaucagcagcauggagcugaagaccgagcccuucgacgacuuccuguuccccgccagcagcagacccagcggcagcgagaccgccagaagcgugcccgacauggaccugagcggcagcuucuacgccgccgacugggagccccugcacagcggcagccugggcaugggccccauggccaccgagcuggagccccugugcacccccguggugaccugcacccccagcugcaccgccuacaccagcagcuucguguucaccuaccccgaggccgacagcuuccccagcugcgccgccgcccacagaaagggcagcagcagcaacgagcccagcagcgacagccugagcagccccacccugcuggcccuguaa

SEQ ID NO: 17188 - RNA, 408 nt, Artificial Sequence
  FOSL1__Homo_sapiens__NP_001287784
auguucagagacuucggcgagcccggccccagcagcggcaacggcggcggcuacggcggccccgcccagccccccgccgccgcccaggccgcccagcagaaguuccaccuggugcccagcaucaacaccaugagcggcagccaggagcugcaguggauggugcagccccacuuccugggccccagcagcuaccccagaccccugaccuacccccaguacagccccccccagcccagacccggcgugaucagagcccugggccccccccccggcgugagaagaagacccugcgagcagcccggcggcagaggcgccccccccagcaaggccagagccgagcaggccggcugcggccaggugcaggagcccgaggagggcaccgacagacugcccgccggcggcgacuaa

SEQ ID NO: 17189 - RNA, 981 nt, Artificial Sequence
  FOSL2__Homo_sapiens__NP_005244
auguaccaggacuaccccggcaacuucgacaccagcagcagaggcagcagcggcagccccgcccacgccgagagcuacagcagcggcggcggcggccagcagaaguucagaguggacaugcccggcagcggcagcgccuucauccccaccaucaacgccaucaccaccagccaggaccugcaguggauggugcagcccaccgugaucaccagcaugagcaaccccuaccccagaagccaccccuacagcccccugcccggccuggccagcgugcccggccacauggcccugcccagacccggcgugaucaagaccaucggcaccaccgugggcagaagaagaagagacgagcagcugagccccgaggaggaggagaagagaagaaucagaagagagagaaacaagcuggccgccgccaagugcagaaacagaagaagagagcugaccgagaagcugcaggccgagaccgaggagcuggaggaggagaagagcggccugcagaaggagaucgccgagcugcagaaggagaaggagaagcuggaguucaugcugguggcccacggccccgugugcaagaucagccccgaggagagaagaagcccccccgcccccggccugcagcccaugagaagcggcggcggcagcgugggcgccgugguggugaagcaggagccccuggaggaggacagccccagcagcagcagcgccggccuggacaaggcccagagaagcgugaucaagcccaucagcaucgccggcggcuucuacggcgaggagccccugcacacccccaucguggugaccagcacccccgccgugacccccggcaccagcaaccugguguucaccuaccccagcgugcuggagcaggagagccccgccagccccagcgagagcugcagcaaggcccacagaagaagcagcagcagcggcgaccagagcagcgacagccugaacagccccacccugcuggcccuguaa

SEQ ID NO: 17190 - RNA, 1419 nt, Artificial Sequence
  FOXA1__Homo_sapiens__NP_004487
augcugggcaccgugaagauggagggccacgagaccagcgacuggaacagcuacuacgccgacacccaggaggccuacagcagcgugcccgugagcaacaugaacagcggccugggcagcaugaacagcaugaacaccuacaugaccaugaacaccaugaccaccagcggcaacaugacccccgccagcuucaacaugagcuacgccaaccccggccugggcgccggccugagccccggcgccguggccggcaugcccggcggcagcgccggcgccaugaacagcaugaccgccgccggcgugaccgccaugggcaccgcccugagccccagcggcaugggcgccaugggcgcccagcaggccgccagcaugaacggccugggccccuacgccgccgccaugaaccccugcaugagccccauggccuacgcccccagcaaccugggcagaagcagagccggcggcggcggcgacgccaagaccuucaagagaagcuacccccacgccaagccccccuacagcuacaucagccugaucaccauggccauccagcaggcccccagcaagaugcugacccugagcgagaucuaccaguggaucauggaccuguuccccuacuacagacagaaccagcagagauggcagaacagcaucagacacagccugagcuucaacgacugcuucgugaagguggccagaagccccgacaagcccggcaagggcagcuacuggacccugcaccccgacagcggcaacauguucgagaacggcugcuaccugagaagacagaagagauucaagugcgagaagcagcccggcgccggcggcggcggcggcagcggcagcggcggcagcggcgccaagggcggccccgagagcagaaaggaccccagcggcgccagcaaccccagcgccgacagcccccugcacagaggcgugcacggcaagaccggccagcuggagggcgcccccgcccccggccccgccgccagcccccagacccuggaccacagcggcgccaccgccaccggcggcgccagcgagcugaagacccccgccagcagcaccgccccccccaucagcagcggccccggcgcccuggccagcgugcccgccagccaccccgcccacggccuggccccccacgagagccagcugcaccugaagggcgacccccacuacagcuucaaccaccccuucagcaucaacaaccugaugagcagcagcgagcagcagcacaagcuggacuucaaggccuacgagcaggcccugcaguacagccccuacggcagcacccugcccgccagccugccccugggcagcgccagcgugaccaccagaagccccaucgagcccagcgcccuggagcccgccuacuaccagggcguguacagcagacccgugcugaacaccagcuaa

SEQ ID NO: 17191 - RNA, 1392 nt, Artificial Sequence
  FOXA2__Homo_sapiens__NP_068556
augcacagcgccagcagcaugcugggcgccgugaagauggagggccacgagcccagcgacuggagcagcuacuacgccgagcccgagggcuacagcagcgugagcaacaugaacgccggccugggcaugaacggcaugaacaccuacaugagcaugagcgccgccgccaugggcagcggcagcggcaacaugagcgccggcagcaugaacaugagcagcuacgugggcgccggcaugagccccagccuggccggcaugagccccggcgccggcgccauggccggcaugggcggcagcgccggcgccgccggcguggccggcaugggcccccaccugagccccagccugagcccccugggcggccaggccgccggcgccaugggcggccuggcccccuacgccaacaugaacagcaugagccccauguacggccaggccggccugagcagagccagagaccccaagaccuacagaagaagcuacacccacgccaagccccccuacagcuacaucagccugaucaccauggccauccagcagagccccaacaagaugcugacccugagcgagaucuaccaguggaucauggaccuguuccccuucuacagacagaaccagcagagauggcagaacagcaucagacacagccugagcuucaacgacugcuuccugaaggugcccagaagccccgacaagcccggcaagggcagcuucuggacccugcaccccgacagcggcaacauguucgagaacggcugcuaccugagaagacagaagagauucaagugcgagaagcagcuggcccugaaggaggccgccggcgccgccggcagcggcaagaaggccgccgccggcgcccaggccagccaggcccagcugggcgaggccgccggccccgccagcgagacccccgccggcaccgagagcccccacagcagcgccagccccugccaggagcacaagagaggcggccugggcgagcugaagggcacccccgccgccgcccugagcccccccgagcccgcccccagccccggccagcagcagcaggccgccgcccaccugcugggccccccccaccaccccggccugccccccgaggcccaccugaagcccgagcaccacuacgccuucaaccaccccuucagcaucaacaaccugaugagcagcgagcagcagcaccaccacagccaccaccaccaccagccccacaagauggaccugaaggccuacgagcaggugaugcacuaccccggcuacggcagccccaugcccggcagccuggccaugggccccgugaccaacaagaccggccuggacgccagcccccuggccgccgacaccagcuacuaccagggcguguacagcagacccaucaugaacagcagcuaa

SEQ ID NO: 17192 - RNA, 1053 nt, Artificial Sequence
  FOXA3__Homo_sapiens__NP_004488
augcugggcagcgugaagauggaggcccacgaccuggccgaguggagcuacuaccccgaggccggcgagguguacagccccgugacccccgugcccaccauggccccccugaacagcuacaugacccugaacccccugagcagccccuacccccccggcggccugcccgccagcccccugcccagcggcccccuggccccccccgcccccgccgccccccugggccccaccuuccccggccugggcgugagcggcggcagcagcagcagcggcuacggcgcccccggccccggccuggugcacggcaaggagaugcccaagggcuacagaagaccccuggcccacgccaagccccccuacagcuacaucagccugaucaccauggccauccagcaggcccccggcaagaugcugacccugagcgagaucuaccaguggaucauggaccuguuccccuacuacagagagaaccagcagagauggcagaacagcaucagacacagccugagcuucaacgacugcuucgugaagguggccagaagccccgacaagcccggcaagggcagcuacugggcccugcaccccagcagcggcaacauguucgagaacggcugcuaccugagaagacagaagagauucaagcuggaggagaaggugaagaagggcggcagcggcgccgccaccaccaccagaaacggcaccggcagcgccgccagcaccaccacccccgccgccaccgugaccagccccccccagccccccccccccgcccccgagcccgaggcccagggcggcgaggacgugggcgcccuggacugcggcagccccgccagcagcacccccuacuucaccggccuggagcugcccggcgagcugaagcuggacgcccccuacaacuucaaccaccccuucagcaucaacaaccugaugagcgagcagacccccgccccccccaagcuggacgugggcuucggcggcuacggcgccgagggcggcgagcccggcguguacuaccagggccuguacagcagaagccugcugaacgccagcuaa

SEQ ID NO: 17193 - RNA, 978 nt, Artificial Sequence
  FOXB1__Homo_sapiens__NP_036314
augcccagacccggcagaaacaccuacagcgaccagaagccccccuacagcuacaucagccugaccgccauggccauccagagcagccccgagaagaugcugccccugagcgagaucuacaaguucaucauggacagauuccccuacuacagagagaacacccagagauggcagaacagccugagacacaaccugagcuucaacgacugcuucaucaagauccccagaagacccgaccagcccggcaagggcagcuucugggcccugcaccccagcugcggcgacauguucgagaacggcagcuuccugagaagaagaaagagauucaaggugcugaagagcgaccaccuggcccccagcaagcccgccgacgccgcccaguaccugcagcagcaggccaagcugagacugagcgcccuggccgccagcggcacccaccugccccagaugcccgccgccgccuacaaccugggcggcguggcccagcccagcggcuucaagcaccccuucgccaucgagaacaucaucgccagagaguacaagaugcccggcggccuggccuucagcgccaugcagcccgugcccgccgccuacccccugcccaaccagcugaccaccaugggcagcagccugggcaccggcuggccccacguguacggcagcgccggcaugaucgacagcgccacccccaucagcauggccagcggcgacuacagcgccuacggcgugccccugaagccccugugccacgccgccggccagacccugcccgccauccccgugcccaucaagcccacccccgccgccgugcccgcccugcccgcccugcccgcccccauccccacccugcugagcaacagcccccccagccugagccccaccagcagccagaccgccaccagccagagcagccccgccacccccagcgagacccugaccagccccgccagcgcccugcacagcguggccgugcacuaa

SEQ ID NO: 17194 - RNA, 1662 nt, Artificial Sequence
  FOXC1__Homo_sapiens__NP_001444
augcaggccagauacagcgugagcagccccaacagccugggcguggugcccuaccugggcggcgagcagagcuacuacagagccgccgccgccgccgccggcggcggcuacaccgccaugcccgcccccaugagcguguacagccaccccgcccacgccgagcaguaccccggcggcauggccagagccuacggccccuacaccccccagccccagcccaaggacauggugaagccccccuacagcuacaucgcccugaucaccauggccauccagaacgcccccgacaagaagaucacccugaacggcaucuaccaguucaucauggacagauuccccuucuacagagacaacaagcagggcuggcagaacagcaucagacacaaccugagccugaacgagugcuucgugaaggugcccagagacgacaagaagcccggcaagggcagcuacuggacccuggaccccgacagcuacaacauguucgagaacggcagcuuccugagaagaagaagaagauucaagaagaaggacgccgugaaggacaaggaggagaaggacagacugcaccugaaggagccccccccccccggcagacagcccccccccgccccccccgagcaggccgacggcaacgcccccggcccccagcccccccccgugagaauccaggacaucaagaccgagaacggcaccugccccagccccccccagccccugagccccgccgccgcccugggcagcggcagcgccgccgccgugcccaagaucgagagccccgacagcagcagcagcagccugagcagcggcagcagcccccccggcagccugcccagcgccagaccccugagccuggacggcgccgacagcgccccccccccccccgcccccagcgccccccccccccaccacagccagggcuucagcguggacaacaucaugaccagccugagaggcagcccccagagcgccgccgccgagcugagcagcggccugcuggccagcgccgccgccagcagcagagccggcaucgcccccccccuggcccugggcgccuacagccccggccagagcagccuguacagcagccccugcagccagaccagcagcgccggcagcagcggcggcggcggcggcggcgccggcgccgccggcggcgccggcggcgccggcaccuaccacugcaaccugcaggccaugagccuguacgccgccggcgagagaggcggccaccugcagggcgcccccggcggcgccggcggcagcgccguggacgacccccugcccgacuacagccugccccccgugaccagcagcagcagcagcagccugagccacggcggcggcggcggcggcggcggcggcggccaggaggccggccaccaccccgccgcccaccagggcagacugaccagcugguaccugaaccaggccggcggcgaccugggccaccuggccagcgccgccgccgccgccgccgccgccggcuaccccggccagcagcagaacuuccacagcgugagagagauguucgagagccagagaaucggccugaacaacagccccgugaacggcaacagcagcugccagauggccuuccccagcagccagagccuguacagaaccagcggcgccuucguguacgacugcagcaaguucuaa

SEQ ID NO: 17195 - RNA, 1506 nt, Artificial Sequence
  FOXC2__Homo_sapiens__NP_005242
augcaggccagauacagcgugagcgaccccaacgcccugggcguggugcccuaccugagcgagcagaacuacuacagagccgccggcagcuacggcggcauggccagccccaugggcguguacagcggccaccccgagcaguacagcgccggcaugggcagaagcuacgcccccuaccaccaccaccagcccgccgcccccaaggaccuggugaagccccccuacagcuacaucgcccugaucaccauggccauccagaacgcccccgagaagaagaucacccugaacggcaucuaccaguucaucauggacagauuccccuucuacagagagaacaagcagggcuggcagaacagcaucagacacaaccugagccugaacgagugcuucgugaaggugcccagagacgacaagaagcccggcaagggcagcuacuggacccuggaccccgacagcuacaacauguucgagaacggcagcuuccugagaagaagaagaagauucaagaagaaggacgugagcaaggagaaggaggagagagcccaccugaaggagcccccccccgccgccagcaagggcgcccccgccaccccccaccuggccgacgcccccaaggaggccgagaagaagguggugaucaagagcgaggccgccagccccgcccugcccgugaucaccaagguggagacccugagccccgagagcgcccugcagggcagccccagaagcgccgccagcacccccgccggcagccccgacggcagccugcccgagcaccacgccgccgcccccaacggccugcccggcuucagcguggagaacaucaugacccugagaaccagcccccccggcggcgagcugagccccggcgccggcagagccggccugguggugcccccccuggcccugcccuacgccgccgccccccccgccgccuacggccagcccugcgcccagggccuggaggccggcgccgccggcggcuaccagugcagcaugagagccaugagccuguacaccggcgccgagagacccgcccacaugugcgugccccccgcccuggacgaggcccugagcgaccaccccagcggccccaccagcccccugagcgcccugaaccuggccgccggccaggagggcgcccuggccgccaccggccaccaccaccagcaccacggccaccaccacccccaggcccccccccccccccccgccccccagccccagcccaccccccagcccggcgccgccgccgcccaggccgccagcugguaccugaaccacagcggcgaccugaaccaccugcccggccacaccuucgccgcccagcagcagaccuuccccaacgugagagagauguucaacagccacagacugggcaucgagaacagcacccugggcgagagccaggugagcggcaacgccagcugccagcugcccuacagaagcacccccccccuguacagacacgccgcccccuacagcuacgacugcaccaaguacuaa

SEQ ID NO: 17196 - RNA, 1398 nt, Artificial Sequence
  FOXD1__Homo_sapiens__NP_004463
augacccugagcaccgagaugagcgacgccagcggccuggccgaggagaccgacaucgacguggugggcgagggcgaggacgaggaggacgaggaggaggaggacgacgacgagggcggcggcggcggccccagacuggccgugcccgcccagagaagaagaagaagaagaagcuacgccggcgaggacgagcuggaggaccuggaggaggaggaggacgacgacgacauccugcuggccccccccgccggcggcagccccgccccccccggccccgcccccgccgccggcgccggcgccggcggcggcggcggcggcggcggcgccggcggcggcggcagcgccggcagcggcgccaagaacccccuggugaagccccccuacagcuacaucgcccugaucaccauggccauccugcagagccccaagaagagacugacccugagcgagaucugcgaguucaucagcggcagauuccccuacuacagagagaaguuccccgccuggcagaacagcaucagacacaaccugagccugaacgacugcuucgugaagauccccagagagcccggcaaccccggcaagggcaacuacuggacccuggaccccgagagcgccgacauguucgacaacggcagcuuccugagaagaagaaagagauucaagagacagccccugcugccccccaacgccgccgccgccgagagccugcugcugagaggcgccggcgccgccggcggcgccggcgaccccgccgccgccgccgcccuguucccccccgccccccccccccccccccacgccuacggcuacggccccuacggcugcggcuacggccugcagcugccccccuacgccccccccagcgcccuguucgccgccgccgccgccgccgccgccgccgccgccuuccacccccacagcccccccccccccccccccccccacggcgccgccgccgagcuggccagaaccgccuucggcuacagaccccacccccugggcgccgcccugcccggcccccugcccgccagcgccgccaaggccggcggccccggcgccagcgcccuggccagaagccccuucagcaucgagagcaucaucggcggcagccugggccccgccgccgccgccgccgccgccgcccaggccgccgccgccgcccaggccagccccagccccagccccguggccgccccccccgcccccggcagcagcggcggcggcugcgccgcccaggccgccgugggccccgccgccgcccugaccagaagccugguggccgccgccgccgccgccgccagcagcgugagcagcagcgccgcccugggcacccugcaccagggcaccgcccugagcagcguggagaacuucaccgccagaaucagcaacugcuaa

SEQ ID NO: 17197 - RNA, 1122 nt, Artificial Sequence
  FOXE1__Homo_sapiens__NP_004464
augaccgccgagagcggccccccccccccccagcccgaggugcuggccaccgugaaggaggagagaggcgagaccgccgccggcgccggcgugcccggcgaggccaccggcagaggcgccggcggcagaagaagaaagagaccccugcagagaggcaagccccccuacagcuacaucgcccugaucgccauggccaucgcccacgcccccgagagaagacugacccugggcggcaucuacaaguucaucaccgagagauuccccuucuacagagacaaccccaagaaguggcagaacagcaucagacacaaccugacccugaacgacugcuuccugaagauccccagagaggccggcagacccggcaagggcaacuacugggcccuggaccccaacgccgaggacauguucgagagcggcagcuuccugagaagaagaaagagauucaagagaagcgaccugagcaccuaccccgccuacaugcacgacgccgccgccgccgccgccgccgccgccgccgccgccgccgccgccgccaucuuccccggcgccgugcccgccgccagaccccccuaccccggcgccguguacgccggcuacgccccccccagccuggccgcccccccccccguguacuaccccgccgccagccccggccccugcagaguguucggccuggugcccgagagaccccugagccccgagcugggccccgcccccagcggccccggcggcagcugcgccuucgccagcgccggcgcccccgccaccaccaccggcuaccagcccgccggcugcaccggcgccagacccgccaaccccagcgccuacgccgccgccuacgccggccccgacggcgccuacccccagggcgccggcagcgccaucuucgccgccgccggcagacuggccggccccgccagcccccccgccggcggcagcagcggcggcguggagaccaccguggacuucuacggcagaaccagccccggccaguucggcgcccugggcgccugcuacaaccccggcggccagcugggcggcgccagcgccggcgccuaccacgccagacacgccgccgccuaccccggcggcaucgacagauucgugagcgccauguaa

SEQ ID NO: 17198 - RNA, 1140 nt, Artificial Sequence
  FOXF1__Homo_sapiens__NP_001442
augagcagcgcccccgagaagcagcagcccccccacggcggcggcggcggcggcggcggcggcggcggcgccgccauggaccccgccagcagcggccccagcaaggccaagaagaccaacgccggcaucagaagacccgagaagccccccuacagcuacaucgcccugaucgugauggccauccagagcagccccaccaagagacugacccugagcgagaucuaccaguuccugcagagcagauuccccuucuucagaggcagcuaccagggcuggaagaacagcgugagacacaaccugagccugaacgagugcuucaucaagcugcccaagggccugggcagacccggcaagggccacuacuggaccaucgaccccgccagcgaguucauguucgaggagggcagcuucagaagaagacccagaggcuucagaagaaagugccaggcccugaagcccauguacagcaugaugaacggccugggcuucaaccaccugcccgacaccuacggcuuccagggcagcgccggcggccugagcugcccccccaacagccuggcccuggagggcggccugggcaugaugaacggccaccugcccggcaacguggacggcauggcccugcccagccacagcgugccccaccugcccagcaacggcggccacagcuacaugggcggcugcggcggcgccgccgccggcgaguacccccaccacgacagcagcgugcccgccagcccccugcugcccaccggcgccggcggcgugauggagccccacgccguguacagcggcagcgccgccgccuggccccccagcgccagcgccgcccugaacagcggcgccagcuacaucaagcagcagccccugagccccugcaaccccgccgccaacccccugagcggcagccugagcacccacagccuggagcagcccuaccugcaccagaacagccacaacgcccccgccgagcugcagggcauccccagauaccacagccagagccccagcaugugcgacagaaaggaguucguguucagcuucaacgccauggccagcagcagcaugcacagcgccggcggcggcagcuacuaccaccagcaggugaccuaccaggacaucaagcccugcgugauguaa

SEQ ID NO: 17199 - RNA, 1335 nt, Artificial Sequence
  FOXF2__Homo_sapiens__NP_001443
augaccaccgagggcggccccccccccgccccccugagaagagccugcagccccgugcccggcgcccugcaggccgcccugaugagccccccccccgccgccgccgccgccgccgccgccgcccccgagaccaccagcagcagcagcagcagcagcagcgccagcugcgccagcagcagcagcagcagcaacagcgccagcgcccccagcgccgccugcaagagcgccggcggcggcggcgccggcgccggcagcggcggcgccaagaaggccagcagcggccugagaagacccgagaagccccccuacagcuacaucgcccugaucgugauggccauccagagcagccccagcaagagacugacccugagcgagaucuaccaguuccugcaggccagauuccccuucuucagaggcgccuaccagggcuggaagaacagcgugagacacaaccugagccugaacgagugcuucaucaagcugcccaagggccugggcagacccggcaagggccacuacuggaccaucgaccccgccagcgaguucauguucgaggagggcagcuucagaagaagacccagaggcuucagaagaaagugccaggcccugaagcccauguaccacagaguggugagcggccugggcuucggcgccagccugcugccccagggcuucgacuuccaggccccccccagcgccccccugggcugccacagccagggcggcuacggcggccuggacaugaugcccgccggcuacgacgccggcgccggcgcccccagccacgcccacccccaccaccaccaccaccaccacgugccccacaugagccccaaccccggcagcaccuacauggccagcugccccgugcccgccggccccggcggcgugggcgccgccggcggcggcggcggcggcgacuacggccccgacagcagcagcagccccgugcccagcagccccgccauggccagcgccaucgagugccacagccccuacaccagccccgccgcccacuggagcagccccggcgccagccccuaccugaagcagccccccgcccugacccccagcagcaaccccgccgccagcgccggccugcacagcagcaugagcagcuacagccuggagcagagcuaccugcaccagaacgccagagaggaccugagcgugggccugcccagauaccagcaccacagcacccccgugugcgacagaaaggacuucgugcugaacuucaacggcaucagcagcuuccaccccagcgccagcggcagcuacuaccaccaccaccaccagagcgugugccaggacaucaagcccugcgugauguaa

SEQ ID NO: 17200 - RNA, 1470 nt, Artificial Sequence
  FOXG1__Homo_sapiens__NP_005240
augcuggacaugggcgacagaaaggaggugaagaugauccccaagagcagcuucagcaucaacagccuggugcccgaggccgugcagaacgacaaccaccacgccagccacggccaccacaacagccaccacccccagcaccaccaccaccaccaccaccaccaccaccacccccccccccccgccccccagccccccccccccccccagcagcagcagcccccccccccccccccccccgccccccagcccccccagaccagaggcgcccccgccgccgacgacgacaagggcccccagcagcugcugcugccccccccccccccccccccccccgccgccgcccuggacggcgccaaggccgacggccugggcggcaagggcgagcccggcggcggccccggcgagcuggcccccgugggccccgacgagaaggagaagggcgccggcgccggcggcgaggagaagaagggcgccggcgagggcggcaaggacggcgagggcggcaaggagggcgagaagaagaacggcaaguacgagaagccccccuucagcuacaacgcccugaucaugauggccaucagacagagccccgagaagagacugacccugaacggcaucuacgaguucaucaugaagaacuuccccuacuacagagagaacaagcagggcuggcagaacagcaucagacacaaccugagccugaacaagugcuucgugaaggugcccagacacuacgacgaccccggcaagggcaacuacuggaugcuggaccccagcagcgacgacguguucaucggcggcaccaccggcaagcugagaagaagaagcaccaccagcagagccaagcuggccuucaagagaggcgccagacugaccagcaccggccugaccuucauggacagagccggcagccuguacuggcccaugagccccuuccugagccugcaccaccccagagccagcagcacccugagcuacaacggcaccaccagcgccuaccccagccaccccaugcccuacagcagcgugcugacccagaacagccugggcaacaaccacagcuucagcaccgccaacggccugagcguggacagacuggugaacggcgagauccccuacgccacccaccaccugaccgccgccgcccuggccgccagcgugcccugcggccugagcgugcccugcagcggcaccuacagccugaaccccugcagcgugaaccugcuggccggccagaccagcuacuucuucccccacgugccccaccccagcaugaccagccagagcagcaccagcaugagcgccagagccgccagcagcagcaccagcccccaggcccccagcacccugcccugcgagagccugagacccagccugcccagcuucaccaccggccugagcggcggccugagcgacuacuucacccaccagaaccagggcagcagcagcaacccccugauccacuaa

SEQ ID NO: 17201 - RNA, 1098 nt, Artificial Sequence
  FOXH1__Homo_sapiens__NP_003914
augggccccugcagcggcagcagacugggcccccccgaggccgagagccccagccagccccccaagagaagaaagaagagauaccugagacacgacaagccccccuacaccuaccuggccaugaucgcccuggugauccaggccgcccccagcagaagacugaagcuggcccagaucaucagacaggugcaggccguguuccccuucuucagagaggacuacgagggcuggaaggacagcaucagacacaaccugagcagcaacagaugcuucagaaaggugcccaaggaccccgccaagccccaggccaagggcaacuucugggccguggacgugagccugauccccgccgaggcccugagacugcagaacaccgcccugugcagaagauggcagaacggcggcgccagaggcgccuucgccaaggaccugggccccuacgugcugcacggcagacccuacagaccccccagccccccccccccccccagcgagggcuucagcaucaagagccugcugggcggcagcggcgagggcgcccccuggcccggccuggccccccagagcagccccgugcccgccggcaccggcaacagcggcgaggaggccgugcccacccccccccugcccagcagcgagagaccccuguggccccugugcccccugcccggccccaccagaguggagggcgagaccgugcagggcggcgccaucggccccagcacccugagccccgagcccagagccuggccccugcaccugcugcagggcaccgccgugcccggcggcagaagcagcggcggccacagagccagccuguggggccagcugcccaccagcuaccugcccaucuacacccccaacguggugaugccccuggcccccccccccaccagcugcccccagugccccagcaccagccccgccuacuggggcguggcccccgagaccagaggcccccccggccugcugugcgaccuggacgcccuguuccagggcgugccccccaacaagagcaucuacgacgugugggugagccaccccagagaccuggccgcccccggccccggcuggcugcugagcuggugcagccuguaa

SEQ ID NO: 17202 - RNA, 1137 nt, Artificial Sequence
  FOXI1__Homo_sapiens__NP_036320
augagcagcuucgaccugcccgcccccagcccccccagaugcagcccccaguuccccagcaucggccaggagccccccgagaugaaccuguacuacgagaacuucuuccacccccagggcgugcccagcccccagagacccagcuucgagggcggcggcgaguacggcgccacccccaaccccuaccugugguucaacggccccaccaugacccccccccccuaccugcccggccccaacgccagccccuuccugccccaggccuacggcgugcagagaccccugcugcccagcgugagcggccugggcggcagcgaccugggcuggcugcccauccccagccaggaggagcugaugaagcuggugagaccccccuacagcuacagcgcccugaucgccauggccauccacggcgcccccgacaagagacugacccugagccagaucuaccaguacguggccgacaacuuccccuucuacaacaagagcaaggccggcuggcagaacagcaucagacacaaccugagccugaacgacugcuucaagaaggugcccagagacgaggacgaccccggcaagggcaacuacuggacccuggaccccaacugcgagaagauguucgacaacggcaacuucagaagaaagagaaagagaaagagcgacgugagcagcagcaccgccagccuggcccuggagaagaccgagagcagccugcccguggacagccccaagaccaccgagccccaggacauccuggacggcgccagccccggcggcaccaccagcagccccgagaagagacccagccccccccccagcggcgcccccugccugaacagcuuccugagcagcaugaccgccuacgugagcggcggcagccccaccagccacccccuggugacccccggccugagccccgagcccagcgacaagaccggccagaacagccugaccuucaacagcuucagcccccugaccaaccugagcaaccacagcggcggcggcgacugggccaaccccaugcccaccaacaugcugagcuacggcggcagcgugcugagccaguucagcccccacuucuacaacagcgugaacaccagcggcgugcuguaccccagagagggcaccgagguguaa

SEQ ID NO: 17203 - RNA, 1266 nt, Artificial Sequence
  FOXJ1__Homo_sapiens__NP_001445
auggccgagagcuggcugagacugagcggcgccggccccgccgaggaggccggccccgagggcggccuggaggagcccgacgcccuggacgacagccugaccagccugcaguggcugcaggaguucagcauccugaacgccaaggcccccgcccugccccccggcggcaccgacccccacggcuaccaccaggugcccggcagcgccgcccccggcagcccccuggccgccgaccccgccugccugggccagccccacacccccggcaagcccaccagcagcugcaccagcagaagcgccccccccggccugcaggcccccccccccgacgacguggacuacgccaccaacccccacgugaagccccccuacagcuacgccacccugaucugcauggccaugcaggccagcaaggccaccaagaucacccugagcgccaucuacaaguggaucaccgacaacuucugcuacuucagacacgccgaccccaccuggcagaacagcaucagacacaaccugagccugaacaagugcuucaucaaggugcccagagagaaggacgagcccggcaagggcggcuucuggagaaucgacccccaguacgccgagagacugcugagcggcgccuucaagaagagaagacugccccccgugcacauccaccccgccuucgccagacaggccgcccaggagcccagcgccgugcccagagccggcccccugaccgugaacaccgaggcccagcagcugcugagagaguucgaggaggccaccggcgaggccggcuggggcgccggcgagggcagacugggccacaagagaaagcagccccugcccaagagaguggccaaggugcccagaccccccagcacccugcugcccacccccgaggagcagggcgagcuggagccccugaagggcaacuucgacugggaggccaucuucgacgccggcacccugggcggcgagcugggcgcccuggaggcccuggagcugagccccccccugagccccgccagccacguggacguggaccugaccauccacggcagacacaucgacugccccgccaccuggggccccagcguggagcaggccgccgacagccuggacuucgacgagaccuuccuggccaccagcuuccugcagcaccccugggacgagagcggcagcggcugccugccccccgagccccuguucgaggccggcgacgccacccuggccagcgaccugcaggacugggccagcgugggcgccuuccuguaa

SEQ ID NO: 17204 - RNA, 1725 nt, Artificial Sequence
  FOXJ2__Homo_sapiens__NP_060886
auggccagcgaccuggagagcagccugaccagcaucgacuggcugccccagcugacccugagagccaccaucgagaagcugggcagcgccagccaggccggcccccccggcagcagcagaaagugcagccccggcagccccaccgaccccaacgccacccugagcaaggacgaggccgccgugcaccaggacggcaagcccagauacagcuacgccacccugaucaccuacgccaucaacagcagccccgccaagaagaugacccugagcgagaucuacagauggaucugcgacaacuuccccuacuacaagaacgccggcaucggcuggaagaacagcaucagacacaaccugagccugaacaagugcuucagaaaggugcccagacccagagacgaccccggcaagggcagcuacuggaccaucgacaccugccccgacaucagcagaaagagaagacacccccccgacgacgaccugagccaggacagccccgagcaggaggccagcaagagccccagaggcggcguggccggcagcggcgaggccagccugccccccgagggcaacccccagaugagccugcagagccccaccagcaucgccagcuacagccagggcaccggcagcguggacggcggcgccguggccgccggcgccagcggcagagagagcgccgagggcccccccccccuguacaacaccaaccacgacuucaaguucagcuacagcgagaucaacuuccaggaccugagcuggagcuucagaaaccuguacaagagcaugcuggagaagagcagcagcagcagccagcacggcuucagcagccugcugggcgacaucccccccagcaacaacuacuacauguaccagcagcagcagcccccccccccccagcagcagcagcagcagcagcagcccccccagccccccccccagcagagccagccccagcagcagcaggcccccgcccagggccccagcgccgugggcggcgcccccccccugcacacccccagcaccgacggcugcaccccccccggcggcaagcaggccggcgccgagggcuacggccccccccccgugauggccaugcacccccccccccugcagcacggcggcuaccacccccaccagcaccacccccacagccaccccgcccagcagcccccccccccccagccccaggcccagggccaggcccccaucaacaacaccggcuucgccuuccccagcgacuggugcagcaacaucgacagccugaaggagagcuucaagauggugaacagacugaacuggagcagcaucgagcagagccaguucagcgagcugauggagagccugagacaggccgagcagaagaacuggacccuggaccagcaccacaucgccaaccugugcgacagccugaaccacuuccugacccagaccggccacgugcccccccagggcggcacccacagaccccccgcccccgccagaaucgccgacagcugcgcccugaccagcggcaagcaggagagcgccaugagccaggugaacagcuacggccacccccaggccccccaccuguaccccggccccagccccauguaccccauccccacccaggacagcgccggcuacaacagacccgcccaccacauggugcccagacccagcgugcccccccccggcgccaacgaggagauccccgacgacuucgacugggaccugaucaccuaa

SEQ ID NO: 17205 - RNA, 2202 nt, Artificial Sequence
  FOXK1__Homo_sapiens__NP_001032242
auggccgaggugggcgaggacagcggcgccagagcccugcuggcccugagaagcgcccccugcagccccgugcugugcgccgccgccgccgccgccgccuuccccgccgccgcccccccccccgcccccgcccagccccagcccccccccggccccccccccccccccccccccccccugccccccggcgccaucgccggcgccggcagcagcggcggcagcagcggcgugagcggcgacagcgccguggccggcgccgcccccgcccugguggccgccgccgccgccagcgugagacagagccccggccccgcccuggccagacuggagggcagagaguucgaguuccugaugagacagcccagcgugaccaucggcagaaacagcagccagggcagcguggaccugagcaugggccugagcagcuucaucagcagaagacaccugcagcugagcuuccaggagccccacuucuaccugagaugccugggcaagaacggcguguucguggacggcgccuuccagagaagaggcgcccccgcccugcagcugcccaagcagugcaccuucagauuccccagcaccgccaucaagauccaguucaccagccuguaccacaaggaggaggcccccgccagcccccugagaccccuguacccccagaucagcccccugaagauccacauccccgagcccgaccugagaagcauggugagccccgugcccagccccaccggcaccaucagcgugcccaacagcugccccgccagccccagaggcgccggcagcagcagcuacagauucgugcagaacgugaccagcgaccugcagcuggccgccgaguucgccgccaaggccgccagcgagcagcaggccgacaccagcggcggcgacagccccaaggacgagagcaagccccccuucagcuacgcccagcugaucgugcaggccaucagcagcgcccaggacagacagcugacccugagcggcaucuacgcccacaucaccaagcacuaccccuacuacagaaccgccgacaagggcuggcagaacagcaucagacacaaccugagccugaacagauacuucaucaaggugcccagaagccaggaggagcccggcaagggcagcuucuggagaaucgaccccgccagcgaggccaagcugguggagcaggccuucagaaagagaagacagagaggcgugagcugcuucagaacccccuucggcccccugagcagcagaagcgcccccgccagccccacccaccccggccugaugagccccagaagcggcggccugcagacccccgagugccugagcagagagggcagccccaucccccacgaccccgaguucggcagcaagcuggccagcgugcccgaguacagauacagccagagcgcccccggcagccccgugagcgcccagcccgugaucauggccgugccccccagacccagcagccugguggccaagcccguggccuacaugcccgccagcaucgugaccagccagcagcccgccggccacgccauccacguggugcagcaggcccccaccgugaccauggugagaguggugaccaccagcgccaacagcgccaacggcuacauccugaccagccagggcgccgccggcggcagccacgacgccgccggcgccgccgugcuggaccugggcagcgaggccagaggccuggaggagaagcccaccaucgccuucgccaccauccccgccgccggcggcgugauccagaccguggccagccagauggcccccggcgugcccggccacaccgugaccauccugcagcccgccacccccgugacccugggccagcaccaccugcccgugagagccgugacccagaacggcaagcacgccgugcccaccaacagccuggccggcaacgccuacgcccugaccagcccccugcagcugcuggccacccaggccagcagcagcgcccccgugguggugaccagagugugcgaggugggccccaaggagcccgccgccgccguggccgccaccgccaccaccacccccgccaccgccaccaccgccagcgccagcgccagcagcaccggcgagcccgaggugaagagaagcagaguggaggagcccagcggcgccgugaccacccccgccggcgugaucgccgccgccggcccccagggccccggcaccggcgaguaa

SEQ ID NO: 17206 - RNA, 1983 nt, Artificial Sequence
  FOXK2__Homo_sapiens__NP_004505
auggccgccgccgccgccgcccugagcggcgccggcaccccccccgccggcggcggcgccggcggcggcggcgccggcggcggcggcagcccccccggcggcugggccguggccagacuggagggcagagaguucgaguaccugaugaagaagagaagcgugaccaucggcagaaacagcagccagggcagcguggacgugagcaugggccacagcagcuucaucagcagaagacaccuggagaucuucaccccccccggcggcggcggccacggcggcgccgcccccgagcugccccccgcccagcccagacccgacgccggcggcgacuucuaccugagaugccugggcaagaacggcguguucguggacggcguguuccagagaagaggcgcccccccccugcagcugcccagagugugcaccuucagauuccccagcaccaacaucaagaucaccuucaccgcccugagcagcgagaagagagagaagcaggaggccagcgagagccccgugaaggccgugcagccccacaucagcccccugaccaucaacauccccgacaccauggcccaccugaucagcccccugcccagccccaccggcaccaucagcgccgccaacagcugccccagcagccccagaggcgccggcagcagcggcuacaaggugggcagagugaugcccagcgaccugaaccugauggccgacaacagccagcccgagaacgagaaggaggccagcggcggcgacagccccaaggacgacagcaagccccccuacagcuacgcccagcugaucgugcaggccaucaccauggcccccgacaagcagcugacccugaacggcaucuacacccacaucaccaagaacuaccccuacuacagaaccgccgacaagggcuggcagaacagcaucagacacaaccugagccugaacagauacuucaucaaggugcccagaagccaggaggagcccggcaagggcagcuucuggagaaucgaccccgccagcgagagcaagcugaucgagcaggccuucagaaagagaagacccagaggcgugcccugcuucagaaccccccugggcccccugagcagcagaagcgcccccgccagccccaaccacgccggcgugcugagcgcccacagcagcggcgcccagacccccgagagccugagcagagagggcagccccgccccccuggagcccgagcccggcgccgcccagcccaagcuggccgugauccaggaggccagauucgcccagagcgcccccggcagcccccugagcagccagcccgugcugaucaccgugcagagacagcugccccaggccaucaagcccgugaccuacaccguggccacccccgugaccaccagcaccagccagccccccguggugcagaccgugcacguggugcaccagauccccgccgugagcgugaccagcguggccggccuggcccccgccaacaccuacaccgugagcggccaggccguggugacccccgccgccgugcuggccccccccaaggccgaggcccaggagaacggcgaccacagagaggugaaggugaagguggagcccauccccgccaucggccacgccacccugggcaccgccagcagaaucauccagaccgcccagaccacccccgugcagaccgugaccaucgugcagcaggccccccugggccagcaccagcugcccaucaagaccgugacccagaacggcacccacguggccagcgugcccaccgccgugcacggccaggugaacaacgccgccgccagcccccugcacaugcuggccacccacgccagcgccagcgccagccugcccaccaagagacacaacggcgaccagcccgagcagcccgagcugaagagaaucaagaccgaggacggcgagggcaucgugaucgcccugagcguggacaccccccccgccgccgugagagagaagggcgugcagaacuaa

SEQ ID NO: 17207 - RNA, 1038 nt, Artificial Sequence
  FOXL1__Homo_sapiens__NP_005241
augagccaccuguucgaccccagacugcccgcccuggccgccagccccaugcuguaccuguacggccccgagagacccggccugccccuggccuucgcccccgccgccgcccuggccgccagcggcagagccgagaccccccagaagccccccuacagcuacaucgcccugaucgccauggccauccaggacgcccccgagcagagagugacccugaacggcaucuaccaguucaucauggacagauuccccuucuaccacgacaacagacagggcuggcagaacagcaucagacacaaccugagccugaacgacugcuucgugaaggugcccagagagaagggcagacccggcaagggcagcuacuggacccuggaccccagaugccuggacauguucgagaacggcaacuacagaagaagaaagagaaagcccaagcccggccccggcgcccccgaggccaagagacccagagccgagacccaccagagaagcgccgaggcccagcccgaggccggcagcggcgccggcggcagcggccccgccaucagcagacugcaggccgcccccgccggccccagcccccugcuggacggccccagcccccccgccccccugcacuggcccggcaccgccagccccaacgaggacgccggcgacgccgcccagggcgccgccgccguggccgugggccaggccgccagaaccggcgacggccccggcagcccccugagacccgccagcagaagcagccccaagagcagcgacaagagcaagagcuucagcaucgacagcauccuggccggcaagcagggccagaagccccccagcggcgacgagcugcugggcggcgccaagcccggccccggcggcagacugggcgccagccugcuggccgccagcagcagccugagaccccccuucaacgccagccugaugcuggacccccacgugcagggcggcuucuaccagcugggcauccccuuccugagcuacuucccccugcaggugcccgacaccgugcugcacuuccaguaa

SEQ ID NO: 17208 - RNA, 1131 nt, Artificial Sequence
  FOXL2__Homo_sapiens__NP_075555
augauggccagcuaccccgagcccgaggacgccgccggcgcccugcuggcccccgagaccggcagaaccgugaaggagcccgagggccccccccccagccccggcaagggcggcggcggcggcggcggcaccgcccccgagaagcccgaccccgcccagaagccccccuacagcuacguggcccugaucgccauggccaucagagagagcgccgagaagagacugacccugagcggcaucuaccaguacaucaucgccaaguuccccuucuacgagaagaacaagaagggcuggcagaacagcaucagacacaaccugagccugaacgagugcuucaucaaggugcccagagagggcggcggcgagagaaagggcaacuacuggacccuggaccccgccugcgaggacauguucgagaagggcaacuacagaagaagaagaagaaugaagagacccuucagacccccccccgcccacuuccagcccggcaagggccuguucggcgccggcggcgccgccggcggcugcggcguggccggcgccggcgccgacggcuacggcuaccuggccccccccaaguaccugcagagcggcuuccugaacaacagcuggccccugccccagccccccagccccaugcccuacgccagcugccagauggccgccgccgccgccgccgccgccgccgccgccgccgccgccggccccggcagccccggcgccgccgccguggugaagggccuggccggccccgccgccagcuacggccccuacaccagagugcagagcauggcccugccccccggcguggugaacagcuacaacggccugggcggcccccccgccgccccccccccccccccccacccccacccccacccccacgcccaccaccugcacgccgccgccgcccccccccccgcccccccccaccacggcgccgccgcccccccccccggccagcugagccccgccagccccgccaccgccgccccccccgcccccgcccccaccagcgcccccggccugcaguucgccugcgccagacagcccgagcuggccaugaugcacugcagcuacugggaccacgacagcaagaccggcgcccugcacagcagacuggaccuguaa

SEQ ID NO: 17209 - RNA, 2292 nt, Artificial Sequence
  FOXM1__Homo_sapiens__NP_068772
augaagaccagccccagaagaccccugauccugaagagaagaagacugccccugcccgugcagaacgcccccagcgagaccagcgaggaggagcccaagagaagccccgcccagcaggagagcaaccaggccgaggccagcaaggagguggccgagagcaacagcugcaaguuccccgccggcaucaagaucaucaaccaccccaccaugcccaacacccaggugguggccauccccaacaacgccaacauccacagcaucaucaccgcccugaccgccaagggcaaggagagcggcagcagcggccccaacaaguucauccugaucagcugcggcggcgcccccacccagccccccggccugagaccccagacccagaccagcuacgacgccaagagaaccgaggugacccuggagacccugggccccaagcccgccgccagagacgugaaccugcccagaccccccggcgcccugugcgagcagaagagagagaccugcgccgacggcgaggccgccggcugcaccaucaacaacagccugagcaacauccaguggcugagaaagaugagcagcgacggccugggcagcagaagcaucaagcaggagauggaggagaaggagaacugccaccuggagcagagacaggugaagguggaggagcccagcagacccagcgccagcuggcagaacagcgugagcgagagaccccccuacagcuacauggccaugauccaguucgccaucaacagcaccgagagaaagagaaugacccugaaggacaucuacaccuggaucgaggaccacuuccccuacuucaagcacaucgccaagcccggcuggaagaacagcaucagacacaaccugagccugcacgacauguucgugagagagaccagcgccaacggcaaggugagcuucuggaccauccaccccagcgccaacagauaccugacccuggaccagguguucaagccccuggaccccggcagcccccagcugcccgagcaccuggagagccagcagaagagacccaaccccgagcugagaagaaacaugaccaucaagaccgagcugccccugggcgccagaagaaagaugaagccccugcugcccagagugagcagcuaccuggugcccauccaguuccccgugaaccagagccuggugcugcagcccagcgugaaggugccccugccccuggccgccagccugaugagcagcgagcuggccagacacagcaagagagugagaaucgcccccaaggugcugcuggccgaggagggcaucgccccccugagcagcgccggccccggcaaggaggagaagcugcuguucggcgagggcuucagcccccugcugcccgugcagaccaucaaggaggaggagauccagcccggcgaggagaugccccaccuggccagacccaucaagguggagagccccccccuggaggaguggcccagccccgcccccagcuucaaggaggagagcagccacagcugggaggacagcagccagagccccacccccagacccaagaagagcuacagcggccugagaagccccaccagaugcgugagcgagaugcuggugauccagcacagagagagaagagagagaagcagaagcagaagaaagcagcaccugcugccccccugcguggacgagcccgagcugcuguucagcgagggccccagcaccagcagaugggccgccgagcugcccuuccccgccgacagcagcgaccccgccagccagcugagcuacagccaggaggugggcggccccuucaagacccccaucaaggagacccugcccaucagcagcacccccagcaagagcgugcugcccagaacccccgagagcuggagacugaccccccccgccaaggugggcggccuggacuucagccccgugcagaccagccagggcgccagcgacccccugcccgacccccugggccugauggaccugagcaccaccccccugcagagcgcccccccccuggagagcccccagagacugcugagcagcgagccccuggaccugaucagcgugcccuucggcaacagcagccccagcgacaucgacgugcccaagcccggcagccccgagccccaggugagcggccuggccgccaacagaagccugaccgagggccuggugcuggacaccaugaacgacagccugagcaagauccugcuggacaucagcuuccccggccuggacgaggacccccugggccccgacaacaucaacuggagccaguucauccccgagcugcaguaa

SEQ ID NO: 17210 - RNA, 1947 nt, Artificial Sequence
  FOXN1__Homo_sapiens__XP_005258103
auggugagccugccccccccccagagcgacgugacccugcccggccccaccagacuggagggcgagagacagggcgaccugaugcaggcccccggccugcccggcagccccgccccccagagcaagcacgccggcuucagcugcagcagcuucgugagcgacggcccccccgagagaacccccagccugcccccccacagccccagaaucgccagccccggccccgagcaggugcagggccacugccccgccggccccggccccggccccuucagacugagccccagcgacaaguaccccggcuucggcuucgaggaggccgccgccagcagccccggcagauuccugaagggcagccacgcccccuuccaccccuacaagagacccuuccacgaggacguguuccccgaggccgagaccacccuggcccugaagggccacagcuucaagacccccggcccccuggaggccuucgaggagauccccguggacguggccgaggccgaggccuuccugcccggcuucagcgccgaggccuggugcaacggccugcccuaccccagccaggagcacggcccccaggugcugggcagcgaggugaaggugaagccccccgugcuggagagcggcgccggcauguucugcuaccagcccccccugcagcacauguacugcagcagccagccccccuuccaccaguacagccccggcggcggcagcuaccccauccccuaccugggcagcagccacuaccaguaccagagaauggccccccaggccagcaccgacggccaccagccccuguuccccaagcccaucuacagcuacagcauccugaucuucauggcccugaagaacagcaagaccggcagccugcccgugagcgagaucuacaacuucaugaccgagcacuuccccuacuucaagaccgcccccgacggcuggaagaacagcgugagacacaaccugagccugaacaagugcuucgagaagguggagaacaagagcggcagcagcagcagaaagggcugccugugggcccugaaccccgccaagaucgacaagaugcaggaggagcugcagaaguggaagagaaaggaccccaucgccgugagaaagagcauggccaagcccgaggagcuggacagccugaucggcgacaagagagagaagcugggcagcccccugcugggcugccccccccccggccugagcggcagcggccccaucagaccccuggccccccccgccggccugagccccccccugcacagccugcaccccgcccccggccccauccccggcaagaacccccugcaggaccugcugaugggccacacccccagcugcuacggccagaccuaccugcaccugagccccggccuggccccccccggccccccccagccccuguucccccagcccgacggccaccuggagcugagagcccagcccggcaccccccaggacagcccccugcccgcccacaccccccccagccacagcgccaagcugcuggccgagcccagccccgccagaaccaugcacgacacccugcugcccgacggcgaccugggcaccgaccuggacgccaucaaccccagccugaccgacuucgacuuccagggcaaccugugggagcagcugaaggacgacagccuggcccuggacccccuggugcuggugaccagcagccccaccagcagcagcaugccccccccccagccccccccccacugcuucccccccggccccugccugaccgagaccggcagcggcgccggcgaccuggccgcccccggcagcggcggcagcggcgcccugggcgaccugcaccugaccacccuguacagcgccuucauggagcuggagcccaccccccccaccgcccccgccggccccagcguguaccugagccccagcagcaagcccguggcccuggccuaa

SEQ ID NO: 17211 - RNA, 1296 nt, Artificial Sequence
  FOXN2__Homo_sapiens__NP_002149
augggccccgugaucggcaugacccccgacaagagagccgagacccccggcgccgagaagaucgccggccugagccagaucuacaagaugggcagccugcccgaggccguggacgccgccagacccaaggccacccugguggacagcgagagcgccgacgacgagcugaccaaccugaacuggcugcacgagagcaccaaccugcugaccaacuucagccugggcagcgagggccugcccaucgugagcccccuguacgacaucgagggcgacgacgugcccagcuucggccccgccugcuaccagaaccccgagaagaagagcgccaccagcaagccccccuacagcuucagccugcugaucuacauggccaucgagcacagccccaacaagugccugcccgugaaggagaucuacagcuggauccuggaccacuuccccuacuucgccaccgcccccaccggcuggaagaacagcgugagacacaaccugagccugaacaagugcuuccagaagguggagagaagccacggcaaggugaacggcaagggcagccuguggugcguggaccccgaguacaagcccaaccugauccaggcccugaagaagcagcccuucagcagcgccagcagccagaacggcagccugagcccccacuaccugagcagcgugaucaagcagaaccaggugagaaaccugaaggagagcgacaucgacgccgccgccgccaugaugcugcugaacaccagcaucgagcagggcauccuggagugcgagaagccccugccccugaagaccgcccugcagaagaagagaagcuacggcaacgccuuccaccaccccagcgccgugagacugcaggagagcgacagccuggccaccagcaucgaccccaaggaggaccacaacuacagcgccagcagcauggccgcccagagaugcgccagcagaagcagcgugagcagccugagcagcguggacgagguguacgaguucauccccaagaacagccacgugggcagcgacggcagcgagggcuuccacagcgaggaggacaccgacguggacuacgaggacgacccccugggcgacagcggcuacgccagccagcccugcgccaagaucagcgagaagggccagagcggcaagaagaugagaaagcagaccugccaggagaucgacgaggagcugaaggaggccgccggcagccugcugcaccuggccggcaucagaaccugccugggcagccugaucagcaccgccaagacccagaaccagaagcagagaaagaaguaa

SEQ ID NO: 17212 - RNA, 1473 nt, Artificial Sequence
  FOXN3__Homo_sapiens__NP_001078940
augggccccgugaugccccccagcaagaagcccgagagcagcggcaucagcgugagcagcggccugagccagugcuacggcggcagcggcuucagcaaggcccugcaggaggacgacgaccuggacuucagccugcccgacaucagacuggaggagggcgccauggaggacgaggagcugaccaaccugaacuggcugcacgagagcaagaaccugcugaagagcuucggcgagagcgugcugagaagcgugagccccgugcaggaccuggacgacgacaccccccccagccccgcccacagcgacaugcccuacgacgccagacagaaccccaacugcaagccccccuacagcuucagcugccugaucuucauggccaucgaggacagccccaccaagagacugcccgugaaggacaucuacaacuggauccuggagcacuuccccuacuucgccaacgcccccaccggcuggaagaacagcgugagacacaaccugagccugaacaagugcuucaagaagguggacaaggagagaagccagagcaucggcaagggcagccuguggugcaucgaccccgaguacagacagaaccugauccaggcccugaagaagacccccuaccacccccacccccacguguucaacaccccccccaccugcccccaggccuaccagagcaccagcggcccccccaucuggcccggcagcaccuucuucaagagaaacggcgcccugcugcaggaccccgacaucgacgccgccagcgccaugaugcugcugaacaccccccccgagauccaggccggcuucccccccggcgugauccagaacggcgccagagugcugagcagaggccuguuccccggcgugagaccccugcccaucacccccaucggcgugaccgccgccaugagaaacggcaucaccagcugcagaaugagaaccgagagcgagcccagcugcggcagccccguggugagcggcgaccccaaggaggaccacaacuacagcagcgccaagagcagcaacgccagaagcaccagccccaccagcgacagcaucagcagcagcagcagcagcgccgacgaccacuacgaguucgccaccaagggcagccaggagggcagcgagggcagcgagggcagcuucagaagccacgagagccccagcgacaccgaggaggacgacagaaagcacagccagaaggagcccaaggacagccugggcgacagcggcuacgccagccagcacaagaagagacagcacuucgccaaggccagaaaggugcccagcgacacccugccccugaagaagagaagaaccgagaagccccccgagagcgacgacgaggagaugaaggaggccgccggcagccugcugcaccuggccggcaucagaagcugccugaacaacaucaccaacagaaccgccaagggccagaaggagcagaaggagaccaccaagaacuaa

SEQ ID NO: 17213 - RNA, 1968 nt, Artificial Sequence
  FOXO1__Homo_sapiens__NP_002006
auggccgaggccccccaggugguggagaucgaccccgacuucgagccccugcccagacccagaagcugcaccuggccccugcccagacccgaguucagccagagcaacagcgccaccagcagccccgcccccagcggcagcgccgccgccaaccccgacgccgccgccggccugcccagcgccagcgccgccgccgugagcgccgacuucaugagcaaccugagccugcuggaggagagcgaggacuucccccaggcccccggcagcguggccgccgccguggccgccgccgccgccgccgccgccaccggcggccugugcggcgacuuccagggccccgaggccggcugccugcaccccgcccccccccagccccccccccccggcccccugagccagcacccccccgugccccccgccgccgccggcccccuggccggccagcccagaaagagcagcagcagcagaagaaacgccuggggcaaccugagcuacgccgaccugaucaccaaggccaucgagagcagcgccgagaagagacugacccugagccagaucuacgaguggauggugaagagcgugcccuacuucaaggacaagggcgacagcaacagcagcgccggcuggaagaacagcaucagacacaaccugagccugcacagcaaguucaucagagugcagaacgagggcaccggcaagagcagcugguggaugcugaaccccgagggcggcaagagcggcaagagccccagaagaagagccgccagcauggacaacaacagcaaguucgccaagagcagaagcagagccgccaagaagaaggccagccugcagagcggccaggagggcgccggcgacagccccggcagccaguucagcaaguggcccgccagccccggcagccacagcaacgacgacuucgacaacuggagcaccuucagacccagaaccagcagcaacgccagcaccaucagcggcagacugagccccaucaugaccgagcaggacgaccugggcgagggcgacgugcacagcaugguguacccccccagcgccgccaagauggccagcacccugcccagccugagcgagaucagcaaccccgagaacauggagaaccugcuggacaaccugaaccugcugagcagccccaccagccugaccgugagcacccagagcagccccggcaccaugaugcagcagacccccugcuacagcuucgccccccccaacaccagccugaacagccccagccccaacuaccagaaguacaccuacggccagagcagcaugagcccccugccccagaugcccauccagacccugcaggacaacaagagcagcuacggcggcaugagccaguacaacugcgcccccggccugcugaaggagcugcugaccagcgacagccccccccacaacgacaucaugacccccguggaccccggcguggcccagcccaacagcagagugcugggccagaacgugaugaugggccccaacagcgugaugagcaccuacggcagccaggccagccacaacaagaugaugaaccccagcagccacacccaccccggccacgcccagcagaccagcgccgugaacggcagaccccugccccacaccgugagcaccaugccccacaccagcggcaugaacagacugacccaggugaagacccccgugcaggugccccugccccaccccaugcagaugagcgcccugggcggcuacagcagcgugagcagcugcaacggcuacggcagaaugggccugcugcaccaggagaagcugcccagcgaccuggacggcauguucaucgagagacuggacugcgacauggagagcaucaucagaaacgaccugauggacggcgacacccuggacuucaacuucgacaacgugcugcccaaccagagcuucccccacagcgugaagaccaccacccacagcugggugagcggcuaa

SEQ ID NO: 17214 - RNA, 2022 nt, Artificial Sequence
  FOXO3__Homo_sapiens__NP_963853
auggccgaggcccccgccagccccgccccccugagcccccuggagguggagcuggaccccgaguucgagccccagagcagacccagaagcugcaccuggccccugcagagacccgagcugcaggccagccccgccaagcccagcggcgagaccgccgccgacagcaugauccccgaggaggaggacgacgaggacgacgaggacggcggcggcagagccggcagcgccauggccaucggcggcggcggcggcagcggcacccugggcagcggccugcugcuggaggacagcgccagagugcuggcccccggcggccaggaccccggcagcggccccgccaccgccgccggcggccugagcggcggcacccaggcccugcugcagccccagcagccccugccccccccccagcccggcgccgccggcggcagcggccagcccagaaagugcagcagcagaagaaacgccuggggcaaccugagcuacgccgaccugaucaccagagccaucgagagcagccccgacaagagacugacccugagccagaucuacgaguggauggugagaugcgugcccuacuucaaggacaagggcgacagcaacagcagcgccggcuggaagaacagcaucagacacaaccugagccugcacagcagauucaugagagugcagaacgagggcaccggcaagagcagcugguggaucaucaaccccgacggcggcaagagcggcaaggcccccagaagaagagccgugagcauggacaacagcaacaaguacaccaagagcagaggcagagccgccaagaagaaggccgcccugcagaccgcccccgagagcgccgacgacagccccagccagcugagcaaguggcccggcagccccaccagcagaagcagcgacgagcuggacgccuggaccgacuucagaagcagaaccaacagcaacgccagcaccgugagcggcagacugagccccaucauggccagcaccgagcuggacgaggugcaggacgacgacgccccccugagccccaugcuguacagcagcagcgccagccugagccccagcgugagcaagcccugcaccguggagcugcccagacugaccgacauggccggcaccaugaaccugaacgacggccugaccgagaaccugauggacgaccugcuggacaacaucacccugccccccagccagcccagccccaccggcggccugaugcagagaagcagcagcuuccccuacaccaccaagggcagcggccugggcagccccaccagcagcuucaacagcaccguguucggccccagcagccugaacagccugagacagagccccaugcagaccauccaggagaacaagcccgccaccuucagcagcaugagccacuacggcaaccagacccugcaggaccugcugaccagcgacagccugagccacagcgacgugaugaugacccagagcgacccccugaugagccaggccagcaccgccgugagcgcccagaacagcagaagaaacgugaugcugagaaacgaccccaugaugagcuucgccgcccagcccaaccagggcagccuggugaaccagaaccugcugcaccaccagcaccagacccagggcgcccugggcggcagcagagcccugagcaacagcgugagcaacaugggccugagcgagagcagcagccugggcagcgccaagcaccagcagcagagccccgugagccagagcaugcagacccugagcgacagccugagcggcagcagccuguacagcaccagcgccaaccugcccgugaugggccacgagaaguuccccagcgaccuggaccuggacauguucaacggcagccuggagugcgacauggagagcaucaucagaagcgagcugauggacgccgacggccuggacuucaacuucgacagccugaucagcacccagaacguggugggccugaacgugggcaacuucaccggcgccaagcaggccagcagccagagcugggugcccggcuaa

SEQ ID NO: 17215 - RNA, 1353 nt, Artificial Sequence
  FOXO4__Homo_sapiens__NP_001164402
auggaccccggcaacgagaacagcgccaccgaggccgccgccaucaucgaccuggaccccgacuucgagccccagagcagacccagaagcugcaccuggccccugcccagacccgagaucgccaaccagcccagcgagccccccgagguggagcccgaccugggcgagaaggccaucgagagcgcccccgagaagagacugacccuggcccagaucuacgaguggauggugagaaccgugcccuacuucaaggacaagggcgacagcaacagcagcgccggcuggaagaacagcaucagacacaaccugagccugcacagcaaguucaucaaggugcacaacgaggccaccggcaagagcagcugguggaugcugaaccccgagggcggcaagagcggcaaggcccccagaagaagagccgccagcauggacagcagcagcaagcugcugagaggcagaagcaaggcccccaagaagaagcccagcgugcugcccgccccccccgagggcgccacccccaccagccccgugggccacuucgccaaguggagcggcagccccugcagcagaaacagagaggaggccgacauguggaccaccuucagacccagaagcagcagcaacgccagcagcgugagcaccagacugagcccccugagacccgagagcgaggugcuggccgaggagauccccgccagcgugagcagcuacgccggcggcgugccccccacccugaacgagggccuggagcugcuggacggccugaaccugaccagcagccacagccugcugagcagaagcggccugagcggcuucagccugcagcaccccggcgugaccggcccccugcacaccuacagcagcagccuguucagccccgccgagggcccccugagcgccggcgagggcugcuucagcagcagccaggcccuggaggcccugcugaccagcgacaccccccccccccccgccgacgugcugaugacccagguggaccccauccugagccaggcccccacccugcugcugcugggcggccugcccagcagcagcaagcuggccaccggcgugggccugugccccaagccccuggaggcccccggccccagcagccuggugcccacccugagcaugaucgcccccccccccgugauggccagcgcccccauccccaaggcccugggcacccccgugcugaccccccccaccgaggccgccagccaggacagaaugccccaggaccuggaccuggacauguacauggagaaccuggagugcgacauggacaacaucaucagcgaccugauggacgagggcgagggccuggacuucaacuucgagcccgaccccuaa

SEQ ID NO: 17216 - RNA, 1680 nt, Artificial Sequence
  FOXO6__Homo_sapiens__NP_001278210
auggccgccaagcugagagcccaccagguggacguggaccccgacuucgccccccagagcagacccagaagcugcaccuggccccugccccagcccgaccuggccggcgacgaggacggcgcccugggcgccggcguggccgagggcgccgaggacugcggccccgagagaagagccaccgcccccgccauggcccccgcccccccccugggcgccgaggugggcccccugagaaaggccaagagcagcagaagaaacgccuggggcaaccugagcuacgccgaccugaucaccaaggccaucgagagcgcccccgacaagagacugacccugagccagaucuacgacuggauggugagauacgugcccuacuucaaggacaagggcgacagcaacagcagcgccggcuggaagaacagcaucagacacaaccugagccugcacaccagauucaucagagugcagaacgagggcaccggcaagagcagcugguggaugcugaaccccgagggcggcaagaccggcaagacccccagaagaagagccgugagcauggacaacggcgccaaguuccugagaaucaagggcaaggccagcaagaagaagcagcugcaggcccccgagagaagccccgacgacagcagccccagcgcccccgcccccggccccgugcccgccgccgccaagugggccgccagccccgccagccacgccagcgacgacuacgaggccugggccgacuucagaggcggcggcagaccccugcugggcgaggccgccgagcuggaggacgacgaggcccuggaggcccuggcccccagcagcccccugauguaccccagccccgccagcgcccugagccccgcccugggcagcagaugccccggcgagcugcccagacuggccgagcugggcggcccccugggccugcacggcggcggcggcgccggccugcccgagggccugcuggacggcgcccaggacgccuacggccccagagccagagccggcacccccgccuacuucggcggcugcaagggcggcgccuacggcggcggcggcggcuucggcccccccgccaugggcgcccugagaagacugcccaugcagaccauccaggagaacaagcaggccagcuucgugcccgccgccgcccccuucagacccggcgcccugcccgcccugcugcccccccccccccccgcccccagacccggccccgugcugggcgcccccggcgagcuggcccuggccggcgccgccgccgccuaccccggcaagggcgccgcccccuacgccccccccgcccccagcagaagcgcccuggcccaccccaucagccugaugacccugcccggcgaggccggcgccgccggccuggcccccagcggccacgccgccgccuucggcggcccccccggcggccugcugcuggacgcccugcccggccccuacgccgccgccgccgccggcccccugggcgccgcccccgacagauuccccgccgaccuggaccuggacauguucagcggcagccuggagugcgacguggagagcaucauccugaacgacuucauggacagcgacgagauggacuucaacuucgacagcgcccugcccccccccccccccggccuggccggcgcccccccccccaaccagagcugggugcccggcuaa

SEQ ID NO: 17217 - RNA, 345 nt, Artificial Sequence
  FOXP1__Homo_sapiens__NP_001012523
augaugcaggagagcggcaccgagaccaagagcaacggcagcgccauccagaacggcagcggcggcagcaaccaccugcuggagugcggcggccugagagagggcagaagcaacggcgagacccccgccguggacaucggcgccgccgaccuggcccacgcccagcagcagcagcagcaguggcaccugaucaaccaccagcccagcagaagccccagcagcuggcugaagagacugaucagcagccccugggagcuggaggugcugcaggugccccuguggggcgccguggccgagaccaagaugagcggccccgugugccagcccaaccccagccccuucuaa

SEQ ID NO: 17218 - RNA, 2145 nt, Artificial Sequence
  FOXP2__Homo_sapiens__NP_001166237
augaugcaggagagcgccaccgagaccaucagcaacagcagcaugaaccagaacggcaugagcacccugagcagccagcuggacgccggcagcagagacggcagaagcagcggcgacaccagcagcgaggugagcaccguggagcugcugcaccugcagcagcagcaggcccugcaggccgccagacagcugcugcugcagcagcagaccagcggccugaagagccccaagagcagcgacaagcagagaccccugcaggugcccgugagcguggccaugaugaccccccaggugaucaccccccagcagaugcagcagauccugcagcagcaggugcugagcccccagcagcugcaggcccugcugcagcagcagcaggccgugaugcugcagcagcagcagcugcaggaguucuacaagaagcagcaggagcagcugcaccugcagcugcugcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcuggccgcccagcagcugguguuccagcagcagcugcugcagaugcagcagcugcagcagcagcagcaccugcugagccugcagagacagggccugaucagcaucccccccggccaggccgcccugcccgugcagagccugccccaggccggccugagccccgccgagauccagcagcuguggaaggaggugaccggcgugcacagcauggaggacaacggcaucaagcacggcggccuggaccugaccaccaacaacagcagcagcaccaccagcagcaacaccagcaaggccagcccccccaucacccaccacagcaucgugaacggccagagcagcgugcugagcgccagaagagacagcagcagccacgaggagaccggcgccagccacacccuguacggccacggcgugugcaaguggcccggcugcgagagcaucugcgaggacuucggccaguuccugaagcaccugaacaacgagcacgcccuggacgacagaagcaccgcccagugcagagugcagaugcagguggugcagcagcuggagauccagcugagcaaggagagagagagacugcaggccaugaugacccaccugcacaugagacccagcgagcccaagcccagccccaagccccugaaccuggugagcagcgugaccaugagcaagaacaugcuggagaccagcccccagagccugccccagacccccaccacccccaccgcccccgugacccccaucacccagggccccagcgugaucacccccgccagcgugcccaacgugggcgccaucagaagaagacacagcgacaaguacaacauccccaugagcagcgagaucgcccccaacuacgaguucuacaagaacgccgacgugagaccccccuucaccuacgccacccugaucagacaggccaucauggagagcagcgacagacagcugacccugaacgagaucuacagcugguucaccagaaccuucgccuacuucagaagaaacgccgccaccuggaagaacgccgugagacacaaccugagccugcacaagugcuucgugagaguggagaacgugaagggcgccguguggaccguggacgagguggaguaccagaagagaagaagccagaagaucaccggcagccccacccuggugaagaacauccccaccagccugggcuacggcgccgcccugaacgccagccugcaggccgcccuggccgagagcagccugccccugcugagcaaccccggccugaucaacaacgccagcagcggccugcugcaggccgugcacgaggaccugaacggcagccuggaccacaucgacagcaacggcaacagcagccccggcugcagcccccagccccacauccacagcauccacgugaaggaggagcccgugaucgccgaggacgaggacugccccaugagccuggugaccaccgccaaccacagccccgagcuggaggacgacagagagaucgaggaggagccccugagcgaggaccuggaguaa

SEQ ID NO: 17219 - RNA, 1191 nt, Artificial Sequence
  FOXP3__Homo_sapiens__NP_001107849
augcccaaccccagacccggcaagcccagcgcccccagccuggcccugggccccagccccggcgccagccccagcuggagagccgcccccaaggccagcgaccugcugggcgccagaggccccggcggcaccuuccagggcagagaccugagaggcggcgcccacgccagcagcagcagccugaaccccaugccccccagccagcugcagcugagcaccguggacgcccacgccagaacccccgugcugcaggugcacccccuggagagccccgccaugaucagccugaccccccccaccaccgccaccggcguguucagccugaaggccagacccggccugccccccggcaucaacguggccagccuggagugggugagcagagagcccgcccugcugugcaccuuccccaaccccagcgcccccagaaaggacagcacccugagcgccgugccccagagcagcuacccccugcuggccaacggcgugugcaaguggcccggcugcgagaagguguucgaggagcccgaggacuuccugaagcacugccaggccgaccaccugcuggacgagaagggcagagcccagugccugcugcagagagagauggugcagagccuggagcagcagcuggugcuggagaaggagaagcugagcgccaugcaggcccaccuggccggcaagauggcccugaccaaggccagcagcguggccagcagcgacaagggcagcugcugcaucguggccgccggcagccagggccccguggugcccgccuggagcggccccagagaggcccccgacagccuguucgccgugagaagacaccuguggggcagccacggcaacagcaccuuccccgaguuccugcacaacauggacuacuucaaguuccacaacaugagaccccccuucaccuacgccacccugaucagaugggccauccuggaggcccccgagaagcagagaacccugaacgagaucuaccacugguucaccagaauguucgccuucuucagaaaccaccccgccaccuggaagaacgccaucagacacaaccugagccugcacaagugcuucgugagaguggagagcgagaagggcgccguguggaccguggacgagcuggaguucagaaagaagagaagccagagacccagcagaugcagcaaccccacccccggccccuaa

SEQ ID NO: 17220 - RNA, 2043 nt, Artificial Sequence
  FOXP4__Homo_sapiens__NP_001012426
augaugguggagagcgccagcgagaccaucagaagcgcccccagcggccagaacggcgugggcagccugagcggccaggccgacggcagcagcggcggcgccaccggcaccaccgccagcggcaccggcagagaggugaccaccggcgccgacagcaacggcgagaugagccccgccgagcugcugcacuuccagcagcagcaggcccugcagguggccagacaguuccugcugcagcaggccagcggccugagcagccccggcaacaacgacagcaagcagagcgccagcgccgugcaggugcccgugagcguggccaugaugagcccccagaugcugaccccccagcagaugcagcagauccugagccccccccagcugcaggcccugcugcagcagcagcaggcccugaugcugcagcagcugcaggaguacuacaagaagcagcaggagcagcugcaccugcagcugcugacccagcagcaggccggcaagccccagcccaaggaggcccugggcaacaagcagcuggccuuccagcagcagcugcugcagaugcagcagcugcagcagcagcaccugcugaaccugcagagacagggccuggugagccugcagcccaaccaggccagcggcccccugcagacccugccccaggccgccgugugccccaccgaccugccccagcuguggaagggcgagggcgcccccggccagcccgccgaggacagcgugaagcaggagggccuggaccugaccggcaccgccgccaccgccaccagcuucgccgccccccccaaggugagccccccccugagccaccacacccugcccaacggccagcccaccgugcugaccagcagaagagacagcagcagccacgaggagacccccggcagccacccccuguacggccacggcgagugcaaguggcccggcugcgagacccugugcgaggaccugggccaguucaucaagcaccugaacaccgagcacgcccuggacgacagaagcaccgcccagugcagagugcagaugcagguggugcagcagcuggagauccagcuggccaaggagagcgagagacugcaggccaugauggcccaccugcacaugagacccagcgagcccaagcccuucagccagccccugaaccccgugcccggcagcagcagcuucagcaaggugaccgugagcgccgccgacagcuuccccgacggccuggugcacccccccaccagcgccgccgcccccgugaccccccugagaccccccggccugggcagcgccagccugcacggcggcggccccgccagaagaagaagcagcgacaaguucugcagccccaucagcagcgagcuggcccagaaccacgaguucuacaagaacgccgacgugagaccccccuucaccuacgccagccugaucagacaggccauccuggagacccccgacagacagcugacccugaacgagaucuacaacugguucaccagaauguucgccuacuucagaagaaacaccgccaccuggaagaacgccgugagacacaaccugagccugcacaagugcuucgugagaguggagaacgugaagggcgccguguggaccguggacgagagagaguaccagaagagaagaccccccaagaugaccggcagccccacccuggugaagaacaugaucagcggccugagcuacggcgcccugaacgccagcuaccaggccgcccuggccgagagcagcuucccccugcugaacagccccggcaugcugaaccccggcagcgccagcagccugcugccccugagccacgacgacgugggcgcccccguggagccccugcccagcaacggcagcagcagcccccccagacugagccccccccaguacagccaccaggugcaggugaaggaggagcccgccgaggccgaggaggacagacagcccggccccccccugggcgcccccaaccccagcgccagcggcccccccgaggacagagaccuggaggaggagcugcccggcgaggagcugagcuaa

SEQ ID NO: 17221 - RNA, 1212 nt, Artificial Sequence
  FOXQ1__Homo_sapiens__NP_150285
augaagcuggagguguucgugcccagagccgcccacggcgacaagcagggcagcgaccuggagggcgccggcggcagcgacgcccccagcccccugagcgccgccggcgacgacagccugggcagcgacggcgacugcgccgccaacagccccgccgccggcggcggcgccagagacacccagggcgacggcgagcagagcgccggcggcggccccggcgccgaggaggccauccccgccgccgccgccgccgccgugguggccgagggcgccgaggccggcgccgccggccccggcgccggcggcgccggcagcggcgagggcgccagaagcaagcccuacaccagaagacccaagccccccuacagcuacaucgcccugaucgccauggccaucagagacagcgccggcggcagacugacccuggccgagaucaacgaguaccugaugggcaaguuccccuucuucagaggcagcuacaccggcuggagaaacagcgugagacacaaccugagccugaacgacugcuucgugaaggugcugagagaccccagcagacccuggggcaaggacaacuacuggaugcugaaccccaacagcgaguacaccuucgccgacggcguguucagaagaagaagaaagagacugagccacagagcccccgugcccgcccccggccugagacccgaggaggcccccggccugcccgccgcccccccccccgcccccgccgcccccgccagccccagaaugagaagccccgccagacaggaggagagagccagccccgccggcaaguucagcagcagcuucgccaucgacagcauccugagaaagcccuucagaagcagaagacugagagacaccgcccccggcaccacccugcaguggggcgccgcccccugccccccccugcccgccuuccccgcccugcugcccgccgcccccugcagagcccugcugccccugugcgccuacggcgccggcgagcccgccagacugggcgccagagaggccgaggugccccccaccgcccccccccugcugcuggccccccugcccgccgccgcccccgccaagccccugagaggccccgccgccggcggcgcccaccuguacugcccccugagacugcccgccgcccugcaggccgccagcgugagaagacccggcccccaccugcccuaccccguggagacccugcuggccuaa

SEQ ID NO: 17222 - RNA, 879 nt, Artificial Sequence
  FOXR1__Homo_sapiens__NP_859072
augggcaacgagcuguuccuggccuucaccaccagccaccugccccuggccgagcagaagcuggccagauacaagcugagaaucgugaagccccccaagcugccccuggagaagaagcccaaccccgacaaggacggccccgacuacgagcccaaccuguggaugugggugaaccccaacaucguguacccccccggcaagcuggaggugagcggcagaagaaagagagaggaccugaccagcacccugcccagcagccagcccccccagaaggaggaggacgccagcugcagcgaggccgccggcguggagagccugagccagagcagcagcaagagaagcccccccagaaagagauucgccuucagccccagcaccugggagcugaccgaggaggaggaggccgaggaccaggaggacagcagcagcauggcccugcccagcccccacaagagagccccccugcagagcagaagacugagacaggccagcagccaggccggcagacuguggagcagacccccccugaacuacuuccaccugaucgcccuggcccugagaaacagcagccccugcggccugaacgugcagcagaucuacagcuucaccagaaagcacuuccccuucuucagaaccgcccccgagggcuggaagaacaccgugagacacaaccugugcuucagagacagcuucgagaaggugcccgugagcaugcagggcggcgccagcaccagacccagaagcugccuguggaagcugaccgaggagggccacagaagauucgccgaggaggccagagcccuggccagcaccagacuggagagcauccagcagugcaugagccagcccgacgugaugcccuuccuguucgaccuguaa

SEQ ID NO: 17223 - RNA, 936 nt, Artificial Sequence
  FOXR2__Homo_sapiens__NP_940853
auggaccugaagcugaaggacugcgaguucugguacagccugcacggccaggugcccggccugcuggacugggacaugagaaacgagcuguuccugcccugcaccaccgaccagugcagccuggccgagcagauccuggccaaguacagagugggcgugaugaagccccccgagaugccccagaagagaagacccagccccgacggcgacggcccccccugcgagcccaaccuguggauguggguggaccccaacauccugugcccccugggcagccaggaggcccccaagcccagcggcaaggaggaccugaccaacaucagccccuucccccagcccccccagaaggacgagggcagcaacugcagcgaggacaaggugguggagagccugcccagcagcagcagcgagcagagcccccugcagaagcagggcauccacagccccagcgacuucgagcugaccgaggaggaggccgaggagcccgacgacaacagccugcagagccccgagaugaagugcuaccagagccagaagcuguggcagaucaacaaccaggagaagagcuggcagagacccccccugaacugcagccaccugaucgcccuggcccugagaaacaacccccacugcggccugagcgugcaggagaucuacaacuucaccagacagcacuuccccuucuucuggaccgcccccgacggcuggaagagcaccauccacuacaaccugugcuuccuggacagcuucgagaaggugcccgacagccugaaggacgaggacaacgccagacccagaagcugccuguggaagcugaccaaggagggccacagaagauucugggaggagaccagagugcuggccuucgcccagagagagagaauccaggagugcaugagccagcccgagcugcugaccagccuguucgaccuguaa

SEQ ID NO: 17224 - RNA, 1461 nt, Artificial Sequence
  FOXRED1__Homo_sapiens__NP_060017
augaucagaagagugcugccccacggcaugggcagaggccugcugaccagaagacccggcaccagaagaggcggcuucagccuggacugggacggcaaggugagcgagaucaagaagaagaucaagagcauccugcccggcagaagcugcgaccugcugcaggacaccagccaccugccccccgagcacagcgacguggugaucgugggcggcggcgugcugggccugagcguggccuacuggcugaagaagcuggagagcagaagaggcgccaucagagugcuggugguggagagagaccacaccuacagccaggccagcaccggccugagcgugggcggcaucugccagcaguucagccugcccgagaacauccagcugagccuguucagcgccagcuuccugagaaacaucaacgaguaccuggccgugguggacgcccccccccuggaccugagauucaaccccagcggcuaccugcugcuggccagcgagaaggacgccgccgccauggagagcaacgugaaggugcagagacaggagggcgccaaggugagccugaugagccccgaccagcugagaaacaaguuccccuggaucaacaccgagggcguggcccuggccagcuacggcauggaggacgagggcugguucgaccccuggugccugcugcagggccugagaagaaaggugcagagccugggcgugcuguucugccagggcgaggugaccagauucgugagcagcagccagagaaugcugaccaccgacgacaaggccguggugcugaagagaauccacgaggugcacgugaagauggacagaagccuggaguaccagcccguggagugcgccaucgugaucaacgccgccggcgccuggagcgcccagaucgccgcccuggccggcgugggcgagggcccccccggcacccugcagggcaccaagcugcccguggagcccagaaagagauacguguacguguggcacugcccccagggccccggccuggagaccccccugguggccgacaccagcggcgccuacuucagaagagagggccugggcagcaacuaccugggcggcagaagccccaccgagcaggaggagcccgaccccgccaaccuggagguggaccacgacuucuuccaggacaagguguggccccaccuggcccugagagugcccgccuucgagacccugaaggugcagagcgccugggccggcuacuacgacuacaacaccuucgaccagaacggcguggugggcccccacccccugguggugaacauguacuucgccaccggcuucagcggccacggccugcagcaggcccccggcaucggcagagccguggccgagauggugcugaagggcagauuccagaccaucgaccugagccccuuccuguucaccagauucuaccugggcgagaagauccaggagaacaacaucaucuaa

SEQ ID NO: 17225 - RNA, 1686 nt, Artificial Sequence
  FPGS__Homo_sapiens__NP_001275732
augagcagagccagaagccaccugagagccgcccuguuccuggccgccgccagcgccagaggcaucaccacccagguggccgccagaagaggccugagcgccuggcccgugccccaggagcccagcauggaguaccaggacgccgugagaaugcugaacacccugcagaccaacgccggcuaccuggagcaggugaagagacagagaggcgacccccagacccagcuggaggccauggagcuguaccuggccagaagcggccugcagguggaggaccuggacagacugaacaucauccacgugaccggcaccaagggcaagggcagcaccugcgccuucaccgagugcauccugagaagcuacggccugaagaccggcuucuucagcagcccccaccuggugcaggugagagagagaaucagaaucaacggccagcccaucagccccgagcuguucaccaaguacuucuggagacuguaccacagacuggaggagaccaagguggaccuggccgugguggaggugggcaucggcggcgccuacgacugcaccaacaucaucagaaagcccguggugugcggcgugagcagccugggcaucgaccacaccagccugcugggcgacaccguggagaagaucgccuggcagaagggcggcaucuucaagcagggcgugcccgccuucaccgugcugcagcccgagggcccccuggccgugcugagagacagagcccagcagaucagcugcccccuguaccugugccccaugcuggaggcccuggaggagggcggccccccccugacccugggccuggagggcgagcaccagagaagcaacgccgcccuggcccugcagcuggcccacugcuggcugcagagacaggacagacacggcgccggcgagcccaaggccagcagacccggccugcuguggcagcugccccuggcccccguguuccagcccaccagccacaugagacugggccugagaaacaccgaguggcccggcagaacccaggugcugagaagaggcccccugaccugguaccuggacggcgcccacaccgccagcagcgcccaggccugcgugagaugguucagacaggcccugcagggcagagagagacccagcggcggccccgaggugagagugcugcuguucaacgccaccggcgacagagaccccgccgcccugcugaagcugcugcagcccugccaguucgacuacgccguguucugccccaaccugaccgaggugagcagcaccggcaacgccgaccagcagaacuucaccgugacccuggaccaggugcugcugagaugccuggagcaccagcagcacuggaaccaccuggacgaggagcaggccagccccgaccuguggagcgcccccagccccgagcccggcggcagcgccagccugcugcuggccccccaccccccccacaccugcagcgccagcagccugguguucagcugcaucagccacgcccugcaguggaucagccagggcagagaccccaucuuccagccccccagcccccccaagggccugcugacccaccccguggcccacagcggcgccagcauccugagagaggccgccgccauccacgugcuggugaccggcagccugcaccuggugggcggcgugcugaagcugcuggagcccgcccugagccaguaa

SEQ ID NO: 17226 - RNA, 1053 nt, Artificial Sequence
  FPR1__Homo_sapiens__NP_001180235
auggagaccaacagcagccugcccaccaacaucagcggcggcacccccgccgugagcgccggcuaccuguuccuggacaucaucaccuaccugguguucgccgugaccuucgugcugggcgugcugggcaacggccuggugaucuggguggccggcuucagaaugacccacaccgugaccaccaucagcuaccugaaccuggccguggccgacuucugcuucaccagcacccugcccuucuucauggugagaaaggccaugggcggccacuggcccuucggcugguuccugugcaaguucguguucaccaucguggacaucaaccuguucggcagcguguuccugaucgcccugaucgcccuggacagaugcgugugcgugcugcaccccguguggacccagaaccacagaaccgugagccuggccaagaaggugaucaucggccccugggugauggcccugcugcugacccugcccgugaucaucagagugaccaccgugcccggcaagaccggcaccguggccugcaccuucaacuucagccccuggaccaacgaccccaaggagagaaucaacguggccguggccaugcugaccgugagaggcaucaucagauucaucaucggcuucagcgcccccaugagcaucguggccgugagcuacggccugaucgccaccaagauccacaagcagggccugaucaagagcagcagaccccugagagugcugagcuucguggccgccgccuucuuccugugcuggagccccuaccaggugguggcccugaucgccaccgugagaaucagagagcugcugcagggcauguacaaggagaucggcaucgccguggacgugaccagcgcccuggccuucuucaacagcugccugaaccccaugcuguacguguucaugggccaggacuucagagagagacugauccacgcccugcccgccagccuggagagagcccugaccgaggacagcacccagaccagcgacaccgccaccaacagcacccugcccagcgccgagguggagcugcaggccaaguaa

SEQ ID NO: 17227 - RNA, 1056 nt, Artificial Sequence
  FPR2__Homo_sapiens__XP_006723183
auggagaccaacuucagcaccccccugaacgaguacgaggaggugagcuacgagagcgccggcuacaccgugcugagaauccugccccugguggugcugggcgugaccuucgugcugggcgugcugggcaacggccuggugaucuggguggccggcuucagaaugaccagaaccgugaccaccaucugcuaccugaaccuggcccuggccgacuucagcuucaccgccacccugcccuuccugaucgugagcauggccaugggcgagaaguggcccuucggcugguuccugugcaagcugauccacaucgugguggacaucaaccuguucggcagcguguuccugaucggcuucaucgcccuggacagaugcaucugcgugcugcaccccgugugggcccagaaccacagaaccgugagccuggccaugaaggugaucgugggccccuggauccuggcccuggugcugacccugcccguguuccuguuccugaccaccgugaccauccccaacggcgacaccuacugcaccuucaacuucgccagcuggggcggcacccccgaggagagacugaagguggccaucaccaugcugaccgccagaggcaucaucagauucgugaucggcuucagccugcccaugagcaucguggccaucugcuacggccugaucgccgccaagauccacaagaagggcaugaucaagagcagcagaccccugagagugcugaccgccgugguggccagcuucuucaucugcugguuccccuuccagcugguggcccugcugggcaccguguggcugaaggagaugcuguucuacggcaaguacaagaucaucgacauccuggugaaccccaccagcagccuggccuucuucaacagcugccugaaccccaugcuguacguguucgugggccaggacuucagagagagacugauccacagccugcccaccagccuggagagagcccugagcgaggacagcgcccccaccaacgacaccgccgccaacagcgccagcccccccgccgagaccgagcugcaggccauguaa

SEQ ID NO: 17228 - RNA, 1062 nt, Artificial Sequence
  FPR3__Homo_sapiens__NP_002021
auggagaccaacuucagcaucccccugaacgagaccgaggaggugcugcccgagcccgccggccacaccgugcuguggaucuucagccugcuggugcacggcgugaccuucguguucggcgugcugggcaacggccuggugaucuggguggccggcuucagaaugaccagaaccgugaacaccaucugcuaccugaaccuggcccuggccgacuucagcuucagcgccauccugcccuucagaauggugagcguggccaugagagagaaguggcccuucggcagcuuccugugcaagcuggugcacgugaugaucgacaucaaccuguucgugagcguguaccugaucaccaucaucgcccuggacagaugcaucugcgugcugcaccccgccugggcccagaaccacagaaccaugagccuggccaagagagugaugaccggccuguggaucuucaccaucgugcugacccugcccaacuucaucuucuggaccaccaucagcaccaccaacggcgacaccuacugcaucuucaacuucgccuucuggggcgacaccgccguggagagacugaacguguucaucaccauggccaagguguuccugauccugcacuucaucaucggcuucagcgugcccaugagcaucaucaccgugugcuacggcaucaucgccgccaagauccacagaaaccacaugaucaagagcagcagaccccugagaguguucgccgccgugguggccagcuucuucaucugcugguuccccuacgagcugaucggcauccugauggccguguggcugaaggagaugcugcugaacggcaaguacaagaucauccuggugcugaucaaccccaccagcagccuggccuucuucaacagcugccugaaccccauccuguacguguucaugggcagaaacuuccaggagagacugaucagaagccugcccaccagccuggagagagcccugaccgaggugcccgacagcgcccagaccagcaacaccgacaccaccagcgccagcccccccgaggagaccgagcugcaggccauguaa

SEQ ID NO: 17229 - RNA, 5931 nt, Artificial Sequence
  FRAS1__Homo_sapiens__NP_001159605
augggcgugcugaagguguggcugggccuggcccuggcccuggccgaguucgccgugcugccccaccacagcgagggcgccugcguguaccaggacagccugcuggccgacgccaccaucuggaagcccgacagcugccagagcugcagaugccacggcgacaucgugaucugcaagcccgccgugugcagaaacccccagugcgccuucgagaagggcgaggugcugcagaucgccgccaaccagugcugccccgagugcgugcugagaacccccggcagcugccaccacgagaagaagauccacgagcacggcaccgagugggccagcagccccugcagcgugugcagcugcaaccacggcgaggugagaugcaccccccagcccugccccccccugagcugcggccaccaggagcuggccuucauccccgagggcagcugcugccccgugugcgugggccugggcaagcccugcagcuacgagggccacguguuccaggacggcgaggacuggagacugagcagaugcgccaagugccugugcagaaacggcguggcccagugcuucaccgcccagugccagccccuguucugcaaccaggacgagaccguggugagagugcccggcaagugcugcccccagugcagcgccagaagcugcagcgccgccggccagguguacgagcacggcgagcaguggagcgagaacgccugcaccaccugcaucugcgacagaggcgaggugagaugccacaagcaggccugccugccccugagaugcggcaagggccagagcagagccagaagacacggccagugcugcgaggagugcgugagccccgccggcagcugcagcuacgacggcguggugagauaccaggacgagauguggaagggcagcgccugcgaguucugcaugugcgaccacggccaggugaccugccagaccggcgagugcgccaagguggagugcgccagagacgaggagcugauccaccuggacggcaagugcugccccgagugcaucagcagaaacggcuacugcguguacgaggagaccggcgaguucaugagcagcaacgccagcgaggugaagagaauccccgagggcgagaagugggaggacggccccugcaaggugugcgagugcagaggcgcccaggugaccugcuacgagcccagcugcccccccugccccgugggcacccuggcccuggaggugaagggccagugcugccccgacugcaccagcgugcacugccaccccgacugccugaccugcagccagagccccgaccacugcgaccugugccaggaccccaccaagcugcugcagaacggcuggugcgugcacagcugcggccugggcuucuaccaggccggcagccugugccuggccugccagccccagugcagcaccugcaccagcggccuggagugcagcagcugccagcccccccugcugaugagacacggccagugcgugcccaccugcggcgacggcuucuaccaggacagacacagcugcgccgugugccacgagagcugcgccggcugcuggggccccaccgagaagcacugccuggccugcagagacccccugcacgugcugagagacggcggcugcgagagcagcugcggcaagggcuucuacaacagacagggcaccugcagcgccugcgaccagagcugcgacagcugcggccccagcagccccagaugccugaccugcaccgagaagaccgugcugcacgacggcaagugcaugagcgagugccccggcggcuacuacgccgacgccaccggcagaugcaaggugugccacaacagcugcgccagcugcagcggccccacccccagccacugcaccgccugcagcccccccaaggcccugagacagggccacugccugcccagaugcggcgagggcuucuacagcgaccacggcgugugcaaggccugccacagcagcugccuggccugcaugggccccgcccccagccacugcaccggcugcaagaagcccgaggagggccugcagguggagcagcugagcgacgugggcauccccagcggcgagugccuggcccagugcagagcccacuucuaccuggagagcaccggcaucugcgaggccugccaccagagcugcuucagaugcgccggcaagagcccccacaacugcaccgacugcggccccagccacgugcugcuggacggccagugccugagccagugccccgacggcuacuuccaccaggagggcagcugcaccgagugccaccccaccugcagacagugccacggcccccuggagagcgacugcaucagcugcuacccccacaucagccugaccaacggcaacugcagaaccagcugcagagaggagcaguuccugaaccuggugggcuacugcgccgacugccaccaccugugccagcacugcgccgccgaccugcacaacaccggcagcaucugccugagaugccagaacgcccacuaccugcugcugggcgaccacugcgugcccgacugccccagcggcuacuacgccgagagaggcgccugcaagaagugccacagcagcugcagaaccugccagggcagaggccccuucagcugcagcagcugcgacaccaaccuggugcugagccacaccggcaccugcagcaccaccugcuuccccggccacuaccuggacgacaaccacgugugccagcccugcaacacccacugcggcagcugcgacagccaggccagcugcaccagcugcagagaccccaacaaggugcugcuguucggcgagugccaguacgagagcugcgccccccaguacuaccuggacuucagcaccaacaccugcaaggagugcgacuggagcugcagcgccugcagcggcccccugaagaccgacugccugcagugcauggacggcuacgugcugcaggacggcgccugcguggagcagugccugagcagcuucuaccaggacagcggccugugcaagaacugcgacagcuacugccugcagugccagggcccccacgagugcaccagaugcaagggccccuuccugcugcuggaggcccagugcgugcaggagugcggcaagggcuacuucgccgaccacgccaagcacaagugcaccgccugcccccagggcugccugcagugcagccacagagacagaugccaccugugcgaccacggcuucuuccugaagagcggccugugcguguacaacugcgugcccggcuucagcgugcacaccagcaacgagaccugcagcggcaagauccacacccccagccugcacgugaacggcagccugauccugcccaucggcagcaucaagccccuggacuucagccugcugaacgugcaggaccaggagggcagaguggaggaccugcuguuccacguggugagcacccccaccaacggccagcuggugcugagcagaaacggcaaggaggugcagcuggacaaggccggcagauucagcuggaaggacgugaacgagaagaaggugagauucgugcacagcaaggagaagcugagaaagggcuaccuguuccugaagaucagcgaccagcaguucuucagcgagccccagcugaucaacauccaggccuucagcacccaggcccccuacgugcugagaaacgaggugcugcacaucagcagaggcgagagagccaccaucaccacccagaugcuggacaucagagacgacgacaacccccaggacguggugaucgagaucaucgaccccccccugcacggccagcugcugcagacccugcagagccccgccacccccaucuaccaguuccagcuggacgagcugagcagaggccugcugcacuacgcccacgacggcagcgacagcaccagcgacguggccgugcugcaggccaacgacggccacagcuuccacaacauccuguuccaggugaagaccgugccccagaacgacagaggccugcagcugguggccaacagcauggugugggugcccgagggcggcaugcugcagaucaccaacagaauccugcaggccgaggcccccggcgccagcgccgaggagaucaucuacaagaucacccaggacuacccccaguucggcgagguggugcugcuggugaacaugcccgccgacagccccgccgacgagggccagcaccugcccgacggcagaaccgccacccccaccagcaccuucacccagcaggacaucaacgagggcaucgugugguacagacacagcggcgcccccgcccagagcgacagcuucagauucgaggugagcagcgccagcaacgcccagaccagacuggagagccacauguucaacaucgccauccugccccagacccccgaggcccccaaggugagccuggaggccagccugcacaugaccgccagagaggacggccugaccgugauccagccccacagccugagcuucaucaacagcgagaagcccagcggcaagaucguguacaacaucacccugccccugcaccccaaccagggcaucaucgagcacagagaccacccccacagccccaucagauacuucacccaggaggacaucaaccagggcaaggugauguacagacccccccccgccgccccccaccugcaggagcugauggccuucagcuucgccggccugcccgagagcgugaaguuccacuucaccgugagcgacggcgagcacaccagccccgagauggugcugaccauccaccugcugcccagcgaccagcagcugcccguguuccaggugaccgcccccagacuggccgugagccccggcggcagcaccagcgugggccugcaggugguggugagagacgccgagaccgcccccaaggagcuguucuucgagcugagaagacccccccagcacggcgugcugcugaagcacaccgccgaguucagaagacccauggccaccggcgacaccuucaccuacgaggacguggagaagaacgcccugcaguacauccacgacggcagcagcaccagagaggacagcauggagaucagcgugaccgacggccugaccgugaccaugcuggaggugagaguggaggugagccugagcgaggacagaggccccagacuggccgccggcagcagccugagcaucaccguggccagcaagagcaccgccaucaucaccagaagccaccuggccuacguggacgacagcagccccgaccccgagaucuggauccagcugaacuaccugcccagcuacggcacccugcugagaaucagcggcagcgagguggaggagcugagcgaggugagcaacuucaccauggaggacaucaacaacaagaagaucagauacagcgccguguucgagaccgacggccaccuggugaccgacagcuucuacuucagcgugagcgacauggaccacaaccaccuggacaaccagaucuucaccaucaugaucacccccgccgagaaccccccccccgugaucgccuucgccgaccugaucaccguggacgagggcggcagagccccccugagcuuccaccacuucuucgccaccgacgacgacgacaaccugcagagagacgccaucaucaagcugagcgcccugcccaaguacggcugcaucgagaacaccggcaccggcgacagauucggccccgagaccgccagcgaccuggaggccagcuuccccauccaggacgugcuggagaacuacaucuacuacuuccagagcgugcacgagagcaucgagcccacccacgacaucuucagcuucuacgugagcgacggcaccagcagaagcgagauccacagcaucaacaucaccaucgaggugaagacccuggaggugggcaagguggagccccugaccaccaucuuccacaccaucagagagcugagccuguaa

SEQ ID NO: 17230 - RNA, 840 nt, Artificial Sequence
  FRAT1__Homo_sapiens__NP_005470
augcccugcagaagagaggaggaggaggaggccggcgaggaggccgagggcgaggaggaggaggaggacagcuuccugcugcugcagcagagcguggcccugggcagcagcggcgagguggacagacugguggcccagaucggcgagacccugcagcuggacgccgcccagcacagccccgccagccccugcggcccccccggcgccccccugagagcccccggcccccuggccgccgccgugcccgccgacaaggccagaagccccgccgugccccugcugcugccccccgcccuggccgagaccgugggccccgccccccccggcgugcugagaugcgcccugggcgacagaggcagagugagaggcagagccgcccccuacugcguggccgagcuggccaccggccccagcgcccugagcccccugcccccccaggccgaccuggacggcccccccggcgccggcaagcagggcaucccccagccccugagcggccccugcagaagaggcuggcugagaggcgccgccgccagcagaagacugcagcagagaagaggcagccagcccgagaccagaaccggcgacgacgacccccacagacugcugcagcagcuggugcugagcggcaaccugaucaaggaggccgugagaagacugcacagcagaagacugcagcugagagccaagcugccccagagaccccugcugggcccccugagcgcccccgugcacgagccccccagccccagaagccccagagccgccugcagcgaccccggcgccagcggcagagcccagcugagaaccggcgacggcgugcuggugcccggcagcuaa

SEQ ID NO: 17231 - RNA, 702 nt, Artificial Sequence
  FRAT2__Homo_sapiens__NP_036215
augcccugcagaagagaggaggaggaggaggccggcgaggaggccgagggcgaggaggaggaggacgacagcuuccugcugcugcagcagagcgugacccugggcagcagcggcgagguggacagacugguggcccagaucggcgagacccugcagcuggacgccgcccaggacagccccgccagccccugcgccccccccggcgugccccugagagcccccggcccccuggccgccgccgugcccgccgacaaggccagaccccccgccgugccccugcugcugccccccgccagcgccgagaccgugggccccgcccccagcggcgcccugagaugcgcccugggcgacagaggcagagugagaggcagagccgcccccuacugcguggccgagguggccgccggccccagcgcccugcccggccccugcagaagaggcuggcugagagacgccgugaccagcagaagacugcagcagagaagauggacccaggccggcgccagagccggcgacgacgacccccacagacugcugcagcagcuggugcugagcggcaaccugaucaaggaggccgugagaagacugcagagagccguggccgccguggccgccaccggccccgccagcgcccccggccccggcggcggcagaagcggccccgacagaaucgcccugcagcccagcggcagccugcuguaa

SEQ ID NO: 17232 - RNA, 2148 nt, Artificial Sequence
  FREM1__Homo_sapiens__XP_006716792
auggugacccaggagagcaugcugaaggccgcccugccccuguucaccagauucaucaucagcaacggccugagaaccgagcacggcguguucgagaucacccuggagaccguggacagagcccugcccguggugaccagaaacaagggccugagacuggcccagggcgccgugggccugcugagccccgaccugcugcagcugaccgaccccgacacccccgccgagaaccugaccuuccugcuggugcagcugccccagcacggccagcuguaccuguggggcaccggccugcugcagcacaacuucacccagcaggacguggacagcaagaacguggccuacagacacagcggcggcgacagccagaccgacugcuucaccuucauggccaccgacggcaccaaccagggcuucaucgugaacggcagagugugggaggagcccgugcuguucaccauccagguggaccagcuggacaagaccgcccccagaaucacccugcugcacagccccagccaggugggccugcugaagaacggcugcuacggcaucuacaucaccagcagagugcugaaggccagcgaccccgacaccgaggacgaccagaucaucuucaagauccugcagggccccaagcacggccaccuggagaacaccaccaccggcgaguucauccacgagaaguucagccagaaggaccugaacagcaagaccauccuguacaucaucaaccccagccuggaggugaacagcgacaccguggaguuccagaucauggaccccaccggcaacagcgccaccccccagauccuggagcugaaguggagccacaucgaguggagccagaccgaguacgaggugugcgagaacgugggccugcugccccuggagaucaucagaagaggcuacagcauggacagcgccuucgugggcaucaaggugaaccaggugagcgccgccgugggcaaggacuucaccgugauccccagcaagcugauccaguucgaccccggcaugagcaccaagauguggaacaucgccaucaccuacgacggccuggaggaggacgacgagguguucgaggugauccugaacagccccgugaacgccgugcugggcaccaagaccaaggccgccgugaagauccuggacagcaagggcggccagugccaccccagcuacagcagcaaccagagcaagcacagcaccugggagaagggcaucuggcaccugcugccccccggcagcagcagcagcaccaccagcggcagcuuccaccuggagagaagaccccugcccagcagcaugcagcuggccgugaucagaggcgacacccugagaggcuucgacagcaccgaccugagccagagaaagcugagaaccagaggcaacggcaagaccgugagacccagcagcguguacagaaacggcaccgacaucaucuacaacuaccacggcaucgugagccugaagcuggaggacgacagcuuccccacccacaagagaaaggccaaggugagcaucaucagccagccccagaagaccaucaagguggccgagcugccccaggccgacaagguggagagcaccaccgacagccacuuccccagacaggaccagcugcccagcuuccccaagaacugcacccuggagcugaagggccuguuccacuucgaggagggcauccagaagcuguaccagugcaacggcaucgccuggaaggccuggagcccccagaccaaggacguggaggacaagagcugccccgccggcuggcaccagcacagcggcuacugccacauccugaucaccgagcagaagggcaccuggaacgccgccgcccaggccugcagagagcaguaccugggcaaccuggugaccguguucagcagacagcacaugagauggcugugggacaucggcggcagaaagagcuucuggaucggccugaacgaccaggugcacgccggccacugggaguggaucggcggcgagcccguggccuucaccaacggcagaagaggccccagccagagaagcaagcugggcaagagcugcgugcuggugcagagacagggcaaguggcagaccaaggacugcagaagagccaagccccacaacuacgugugcagcagaaagcuguaa

SEQ ID NO: 17233 - RNA, 9510 nt, Artificial Sequence
  FREM2__Homo_sapiens__NP_997244
augcacagcgccggcacccccggccugagcagcagaagaaccggcaacagcaccagcuuccagcccggccccccccccccccccagacugcugcugcugcugcugcugcugcugagccuggugagcagagugcccgcccagcccgccgccuucggcagagcccugcugagccccggccuggccggcgccgccggcgugcccgccgaggaggccaucgugcuggccaacagaggccugagagugcccuucggcagagagguguggcuggacccccugcacgaccuggugcugcaggugcagcccggcgacagaugcgccgugagcgugcuggacaacgacgcccuggcccagagacccggcagacugagccccaagagauuccccugcgacuucggccccggcgaggugagauacagccaccugggcgccagaagccccagcagagacagagugagacugcagcugagauacgacgcccccggcggcgccguggugcugccccuggugcuggagguggaggugguguucacccagcuggagguggugaccagaaaccugccccuggugguggaggagcugcugggcaccagcaacgcccuggacgccagaagccuggaguucgccuuccagcccgagaccgaggagugcagagugggcauccugagcggccugggcgcccugcccagauacggcgagcugcugcacuacccccaggugcccggcggcgccagagagggcggcgcccccgagacccugcugauggacugcaaggccuuccaggagcugggcgugagauacagacacaccgccgccagcagaagccccaacagagacuggauccccauggugguggagcugagaagcagaggcgcccccgugggcagccccgcccugaagagagagcacuuccaggugcuggugagaaucagaggcggcgccgagaacaccgcccccaagcccagcuucguggccaugaugaugauggagguggaccaguucgugcugaccgcccugacccccgacaugcuggccgccgaggacgccgagagccccagcgaccugcugaucuucaaccugaccagccccuuccagcccggccagggcuaccuggugagcaccgacgacagaagccugccccugagcagcuucacccagagagaccugagacugcugaagaucgccuaccagccccccagcgaggacagcgaccaggagagacuguucgagcuggagcuggaggugguggaccuggagggcgccgccagcgaccccuucgccuucauggugguggugaagcccaugaacaccauggcccccguggugaccagaaacaccggccugauccuguacgagggccagagcagaccccugaccggccccgccggcagcggcccccagaaccuggugaucagcgacgaggacgaccuggaggccgugagacuggaggugguggccggccugagacacggccaccuggugauccugggcgccagcagcggcagcagcgcccccaagagcuucaccguggccgagcuggccgccggccaggugguguaccagcacgacgacagagacggcagccugagcgacaaccuggugcugagaaugguggacggcggcggcagacaccaggugcaguuccuguuccccaucacccuggugcccguggacgaccagccccccgugcugaacgccaacaccggccugacccuggccgagggcgagaccgugcccauccugccccugagccugagcgccaccgacauggacagcgacgacagccugcugcuguucgugcuggagagccccuuccugaccaccggccaccugcugcugagacagacccaccccccccacgagaagcaggagcugcugagaggccuguggagaaaggagggcgccuucuacgagagaaccgugaccgaguggcagcagcaggacaucaccgagggcagacuguucuacagacacagcggcccccacagccccggccccgugaccgaccaguucaccuucagagugcaggacaaccacgacccccccaaccagagcggccugcagagauucgugaucagaauccaccccguggacagacugccccccgagcugggcagcggcugcccccugagaaugguggugcaggagagccagcugaccccccugagaaagaaguggcugagauacaccgaccuggacaccgacgacagagagcugagauacaccgugacccagccccccaccgacaccgacgagaaccaccugcccgccccccugggcacccuggugcugaccgacaaccccagcgugguggugacccacuucacccaggcccagaucaaccaccacaagaucgccuacagaccccccggccaggagcugggcguggccaccagaguggcccaguuccaguuccagguggaggacagagccggcaacguggcccccggcaccuucacccuguaccugcaccccguggacaaccagccccccgagauccugaacaccggcuucaccauccaggagaagggccaccacauccugagcgagaccgagcugcacgugaacgacguggacaccgacguggcccacaucagcuucacccugacccaggcccccaagcacggccacaugagagugagcggccagauccugcacgugggcggccuguuccaccuggaggacaucaagcagggcagagugagcuacgcccacaacggcgacaagagccugaccgacagcugcagccuggaggugagcgacagacaccacguggugcccaucacccugagagugaacgugagacccguggacgacgaggugcccauccugagccaccccaccggcacccuggagagcuaccuggacgugcuggagaacggcgccaccgagaucaccgccaacgugaucaagggcaccaacgaggagaccgacgaccugaugcugaccuuccugcuggaggaccccccccuguacggcgagauccuggugaacggcauccccgccgagcaguucacccagagagacauccuggagggcagcgugguguacacccacaccagcggcgagaucggccugcugcccaaggccgacagcuucaaccugagccugagcgacaugagccaggaguggagaaucggcggcaacaccauccagggcgugaccaucugggugaccauccugcccguggacagccaggcccccgagaucuucgugggcgagcagcugaucgugauggagggcgacaagagcgugaucaccagcgugcacaucagcgccgaggacguggacagccugaacgacgacauccugugcaccaucgugauccagcccaccagcggcuacguggagaacaucagccccgcccccggcagcgagaagagcagagccggcaucgccaucagcgccuucaaccugaaggaccugagacagggccacaucaacuacgugcagagcgugcacaagggcguggagcccguggaggacagauucguguucagaugcagcgacggcaucaacuucagcgagagacaguucuuccccaucgugaucauccccaccaacgacgagcagcccgagauguucaugagagaguucauggugauggagggcaugagccuggugaucgacacccccauccugaacgccgccgacgccgacgugccccuggacgaccugaccuucaccaucacccaguuccccacccacggccacaucaugaaccagcugaucaacggcaccgugcugguggagagcuucacccuggaccagaucaucgagagcagcagcaucaucuacgagcacgacgacagcgagacccaggaggacagcuucgugaucaagcugaccgacggcaagcacagcguggagaagaccgugcugaucaucgugauccccguggacgacgagacccccagaaugaccaucaacaacggccuggagaucgagaucggcgacaccaagaucaucaacaacaagauccugauggccaccgaccuggacagcgaggacaagagccugguguacaucaucagauacggccccggccacggccugcugcagagaagaaagcccaccggcgccuucgagaacaucacccugggcaugaacuucacccaggacgagguggacagaaaccugauccaguacgugcaccugggccaggagggcaucagagaccugaucaaguucgacgugaccgacggcaucaacccccugaucgacagauacuucuacgugagcaucggcagcaucgacaucguguuccccgacgugaucagcaagggcgugagccugaaggagggcggcaaggugacccugaccaccgaccugcugagcaccagcgaccugaacagccccgacgagaaccugguguucaccaucaccagagcccccaugagaggccaccuggagugcaccgaccagcccggcgugagcaucaccagcuucacccagcugcagcuggccggcaacaagaucuacuacauccacaccgccgacgacgaggugaagauggacagcuucgaguuccaggugaccgacggcagaaaccccguguucagaaccuucagaaucagcaucagcgacguggacaacaagaagcccguggugaccauccacaagcugguggugagcgagagcgagaacaagcugaucacccccuucgagcugaccguggaggacagagacacccccgacaagcugcugaaguucaccaucacccaggugcccauccacggccaccugcuguucaacaacaccagacccgugaugguguucaccaagcaggaccugaacgagaaccugaucagcuacaagcacgacggcaccgagagcagcgaggacagcuucagcuucaccgugaccgacggcacccacaccgacuucuacguguuccccgacaccguguucgagaccagaagaccccaggugaugaagauccaggugcuggccguggacaacagcgugccccagaucgccgugaacaagggcgccagcacccugagaacccuggccaccggccaccugggcuucaugaucaccagcaagauccugaagguggaggacagagacagccugcacaucagccugagauucaucgugaccgaggccccccagcacggcuaccugcugaaccuggacaagggcaaccacagcaucacccaguucacccaggccgacaucgacgacaugaagaucugcuacgugcugagagagggcgccaacgccaccagcgacauguucuacuucgccguggaggacggcggcggcaacaagcugaccuaccagaacuucagacugaacugggccuggaucagcuucgagaaggaguacuaccuggugaacgaggacagcaaguuccuggacguggugcugaagagaagaggcuaccugggcgagaccagcuucaucagcaucggcaccagagacagaaccgccgagaaggacaaggacuucaagggcaaggcccagaagcaggugcaguucaaccccggccagaccagagccaccuggagagugagaauccugagcgacggcgagcacgagcagagcgagaccuuccagguggugcugagcgagcccgugcuggccgcccuggaguuccccaccguggccaccguggagaucguggaccccggcgacgagcccaccguguucaucccccagagcaaguacagcguggaggaggacgugggcgagcuguucauccccaucagaagaagcggcgacgugagccaggagcugaugguggugugcuacacccagcagggcaccgccaccggcaccgugcccaccagcgugcugagcuacagcgacuacaucagcagacccgaggaccacaccagcguggugagauucgacaaggacgagagagagaagcugugcagaaucgugaucaucgacgacagccuguacgaggaggaggagaccuuccacgugcugcugagcaugcccaugggcggcagaaucggcagcgaguuccccggcgcccaggugaccaucgugcccgacaaggacgacgagcccaucuucuacuucggcgacguggaguacagcguggacgagagcgccggcuacguggaggugcagguguggagaaccggcaccgaccugagcaagagcagcagcgugaccgugagaagcagaaagaccgacccccccagcgccgacgccggcaccgacuacgugggcaucagcagaaaccuggacuucgcccccggcgugaacaugcagcccgugagaguggugauccuggacgaccugggccagcccgcccuggagggcaucgagaaguucgagcuggugcugagaaugcccaugaacgccgcccugggcgagcccagcaaggccaccgugagcaucaacgacagcgugagcgaccugcccaagaugcaguucaaggagagaaucuacaccggcagcgagagcgacggccagaucgugaccaugauccacagaaccggcgacgugcaguacagaagcagcgugagaugcuacaccagacagggcagcgcccaggugaugauggacuucgaggagagacccaacaccgacaccagcaucaucaccuuccugcccggcgagaccgagaagcccugcauccuggagcugauggacgacgugcuguacgaggagguggaggagcugagacuggugcugggcaccccccagagcaacagccccuucggcgccgccgugggcgagcagaacgagacccugaucagaaucagagacgacgccgacaagaccgugaucaaguucggcgagaccaaguucagcgugaccgagcccaaggagcccggcgagagcguggugaucagaauccccgugaucagacagggcgacaccagcaaggugagcaucgugagagugcacaccaaggacggcagcgccaccagcggcgaggacuaccaccccgugagcgaggagaucgaguucaaggagggcgagacccagcacgugguggagaucgaggugaccuucgacggcgugagagagaugagagaggccuucaccgugcaccugaagcccgacgagaacaugaucgccgagaugcagcugaccaaggccaucguguacaucgaggagaugagcagcauggccgacgugaccuuccccagcgugccccagaucgugagccugcugauguacgacgacaccagcaaggccaaggagagcgccgagcccaugagcggcuaccccgugaucugcaucaccgccugcaaccccaaguacagcgacuacgacaagaccggcagcaucugcgccagcgagaacaucaacgacacccugaccagauacagauggcugaucagcgcccccgccggccccgacggcgugaccagccccaugagagagguggacuucgacaccuucuucaccagcagcaagauggugacccuggacagcaucuacuuccagcccggcagcagagugcagugcgccgccagagccgugaacaccaacggcgacgagggccuggagcugaugagccccaucgugaccaucagcagagaggagggccugugccagcccagagugcccggcguggugggcgccgagcccuucagcgccaagcugagauacaccggccccgaggacgccgacuacaccaaccugaucaagcugaccgugaccaugccccacaucgacggcaugcugcccgugaucagcaccagagagcugagcaacuucgagcugacccugagccccgacggcaccagagugggcaaccacaagugcagcaaccugcuggacuacaccgaggugaagacccacuacggcuuccugaccgacgccaccaagaaccccgagaucaucggcgagaccuaccccuaccaguacagccugagcaucagaggcagcaccacccugagauucuacagaaaccugaaccuggaggccugccugugggaguucgugagcuacuacgacaugagcgagcugcuggccgacugcggcggcaccaucggcaccgacggccaggugcugaaccuggugcagagcuacgugacccugagagugccccuguacgugagcuacguguuccacagccccgugggcgugggcggcuggcagcacuucgaccugaagagcgagcugagacugaccuucguguacgacaccgccauccuguggaacgacggcaucggcagcccccccgaggccgagcugcagggcagccuguaccccaccagcaugagaaucggcgacgagggcagacuggccgugcacuucaagaccgaggcccaguuccacggccuguucgugcugagccaccccgccagcuucaccagcagcgugaucaugagcgccgaccaccccggccugaccuucagccugagacugaucagaagcgagcccaccuacaaccagcccgugcagcaguggagcuucgugagcgacuucgccgugagagacuacagcggcaccuacaccgugaagcuggugcccugcaccgcccccagccaccaggaguacagacugcccgugaccugcaaccccagagagcccgugaccuucgaccuggacaucagauuccagcaggugagcgaccccguggccgccgaguucagccugaacacccagauguaccugcugagcaagaagagccuguggcugagcgacggcagcaugggcuucggccaggagagcgacguggccuucgccgagggcgacaucaucuacggcagagugaugguggaccccgugcagaaccugggcgacagcuucuacugcagcaucgagaagguguuccugugcaccggcgccgacggcuacgugcccaaguacagccccaugaacgccgaguacggcugccuggccgacagccccagccugcuguacagauucaagaucguggacaaggcccagcccgagacccaggccaccagcuucggcaacgugcuguucaacgccaagcuggccguggacgaccccgaggccauccugcuggugaaccagcccggcagcgacggcuucaagguggacagcaccccccuguuccagguggcccugggcagagagugguacauccacaccaucuacaccgugagaagcaaggacaacgccaacagaggcaucggcaagagaagcguggaguaccacagccuggugagccagggcaagccccagagcaccaccaagagcagaaagaagagagagaucagaagcacccccagccuggccugggagaucggcgccgagaacagcagaggcaccaacauccagcacaucgcccuggacagaaccaagagacagaucccccacggcagagccccccccgacggcauccugcccugggagcugaacagccccagcagcgccgugagccuggugaccguggugggcggcaccaccgugggccugcugaccaucugccugaccgugaucgccgugcugaugugcagaggcaaggagagcuucagaggcaaggacgcccccaagggcagcagcagcagcgagcccauggugcccccccagagccaccacaacgacagcagcgagguguaa

SEQ ID NO: 17234 - RNA, 6420 nt, Artificial Sequence
  FREM3__Homo_sapiens__NP_001161707
auggccggcgccagcagacaccccaccggcacccccagacagcugcugguggcccuggccugccugcugcugagcagacccgcccugcagggcagagccagcagccugggcaccgagcccgaccccgcccuguaccugcccgccagaggcgcccuggacggcaccagacccgacggccccagcgugcugaucgccaaccccggccugagagugccccugggcagaagccuguggcuggacccccugagagaccuggugaucggcgugcagcccggcgacagaugcgaggugaccgugcuggacgcccugcccagacugaagggcgcccugagccccagaagauuccccugcaccuucggccccagacaggugcaguacacccacuucggcagccacagccccggcagagccagagugcugcugcagcugagauacgacgcccccacccacacccuggugcugcccuucacccuggccguggaccugguguucagccagcuggagcuggugaccagaaacagaccccuggugguggagaagcugagaagcuggagcagagccaucgacagaagagugcuggacuucgccagccugaagagcggcgccaccgccaccagaagaugcagacugaccccccugccccacgaggacggcccccugcccaaguacggcagacugguggacgccgugggcgccccccugcccagaggcaagggcguggacugcgaggccuuccugagagccggcgugagauaccagcacaccgccaccagcagccccaacagagacuacgugcccaugaugguggagcugcugggccccgagggccaggacgccggcagcgccggcgugcuggugagagagcacuuccagcugcuggugagaaucagaggcggcgccgagaacaccccccccagacccagcuucauggccaccaugaugauggagguggacccccuggugcugaccgcccugacccccgacgcccuggccgccgaggacguggagagcgaccccggcgaccugguguucaacauccugaacgcccccacccacccccccggccaccccggccagcagggcuacguggugagcaccgacgacccccugggccugcccgugagcuucuucacccagcaggagcugagagagcugaagaucgccuaccagccccccgccgagaacagccacggcgagagacuguuccagcuggagcuggaggugguggacggcgacggcgccgccagcgaccccuucgccuucauggugaccgugaagagcaugaacacccuggugcccguggccagccacaacagaggccuggugcuguucgagggccagagcagaccccugagcagcacccacagcauccccaucagcgacaaggacaaccuggaggaggugaagauggccgccgugagaggccugagacacggccagcuggugguguucggcgcccccgccggcugcaaguacuucacccccgccgaccuggccgccggcagagugguguaccagcacgacggcagcaacaccuacagcgacaacaucaucuucagaauggaggacggccaccaccagguggacuuccuguucccccugaccauccugcccguggacgacgagccccccauggugaacaccaacaccggccugagccugaccgagggccagguggugcagaucagccccuucgugcugagcgccaccgacaucgacagcgaggacagcaccauccacuucgugcuggagaaccagccccugaagggcaacgaggaggagccccagugggagcuggcccccggcagcagccacagcggccacuaccugggcgaccugcugcugcagcaggccgagcugccccugagcaccgaggacgaggacuggcacuacauggagaaggagggccuguacgagaagguggugaccgaguggcugcagagagacaucauggagggcagacuguucuacagacaccugggcccccacagcccccagagcgugauggugcagcuggccuuccacgugcaggacgaccacgacccccccaaccugagcaagcagcacaucuucaccaucaaggugcagcccguggacauccugagcccccagcuguaccccggcaccacccuggagaugaccgugcaggaguaccagcugacccacuuccagaagaacuuccugagauacaucgaccaggacagcgacgaccagaaccugugguacacccugcugacccugcccaccgacaccgacggcaaccaccaggugagagccggcgagaucgugcugaccgacagccccgacacccugaucaugcacuucacccaggcccaggugaaccagcacaagguggccuaccagcccccccagaagcugggcaucgcccccagaguggugcaguucaccuaccagguggaggacgccgccggcaacagcgugcccggcaccuucacccuguuccugcagcccguggacaaccagccccccgaggugaccaacagaggcuucgccauccuggagggcggcagcuucaaccugagcagcaacgagcugcacgugaccgaccccgacaccgacaucgaccagaucguguucauccuggugagaggcccccagcacggccaccugcaguacuucaagagaugcauggugcccggcgagagcuucaugcaggccgacgugaucaacggcagcgugagcuaccagcacggcagagaccagaccaccaccagcgacaccuuccaccuggaggugagcgacggcgugcaccacauccccaucaccauccccaucagcgugcaccccaacguggccaacagaagccccagaaucagccugagaagcagcagccugcuggacgugagcaucgacgugcuggagaacaaggccaccgagaucaccaugggcgugauccacggcaagagaaaggacgugggcgaccugaugcugagcuucaucgugaaggacagccccaagcugggcaccauccuggugaacggccugcccaccgagagauucacccaggaggaccugaucaacggcagaguggccuacgcccacaccgccggcgaggugggcuuccagaagcagcacgacgccuucagccugauccugagcaaggacagcuaccaguggguggugggcaacagcaucaucgagaaggugcaggugcaggugaccgugcugcccguggacaacgugggccccaagguguucgugggcgagagcuucaucguguacgagggcgagaagaacagccugacccugcagcaccugcacguggaggacguggacacccaccaggacgagcugcugugcaccgugaccagccagcccgccagcggcuaccuggagaagaucgccagcgcccccggcagcaagaugagccagagcggcagccccaucagcgccuucagccugagagacauccaggugagacacaucaacuacgugcagagcauccacaagggcguggagccccaggaggaccaguucaccuucuacugcagcgacggcaucaacuucagccccaacguguucuuccccaucaucauccugcccaccaacgacgagcagcccaagcuguucgcccacgaguucaaggugcuggagggcaugagccuggugaucgacacccagcugcugaacggcgccgacgccgaccugccccccaacgagcugcacuuccagcugaccgcccugcccagacacggcagaaucauccagcagcuggccaccggcagccagcccauccacagcuucacccugaaggagauccaggaggccagcaccaucguguacgagcacgacgacagcgagaccaaggaggacagcuucgagguguggcugagcgacggcaagcacaccacccacagaaaggugcccaucguggugacccugguggacgacgagaccccccaccugaccgugaacaacggccugaagguggagaagggccacagcgagaucaucaccaacagaauccugaaggccaccgaccuggacagcgacgacaagagccugagcuucgugcugcacagcggcccccagcagggccugcugcagagacugagaaagcccagaggcgaggugagaaacaaccugacccugggcaugaacuucacccaggacgagaucaacagaggccugaucugcuacauccacaccggccaggagggcaucguggacaucaucaaguucgacgugaccgacggcgugaacacccugaccgaccacuacuucuacgugaccaucggcaaccuggacagcguguuccccgaggugaucagcaagagaaucacccugaucgagggcgccagagugacccugaccaacaaccugcugaccaacagcgacaucaacagcagcgacgagcaccacuucagcaucaccagagcccccagccugggccaccuggagagcagcgacuacgccggcgagcccaucgccagcuucacccagcugcagcuggccagcaacaagaucagcuacgugcacaccagcaacgacgagaagaagauggacagcuucgaguuccaggugaucggcgagcuguaccccguguucagaaccuucagaaucuucaucaccgacguggacaacaagaagcccauccugaccauccacagacugacccugcagaaggaggacagccagcugaucacccugcuggagcugaccguggaggacagcgacacccccgacgaccugauccuguucaccaucacccaggugcccaugcacggcaagauccuguacaacggcagcagacccgugaccaccuucaccaagcaggaccugaacaagaaccugaucagcuacaagcacgacggcagcgagaccaccgaggacagcuucagccugaccgugaccgacggcacccacaccgacuucuacgugcugcccgacaccgcccuggccacccacaagccccaggugaugagagugcagaucagaagccuggacaacagacugccccagaucaccaccaacagaggcgcccccgcccugaagagacugcacaccggccacaugggcuuccugaucaccagcaagagccugaaggccgaggaccaggacagcccccacagacugcugaaguacaaggugaccagaggccccgagcacggcuucaucaucaagaccggccugggcaaccagagcaccagaguguucacccaggccgacaucgacgagaugaagaucagcuacgugcugaacgagggcagcaacgccagcaaggacaucuucuacuucagcguggaggacaacggcggcaacaagcugaccaaccagcccuuccaccugaacugggccuggaucugccuggagaaggaguacuacaucguggacgaggacagcaccuuccuggaggugacccugaccagaagaggcuaccugggcgagaccagcuucaucagcaucggcaccaaggacgagaccgccaagaaggacaaggacuucaaguggaagaccaacaagcagauccaguucaaccccggccagaccaccgccaccuggagagugagaaucauccccgacaacgaguacgagaccagcgagaccuuccagaucauccugagcgagccccugauggccgugcuggaguuccccgagauggccaccguggagaucguggaccccggcgacgagagcaccguguacauccccgaggccgaguacaagaucgaggaggacaucggcgagcugcugauccccgugagaagaagcggcgacgccagccaggagcugaucgugaucugcagcaccagacagggcagcgccaccggcaccaucagcagcaccgugcuguucagcgacuacaucagcagacccgaggaccacaccagcauccugcacuucgacaagaacgagacccagaagaccugccaggugcugaucaucgacgacagccuguacgaggaggaggagagcuucagcgugagccugagacugcccgugggcggccagcugggcgccagauuccccaccaccaaggugaccauccuggccgacagauacgacgagcccgugcugcacuucggcgacgccgaguaccacgugaacgagagcgccagauacguggaggugugcguguggagaagaggcaccgaccugagccagcccagcagcaucgccgugagaagcagaaagagcgagcaggagagcgccgaggccggcaccgacuacgugggcaucagcagaaaccuggacuucgcccccggcgugagaaugcagaccuuccaggugaccauccuggacgaccugggccagcccacccuggagggccccgagaaguucgagcugcugcugcagaugcccaugggcgccgugcugggcgagcccaacaagaccaccaucuucaucgaggacaccaucaccgacugcaagcagagcgccugcagcagcuucgacuaa

SEQ ID NO: 17235 - RNA, 777 nt, Artificial Sequence
  FRG1__Homo_sapiens__NP_004468
auggccgaguacagcuacgugaagagcaccaagcuggugcugaagggcaccaagaccaagagcaagaagaagaagagcaaggacaagaagagaaagagagaggaggacgaggagacccagcuggacaucgugggcaucugguggaccgugaccaacuucggcgagaucagcggcaccaucgccaucgagauggacaagggcaccuacauccacgcccuggacaacggccuguucacccugggcgccccccacaaggagguggacgagggccccagcccccccgagcaguucaccgccgugaagcugagcgacagcagaaucgcccugaagagcggcuacggcaaguaccugggcaucaacagcgacggccugguggugggcagaagcgacgccaucggccccagagagcagugggagcccguguuccagaacggcaagauggcccugcuggccagcaacagcugcuucaucagaugcaacgaggccggcgacaucgaggccaagagcaagaccgccggcgaggaggagaugaucaagaucagaagcugcgccgagagagagaccaagaagaaggacgacauccccgaggaggacaagggcaacgugaagcagugcgagaucaacuacgugaagaaguuccagagcuuccaggaccacaagcugaagaucagcaaggaggacagcaagauccugaagaaggccagaaaggacggcuuccugcacgagacccugcuggacagaagagccaagcugaaggccgacagauacugcaaguaa

SEQ ID NO: 17236 - RNA, 837 nt, Artificial Sequence
  FRG2__Homo_sapiens__NP_001005217
augggcaagggcaacgaggacagcgaccugcacugcagcagcauccagugcagcaccgaccagccccccuuccagcagaucagcuucaccgagaagggcagcgacgagaagaagcccuucaaggagaagggcaagaccgccuucagccacagcagcgagaagcacauccagagacagggcagcgagcccaaccccaacaaggagaacagcgaggagaccaagcugaaggccggcaacagcaccgccggcagcgagcccgagagcagcagcuacagagagaacugcagaaagagaaagaugagcagcaaggacagcugccaggacaccgccggcaacugccccgagaaggagugcagccugagccugaacaagaagagcagaagcagcaccgccgugcacaacagcgagauccaggagaccugcgacgcccaccacagaggccacagcagagccugcaccggccacagcaagagacacagaagcagagcccugggcgugcagacccccagcaucagaaagagccuggugaccagcgugagagccaugagcgaggccguguaccaggaccuggcccaggugugggcccagcagauccacagcccccugaccugcgagcagcugacccugcugaccagacugagaggcccccugugcgcccaggugcagacccuguacagcauggccacccaggccgccuacguguuccccgccgagagcuggcuggugcccgccacccugcccggccccggcgagagcgcccuggacagagaggcccaccccuuccccggccaggagaucaccgagaccgugagcggcagcgacgaggccaagcuguaa

SEQ ID NO: 17237 - RNA, 1518 nt, Artificial Sequence
  FRK__Homo_sapiens__XP_011533957
augagcaacaucugccagagacugugggaguaccuggagcccuaccugcccugccugagcaccgaggccgacaagagcaccgugaucgagaaccccggcgcccugugcagcccccagagccagagacacggccacuacuucguggcccuguucgacuaccaggccagaaccgccgaggaccugagcuucagagccggcgacaagcugcaggugcuggacacccugcacgagggcuggugguucgccagacaccuggagaagagaagagacggcagcagccagcagcugcagggcuacauccccagcaacuacguggccgaggacagaagccugcaggccgagcccugguucuucggcgccaucggcagaagcgacgccgagaagcagcugcuguacagcgagaacaagaccggcagcuuccugaucagagagagcgagagccagaagggcgaguucagccugagcgugcuggacggcgccguggugaagcacuacagaaucaagagacuggacgagggcggcuucuuccugaccagaagaagaaucuucagcacccugaacgaguucgugagccacuacaccaagaccagcgacggccugugcgugaagcugggcaagcccugccugaagauccaggugcccgcccccuucgaccugagcuacaagaccguggaccagugggagaucgacagaaacagcauccagcugcugaagagacugggcagcggccaguucggcgaggugugggagggccuguggaacaacaccacccccguggccgugaagacccugaagcccggcagcauggaccccaacgacuuccugagagaggcccagaucaugaagaaccugagacaccccaagcugauccagcuguacgccgugugcacccuggaggaccccaucuacaucaucaccgagcugaugagacacggcagccugcaggaguaccugcagaacgacaccggcagcaagauccaccugacccagcagguggacauggccgcccagguggccagcggcauggccuaccuggagagcagaaacuacauccacagagaccuggccgccagaaacgugcuggugggcgagcacaacaucuacaagguggccgacuucggccuggccagaguguucaagguggacaacgaggacaucuacgagagcagacacgagaucaagcugcccgugaaguggaccgcccccgaggccaucagaagcaacaaguucagcaucaagagcgacguguggagcuucggcauccugcuguacgagaucaucaccuacggcaagaugcccuacagcggcaugaccggcgcccaggugauccagaugcuggcccagaacuacagacugccccagcccagcaacugcccccagcaguucuacaacaucaugcuggagugcuggaacgccgagcccaaggagagacccaccuucgagacccugagauggaagcuggaggacuacuucgagaccgacagcagcuacagcgacgccaacaacuucaucagauaa

SEQ ID NO: 17238 - RNA, 1671 nt, Artificial Sequence
  FRMD3__Homo_sapiens__NP_001231888
auguucgccagcugccacugcgugcccagaggcagaagaaccaugaagaugauccacuucagaagcagcagcgugaagagccugagccaggagaugagaugcaccaucagacugcuggacgacagcgagaucagcugccacauccagagagagaccaagggccaguuccugaucgaccacaucugcaacuacuacagccugcuggagaaggacuacuucggcaucagauacguggaccccgagaagcagagacacuggcuggagcccaacaagagcaucuucaagcagaugaagacccacccccccuacaccaugugcuucagagugaaguucuacccccacgagccccugaagaucaaggaggagcugaccagauaccugcuguaccugcagaucaagagagacaucuuccacggcagacugcugugcagcuucagcgacgccgccuaccugggcgccugcaucgugcaggccgagcugggcgacuacgaccccgacgagcaccccgagaacuacaucagcgaguucgagaucuuccccaagcagagccagaagcuggagagaaagaucguggagauccacaagaacgagcugagaggccagagcccccccguggccgaguucaaccugcugcugaaggcccacacccuggagaccuacggcguggacccccaccccugcaaggacagcaccggcaccaccaccuuccugggcuucaccgccgccggcuucgugguguuccagggcaacaagagaauccaccugaucaaguggcccgacgugugcaagcugaaguucgagggcaagaccuucuacgugaucggcacccagaaggagaagaaggccaugcuggccuuccacaccagcacccccgccgccugcaagcaccuguggaagugcggcguggagaaccaggccuucuacaaguacgccaagagcagccagaucaagaccgugagcagcagcaagaucuucuucaagggcagcagauucagauacagcggcaagguggccaaggaggugguggaggccagcagcaagauccagagagagccccccgaggugcacagagccaacaucacccagagcagaagcagccacagccugaacaagcagcugaucaucaacauggagccccugcagccccugcugcccagccccagcgagcaggaggaggagcugccccugggcgagggcgugccccugcccaaggaggagaacaucagcgccccccugaucagcagcagccccgugaaggccgccagagaguacgaggacccccccagcgaggaggaggacaagaucaaggaggagccccugaccaucagcgagcugguguacaaccccagcgccagccugcugcccacccccguggacgacgacgagaucgacaugcuguucgacugccccagcagacuggagcuggagagagaggacaccgacagcuucgaggaccuggaggccgacgagaacgccuuccugaucgccgaggaggaggagcugaaggaggccagaagagcccugagcuggagcuacgacauccugaccggccacaucagagugaacccccuggugaagagcuucagcagacugcugguggugggccugggccugcugcuguucguguucccccugcugcugcugcugcuggagagcgugagcaugcaguaa

SEQ ID NO: 17239 - RNA, 3120 nt, Artificial Sequence
  FRMD4A__Homo_sapiens__NP_060497
auggccgugcagcuggugcccgacagcgcccugggccugcugaugaugaccgagggcagaagaugccaggugcaccugcuggacgacagaaagcuggagcugcuggugcagcccaagcugcuggccaaggagcugcuggaccugguggccagccacuucaaccugaaggagaaggaguacuucggcaucgccuucaccgacgagaccggccaccugaacuggcugcagcuggacagaagagugcuggagcacgacuuccccaagaagagcggccccguggugcuguacuucugcgugagauucuacaucgagagcaucagcuaccugaaggacaacgccaccaucgagcuguucuuccugaacgccaagagcugcaucuacaaggagcugaucgacguggacagcgaggugguguucgagcuggccagcuacauccugcaggaggccaagggcgacuucagcagcaacgagguggugagaagcgaccugaagaagcugcccgcccugcccacccaggcccugaaggagcaccccagccuggccuacugcgaggacagagugaucgagcacuacaagaagcugaacggccagaccagaggccaggccaucgugaacuacaugagcaucguggagagccugcccaccuacggcgugcacuacuacgccgugaaggacaagcagggcauccccugguggcugggccugagcuacaagggcaucuuccaguacgacuaccacgacaaggugaagcccagaaagaucuuccaguggagacagcuggagaaccuguacuucagagagaagaaguucagcguggaggugcacgaccccagaagagccagcgugaccagaagaaccuucggccacagcggcaucgccgugcacaccugguacgccugccccgcccugaucaagagcaucugggccauggccaucagccagcaccaguucuaccuggacagaaagcagagcaagagcaagauccacgccgccagaagccugagcgagaucgccaucgaccugaccgagaccggcacccugaagaccagcaagcuggccaacaugggcagcaagggcaagaucaucagcggcagcagcggcagccugcugagcagcggcagccaggagagcgacagcagccagagcgccaagaaggacaugcuggccgcccugaagagcagacaggaggcccuggaggagacccugagacagagacuggaggagcugaagaagcugugccugagagaggccgagcugaccggcaagcugcccguggaguacccccuggaccccggcgaggagccccccaucgugagaagaagaaucggcaccgccuucaagcuggacgagcagaagauccugcccaagggcgaggaggccgagcuggagagacuggagagagaguucgccauccagagccagaucaccgaggccgccagaagacuggccagcgaccccaacgugagcaagaagcugaagaagcagagaaagaccagcuaccugaacgcccugaagaagcugcaggagaucgagaacgccaucaacgagaacagaaucaagagcggcaagaagcccacccagagagccagccugaucaucgacgacggcaacaucgccagcgaggacagcagccugagcgacgcccuggugcuggaggacgaggacagccaggugaccagcaccaucagcccccugcacagcccccacaagggccugccccccagaccccccagccacaacagacccccccccccccagagccuggagggccugagacagaugcacuaccacagaaacgacuacgacaagagccccaucaagcccaagauguggagcgagagcagccuggacgagcccuacgagaaggugaagaagagaagcagccacagccacagcagcagccacaagagauuccccagcaccggcagcugcgccgaggccggcggcggcagcaacagccugcagaacagccccaucagaggccugccccacuggaacagccagagcagcaugcccagcacccccgaccugagagugagaagcccccacuacgugcacagcaccagaagcguggacaucagccccaccagacugcacagccuggcccugcacuucagacacagaagcagcagccuggagagccagggcaagcugcugggcagcgagaacgacaccggcagccccgacuucuacacccccagaaccagaagcagcaacggcagcgaccccauggacgacugcagcagcugcaccagccacagcagcagcgagcacuacuaccccgcccagaugaacgccaacuacagcacccuggccgaggacagccccagcaaggccagacagagacagagacagagacagagagccgccggcgcccugggcagcgccagcagcggcagcaugcccaaccuggccgccagaggcggcgccggcggcgccggcggcgccggcggcggcguguaccugcacagccagagccagcccagcagccaguacagaaucaaggaguacccccuguacaucgagggcggcgccacccccgugguggugagaagccuggagagcgaccaggagggccacuacagcgugaaggcccaguucaagaccagcaacagcuacaccgccggcggccuguucaaggagagcuggagaggcggcggcggcgacgagggcgacaccggcagacugacccccagcagaagccagauccugagaacccccagccugggcagagagggcgcccacgacaagggcgccggcagagccgccgugagcgacgagcugagacagugguaccagagaagcaccgccagccacaaggagcacagcagacugagccacaccagcagcaccagcagcgacagcggcagccaguacagcaccagcagccagagcaccuucguggcccacagcagagugaccagaaugccccagaugugcaaggccaccagcgccgcccugccccagagccagagaagcagcacccccagcagcgagaucggcgccaccccccccagcagcccccaccacauccugaccuggcagaccggcgaggccaccgagaacagccccauccuggacggcagcgagagccccccccaccagagcaccgacgaguaa

SEQ ID NO: 17240 - RNA, 3105 nt, Artificial Sequence
  FRMD4B__Homo_sapiens__NP_055938
auggccagcguguucaugugcggcguggaggaccugcuguucagcggcagcagauucguguggaaccugaccgugagcacccugagaagaugguacaccgagagacugagagccugccaccaggugcugagaaccuggugcggccugcaggacguguaccagaugaccgagggcagacacugccaggugcaccugcuggacgacagaagacuggagcugcuggugcagcccaagcugcuggccagagagcugcuggaccugguggccagccacuucaaccugaaggagaaggaguacuucggcaucaccuucaucgacgacaccggccagcagaacuggcugcagcuggaccacagagugcuggaccacgaccugcccaagaagcccggccccaccauccugcacuucgccgugagauucuacaucgagagcaucagcuuccugaaggacaagaccaccguggagcuguucuuccugaacgccaaggccugcgugcacaagggccagaucgagguggagagcgagaccaucuucaagcuggccgccuucauccugcaggaggccaagggcgacuacaccagcgacgagaacgccagaaaggaccugaagacccugcccgccuuccccaccaagacccugcaggagcaccccagccuggccuacugcgaggacagagugaucgagcacuaccugaagaucaagggccugaccagaggccaggccguggugcaguacaugaagaucguggaggcccugcccaccuacggcgugcacuacuacgccgugaaggacaagcagggccugcccugguggcugggcaucagcuacaagggcaucggccaguacgacauccaggacaaggugaagcccagaaagcuguuccaguggaagcagcuggagaaccuguacuucagagagaagaaguucgccguggaggugcacgaccccagaagaaucagcgugagcagaagaaccuucggccagagcggccuguucgugcagaccugguacgccaacagcagccugaucaagagcaucugggugauggccaucagccagcaccaguucuaccuggacagaaagcagagcaaggccaagauccccagcgccagaagccuggacgagaucgccauggaccugaccgagaccggcacccagagagccagcaagcuggugacccuggaggccaagagccaguucaucauggccagcaacggcagccugaucagcagcggcagccaggacagcgaggugagcgaggagcagaagagagagaagauccuggagcugaagaagaaggagaagcugcugcaggagaagcugcugaagaagguggaggagcugaagaagaucugccugagagaggccgagcugaccggcaagaugcccaaggaguacccccugaacaucggcgagaagcccccccaggugagaagaagagugggcaccgccuucaagcuggacgacaaccugcugcccagcgaggaggaccccgcccugcaggagcuggagagcaacuuccugauccagcagaagcugguggaggccgccaagaagcuggccaacgagcccgaccugugcaagaccgugaagaagaagagaaagcaggacuacaccgacgccaugaagaagcugcaggagaucgagaacgccaucaacgaguacagaaucagaugcggcaagaagcccagccagaaggccaccgugcugcccgaggacaucauccccagcgagagcagcagccugagcgacaccaccaccuacgacgaccccagcgacgccuucaccuuccccggccagagaagcagcagcgugccccacagccccagaauccugccccccaagagccugggcaucgagagaauccacuucagaaagagcagcaucaacgagcaguucguggacaccagacagagcagagagaugcugagcacccacagcagccccuacaagacccuggagagaagaccccagggcggcagaagcaugcccaccacccccgugcugaccagaaacgccuacagcagcagccaccuggagcccgagagcagcagccagcacugcagacagagaagcggcagccuggagagccagagccaccugcugagcgagauggacagcgacaagcccuucuucagccugagcaagagccagagaagcagcagcaccgagauccuggacgacggcagcagcuacaccagccagagcagcaccgaguacuacugcgugacccccgugaccggccccuacuacaccacccagacccuggacaccagaaccagaggcagaagaagaagcaagaagcagaacgugagcaccagcaacagcggcagcaugcccaaccuggcccagaaggacagccugagaaacggcguguacagcaagagccaggagccccccagcagcagcuacuacaucgccggcuacacccccuacgccgagugcgacuucuacuacagcggcggcuacguguacgagaacgacaccgagggccaguacagcgugaaccccagcuacagaagcagcgcccacuacggcuacgagagacagagagacuacagcagaagcuuccacgaggacgagguggacagagugccccacaaccccuacgccacccugagacugcccagaaaggccgccgccaagagcgagcacaucaccaagaacauccacaaggcccugguggccgagcaccugagaggcugguaccagagagccagcggccagaaggaccagggccacagcccccagaccagcuucgacagcgacagaggcagccagagaugccugggcuucgccggccugcaggugcccugcagccccagcagcagagccagcagcuacagcagcgugagcagcaccaacgccagcggcaacuggagaacccagcugaccaucggccugagcgacuacgagacccccgcccacagcagcuacaccagcugcuacggcaacguguacaacccccugcccagccccagcagacaguacaccgagaucagccagcuggacggcaccgacggcaaccagcuggaggacaaccuggagagcagcgagcagagacuguucuggcacgaggacagcaagcccggcacccugguguaa

SEQ ID NO: 17241 - RNA, 1245 nt, Artificial Sequence
  FRMD5__Homo_sapiens__NP_001273419
augugcuucagagugaaguucuaccccgccgaccccgccgcccugaaggaggagaucaccagauaccugguguuccugcagaucaagagagaccuguaccacggcagacugcugugcaagaccagcgacgccgcccugcuggccgccuacauccugcaggccgagaucggcgacuacgacagcggcaagcaccccgagggcuacagcagcaaguuccaguucuuccccaagcacagcgagaagcuggagagaaagaucgccgagauccacaagaccgagcugagcggccagacccccgccaccagcgagcugaacuuccugagaaaggcccagacccuggagaccuacggcguggacccccaccccugcaaggacgugagcggcaacgccgccuuccuggccuucacccccuucggcuucguggugcugcagggcaacaagagagugcacuucaucaaguggaacgaggugaccaagcugaaguucgagggcaagaccuucuaccuguacgagaagaagaucauccugaccuacuucgcccccacccccgaggccugcaagcaccuguggaagugcggcaucgagaaccaggccuucuacaagcuggagaagagcagccaggugagaaccgugagcagcagcaaccuguucuucaagggcagcagauucagauacagcggcagaguggccaaggaggugauggagagcagcgccaagaucaagagagagccccccgagauccacagagccggcauggugcccagcagaagcugccccagcaucacccacggccccagacugagcagcgugcccagaaccagaagaagagccgugcacaucagcaucauggagggccuggagagccugagagacagcgcccacagcacccccgugagaagcaccagccacggcgacaccuuccugccccacgugagaagcagcagaaccgacagcaacgagagaguggccgugaucgccgacgaggccuacagccccgccgacagcgugcugcccacccccguggccgagcacagccuggagcugaugcugcugagcagacagaucaacggcgccaccugcagcaucgaggaggagaaggagagcgaggccagcacccccaccgccaccgagguggaggcccugggcggcgagcugagagcccugugccagggccacagcggccccgaggaggagcaggccauggugugccugcagaacccccugagcggcgagcccgcccacuaa

SEQ ID NO: 17242 - RNA, 795 nt, Artificial Sequence
  FRMD6__Homo_sapiens__NP_001253976
auggaccagcuggagaagagaagcagagccagcggcagcagcgccggcagcaugaagcacaagagacugagcagacacagcaccgccagccacagcagcagccacaccagcggcaucgaggccgacaccaagcccagagacaccggccccgaggacagcuacagcagcagcgccauccacagaaagcugaagaccugcagcagcaugaccagccacggcagcagccacaccagcggcguggagagcggcggcaaggacagacuggaggaggaccugcaggacgacgagaucgagaugcugguggacgaccccagagaccuggagcagaugaacgaggagagccuggaggugagccccgacaugugcaucuacaucaccgaggacaugcugaugagcagaaagcugaacggccacagcggccugaucgugaaggagaucggcagcagcaccagcagcagcagcgagaccguggugaagcugagaggccagagcaccgacagccugccccagaccaucugcagaaagcccaagaccagcaccgacagacacagccugagccuggacgacaucagacuguaccagaaggacuuccugagaaucgccggccugugccaggacaccgcccagagcuacaccuucggcugcggccacgagcuggacgaggagggccuguacugcaacagcugccuggcccagcagugcaucaacauccaggacgccuuccccgugaagagaaccagcaaguacuucagccuggaccugacccacgacgaggugcccgaguucgugguguaa

SEQ ID NO: 17243 - RNA, 2145 nt, Artificial Sequence
  FRMD7__Homo_sapiens__NP_919253
augcugcaccugaaggugcaguuccuggacgacagccagaagaucuucgugguggaccagaagagcagcggcaaggcccuguucaaccugagcugcagccaccugaaccuggccgagaaggaguacuucggccuggaguucugcagccacagcggcaacaacguguggcuggagcugcugaagcccaucaccaagcaggugaagaaccccaaggagaucguguucaaguucauggugaaguucuuccccguggaccccggccaccugagagaggagcugaccagauaccuguucacccugcagaucaagaaggaccuggcccugggcagacugcccugcagcgacaacugcaccgcccugauggugagccacauccugcagagcgagcugggcgacuuccacgaggagaccgacagaaagcaccuggcccagaccagauaccugcccaaccaggacugccuggagggcaagaucaugcacuuccaccagaagcacaucggcagaagccccgccgagagcgacauccugcugcuggacaucgccagaaagcuggacauguacggcaucagaccccaccccgccagcgacggcgagggcaugcagauccaccuggccguggcccacaugggcgugcuggugcugagaggcaacaccaagaucaacaccuucaacugggccaagaucagaaagcugagcuucaagagaaagcacuuccugaucaagcugcacgccaacauccuggugcugugcaaggacacccuggaguucaccauggccagcagagacgccugcaaggccuucuggaagaccugcguggaguaccacgccuucuucagacugagcgaggagcccaagagcaagcccaagacccugcugugcagcaagggcagcagcuucagauacagcggcagaacccagagacagcugcuggaguacggcagaaagggcagacugaagagccugcccuucgagagaaagcacuaccccagccaguaccacgagagacagugcagaagcagccccgaccugcugagcgacgugagcaagcagguggaggaccugagacuggccuacggcggcggcuacuaccagaacgugaacggcgugcacgccagcgagcccgugcuggagagcagaagaagaaacagcgcccuggaggugaccuucgccaccgagcuggagcacagcaagcccgaggccgaccccacccugcugcaccagagccagagcagcagcagcuuccccuucaucuacauggaccccguguucaacaccgagcccaaccccaaccccgaccccagagacaucuucagcgagagaagcagccugagcagcuuccagaccagcugcaaguucagcggcaaccacaugagcaucuacagcggccugaccagcaaggugagacccgccaagcagcugaccuacaccgacgugcccuacauccccugcaccggccagcaggugggcaucaugcccccccagguguucuucuacguggacaagcccccccaggugcccagauggagccccaucagagccgaggagagaaccagcccccacagcuacguggagcccaccgccaugaagcccgccgagagaagccccagaaacaucagaaugaagagcuuccagcaggaccugcaggugcugcaggaggccaucgccagaaccagcggcagaagcaacaucaacgugggccuggaggaggaggaccccaaccuggaggacgccuucgugugcaacauccaggagcagacccccaagagaagccagagccagagcgacaugaagaccaucagauuccccuucggcagcgaguucagaccccugggccccugccccgcccugagccacaaggccgaccuguucaccgacauguucgccgagcaggagcugcccgccgugcugauggaccagagcaccgccgagagauacguggccagcgagagcagcgacagcgagagcgagauccugaagcccgacuacuacgcccuguacggcaaggagaucagaagccccauggccagaaucagacugagcagcggcagccugcagcuggacgaggaggacgaggacgccuacuucaacacccccaccgccgaggacagaaccagccugaagcccugcaacuacuuccuggccuaa

SEQ ID NO: 17244 - RNA, 4737 nt, Artificial Sequence
  FRMPD1__Homo_sapiens__NP_055722
auggaggagcuggagaccagccuguuccagaccagaaaggcccacagaaucgagcagaugguggccagauggcugagaagaagcagagacagcagcgccagagccaagguggccgccgccgacggccccgccagaaaccccacccagacccugauccccgugagacacaccgugaagaucgacaaggacacccugcugcaggacuacggcuuccacaucagcgagagccugccccugaccgugguggccgugaccgccggcggcagcgcccacggcaagcuguuccccggcgaccagauccugcagaugaacaacgagcccgccgaggaccugagcugggagagagccguggacauccugagagaggccgaggacagccugagcaucaccguggugagaugcaccagcggcgugcccaagagcagcuuccugaccgaggagaagagagccagacugaagaccaaccccgugaaggugcacuucgccgaggaggugcugaucagcggccacagccagggcaacagccugcugugcaugcccaacgugcugaagcuguaccuggagaacggccagaccaaggccuucaaguucgaggccaacaccaccgugaaggacaucauccugaccgugaaggagaagcugagcaucagaagcaucgaguacuucgcccuggcccuggaggagcaguacagcaucagcagacugcaccugcugcacgaggaggagcugauccagcaggugguggagagagaggagagccacgacuacagaugccuguucagagugugcuucgugcccaaggacccccuggaccugcugaaggaggaccccguggccuucgaguaccuguaccugcagagcugcagcgacgugcugcaggagagauucgccguggagaugaagugcagcagcgcccugagacuggccgcccugcacauccaggagagaaucuacgccugcgcccagccccagaagaucagccugaaguacaucgagaaggacuggggcaucgagaacuucaucagccccacccugcugagaaacaugaagggcaaggacaucaagaaggccaucagcuuccacaugaagagaaaccagaaccugcuggagcccagacagaagcagcugaucagcgccgcccagcugagacugaacuaccugcagauccugggcgagcugaagaccuacggcggcagaaucuucaacgccacccugaugcugcaggacagagagagcuacaucgcccugcuggugggcgccaaguacggcaucagccaggugaucaacagcaagcugaacaucaugagcacccuggccgaguucgccaacaucagcagaguggagcugaccgaggagagcgagaaggugagcguggugaagguguaccugcaggacgugaaggugcugacccugcugcuggagagcaacagcgccaaggaccuggccugccugaucgccggcuacuacagacugcugguggaccccgugaccagcaucuuccuguggcccggcaacaagcagcaggcccacagagugagcgccgaggagggcuacgagagcagagccugcagcgacagcgaggagagcagcgagguggacugcgugcuggagccccugagcgacagaagacuggugaagcuggcccccugcagaagccugaucaaggaggagcagccccccggcaacagccccacccccgagguggccagaagaggccccagcaccugcggcgccagcagcaccaccgacagcgccgagagcgaggccagcgacagcgccaacaccgagagcagaggcuacagaaccagcggcagcagcgagagcauggacgcccuggaggaggacgaccuggacaccugcagcagcagcagaagcaccuucuuccacuucggcagccccggccuggccgagagcaucgacagcgacagccaggaggagagaagcggcaucgagaccagcggcuuccugugccugcuggaccuggcccagagagccaacccccagugccagaagaccgaguucagcgagagcgccgcccuggagaccuucggcugggcccccgagcugagcaccgugagacuggaccccagacuguacgagggcagccacgccgacuacuacagccugugcagcagcgugagccccgccagcuaccugagcgacagcagcgagagcaccgccagcagacagggcggcgccccccccgccuggggccagcagggcuggaccgaggcccagcccagcagcaugcuggagccccuggcccugcaccccccccuggccuucgaggacggcagcagcgacgaggaguacuacgacgccgccgacaagcugaccccccccggcccccccagcggccccagagacgugagcaccgccgagcccagcgccaccagccugcagaacaaggccagcaccagcagccccgagaacagccugcccugcggccccgacggcagacagcccagcagaagaggcggcgugaagaaguacgccaagacccugagaaagagaagaagcuuccugcagaccgacuacaccagccaggugagcuucccccuggugcccagcgccagccuggagagcguggacgacgugugcuacuacgacagagagcccuaccuggcccugggcgcccccagccccaccgugagcagccugcaggacaugcagggcgagcccggccugcuggagaccaaggcccugggccugcuggccccccugagagagaccaagagcaccaaccccgccagcagagugauggagauggagcccgagaccauggagaccaagagcgugaucgacagcagagugagcagcaucagcgccaucagauucagaaucgaccccaacaacaaggagaacagcggcguggugcccgccgccagcagcagcgccagcaccccccacugcagcaaccccggcagcagcggccccgacaccgcccaggccagacccagccagauccugccccugagccaggaccuggacggcaucgcccccaaggagcccaccaucgagcacggcgacagcagcuucagccugagcagcggcgaccccaaccccgacagagccugccuggccagcaaccccggccugaacaacgugagccagggcgacacccuggagcugcagcuggagccccacgugcagcuggagaugggccuggagagcuucugcaccaaccacauccaggagaccgcccccaaguacaccgagccccugcugagccccagagacgagcccagaagcgacgagugcggcaucaaccccggcgagaagaucgccagcauccccaccaaggaggagccccagggccagcugagccuggagagagacagagaggugaccaacaagaacggcaccaacguguuccaggaggagagcagaaaggacagcggcgacagccccggcgacgugagcaacaacgugagccagacccuggacaucagcagccccgccggcaagaucgugaccagccugagccuggacgcccccgugaccggcaccgagcagauccccccccacccccccagagacccccagggccagagcagagagccccccggccagggcugccaggcccaggagcagaagcuguucguggagcuggaccuggaccccgacuucuuccugggcaagcagaccgugagccccgccgugccccccgagggcaucaaggccgaggcccccaaccacgugaccggccaggacaucgcccccagagacagccccgagugggugugcuucaaccccgagcccagccugcccgagccccugcccugcccccaggaggacccccaccuggagaccagcaaccacugccugcugagcgagggcaagagcgacagcagcagcaucugccugagcgccgagaagagcuuccugugcuucgcccccgagagccaccccgaggugagcgccagccugagaguggccaccagccugggcuucgccggcaugaacgagaugguggcccccagaaucggcauggaccagugcagcugccaguucagcuacgccaccugcuucagaggcccccagcccgagaccgaggaggaggacagagaccuggaggcccaccccauggccccccugaccagcccccccagcgccggcagccccguggugcugcccuggagacccgccagagcccacagcugcaccaccgccccccugagcagaaagagccacaucuggcccgaguacugcagcagagcccugagacagcugaaggccacccccgccagcacccccgagggcuucauccagcugauggagagccugcuggagcugcaggacauccuggagaccagcuggggcgugggcaacaagcacccccccgagaagugcaccuggcacuucaccgagagcagaagcagacugugcaugggcagccagaagcugcugagcagcugcagacacgugaucagaauggaccagagccccgaggagaugcagggcgccgugagagacaccuuccagcaccuggugcagcuggccggccugugcuuccaguucaccgacugcagcagaugcagcgccagacacagagaggccgccggcaaccugagagacgugguguacaccuaccaccaguucaucgaggccgccaagagcaccugcgagagaggcuaccacgaccugagcgugaagcugcuggccagacagugcaccgcccugaccgccgccguguucugccugacccagaaguucagagccagcaccgcccuguaa

SEQ ID NO: 17245 - RNA, 3930 nt, Artificial Sequence
  FRMPD2__Homo_sapiens__NP_001018081
augcagccccugaccaaggacgccggcaugagccugagcagcgugacccuggccagcgcccugcaggugagaggcgaggcccugagcgaggaggagaucuggagccugcuguuccuggccgccgagcagcugcuggaggaccugagaaacgacagcagcgacuacguggugugccccuggagcgcccugcugagcgccgccggcagccugagcuuccagggcagagugagccacaucgaggccgcccccuucaaggcccccgagcugcugcagggccagagcgaggacgagcagcccgacgccagccagaugcacguguacagccugggcaugacccuguacuggagcgccggcuuccacgugcccccccaccagccccugcagcugugcgagccccugcacagcauccugcugaccaugugcgaggaccagccccacagaagaugcacccugcagagcgugcuggaggccugcagagugcacgagaaggaggugagcguguaccccgcccccgccggccugcacaucagaagacuggugggccuggugcugggcaccaucagcgagguggagaagagagugguggaggagagcagcagcgugcagcagaacagaagcuaccugcugagaaagagacugagaggcaccagcagcgagagccccgccgcccaggcccccgagugccugcaccccugcagagugagcgagagaagcaccgagacccagagcagccccgagccccacuggagcacccugacccacagccacugcagccugcuggugaacagagcccugcccggcgccgacccccaggaccagcaggccggcagaagacugagcagcggcagcgugcacagcgccgccgacagcagcuggcccaccacccccagccagagaggcuuccugcagagaagaagcaaguucagcagacccgaguucauccugcuggccggcgaggcccccaugacccugcaccugcccggcagcguggugaccaagaagggcaagagcuaccuggcccugagagaccugugcguggugcugcugaacggccagcaccuggaggugaagugcgacguggagagcaccgugggcgccguguucaacgccgugaccagcuucgccaaccuggaggagcugaccuacuucggccuggccuacaugaagagcaaggaguucuucuuccuggacagcgagaccagacugugcaagaucgcccccgagggcuggagagagcagccccagaagaccagcaugaacaccuucacccuguuccugagaaucaaguucuucgugagccacuacggccugcugcagcacagccugaccagacaccaguucuaccugcagcugagaaaggacauccuggaggagagacuguacugcaacgaggagauccugcugcagcugggcgugcuggcccugcaggccgaguucggcaacuaccccaaggagcagguggagagcaagcccuacuuccacguggaggacuacauccccgccagccugaucgagagaaugaccgcccugagagugcagguggaggugagcgagaugcacagacugagcagcgcccuguggggcgaggacgccgagcugaaguuccugagagugacccagcagcugcccgaguacggcgugcuggugcaccagguguucagcgagaagagaagacccgaggaggagauggcccugggcaucugcgccaagggcgugaucguguacgaggugaagaacaacagcagaaucgccaugcugagauuccaguggagagagaccggcaagaucagcaccuaccagaagaaguucaccaucaccagcagcgugaccggcaagaagcacaccuucgugaccgacagcgccaagaccagcaaguaccugcuggaccugugcagcgcccagcacggcuucaacgcccagaugggcagcggccagcccagccacgugcuguucgaccacgacaaguucgugcagauggccaaccugagccccgcccaccaggccagaagcaagccccugaucuggauccagagacugagcugcagcgagaacgagcuguucgugagcagacugcagggcgccgccggcggccugcugagcaccagcauggacaacuucaacguggacggcagcaaggaggccggcgccgagggcaucggcagaagccccugcaccggcagagagcagcugaagagcgccugcgugauccagaagcccaugaccugggacagccugagcggcccccccgugcagagcaugcacgccggcagcaagaacaacagaagaaagagcuucaucgccgagcccggcagagagaucgugagagugacccugaagagagacccccacagaggcuucggcuucgugaucaacgagggcgaguacagcggccaggccgaccccggcaucuucaucagcagcaucauccccggcggccccgccgagaaggccaagaccaucaagcccggcggccagauccuggcccugaaccacaucagccuggagggcuucaccuucaacauggccgugagaaugauccagaacagccccgacaacaucgagcugaucaucagccagagcaagggcgugggcggcaacaaccccgacgaggagaagaacagcaccgccaacagcggcgugagcagcaccgacauccugagcuucggcuaccagggcagccugcugagccacacccaggaccaggacagaaacaccgaggagcuggacauggccggcgugcagagccuggugcccagacugagacaccagcugagcuuccugccccugaagggcgccggcagcagcugcccccccagcccccccgagaucagcgccggcgagaucuacuucguggagcuggugaaggaggacggcacccugggcuucagcgugaccggcggcaucaacaccagcgugcccuacggcggcaucuacgugaagagcaucgugcccggcggccccgccgccaaggagggccagauccugcagggcgacagacugcugcagguggacggcgugauccugugcggccugacccacaagcaggccgugcagugccugaagggccccggccagguggccagacuggugcuggagagaagagugcccagaagcacccagcagugccccagcgccaacgacagcaugggcgacgagagaaccgccgugagccuggugaccgcccugcccggcagacccagcagcugcgugagcgugaccgacggccccaaguucgaggugaagcugaagaagaacgccaacggccugggcuucagcuucgugcagauggagaaggagagcugcagccaccugaagagcgaccuggugagaaucaagagacuguuccccggccagcccgccgaggagaacggcgccaucgccgccggcgacaucauccuggccgugaacggcagaagcaccgagggccugaucuuccaggaggugcugcaccugcugagaggcgccccccaggaggugacccugcugcugugcagacccccccccggcgcccugcccgagcuggagcaggaguggcagacccccgagcugagcgccgacaaggaguucaccagagccaccugcaccgacagcugcaccagccccauccuggaccaggaggacagcuggagagacagcgccagccccgacgccggcgagggccugggccugagacccgagagcagccagaaggccaucagagaggcccaguggggccagaacagagagagacccugggccagcagccugacccacagccccgagagccacccccaccugugcaagcugcaccaggagagagacgagagcacccuggccaccagccuggagaaggacgugagacagaacugcuacagcgugugcgacaucaugagacugggcagauacagcuucagcagcccccugaccagacugagcaccgacaucuucuaa

SEQ ID NO: 17246 - RNA, 3969 nt, Artificial Sequence
  FRMPD4__Homo_sapiens__NP_055543
auggacguguucagcuucgugaagaucgccaagcugagcagccacagaaccaagagcagcggcuggcccccccccagcggcaccuggggccugagccaggugccccccuacggcugggagaugaccgccaacagagacggcagagacuacuucaucaaccacaugacccaggccauccccuucgacgaccccagacuggagagcugccagaucaucccccccgcccccagaaagguggagaugagaagagaccccgugcugggcuucggcuucguggccggcagcgagaagcccgugguggugagaagcgugacccccggcggccccagcgagggcaagcugauccccggcgaccagaucgugaugaucaacgacgagcccgugagcgccgcccccagagagagagugaucgaccuggugagaagcugcaaggagagcauccugcugaccgugauccagcccuaccccagccccaagagcgccuucaucagcgccgccaagaaggccagacugaagagcaaccccgugaaggugagauucagcgaggaggugaucaucaacggccaggugagcgagaccgugaaggacaacagccugcuguucaugcccaacgugcugaagguguaccuggagaacggccagaccaagagcuucagauucgacugcagcaccagcaucaaggacgugauccugacccugcaggagaagcugagcaucaagggcaucgagcacuucagccugaugcuggagcagagaaccgagggcgccggcaccaagcugcugcugcugcacgagcaggagacccugacccaggugacccagagacccagcagccacaagaugagaugccuguucagaaucagcuucgugcccaaggaccccaucgaccugcugagaagagaccccguggccuucgaguaccuguacgugcagagcugcaacgacguggugcaggagagauucggccccgagcugaaguacgacaucgcccugagacuggccgcccugcagauguacaucgccaccgugaccaccaagcagacccagaagaucagccugaaguacaucgagaaggaguggggccuggagaccuuccugcccagcgccgugcugcagagcaugaaggagaagaacaucaagaaggcccugagccaccuggugaaggccaaccagaaccuggugccccccggcaagaagcugagcgcccugcaggccaaggugcacuaccugaaguuccugagcgaccugagacuguacggcggcagaguguucaaggccacccuggugcaggccgagaagagaagcgaggugacccugcuggugggccccagauacggcaucagccacgugaucaacaccaagaccaaccugguggcccugcuggccgacuucagccacgugaacagaaucgagauguucagcgaggaggagagccuggugagaguggagcugcacgugcuggacgugaagcccaucacccugcugauggagagcagcgacgccaugaaccuggccugccugaccgccggcuacuacagacugcugguggacagcagaagaagcaucuucaacauggccaacaagaagaacaccgccacccaggagaccggccccgagaacaagggcaagcacaaccugcugggccccgacuggaacugcaucccccagaugaccaccuucaucggcgagggcgagcaggaggcccagaucaccuacaucgacagcaagcagaagaccguggagaucaccgacagcaccaugugccccaaggagcacagacaccuguacaucgacaacgccuacagcagcgacggccugaaccagcagcugagccagcccggcgaggcccccugcgaggccgacuacagaagccuggcccagagaagccugcugacccugagcggccccgagacccugaagaaggcccaggagagccccagaggcgccaaggugagcuucaucuucggcgacuucgcccuggacgacggcaucagcccccccacccugggcuacgagacccugcuggacgagggccccgagaugcuggagaagcagagaaaccuguacaucggcagcgccaacgacaugaagggccuggaccugacccccgaggccgagggcauccaguucguggagaacagcguguacgccaacaucggcgacgugaagagcuuccaggccgccgagggcaucgaggagccccugcugcacgacaucugcuacgccgagaacaccgacgacgccgaggacgaggacgaggugagcugcgaggaggaccugguggugggcgagaugaaccagcccgccauccugaaccugagcggcagcagcgacgacaucaucgaccugaccagccugcccccccccgagggcgacgacaacgaggacgacuuccugcugagaagccugaacauggccaucgccgcccccccccccggcuucagagacagcagcgacgaggaggacagccagagccaggccgccagcuuccccgaggacaaggagaagggcagcagccugcagaacgacgagauccccgugagccugaucgacgccgugcccaccagcgccgagggcaagugcgagaagggccuggacaacgccguggugagcacccugggcgcccuggaggcccugagcgugagcgaggagcagcagaccagcgacaacagcggcguggccauccugagagccuacagccccgagagcagcagcgacagcggcaacgagaccaacagcagcgagaugaccgagagcagcgagcuggccaccgcccagaagcagagcgagaaccugagcagaauguuccuggccacccacgagggcuaccacccccuggccgaggagcagaccgaguuccccgccagcaagacccccgccggcggccugccccccaagagcagccacgcccuggccgccagacccgccaccgaccugccccccaagguggugcccagcaagcagcugcugcacagcgaccacauggagauggagcccgagaccauggagaccaagagcgugaccgacuacuucagcaagcugcacaugggcagcguggccuacagcugcaccagcaagagaaagagcaagcuggccgacggcgagggcaaggccccccccaacggcaacaccaccggcaagaagcagcagggcaccaagaccgccgagauggaggaggaggccagcggcaaguucggcaccgugagcagcagagacagccagcaccugagcaccuucaaccuggagagaaccgccuucagaaaggacagccagagaugguacguggccaccgagggcggcauggccgagaagagcggccuggaggccgccaccggcaagaccuuccccagagccagcggccugggcgccagagaggccgagggcaaggaggagggcgcccccgacggcgagaccagcgacggcagcggccugggccagggcgacagauuccugaccgacgugaccugcgccagcagcgccaaggaccuggacaaccccgaggacgccgacagcagcaccugcgaccaccccagcaagcugcccgaggccgacgagagcguggccagacugugcgacuaccaccuggccaagagaaugagcagccugcagagcgagggccacuucagccugcagagcagccagggcagcagcguggacgccggcugcggcaccggcagcagcggcagcgccugcgccacccccguggagagcccccugugccccagccugggcaagcaccugauccccgacgccagcggcaagggcgugaacuacauccccagcgaggagagagcccccggccugcccaaccacggcgccaccuucaaggagcugcacccccagaccgagggcaugugccccagaaugaccgugcccgcccugcacaccgccaucaacaccgagccccuguucggcacccugagagacggcugccacagacugcccaagaucaaggagaccaccguguaa

SEQ ID NO: 17247 - RNA, 1035 nt, Artificial Sequence
  FRRS1L__Homo_sapiens__NP_055149
augagaagacccagacagggcggcggcggcgccggcggcagcgccgccgccagagccagagccggcggccugggcggcggcagcgugcccgccagagccagaggcgcccccgccgccgccagagccgccuggcugagagaccugugcgccagaauggccagaccccccagacagcaccccggcgugugggccagccugcugcugcugcugcugaccggccccgccgccugcgccgccagccccgccgacgacggcgccggccccggcggcagaggccccagaggcagagccagaggcgacaccggcgccgacgaggccgugcccagacacgacagcagcuacggcaccuucgccggcgaguucuacgaccugagauaccugagcgaggagggcuaccccuuccccaccgccccccccguggaccccuucgccaagaucaagguggacgacugcggcaagaccaagggcugcuucagauacggcaagcccggcugcaacgccgagaccugcgacuacuuccugagcuacagaaugaucggcgccgacguggaguucgagcugagcgccgacaccgacggcuggguggccgugggcuucagcagcgacaagaagaugggcggcgacgacgugauggccugcgugcacgacgacaacggcagagugagaauccagcacuucuacaacgugggccagugggccaaggagauccagagaaaccccgccagagacgaggagggcguguucgagaacaacagagugaccugcagauucaagagacccgugaacgugcccagagacgagaccaucguggaccugcaccugagcugguacuaccuguucgccuggggccccgccauccagggcagcaucaccagacacgacaucgacagcccccccgccagcgagagaguggugagcaucuacaaguacgaggacaucuucaugcccagcgccgccuaccagaccuucagcagccccuucugccugcugcugaucguggcccugaccuucuaccugcugaugggcacccccuaa

SEQ ID NO: 17248 - RNA, 1527 nt, Artificial Sequence
  FRS2__Homo_sapiens__NP_001265286
augggcagcugcugcagcugccccgacaaggacaccgugcccgacaaccacagaaacaaguucaaggugaucaacguggacgacgacggcaacgagcugggcagcggcaucauggagcugaccgacaccgagcugauccuguacaccagaaagagagacagcgugaaguggcacuaccugugccugagaagauacggcuacgacagcaaccuguucagcuucgagagcggcagaagaugccagaccggccagggcaucuucgccuucaagugcgccagagccgaggagcuguucaacaugcugcaggagaucaugcagaacaacagcaucaacgugguggaggagcccgugguggagagaaacaaccaccagaccgagcuggaggugcccagaacccccagaacccccaccacccccggcuucgccgcccagaaccugcccaacggcuaccccagauaccccagcuucggcgacgccagcagccaccccagcagcagacaccccagcgugggcagcgccagacugcccagcgugggcgaggagagcacccacccccugcugguggccgaggagcaggugcacaccuacgugaacaccaccggcgugcaggaggagagaaagaacagaaccagcgugcacgugccccuggaggccagagugagcaacgccgagagcagcacccccaaggaggagcccagcagcaucgaggacagagacccccagauccugcuggagcccgagggcgugaaguucgugcugggccccacccccgugcagaagcagcugauggagaaggagaagcuggagcagcugggcagagaccaggugagcggcagcggcgccaacaacaccgagugggacaccggcuacgacagcgacgagagaagagacgcccccagcgugaacaagcugguguacgagaacaucaacggccugagcauccccagcgccagcggcgugagaagaggcagacugaccagcaccagcaccagcgacacccagaacaucaacaacagcgcccagagaagaaccgcccugcugaacuacgagaaccugcccagccugccccccgugugggaggccagaaagcugagcagagacgaggacgacaaccugggccccaagacccccagccugaacggcuaccacaacaaccuggaccccaugcacaacuacgugaacaccgagaacgugaccgugcccgccagcgcccacaagaucgaguacagcagaagaagagacugcacccccaccguguucaacuucgacaucagaagacccagccuggagcacagacagcugaacuacauccagguggaccuggagggcggcagcgacagcgacaacccccagacccccaagacccccaccaccccccugccccagacccccaccagaagaaccgagcuguacgccgugaucgacaucgagagaaccgccgccaugagcaaccugcagaaggcccugcccagagacgacggcaccagcagaaagaccagacacaacagcaccgaccugcccauguaa

SEQ ID NO: 17249 - RNA, 1479 nt, Artificial Sequence
  FRS3__Homo_sapiens__XP_011512557
augggcagcugcugcagcugccugaacagagacagcgugcccgacaaccaccccaccaaguucaaggugaccaacguggacgacgagggcguggagcugggcagcggcgugauggagcugacccagagcgagcuggugcugcaccugcacagaagagaggccgugagauggcccuaccugugccugagaagauacggcuacgacagcaaccuguucagcuucgagagcggcagaagaugccagaccggccagggcaucuucgccuucaagugcagcagagccgaggagaucuucaaccugcugcaggaccugaugcagugcaacagcaucaacgugauggaggagcccgugaucaucaccagaaacagccaccccgccgagcuggaccugcccagagccccccagccccccaacgcccugggcuacaccgugagcagcuucagcaacggcugccccggcgagggccccagauucagcgcccccagaagacugagcaccagcagccugagacaccccagccugggcgaggagagcacccacgcccugaucgcccccgacgagcagagccacaccuacgugaacacccccgccagcgaggacgaccacagaagaggcagacacugccugcagccccugcccgagggccaggcccccuuccugccccaggccagaggccccgaccagagagacccccagguguuccugcagcccggccaggugaaguucgugcugggccccacccccgccagaagacacauggugaagugccagggccugugccccagccugcacgaccccccccaccacaacaacaacaacgaggcccccagcgagugccccgcccagcccaagugcaccuacgagaacgugaccggcggccuguggagaggcgccggcuggagacugagccccgaggagcccggcuggaacggccuggcccacagaagagccgcccugcugcacuacgagaaccugcccccccugccccccgugugggagagccaggcccagcagcugggcggcgaggccggcgacgacggcgacagcagagacggccugacccccagcagcaacggcuuccccgacggcgaggaggacgagaccccccugcagaagcccaccagcaccagagccgccaucagaagccacggcagcuuccccgugccccugaccagaagaagaggcagccccagaguguucaacuucgacuucagaagacccggccccgagccccccagacagcugaacuacauccagguggagcugaagggcuggggcggcgacagacccaagggcccccagaaccccagcagcccccaggcccccaugcccaccacccaccccgccagaagcagcgacagcuacgccgugaucgaccugaagaagaccguggccaugagcaaccugcagagagcccugcccagagacgacggcaccgccagaaagaccagacacaacagcaccgaccugccccuguaa

SEQ ID NO: 17250 - RNA, 9042 nt, Artificial Sequence
  FRY__Homo_sapiens__NP_075463
auggccagccagcaggacagcggcuucuucgagaucagcaucaaguaccugcugaagagcuggagcaacaccagccccgugggcaacggcuacaucaagccccccgugccccccgccagcggcacccacagagagaagggcccccccaccaugcugcccaucaacguggaccccgacagcaagcccggcgaguacgugcugaagagccuguucgugaacuucaccacccaggccgagagaaagaucagaaucaucauggccgagccccuggagaagccccugaccaagagccugcagagaggcgaggacccccaguucgaccaggugaucagcagcaugagcagccugagcgaguacugccugcccagcauccugagaacccuguucgacugguacaagagacagaacggcaucgaggacgagagccacgaguacagacccagaaccagcaacaagagcaagagcgacgagcagcagagagacuaccugauggagagaagagaccuggccaucgacuucaucuucagccuggugcugaucgaggugcugaagcagaucccccugcaccccgugaucgacagccugauccacgacgugaucaaccuggccuucaagcacuucaaguacaaggagggcuaccugggccccaacaccggcaacaugcacaucguggccgaccuguacgccgaggugaucggcgugcuggcccaggccaaguuccccgccgugaagaagaaguucauggccgagcugaaggagcugagacacaaggagcagaaccccuacguggugcagagcaucaucagccugaucaugggcaugaaguucuucagaaucaagauguaccccguggaggacuucgaggccagccugcaguucaugcaggagugcgcccacuacuuccuggaggugaaggacaaggacaucaagcacgcccuggccggccuguucguggagauccuggugcccguggccgccgccgugaagaacgaggugaacgugcccugccugagaaacuucguggagagccuguacgacaccacccuggagcugagcagcagaaagaagcacagccuggcccuguacccccuggugaccugccugcugugcgugagccagaagcagcuguuccugaacagauggcacaucuuccugaacaacugccugagcaaccugaagaacaaggaccccaagauggccagaguggcccuggagagccuguacagacugcuguggguguacaugaucagaaucaagugcgagagcaacaccgccacccagagcagacugaucaccaucaucaccacccuguuccccaagggcagcagaggcguggugcccagagacaugccccugaacaucuucgugaagaucauccaguucaucgcccaggagagacuggacuucgccaugaaggagaucaucuucgacuuccugugcgugggcaagcccgccaaggccuucagccugaaccccgagagaaugaacaucggccugagagccuuccuggugaucgccgacagccugcagcagaaggacggcgagccccccaugcccgugaccggcgccgugcugcccagcggcaacacccugagagugaagaagaccuaccugagcaagacccugaccgaggaggaggccaagaugaucggcaugagccuguacuacagccaggugagaaaggccguggacaacauccugagacaccuggacaaggaggugggcagaugcaugaugcugaccaacgugcagaugcugaacaaggagcccgaggacaugaucaccggcgagagaaagcccaagaucgaccuguucagaaccugcguggccgccauccccagacugcugcccgacggcaugagcaagcuggagcugaucgaccugcuggccagacugagcauccacauggacgacgagcugagacacaucgcccagaacagccugcagggccugcugguggacuucagcgacuggagagaggacgugcuguucggcuucaccaacuuccugcugagagaggugaacgacaugcaccacacccugcuggacagcagccugaagcugcugcugcagcugcugacccaguggaagcuggugauccagacccagggcaagguguacgagcaggccaacaagaucagaaacagcgagcugaucgccaacggcagcagccacagaauccagagcgagagaggcccccacugcagcgugcugcacgccguggagggcuucgcccuggugcugcugugcagcuuccagguggccaccagaaagcugagcgugcugauccugaaggagaucagagcccuguucaucgcccugggccagcccgaggacgacgacagacccaugaucgacgugauggaccagcugagcagcagcauccuggagagcuucauccacguggccgugagcgacagcgccacccugccccugacccacaacguggaccugcaguggcugguggaguggaacgccgugcuggugaacagccacuacgacgugaagagccccagccacguguggaucuucgcccagagcgugaaggaccccugggugcugugccuguucagcuuccugagacaggagaaccugcccaagcacugccccaccgcccugagcuacgccuggcccuacgccuucaccagacugcagagcgugaugccccugguggaccccaacagccccaucaacgccaagaagaccagcaccgccggcagcggcgacaacuacgugacccuguggagaaacuaccugauccugugcuucggcguggccaagcccagcaucaugagccccggccaccugagagccagcacccccgagaucauggccaccacccccgacggcaccgugagcuacgacaacaaggccaucggcacccccagcgugggcgugcugcugaagcagcuggugccccugaugagacuggagagcaucgagaucaccgagagccuggugcugggcuucggcagaaccaacagccugguguucagagagcugguggaggagcugcacccccugaugaaggaggcccuggagagaagacccgagaacaagaagagaagagagagaagagaccugcugagacugcagcugcugagaaucuucgagcugcuggccgacgccggcgugaucagcgacagcaccaacggcgcccuggagagagacacccuggcccugggcgcccuguuccuggaguacguggaccugaccagaaugcugcuggaggccgagaacgacaaggagguggagauccugaaggacaucagagcccacuucagcgccaugguggccaaccugauccagugcgugcccgugcaccacagaagauuccuguucccccagcagagccugagacaccaccuguucauccuguucagccagugggccggccccuucagcaucauguucaccccccuggacagauacagcgacagaaaccaccagaucaccagauaccaguacugcgcccugaaggccaugagcgccgugcugugcugcggccccguguucgacaacgugggccugagccccgacggcuaccuguacaaguggcuggacaacauccuggccugccaggaccugagagugcaccagcugggcugcgaggugguggugcugcugcuggagcugaaccccgaccagaucaaccuguucaacugggccaucgacagaugcuacaccggcagcuaccagcuggccagcggcugcuucaaggccaucgccaccgugugcggcagcagaaacuaccccuucgacaucgugacccugcugaaccuggugcuguucaaggccagcgacaccaacagagagaucuacgagaucagcaugcagcugaugcagauccuggaggccaagcuguucguguacagcaagaagguggccgagcagagacccggcagcauccuguacggcacccacggcccccugcccccccuguacagcgugagccuggcccugcugagcugcgagcuggccagaauguaccccgagcugacccugccccuguucagcgaggugagccagagauuccccaccacccaccccaacggcagacagaucaugcugaccuaccugcugcccuggcugcacaacaucgagcugguggacagcagacugcugcugcccggcagcagccccagcagccccgaggacgaggugaaggacagagagggcgacgugaccgccagccacggccugagaggcaacggcuggggcagccccgaggccaccagccuggugcugaacaaccugauguacaugaccgccaaguacggcgacgaggugcccggccccgagauggagaacgccuggaacgcccuggccaacaacgagaaguggagcaacaaccugagaaucacccugcaguuccugaucagccugugcggcgugagcagcgacaccgugcugcugcccuacaucaagaagguggccaucuaccugugcagaaacaacaccauccagaccauggaggagcugcuguucgagcugcagcagaccgagcccgugaaccccaucgugcagcacugcgacaacccccccuucuacagauucaccgccagcagcaaggccagcgccgccgccagcggcaccaccagcagcagcaacaccgugguggccggccaggagaacuuccccgacgccgaggagaacaagauccugaaggagagcgacgagagauucagcaacgugaucagagcccacaccagacuggagagcagauacagcaacagcagcggcggcagcuacgacgaggacaagaacgaccccaucagccccuacaccggcuggcugcugaccaucaccgagaccaagcagccccagccccugcccaugcccugcaccggcggcugcugggccccccugguggacuaccugcccgagaccaucacccccagaggcccccugcacagaugcaacaucgccgugaucuucaugaccgagauggugguggaccacagcgugagagaggacugggcccugcaccugccccugcugcugcacgccguguuccugggccuggaccacuacagacccgagguguucgagcacagcaagaagcugcugcugcaccugcugaucgcccugagcugcaacagcaacuuccacagcaucgccagcgugcugcugcagaccagagagaugggcgaggccaagacccugaccgugcagcccgccuaccagcccgaguaccuguacaccggcggcuucgacuuccugagagaggaccagagcagccccgugcccgacagcggccugagcagcagcagcaccagcagcagcaucagccugggcggcagcagcggcaaccugccccagaugacccaggagguggaggacguggacaccgccgccgagaccgacgagaaggccaacaagcugaucgaguuccugaccaccagagccuucggcccccuguggugccacgaggacaucacccccaagaaccagaacagcaagagcgccgagcagcugaccaacuuccugagacacguggugagcguguucaaggacagcaagagcggcuuccaccuggagcaccagcugagcgagguggcccugcagaccgcccuggccagcagcagcagacacuacgccggcagaagcuuccagaucuucagagcccugaagcagccccugagcgcccacgcccugagcgaccugcugagcagacugguggaggugaucggcgagcacggcgacgagauccagggcuacgugauggaggcccugcugacccuggaggccgccguggacaaccugagcgacugccugaagaacagcgaccugcugaccgugcugagcagaagcagcagccccgaccugagcagcagcagcaagcugaccgccagcagaaagagcaccggccagcugaacaugaaccccggcaccaccagcggcaacaccgccaccgccgagagaagcagacaccagagaagcuucagcgugcccaagaaguucggcgugaucgacagaagcagcgacccccccagaagcgccacccuggacagaauccaggccugcacccagcagggccugagcagcaagaccagaagcagcagcagccugaaggacagccugaccgaccccagccacaucaaccaccccaccaaccugcuggccaccaucuucugggugaccguggcccugauggagagcgacuucgaguucgaguaccugauggcccugagacugcugagcagacugcuggcccacaugccccuggacaaggccgagaacagagagaagcuggagaagcugcaggcccagcugaagugggccgacuucagcggccugcagcagcugcugcugaagggcuucaccagccugaccaccaccgaccugacccugcagcuguucagccugcugacccccgugagcaagaucagcaugguggacgccagccacgccaucggcuucccccugaacgugcugugccugcugccccagcugauccagcacuucgagaaccccaaccaguucugcaaggacaucgccgagagaaucgcccaggugugccuggaggagaagaaccccaagcugagcaaccuggcccacgugaugacccuguacaagacccacagcuacaccagagacugcgccaccugggugaacguggugugcagauaccugcacgaggccuacgccgacaucacccugaacauggugaccuaccuggccgagcugcuggagaagggccugcccagcgugcagcagccccugcugcaggugaucuacagccugcugagcuacauggaccugagcguggugcccgugaagcaguucaacguggaggugcugaagaccaucgagaaguacgugcagagcgugcacuggagagaggcccugaacauccugaagcugguggugagcagaagcgccagccuggugcugcccagcuaccagcacagcgaccugagcaagaucgagauccacagaguguggaccagcgccagcaaggagcugcccggcaagacccuggacuuccacuucgacaucagcgagacccccaucaucggcagaagauacgacgagcugcagaacagcagcggcagagacggcaagcccagagccauggccgugaccagaagcaccagcagcaccagcagcggcagcaacagcaacgugcuggugcccgugagcuggaagagaccccaguacagccagaagagaaccaaggagaagcuggugcacgugcugagccugugcggccaggaggugggccugagcaagaaccccagcgugaucuucagcagcugcggcgaccuggaccugcuggagcaccagaccagccuggugagcagcgaggacggcgccagagagcaggagaacauggacgacaccaacagcgagcagcaguucagaguguucagagacuucgacuuccuggacguggagcuggaggacggcgagggcgagagcauggacaacuucaacuggggcgugagaagaagaagccuggacagccuggacaagugcgacaugcagauccuggaggagagacagcugagcggcagcacccccagccugaacaagaugcaccacgaggacagcgacgagagcagcgaggaggaggaccugaccgccagccagauccuggagcacagcgaccugaucaugacccugagccccagcgaggagaccaaccccauggagcugcugaccaccgccugcgacagcacccccgccgagccccacagcuucaacaccagaaugagcagcuucgacgccagccugcccgacaugaacaaccugcagaucagcgagggcagcaaggccgaggccgugagagaggaggaggacaccaccgugcacgaggacgaccugagcagcagcaucaacgagcugcccgccgccuucgagugcagcgacagcuucagccuggacaugaccgagggcgaggagaagggcaacagagcccuggaccaguucacccuggccagcuucggcgagggcgacagaggcgugagccccccccccagccccuucuucagcgccauccuggccgccuuccagcccgccgccugcgacgacgccgaggaggccuggagaagccacaucaaccagcugaugugcgacagcgacggcagcugcgccguguacaccuuccacguguucagcagccuguucaagaacauccagaagagauucugcuuccugaccugcgacgccgccagcuaccugggcgacaaccugagaggcaucggcagcaaguucgugagcagcagccagaugcugaccagcugcagcgagugccccacccuguucguggacgccgagacccugcugagcugcggccugcuggacaagcugaaguucagcgugcuggagcugcaggaguaccuggacaccuacaacaacagaaaggaggccacccugagcuggcuggccaacugcaaggccaccuucgccggcggcagcagagacggcgugaucaccugccagcccggcgacagcgaggagaagcagcuggagcugugccagagacuguacaagcugcacuuccagcugcugcugcuguuccagagcuacugcaagcugaucggccaggugcacgaggugagcagcaugcccgagcugcugaacaugagcagagagcugagcgaccugaagaagcaccugaaggaggccagcgccgugaucgccgccgacccccuguacagcgacggcgccuggagcgagcccaccuucaccagcaccgaggccgccauccagagcaugcuggagugccugaagaacaacgagcugggcaaggcccugagacagaucagagagugcagaagccuguggcccaacgacaucuucggcagcagcagcgacgacgaggugcagacccugcugaacaucuacuucagacaccagacccugggccagaccggcaccuacgcccuggugggcagcaaccagagccugaccgagaucugcaccaagcugauggagcugaacauggagaucagagacaugaucagaagagcccagagcuacagagugcugaccaccuuccugcccgacagcagcgugagcggcaccagccuguaa

SEQ ID NO: 17251 - RNA, 9042 nt, Artificial Sequence
  FRYL__Homo_sapiens__NP_055845
augagcaacaucaccaucgaccccgacgugaagcccggcgaguacgugaucaagagccuguucgccgaguucgccgugcaggccgagaagaagaucgagguggugauggccgagccccuggagaagcugcugagcagaagccugcagagaggcgaggaccugcaguucgaccagcugaucagcagcaugagcagcguggccgagcacugccugcccagccugcugagaacccuguucgacugguacagaagacagaacggcaccgaggacgagagcuacgaguacagacccagaagcagcaccaagagcaagggcgacgagcagcagagagagagagacuaccugcuggagagaagagaccuggccguggacuucaucuucugccuggugcugguggaggugcugaagcagauccccgugcaccccgugcccgacccccuggugcacgaggugcugaaccuggccuucaagcacuucaagcacaaggagggcuacagcggcaccaacaccggcaacgugcacaucaucgccgaccuguacgccgaggugaucggcgugcuggcccagagcaaguuccaggccgugagaaagaaguucgugaccgagcugaaggagcugagacagaaggagcagagcccccacguggugcagagcgugaucagccugaucaugggcaugaaguucuucagagugaagauguaccccguggaggacuucgaggccagcuuccaguucaugcaggagugcgcccaguacuuccuggaggugaaggacaaggacaucaagcacgcccuggccggccuguucguggagauccugauccccguggccgccgccgugaagaacgaggugaacgugcccugccugaagaacuucguggagaugcuguaccagaccaccuucgagcugagcagcagaaagaagcacagccuggcccuguacccccugaucaccugccugcugugcgugagccagaagcaguucuuccugaacaacuggcacaucuuccugcagaacugccugagccaccugaagaacaaggaccccaagaugagcagaguggcccuggagagccuguacagacugcuguggguguacgugaucagaaucaagugcgagagcaacaccgugacccagagcagacugaugagcaucgugagcgcccuguuccccaagggcagcagaagcguggugcccagagacaccccccugaacaucuucgugaagaucauccaguucaucgcccaggagagacuggacuucgccaugaaggagaucaucuucgaccugcugagcgugggcaagagcaccaagaccuucaccaucaaccccgagagaaugaacaucggccugagaguguuccuggugaucgccgacagccugcagcagaaggacggcgagccccccaugcccaccaccggcgugauccugcccagcggcaacacccugagagugaagaagaucuuccugaacaagacccugaccgacgaggaggccaaggugaucggcaugagcguguacuacccccaggugagaaaggcccuggacagcauccugagacaccuggacaaggaggugggcagacccaugugcaugaccagcgugcagaugagcaacaaggagcccgaggacaugaucaccggcgagagaaagcccaagaucgaccuguucagaaccugcaucgccgccauccccagacugauccccgacggcaugagcagaaccgaccugaucgagcugcuggccagacugaccauccacauggacgaggagcugagagcccuggccuucaacacccugcaggcccugaugcuggacuuccccgacuggagagaggacgugcugagcggcuucguguacuucaucgugagagaggugaccgacgugcaccccacccugcuggacaacgccgugaagaugcuggugcagcugaucaaccaguggaagcaggccgcccagaugcacaacaagaaccaggacacccagcacggcguggccaacggcgccagccacccccccccccuggagagaagccccuacagcaacguguuccacgugguggagggcuucgcccuggugauccugugcagcagcagacccgccaccagaagacuggccgugagcgugcugagagagaucagagcccuguucgcccugcuggagauccccaagggcgacgacgagcuggccaucgacgugauggacagacugagccccagcauccuggagagcuucauccaccugaccggcgccgaccagaccacccugcuguacugccccagcagcaucgaccugcagacccuggccgaguggaacagcagccccaucagccaccaguucgacgugaucagccccagccacaucuggaucuucgcccacgugacccagggccaggaccccuggaucaucagccugagcagcuuccugaagcaggagaaccugcccaagcacugcagcaccgccgugagcuacgccuggauguucgccuacaccagacugcagcugcugagcccccagguggacaucaacagccccaucaacgccaagaaggugaacaccaccaccagcagcgacagcuacaucggccuguggagaaacuaccugauccugugcugcagcgccgccaccagcagcagcagcaccagcgccggcagcgugagaugcagcccccccgagacccuggccagcacccccgacagcggcuacagcaucgacagcaagaucaucggcauccccagccccagcagccuguucaagcacaucgugcccaugaugagaagcgagagcauggagaucaccgagagccuggugcugggccugggcagaaccaaccccggcgccuucagagagcugaucgaggagcugcaccccaucaucaaggaggcccuggagagaagacccgagaacaugaagagaagaagaagaagagacauccugagagugcagcuggugagaaucuucgagcugcuggccgacgccggcgugaucagccacagcgccagcggcggccuggacaacgagacccacuuccugaacaacacccugcuggaguacguggaccugaccagacagcugcuggaggccgagaacgagaaggacagcgacacccugaaggacaucagaugccacuucagcgcccugguggccaacaucauccagaacgugcccgugcaccagagaagaagcaucuucccccagcagagccugagacacagccuguucaugcuguucagccacugggccggccccuucagcaucauguucaccccccuggacagauacagcgacagaaacaugcagaucaacagacaccaguacugcgcccugaaggccaugagcgccgugcugugcugcggccccguggccgacaacgugggccugagcagcgacggcuaccuguacaaguggcuggacaacauccuggacagccuggacaagaaggugcaccagcugggcugcgaggccgugacccugcugcuggagcugaaccccgaccagagcaaccugauguacugggccguggacagaugcuacaccggcagcggcagaguggccgccggcugcuucaaggccaucgccaacguguuccagaacagagacuaccagugcgacaccgugaugcugcugaaccugauccuguucaaggccgccgacagcagcagaagcaucuacgagguggccaugcagcugcugcagauccuggagcccaagauguucagauacgcccacaagcuggaggugcagagaaccgacggcgugcugagccagcugagcccccugccccaccuguacagcgugagcuacuaccagcugagcgaggagcuggccagagccuaccccgagcugacccuggccaucuucagcgagaucagccagagaauccagaccgcccaccccgccggcagacaggugaugcugcacuaccugcugcccuggaugaacaacaucgagcugguggaccugaagccccugcccaccgccagaagacacgacgaggacgaggacgacagccugaaggacagagagcugauggugaccagcagaagauggcugagaggcgagggcuggggcagcccccaggccaccgccauggugcugaacaaccugauguacaugaccgccaaguacggcgacgagcuggccuggagcgagguggagaacguguggaccacccuggccgacggcuggcccaagaaccugaagaucauccugcacuuccugaucagcaucugcggcgugaacagcgagcccagccugcugcccuacgugaagaaggugaucguguaccugggcagagacaagaccaugcagcugcuggaggagcuggugagcgagcugcagcugaccgaccccgugagcagcggcgugacccacauggacaacccccccuacuacagaaucaccagcagcuacaagauccccagcgugaccagcggcaccaccagcagcagcaacaccaugguggcccccaccgacggcaaccccgacaacaagcccaucaaggagaacaucgaggagagcuacgugcaccuggacaucuacagcggccugaacagccaccugaacagacagcaccacagacuggagagcagauacagcagcagcagcggcggcagcuacgaggaggagaagagcgacagcaugccccuguacagcaacuggagacugaaggugauggagcacaaccagggcgagccccugcccuucccccccgccggcggcugcuggagcccccugguggacuacgugcccgagaccagcagccccggccugccccugcacagaugcaacaucgccgugauccugcugaccgaccugaucaucgaccacagcgugaagguggaguggggcagcuaccugcaccugcugcugcacgccaucuucaucggcuucgaccacugccaccccgagguguacgagcacugcaagagacugcugcugcaccugcugaucgugaugggccccaacagcaacaucagaaccguggccagcgugcugcugagaaacaaggaguucaacgagcccagagugcugaccgugaagcagguggcccaccuggacuacaacuucaccgccggcaucaacgacuucauccccgacuaccagcccagccccaugaccgacagcggccugagcagcagcagcaccagcagcagcaucagccugggcaacaacagcgccgccaucagccaccugcacaccaccauccugaacgagguggacaucagcguggagcaggacggcaaggugaagacccugauggaguucaucaccagcagaaagagaggcccccuguggaaccacgaggacgugagcgccaagaaccccagcaucaagagcgccgagcagcugaccaccuuccugaagcacguggugagcguguucaagcagagcagcagcgagggcauccaccuggagcaccaccugagcgagguggcccugcagaccgcccugagcugcagcagcagacacuacgccggcagaagcuuccagaucuucagagcccugaagcagccccugaccgccaccacccugagcgacgugcugagcagacugguggagaccgugggcgaccccggcgaggacgcccagggcuucgugaucgagcugcugcugacccuggagagcgccaucgacacccuggccgagaccaugaagcacuacgaccugcugagcgcccugagccagaccagcuaccacgaccccaucaugggcaacaaguacgccgccaacagaaagagcaccggccagcugaaccugagcaccagccccaucaacagcagcagcuaccugggcuacaacagcaacgccagaagcaacagccugagacugagccugaucggcgacagaagaggcgacagaagaagaagcaacacccuggacaucauggacggcagaaucaaccacagcagcagccuggccagaaccagaagccugagcagccugagagagaagggcauguacgacgugcagagcaccaccgagcccaccaaccugauggccaccaucuucuggaucgccgccagccugcuggagagcgacuacgaguacgaguaccugcuggcccugagacugcugaacaagcugcugauccaccugccccuggacaagagcgagagcagagagaagaucgagaacgugcagagcaagcugaaguggaccaacuuccccggccugcagcagcuguuccugaagggcuucaccagcgccagcacccaggagaugaccgugcaccugcugagcaagcugaucagcgugagcaagcacacccugguggaccccagccagcugagcggcuucccccugaacauccugugccugcugccccaccugauccagcacuucgacagccccacccaguucugcaaggagaccgccagcagaaucgccaaggugugcgccgaggagaagugccccacccuggugaaccuggcccacaugaugagccuguacagcacccacaccuacagcagagacugcagcaacuggaucaacguggugugcagauaccugcacgacagcuucagcgacaccaccuucaaccuggugaccuaccuggccgagcugcuggagaagggccugagcagcaugcagcagagccugcugcagaucaucuacagccugcugagccacaucgaccugagcgccgcccccgccaagcaguucaaccuggagaucaucaagaucaucggcaaguacgugcagagccccuacuggaaggaggcccugaacauccugaagcugguggugagcagaagcgccagccugguggugcccagcgacauccccaagaccuacggcggcgacaccggcagccccgagaucagcuucaccaagaucuucaacaacgugagcaaggagcugcccggcaagacccuggacuuccacuucgacaucagcgagacccccaucaucggcaacaaguacggcgaccagcacagcgccgccggcagaaacggcaagcccaaggugaucgccgugaccagaagcaccagcagcaccagcagcggcagcaacagcaacgcccuggugcccgugagcuggaagagaccccagcugagccagagaagaaccagagagaagcugaugaacgugcugagccugugcggccccgagagcggccugcccaagaaccccagcgugguguucagcagcaacgaggaccuggaggugggcgaccagcagaccagccugaucagcaccaccgaggacaucaaccaggaggaggagguggccguggaggacaacagcagcgagcagcaguucggcguguucaaggacuucgacuuccuggacguggagcuggaggacgccgagggcgagagcauggacaacuucaacuggggcgugagaagaagaagccuggacagcaucgacaagggcgacacccccagccugcaggaguaccagugcagcagcagcacccccagccugaaccugaccaaccaggaggacaccgacgagagcagcgaggaggaggccgcccugaccgccagccagauccugagcagaacccagaugcugaacagcgacagcgccaccgacgagaccauccccgaccaccccgaccugcugcugcagagcgaggacagcaccggcagcaucaccaccgaggaggugcugcagaucagagacgagacccccacccuggaggccagccuggacaacgccaacagcagacugcccgaggacaccaccagcgugcugaaggaggagcacgugaccaccuucgaggacgagggcagcuacaucauccaggagcagcaggagagccuggugugccagggcauccuggaccuggaggagaccgagaugcccgagccccuggcccccgagagcuaccccgagagcgugugcgaggaggacgugacccuggcccugaaggagcuggacgagagaugcgaggaggaggaggccgacuucagcggccugagcagccaggacgaggaggagcaggacggcuuccccgaggugcagaccagcccccugcccagccccuuccugagcgccaucaucgccgccuuccagcccguggccuacgacgacgaggaggaggccuggagaugccacgugaaccagaugcugagcgacaccgacggcagcagcgccguguucaccuuccacguguucagcagacuguuccagaccauccagagaaaguucggcgagaucaccaacgaggccgugagcuuccugggcgacagccugcagagaaucggcaccaaguucaagagcagccuggaggugaugaugcugugcagcgagugccccaccguguucguggacgccgagacccugaugagcugcggccugcuggagacccugaaguucggcgugcuggagcugcaggagcaccuggacaccuacaacgugaagagagaggccgccgagcaguggcuggacgacugcaagagaaccuucggcgccaaggaggacauguacagaaucaacaccgacgcccagcagauggagauccuggccgagcuggagcugugcagaagacuguacaagcugcacuuccagcugcugcugcuguuccaggccuacugcaagcugaucaaccaggugaacaccaucaagaacgaggccgaggugaucaacaugagcgaggagcuggcccagcuggagagcauccugaaggaggccgagagcgccagcgagaacgaggagaucgacaucagcaaggccgcccagaccaccaucgagaccgccauccacagccugaucgagacccugaagaacaaggaguucaucagcgccguggcccaggugaaggccuucagaagccuguggcccagcgacaucuucggcagcugcgaggacgaccccgugcagacccugcugcacaucuacuuccaccaccagacccugggccagaccggcagcuucgccgugaucggcagcaaccuggacaugagcgaggccaacuacaagcugauggagcugaaccuggagaucagagagagccugagaauggugcagagcuaccagcugcuggcccaggccaagcccaugggcaacauggugagcaccggcuucuaa

SEQ ID NO: 17252 - RNA, 978 nt, Artificial Sequence
  FRZB__Homo_sapiens__NP_001454
auggugugcggcagccccggcggcaugcugcugcugagagccggccugcuggcccuggccgcccugugccugcugagagugcccggcgccagagccgccgccugcgagcccgugagaaucccccugugcaagagccugcccuggaacaugaccaagaugcccaaccaccugcaccacagcacccaggccaacgccauccuggccaucgagcaguucgagggccugcugggcacccacugcagccccgaccugcuguucuuccugugcgccauguacgcccccaucugcaccaucgacuuccagcacgagcccaucaagcccugcaagagcgugugcgagagagccagacagggcugcgagcccauccugaucaaguacagacacagcuggcccgagaaccuggccugcgaggagcugcccguguacgacagaggcgugugcaucagccccgaggccaucgugaccgccgacggcgccgacuuccccauggacagcagcaacggcaacugcagaggcgccagcagcgagagaugcaagugcaagcccaucagagccacccagaagaccuacuucagaaacaacuacaacuacgugaucagagccaaggugaaggagaucaagaccaagugccacgacgugaccgccgugguggaggugaaggagauccugaagagcagccuggugaacauccccagagacaccgugaaccuguacaccagcagcggcugccugugccccccccugaacgugaacgaggaguacaucaucaugggcuacgaggacgaggagagaagcagacugcugcugguggagggcagcaucgccgagaaguggaaggacagacugggcaagaaggugaagagaugggacaugaagcugagacaccugggccugagcaagagcgacagcagcaacagcgacagcacccagagccagaagagcggcagaaacagcaaccccagacaggccagaaacuaa

SEQ ID NO: 17253 - RNA, 900 nt, Artificial Sequence
  FSBP__Homo_sapiens__NP_001243070
auggugggcaaggccagaagcagcaacuucacccugagcgagaagcuggaccugcugaagcuggugaagcccuacgugaagauccuggaggagcacaccaacaagcacagcgugaucguggagaagaacagaugcugggacaucaucgccgugaacuacaacgccaucggcguggacagaccccccagaaccgcccagggccugagaacccuguacaagagacugaaggaguacgccaagcaggagcugcugcagcagaaggagacccagagcgacuucaagagcaacaucagcgagcccaccaagaaggugauggagaugaucccccagaucagcagcuucugccuggugagagacagaaaccacauccagagcgccaaccuggacgaggaggcccaggccggcaccagcagccugcaggugaugcuggaccaccaccccguggccaucaccguggaggugaagcaggaggaggacaucaagcccccccccccccuggugcugaacagccagcagagcgacacccuggagcagagagaggagcacgagcuggugcacgugauggagagaagccugagccccagccugagcagcguggacaugagaaugaccagcagccccagcagcauccccagaagagacgacuucuucagacacgagagcggcgagcacuucagaagccugcugggcuacgacccccagauccugcagaugcugaaggaggagcaccagaucauccuggagaaccagaagaacuucggccuguacgugcaggagaagagagacggccugaagagaagacagcagcuggaggaggagcugcugagagccaagaucgagguggagaagcugaaggccaucagacugagacacgaccugcccgaguacaacagccuguaa

SEQ ID NO: 17254 - RNA, 2478 nt, Artificial Sequence
  FSCB__Homo_sapiens__NP_115511
auggugggcaagagccagcagaccgacgugaucgagaagaagaagcacauggccauccccaagagcagcagccccaaggccacccacagaaucggcaacaccagcggcagcaagggcagcuacagcgccaaggccuacgagagcaucagagugagcagcgagcugcagcagaccuggaccaagagaaagcacggccaggagaugaccagcaagagccugcagaccgacaccaucguggaggagaagaaggaggugaagcugguggaggagaccguggugcccgaggagaagagcgccgacgugagagaggccgccaucgagcugcccgagagcgugcaggacguggagaucccccccaacauccccagcgugcagcugaagauggacagaagccagcagaccagcagaaccggcuacuggaccaugaugaacaucccccccguggagaagguggacaaggagcagcagaccuacuucagcgagagcgagaucguggugaucagcagacccgacagcagcagcaccaagagcaaggaggacgcccugaagcacaagagcagcggcaagaucuucgccagcgagcaccccgaguuccagcccgccaccaacagcaacgaggagaucggccagaagaacaucagcagaaccagcuucacccaggagaccaagaagggcccccccgugcugcuggaggacgagcugagagaggaggugaccgugcccguggugcaggagggcagcgccgugaagaagguggccagcgccgagaucgagccccccagcaccgagaaguuccccgccaagauccagcccccccugguggaggaggccaccgccaaggccgagcccagacccgccgaggagacccacgugcaggugcagcccagcaccgaggagacccccgacgccgaggccgccaccgccguggccgagaacagcgugaaggugcagcccccccccgccgaggaggccccccugguggaguuccccgccgagauccagccccccagcgccgaggagagccccagcguggagcugcuggccgagauccugccccccagcgccgaggagagccccagcgaggagccccccgccgagauccugcccccccccgccgagaagagccccagcguggagcugcugggcgagaucagaagccccagcgcccagaaggcccccaucgaggugcagccccugcccgccgagggcgcccuggaggaggcccccgccaagguggagccccccaccguggaggagacccuggccgacgugcagccccugcugcccgaggaggcccccagagaggaggccagagagcugcagcugagcaccgccauggagacccccgccgaggaggcccccaccgaguuccagagcccccugcccaaggagaccaccgccgaggaggccagcgccgagauccagcugcuggccgccaccgagccccccgccgacgagacccccgccgaggccagaagcccccugagcgaggagaccagcgccgaggaggcccacgccgaggugcagagcccccuggccgaggagaccaccgccgaggaggccagcgccgagauccagcugcuggccgccaucgaggcccccgccgacgagacccccgccgaggcccagagcccccugagcgaggagaccagcgccgaggaggcccccgccgaggugcagagccccagcgccaagggcgugagcaucgaggaggccccccuggagcugcagccccccagcggcgaggagaccaccgccgaggaggccagcgccgccauccagcugcuggccgccaccgaggccagcgccgaggaggcccccgccgaggugcagcccccccccgccgaggaggcccccgccgaggugcagcccccccccgccgaggaggcccccgccgaggugcagcccccccccgccgaggaggcccccgccgaggugcagcccccccccgccgaggaggcccccgccgaggugcagcccccccccgccgaggaggcccccgccgaggugcagcccccccccgccgaggaggcccccgccgaggugcagagccugcccgccgaggagacccccaucgaggagacccuggccgccgugcacagcccccccgccgacgacgugcccgccgaggaggccagcguggacaagcacagcccccccgccgaccugcugcugaccgaggaguuccccaucggcgaggccagcgccgaggugagccccccccccagcgagcagacccccgaggacgaggcccugguggagaacgugagcaccgaguuccagagcccccagguggccggcauccccgccgugaagcugggcagcguggugcuggagggcgaggccaaguucgaggaggugagcaagaucaacagcgugcugaaggaccugagcaacaccaacgacggccaggcccccacccuggagaucgagagcguguuccacaucgagcugaagcagagaccccccgagcuguaa

SEQ ID NO: 17255 - RNA, 1482 nt, Artificial Sequence
  FSCN1__Homo_sapiens__NP_003079
augaccgccaacggcaccgccgaggccgugcagauccaguucggccugaucaacugcggcaacaaguaccugaccgccgaggccuucggcuucaaggugaacgccagcgccagcagccugaagaagaagcagaucuggacccuggagcagccccccgacgaggccggcagcgccgccgugugccugagaagccaccugggcagauaccuggccgccgacaaggacggcaacgugaccugcgagagagaggugcccggccccgacugcagauuccugaucguggcccacgacgacggcagauggagccugcagagcgaggcccacagaagauacuucggcggcaccgaggacagacugagcugcuucgcccagaccgugagccccgccgagaaguggagcgugcacaucgccaugcacccccaggugaacaucuacagcgugaccagaaagagauacgcccaccugagcgccagacccgccgacgagaucgccguggacagagacgugcccuggggcguggacagccugaucacccuggccuuccaggaccagagauacagcgugcagaccgccgaccacagauuccugagacacgacggcagacugguggccagacccgagcccgccaccggcuacacccuggaguucagaagcggcaagguggccuucagagacugcgagggcagauaccuggcccccagcggccccagcggcacccugaaggccggcaaggccaccaaggugggcaaggacgagcuguucgcccuggagcagagcugcgcccagguggugcugcaggccgccaacgagagaaacgugagcaccagacagggcauggaccugagcgccaaccaggacgaggagaccgaccaggagaccuuccagcuggagaucgacagagacaccaagaagugcgccuucagaacccacaccggcaaguacuggacccugaccgccaccggcggcgugcagagcaccgccagcagcaagaacgccagcugcuacuucgacaucgaguggagagacagaagaaucacccugagagccagcaacggcaaguucgugaccagcaagaagaacggccagcuggccgccagcguggagaccgccggcgacagcgagcuguuccugaugaagcugaucaacagacccaucaucguguucagaggcgagcacggcuucaucggcugcagaaaggugaccggcacccuggacgccaacagaagcagcuacgacguguuccagcuggaguucaacgacggcgccuacaacaucaaggacagcaccggcaaguacuggaccgugggcagcgacagcgccgugaccagcagcggcgacacccccguggacuucuucuucgaguucugcgacuacaacaagguggccaucaaggugggcggcagauaccugaagggcgaccacgccggcgugcugaaggccagcgccgagaccguggaccccgccagccugugggaguacuaa

SEQ ID NO: 17256 - RNA, 1551 nt, Artificial Sequence
  FSCN2__Homo_sapiens__XP_011522894
augcccaccaacggccugcaccaggugcugaagauccaguucggccuggugaacgacaccgacagauaccugaccgccgagagcuucggcuucaaggugaacgccagcgcccccagccugaagagaaagcagaccugggugcuggagcccgaccccggccagggcaccgccgugcugcugagaagcagccaccugggcagauaccugagcgccgaggaggacggcagaguggccugcgaggccgagcagcccggcagagacugcagauuccuggugcugccccagcccgacggcagaugggugcugagaagcgagccccacggcagauucuucggcggcaccgaggaccagcugagcugcuucgccaccgccgugagccccgccgagcuguggaccgugcaccuggccauccacccccaggcccaccugcugagcgugagcagaagaagauacgugcaccugugccccagagaggacgagauggccgccgacggcgacaagcccuggggcguggacgcccugcugacccugaucuucagaagcagaagauacugccugaagagcugcgacagcagauaccugagaagcgacggcagacuggugugggagcccgagcccagagccugcuacacccuggaguucaaggccggcaagcuggccuucaaggacugcgacggccacuaccuggcccccgugggccccgccggcacccugaaggccggcagaaacaccagacccggcaaggacgagcuguucgaccuggaggagagccacccccagguggugcugguggccgccaaccacagauacgugagcgugagacagggcgugaacgugagcgccaaccaggacgacgagcuggaccacgagaccuuccugaugcagaucgaccaggagaccaagaagugcaccuucuacagcagcaccggcggcuacuggacccuggugacccacggcggcauccacgccaccgccacccaggugagcgccaacaccauguucgagauggaguggagaggcagaagaguggcccugaaggccagcaacggcagauacgugugcaugaagaagaacggccagcuggccgccaucagcgacuucgugggccccccccccagacccgccuggaccggcaagguggccggcggcgccgcccagcagacccugagcccccccggcaaggacgaggaguucacccugaagcugaucaacagacccauccuggugcugagaggccuggacggcuucgugugccaccacagaggcagcaaccagcuggacaccaacagaagcguguacgacguguuccaccugagcuucagcgacggcgccuacagaaucagaggcagagacggcggcuucugguacaccggcagccacggcagcgugugcagcgacggcgagagagccgaggacuucguguucgaguucagagagagaggcagacuggccaucagagccagaagcggcaaguaccugagaggcggcgccagcggccugcugagagccgacgccgacgcccccgccggcaccgcccugugggaguacuaa

SEQ ID NO: 17257 - RNA, 1491 nt, Artificial Sequence
  FSD1__Homo_sapiens__NP_077309
auggaggagcagagagaggcccugagaaagaucaucaagacccuggccgugaagaacgaggagauccagagcuucaucuacagccugaagcagaugcugcugaacguggaggccaacagcgccaaggugcaggaggaccuggaggccgaguuccagagccuguucagccugcuggaggagcugaaggagggcaugcugaugaagaucaagcaggacagagccagcagaaccuacgagcugcagaaccagcuggccgccugcaccagagcccuggagagcagcgaggagcugcuggagaccgccaaccagacccugcaggccauggacagcgaggacuucccccaggccgccaagcagaucaaggacggcgugaccauggcccccgccuucagacugagccugaaggccaaggugagcgacaacaugagccaccugaugguggacuucgcccaggagagacagaugcugcaggcccugaaguuccugcccgugcccagcgcccccgugaucgaccuggccgagagccugguggccgacaacugcgugacccugguguggagaaugcccgacgaggacagcaagaucgaccacuacgugcuggaguacagaagaaccaacuucgagggcccccccagacugaaggaggaccagcccuggauggugaucgagggcaucagacagaccgaguacacccugaccggccugaaguucgacaugaaguacaugaacuucagagugaaggccugcaacaaggccguggccggcgaguucagcgagcccgugacccuggagacccccgccuucauguucagacuggacgccagcaccagccaccagaaccugagaguggacgaccugagcguggagugggacgccaugggcggcaaggugcaggacaucaaggccagagagaaggacggcaagggcagaaccgccagccccaucaacagccccgccagaggcacccccagccccaagagaaugcccagcggcagaggcggcagagacagauucaccgccgagagcuacaccgugcugggcgacacccugaucgacggcggcgagcacuacugggaggugagauacgagcccgacagcaaggccuucggcgugggcguggccuacagaagccugggcagauucgagcagcugggcaagaccgccgccagcuggugccugcacgugaacaacuggcugcaggugagcuucaccgccaagcacgccaacaaggugaaggugcuggacgcccccgugcccgacugccugggcgugcacugcgacuuccaccagggccugcugagcuucuacaacgccagaaccaagcaggugcugcacaccuucaagaccagauucacccagccccugcugcccgccuucaccguguggugcggcagcuuccaggugaccaccggccugcaggugcccagcgccgugagaugccugcagaagagaggcagcgccaccagcagcagcaacaccagccugaccuaa

SEQ ID NO: 17258 - RNA, 1593 nt, Artificial Sequence
  FSD1L__Homo_sapiens__NP_001138785
auggacagccagaaguacugcuucaaggagaacgagaacgugaccguggacaaggccugcuuccugaucagcaacaucaccaucggccccgagagcaucaaccugcagcaggaggcccugcagagaaucaucagcacccuggccaacaagaacgacgagauccagaacuucaucgacacccugcaccacacccugaagggcgugcaggagaacagcagcaacauccugagcgagcuggacgaggaguucgacagccuguacagcauccuggacgaggugaaggagagcaugaucaacugcaucaagcaggagcaggccagaaagagccaggagcugcagagccagaucagccagugcaacaacgcccuggagaacagcgaggagcugcuggaguucgccaccagaagccuggacaucaaggagcccgaggaguucagcaaggccgccagacagaucaaggacagagugaccauggccagcgccuucagacugagccugaagcccaaggugagcgacaacaugacccaccugaugguggacuucagccaggagagacagaugcugcagacccugaaguuccugcccgugcccaaggcccccgagaucgaccccguggagugccugguggccgacaacagcgugaccguggccuggagaaugcccgaggaggacaacaagaucgaccacuucauccuggagcacagaaagaccaacuucgacggccugcccagagugaaggacgagagaugcugggagaucaucgacaacaucaagggcaccgaguacacccugagcggccugaaguucgacagcaaguacaugaacuucagagugagagccugcaacaaggccguggccggcgaguacagcgaccccgugacccuggagaccaaggcccugaacuucaaccuggacaacagcagcagccaccugaaccugaagguggaggacaccugcguggagugggaccccaccggcggcaagggccaggagagcaagaucaagggcaaggagaacaagggcagaagcggcacccccagccccaagagaaccagcgugggcagcagaccccccgccgugagaggcagcagagacagauucaccggcgagagcuacaccgugcugggcgacaccgccaucgagagcggccagcacuacugggaggugaaggcccagaaggacugcaagagcuacagcgugggcguggccuacaagacccugggcaaguucgaccagcugggcaagaccaacaccagcuggugcauccacgugaacaacuggcugcagaacaccuucgccgccaagcacaacaacaaggugaaggcccuggacgugaccgugcccgagaagaucggcguguucugcgacuucgacggcggccagcugagcuucuacgacgccaacagcaagcagcugcuguacagcuucaagaccaaguucacccagcccgugcugcccggcuucaugguguggugcggcggccugagccugagcaccggcaugcaggugcccagcgccgugagaacccugcagaagagcgagaacggcaugaccggcagcgccagcagccugaacaacguggugacccaguaa

SEQ ID NO: 17259 - RNA, 2250 nt, Artificial Sequence
  FSD2__Homo_sapiens__NP_001007123
auggaggaggagagcggcgaggagcugggccuggacagaagcacccccaaggacuuccacuucuaccacauggaccuguacgacagcgaggacagacugcaccuguuccccgaggagaacaccagaaugagaaagguggugcaggccgagauggccaacgagagcagaggcgccggcgacggcaaggcccagagagaccugcaggaggagguggacgagcuggugcaccuguacggccuggaggacgaccacgagcugggcgacgaguucguggacgagaacauccccagaaccggcgugagcgaguacccccccuacaugaugaagagaagagaccccgccagagagcagagagacuggagacugagcggcgaggccgccgaggccgaggaccugggcuucggcggcuggggcagcgccggccagugccaggaccugagagaggccuacagauacacccacggcagagccagcgaggaguacgagugcuacgugauccccgaggaggaggacgaggaggaggccgccgacguguucugcgugaccugcaagacccccaucagagccuuccagaagguguucgacgagcacaaggagcacgaggugaucccccugaacgaggcccuggagagcgccaaggacgagauccacaagaacauguacaagcuggagaagcagaucaucgagauggagaacuucgccaaccaccuggaggagguguucaucaccguggaggagaacuucggcaagcaggagcagaacuucgagagccacuacaacgagauccuggagacccuggcccagaaguacgaggagaagauccaggcccugggcgagaagaagaaggagaagcuggaggcccuguacggccagcuggugagcugcggcgagaaccuggacaccugcaaggagcugauggagaccaucgaggagaugugccacgaggagaagguggacuucaucaaggacgccguggccauggccgacagacugggcaaguuccugaagaccaagaccgacguggagaucagcgcccagcccgaguucgaggaccagacccuggacuucagcgacguggagcagcugaugggcagcaucaacaccauccccgcccccagcgcccccgugaucaacccccaggugcccaacagcgccaccggcagcagcgugagagugugcuggagccuguacagcgacgacaccguggagagcuaccagcugagcuacagacccgugcaggacagcagccccggcaccgaccaggccgaguucaccgugaccgugaaggagaccuacugcagcgugaccaaccuggugcccaacacccaguacgaguucugggugaccgcccacaacagagccggccccagccccagcagcgagagagccguguacaugaccgcccccagcccccccaucaucaagaccaaggagaucagaagcugcgaggaggccgugcugaucugcugggagagcggcaaccugaaccccguggacagcuacaccguggagcugacccaggccgagagccccgaggccagcggcgugaccgagagcguggugggcauccccaccugcgagagcguggugcagcugcagcccggcagaagcuacaucaucuacgugagagcccugaacaugggcggccccagcgugagaagcgagcccgccaccgugcacaccaucggcagcuacuucagacugaacaaggacaccugccaccccuggcugaccaucagcgaggacggccugaccgccgugagaagcgagagaagaacccccgccagagagcugagccccagcgacacccacuucaccagaugcguggccgugaugggcaaccugauccccgugagaggccaccacuacugggagguggagguggacgagcaccuggacuacagagugggcguggccuucgccgacgugagaaagcaggaggaccugggcgccaacugccugagcuggugcaugagacacaccuucgccagcagcagacacaaguacgaguuccugcacaacagaaccacccccgacaucagaaucaccgugccccccaagaagaucggcauccugcuggacuacgagcacagcaagcugagcuucuucaacguggaccugagccagcaccuguacaccuucagcugccagcugcacgaguucgugcaccccugcuucagccuggagaagcccggcugccugaaggugcacaacggcaucagcaugcccaagcacgugaccuucuacuaa

SEQ ID NO: 17260 - RNA, 390 nt, Artificial Sequence
  FSHB__Homo_sapiens__NP_001018090
augaagacccugcaguucuucuuccuguucugcugcuggaaggccaucugcugcaacagcugcgagcugaccaacaucaccaucgccaucgagaaggaggagugcagauucugcaucagcaucaacaccaccuggugcgccggcuacugcuacaccagagaccugguguacaaggaccccgccagacccaagauccagaagaccugcaccuucaaggagcugguguacgagaccgugagagugcccggcugcgcccaccacgccgacagccuguacaccuaccccguggccacccagugccacugcggcaagugcgacagcgacagcaccgacugcaccgugagaggccugggccccagcuacugcagcuucggcgagaugaaggaguaa

SEQ ID NO: 17261 - RNA, 2088 nt, Artificial Sequence
  FSHR__Homo_sapiens__NP_000136
auggcccugcugcuggugagccugcuggccuuccugagccugggcagcggcugccaccacagaaucugccacugcagcaacagaguguuccugugccaggagagcaaggugaccgagauccccagcgaccugcccagaaacgccaucgagcugagauucgugcugaccaagcugagagugauccagaagggcgccuucagcggcuucggcgaccuggagaagaucgagaucagccagaacgacgugcuggaggugaucgaggccgacguguucagcaaccugcccaagcugcacgagaucagaaucgagaaggccaacaaccugcuguacaucaaccccgaggccuuccagaaccugcccaaccugcaguaccugcugaucagcaacaccggcaucaagcaccugcccgacgugcacaagauccacagccugcagaaggugcugcuggacauccaggacaacaucaacauccacaccaucgagagaaacagcuucgugggccugagcuucgagagcgugauccuguggcugaacaagaacggcauccaggagauccacaacugcgccuucaacggcacccagcuggacgagcugaaccugagcgacaacaacaaccuggaggagcugcccaacgacguguuccacggcgccagcggccccgugauccuggacaucagcagaaccagaauccacagccugcccagcuacggccuggagaaccugaagaagcugagagccagaagcaccuacaaccugaagaagcugcccacccuggagaagcugguggcccugauggaggccagccugaccuaccccagccacugcugcgccuucgccaacuggagaagacagaucagcgagcugcaccccaucugcaacaagagcauccugagacaggagguggacuacaugacccaggccagaggccagagaagcagccuggccgaggacaacgagagcagcuacagcagaggcuucgacaugaccuacaccgaguucgacuacgaccugugcaacgaggugguggacgugaccugcagccccaagcccgacgccuucaaccccugcgaggacaucaugggcuacaacauccugagagugcugaucugguucaucagcauccuggccaucaccggcaacaucaucgugcuggugauccugaccaccagccaguacaagcugaccgugcccagauuccugaugugcaaccuggccuucgccgaccugugcaucggcaucuaccugcugcugaucgccagcguggacauccacaccaagagccaguaccacaacuacgccaucgacuggcagaccggcgccggcugcgacgccgccggcuucuucaccguguucgccagcgagcugagcguguacacccugaccgccaucacccuggagagauggcacaccaucacccacgccaugcagcuggacugcaaggugcagcugagacacgccgccagcgugauggugaugggcuggaucuucgccuucgccgccgcccuguuccccaucuucggcaucagcagcuacaugaaggugagcaucugccugcccauggacaucgacagcccccugagccagcuguacgugaugagccugcuggugcugaacgugcuggccuucguggugaucugcggcugcuacauccacaucuaccugaccgugagaaaccccaacaucgugagcagcagcagcgacaccagaaucgccaagagaauggccaugcugaucuucaccgacuuccugugcauggcccccaucagcuucuucgccaucagcgccagccugaaggugccccugaucaccgugagcaaggccaagauccugcuggugcuguuccaccccaucaacagcugcgccaaccccuuccuguacgccaucuucaccaagaacuucagaagagacuucuucauccugcugagcaagugcggcugcuacgagaugcaggcccagaucuacagaaccgagaccagcagcaccgugcacaacacccaccccagaaacggccacugcagcagcgcccccagagugaccagcggcagcaccuacauccuggugccccugagccaccuggcccagaacuaa

SEQ ID NO: 17262 - RNA, 1746 nt, Artificial Sequence
  FSIP1__Homo_sapiens__XP_011519608
auggacaucaucaagggcaaccuggacggcaucagcaagcccgccagcaacagcagaaucagacccggcagcagaagcagcaacgccagccuggaggugcugagcaccgagcccggcagcuucaagguggacaccgccagcaaccugaacagcggcaaggaggaccacagcgagagcagcaacaccgagaacagaagaaccagcaacgacgacaagcaggagagcugcagcgagaagaucaagcuggccgaggagggcagcgacgaggaccuggaccuggugcagcaccagaucaucagcgagugcagcgacgagcccaagcugaaggagcuggacagccagcugcaggacgccauccagaagaugaagaagcuggacaagauccuggccaagaagcagagaagagagaaggagaucaagaagcagggccuggagaugagaaucaagcugugggaggagaucaagagcgccaaguacagcgaggccuggcagagcaaggaggagauggagaacaccaagaaguuccugagccugaccgccgugagcgaggagaccgugggccccagccacgaggaggaggacaccuucagcagcguguuccacacccagaucccccccgaggaguacgagaugcagaugcagaagcugaacaaggacuucaccugcgacguggagagaaacgagagccugaucaagagcggcaagaagcccuucagcaacaccgagaagaucgagcugagaggcaagcacaaccaggacuucaucaagagaaacaucgagcuggccaaggagagcagaaaccccguggugaugguggacagagagaagaagagacugguggagcugcugaaggaccuggacgagaaggacagcggccugagcagcagcgagggcgaccagagcggcuggguggugcccgugaagggcuacgagcuggccgugacccagcaccagcagcuggccgagaucgacaucaagcugcaggagcugagcgccgccagccccaccaucagcagcuucagccccagacuggagaacagaaacaaccagaagcccgacagagacggcgagagaaacauggaggugacccccggcgagaagauccugagaaacaccaaggagcagagagaccugcacaacagacugagagagaucgacgagaagcugaagaugaugaaggagaacgugcuggagagcaccagcugccugagcgaggagcagcugaagugccugcuggacgagugcauccugaagcagaagagcaucaucaagcugagcagcgagagaaagaaggaggacaucgaggacgugacccccguguucccccagcugagcagaagcaucaucagcaagcugcugaacgagagcgagaccaaggugcagaagaccgagguggaggacgccgacaugcuggagagcgaggagugcgaggccagcaagggcuacuaccugaccaaggcccugaccggccacaacaugagcgaggcccuggugaccgaggccgagaacaugaagugccugcaguucagcaaggacgugaucaucagcgacaccaaggacuacuucaugagcaagacccugggcaucggcagacugaagagacccagcuuccuggacgacccccuguacggcaucagcgugagccugagcagcgaggaccagcaccugaagcugagcagccccgagaacaccaucgccgacgagcaggagaccaaggacgccgccgaggagugcaaggagcccuaa

SEQ ID NO: 17263 - RNA, 954 nt, Artificial Sequence
  FST__Homo_sapiens__NP_006341
auggugagagccagacaccagcccggcggccugugccugcugcugcugcugcugugccaguucauggaggacagaagcgcccaggccggcaacugcuggcugagacaggccaagaacggcagaugccaggugcuguacaagaccgagcugagcaaggaggagugcugcagcaccggcagacugagcaccagcuggaccgaggaggacgugaacgacaacacccuguucaaguggaugaucuucaacggcggcgcccccaacugcauccccugcaaggagaccugcgagaacguggacugcggccccggcaagaagugcagaaugaacaagaagaacaagcccagaugcgugugcgcccccgacugcagcaacaucaccuggaagggccccgugugcggccuggacggcaagaccuacagaaacgagugcgcccugcugaaggccagaugcaaggagcagcccgagcuggaggugcaguaccagggcagaugcaagaagaccugcagagacguguucugccccggcagcagcaccugcgugguggaccagaccaacaacgccuacugcgugaccugcaacagaaucugccccgagcccgccagcagcgagcaguaccugugcggcaacgacggcgugaccuacagcagcgccugccaccugagaaaggccaccugccugcugggcagaagcaucggccuggccuacgagggcaagugcaucaaggccaagagcugcgaggacauccagugcaccggcggcaagaagugccugugggacuucaaggugggcagaggcagaugcagccugugcgacgagcugugccccgacagcaagagcgacgagcccgugugcgccagcgacaacgccaccuacgccagcgagugcgccaugaaggaggccgccugcagcagcggcgugcugcuggaggugaagcacagcggcagcugcaacuaa

SEQ ID NO: 17264 - RNA, 927 nt, Artificial Sequence
  FSTL1__Homo_sapiens__NP_009016
auguggaagagauggcuggcccuggcccuggcccugguggccguggccugggugagagccgaggaggagcugagaagcaagagcaagaucugcgccaacguguucugcggcgccggcagagagugcgccgugaccgagaagggcgagcccaccugccugugcaucgagcagugcaagccccacaagagacccgugugcggcagcaacggcaagaccuaccugaaccacugcgagcugcacagagacgccugccugaccggcagcaagauccagguggacuacgacggccacugcaaggagaagaagagcgugagccccagcgccagccccguggugugcuaccagagcaacagagacgagcugagaagaagaaucauccaguggcuggaggccgagaucauccccgacggcugguucagcaagggcagcaacuacagcgagauccuggacaaguacuucaagaacuucgacaacggcgacagcagacuggacagcagcgaguuccugaaguucguggagcagaacgagaccgccaucaacaucaccaccuaccccgaccaggagaacaacaagcugcugagaggccugugcguggacgcccugaucgagcugagcgacgagaacgccgacuggaagcugagcuuccaggaguuccugaagugccugaaccccagcuucaacccccccgagaagaagugcgcccuggaggacgagaccuacgccgacggcgccgagaccgagguggacugcaacagaugcgugugcgccugcggcaacugggugugcaccgccaugaccugcgacggcaagaaccagaagggcgcccagacccagaccgaggaggagaugaccagauacgugcaggagcugcagaagcaccaggagaccgccgagaagaccaagagagugagcaccaaggagaucuaa

SEQ ID NO: 17265 - RNA, 792 nt, Artificial Sequence
  FSTL3__Homo_sapiens__NP_005851
augagacccggcgcccccggcccccuguggccccugcccuggggcgcccuggccugggccgugggcuucgugagcagcaugggcagcggcaaccccgcccccggcggcgugugcuggcugcagcagggccaggaggccaccugcagccuggugcugcagaccgacgugaccagagccgagugcugcgccagcggcaacaucgacaccgccuggagcaaccugacccaccccggcaacaagaucaaccugcugggcuuccugggccuggugcacugccugcccugcaaggacagcugcgacggcguggagugcggccccggcaaggccugcagaaugcugggcggcagacccagaugcgagugcgcccccgacugcagcggccugcccgccagacugcaggugugcggcagcgacggcgccaccuacagagacgagugcgagcugagagccgccagaugcagaggccaccccgaccugagcgugauguacagaggcagaugcagaaagagcugcgagcacguggugugccccagaccccagagcugcgugguggaccagaccggcagcgcccacugcguggugugcagagccgcccccugccccgugcccagcagccccggccaggagcugugcggcaacaacaacgugaccuacaucagcagcugccacaugagacaggccaccugcuuccugggcagaagcaucggcgugagacacgccggcagcugcgccggcacccccgaggagccccccggcggcgagagcgccgaggaggaggagaacuucguguaa

SEQ ID NO: 17266 - RNA, 2529 nt, Artificial Sequence
  FSTL4__Homo_sapiens__NP_055897
augaagcccggcggcuucuggcugcaccugacccugcugggcgccagccugcccgccgcccugggcuggauggaccccggcaccagcagaggccccgacgugggcgugggcgagagccaggccgaggagcccagaagcuucgaggugaccagaagagagggccugagcagccacaacgagcugcuggccagcugcggcaagaaguucugcagcagaggcagcagaugcgugcugagcagaaagaccggcgagcccgagugccagugccuggaggccugcagacccagcuacgugcccgugugcggcagcgacggcagauucuacgagaaccacugcaagcugcacagagccgccugccugcugggcaagagaaucaccgugauccacagcaaggacugcuuccugaagggcgacaccugcaccauggccggcuacgccagacugaagaacgugcugcuggcccugcagaccagacugcagccccugcaggagggcgacagcagacaggaccccgccagccagaagagacugcugguggagagccuguucagagaccuggacgccgacggcaacggccaccugagcagcagcgagcuggcccagcacgugcugaagaagcaggaccuggacgaggaccugcugggcugcagccccggcgaccugcugagauucgacgacuacaacagcgacagcagccugacccugagagaguucuacauggccuuccagguggugcagcugagccuggcccccgaggacagagugagcgugaccaccgugaccgugggccugagcaccgugcugaccugcgccgugcacggcgaccugagaccccccaucaucuggaagagaaacggccugacccugaacuuccuggaccuggaggacaucaacgacuucggcgaggacgacagccuguacaucaccaaggugaccaccauccacaugggcaacuacaccugccacgccagcggccacgagcagcuguuccagacccacgugcugcaggugaacgugccccccgugaucagaguguaccccgagagccaggcccaggagcccggcguggccgccagccugagaugccacgccgagggcauccccaugcccagaaucaccuggcugaagaacggcguggacgugagcacccagaugagcaagcagcugagccugcuggccaacggcagcgagcugcacaucagcagcgugagauacgaggacaccggcgccuacaccugcaucgccaagaacgaggugggcguggacgaggacaucagcagccuguucaucgaggacagcgccagaaagacccuggccaacauccuguggagagaggagggccugagcgugggcaacauguucuacguguucagcgacgacggcaucaucgugauccaccccguggacugcgagauccagagacaccugaagcccaccgagaagaucuucaugagcuacgaggagaucugcccccagagagagaagaacgccacccagcccugccagugggugagcgccgugaacgugagaaacagauacaucuacguggcccagcccgcccugagcagagugcuggugguggacauccaggcccagaaggugcugcagagcaucggcguggacccccugcccgccaagcugagcuacgacaagagccacgaccaggugugggugcugagcuggggcgacgugcacaagagcagacccagccugcaggugaucaccgaggccagcaccggccagagccagcaccugaucagaacccccuucgccggcguggacgacuucuucaucccccccaccaaccugaucaucaaccacaucagauucggcuucaucuucaacaagagcgaccccgccgugcacaagguggaccuggagaccaugaugccccugaagaccaucggccugcaccaccacggcugcgugccccaggccauggcccacacccaccugggcggcuacuucuucauccagugcagacaggacagccccgccagcgccgccagacagcugcugguggacagcgugaccgacagcgugcugggccccaacggcgacgugaccggcaccccccacaccagccccgacggcagauucaucgugagcgccgccgccgacagccccuggcugcacgugcaggagaucaccgugagaggcgagauccagacccuguacgaccugcagaucaacagcggcaucagcgaccuggccuuccagagaagcuucaccgagagcaaccaguacaacaucuacgccgcccugcacaccgagcccgaccugcuguuccuggagcugagcaccggcaaggugggcaugcugaagaaccugaaggagccccccgccggccccgcccagcccuggggcggcacccacagaaucaugagagacagcggccuguucggccaguaccugcugacccccgccagagagagccuguuccugaucaacggcagacagaacacccugagaugcgaggugagcggcaucaagggcggcaccaccguggugugggugggcgagguguaa

SEQ ID NO: 17267 - RNA, 2541 nt, Artificial Sequence
  FSTL5__Homo_sapiens__NP_001121899
auguucaagugcuggagcguggugcuggugcugggcuucaucuuccuggagagcgagggcagacccaccaaggagggcggcuacggccugaagagcuaccagccccugaugagacugagacacaaggagaagaaccaggagagcagcagagugaagggcuucaugauccaggacggccccuucggcagcugcgagaacaaguacugcggccugggcagacacugcgugaccagcagagagaccggccaggccgagugcgccugcauggaccugugcaagagacacuacaagcccgugugcggcagcgacggcgaguucuacgagaaccacugcgaggugcacagagccgccugccugaagaagcagaagaucaccaucgugcacaacgaggacugcuucuucaagggcgacaagugcaagaccaccgaguacagcaagaugaagaacaugcugcuggaccugcagaaccagaaguacaucaugcaggagaacgagaaccccaacggcgacgacaucagcagaaagaagcugcugguggaccagauguucaaguacuucgacgccgacagcaacggccugguggacaucaacgagcugacccaggugaucaagcaggaggagcugggcaaggaccuguucgacugcacccuguacgugcugcugaaguacgacgacuucaacgccgacaagcaccuggcccuggaggaguucuacagagccuuccaggugauccagcugagccugcccgaggaccagaagcugagcaucaccgccgccaccgugggccagagcgccgugcugagcugcgccauccagggcacccugagaccccccaucaucuggaagagaaacaacaucauccugaacaaccuggaccuggaggacaucaacgacuucggcgacgacggcagccuguacaucaccaaggugaccaccacccacgugggcaacuacaccugcuacgccgacggcuacgagcagguguaccagacccacaucuuccaggugaacgugccccccgugaucagaguguaccccgagagccaggccagagagcccggcgugaccgccagccugagaugccacgccgagggcauccccaagccccagcugggcuggcugaagaacggcaucgacaucacccccaagcugagcaagcagcugacccugcaggccaacggcagcgaggugcacaucagcaacgugagauacgaggacaccggcgccuacaccugcaucgccaagaacgaggccggcguggacgaggacaucagcagccuguucguggaggacagcgccagaaagacccuggccaacauccuguggagagaggagggccugggcaucggcaacauguucuacguguucuacgaggacggcaucaaggugauccagcccaucgagugcgaguuccagagacacaucaagcccagcgagaagcugcugggcuuccaggacgaggugugccccaaggccgagggcgacgaggugcagagaugcgugugggccagcgccgugaacgugaaggacaaguucaucuacguggcccagcccacccuggacagagugcugaucguggacgugcagagccagaagguggugcaggccgugagcaccgaccccgugcccgugaagcugcacuacgacaagagccacgaccaggugugggugcugagcuggggcacccuggagaagaccagccccacccugcaggugaucacccuggccagcggcaacgugccccaccacaccauccacacccagcccgugggcaagcaguucgacagaguggacgacuucuucauccccaccaccacccugaucaucacccacaugagauucggcuucauccugcacaaggacgaggccgcccugcagaagaucgaccuggagaccaugagcuacaucaagaccaucaaccugaaggacuacaagugcgugccccagagccuggccuacacccaccugggcggcuacuacuucaucggcugcaagcccgacagcaccggcgccgugagcccccaggugaugguggacggcgugaccgacagcgugaucggcuucaacagcgacgugaccggcacccccuacgugagccccgacggccacuaccuggugagcaucaacgacgugaagggccuggugagagugcaguacaucaccaucagaggcgagauccaggaggccuucgacaucuacaccaaccugcacaucagcgaccuggccuuccagcccagcuucaccgaggcccaccaguacaacaucuacggcagcagcagcacccagaccgacgugcuguucguggagcugagcagcggcaaggugaagaugaucaagagccugaaggagccccugaaggccgaggaguggcccuggaacagaaagaacagacagauccaggacagcggccuguucggccaguaccugaugacccccagcaaggacagccuguucauccuggacggcagacugaacaagcugaacugcgagaucaccgagguggagaagggcaacaccgugaucugggugggcgacgccuaa

SEQ ID NO: 17268 - RNA, 1626 nt, Artificial Sequence
  FTCD__Homo_sapiens__NP_996848
augagccagcugguggagugcgugcccaacuucagcgagggcaagaaccaggaggugaucgacgccaucagcggcgccaucacccagacccccggcugcgugcugcuggacguggacgccggccccagcaccaacagaaccguguacaccuucgugggcccccccgagugcgugguggagggcgcccugaacgccgccagaguggccagcagacugaucgacaugagcagacaccagggcgagcaccccagaaugggcgcccuggacgugugccccuucauccccgugagaggcgugagcguggacgagugcgugcugugcgcccaggccuucggccagagacuggccgaggagcuggacgugcccguguaccuguacggcgaggccgccagaauggacagcagaagaacccugcccgccaucagagccggcgaguacgaggcccugcccaagaagcugcagcaggccgacugggcccccgacuucggccccagcagcuucgugcccagcuggggcgccaccgccaccggcgccagaaaguuccugaucgccuucaacaucaaccugcugggcaccaaggagcaggcccacagaaucgcccugaaccugagagagcagggcagaggcaaggaccagcccggcagacugaagaaggugcagggcaucggcugguaccuggacgagaagaaccuggcccaggugagcaccaaccugcuggacuucgaggugaccgcccugcacaccguguacgaggagaccugcagagaggcccaggagcugagccugcccguggugggcagccagcuggugggccuggugccccugaaggcccugcuggacgccgccgccuucuacugcgagaaggagaaccuguucauccuggaggaggagcagagaaucagacugguggugagcagacugggccuggacagccugugccccuucagccccaaggagagaaucaucgaguaccuggugcccgagagaggccccgagagaggccugggcagcaagagccugagagccuucgugggcgaggugggcgccagaagcgccgcccccggcggcggcagcguggccgccgccgccgccgccaugggcgccgcccugggcagcauggugggccugaugaccuacggcagaagacaguuccagagccuggacaccaccaugagaagacugaucccccccuucagagaggccagcgccaagcugaccacccugguggacgccgacgccgaggccuucaccgccuaccuggaggccaugagacugcccaagaacacccccgaggagaaggacagaagaaccgccgcccugcaggagggccugagaagagccgugagcgugccccugacccuggccgagaccguggccagccuguggcccgcccugcaggagcuggccagaugcggcaaccuggccugcagaagcgaccugcagguggccgccaaggcccuggagaugggcguguucggcgccuacuucaacgugcugaucaaccugagagacaucaccgacgaggccuucaaggaccagauccaccacagagugagcagccugcugcaggaggccaagacccaggccgcccuggugcuggacugccuggagaccagacaggaguaa

SEQ ID NO: 17269 - RNA, 552 nt, Artificial Sequence
  FTH1__Homo_sapiens__NP_002023
augaccaccgccagcaccagccaggugagacagaacuaccaccaggacagcgaggccgccaucaacagacagaucaaccuggagcuguacgccagcuacguguaccugagcaugagcuacuacuucgacagagacgacguggcccugaagaacuucgccaaguacuuccugcaccagagccacgaggagagagagcacgccgagaagcugaugaagcugcagaaccagagaggcggcagaaucuuccugcaggacaucaagaagcccgacugcgacgacugggagagcggccugaacgccauggagugcgcccugcaccuggagaagaacgugaaccagagccugcuggagcugcacaagcuggccaccgacaagaacgacccccaccugugcgacuucaucgagacccacuaccugaacgagcaggugaaggccaucaaggagcugggcgaccacgugaccaaccugagaaagaugggcgcccccgagagcggccuggccgaguaccuguucgacaagcacacccugggcgacagcgacaacgagagcuaa

SEQ ID NO: 17270 - RNA, 528 nt, Artificial Sequence
  FTL__Homo_sapiens__NP_000137
augagcagccagaucagacagaacuacagcaccgacguggaggccgccgugaacagccuggugaaccuguaccugcaggccagcuacaccuaccugagccugggcuucuacuucgacagagacgacguggcccuggagggcgugagccacuucuucagagagcuggccgaggagaagagagagggcuacgagagacugcugaagaugcagaaccagagaggcggcagagcccuguuccaggacaucaagaagcccgccgaggacgaguggggcaagacccccgacgccaugaaggccgccauggcccuggagaagaagcugaaccaggcccugcuggaccugcacgcccugggcagcgccagaaccgacccccaccugugcgacuuccuggagacccacuuccuggacgaggaggugaagcugaucaagaagaugggcgaccaccugaccaaccugcacagacugggcggccccgaggccggccugggcgaguaccuguucgagagacugacccugaagcacgacuaa

SEQ ID NO: 17271 - RNA, 729 nt, Artificial Sequence
  FTMT__Homo_sapiens__NP_803431
augcugagcugcuucagacugcugagcagacacaucagccccagccuggccagccugagacccgugagaugcugcuucgcccugccccugagaugggcccccggcagaccccuggaccccagacagaucgcccccagaagaccccuggccgccgccgccagcagcagagaccccaccggccccgccgccggccccagcagagugagacagaacuuccaccccgacagcgaggccgccaucaacagacagaucaaccuggagcuguacgccagcuacguguaccugagcauggccuacuacuucagcagagacgacguggcccugaacaacuucagcagauacuuccugcaccagagcagagaggagaccgagcacgccgagaagcugaugagacugcagaaccagagaggcggcagaaucagacugcaggacaucaagaagcccgagcaggacgacugggagagcggccugcacgccauggagugcgcccugcugcuggagaagaacgugaaccagagccugcuggagcugcacgcccuggccagcgacaagggcgacccccaccugugcgacuuccuggagaccuacuaccugaacgagcaggugaagagcaucaaggagcugggcgaccacgugcacaaccuggugaagaugggcgcccccgacgccggccuggccgaguaccuguucgacacccacacccugggcaacgagaacaagcagaacuaa

SEQ ID NO: 17272 - RNA, 1518 nt, Artificial Sequence
  FTO__Homo_sapiens__NP_001073901
augaagagaacccccaccgccgaggagagagagagagaggccaagaagcugagacugcuggaggagcuggaggacaccuggcugcccuaccugacccccaaggacgacgaguucuaccagcaguggcagcugaaguaccccaagcugauccugagagaggccagcagcgugagcgaggagcugcacaaggaggugcaggaggccuuccugacccugcacaagcacggcugccuguucagagaccuggugagaauccagggcaaggaccugcugacccccgugagcagaauccugaucggcaaccccggcugcaccuacaaguaccugaacaccagacuguucaccgugcccuggcccgugaagggcagcaacaucaagcacaccgaggccgagaucgccgccgccugcgagaccuuccugaagcugaacgacuaccugcagaucgagaccauccaggcccuggaggagcuggccgccaaggagaaggccaacgaggacgccgugccccugugcaugagcgccgacuuccccagagugggcaugggcagcagcuacaacggccaggacgagguggacaucaagagcagagccgccuacaacgugacccugcugaacuucauggacccccagaagaugcccuaccugaaggaggagcccuacuucggcaugggcaagauggccgugagcuggcaccacgacgagaaccugguggacagaagcgccguggccguguacagcuacagcugcgagggccccgaggaggagagcgaggacgacagccaccuggagggcagagaccccgacaucuggcacgugggcuucaagaucagcugggacaucgagacccccggccuggccaucccccugcaccagggcgacugcuacuucaugcuggacgaccugaacgccacccaccagcacugcgugcuggccggcagccagcccagauucagcagcacccacagaguggccgagugcagcaccggcacccuggacuacauccugcagagaugccagcuggcccugcagaacgugugcgacgacguggacaacgacgacgugagccugaagagcuucgagcccgccgugcugaagcagggcgaggagauccacaacgagguggaguucgaguggcugagacaguucugguuccagggcaacagauacagaaagugcaccgacugguggugccagcccauggcccagcuggaggcccuguggaagaagauggagggcgugaccaacgccgugcugcacgaggugaagagagagggccugcccguggagcagagaaacgagauccugaccgccauccuggccagccugaccgccagacagaaccugagaagagaguggcacgccagaugccagagcagaaucgccagaacccugcccgccgaccagaagcccgagugcagacccuacugggagaaggacgacgccagcaugccccugcccuucgaccugaccgacaucgugagcgagcugagaggccagcugcuggaggccaagcccuaa

SEQ ID NO: 17273 - RNA, 579 nt, Artificial Sequence
  FTSJ1__Homo_sapiens__NP_001269086
auggcccugaacaucgccacccacgugcugaagcccggcggcugcuucguggccaagaucuucagaggcagagacgugacccugcuguacagccagcugcagguguucuucagcagcgugcugugcgccaagcccagaagcagcagaaacagcagcaucgaggccuucgccgugugccagggcuacgacccccccgagggcuucauccccgaccugagcaagccccugcuggaccacagcuacgaccccgacuucaaccagcuggacggccccaccagaaucaucgugcccuucgugaccugcggcgaccugagcagcuacgacagcgacagaagcuacccccuggaccuggagggcggcagcgaguacaaguacaccccccccacccagccccccaucagcccccccuaccaggaggccugcacccugaagagaaagggccagcuggccaaggagaucagaccccaggacugccccaucagcagaguggacaccuucccccagccccuggccgccccccagugccacacccugcuggcccccgagauggaggacaacgagaugagcugcagccccuaa

SEQ ID NO: 17274 - RNA, 741 nt, Artificial Sequence
  FTSJ2__Homo_sapiens__NP_037525
auggccggcuaccugaagcuggugugcgugagcuuccagagacagggcuuccacaccgugggcagcagaugcaagaacagaaccggcgccgagcaccuguggcugaccagacaccugagagaccccuucgugaaggccgccaagguggagagcuacagaugcagaagcgccuucaagcugcuggaggugaacgagagacaccagauccugagacccggccugagagugcuggacugcggcgccgcccccggcgccuggagccagguggccgugcagaaggugaacgccgccggcaccgaccccagcagccccgugggcuucgugcugggcguggaccugcugcacaucuucccccuggagggcgccaccuuccugugccccgccgacgugaccgaccccagaaccagccagagaauccuggaggugcugcccggcagaagagccgacgugauccugagcgacauggcccccaacgccaccggcuucagagaccuggaccacgacagacugaucagccugugccugacccugcugagcgugacccccgacauccugcagcccggcggcaccuuccugugcaagaccugggccggcagccagagcagaagacugcagagaagacugaccgaggaguuccagaacgugagaaucaucaagcccgaggccagcagaaaggagagcagcgagguguacuuccuggccacccaguaccacggcagaaagggcaccgugaagcaguaa

SEQ ID NO: 17275 - RNA, 2544 nt, Artificial Sequence
  FTSJ3__Homo_sapiens__NP_060117
augggcaagaagggcaaggugggcaagagcagaagagacaaguucuaccaccuggccaaggagaccggcuacagaagcagaagcgccuucaagcugauccagcugaacagaagauuccaguuccugcagaaggccagagcccugcuggaccugugcgccgcccccggcggcuggcugcagguggccgccaaguucaugcccgugagcagccugaucgugggcguggaccuggugcccaucaagccccugcccaacguggugacccugcagcaggacaucaccaccgagagaugcagacaggcccugagaaaggagcugaagaccuggaagguggacguggugcugaacgacggcgcccccaacgugggcgccagcugggugcacgacgccuacagccaggcccaccugacccugauggcccugagacuggccugcgacuuccuggccagaggcggcagcuucaucaccaagguguucagaagcagagacuaccagccccugcuguggaucuuccagcagcuguucagaagagugcaggccaccaagccccaggccagcagacacgagagcgccgagaucuucguggugugccagggcuuccuggcccccgacaagguggacagcaaguucuucgaccccaaguucgccuucaaggagguggaggugcaggccaagaccgugaccgagcuggugaccaagaagaagcccaaggccgagggcuacgccgagggcgaccugacccuguaccacagaaccagcgugaccgacuuccugagagccgccaaccccguggacuuccugagcaaggccagcgagaucaugguggacgacgaggagcuggcccagcaccccgccaccaccgaggacaucagagugugcugccaggacaucagagugcugggcagaaaggagcugagaagccugcugaacuggagaaccaagcugagaagauacguggccaagaagcugaaggagcaggccaaggcccuggacaucagccugagcagcggcgaggaggacgagggcgacgaggaggacagcaccgccggcaccaccaagcagcccagcaaggaggaggaggaggaggaggaggaggagcagcugaaccagacccuggccgagaugaaggcccaggagguggccgagcugaagagaaagaagaagaagcugcugagagagcagagaaagcagagagagagaguggagcugaagauggaccugcccggcgugagcaucgccgacgagggcgagaccggcauguucagccugagcaccaucagaggccaccagcugcuggaggaggugacccagggcgacaugagcgccgccgacaccuuccugagcgaccugcccagagacgacaucuacgugagcgacguggaggacgacggcgacgacaccagccuggacagcgaccuggaccccgaggagcuggccggcgugagaggccaccagggccugagagaccagaagagaaugagacugaccgaggugcaggacgacaaggaggaggaggaggaggagaacccccugcuggugccccuggaggagaaggccgugcugcaggaggagcaggccaaccugugguucagcaagggcagcuucgccggcaucgaggacgacgccgacgaggcccuggagaucagccaggcccagcugcuguucgagaacagaagaaagggcagacagcagcagcagaagcagcagcugccccagaccccccccagcugccugaagaccgagaucaugagcccccuguaccaggacgaggcccccaagggcaccgaggccagcagcggcaccgaggccgccaccggccuggagggcgaggagaaggacggcaucagcgacagcgacagcagcaccagcagcgaggaggaggagagcugggagccccugagaggcaagaagagaagcagaggccccaagagcgacgacgacggcuucgagaucgugcccaucgaggaccccgccaagcacagaauccuggaccccgagggccuggcccugggcgccgugaucgccagcagcaagaaggccaagagagaccugaucgacaacagcuucaacagauacaccuucaacgaggacgagggcgagcugcccgagugguucgugcaggaggagaagcagcacagaaucagacagcugcccgugggcaagaaggagguggagcacuacagaaagagauggagagagaucaacgccagacccaucaagaagguggccgaggccaaggccagaaagaagagaagaaugcugaagagacuggagcagaccagaaagaaggccgaggccguggugaacaccguggacaucagcgagagagagaagguggcccagcugagaagccuguacaagaaggccggccugggcaaggagaagagacacgugaccuacgugguggccaagaagggcgugggcagaaaggugagaagacccgccggcgugagaggccacuucaaggugguggacagcagaaugaagaaggaccagagagcccagcagagaaaggagcagaagaagaagcacaagagaaaguaa

SEQ ID NO: 17276 - RNA, 1998 nt, Artificial Sequence
  FUBP1__Homo_sapiens__NP_001290362
auggccgacuacagcaccgugcccccccccagcagcggcagcgccggcggcggcggcggcggcggcggcggcggcggcgugaacgacgccuucaaggacgcccugcagagagccagacagaucgccgccaagaucggcggcgacgccggcaccagccugaacagcaacgacuacggcuacggcggccagaagagaccccuggaggacggcgacggcagcuggaccagccccagcagcaccacccacugggagggcaugcccagccccuucaaggaccagcccgacgccaagaagguggccccccagaacgacagcuucggcacccagcugccccccaugcaccagcagcagagcagaagcgugaugaccgaggaguacaaggugcccgacggcauggugggcuucaucaucggcagaggcggcgagcagaucagcagaauccagcaggagagcggcugcaagauccagaucgcccccgacagcggcggccugcccgagagaagcugcaugcugaccggcacccccgagagcgugcagagcgccaagagacugcuggaccagaucguggagaagggcagacccgcccccggcuuccaccacggcgacggccccggcaacgccgugcaggagaucaugauccccgccagcaaggccggccuggugaucggcaagggcggcgagaccaucaagcagcugcaggagagagccggcgugaagauggugaugauccaggacggcccccagaacaccggcgccgacaagccccugagaaucaccggcgaccccuacaaggugcagcaggccaaggagauggugcuggagcugaucagagaccagggcggcuucagagaggugagaaacgaguacggcagcagaaucggcggcaacgagggcaucgacgugcccauccccagauucgccgugggcaucgugaucggcagaaacggcgagaugaucaagaagauccagaacgacgccggcgugagaauccaguucaagcccgacgacggcaccacccccgagagaaucgcccagaucaccggcccccccgacagaugccagcacgccgccgagaucaucaccgaccugcugagaagcgugcaggccggcaaccccggcggccccggccccggcggcagaggcagaggcagaggccagggcaacuggaacaugggcccccccggcggccugcaggaguucaacuucaucgugcccaccggcaagaccggccugaucaucggcaagggcggcgagaccaucaagagcaucagccagcagagcggcgccagaaucgagcugcagagaaaccccccccccaacgccgaccccaacaugaagcuguucaccaucagaggcaccccccagcagaucgacuacgccagacagcugaucgaggagaagaucggcggccccgugaacccccugggcccccccgugccccacggcccccacggcgugcccggcccccacggcccccccggcccccccggccccggcacccccaugggccccuacaaccccgcccccuacaaccccggcccccccggccccgccccccacggcccccccgcccccuacgccccccagggcuggggcaacgccuacccccacuggcagcagcaggccccccccgaccccgccaaggccggcaccgaccccaacagcgccgccugggccgccuacuacgcccacuacuaccagcagcaggcccagcccccccccgccgcccccgccggcgcccccaccaccacccagaccaacggccagggcgaccagcagaaccccgcccccgccggccagguggacuacaccaaggccugggaggaguacuacaagaagaugggccaggccgugcccgcccccaccggcgccccccccggcggccagcccgacuacagcgccgccugggccgaguacuacagacagcaggccgccuacuacgcccagaccagcccccagggcaugccccagcacccccccgccccccagggccaguaa

SEQ ID NO: 17277 - RNA, 1719 nt, Artificial Sequence
  FUBP3__Homo_sapiens__NP_003925
auggccgagcuggugcagggccagagcgcccccgugggcaugaaggccgagggcuucguggacgcccugcacagagugagacagaucgccgccaagaucgacagcaucccccaccugaacaacagcaccccccugguggaccccagcguguacggcuacggcgugcagaagagaccccuggacgacggcgugggcaaccagcugggcgcccuggugcaccagagaaccgugaucaccgaggaguucaaggugcccgacaagauggugggcuucaucaucggcagaggcggcgagcagaucagcagaauccaggccgagagcggcugcaagauccagaucgccagcgagagcagcggcauccccgagagacccugcgugcugaccggcacccccgagagcaucgagcaggccaagagacugcugggccagaucguggacagaugcagaaacggccccggcuuccacaacgacaucgacagcaacagcaccauccaggagauccugauccccgccagcaaggugggccuggugaucggcagaggcggcgagaccaucaagcagcugcaggagagaaccggcgugaagauggugaugauccaggacggcccccugcccaccggcgccgacaagccccugagaaucaccggcgacgccuucaaggugcagcaggccagagagauggugcuggagaucaucagagagaaggaccaggccgacuucagaggcgugagaggcgacuucaacagcagaaugggcggcggcagcaucgaggugagcgugcccagauucgccgugggcaucgugaucggcagaaacggcgagaugaucaagaagauccagaacgacgccggcgugagaauccaguucaagcccgacgacggcaucagccccgagagagccgcccaggugaugggcccccccgacagaugccagcacgccgcccacaucaucagcgagcugauccugaccgcccaggagagagacggcuucggcggccuggccgccgccagaggcagaggcagaggcagaggcgacuggagcgugggcgcccccggcggcgugcaggagaucaccuacaccgugcccgccgacaagugcggccuggugaucggcaagggcggcgagaacaucaagagcaucaaccagcagagcggcgcccacguggagcugcagagaaaccccccccccaacagcgaccccaaccugagaagauucaccaucagaggcgugccccagcagaucgagguggccagacagcugaucgacgagaaggugggcggcaccaaccugggcgcccccggcgccuucggccagagccccuucagccagccccccgcccccccccaccagaacaccuucccccccagaagcagcggcugcuuccccaacauggccgccaaggugaacggcaacccccacagcacccccgugagcggcccccccgccuuccugacccagggcuggggcagcaccuaccaggccuggcagcagcccacccagcaggugcccagccagcagagccagccccagagcagccagcccaacuacagcaaggccugggaggacuacuacaagaagcagagccacgccgccagcgccgccccccaggccagcagcccccccgacuacaccauggccugggccgaguacuacagacagcagguggccuucuacggccagacccugggccaggcccaggcccacagccaggagcaguaa

SEQ ID NO: 17278 - RNA, 768 nt, Artificial Sequence
  FUCA1__Homo_sapiens__XP_011539469
augcccgagcuguacgaccuggugaacagcuacaagcccgaccugaucuggagcgacggcgagugggagugccccgacaccuacuggaacagcaccaacuuccugagcuggcuguacaacgacagccccgugaaggacgaggugguggugaacgacagauggggccagaacugcagcugccaccacggcggcuacuacaacugcgaggacaaguucaagccccagagccugcccgaccacaagugggagaugugcaccagcaucgacaaguucagcuggggcuacagaagagacauggcccugagcgacgugaccgaggagagcgagaucaucagcgagcuggugcagaccgugagccugggcggcaacuaccugcugaacaucggccccaccaaggacggccugaucgugcccaucuuccaggagagacugcuggccgugggcaaguggcugagcaucaacggcgaggccaucuacgccagcaagcccuggagagugcagugggagaagaacaccaccagcgugugguacaccagcaagggcagcgccguguacgccaucuuccugcacuggcccgagaacggcgugcugaaccuggagagccccaucaccaccagcaccaccaagaucaccaugcugggcauccagggcgaccugaaguggagcaccgaccccgacaagggccuguucaucagccugccccagcugccccccagcgccgugcccgccgaguucgccuggaccaucaagcugaccggcgugaaguaa

SEQ ID NO: 17279 - RNA, 1404 nt, Artificial Sequence
  FUCA2__Homo_sapiens__NP_114409
augagaccccaggagcugcccagacuggccuucccccugcugcugcugcugcugcugcugcugccccccccccccugccccgcccacagcgccaccagauucgaccccaccugggagagccuggacgccagacagcugcccgccugguucgaccaggccaaguucggcaucuucauccacuggggcguguucagcgugcccagcuucggcagcgagugguucuggugguacuggcagaaggagaagauccccaaguacguggaguucaugaaggacaacuacccccccagcuucaaguacgaggacuucggcccccuguucaccgccaaguucuucaacgccaaccagugggccgacaucuuccaggccagcggcgccaaguacaucgugcugaccagcaagcaccacgagggcuucacccuguggggcagcgaguacagcuggaacuggaacgccaucgacgagggccccaagagagacaucgugaaggagcuggagguggccaucagaaacagaaccgaccugagauucggccuguacuacagccuguucgagugguuccacccccuguuccuggaggacgagagcagcagcuuccacaagagacaguuccccgugagcaagacccugcccgagcuguacgagcuggugaacaacuaccagcccgaggugcuguggagcgacggcgacggcggcgcccccgaccaguacuggaacagcaccggcuuccuggccuggcuguacaacgagagccccgugagaggcaccguggugaccaacgacagauggggcgccggcagcaucugcaagcacggcggcuucuacaccugcagcgacagauacaaccccggccaccugcugccccacaagugggagaacugcaugaccaucgacaagcugagcuggggcuacagaagagaggccggcaucagcgacuaccugaccaucgaggagcuggugaagcagcugguggagaccgugagcugcggcggcaaccugcugaugaacaucggccccacccuggacggcaccaucagcgugguguucgaggagagacugagacagaugggcagcuggcugaaggugaacggcgaggccaucuacgagacccacaccuggagaagccagaacgacaccgugacccccgacgugugguacaccagcaagcccaaggagaagcugguguacgccaucuuccugaaguggcccaccagcggccagcuguuccugggccaccccaaggccauccugggcgccaccgaggugaagcugcugggccacggccagccccugaacuggaucagccuggagcagaacggcaucaugguggagcugccccagcugaccauccaccagaugcccugcaaguggggcugggcccuggcccugaccaacgugaucuaa

SEQ ID NO: 17280 - RNA, 468 nt, Artificial Sequence
  FUNDC1__Homo_sapiens__NP_776155
auggccaccagaaacccccccccccaggacuacgagagcgacgacgacagcuacgaggugcuggaccugaccgaguacgccagaagacaccagugguggaacagaguguucggccacagcagcggccccaugguggagaaguacagcguggccacccagaucgugaugggcggcgugaccggcuggugcgccggcuuccuguuccagaaggugggcaagcuggccgccaccgccgugggcggcggcuuccugcugcugcagaucgccagccacagcggcuacgugcagaucgacuggaagagaguggagaaggacgugaacaaggccaagagacagaucaagaagagagccaacaaggccgcccccgagaucaacaaccugaucgaggaggccaccgaguucaucaagcagaacaucgugaucagcagcggcuucgugggcggcuuccugcugggccuggccagcuaa

SEQ ID NO: 17281 - RNA, 570 nt, Artificial Sequence
  FUNDC2__Homo_sapiens__NP_076423
auggagaccagcgcccccagagccggcagccaggugguggccaccaccgccagacacagcgccgccuacagagccgacccccugagagugagcagcagagacaagcugaccgagauggccgccagcagccagggcaacuucgagggcaacuucgagagccuggaccuggccgaguucgccaagaagcagcccugguggagaaagcuguucggccaggagagcggccccagcgccgagaaguacagcguggccacccagcuguucaucggcggcgugaccggcuggugcaccggcuucaucuuccagaaggugggcaagcuggccgccaccgccgugggcggcggcuucuuccugcugcagcuggccaaccacaccggcuacaucaagguggacuggcagagaguggagaaggacaugaagaaggccaaggagcagcugaagaucagaaagagcaaccagauccccaccgaggugagaagcaaggccgaggagguggugagcuucgugaagaagaacgugcuggugaccggcggcuucuucggcggcuuccugcugggcauggccagcuaa

SEQ ID NO: 17282 - RNA, 2385 nt, Artificial Sequence
  FURIN__Homo_sapiens__NP_001276752
auggagcugagacccuggcugcugugggugguggccgccaccggcacccuggugcugcuggccgccgacgcccagggccagaagguguucaccaacaccugggccgugagaauccccggcggccccgccguggccaacagcguggccagaaagcacggcuuccugaaccugggccagaucuucggcgacuacuaccacuucuggcacagaggcgugaccaagagaagccugagcccccacagacccagacacagcagacugcagagagagccccaggugcaguggcuggagcagcagguggccaagagaagaaccaagagagacguguaccaggagcccaccgaccccaaguucccccagcagugguaccugagcggcgugacccagagagaccugaacgugaaggccgccugggcccagggcuacaccggccacggcaucguggugagcauccuggacgacggcaucgagaagaaccaccccgaccuggccggcaacuacgaccccggcgccagcuucgacgugaacgaccaggaccccgacccccagcccagauacacccagaugaacgacaacagacacggcaccagaugcgccggcgagguggccgccguggccaacaacggcgugugcggcgugggcguggccuacaacgccagaaucggcggcgugagaaugcuggacggcgaggugaccgacgccguggaggccagaagccugggccugaaccccaaccacauccacaucuacagcgccagcuggggccccgaggacgacggcaagaccguggacggccccgccagacuggccgaggaggccuucuucagaggcgugagccagggcagaggcggccugggcagcaucuucgugugggccagcggcaacggcggcagagagcacgacagcugcaacugcgacggcuacaccaacagcaucuacacccugagcaucagcagcgccacccaguucggcaacgugcccugguacagcgaggccugcagcagcacccuggccaccaccuacagcagcggcaaccagaacgagaagcagaucgugaccaccgaccugagacagaagugcaccgagagccacaccggcaccagcgccagcgccccccuggccgccggcaucaucgcccugacccuggaggccaacaagaaccugaccuggagagacaugcagcaccugguggugcagaccagcaagcccgcccaccugaacgccaacgacugggccaccaacggcgugggcagaaaggugagccacagcuacggcuacggccugcuggacgccggcgccaugguggcccuggcccagaacuggaccaccguggccccccagagaaagugcaucaucgacauccugaccgagcccaaggacaucggcaagagacuggaggugagaaagaccgugaccgccugccugggcgagcccaaccacaucaccagacuggagcacgcccaggccagacugacccugagcuacaacagaagaggcgaccuggccauccaccuggugagccccaugggcaccagaagcacccugcuggccgccagaccccacgacuacagcgccgacggcuucaacgacugggccuucaugaccacccacagcugggacgaggaccccagcggcgagugggugcuggagaucgagaacaccagcgaggccaacaacuacggcacccugaccaaguucacccuggugcuguacggcaccgcccccgagggccugcccgugccccccgagagcagcggcugcaagacccugaccagcagccaggccugcguggugugcgaggagggcuucagccugcaccagaagagcugcgugcagcacugcccccccggcuucgccccccaggugcuggacacccacuacagcaccgagaacgacguggagaccaucagagccagcgugugcgcccccugccacgccagcugcgccaccugccagggccccgcccugaccgacugccugagcugccccagccacgccagccuggaccccguggagcagaccugcagcagacagagccagagcagcagagagagccccccccagcagcagccccccagacugccccccgagguggaggccggccagagacugagagccggccugcugcccagccaccugcccgaggugguggccggccugagcugcgccuucaucgugcugguguucgugaccguguuccuggugcugcagcugagaagcggcuucagcuucagaggcgugaagguguacaccauggacagaggccugaucagcuacaagggccugccccccgaggccuggcaggaggagugccccagcgacagcgaggaggacgagggcagaggcgagagaaccgccuucaucaaggaccagagcgcccuguaa

SEQ ID NO: 17283 - RNA, 1569 nt, Artificial Sequence
  FUS__Homo_sapiens__NP_001164408
auggccagcaacgacuacacccagcaggccacccagagcuacggcgccuaccccacccagcccggccagggcuacagccagcagagcagccagcccuacggccagcagagcuacagcggcuacagccagagcaccgacaccagcggcuacggccagagcagcuacagcagcuacggccagagccagaacaccggcuacggcacccagagcaccccccagggcuacggcagcaccggcggcuacggcagcagccagagcagccagagcagcuacggccagcagagcagcuaccccggcuacggccagcagcccgcccccagcagcaccagcggcagcuacggcagcagcagccagagcagcagcuacggccagccccagagcggcagcuacagccagcagcccagcuacggcggccagcagcagagcuacggccagcagcagagcuacaaccccccccagggcuacggccagcagaaccaguacaacagcagcagcggcggcggcggcggcggcaacuacggccaggaccagagcagcaugagcagcggcggcggcagcggcggcggcuacggcaaccaggaccagagcggcggcggcggcagcggcggcuacggccagcaggacagaggcggcagaggcagaggcggcagcggcggcggcggcggcggcggcggcggcggcuacaacagaagcagcggcggcuacgagcccagaggcagaggcggcggcagaggcggcagaggcggcaugggcggcagcgacagaggcggcuucaacaaguucggcggccccagagaccagggcagcagacacgacagcgagcaggacaacagcgacaacaacaccaucuucgugcagggccugggcgagaacgugaccaucgagagcguggccgacuacuucaagcagaucggcaucaucaagaccaacaagaagaccggccagcccaugaucaaccuguacaccgacagagagaccggcaagcugaagggcgaggccaccgugagcuucgacgacccccccagcgccaaggccgccaucgacugguucgacggcaaggaguucagcggcaaccccaucaaggugagcuucgccaccagaagagccgacuucaacagaggcggcggcaacggcagaggcggcagaggcagaggcggccccaugggcagaggcggcuacggcggcggcggcagcggcggcggcggcagaggcggcuuccccagcggcggcggcggcggcggcggccagcagagagccggcgacuggaagugccccaaccccaccugcgagaacaugaacuucagcuggagaaacgagugcaaccagugcaaggcccccaagcccgacggccccggcggcggccccggcggcagccacaugggcggcaacuacggcgacgacagaagaggcggcagaggcggcuacgacagaggcggcuacagaggcagaggcggcgacagaggcggcuucagaggcggcagaggcggcggcgacagaggcggcuucggccccggcaagauggacagcagaggcgagcacagacaggacagaagagagagacccuacuaa

SEQ ID NO: 17284 - RNA, 1440 nt, Artificial Sequence
  FUT10__Homo_sapiens__NP_116053
auggugagaauccagagaagaaagcugcuggccagcugccugugcgugaccgccaccguguuccugcuggugacccugcaggugaugguggagcugggcaaguucgagagaaaggaguucaagagcagcagccugcaggacggccacaccaagauggaggaggcccccacccaccugaacagcuuccugaagaaggagggccugaccuucaacagaaagagaaagugggagcuggacagcuaccccaucaugcugugguggagcccccugaccggcgagaccggcagacugggccagugcggcgccgacgccugcuucuucaccaucaacagaaccuaccugcaccaccacaugaccaaggccuuccuguucuacggcaccgacuucaacaucgacagccugccccugcccagaaaggcccaccacgacugggccguguuccacgaggagagccccaagaacaacuacaagcuguuccacaagcccgugaucacccuguucaacuacaccgccaccuucagcagacacagccaccugccccugaccacccaguaccuggagagcaucgaggugcugaagagccugagauaccuggugccccugcagagcaagaacaagcugagaaagagacuggccccccugguguacgugcagagcgacugcgacccccccagcgacagagacagcuacgugagagagcugaugaccuacaucgagguggacagcuacggcgagugccugagaaacaaggaccugccccagcagcugaagaaccccgccagcauggacgccgacggcuucuacagaaucaucgcccaguacaaguucauccuggccuucgagaacgccgugugcgacgacuacaucaccgagaaguucuggagaccccugaagcugggcguggugcccguguacuacggcagccccagcaucaccgacuggcugcccagcaacaagagcgccauccuggugagcgaguucagccaccccagagagcuggccagcuacaucagaagacuggacagcgacgacagacuguacgaggccuacguggaguggaagcugaagggcgagaucagcaaccagagacugcugaccgcccugagagagagaaaguggggcgugcaggacgugaaccaggacaacuacaucgacgccuucgagugcauggugugcaccaaggugugggccaacaucagacugcaggagaagggccugccccccaagagaugggaggccgaggacacccaccugagcugccccgagcccaccguguucgccuucagcccccugagaacccccccccugagcagccugagagagauguggaucagcagcuucgagcagagcaagaaggaggcccaggcccugagauggcugguggacagaaaccagaacuucagcagccaggaguucuggggccugguguucaaggacuaa

SEQ ID NO: 17285 - RNA, 1431 nt, Artificial Sequence
  FUT11__Homo_sapiens__NP_001271123
auggccgccggccccaucagaguggugcuggugcugcugggcgugcugagcgugugcgccgccagcggccacggcagcguggccgagagagaggccggcggcgaggccgagugggccgagcccugggacggcgccguguucagaccccccagcgcccugggcgccgugggcgugaccagaagcagcggcacccccagacccggcagagaggaggccggcgaccugcccgugcugcugugguggagccccggccuguucccccacuuccccggcgacagcgagagaaucgagugcgccagaggcgccugcguggccagcagaaacagaagagcccugagagacagcagaaccagagcccugcuguucuacggcaccgacuucagagccagcgccgccccccugcccagacuggcccaccagagcugggcccugcugcacgaggagagcccccugaacaacuuccugcugagccacggccccggcaucagacuguucaaccugaccagcaccuucagcagacacagcgacuacccccugagccugcaguggcugcccggcaccgccuaccugagaagacccgugcccccccccauggagagagccgaguggagaagaagaggcuacgccccccugcuguaccugcagagccacugcgacgugcccgccgacagagacagauacgugagagagcugaugagacacauccccguggacagcuacggcaagugccugcagaacagagagcugcccaccgccagacugcaggacaccgccaccgccaccaccgaggaccccgagcugcuggccuuccugagcagauacaaguuccaccuggcccuggagaacgccaucugcaacgacuacaugaccgagaagcuguggagacccaugcaccugggcgccgugcccguguacagaggcagccccagcgugagagacuggaugcccaacaaccacagcgugauccugaucgacgacuucgagagcccccagaagcuggccgaguucaucgacuuccuggacaagaacgacgaggaguacaugaaguaccuggccuacaagcagcccggcggcaucaccaaccaguuccugcuggacagccugaagcacagagaguggggcgugaacgacccccugcugcccaacuaccugaacggcuucgagugcuucgugugcgacuacgagcuggccagacuggacgccgagaaggcccacgccgccagccccggcgacagccccguguucgagccccacaucgcccagcccagccacauggacugccccgugcccacccccggcuucggcaacguggaggagauccccgagaacgacagcagccuggugcaggugagagaccacugcaucugccugagauuccuguggccccacagcgagaagggcagaacccacaacuacgccgccgugcccuaa

SEQ ID NO: 17286 - RNA, 1098 nt, Artificial Sequence
  FUT1__Homo_sapiens__NP_000139
auguggcugagaagccacagacagcugugccuggccuuccugcuggugugcgugcugagcgugaucuucuuccugcacauccaccaggacagcuucccccacggccugggccugagcauccugugccccgacagaagacuggugaccccccccguggccaucuucugccugcccggcaccgccaugggccccaacgccagcagcagcugcccccagcaccccgccagccugagcggcaccuggaccguguaccccaacggcagauucggcaaccagaugggccaguacgccacccugcuggcccuggcccagcugaacggcagaagagccuucauccugcccgccaugcacgccgcccuggcccccguguucagaaucacccugcccgugcuggcccccgagguggacagcagaacccccuggagagagcugcagcugcacgacuggaugagcgaggaguacgccgaccugagagaccccuuccugaagcugagcggcuuccccugcagcuggaccuucuuccaccaccugagagagcagaucagaagagaguucacccugcacgaccaccugagagaggaggcccagagcgugcugggccagcugagacugggcagaaccggcgacagacccagaaccuucgugggcgugcacgugagaagaggcgacuaccugcaggugaugccccagagauggaagggcguggugggcgacagcgccuaccugagacaggccauggacugguucagagccagacacgaggcccccguguucguggugaccagcaacggcauggaguggugcaaggagaacaucgacaccagccagggcgacgugaccuucgccggcgacggccaggaggccacccccuggaaggacuucgcccugcugacccagugcaaccacaccaucaugaccaucggcaccuucggcuucugggccgccuaccuggccggcggcgacaccguguaccuggccaacuucacccugcccgacagcgaguuccugaagaucuucaagcccgaggccgccuuccugcccgagugggugggcaucaacgccgaccugagcccccuguggacccuggccaagcccuaa

SEQ ID NO: 17287 - RNA, 1032 nt, Artificial Sequence
  FUT2__Homo_sapiens__NP_001091107
augcugguggugcagaugcccuucagcuuccccauggcccacuucauccuguucguguucaccgugagcaccaucuuccacgugcagcagagacuggccaagauccaggccaugugggagcugcccgugcagauccccgugcuggccagcaccagcaaggcccugggccccagccagcugagaggcauguggaccaucaacgccaucggcagacugggcaaccagaugggcgaguacgccacccuguacgcccuggccaagaugaacggcagacccgccuucauccccgcccagaugcacagcacccuggcccccaucuucagaaucacccugcccgugcugcacagcgccaccgccagcagaauccccuggcagaacuaccaccugaacgacuggauggaggaggaguacagacacauccccggcgaguacgugagauucaccggcuaccccugcagcuggaccuucuaccaccaccugagacaggagauccugcaggaguucacccugcacgaccacgugagagaggaggcccagaaguuccugagaggccugcaggugaacggcagcagacccggcaccuucgugggcgugcacgugagaagaggcgacuacgugcacgugaugcccaagguguggaagggcgugguggccgacagaagauaccugcagcaggcccuggacugguucagagccagauacagcagccugaucuucguggugaccagcaacggcauggccuggugcagagagaacaucgacaccagccacggcgacgugguguucgccggcgacggcaucgagggcagccccgccaaggacuucgcccugcugacccagugcaaccacaccaucaugaccaucggcaccuucggcaucugggccgccuaccugaccggcggcgacaccaucuaccuggccaacuacacccugcccgacagccccuuccugaagaucuucaagcccgaggccgccuuccugcccgaguggaccggcaucgccgccgaccugagcccccugcugaagcacuaa

SEQ ID NO: 17288 - RNA, 1086 nt, Artificial Sequence
  FUT3__Homo_sapiens__XP_011526169
auggacccccugggcgccgccaagccccaguggcccuggagaagaugccuggccgcccugcuguuccagcugcugguggccgugugcuucuucagcuaccugagagugagcagagacgacgccaccggcagccccagagcccccagcggcagcagcagacaggacaccacccccaccagacccacccugcugauccugcugagaaccuggcccuuccacauccccguggcccugagcagaugcagcgagauggugcccggcaccgccgacugccacaucaccgccgacagaaagguguacccccaggccgacauggugaucgugcaccacugggacaucaugagcaaccccaagagcagacugccccccagccccagaccccagggccagagauggaucugguucaaccuggagcccccccccaacugccagcaccuggaggcccuggacagauacuucaaccugaccaugagcuacagaagcgacagcgacaucuucacccccuacggcuggcuggagcccuggagcggccagcccgcccaccccccccugaaccugagcgccaagaccgagcugguggccugggccgugagcaacuggaagcccgacagcgccagagugagauacuaccagagccugcaggcccaccugaagguggacguguacggcagaagccacaagccccugcccaagggcaccaugauggagacccugagcagauacaaguucuaccuggccuucgagaacagccugcaccccgacuacaucaccgagaagcuguggagaaacgcccuggaggccugggccgugcccguggugcugggccccagcagaagcaacuacgagagauuccugccccccgacgccuucauccacguggacgacuuccagagccccaaggaccuggccagauaccugcaggagcuggacaaggaccacgccagauaccugagcuacuucagauggagagagacccugagacccagaagcuucagcugggcccuggacuucugcaaggccugcuggaagcugcagcaggagagcagauaccagaccgugagaagcaucgccgccugguucaccuaa

SEQ ID NO: 17289 - RNA, 1593 nt, Artificial Sequence
  FUT4__Homo_sapiens__NP_002024
augagaagacuguggggcgccgccagaaagcccagcggcgccggcugggagaaggagugggccgaggccccccaggaggcccccggcgccuggagcggcagacugggccccggcagaagcggcagaaagggcagagccgugcccggcugggccagcuggcccgcccaccuggcccuggccgccagacccgccagacaccugggcggcgccggccagggccccagaccccugcacagcggcaccgcccccuuccacagcagagccagcggcgagagacagagaagacuggagccccagcugcagcacgagagcagaugcagaagcagcacccccgccgacgccuggagagccgaggccgcccugcccgugagagccaugggcgcccccuggggcagccccaccgccgccgccggcggcagaagaggcuggagaagaggcagaggccugcccuggaccgugugcgugcuggccgccgccggccugaccugcaccgcccugaucaccuacgccugcuggggccagcugcccccccugcccugggccagccccacccccagcagacccgugggcgugcugcuguggugggagcccuucggcggcagagacagcgcccccagacccccccccgacugcagacugagauucaacaucagcggcugcagacugcugaccgacagagccagcuacggcgaggcccaggccgugcuguuccaccacagagaccuggugaagggcccccccgacuggcccccccccuggggcauccaggcccacaccgccgaggagguggaccugagagugcuggacuacgaggaggccgccgccgccgccgaggcccuggccaccagcagccccagaccccccggccagagauggguguggaugaacuucgagagccccagccacagccccggccugagaagccuggccagcaaccuguucaacuggacccugagcuacagagccgacagcgacguguucgugcccuacggcuaccuguaccccagaagccaccccggcgacccccccagcggccuggcccccccccugagcagaaagcagggccugguggccuggguggugagccacugggacgagagacaggccagagugagauacuaccaccagcugagccagcacgugaccguggacguguucggcagaggcggccccggccagcccgugcccgagaucggccugcugcacaccguggccagauacaaguucuaccuggccuucgagaacagccagcaccuggacuacaucaccgagaagcuguggagaaacgcccugcuggccggcgccgugcccguggugcugggccccgacagagccaacuacgagagauucgugcccagaggcgccuucauccacguggacgacuuccccagcgccagcagccuggccagcuaccugcuguuccuggacagaaaccccgccguguacagaagauacuuccacuggagaagaagcuacgccgugcacaucaccagcuucugggacgagcccuggugcagagugugccaggccgugcagagagccggcgacagacccaagagcaucagaaaccuggccagcugguucgagagauaa

SEQ ID NO: 17290 - RNA, 1125 nt, Artificial Sequence
  FUT5__Homo_sapiens__NP_002025
auggacccccugggccccgccaagccccaguggcuguggagaagaugccuggccggccugcuguuccagcugcugguggccgugugcuucuucagcuaccugagagugagcagagacgacgccaccggcagccccagacccggccugauggccguggagcccgugaccggcgcccccaacggcagcagaugccaggacagcauggccacccccgcccaccccacccugcugauccugcuguggaccuggcccuucaacacccccguggcccugcccagaugcagcgagauggugcccggcgccgccgacugcaacaucaccgccgacagcagcguguacccccaggccgacgccgugaucgugcaccacugggacaucauguacaaccccagcgccaaccugcccccccccaccagaccccagggccagagauggaucugguucagcauggagagccccagcaacugcagacaccuggaggcccuggacggcuacuucaaccugaccaugagcuacagaagcgacagcgacaucuucacccccuacggcuggcuggagcccuggagcggccagcccgcccaccccccccugaaccugagcgccaagaccgagcugguggccugggccgugagcaacuggaagcccgacagcgccagagugagauacuaccagagccugcaggcccaccugaagguggacguguacggcagaagccacaagccccugcccaagggcaccaugauggagacccugagcagauacaaguucuaccuggccuucgagaacagccugcaccccgacuacaucaccgagaagcuguggagaaacgcccuggaggccugggccgugcccguggugcugggccccagcagaagcaacuacgagagauuccugccccccgacgccuucauccacguggacgacuuccagagccccaaggaccuggccagauaccugcaggagcuggacaaggaccacgccagauaccugagcuacuuccacuggagagagacccugagacccagaagcuucagcugggcccuggccuucugcaaggccugcuggaagcugcagcaggagagcagauaccagaccgugagaagcaucgccgccugguucaccuaa

SEQ ID NO: 17291 - RNA, 1080 nt, Artificial Sequence
  FUT6__Homo_sapiens__NP_001035791
auggacccccugggccccgccaagccccaguggagcuggagaugcugccugaccacccugcuguuccagcugcugauggccgugugcuucuucagcuaccugagagugagccaggacgaccccaccguguaccccaacggcagcagauuccccgacagcaccggcacccccgcccacagcaucccccugauccugcuguggaccuggcccuucaacaagcccaucgcccugcccagaugcagcgagauggugcccggcaccgccgacugcaacaucaccgccgacagaaagguguacccccaggccgacgccgugaucgugcaccacagagaggugauguacaaccccagcgcccagcugcccagaagccccagaagacagggccagagauggaucugguucagcauggagagccccagccacugcuggcagcugaaggccauggacggcuacuucaaccugaccaugagcuacagaagcgacagcgacaucuucacccccuacggcuggcuggagcccuggagcggccagcccgcccaccccccccugaaccugagcgccaagaccgagcugguggccugggccgugagcaacuggggccccaacagcgccagagugagauacuaccagagccugcaggcccaccugaagguggacguguacggcagaagccacaagccccugccccagggcaccaugauggagacccugagcagauacaaguucuaccuggccuucgagaacagccugcaccccgacuacaucaccgagaagcuguggagaaacgcccuggaggccugggccgugcccguggugcugggccccagcagaagcaacuacgagagauuccugccccccgacgccuucauccacguggacgacuuccagagccccaaggaccuggccagauaccugcaggagcuggacaaggaccacgccagauaccugagcuacuucagauggagagagacccugagacccagaagcuucagcugggcccuggccuucugcaaggccugcuggaagcugcaggaggagagcagauaccagaccagaggcaucgccgccugguucaccuaa

SEQ ID NO: 17292 - RNA, 1029 nt, Artificial Sequence
  FUT7__Homo_sapiens__NP_004470
augaacaacgccggccacggccccaccagaagacugagaggccugggcgugcuggccggcguggcccugcuggccgcccuguggcugcuguggcugcugggcagcgcccccagaggcacccccgccccccagcccaccaucaccauccugguguggcacuggcccuucaccgaccagccccccgagcugcccagcgacaccugcaccagauacggcaucgccagaugccaccugagcgccaacagaagccugcuggccagcgccgacgccgugguguuccaccacagagagcugcagaccagaagaagccaccugccccuggcccagagacccagaggccagcccugggugugggccagcauggagagccccagccacacccacggccugagccaccugagaggcaucuucaacugggugcugagcuacagaagagacagcgacaucuucgugcccuacggcagacuggagccccacuggggccccagccccccccugcccgccaagagcagaguggccgccuggguggugagcaacuuccaggagagacagcugagagccagacuguacagacagcuggccccccaccugagaguggacguguucggcagagccaacggcagaccccugugcgccagcugccuggugcccaccguggcccaguacagauucuaccugagcuucgagaacagccagcacagagacuacaucaccgagaaguucuggagaaacgcccugguggccggcaccgugcccguggugcugggcccccccagagccaccuacgaggccuucgugcccgccgacgccuucgugcacguggacgacuucggcagcgccagagagcuggccgccuuccugaccggcaugaacgagagcagauaccagagauucuucgccuggagagacagacugagagugagacuguucaccgacuggagagagagauucugcgccaucugcgacagauacccccaccugcccagaagccagguguacgaggaccuggagggcugguuccaggccuaa

SEQ ID NO: 17293 - RNA, 1239 nt, Artificial Sequence
  FUT8__Homo_sapiens__NP_004471
augaccgaccuguacuaccugagccagaccgacggcgccggcgacuggagagagaaggaggccaaggaccugaccgagcuggugcagagaagaaucaccuaccugcagaaccccaaggacugcagcaaggccaagaagcuggugugcaacaucaacaagggcugcggcuacggcugccagcugcaccacgugguguacugcuucaugaucgccuacggcacccagagaacccugauccuggagagccagaacuggagauacgccaccggcggcugggagaccguguucagacccgugagcgagaccugcaccgacagaagcggcaucagcaccggccacuggagcggcgaggugaaggacaagaacgugcaggugguggagcugcccaucguggacagccugcaccccagaccccccuaccugccccuggccgugcccgaggaccuggccgacagacuggugagagugcacggcgaccccgccguguggugggugagccaguucgugaaguaccugaucagaccccagcccuggcuggagaaggagaucgaggaggccaccaagaagcugggcuucaagcaccccgugaucggcgugcacgugagaagaaccgacaaggugggcaccgaggccgccuuccaccccaucgaggaguacauggugcacguggaggagcacuuccagcugcuggccagaagaaugcagguggacaagaagagaguguaccuggccaccgacgaccccagccugcugaaggaggccaagaccaaguaccccaacuacgaguucaucagcgacaacagcaucagcuggagcgccggccugcacaacagauacaccgagaacagccugagaggcgugauccuggacauccacuuccugagccaggccgacuuccuggugugcaccuucagcagccaggugugcagaguggccuacgagaucaugcagacccugcaccccgacgccagcgccaacuuccacagccuggacgacaucuacuacuucggcggccagaacgcccacaaccagaucgccaucuacgcccaccagcccagaaccgccgacgagauccccauggagcccggcgacaucaucggcguggccggcaaccacugggacggcuacagcaagggcgugaacagaaagcugggcagaaccggccuguaccccagcuacaaggugagagagaagaucgagaccgugaaguaccccaccuaccccgaggccgagaaguaa

SEQ ID NO: 17294 - RNA, 1080 nt, Artificial Sequence
  FUT9__Homo_sapiens__XP_011533687
augaccagcaccagcaagggcauccugagacccuuccugaucgugugcaucauccugggcugcuucauggccugccugcugaucuacaucaagcccaccaacagcuggaucuucagccccauggagagcgccagcagcgugcugaagaugaagaacuucuucagcaccaagaccgacuacuucaacgagaccaccauccugguguggguguggcccuucggccagaccuucgaccugaccagcugccaggccauguucaacauccagggcugccaccugaccaccgacagaagccuguacaacaagagccacgccgugcugauccaccacagagacaucagcugggaccugaccaaccugccccagcaggccagaccccccuuccagaaguggaucuggaugaaccuggagagccccacccacaccccccagaagagcggcaucgagcaccuguucaaccugacccugaccuacagaagagacagcgacauccaggugcccuacggcuuccugaccgugagcaccaaccccuucguguucgaggugcccagcaaggagaagcuggugugcuggguggugagcaacuggaaccccgagcacgccagagugaaguacuacaacgagcugagcaagagcaucgagauccacaccuacggccaggccuucggcgaguacgugaacgacaagaaccugauccccaccaucagcaccugcaaguucuaccugagcuucgagaacagcauccacaaggacuacaucaccgagaagcuguacaacgccuuccuggccggcagcgugcccguggugcugggccccagcagagagaacuacgagaacuacauccccgccgacagcuucauccacguggaggacuacaacagccccagcgagcuggccaaguaccugaaggagguggacaagaacaacaagcuguaccugagcuacuucaacuggagaaaggacuucaccgugaaccugcccagauucugggagagccacgccugccuggccugcgaccacgugaagagacaccaggaguacaagagcgugggcaaccuggagaagugguucuggaacuaa

SEQ ID NO: 17295 - RNA, 1149 nt, Artificial Sequence
  FUZ__Homo_sapiens__NP_001165408
augggcgaggagggcaccggcggcaccgugcaccugcugugccuggccgccagcagcggcgugccccuguucugcagaagcagcagaggcggcgcccccgccagacagcagcugcccuucagcgugaucggcagccugaacggcgugcacauguucggccagaaccuggaggugcagcugagcagcgccagaaccgagaacaccaccguggugcugcuggugggccuggaggagcugaccaacaucagaaacguggagagacugaagaaggaccugagagccagcuacugccugaucgacagcuuccugggcgacagcgagcugaucggcgaccugacccagugcguggacugcgugaucccccccgagggcagccugcugcaggaggcccugagcggcuucgccgaggccgccggcaccaccuucgugagccugguggugagcggcagagugguggccgccaccgagggcugguggagacugggcacccccgaggccgugcugcugcccuggcuggugggcagccugcccccccagaccgccagagacuaccccguguaccugccccacggcagccccaccgugccccacagacugcugacccugacccugcugcccagccuggagcugugccugcugugcggccccagccccccccugagccagcuguacccccagcugcuggagagaugguggcagccccugcuggacccccugagagccugccugccccugggccccagagcccugcccagcggcuucccccugcacaccgacauccugggccugcugcugcugcaccuggagcugaagagaugccuguucaccguggagccccugggcgacaaggagcccagccccgagcagagaagaagacugcugagaaacuucuacacccuggugaccagcacccacuucccccccgagcccggcccccccgagaagaccgaggacgagguguaccaggcccagcugcccagagccugcuaccuggugcugggcaccgaggagcccggcaccggcgugagacugguggcccugcagcugggccugagaagacugcugcugcugcugagcccccagagccccacccacggccugagaagccuggccacccacacccugcacgcccugaccccccugcuguaa

SEQ ID NO: 17296 - RNA, 633 nt, Artificial Sequence
  FXN__Homo_sapiens__NP_000135
auguggacccugggcagaagagccguggccggccugcuggccagccccagccccgcccaggcccagacccugaccagagugcccagacccgccgagcuggccccccugugcggcagaagaggccugagaaccgacaucgacgccaccugcacccccagaagagccagcagcaaccagagaggccugaaccagaucuggaacgugaagaagcagagcguguaccugaugaaccugagaaagagcggcacccugggccaccccggcagccuggacgagaccaccuacgagagacuggccgaggagacccuggacagccuggccgaguucuucgaggaccuggccgacaagcccuacaccuucgaggacuacgacgugagcuucggcagcggcgugcugaccgugaagcugggcggcgaccugggcaccuacgugaucaacaagcagacccccaacaagcagaucuggcugagcagccccagcagcggccccaagagauacgacuggaccggcaagaacuggguguacagccacgacggcgugagccugcacgagcugcuggccgccgagcugaccaaggcccugaagaccaagcuggaccugagcagccuggccuacagcggcaaggacgccuaa

SEQ ID NO: 17297 - RNA, 1620 nt, Artificial Sequence
  FXR1__Homo_sapiens__NP_001013456
auggccgagcugaccguggaggugagaggcagcaacggcgccuucuacaagggcuucaucaaggacgugcacgaggacagccugaccgugguguucgagaacaacuggcagcccgagagacaggugcccuucaacgaggugagacugccccccccccccgacaucaagaaggagaucagcgagggcgacgagguggagguguacagcagagccaacgaccaggagcccugcggcugguggcuggccaaggugagaaugaugaagggcgaguucuacgugaucgaguacgccgccugcgacgccaccuacaacgagaucgugaccuucgagagacugagacccgugaaccagaacaagaccgugaagaagaacaccuucuucaagugcaccguggacgugcccgaggaccugagagaggccugcgccaacgagaacgcccacaaggacuucaagaaggccgugggcgccugcagaaucuucuaccaccccgagaccacccagcugaugauccugagcgccagcgaggccaccgugaagagagugaacauccugagcgacaugcaccugagaagcaucagaaccaagcugaugcugaugagcagaaacgaggaggccaccaagcaccuggagugcaccaagcagcuggccgccgccuuccacgaggaguucguggugagagaggaccugaugggccuggccaucggcacccacggcagcaacauccagcaggccagaaaggugcccggcgugaccgccaucgagcuggacgaggacaccggcaccuucagaaucuacggcgagagcgccgacgccgugaagaaggccagaggcuuccuggaguucguggaggacuucauccaggugcccagaaaccuggugggcaaggugaucggcaagaacggcaaggugauccaggagaucguggacaagagcggcguggugagagugagaaucgagggcgacaacgagaacaagcugcccagagaggacggcauggugcccuucguguucgugggcaccaaggagagcaucggcaacgugcaggugcugcuggaguaccacaucgccuaccugaaggagguggagcagcugagaauggagagacugcagaucgacgagcagcugagacagaucggcagcagaagcuacagcggcagaggcagaggcagaagaggccccaacuacaccagcggcuacggcaccaacagcgagcugagcaaccccagcgagaccgagagcgagagaaaggacgagcugagcgacuggagccuggccggcgaggacgacagagacagcagacaccagagagacagcagaagaagacccggcggcagaggcagaagcgugagcggcggcagaggcagaggcggccccagaggcggcaagagcagcaucagcagcgugcugaaggaccccgacagcaaccccuacagccugcuggacaacaccgagagcgaccagaccgccgacaccgacgccagcgagagccaccacagcaccaacagaagaagaagaagcagaagaagaagaaccgacgaggacgccgugcugauggacggcaugaccgagagcgacaccgccagcgugaacgagaacggccugggcaagagaugcgacuaa

SEQ ID NO: 17298 - RNA, 2022 nt, Artificial Sequence
  FXR2__Homo_sapiens__NP_004851
augggcggccuggccagcggcggcgacguggagcccggccugcccguggaggugagaggcagcaacggcgccuucuacaagggcuucgugaaggacgugcacgaggacagcgugaccaucuucuucgagaacaacuggcagagcgagagacagauccccuucggcgacgugagacugcccccccccgccgacuacaacaaggagaucaccgagggcgacgagguggagguguacagcagagccaacgagcaggagcccugcggcugguggcuggccagagugagaaugaugaagggcgacuucuacgugaucgaguacgccgccugcgacgccaccuacaacgagaucgugacccuggagagacugagacccgugaaccccaacccccuggccaccaagggcagcuucuucaaggugaccauggccgugcccgaggaccugagagaggccugcagcaacgagaacgugcacaaggaguucaagaaggcccugggcgccaacugcaucuuccugaacaucaccaacagcgagcuguucauccugagcaccaccgaggcccccgugaagagagccagccugcugggcgacaugcacuucagaagccugagaaccaagcugcugcugaugagcagaaacgaggaggccaccaagcaccuggagaccagcaagcagcuggccgccgccuuccaggaggaguucaccgugagagaggaccugaugggccuggccaucggcacccacggcgccaacauccagcaggccagaaaggugcccggcgugaccgccaucgagcugggcgaggagaccugcaccuucagaaucuacggcgagacccccgaggccugcagacaggccagaagcuaccuggaguucagcgaggacagcgugcaggugcccagaaaccuggugggcaaggugaucggcaagaacggcaaggugauccaggagaucguggacaagagcggcguggugagagugagaguggagggcgacaacgacaagaagaaccccagagaggagggcauggugcccuucaucuucgugggcaccagagagaacaucagcaacgcccaggcccugcuggaguaccaccugagcuaccugcaggagguggagcagcugagacuggagagacugcagaucgacgagcagcugagacagaucggccugggcuucagaccccccggcagcggcagaggcagcggcggcagcgacaaggccggcuacagcaccgacgagagcagcagcagcagccugcacgccaccagaaccuacggcggcagcuacggcggcagaggcagaggcagaagaaccggcggccccgccuacggccccagcagcgacgugagcaccgccagcgagaccgagagcgagaagagagaggagcccaacagagccggccccggcgacagagacccccccaccagaggcgaggagagcagaagaagacccaccggcggcagaggcagaggccccccccccgcccccagacccaccagcagauacaacagcagcagcaucagcagcgugcugaaggaccccgacagcaaccccuacagccugcuggacaccagcgagcccgagccccccguggacagcgagcccggcgagcccccccccgccagcgccagaagaagaagaagcagaagaagaagaaccgacgaggacagaaccgugauggacggcggccuggagagcgacggccccaacaugaccgagaacggccuggaggacgagagcagaccccagagaagaaacagaagcagaagaagaagaaacagaggcaacagaaccgacggcagcaucagcggcgacagacagcccgugaccguggccgacuacaucagcagagccgagagccagagcagacagagacccccccuggagagaaccaagcccagcgaggacagccugagcggccagaagggcgacagcgugagcaagcugcccaagggccccagcgagaacggcgagcugagcgccccccuggagcugggcagcauggugaacggcgugagcuaa

SEQ ID NO: 17299 - RNA, 279 nt, Artificial Sequence
  FXYD1__Homo_sapiens__NP_001265647
auggccagccugggccacauccugguguucugcgugggccugcugaccauggccaaggccgagagccccaaggagcacgaccccuucaccuacgacuaccagagccugcagaucggcggccuggugaucgccggcauccuguucauccugggcauccugaucgugcugagcagaagaugcagaugcaaguucaaccagcagcagagaaccggcgagcccgacgaggaggagggcaccuucagaagcagcaucagaagacugagcaccagaagaagauaa

SEQ ID NO: 17300 - RNA, 201 nt, Artificial Sequence
  FXYD2__Homo_sapiens__NP_001671
augaccggccugagcauggacggcggcggcagccccaagggcgacguggaccccuucuacuacgacuacgagaccgugagaaacggcggccugaucuucgccggccuggccuucaucgugggccugcugauccugcugagcagaagauucagaugcggcggcaacaagaagagaagacagaucaacgaggacgagcccuaa

SEQ ID NO: 17301 - RNA, 435 nt, Artificial Sequence
  FXYD3__Homo_sapiens__NP_001129479
augggcagaggcuacagcggcgcccugcaggccagaggcggccuggaggagccccuggagagaggccugagaggccccagcuucacccagagcccccugcacggcgccgccgccgccuaccugagcgcccagagagacgccagccugcccgugcccggccagagaagcgacaugcagaaggugacccugggccugcugguguuccuggccggcuuccccgugcuggacgccaacgaccuggaggacaagaacagccccuucuacuacgacuggcacagccugcaggugggcggccugaucugcgccggcgugcugugcgccaugggcaucaucaucgugaugagcgccaagugcaagugcaaguucggccagaagagcggccaccaccccggcgagacccccccccugaucacccccggcagcgcccagagcuaa

SEQ ID NO: 17302 - RNA, 537 nt, Artificial Sequence
  FXYD5__Homo_sapiens__NP_659003
augagccccagcggcagacugugccugcugaccaucgugggccugauccugcccaccagaggccagacccugaaggacaccaccagcagcagcagcgccgacagcaccaucauggacauccaggugcccaccagagcccccgacgccguguacaccgagcugcagcccaccagccccacccccaccuggcccgccgacgagaccccccagccccagacccagacccagcagcuggagggcaccgacggcccccuggugaccgaccccgagacccacaagagcaccaaggccgcccaccccaccgacgacaccaccacccugagcgagagacccagccccagcaccgacgugcagaccgacccccagacccugaagcccagcggcuuccacgaggacgaccccuucuucuacgacgagcacacccugagaaagagaggccugcugguggccgccgugcuguucaucaccggcaucaucauccugaccagcggcaagugcagacagcugagcagacugugcagaaacagaugcagauaa

SEQ ID NO: 17303 - RNA, 288 nt, Artificial Sequence
  FXYD6__Homo_sapiens__NP_001158303
auggagcuggugcugguguuccugugcagccugcuggcccccauggugcuggccagcgccgccgagaaggagaaggagauggaccccuuccacuacgacuaccagacccugagaaucggcggccugguguucgccguggugcuguucagcgugggcauccugcugauccugagcagaagaugcaagugcagcuucaaccagaagcccagagcccccggcgacgaggaggcccagguggagaaccugaucaccgccaacgccaccgagccccagaaggccgagaacuaa

SEQ ID NO: 17304 - RNA, 2520 nt, Artificial Sequence
  FYB__Homo_sapiens__NP_001230022
auggacggcaaggccgacgugaagagccugauggccaaguacaacaccggcggcaaccccaccgaggacgugagcgugaacagcagacccuucagagugaccggccccaacagcagcagcggcauccaggccagaaagaaccuguucaacaaccagggcaacgccagcccccccgccggccccagcaacgugcccaaguucggcagccccaagccccccguggccgugaagcccagcagcgaggagaagcccgacaaggagcccaagccccccuuccugaagcccaccggcgccggccagagauucggcacccccgccagccugaccaccagagaccccgaggccaaggugggcuuccugaagcccgugggccccaagcccaucaaccugcccaaggaggacagcaagcccaccuuccccuggccccccggcaacaagcccagccugcacagcgugaaccaggaccacgaccugaagccccugggccccaagagcggccccaccccccccaccagcgagaacgagcagaagcaggccuuccccaagcugaccggcgugaagggcaaguucaugagcgccagccaggaccuggagcccaagccccuguuccccaagcccgccuucggccagaagcccccccugagcaccgagaacagccacgaggacgagagccccaugaagaacgugagcagcagcaagggcagccccgccccccugggcgugagaagcaagagcggcccccugaagcccgccagagaggacagcgagaacaaggaccacgccggcgagaucagcagccugcccuuccccggcguggugcugaagcccgccgccagcagaggcggccccggccugagcaagaacggcgaggagaagaaggaggacagaaagaucgacgccgccaagaacaccuuccagagcaagaucaaccaggaggagcuggccagcggcaccccccccgccagauuccccaaggcccccagcaagcugaccgugggcggccccuggggccagagccaggagaaggagaagggcgacaagaacagcgccacccccaagcagaagccccugcccccccuguucacccugggcccccccccccccaagcccaacagaccccccaacguggaccugaccaaguuccacaagaccagcagcggcaacagcaccagcaagggccagaccagcuacagcaccaccagccugcccccccccccccccagccaccccgccagccagcccccccugcccgccagccaccccagccagccccccgugcccagccugccccccagaaacaucaagccccccuucgaccugaagagccccgugaacgaggacaaccaggacggcgugacccacagcgacggcgccggcaaccuggacgaggagcaggacagcgagggcgagaccuacgaggacaucgaggccagcaaggagagagagaagaagagagagaaggaggagaagaagagacuggagcuggagaagaaggagcagaaggagaaggagaagaaggagcaggagaucaagaagaaguucaagcugaccggccccauccaggugauccaccuggccaaggccugcugcgacgugaagggcggcaagaacgagcugagcuucaagcagggcgagcagaucgagaucaucagaaucaccgacaaccccgagggcaaguggcugggcagaaccgccagaggcagcuacggcuacaucaagaccaccgccguggagaucgacuacgacagccugaagcugaagaaggacagccugggcgcccccagcagacccaucgaggacgaccaggagguguacgacgacguggccgagcaggacgacaucagcagccacagccagagcggcagcggcggcaucuucccccccccccccgacgacgacaucuacgacggcaucgaggaggaggacgccgacgacggcagcacccugcaggugcaggagaagagcaacaccuggagcuggggcauccugaagaugcugaagggcaaggacgacagaaagaagagcaucagagagaagcccaaggugagcgacagcgacaacaacgagggcagcagcuuccccgccccccccaagcagcuggacaugggcgacgagguguacgacgacguggacaccagcgacuuccccgugagcagcgccgagaugagccagggcaccaacgugggcaaggccaagaccgaggagaaggaccugaagaagcugaagaagcaggagaaggaggagaaggacuucagaaagaaguucaaguacgacggcgagaucagagugcuguacagcaccaaggugaccaccagcaucaccagcaagaaguggggcaccagagaccugcaggugaagcccggcgagagccuggaggugauccagaccaccgacgacaccaaggugcugugcagaaacgaggagggcaaguacggcuacgugcugagaagcuaccuggccgacaacgacggcgagaucuacgacgacaucgccgacggcugcaucuacgacaacgacuaa

SEQ ID NO: 17305 - RNA, 4437 nt, Artificial Sequence
  FYCO1__Homo_sapiens__NP_078789
auggccagcaccaacgccgagagccagcugcagagaaucaucagagaccugcaggacgccgugaccgagcugagcaaggaguuccaggaggccggcgagcccaucaccgacgacagcaccagccugcacaaguucagcuacaagcuggaguaccugcugcaguucgaccagaaggagaaggccacccugcugggcaacaagaaggacuacugggacuacuucugcgccugccuggccaaggugaagggcgccaacgacggcaucagauucgugaagagcaucagcgagcugagaaccagccugggcaagggcagagccuucaucagauacagccuggugcaccagagacuggccgacacccugcagcagugcuucaugaacaccaaggugaccagcgacugguacuacgccagaagccccuuccugcagcccaagcugagcagcgacaucgugggccagcuguacgagcugaccgaggugcaguucgaccuggccagcagaggcuucgaccuggacgccgccuggcccaccuucgccagaagaacccugaccaccggcagcagcgccuaccuguggaagccccccagcagaagcagcagcaugagcagccuggugagcagcuaccugcagacccaggagauggugagcaacuucgaccugaacagcccccugaacaacgaggcccuggagggcuucgacgagaugagacuggagcuggaccagcuggaggugagagagaagcagcugagagagagaaugcagcagcuggacagagagaaccaggagcugagagccgccgugagccagcagggcgagcagcugcagaccgagagagagagaggcagaaccgccgccgaggacaacgugagacugaccugccugguggccgagcugcagaagcagugggaggugacccaggccacccagaacaccgugaaggagcugcagaccugccugcagggccuggagcugggcgccgccgagaaggaggaggacuaccacaccgcccugagaagacuggagagcaugcugcagccccuggcccaggagcuggaggccaccagagacagccuggacaagaagaaccagcaccuggccagcuuccccggcuggcuggccauggcccagcagaaggccgacaccgccagcgacaccaagggcagacaggagcccauccccagcgacgccgcccaggagaugcaggagcugggcgagaagcugcaggcccuggagagagagagaaccaagguggaggaggugaacagacagcagagcgcccagcuggagcagcuggugaaggagcugcagcugaaggaggacgccagagccagccuggagagacuggugaaggagauggccccccugcaggaggagcugagcggcaagggccaggaggccgaccagcuguggagaagacugcaggagcugcuggcccacaccagcagcugggaggaggagcuggccgagcugagaagagagaagaagcagcagcaggaggagaaggagcugcuggagcaggaggugagaagccugaccagacagcugcaguuccuggagacccagcuggcccaggugagccagcacgugagcgaccuggaggagcagaagaagcagcugauccaggacaaggaccaccugagccagcaggugggcaugcuggagagacuggccggcccccccggccccgagcugcccguggccggcgagaagaacgaggcccuggugcccgugaacagcagccugcaggaggccuggggcaagcccgaggaggagcagagaggccugcaggaggcccagcuggacgacaccaaggugcaggagggcagccaggaggaggagcugagacaggccaacagagagcuggagaaggagcugcagaacguggugggcagaaaccagcugcuggagggcaagcugcaggcccugcaggccgacuaccaggcccugcagcagagagagagcgccauccagggcagccuggccagccuggaggccgagcaggccagcaucagacaccugggcgaccagauggaggccagccugcuggccgugagaaaggccaaggaggccaugaaggcccagauggccgagaaggaggccauccugcagagcaaggagggcgagugccagcagcugagagaggagguggagcagugccagcagcuggccgaggccagacacagagagcugagagcccuggagagccagugccagcagcagacccagcugaucgaggugcugaccgccgagaagggccagcagggcgugggcccccccaccgacaacgaggccagagagcuggccgcccagcuggcccugagccaggcccagcuggaggugcaccagggcgaggugcagagacugcaggcccaggugguggaccugcaggccaagaugagagccgcccuggacgaccaggacaaggugcagagccagcugagcauggccgaggccgugcugagagagcacaagacccuggugcagcagcugaaggagcagaacgaggcccugaacagagcccacgugcaggagcugcugcagugcagcgagagagagggcgcccugcaggaggagagagccgacgaggcccagcagagagaggaggagcugagagcccugcaggaggagcugagccaggccaagugcagcagcgaggaggcccagcuggagcacgccgagcugcaggagcagcugcacagagccaacaccgacaccgccgagcugggcauccaggugugcgcccugaccguggagaaggagagaguggaggaggcccuggccugcgccgugcaggagcugcaggacgccaaggaggccgccagcagagagagagagggccuggagagacagguggccggccugcagcaggagaaggagagccugcaggagaagcugaaggccgccaaggccgccgccggcagccugcccggccugcaggcccagcuggcccaggccgagcagagagcccagagccugcaggaggccgcccaccaggagcugaacacccugaaguuccagcugagcgccgagaucauggacuaccagagcagacugaagaacgccggcgaggagugcaagagccugagaggccagcuggaggagcagggcagacagcugcaggccgccgaggaggccguggagaagcugaaggccacccaggccgacaugggcgagaagcugagcugcaccagcaaccaccuggccgagugccaggccgccaugcugagaaaggacaaggagggcgccgcccugagagaggaccuggagagaacccagaaggagcuggagaaggccaccaccaagauccaggaguacuacaacaagcugugccaggaggugaccaacagagagagaaacgaccagaagaugcuggccgaccuggacgaccugaacagaaccaagaaguaccuggaggagagacugaucgagcugcugagagacaaggacgcccuguggcagaagagcgacgcccuggaguuccagcagaagcugagcgccgaggagagauggcugggcgacaccgaggccaaccacugccuggacugcaagagagaguucagcuggauggugagaagacaccacugcagaaucugcggcagaaucuucugcuacuacugcugcaacaacuacgugcugagcaagcacggcggcaagaaggagagaugcugcagagccugcuuccagaagcugagcgagggccccggcagccccgacagcagcggcagcggcaccagccagggcgagcccagccccgcccugagccccgccagccccggcccccaggccaccggcggccagggcgccaacaccgacuacagaccccccgacgacgccguguucgacaucaucaccgacgaggagcugugccagauccaggagagcggcagcagccugcccgagacccccaccgagaccgacagccuggaccccaacgccgccgagcaggacaccaccagcaccagccugacccccgaggacaccgaggacaugcccgugggccaggacagcgagaucugccugcugaagagcggcgagcugaugaucaaggugccccugaccguggacgagaucgccagcuucggcgagggcagcagagagcuguucgugagaagcagcaccuacagccugauccccaucaccguggccgaggccggccugaccaucagcuggguguucagcagcgaccccaagagcaucagcuucagcgugguguuccaggaggccgaggacaccccccuggaccagugcaaggugcugauccccaccaccagaugcaacagccacaaggagaacauccagggccagcugaaggugagaacccccggcaucuacaugcugaucuucgacaacaccuucagcagauucgugagcaagaagguguucuaccaccugaccguggacagacccgugaucuacgacggcagcgacuuccuguaa

SEQ ID NO: 17306 - RNA, 1614 nt, Artificial Sequence
  FYN__Homo_sapiens__NP_002028
augggcugcgugcagugcaaggacaaggaggccaccaagcugaccgaggagagagacggcagccugaaccagagcagcggcuacagauacggcaccgaccccaccccccagcacuaccccagcuucggcgugaccagcauccccaacuacaacaacuuccacgccgccggcggccagggccugaccguguucggcggcgugaacagcagcagccacaccggcacccugagaaccagaggcggcaccggcgugacccuguucguggcccuguacgacuacgaggccagaaccgaggacgaccugagcuuccacaagggcgagaaguuccagauccugaacagcagcgagggcgacuggugggaggccagaagccugaccaccggcgagaccggcuacauccccagcaacuacguggcccccguggacagcauccaggccgaggagugguacuucggcaagcugggcagaaaggacgccgagagacagcugcugagcuucggcaaccccagaggcaccuuccugaucagagagagcgagaccaccaagggcgccuacagccugagcaucagagacugggacgacaugaagggcgaccacgugaagcacuacaagaucagaaagcuggacaacggcggcuacuacaucaccaccagagcccaguucgagacccugcagcagcuggugcagcacuacagcgagagagccgccggccugugcugcagacugguggugcccugccacaagggcaugcccagacugaccgaccugagcgugaagaccaaggacgugugggagauccccagagagagccugcagcugaucaagagacugggcaacggccaguucggcgagguguggaugggcaccuggaacggcaacaccaagguggccaucaagacccugaagcccggcaccaugagccccgagagcuuccuggaggaggcccagaucaugaagaagcugaagcacgacaagcuggugcagcuguacgccguggugagcgaggagcccaucuacaucgugaccgaguacaugaacaagggcagccugcuggacuuccugaaggacggcgagggcagagcccugaagcugcccaaccugguggacauggccgcccagguggccgccggcauggccuacaucgagagaaugaacuacauccacagagaccugagaagcgccaacauccuggugggcaacggccugaucugcaagaucgccgacuucggccuggccagacugaucgaggacaacgaguacaccgccagacagggcgccaaguuccccaucaaguggaccgcccccgaggccgcccuguacggcagauucaccaucaagagcgacguguggagcuucggcauccugcugaccgagcuggugaccaagggcagagugcccuaccccggcaugaacaacagagaggugcuggagcagguggagagaggcuacagaaugcccugcccccaggacugccccaucagccugcacgagcugaugauccacugcuggaagaaggaccccgaggagagacccaccuucgaguaccugcagagcuuccuggaggacuacuucaccgccaccgagccccaguaccagcccggcgagaaccuguaa

SEQ ID NO: 17307 - RNA, 1746 nt, Artificial Sequence
  FZD10__Homo_sapiens__NP_009128
augcagagacccggccccagacuguggcuggugcugcaggugaugggcagcugcgccgccaucagcagcauggacauggagagacccggcgacggcaagugccagcccaucgagauccccaugugcaaggacaucggcuacaacaugaccagaaugcccaaccugaugggccacgagaaccagagagaggccgccauccagcugcacgaguucgccccccugguggaguacggcugccacggccaccugagauucuuccugugcagccuguacgcccccaugugcaccgagcaggugagcacccccauccccgccugcagagugaugugcgagcaggccagacugaagugcagccccaucauggagcaguucaacuucaaguggcccgacagccuggacugcagaaagcugcccaacaagaacgaccccaacuaccugugcauggaggcccccaacaacggcagcgacgagcccaccagaggcagcggccuguuccccccccuguucagaccccagagaccccacagcgcccaggagcacccccugaaggacggcggccccggcagaggcggcugcgacaaccccggcaaguuccaccacguggagaagagcgccagcugcgccccccugugcacccccggcguggacguguacuggagcagagaggacaagagauucgccgugguguggcuggccaucugggccgugcugugcuucuucagcagcgccuucaccgugcugaccuuccugaucgaccccgccagauucagauaccccgagagacccaucaucuuccugagcaugugcuacugcguguacagcgugggcuaccugaucagacuguucgccggcgccgagagcaucgccugcgacagagacagcggccagcuguacgugauccaggagggccuggagagcaccggcugcacccugguguuccuggugcuguacuacuucggcauggccagcagccugugguggguggugcugacccugaccugguuccuggccgccggcaagaaguggggccacgaggccaucgaggccaacagcagcuacuuccaccuggccgccugggccauccccgccgugaagaccauccugauccuggugaugagaagaguggccggcgacgagcugaccggcgugugcuacgugggcagcauggacgugaacgcccugaccggcuucgugcugaucccccuggccugcuaccuggugaucggcaccagcuucauccugagcggcuucguggcccuguuccacaucagaagagugaugaagaccggcggcgagaacaccgacaagcuggagaagcugauggugagaaucggccuguucagcgugcuguacaccgugcccgccaccugcgugaucgccugcuacuucuacgagagacugaacauggacuacuggaagauccuggccgcccagcacaagugcaagaugaacaaccagaccaagacccuggacugccugauggccgccagcauccccgccguggagaucuucauggugaagaucuucaugcugcugguggugggcaucaccagcggcauguggaucuggaccagcaagacccugcagagcuggcagcaggugugcagcagaagacugaagaagaagagcagaagaaagcccgccagcgugaucaccagcggcggcaucuacaagaaggcccagcacccccagaagacccaccacggcaaguacgagauccccgcccagagccccaccugcguguaa

SEQ ID NO: 17308 - RNA, 1944 nt, Artificial Sequence
  FZD1__Homo_sapiens__NP_003496
auggccgaggaggaggcccccaagaagagcagagccgccggcggcggcgccagcugggagcugugcgccggcgcccugagcgccagacuggccgaggagggcagcggcgacgccggcggcagaagaagaccccccguggaccccagaagacuggccagacagcugcugcugcugcuguggcugcuggaggccccccugcugcugggcgugagagcccaggccgccggccagggccccggccagggccccggccccggccagcagccccccccccccccccagcagcagcagagcggccagcaguacaacggcgagagaggcaucagcgugcccgaccacggcuacugccagcccaucagcaucccccugugcaccgacaucgccuacaaccagaccaucaugcccaaccugcugggccacaccaaccaggaggacgccggccuggaggugcaccaguucuacccccuggugaaggugcagugcagcgccgagcugaaguucuuccugugcagcauguacgcccccgugugcaccgugcuggagcaggcccugccccccugcagaagccugugcgagagagccagacagggcugcgaggcccugaugaacaaguucggcuuccaguggcccgacacccugaagugcgagaaguuccccgugcacggcgccggcgagcugugcgugggccagaacaccagcgacaagggcacccccacccccagccugcugcccgaguucuggaccagcaacccccagcacggcggcggcggccacagaggcggcuuccccggcggcgccggcgccagcgagagaggcaaguucagcugccccagagcccugaaggugcccagcuaccugaacuaccacuuccugggcgagaaggacugcggcgcccccugcgagcccaccaagguguacggccugauguacuucggccccgaggagcugagauucagcagaaccuggaucggcaucuggagcgugcugugcugcgccagcacccuguucaccgugcugaccuaccugguggacaugagaagauucagcuaccccgagagacccaucaucuuccugagcggcugcuacaccgccguggccguggccuacaucgccggcuuccugcuggaggacagaguggugugcaacgacaaguucgccgaggacggcgccagaaccguggcccagggcaccaagaaggagggcugcaccauccuguucaugaugcuguacuucuucagcauggccagcagcaucuggugggugauccugagccugaccugguuccuggccgccggcaugaaguggggccacgaggccaucgaggccaacagccaguacuuccaccuggccgccugggccgugcccgccaucaagaccaucaccauccuggcccugggccagguggacggcgacgugcugagcggcgugugcuucgugggccugaacaacguggacgcccugagaggcuucgugcuggccccccuguucguguaccuguucaucggcaccagcuuccugcuggccggcuucgugagccuguucagaaucagaaccaucaugaagcacgacggcaccaagaccgagaagcuggagaagcugauggugagaaucggcguguucagcgugcuguacaccgugcccgccaccaucgugaucgccugcuacuucuacgagcaggccuucagagaccagugggagagaagcuggguggcccagagcugcaagagcuacgccauccccugcccccaccugcaggccggcggcggcgcccccccccacccccccaugagccccgacuucaccguguucaugaucaaguaccugaugacccugaucgugggcaucaccagcggcuucuggaucuggagcggcaagacccugaacagcuggagaaaguucuacaccagacugaccaacagcaagcagggcgagaccaccguguaa

SEQ ID NO: 17309 - RNA, 1698 nt, Artificial Sequence
  FZD2__Homo_sapiens__NP_001457
augagacccagaagcgcccugcccagacugcugcugccccugcugcugcugcccgccgccggccccgcccaguuccacggcgagaagggcaucagcauccccgaccacggcuucugccagcccaucagcaucccccugugcaccgacaucgccuacaaccagaccaucaugcccaaccugcugggccacaccaaccaggaggacgccggccuggaggugcaccaguucuacccccuggugaaggugcagugcagccccgagcugagauucuuccugugcagcauguacgcccccgugugcaccgugcuggagcaggccaucccccccugcagaagcaucugcgagagagccagacagggcugcgaggcccugaugaacaaguucggcuuccaguggcccgagagacugagaugcgagcacuuccccagacacggcgccgagcagaucugcgugggccagaaccacagcgaggacggcgcccccgcccugcugaccaccgcccccccccccggccugcagcccggcgccggcggcacccccggcggccccggcggcggcggcgccccccccagauacgccacccuggagcaccccuuccacugccccagagugcugaaggugcccagcuaccugagcuacaaguuccugggcgagagagacugcgccgcccccugcgagcccgccagacccgacggcagcauguucuucagccaggaggagaccagauucgccagacuguggauccugaccuggagcgugcugugcugcgccagcaccuucuucaccgugaccaccuaccugguggacaugcagagauucagauaccccgagagacccaucaucuuccugagcggcugcuacaccauggugagcguggccuacaucgccggcuucgugcugcaggagagaguggugugcaacgagagauucagcgaggacggcuacagaaccguggugcagggcaccaagaaggagggcugcaccauccuguucaugaugcuguacuucuucagcauggccagcagcaucuggugggugauccugagccugaccugguuccuggccgccggcaugaaguggggccacgaggccaucgaggccaacagccaguacuuccaccuggccgccugggccgugcccgccgugaagaccaucaccauccuggccaugggccagaucgacggcgaccugcugagcggcgugugcuucgugggccugaacagccuggacccccugagaggcuucgugcuggccccccuguucguguaccuguucaucggcaccagcuuccugcuggccggcuucgugagccuguucagaaucagaaccaucaugaagcacgacggcaccaagaccgagaagcuggagagacugauggugagaaucggcguguucagcgugcuguacaccgugcccgccaccaucgugaucgccugcuacuucuacgagcaggccuucagagagcacugggagagaagcugggugagccagcacugcaagagccuggccauccccugccccgcccacuacacccccagaaugagccccgacuucaccguguacaugaucaaguaccugaugacccugaucgugggcaucaccagcggcuucuggaucuggagcggcaagacccugcacagcuggagaaaguucuacaccagacugaccaacagcagacacggcgagaccaccguguaa

SEQ ID NO: 17310 - RNA, 2001 nt, Artificial Sequence
  FZD3__Homo_sapiens__NP_665873
auggccaugaccuggaucguguucagccuguggccccugaccguguucaugggccacaucggcggccacagccuguucagcugcgagcccaucacccugagaaugugccaggaccugcccuacaacaccaccuucaugcccaaccugcugaaccacuacgaccagcagaccgccgcccuggccauggagcccuuccaccccauggugaaccuggacugcagcagagacuucagacccuuccugugcgcccuguacgcccccaucugcauggaguacggcagagugacccugcccugcagaagacugugccagagagccuacagcgagugcagcaagcugauggagauguucggcgugcccuggcccgaggacauggagugcagcagauuccccgacugcgacgagcccuaccccagacugguggaccugaaccuggccggcgagcccaccgagggcgcccccguggccgugcagagagacuacggcuucuggugccccagagagcugaagaucgaccccgaccugggcuacagcuuccugcacgugagagacugcagcccccccugccccaacauguacuucagaagagaggagcugagcuucgccagauacuucaucggccugaucagcaucaucugccugagcgccacccuguucaccuuccugaccuuccugaucgacgugaccagauucagauaccccgagagacccaucaucuucuacgccgugugcuacaugauggugagccugaucuucuucaucggcuuccugcuggaggacagaguggccugcaacgccagcauccccgcccaguacaaggccagcaccgugacccagggcagccacaacaaggccugcaccaugcuguucaugauccuguacuucuucaccauggccggcagcguguggugggugauccugaccaucaccugguuccuggccgccgugcccaaguggggcagcgaggccaucgagaagaaggcccugcuguuccacgccagcgccuggggcauccccggcacccugaccaucauccugcuggccaugaacaagaucgagggcgacaacaucagcggcgugugcuucgugggccuguacgacguggacgcccugagauacuucgugcuggccccccugugccuguacgugguggugggcgugagccugcugcuggccggcaucaucagccugaacagagugagaaucgagaucccccuggagaaggagaaccaggacaagcuggugaaguucaugaucagaaucggcguguucagcauccuguaccuggugccccugcugguggugaucggcugcuacuucuacgagcaggccuacagaggcaucugggagaccaccuggauccaggagagaugcagagaguaccacauccccugccccuaccaggugacccagaugagcagacccgaccugauccuguuccugaugaaguaccugauggcccugaucgugggcauccccagcguguucugggugggcagcaagaagaccugcuucgagugggccagcuucuuccacggcagaagaaagaaggagaucgugaacgagagcagacaggugcugcaggagcccgacuucgcccagagccugcugagagaccccaacacccccaucaucagaaagagcagaggcaccagcacccagggcaccagcacccacgccagcagcacccagcuggccaugguggacgaccagagaagcaaggccggcagcauccacagcaaggugagcagcuaccacggcagccugcacagaagcagagacggcagauacacccccugcagcuacagaggcauggaggagagacugccccacggcagcaugagcagacugaccgaccacagcagacacagcagcagccacagacugaacgagcagagcagacacagcagcaucagagaccugagcaacaaccccaugacccacaucacccacggcaccagcaugaacagagugaucgaggaggacggcaccagcgccuaa

SEQ ID NO: 17311 - RNA, 1614 nt, Artificial Sequence
  FZD4__Homo_sapiens__NP_036325
auggccuggagaggcgccggccccagcgugcccggcgcccccggcggcgugggccugagccugggccugcugcugcagcugcugcugcugcugggccccgccagaggcuucggcgacgaggaggagagaagaugcgaccccaucagaaucagcaugugccagaaccugggcuacaacgugaccaagaugcccaaccuggugggccacgagcugcagaccgacgccgagcugcagcugaccaccuucaccccccugauccaguacggcugcagcagccagcugcaguucuuccugugcagcguguacgugcccaugugcaccgagaagaucaacauccccaucggccccugcggcggcaugugccugagcgugaagagaagaugcgagcccgugcugaaggaguucggcuucgccuggcccgagagccugaacugcagcaaguuccccccccagaacgaccacaaccacaugugcauggagggccccggcgacgaggaggugccccugccccacaagacccccauccagcccggcgaggagugccacagcgugggcaccaacagcgaccaguacaucugggugaagagaagccugaacugcgugcugaagugcggcuacgacgccggccuguacagcagaagcgccaaggaguucaccgacaucuggauggccgugugggccagccugugcuucaucagcaccgccuucaccgugcugaccuuccugaucgacagcagcagauucagcuaccccgagagacccaucaucuuccugagcaugugcuacaacaucuacagcaucgccuacaucgugagacugaccgugggcagagagagaaucagcugcgacuucgaggaggccgccgagcccgugcugauccaggagggccugaagaacaccggcugcgccaucaucuuccugcugauguacuucuucggcauggccagcagcaucuggugggugauccugacccugaccugguuccuggccgccggccugaaguggggccacgaggccaucgagaugcacagcagcuacuuccacaucgccgccugggccauccccgccgugaagaccaucgugauccugaucaugagacugguggacgccgacgagcugaccggccugugcuacgugggcaaccagaaccuggacgcccugaccggcuucgugguggccccccuguucaccuaccuggugaucggcacccuguucaucgccgccggccugguggcccuguucaagaucagaagcaaccugcagaaggacggcaccaagaccgacaagcuggagagacugauggugaagaucggcguguucagcgugcuguacaccgugcccgccaccugcgugaucgccugcuacuucuacgagaucagcaacugggcccuguucagauacagcgccgacgacagcaacauggccguggagaugcugaagaucuucaugagccugcuggugggcaucaccagcggcauguggaucuggagcgccaagacccugcacaccuggcagaagugcagcaacagacuggugaacagcggcaaggugaagagagagaagagaggcaacggcugggugaagcccggcaagggcagcgagaccgugguguaa

SEQ ID NO: 17312 - RNA, 1758 nt, Artificial Sequence
  FZD5__Homo_sapiens__NP_003459
auggccagacccgaccccagcgccccccccagccugcugcugcugcugcuggcccagcuggugggcagagccgccgccgccagcaaggcccccgugugccaggagaucaccgugcccaugugcagaggcaucggcuacaaccugacccacaugcccaaccaguucaaccacgacacccaggacgaggccggccuggaggugcaccaguucuggccccugguggagauccagugcagccccgaccugagauucuuccugugcagcauguacacccccaucugccugcccgacuaccacaagccccugccccccugcagaagcgugugcgagagagccaaggccggcugcagcccccugaugagacaguacggcuucgccuggcccgagagaaugagcugcgacagacugcccgugcugggcagagacgccgaggugcugugcauggacuacaacagaagcgaggccaccaccgccccccccagacccuuccccgccaagcccacccugcccggcccccccggcgcccccgccagcggcggcgagugccccgccggcggccccuucgugugcaagugcagagagcccuucgugcccauccugaaggagagccacccccuguacaacaaggugagaaccggccaggugcccaacugcgccgugcccugcuaccagcccagcuucagcgccgacgagagaaccuucgccaccuucuggaucggccuguggagcgugcugugcuucaucagcaccagcaccaccguggccaccuuccugaucgacauggagagauucagauaccccgagagacccaucaucuuccugagcgccugcuaccugugcgugagccugggcuuccuggugagacugguggugggccacgccagcguggccugcagcagagagcacaaccacauccacuacgagaccaccggccccgcccugugcaccaucguguuccugcugguguacuucuucggcauggccagcagcaucuggugggugauccugagccugaccugguuccuggccgccggcaugaaguggggcaacgaggccaucgccggcuacgcccaguacuuccaccuggccgccuggcugauccccagcgugaagagcaucaccgcccuggcccugagcagcguggacggcgaccccguggccggcaucugcuacgugggcaaccagaaccugaacagccugagaggcuucgugcugggcccccuggugcuguaccugcuggugggcacccuguuccugcuggccggcuucgugagccuguucagaaucagaagcgugaucaagcagggcggcaccaagaccgacaagcuggagaagcugaugaucagaaucggcaucuucacccugcuguacaccgugcccgccagcaucgugguggccugcuaccuguacgagcagcacuacagagagagcugggaggccgcccugaccugcgccugccccggccacgacaccggccagcccagagccaagcccgaguacugggugcugaugcugaaguacuucaugugccugguggugggcaucaccagcggcguguggaucuggagcggcaagaccguggagagcuggagaagauucaccagcagaugcugcugcagacccagaagaggccacaagagcggcggcgccauggccgccggcgacuaccccgaggccagcgccgcccugaccggcagaaccggcccccccggccccgccgccaccuaccacaagcaggugagccugagccacguguaa

SEQ ID NO: 17313 - RNA, 2025 nt, Artificial Sequence
  FZD6__Homo_sapiens__NP_001158088
augaagauggccuacaacaugaccuucuuccccaaccugaugggccacuacgaccagagcaucgccgccguggagauggagcacuuccugccccuggccaaccuggagugcagccccaacaucgagaccuuccugugcaaggccuucgugcccaccugcaucgagcagauccacguggugccccccugcagaaagcugugcgagaagguguacagcgacugcaagaagcugaucgacaccuucggcaucagauggcccgaggagcuggagugcgacagacugcaguacugcgacgagaccgugcccgugaccuucgacccccacaccgaguuccugggcccccagaagaagaccgagcaggugcagagagacaucggcuucuggugccccagacaccugaagaccagcggcggccagggcuacaaguuccugggcaucgaccagugcgccccccccugccccaacauguacuucaagagcgacgagcuggaguucgccaagagcuucaucggcaccgugagcaucuucugccugugcgccacccuguucaccuuccugaccuuccugaucgacgugagaagauucagauaccccgagagacccaucaucuacuacagcgugugcuacagcaucgugagccugauguacuucaucggcuuccugcugggcgacagcaccgccugcaacaaggccgacgagaagcuggagcugggcgacaccguggugcugggcagccagaacaaggccugcaccgugcuguucaugcugcuguacuucuucaccauggccggcaccguguggugggugauccugaccaucaccugguuccuggccgccggcagaaaguggagcugcgaggccaucgagcagaaggccgugugguuccacgccguggccuggggcacccccggcuuccugaccgugaugcugcuggccaugaacaagguggagggcgacaacaucagcggcgugugcuucgugggccuguacgaccuggacgccagcagauacuucgugcugcugccccugugccugugcguguucgugggccugagccugcugcuggccggcaucaucagccugaaccacgugagacaggugauccagcacgacggcagaaaccaggagaagcugaagaaguucaugaucagaaucggcguguucagcggccuguaccuggugccccuggugacccugcugggcugcuacguguacgagcaggugaacagaaucaccugggagaucaccugggugagcgaccacugcagacaguaccacauccccugccccuaccaggccaaggccaaggccagacccgagcuggcccuguucaugaucaaguaccugaugacccugaucgugggcaucagcgccguguucugggugggcagcaagaagaccugcaccgagugggccggcuucuucaagagaaacagaaagagagaccccaucagcgagagcagaagagugcugcaggagagcugcgaguucuuccugaagcacaacagcaaggugaagcacaagaagaagcacuacaagcccagcagccacaagcugaaggugaucagcaagagcaugggcaccagcaccggcgccaccgccaaccacggcaccagcgccguggccaucaccagccacgacuaccugggccaggagacccugaccgagauccagaccagccccgagaccagcaugagagaggugaaggccgacggcgccagcacccccagacugagagagcaggacugcggcgagcccgccagccccgccgccagcaucagcagacugagcggcgagcagguggacggcaagggccaggccggcagcgugagcgagagcgccagaagcgagggcagaaucagccccaagagcgacaucaccgacaccggccuggcccagagcaacaaccugcaggugcccagcagcagcgagcccagcagccugaagggcagcaccagccugcuggugcaccccgugagcggcgugagaaaggagcagggcggcggcugccacagcgacaccuaa

SEQ ID NO: 17314 - RNA, 1725 nt, Artificial Sequence
  FZD7__Homo_sapiens__NP_003498
augagagaccccggcgccgccgccccccugagcagccugggccugugcgcccuggugcuggcccugcugggcgcccugagcgccggcgccggcgcccagcccuaccacggcgagaagggcaucagcgugcccgaccacggcuucugccagcccaucagcaucccccugugcaccgacaucgccuacaaccagaccauccugcccaaccugcugggccacaccaaccaggaggacgccggccuggaggugcaccaguucuacccccuggugaaggugcagugcagccccgagcugagauucuuccugugcagcauguacgcccccgugugcaccgugcuggaccaggccaucccccccugcagaagccugugcgagagagccagacagggcugcgaggcccugaugaacaaguucggcuuccaguggcccgagagacugagaugcgagaacuuccccgugcacggcgccggcgagaucugcgugggccagaacaccagcgacggcagcggcggccccggcggcggccccaccgccuaccccaccgcccccuaccugcccgaccugcccuucaccgcccugccccccggcgccagcgacggcagaggcagacccgccuuccccuucagcugccccagacagcugaaggugccccccuaccugggcuacagauuccugggcgagagagacugcggcgcccccugcgagcccggcagagccaacggccugauguacuucaaggaggaggagagaagauucgccagacugugggugggcguguggagcgugcugugcugcgccagcacccuguucaccgugcugaccuaccugguggacaugagaagauucagcuaccccgagagacccaucaucuuccugagcggcugcuacuucaugguggccguggcccacguggccggcuuccugcuggaggacagagccgugugcguggagagauucagcgacgacggcuacagaaccguggcccagggcaccaagaaggagggcugcaccauccuguucauggugcuguacuucuucggcauggccagcagcaucuggugggugauccugagccugaccugguuccuggccgccggcaugaaguggggccacgaggccaucgaggccaacagccaguacuuccaccuggccgccugggccgugcccgccgugaagaccaucaccauccuggccaugggccagguggacggcgaccugcugagcggcgugugcuacgugggccugagcagcguggacgcccugagaggcuucgugcuggccccccuguucguguaccuguucaucggcaccagcuuccugcuggccggcuucgugagccuguucagaaucagaaccaucaugaagcacgacggcaccaagaccgagaagcuggagaagcugauggugagaaucggcguguucagcgugcuguacaccgugcccgccaccaucgugcuggccugcuacuucuacgagcaggccuucagagagcacugggagagaaccuggcugcugcagaccugcaagagcuacgccgugcccugcccccccggccacuucccccccaugagccccgacuucaccguguucaugaucaaguaccugaugaccaugaucgugggcaucaccaccggcuucuggaucuggagcggcaagacccugcagagcuggagaagauucuaccacagacugagccacagcagcaagggcgagaccgccguguaa

SEQ ID NO: 17315 - RNA, 2085 nt, Artificial Sequence
  FZD8__Homo_sapiens__NP_114072
auggaguggggcuaccugcuggaggugaccagccugcuggccgcccuggcccugcugcagagaagcagcggcgccgccgccgccagcgccaaggagcuggccugccaggagaucaccgugccccugugcaagggcaucggcuacaacuacaccuacaugcccaaccaguucaaccacgacacccaggacgaggccggccuggaggugcaccaguucuggccccugguggagauccagugcagccccgaccugaaguucuuccugugcagcauguacacccccaucugccuggaggacuacaagaagccccugccccccugcagaagcgugugcgagagagccaaggccggcugcgccccccugaugagacaguacggcuucgccuggcccgacagaaugagaugcgacagacugcccgagcagggcaaccccgacacccugugcauggacuacaacagaaccgaccugaccaccgccgcccccagcccccccagaagacugcccccccccccccccggcgagcagccccccagcggcagcggccacggcagaccccccggcgccagacccccccacagaggcggcggcagaggcggcggcggcggcgacgccgccgccccccccgccagaggcggcggcggcggcggcaaggccagaccccccggcggcggcgccgcccccugcgagcccggcugccagugcagagcccccauggugagcgugagcagcgagagacacccccuguacaacagagugaagaccggccagaucgccaacugcgcccugcccugccacaaccccuucuucagccaggacgagagagccuucaccguguucuggaucggccuguggagcgugcugugcuucgugagcaccuucgccaccgugagcaccuuccugaucgacauggagagauucaaguaccccgagagacccaucaucuuccugagcgccugcuaccuguucgugagcgugggcuaccuggugagacugguggccggccacgagaagguggccugcagcggcggcgcccccggcgccggcggcgccggcggcgccggcggcgccgccgccggcgccggcgccgccggcgccggcgccggcggccccggcggcagaggcgaguacgaggagcugggcgccguggagcagcacgugagauacgagaccaccggccccgcccugugcaccgugguguuccugcugguguacuucuucggcauggccagcagcaucuggugggugauccugagccugaccugguuccuggccgccggcaugaaguggggcaacgaggccaucgccggcuacagccaguacuuccaccuggccgccuggcuggugcccagcgugaagagcaucgccgugcuggcccugagcagcguggacggcgaccccguggccggcaucugcuacgugggcaaccagagccuggacaaccugagaggcuucgugcuggccccccuggugaucuaccuguucaucggcaccauguuccugcuggccggcuucgugagccuguucagaaucagaagcgugaucaagcagcaggacggccccaccaagacccacaagcuggagaagcugaugaucagacugggccuguucaccgugcuguacaccgugcccgccgccguggugguggccugccuguucuacgagcagcacaacagacccagaugggaggccacccacaacugccccugccugagagaccugcagcccgaccaggccagaagacccgacuacgccguguucaugcugaaguacuucaugugccugguggugggcaucaccagcggcguguggguguggagcggcaagacccuggagagcuggagaagccugugcaccagaugcugcugggccagcaagggcgccgccgugggcggcggcgccggcgccaccgccgccggcggcggcggcggccccggcggcggcggcggcggcggccccggcggcggcggcggccccggcggcggcggcggcagccuguacagcgacgugagcaccggccugaccuggagaagcggcaccgccagcagcgugagcuaccccaagcagaugccccugagccagguguaa

SEQ ID NO: 17316 - RNA, 1776 nt, Artificial Sequence
  FZD9__Homo_sapiens__NP_003499
auggccguggccccccugagaggcgcccugcugcuguggcagcugcuggccgccggcggcgccgcccuggagaucggcagauucgaccccgagagaggcagaggcgccgcccccugccaggccguggagauccccaugugcagaggcaucggcuacaaccugaccagaaugcccaaccugcugggccacaccagccagggcgaggccgccgccgagcuggccgaguucgccccccuggugcaguacggcugccacagccaccugagauucuuccugugcagccuguacgcccccaugugcaccgaccaggugagcacccccauccccgccugcagacccaugugcgagcaggccagacugagaugcgcccccaucauggagcaguucaacuucggcuggcccgacagccuggacugcgccagacugcccaccagaaacgacccccacgcccugugcauggaggcccccgagaacgccaccgccggccccgccgagccccacaagggccugggcaugcugcccguggcccccagacccgccagaccccccggcgaccugggccccggcgccggcggcagcggcaccugcgagaaccccgagaaguuccaguacguggagaagagcagaagcugcgcccccagaugcggccccggcguggagguguucuggagcagaagagacaaggacuucgcccugguguggauggccguguggagcgcccugugcuucuucagcaccgccuucaccgugcugaccuuccugcuggagccccacagauuccaguaccccgagagacccaucaucuuccugagcaugugcuacaacguguacagccuggccuuccugaucagagccguggccggcgcccagagcguggccugcgaccaggaggccggcgcccuguacgugauccaggagggccuggagaacaccggcugcacccugguguuccugcugcuguacuacuucggcauggccagcagccugugguggguggugcugacccugaccugguuccuggccgccggcaagaaguggggccacgaggccaucgaggcccacggcagcuacuuccacauggccgccuggggccugcccgcccugaagaccaucgugauccugacccugagaaagguggccggcgacgagcugaccggccugugcuacguggccagcaccgacgccgccgcccugaccggcuucgugcuggugccccugagcggcuaccuggugcugggcagcagcuuccugcugaccggcuucguggcccuguuccacaucagaaagaucaugaagaccggcggcaccaacaccgagaagcuggagaagcugauggugaagaucggcguguucagcauccuguacaccgugcccgccaccugcgugaucgugugcuacguguacgagagacugaacauggacuucuggagacugagagccaccgagcagcccugcgccgccgccgccggccccggcggcagaagagacugcagccugcccggcggcagcgugcccaccguggccguguucaugcugaagaucuucaugagccugguggugggcaucaccagcggcguguggguguggagcagcaagaccuuccagaccuggcagagccugugcuacagaaagaucgccgccggcagagccagagccaaggccugcagagcccccggcagcuacggcagaggcacccacugccacuacaaggcccccaccguggugcugcacaugaccaagaccgaccccagccuggagaaccccacccaccuguaa

SEQ ID NO: 17317 - RNA, 1215 nt, Artificial Sequence
  FZR1__Homo_sapiens__NP_001129669
auggaccaggacuacgagagaagacugcugagacagaucgugauccagaacgagaacaccaugcccagagugaccgagaugagaagaacccugacccccgccagcagccccgugagcagccccagcaagcacggcgacagauucauccccagcagagccggcgccaacuggagcgugaacuuccacagaaucaacgagaacgagaagagccccagccagaacagaaaggccaaggacgccaccagcgacaacggcaaggacggccuggccuacagcgcccugcugaagaacgagcugcugggcgccggcaucgagaaggugcaggacccccagaccgaggacagaagacugcagcccagcacccccgagaagaagggccuguucaccgugaccagacugugcgaccugagcguggagggcgacagcgugaccagcgugggcuggagcgagagaggcaaccugguggccgugggcacccacaagggcuucgugcagaucugggacgccgccgccggcaagaagcugagcaugcuggagggccacaccgccagagugggcgcccuggccuggaacgccgagcagcugagcagcggcagcagagacagaaugauccugcagagagacaucagaacccccccccugcagagcgagagaagacugcagggccacagacaggaggugugcggccugaaguggagcaccgaccaccagcugcuggccagcggcggcaacgacaacaagcugcugguguggaaccacagcagccugagccccgugcagcaguacaccgagcaccuggccgccgugaaggccaucgccuggagcccccaccagcacggccugcuggccagcggcggcggcaccgccgacagaugcaucagauucuggaacacccugaccggccagccccugcagugcaucgacaccggcagccaggugugcaaccuggccuggagcaagcacgccaacgagcuggugagcacccacggcuacagccagaaccagauccugguguggaaguaccccagccugacccagguggccaagcugaccggccacagcuacagagugcuguaccuggccaugagccccgacggcgaggccaucgugaccggcgccggcgacgagacccugagauucuggaacguguucagcaagaccagaagcaccaaggagagcgugagcgugcugaaccuguucaccagaaucagauaa

SEQ ID NO: 17318 - RNA, 312 nt, Artificial Sequence
  G0S2__Homo_sapiens__NP_056529
auggagaccgugcaggagcugaucccccuggccaaggagaugauggcccagaagagaaagggcaagauggugaagcuguacgugcugggcagcgugcuggcccuguucggcguggugcugggccugauggagaccgugugcagccccuucaccgccgccagaagacugagagaccaggaggccgccguggccgagcugcaggccgcccuggagagacaggcccugcagaagcaggcccugcaggagaagggcaagcagcaggacaccgugcugggcggcagagcccugagcaacagacagcacgccagcuaa

SEQ ID NO: 17319 - RNA, 2121 nt, Artificial Sequence
  G2E3__Homo_sapiens__NP_060239
augaacgagagcaagcccggcgacagccagaaccuggccugcguguucugcagaaagcacgacgacugccccaacaaguacggcgagaagaagaccaaggagaaguggaaccugaccgugcacuacuacugccugcugaugagcagcggcaucuggcagagaggcaaggaggaggagggcguguacggcuuccugaucgaggacaucagaaaggaggugaacagagccagcaagcugaagugcugcgugugcaagaagaacggcgccagcaucggcugcguggcccccagaugcaagagaagcuaccacuuccccugcggccugcagagagagugcaucuuccaguucaccggcaacuucgccagcuucugcugggaccacagacccgugcagaucaucaccagcaacaacuacagagagagccugcccugcaccaucugccuggaguucaucgagcccauccccagcuacaacauccugagaagccccugcugcaagaacgccugguuccacagagacugccugcaggugcaggccaucaacgccggcguguucuucuucagaugcaccaucugcaacaacagcgacaucuuccagaaggagaugcugagaaugggcauccacauccccgagaaggacgccagcugggagcuggaggagaacgccuaccaggagcugcugcagcacuacgagagaugcgacgugagaagaugcagaugcaaggagggcagagacuacaacgcccccgacagcaagugggagaucaagagaugccagugcugcggcagcagcggcacccaccuggccugcagcagccugagaagcugggagcagaacugggagugccuggagugcagaggcaucaucuacaacagcggcgaguuccagaaggccaagaagcacgugcugcccaacagcaacaacgugggcaucaccgacugccugcuggaggagagcagccccaagcugcccagacagagccccggcagccagagcaaggaccugcugagacagggcagcaaguucagaagaaacgugagcacccugcugaucgagcugggcuuccagaucaagaagaagaccaagagacuguacaucaacaaggccaacaucuggaacagcgcccuggacgccuucagaaacagaaacuucaaccccagcuacgccaucgagguggccuacgugaucgagaacgacaacuucggcagcgagcaccccggcagcaagcaggaguuccugagccugcugaugcagcaccuggagaacagcagccuguucgagggcagccugagcaagaaccugagccugaacagccaggcccugaaggagaaccuguacuacgaggccggcaagaugcuggccaucagccuggugcacggcggccccagccccggcuucuucagcaagacccuguucaacugccugguguacggccccgagaacacccagcccauccuggacgacgugagcgacuucgacguggcccagaucaucaucagaaucaacaccgccaccaccguggccgaccugaagagcaucaucaacgagugcuacaacuaccuggagcugaucggcugccugagacugaucaccacccugagcgacaaguacaugcuggugaaggacauccugggcuaccacgugauccagagagugcacacccccuucgagagcuucaagcagggccugaagacccugggcgugcuggagaagauccaggccuaccccgaggccuucugcagcauccugugccacaagcccgagagccugagcgccaagauccugagcgagcuguucaccgugcacacccugcccgacgugaaggcccugggcuucuggaacagcuaccugcaggccguggaggacggcaagagcaccaccaccauggaggacauccugaucuucgccaccggcugcagcagcaucccccccgccggcuucaagcccacccccagcaucgagugccugcacguggacuuccccgugggcaacaagugcaacaacugccuggccauccccaucaccaacaccuacaaggaguuccaggagaacauggacuucaccaucagaaacacccugagacuggagaaggaggagagcagccacuacaucggccacuaa

SEQ ID NO: 17320 - RNA, 1401 nt, Artificial Sequence
  G3BP1__Homo_sapiens__XP_006714813
auggugauggagaagcccagcccccugcuggugggcagagaguucgugagacaguacuacacccugcugaaccaggcccccgacaugcugcacagauucuacggcaagaacagcagcuacgugcacggcggccuggacagcaacggcaagcccgccgacgccguguacggccagaaggagauccacagaaaggugaugagccagaacuucaccaacugccacaccaagaucagacacguggacgcccacgccacccugaacgacggcgugguggugcaggugaugggccugcugagcaacaacaaccaggcccugagaagauucaugcagaccuucgugcuggcccccgagggcagcguggccaacaaguucuacgugcacaacgacaucuucagauaccaggacgagguguucggcggcuucgugaccgagccccaggaggagagcgaggaggagguggaggagcccgaggagagacagcagacccccgagguggugcccgacgacagcggcaccuucuacgaccaggccguggugagcaacgacauggaggagcaccuggaggagcccguggccgagcccgagcccgaccccgagcccgagcccgagcaggagcccgugagcgagauccaggaggagaagcccgagcccgugcuggaggagaccgcccccgaggacgcccagaagagcagcagccccgcccccgccgacaucgcccagaccgugcaggaggaccugagaaccuucagcugggccagcgugaccagcaagaaccugccccccagcggcgccgugcccgugaccggcauccccccccacguggugaaggugcccgccagccagcccagacccgagagcaagcccgagagccagauccccccccagagaccccagagagaccagagagugagagagcagagaaucaacauccccccccagagaggccccagacccaucagagaggccggcgagcagggcgacaucgagcccagaagaauggugagacaccccgacagccaccagcuguucaucggcaaccugccccacgagguggacaagagcgagcugaaggacuucuuccagagcuacggcaacgugguggagcugagaaucaacagcggcggcaagcugcccaacuucggcuucgugguguucgacgacagcgagcccgugcagaaggugcugagcaacagacccaucauguucagaggcgaggugagacugaacguggaggagaagaagaccagagccgccagagagggcgacagaagagacaacagacugagaggccccggcggccccagaggcggccugggcggcggcaugagaggcccccccagaggcggcauggugcagaagcccggcuucggcgugggcagaggccuggcccccagacaguaa

SEQ ID NO: 17321 - RNA, 465 nt, Artificial Sequence
  G6PC2__Homo_sapiens__NP_001075155
auggacuuccugcacagaaacggcgugcugaucauccagcaccugcagaaggacuacagagccuacuacaccuuccugaacuucaugagcaacgugggcgaccccagaaacaucuucuucaucuacuucccccugugcuuccaguucaaccagaccgugggcaccaagaugaucuggguggccgugaucggcgacuggcugaaccugaucuucaaguggauccuguucggccacagacccuacuggugggugcaggagacccagaucuaccccaaccacagcagccccugccuggagcaguuccccaccaccugcgagaccggccccggcagccccagcggccacgccaugggcgccagcugcgugugguacgugauggugaccgccgcccugagccacaccgugugcggcauggacaaguucagcaucacccugcacagacacgccggcggcagaggccuguaa

SEQ ID NO: 17322 - RNA, 1041 nt, Artificial Sequence
  G6PC3__Homo_sapiens__NP_612396
auggagagcacccugggcgccggcaucgugaucgccgaggcccugcagaaccagcuggccuggcuggagaacguguggcuguggaucaccuuccugggcgaccccaagauccuguuccuguucuacuuccccgccgccuacuacgccagcagaagagugggcaucgccgugcuguggaucagccugaucaccgaguggcugaaccugaucuucaagugguuccuguucggcgacagacccuucuggugggugcacgagagcggcuacuacagccaggcccccgcccaggugcaccaguuccccagcagcugcgagaccggccccggcagccccagcggccacugcaugaucaccggcgccgcccuguggcccaucaugaccgcccugagcagccagguggccaccagagccagaagcagaugggugagagugaugcccagccuggccuacugcaccuuccugcuggccgugggccugagcagaaucuucauccuggcccacuucccccaccaggugcuggccggccugaucaccggcgccgugcugggcuggcugaugacccccagagugcccauggagagagagcugagcuucuacggccugaccgcccuggcccugaugcugggcaccagccugaucuacuggacccuguucacccugggccuggaccugagcuggagcaucagccuggccuucaaguggugcgagagacccgaguggauccacguggacagcagacccuucgccagccugagcagagacagcggcgccgcccugggccugggcaucgcccugcacagccccugcuacgcccaggugagaagagcccagcugggcaacggccagaagaucgccugccuggugcuggccaugggccugcugggcccccuggacuggcugggccaccccccccagaucagccuguucuacaucuucaacuuccugaaguacacccuguggcccugccuggugcuggcccuggugcccugggccgugcacauguucagcgcccaggaggccccccccauccacagcagcuaa

SEQ ID NO: 17323 - RNA, 1074 nt, Artificial Sequence
  G6PC__Homo_sapiens__NP_000142
auggaggagggcaugaacgugcugcacgacuucggcauccagagcacccacuaccugcaggugaacuaccaggacagccaggacugguucauccuggugagcgugaucgccgaccugagaaacgccuucuacgugcuguuccccaucugguuccaccugcaggaggccgugggcaucaagcugcuguggguggccgugaucggcgacuggcugaaccugguguucaaguggauccuguucggccagagacccuacuggugggugcuggacaccgacuacuacagcaacaccagcgugccccugaucaagcaguuccccgugaccugcgagaccggccccggcagccccagcggccacgccaugggcaccgccggcguguacuacgugauggugaccagcacccugagcaucuuccagggcaagaucaagcccaccuacagauucagaugccugaacgugauccuguggcugggcuucugggccgugcagcugaacgugugccugagcagaaucuaccuggccgcccacuucccccaccaggugguggccggcgugcugagcggcaucgccguggccgagaccuucagccacauccacagcaucuacaacgccagccugaagaaguacuuccugaucaccuucuuccuguucagcuucgccaucggcuucuaccugcugcugaagggccugggcguggaccugcuguggacccuggagaaggcccagagauggugcgagcagcccgagugggugcacaucgacaccacccccuucgccagccugcugaagaaccugggcacccuguucggccugggccuggcccugaacagcagcauguacagagagagcugcaagggcaagcugagcaaguggcugcccuucagacugagcagcaucguggccagccuggugcugcugcacguguucgacagccugaagccccccagccagguggagcugguguucuacgugcugagcuucugcaagagcgccguggugccccuggccagcgugagcgugauccccuacugccuggcccaggugcugggccagccccacaagaagagccuguaa

SEQ ID NO: 17324 - RNA, 1638 nt, Artificial Sequence
  G6PD__Homo_sapiens__NP_000393
augggcagaagaggcagcgcccccggcaacggcagaacccugagaggcugcgagagaggcggcagaagaagaagaagcgccgacagcgugauggccgagcagguggcccugagcagaacccaggugugcggcauccugagagaggagcuguuccagggcgacgccuuccaccagagcgacacccacaucuucaucaucaugggcgccagcggcgaccuggccaagaagaagaucuaccccaccaucugguggcuguucagagacggccugcugcccgagaacaccuucaucgugggcuacgccagaagcagacugaccguggccgacaucagaaagcagagcgagcccuucuucaaggccacccccgaggagaagcugaagcuggaggacuucuucgccagaaacagcuacguggccggccaguacgacgacgccgccagcuaccagagacugaacagccacaugaacgcccugcaccugggcagccaggccaacagacuguucuaccuggcccugccccccaccguguacgaggccgugaccaagaacauccacgagagcugcaugagccagaucggcuggaacagaaucaucguggagaagcccuucggcagagaccugcagagcagcgacagacugagcaaccacaucagcagccuguucagagaggaccagaucuacagaaucgaccacuaccugggcaaggagauggugcagaaccugauggugcugagauucgccaacagaaucuucggccccaucuggaacagagacaacaucgccugcgugauccugaccuucaaggagcccuucggcaccgagggcagaggcggcuacuucgacgaguucggcaucaucagagacgugaugcagaaccaccugcugcagaugcugugccugguggccauggagaagcccgccagcaccaacagcgacgacgugagagacgagaaggugaaggugcugaagugcaucagcgaggugcaggccaacaacguggugcugggccaguacgugggcaaccccgacggcgagggcgaggccaccaagggcuaccuggacgaccccaccgugcccagaggcagcaccaccgccaccuucgccgccguggugcuguacguggagaacgagagaugggacggcgugcccuucauccugagaugcggcaaggcccugaacgagagaaaggccgaggugagacugcaguuccacgacguggccggcgacaucuuccaccagcagugcaagagaaacgagcuggugaucagagugcagcccaacgaggccguguacaccaagaugaugaccaagaagcccggcauguucuucaaccccgaggagagcgagcuggaccugaccuacggcaacagauacaagaacgugaagcugcccgacgccuacgagagacugauccuggacguguucugcggcagccagaugcacuucgugagaagcgacgagcugagagaggccuggagaaucuucaccccccugcugcaccagaucgagcuggagaagcccaagcccauccccuacaucuacggcagcagaggccccaccgaggccgacgagcugaugaagagagugggcuuccaguacgagggcaccuacaagugggugaacccccacaagcuguaa

SEQ ID NO: 17325 - RNA, 2859 nt, Artificial Sequence
  GAA__Homo_sapiens__XP_005257251
augggcgugagacacccccccugcagccacagacugcuggccgugugcgcccuggugagccuggccaccgccgcccugcugggccacauccugcugcacgacuuccugcuggugcccagagagcugagcggcagcagccccgugcuggaggagacccaccccgcccaccagcagggcgccagcagacccggccccagagacgcccaggcccaccccggcagacccagagccgugcccacccagugcgacgugccccccaacagcagauucgacugcgcccccgacaaggccaucacccaggagcagugcgaggccagaggcugcugcuacauccccgccaagcagggccugcagggcgcccagaugggccagcccuggugcuucuucccccccagcuaccccagcuacaagcuggagaaccugagcagcagcgagaugggcuacaccgccacccugaccagaaccacccccaccuucuuccccaaggacauccugacccugagacuggacgugaugauggagaccgagaacagacugcacuucaccaucaaggaccccgccaacagaagauacgaggugccccuggagaccccccacgugcacagcagagcccccagcccccuguacagcguggaguucagcgaggagcccuucggcgugaucgugagaagacagcuggacggcagagugcugcugaacaccaccguggccccccuguucuucgccgaccaguuccugcagcugagcaccagccugcccagccaguacaucaccggccuggccgagcaccugagcccccugaugcugagcaccagcuggaccagaaucacccuguggaacagagaccuggcccccacccccggcgccaaccuguacggcagccaccccuucuaccuggcccuggaggacggcggcagcgcccacggcguguuccugcugaacagcaacgccauggacguggugcugcagcccagccccgcccugagcuggagaagcaccggcggcauccuggacguguacaucuuccugggccccgagcccaagagcguggugcagcaguaccuggacguggugggcuaccccuucaugccccccuacuggggccugggcuuccaccugugcagauggggcuacagcagcaccgccaucaccagacaggugguggagaacaugaccagagcccacuucccccuggacgugcaguggaacgaccuggacuacauggacagcagaagagacuucaccuucaacaaggacggcuucagagacuuccccgccauggugcaggagcugcaccagggcggcagaagauacaugaugaucguggaccccgccaucagcagcagcggccccgccggcagcuacagacccuacgacgagggccugagaagaggcguguucaucaccaacgagaccggccagccccugaucggcaagguguggcccggcagcaccgccuuccccgacuucaccaaccccaccgcccuggccuggugggaggacaugguggccgaguuccacgaccaggugcccuucgacggcauguggaucgacaugaacgagcccagcaacuucaucagaggcagcgaggacggcugccccaacaacgagcuggagaacccccccuacgugcccggcguggugggcggcacccugcaggccgccaccaucugcgccagcagccaccaguuccugagcacccacuacaaccugcacaaccuguacggccugaccgaggccaucgccagccacagagcccuggugaaggccagaggcaccagacccuucgugaucagcagaagcaccuucgccggccacggcagauacgccggccacuggaccggcgacguguggagcagcugggagcagcuggccagcagcgugcccgagauccugcaguucaaccugcugggcgugccccuggugggcgccgacgugugcggcuuccugggcaacaccagcgaggagcugugcgugagauggacccagcugggcgccuucuaccccuucaugagaaaccacaacagccugcugagccugccccaggagcccuacagcuucagcgagcccgcccagcaggccaugagaaaggcccugacccugagauacgcccugcugccccaccuguacacccuguuccaccaggcccacguggccggcgagaccguggccagaccccuguuccuggaguuccccaaggacagcagcaccuggaccguggaccaccagcugcuguggggcgaggcccugcugaucacccccgugcugcaggccggcaaggccgaggugaccggcuacuucccccugggcaccugguacgaccugcagaccgugcccguggaggcccugggcagccugccccccccccccgccgcccccagagagcccgccauccacagcgagggccagugggugacccugcccgccccccuggacaccaucaacgugcaccugagagccggcuacaucaucccccugcagggccccggccugaccaccaccgagagcagacagcagcccauggcccuggccguggcccugaccaagggcggcgaggccagaggcgagcuguucugggacgacggcgagagccuggaggugcuggagagaggcgccuacacccaggugaucuuccuggccagaaacaacaccaucgugaacgagcuggugagagugaccagcgagggcgccggccugcagcugcagaaggugaccgugcugggcguggccaccgccccccagcaggugcugagcaacggcgugcccgugagcaacuucaccuacagccccgacaccaaggugcuggacaucugcgugagccugcugaugggcgagcaguuccuggugagcuggugcuaa

SEQ ID NO: 17326 - RNA, 2085 nt, Artificial Sequence
  GAB1__Homo_sapiens__NP_002030
augagcggcggcgagguggugugcagcggcuggcugagaaagagcccccccgagaagaagcugaagagauacgccuggaagagaagaugguucgugcugagaagcggcagacugaccggcgaccccgacgugcuggaguacuacaagaacgaccacgccaagaagcccaucagaaucaucgaccugaaccugugccagcagguggacgccggccugaccuucaacaagaaggaguucgagaacagcuacaucuucgacaucaacaccaucgacagaaucuucuaccugguggccgacagcgaggaggagaugaacaagugggugagaugcaucugcgacaucugcggcuucaaccccaccgaggaggaccccgugaagccccccggcagcagccugcaggcccccgccgaccugccccuggccaucaacaccgccccccccagcacccaggccgacagcagcagcgccacccugcccccccccuaccagcugaucaacgugcccccccaccuggagacccugggcauccaggaggacccccaggacuaccugcugcugaucaacugccagagcaagaagcccgagcccaccagaacccacgccgacagcgccaagagcaccagcagcgagaccgacugcaacgacaacgugcccagccacaagaaccccgccagcagccagagcaagcacggcaugaacggcuucuuccagcagcagaugaucuacgacagcccccccagcagagcccccagcgccagcguggacagcagccuguacaaccugcccagaagcuacagccacgacgugcugcccaaggugagccccagcagcaccgaggccgacggcgagcuguacguguucaacacccccagcggcaccagcagcguggagacccagaugagacacgugagcaucagcuacgacaucccccccacccccggcaacaccuaccagauccccagaaccuuccccgagggcacccugggccagaccagcaagcuggacaccauccccgacauccccccccccagaccccccaagccccaccccgcccacgacagaagccccguggagaccugcagcauccccagaaccgccagcgacaccgacagcagcuacugcauccccaccgccggcaugagccccagcagaagcaacaccaucagcaccguggaccugaacaagcugagaaaggacgccagcagccaggacugcuacgacauccccagagccuuccccagcgacagaagcagcagccuggagggcuuccacaaccacuucaaggugaagaacgugcugaccgugggcagcgugagcagcgaggagcuggacgagaacuacgugcccaugaaccccaacagcccccccagacagcacagcagcagcuucaccgagcccauccaggaggccaacuacgugcccaugacccccggcaccuucgacuucagcagcuucggcaugcaggugcccccccccgcccacaugggcuucagaagcagccccaagaccccccccagaagacccgugcccguggccgacugcgagcccccccccguggacagaaaccugaagcccgacagaaaggugaagcccgccccccuggagaucaagccccugcccgagugggaggagcugcaggcccccgugagaagccccaucaccagaagcuucgccagagacagcagcagauuccccaugagccccagacccgacagcgugcacagcaccaccagcagcagcgacagccacgacagcgaggagaacuacgugcccaugaaccccaaccugagcagcgaggaccccaaccuguucggcagcaacagccuggacggcggcagcagccccaugaucaagcccaagggcgacaagcagguggaguaccuggaccuggaccuggacagcggcaagagcaccccccccagaaagcagaagagcagcggcagcggcagcagcguggccgacgagagaguggacuacguggugguggaccagcagaagacccuggcccugaagagcaccagagaggccuggaccgacggcagacagagcaccgagagcgagacccccgccaagagcgugaaguaa

SEQ ID NO: 17327 - RNA, 1917 nt, Artificial Sequence
  GAB2__Homo_sapiens__NP_036428
augagcggcgaccccgacgugcuggaguacuacaagaacgaccacagcaagaagccccugagaaucaucaaccugaacuucugcgagcagguggacgccggccugaccuucaacaagaaggagcugcaggacagcuucguguucgacaucaagaccagcgagagaaccuucuaccugguggccgagaccgaggaggacaugaacaagugggugcagagcaucugccagaucugcggcuucaaccaggccgaggagagcaccgacagccugagaaacgugagcagcgccggccacggccccagaagcagccccgccgagcugagcagcagcagccagcaccugcugagagagagaaagagcagcgcccccagccacagcagccagcccacccuguucaccuucgagccccccgugagcaaccacaugcagcccacccugagcaccagcgccccccaggaguaccuguaccugcaccagugcaucagcagaagagccgagaacgccagaagcgccagcuucagccagggcaccagagccagcuuccugaugagaagcgacaccgccgugcagaagcuggcccagggcaacggccacugcgugaacggcaucagcggccaggugcacggcuucuacagccugcccaagcccagcagacacaacaccgaguucagagacagcaccuacgaccugcccagaagccuggccagccacggccacaccaagggcagccugaccggcagcgagaccgacaacgaggacguguacaccuucaagacccccagcaacacccugugcagagaguucggcgaccugcugguggacaacauggacgugcccgccaccccccugagcgccuaccagauccccagaaccuucacccuggacaagaaccacaacgccaugaccguggccacccccggcgacagcgccaucgcccccccccccagaccccccaagcccagccaggccgagacccccagauggggcagcccccagcagagaccccccaucagcgagaacagcagaagcguggccgccaccauccccagaagaaacacccugcccgccauggacaacagcagacugcacagagccagcagcugcgagaccuacgaguacccccagagaggcggcgagagcgccggcagaagcgccgagagcaugagcgacggcgugggcagcuuccugcccggcaagaugaucgugggcagaagcgacagcaccaacagcgaggacaacuacgugcccaugaaccccggcagcagcacccugcuggccauggagagagccggcgacaacagccagagcguguacauccccaugagccccggcgcccaccacuucgacagccugggcuaccccagcaccacccugcccgugcacagaggccccagcagaggcagcgagauccagcccccccccgugaacagaaaccugaagcccgacagaaaggccaagcccaccccccuggaccugagaaacaacaccgugaucgacgagcugcccuucaagagccccaucaccaagagcuggagcagagccaaccacaccuucaacagcagcagcagccaguacugcagacccaucagcacccagagcaucaccagcaccgacagcggcgacagcgaggagaacuacgugcccaugcagaaccccgugagcgccagccccgugcccagcggcaccaacagccccgcccccaagaagagcaccggcagcguggacuaccuggcccuggacuuccagcccagcagccccagcccccacagaaagcccagcaccagcagcgugaccagcgacgagaagguggacuacgugcagguggacaaggagaagacccaggcccugcagaacaccaugcaggaguggaccgacgugagacagagcagcgagcccagcaagggcgccaagcuguaa

SEQ ID NO: 17328 - RNA, 1764 nt, Artificial Sequence
  GAB3__Homo_sapiens__NP_001075042
augagcgccggcgacgccgugugcaccggcuggcuggugaagagcccccccgagagaaagcugcagagauacgccuggagaaagagaugguucgugcugagaagaggcagaaugagcggcaaccccgacgugcuggaguacuacagaaacaagcacagcagcaagcccaucagagugaucgaccugagcgagugcgccguguggaagcacgugggccccagcuucgugagaaaggaguuccagaacaacuucguguucaucgugaagaccaccagcagaaccuucuaccugguggccaagaccgagcaggagaugcaggugugggugcacagcaucagccaggugugcaaccugggccaccuggaggacggcgccgccgacagcauggagagccugagcuacacccccagcagccugcagcccagcagcgccagcagccugcugaccgcccacgccgccagcagcagccugcccagagacgaccccaacaccaacgccguggccaccgaggagaccagaagcgagagcgagcugcuguuccugcccgacuaccuggugcugagcaacugcgagaccggcagacugcaccacaccagccugcccaccagaugcgacagcuggagcaacagcgacagaagccuggagcaggccagcuucgacgacguguucguggacugccugcagccccugcccagcagccaccuggugcaccccagcugccacggcagcggcgcccaggaggugcccagcagcagaccccaggccgcccugaucuggagcagagagaucaacggcccccccagagaccaccugagcagcagcccccugcuggagagcagccugagcagcaccauccagguggacaagaaccagggcagccugcccugcggcgccaaggagcuggacaucaugagcaacacccccccccccagaccccccaagcccagccaccugagcgagagaagacaggaggaguggagcacccacagcggcagcaagaagcccgagugcacccuggugcccagaagaaucagccugagcggccuggacaacaugagaaccuggaaggccgacguggagggccagagccugagacacagagacaagagacugagccugaaccugcccugcagauucagccccauguaccccaccgccagcgccagcaucgaggacagcuacgugcccaugagcccccaggccggcgccagcggccugggcccccacugcagccccgacgacuacauccccaugaacagcggcagcaucagcagcccccugcccgagcugcccgccaaccuggagcccccccccgugaacagagaccugaagccccagagaaagagcagaccccccccccuggaccugagaaaccugagcaucaucagagagcacgccagccugaccagaaccagaaccgugcccugcagcagaaccagcuuccugagccccgagagaaacggcaucaacagcgccagauucuucgccaaccccgugagcagagaggacgaggagagcuacaucgagauggaggagcacagaaccgccagcagccugagcagcggcgcccugaccuggaccaagaaguucagccuggacuaccuggcccuggacuucaacagcgccagccccgcccccaugcagcagaagcugcugcugagcgaggagcagagaguggacuacgugcagguggacgagcagaagacccaggcccugcagagcaccaagcaggaguggaccgacgagagacagagcaagguguaa

SEQ ID NO: 17329 - RNA, 354 nt, Artificial Sequence
  GABARAP__Homo_sapiens__NP_009209
augaaguucguguacaaggaggagcaccccuucgagaagagaagaagcgagggcgagaagaucagaaagaaguaccccgacagagugcccgugaucguggagaaggcccccaaggccagaaucggcgaccuggacaagaagaaguaccuggugcccagcgaccugaccgugggccaguucuacuuccugaucagaaagagaauccaccugagagccgaggacgcccuguucuucuucgugaacaacgugaucccccccaccagcgccaccaugggccagcuguaccaggagcaccacgaggaggacuucuuccuguacaucgccuacagcgacgagagcguguacggccuguaa

SEQ ID NO: 17330 - RNA, 354 nt, Artificial Sequence
  GABARAPL1__Homo_sapiens__NP_113600
augaaguuccaguacaaggaggaccaccccuucgaguacagaaagaaggagggcgagaagaucagaaagaaguaccccgacagagugcccgugaucguggagaaggcccccaaggccagagugcccgaccuggacaagagaaaguaccuggugcccagcgaccugaccgugggccaguucuacuuccugaucagaaagagaauccaccugagacccgaggacgcccuguucuucuucgugaacaacaccaucccccccaccagcgccaccaugggccagcuguacgaggacaaccacgaggaggacuacuuccuguacguggccuacagcgacgagagcguguacggcaaguaa

SEQ ID NO: 17331 - RNA, 354 nt, Artificial Sequence
  GABARAPL2__Homo_sapiens__NP_009216
augaaguggauguucaaggaggaccacagccuggagcacagaugcguggagagcgccaagaucagagccaaguaccccgacagagugcccgugaucguggagaaggugagcggcagccagaucguggacaucgacaagagaaaguaccuggugcccagcgacaucaccguggcccaguucauguggaucaucagaaagagaauccagcugcccagcgagaaggccaucuuccuguucguggacaagaccgugccccagagcagccugaccaugggccagcuguacgagaaggagaaggacgaggacggcuuccuguacguggccuacagcggcgagaacaccuucggcuucuaa

SEQ ID NO: 17332 - RNA, 2886 nt, Artificial Sequence
  GABBR1__Homo_sapiens__NP_001461
augcugcugcugcugcugcuggccccccuguuccugagaccccccggcgccggcggcgcccagacccccaacgccaccagcgagggcugccagaucauccacccccccugggagggcggcaucagauacagaggccugaccagagaccaggugaaggccaucaacuuccugcccguggacuacgagaucgaguacgugugcagaggcgagagagagguggugggccccaaggugagaaagugccuggccaacggcagcuggaccgacauggacacccccagcagaugcgugagaaucugcagcaagagcuaccugacccuggagaacggcaagguguuccugaccggcggcgaccugcccgcccuggacggcgccagaguggacuucagaugcgaccccgacuuccaccuggugggcagcagcagaagcaucugcagccagggccaguggagcacccccaagccccacugccaggugaacagaaccccccacagcgagagaagagccguguacaucggcgcccuguuccccaugagcggcggcuggcccggcggccaggccugccagcccgccguggagauggcccuggaggacgugaacagcagaagagacauccugcccgacuacgagcugaagcugauccaccacgacagcaagugcgaccccggccaggccaccaaguaccuguacgagcugcuguacaacgaccccaucaagaucauccugaugcccggcugcagcagcgugagcacccugguggccgaggccgccagaauguggaaccugaucgugcugagcuacggcagcagcagccccgcccugagcaacagacagagauuccccaccuucuucagaacccaccccagcgccacccugcacaaccccaccagagugaagcuguucgagaaguggggcuggaagaagaucgccaccauccagcagaccaccgagguguucaccagcacccuggacgaccuggaggagagagugaaggaggccggcaucgagaucaccuucagacagagcuucuucagcgaccccgccgugcccgugaagaaccugaagagacaggacgccagaaucaucgugggccuguucuacgagaccgaggccagaaagguguucugcgagguguacaaggagagacuguucggcaagaaguacgugugguuccugaucggcugguacgccgacaacugguucaagaucuacgaccccagcaucaacugcaccguggacgagaugaccgaggccguggagggccacaucaccaccgagaucgugaugcugaaccccgccaacaccagaagcaucagcaacaugaccagccaggaguucguggagaagcugaccaagagacugaagagacaccccgaggagaccggcggcuuccaggaggccccccuggccuacgacgccaucugggcccuggcccuggcccugaacaagaccagcggcggcggcggcagaagcggcgugagacuggaggacuucaacuacaacaaccagaccaucaccgaccagaucuacagagccaugaacagcagcagcuucgagggcgugagcggccacgugguguucgacgccagcggcagcagaauggccuggacccugaucgagcagcugcagggcggcagcuacaagaagaucggcuacuacgacagcaccaaggacgaccugagcuggagcaagaccgacaaguggaucggcggcagcccccccgccgaccagacccuggugaucaagaccuucagauuccugagccagaagcuguucaucagcgugagcgugcugagcagccugggcaucgugcuggccguggugugccugagcuucaacaucuacaacagccacgugagauacauccagaacagccagcccaaccugaacaaccugaccgccgugggcugcagccuggcccuggccgccguguucccccugggccuggacggcuaccacaucggcagaaaccaguuccccuucgugugccaggccagacuguggcugcugggccugggcuucagccugggcuacggcagcauguucaccaagaucuggugggugcacaccguguucaccaagaaggaggagaagaaggaguggagaaagacccuggagcccuggaagcuguacgccaccgugggccugcuggugggcauggacgugcugacccuggccaucuggcagaucguggacccccugcacagaaccaucgagaccuucgccaaggaggagcccaaggaggacaucgacgugagcauccugccccagcuggagcacugcagcagcagaaagaugaacaccuggcugggcaucuucuacggcuacaagggccugcugcugcugcugggcaucuuccuggccuacgagaccaagagcgugagcaccgagaagaucaacgaccacagagccgugggcauggccaucuacaacguggccgugcugugccugaucaccgcccccgugaccaugauccugagcagccagcaggacgccgccuucgccuucgccagccuggccaucguguucagcagcuacaucacccugguggugcuguucgugcccaagaugagaagacugaucaccagaggcgaguggcagagcgaggcccaggacaccaugaagaccggcagcagcaccaacaacaacgaggaggagaagagcagacugcuggagaaggagaacagagagcuggagaagaucaucgccgagaaggaggagagagugagcgagcugagacaccagcugcagagcagacagcagcugagaagcagaagacacccccccaccccccccgagcccagcggcggccugcccagaggcccccccgagccccccgacagacugagcugcgacggcagcagagugcaccugcuguacaaguaa

SEQ ID NO: 17333 - RNA, 2826 nt, Artificial Sequence
  GABBR2__Homo_sapiens__NP_005449
auggccagccccagaagcagcggccagcccggccccccccccccccccccccccccccccgccagacugcugcugcugcugcugcugccccugcugcugccccuggcccccggcgccuggggcugggccagaggcgcccccagacccccccccagcagccccccccugagcaucaugggccugaugccccugaccaaggagguggccaagggcagcaucggcagaggcgugcugcccgccguggagcuggccaucgagcagaucagaaacgagagccugcugagacccuacuuccuggaccugagacuguacgacaccgagugcgacaacgccaagggccugaaggccuucuacgacgccaucaaguacggccccaaccaccugaugguguucggcggcgugugccccagcgugaccagcaucaucgccgagagccugcagggcuggaaccuggugcagcugagcuucgccgccaccacccccgugcuggccgacaagaagaaguaccccuacuucuucagaaccgugcccagcgacaacgccgugaaccccgccauccugaagcugcugaagcacuaccaguggaagagagugggcacccugacccaggacgugcagagauucagcgaggugagaaacgaccugaccggcgugcuguacggcgaggacaucgagaucagcgacaccgagagcuucagcaacgaccccugcaccagcgugaagaagcugaagggcaacgacgugagaaucauccugggccaguucgaccagaacauggccgccaagguguucugcugcgccuacgaggagaacauguacggcagcaaguaccaguggaucauccccggcugguacgagcccagcuggugggagcaggugcacaccgaggccaacagcagcagaugccugagaaagaaccugcuggccgccauggagggcuacaucggcguggacuucgagccccugagcagcaagcagaucaagaccaucagcggcaagaccccccagcaguacgagagagaguacaacaacaagagaagcggcgugggccccagcaaguuccacggcuacgccuacgacggcaucugggugaucgccaagacccugcagagagccauggagacccugcacgccagcagcagacaccagagaauccaggacuucaacuacaccgaccacacccugggcagaaucauccugaacgccaugaacgagaccaacuucuucggcgugaccggccaggugguguucagaaacggcgagagaaugggcaccaucaaguucacccaguuccaggacagcagagaggugaaggugggcgaguacaacgccguggccgacacccuggagaucaucaacgacaccaucagauuccagggcagcgagccccccaaggacaagaccaucauccuggagcagcugagaaagaucagccugccccuguacagcauccugagcgcccugaccauccugggcaugaucauggccagcgccuuccuguucuucaacaucaagaacagaaaccagaagcugaucaagaugagcagccccuacaugaacaaccugaucauccugggcggcaugcugagcuacgccagcaucuuccuguucggccuggacggcagcuucgugagcgagaagaccuucgagacccugugcaccgugagaaccuggauccugaccgugggcuacaccaccgccuucggcgccauguucgccaagaccuggagagugcacgccaucuucaagaacgugaagaugaagaagaagaucaucaaggaccagaagcugcuggugaucgugggcggcaugcugcugaucgaccugugcauccugaucugcuggcaggccguggacccccugagaagaaccguggagaaguacagcauggagcccgaccccgccggcagagacaucagcaucagaccccugcuggagcacugcgagaacacccacaugaccaucuggcugggcaucguguacgccuacaagggccugcugaugcuguucggcugcuuccuggccugggagaccagaaacgugagcauccccgcccugaacgacagcaaguacaucggcaugagcguguacaacgugggcaucaugugcaucaucggcgccgccgugagcuuccugaccagagaccagcccaacgugcaguucugcaucguggcccuggugaucaucuucugcagcaccaucacccugugccugguguucgugcccaagcugaucacccugagaaccaaccccgacgccgccacccagaacagaagauuccaguucacccagaaccagaagaaggaggacagcaagaccagcaccagcgugaccagcgugaaccaggccagcaccagcagacuggagggccugcagagcgagaaccacagacugagaaugaagaucaccgagcuggacaaggaccuggaggaggugaccaugcagcugcaggacacccccgagaagaccaccuacaucaagcagaaccacuaccaggagcugaacgacauccugaaccugggcaacuucaccgagagcaccgacggcggcaaggccauccugaagaaccaccuggaccagaacccccagcugcaguggaacaccaccgagcccagcagaaccugcaaggaccccaucgaggacaucaacagccccgagcacauccagagaagacugagccugcagcugcccauccugcaccacgccuaccugcccagcaucggcggcguggacgccagcugcgugagccccugcgugagccccaccgccagccccagacacagacacgugccccccagcuucagagugauggugagcggccuguaa

SEQ ID NO: 17334 - RNA, 1365 nt, Artificial Sequence
  GABPA__Homo_sapiens__NP_002031
augaccaagagagaggccgaggagcugaucgagaucgagaucgacggcaccgagaaggccgagugcaccgaggagagcaucguggagcagaccuacgcccccgccgagugcgugagccaggccaucgacaucaacgagcccaucggcaaccugaagaagcugcuggagcccagacugcagugcagccuggacgcccacgagaucugccugcaggacauccagcuggaccccgagagaagccuguucgaccagggcgugaagaccgacggcaccgugcagcugagcgugcaggugaucagcuaccagggcaucgagcccaagcugaacauccuggagaucgugaagcccgccgacaccguggagguggugaucgaccccgacgcccaccacgccgagagcgaggcccaccugguggaggaggcccaggugaucacccuggacggcaccaagcacaucaccaccaucagcgacgagaccagcgagcaggugaccagaugggccgccgcccuggagggcuacagaaaggagcaggagagacugggcauccccuacgaccccauccaguggagcaccgaccaggugcugcacuggguggugugggugaugaaggaguucagcaugaccgacaucgaccugaccacccugaacaucagcggcagagagcugugcagccugaaccaggaggacuucuuccagagagugcccagaggcgagauccuguggagccaccuggagcugcugagaaaguacgugcuggccagccaggagcagcagaugaacgagaucgugaccaucgaccagcccgugcagaucauccccgccagcgugcagagcgccacccccaccaccaucaaggugaucaacagcagcgccaaggccgccaaggugcagagagcccccagaaucagcggcgaggacagaagcagccccggcaacagaaccggcaacaacggccagauccagcuguggcaguuccugcuggagcugcugaccgacaaggacgccagagacugcaucagcugggugggcgacgagggcgaguucaagcugaaccagcccgagcugguggcccagaaguggggccagagaaagaacaagcccaccaugaacuacgagaagcugagcagagcccugagauacuacuacgacggcgacaugaucugcaaggugcagggcaagagauucguguacaaguucgugugcgaccugaagacccugaucggcuacagcgccgccgagcugaacagacuggugaccgagugcgagcagaagaagcuggccaagaugcagcugcacggcaucgcccagcccgugaccgccguggcccuggccaccgccagccugcagaccgagaaggacaacuaa

SEQ ID NO: 17335 - RNA, 1083 nt, Artificial Sequence
  GABPB1__Homo_sapiens__NP_002032
augagccugguggaccugggcaagaagcugcuggaggccgccagagccggccaggacgacgaggugagaauccugauggccaacggcgcccccuucaccaccgacuggcugggcaccagcccccugcaccuggccgcccaguacggccacuacagcaccaccgaggugcugcugagagccggcgugagcagagacgccagaaccaagguggacagaaccccccugcacauggccgccagcgagggccacgccagcaucguggaggugcugcugaagcacggcgccgacgugaacgccaaggacaugcugaagaugaccgcccugcacugggccaccgagcacaaccaccaggaggugguggagcugcugaucaaguacggcgccgacgugcacacccagagcaaguucugcaagaccgccuucgacaucagcaucgacaacggcaacgaggaccuggccgagauccugcagaucgccaugcagaaccagaucaacaccaaccccgagagccccgacaccgugaccauccacgccgccaccccccaguucaucaucggccccggcggcguggugaaccugaccggccuggugagcagcgagaacagcagcaaggccaccgacgagaccggcgugagcgccgugcaguucggcaacagcagcaccagcgugcuggccacccuggccgcccuggccgaggccagcgccccccugagcaacagcagcgagacccccgugguggccaccgaggagguggugaccgccgagagcguggacggcgccauccagcagguggugagcagcggcggccagcaggugaucaccaucgugaccgacggcauccagcugggcaaccugcacagcauccccaccagcggcaucggccagcccaucaucgugaccaugcccgacggccagcaggugcugaccgugcccgccaccgacaucgccgaggagaccgugaucagcgaggagccccccgccaagagacagugcaucgagaucaucgagaacagaguggagagcgccgagaucgaggugagaagccugcugcccggcgugcugugcagaagccaccccaaguaa

SEQ ID NO: 17336 - RNA, 1371 nt, Artificial Sequence
  GABRA1__Homo_sapiens__NP_001121120
augagaaagagccccggccugagcgacugccugugggccuggauccugcugcugagcacccugaccggcagaagcuacggccagcccagccugcaggacgagcugaaggacaacaccaccguguucaccagaauccuggacagacugcuggacggcuacgacaacagacugagacccggccugggcgagagagugaccgaggugaagaccgacaucuucgugaccagcuucggccccgugagcgaccacgacauggaguacaccaucgacguguucuucagacagagcuggaaggacgagagacugaaguucaagggccccaugaccgugcugagacugaacaaccugauggccagcaagaucuggacccccgacaccuucuuccacaacggcaagaagagcguggcccacaacaugaccaugcccaacaagcugcugagaaucaccgaggacggcacccugcuguacaccaugagacugaccgugagagccgagugccccaugcaccuggaggacuuccccauggacgcccacgccugcccccugaaguucggcagcuacgccuacaccagagccgaggugguguacgaguggaccagagagcccgccagaagcguggugguggccgaggacggcagcagacugaaccaguacgaccugcugggccagaccguggacagcggcaucgugcagagcagcaccggcgaguacguggugaugaccacccacuuccaccugaagagaaagaucggcuacuucgugauccagaccuaccugcccugcaucaugaccgugauccugagccaggugagcuucuggcugaacagagagagcgugcccgccagaaccguguucggcgugaccaccgugcugaccaugaccacccugagcaucagcgccagaaacagccugcccaagguggccuacgccaccgccauggacugguucaucgccgugugcuacgccuucguguucagcgcccugaucgaguucgccaccgugaacuacuucaccaagagaggcuacgccugggacggcaagagcguggugcccgagaagcccaagaaggugaaggacccccugaucaagaagaacaacaccuacgcccccaccgccaccagcuacacccccaaccuggccagaggcgaccccggccuggccaccaucgccaagagcgccaccaucgagcccaaggaggugaagcccgagaccaagccccccgagcccaagaagaccuucaacagcgugagcaagaucgacagacugagcagaaucgccuucccccugcuguucggcaucuucaaccugguguacugggccaccuaccugaacagagagccccagcugaaggcccccaccccccaccaguaa

SEQ ID NO: 17337 - RNA, 1356 nt, Artificial Sequence
  GABRA2__Homo_sapiens__NP_000798
augaagaccaagcugaacaucuacaacaugcaguuccugcuguucguguuccuggugugggaccccgccagacuggugcuggccaacauccaggaggacgaggccaagaacaacaucaccaucuucaccagaauccuggacagacugcuggacggcuacgacaacagacugagacccggccugggcgacagcaucaccgagguguucaccaacaucuacgugaccagcuucggccccgugagcgacaccgacauggaguacaccaucgacguguucuucagacagaaguggaaggacgagagacugaaguucaagggccccaugaacauccugagacugaacaaccugauggccagcaagaucuggacccccgacaccuucuuccacaacggcaagaagagcguggcccacaacaugaccaugcccaacaagcugcugagaauccaggacgacggcacccugcuguacaccaugagacugaccgugcaggccgagugccccaugcaccuggaggacuuccccauggacgcccacagcugcccccugaaguucggcagcuacgccuacaccaccagcgaggugaccuacaucuggaccuacaacgccagcgacagcgugcagguggcccccgacggcagcagacugaaccaguacgaccugcugggccagagcaucggcaaggagaccaucaagagcagcaccggcgaguacaccgugaugaccgcccacuuccaccugaagagaaagaucggcuacuucgugauccagaccuaccugcccugcaucaugaccgugauccugagccaggugagcuucuggcugaacagagagagcgugcccgccagaaccguguucggcgugaccaccgugcugaccaugaccacccugagcaucagcgccagaaacagccugcccaagguggccuacgccaccgccauggacugguucaucgccgugugcuacgccuucguguucagcgcccugaucgaguucgccaccgugaacuacuucaccaagagaggcugggccugggacggcaagagcguggugaacgacaagaagaaggagaaggccagcgugaugauccagaacaacgccuacgccguggccguggccaacuacgcccccaaccugagcaaggaccccgugcugagcaccaucagcaagagcgccaccacccccgagcccaacaagaagcccgagaacaagcccgccgaggccaagaagaccuucaacagcgugagcaagaucgacagaaugagcagaaucguguuccccgugcuguucggcaccuucaaccugguguacugggccaccuaccugaacagagagcccgugcugggcgugagccccuaa

SEQ ID NO: 17338 - RNA, 1479 nt, Artificial Sequence
  GABRA3__Homo_sapiens__NP_000799
augaucaucacccagaccagccacugcuacaugaccagccugggcauccuguuccugaucaacauccugcccggcaccaccggccagggcgagagcagaagacaggagcccggcgacuucgugaagcaggacaucggcggccugagccccaagcacgcccccgacauccccgacgacagcaccgacaacaucaccaucuucaccagaauccuggacagacugcuggacggcuacgacaacagacugagacccggccugggcgacgccgugaccgaggugaagaccgacaucuacgugaccagcuucggccccgugagcgacaccgacauggaguacaccaucgacguguucuucagacagaccuggcacgacgagagacugaaguucgacggccccaugaagauccugccccugaacaaccugcuggccagcaagaucuggacccccgacaccuucuuccacaacggcaagaagagcguggcccacaacaugaccacccccaacaagcugcugagacugguggacaacggcacccugcuguacaccaugagacugaccauccacgccgagugccccaugcaccuggaggacuuccccauggacgugcacgccugcccccugaaguucggcagcuacgccuacaccaccgccgaggugguguacagcuggacccugggcaagaacaagagcguggagguggcccaggacggcagcagacugaaccaguacgaccugcugggccacguggugggcaccgagaucaucagaagcagcaccggcgaguacguggugaugaccacccacuuccaccugaagagaaagaucggcuacuucgugauccagaccuaccugcccugcaucaugaccgugauccugagccaggugagcuucuggcugaacagagagagcgugcccgccagaaccguguucggcgugaccaccgugcugaccaugaccacccugagcaucagcgccagaaacagccugcccaagguggccuacgccaccgccauggacugguucaucgccgugugcuacgccuucguguucagcgcccugaucgaguucgccaccgugaacuacuucaccaagagaagcugggccugggagggcaagaaggugcccgaggcccuggagaugaagaagaagacccccgccgcccccgccaagaagaccagcaccaccuucaacaucgugggcaccaccuaccccaucaaccuggccaaggacaccgaguucagcaccaucagcaagggcgccgcccccagcgccagcagcacccccaccaucaucgccagccccaaggccaccuacgugcaggacagccccaccgagaccaagaccuacaacagcgugagcaagguggacaagaucagcagaaucaucuuccccgugcuguucgccaucuucaaccugguguacugggccaccuacgugaacagagagagcgccaucaagggcaugaucagaaagcaguaa

SEQ ID NO: 17339 - RNA, 1665 nt, Artificial Sequence
  GABRA4__Homo_sapiens__NP_000800
auggugagcgccaagaaggugcccgccaucgcccugagcgccggcgugagcuucgcccugcugagauuccugugccuggccgugugccugaacgagagccccggccagaaccagaaggaggagaagcugugcaccgagaacuucaccagaauccuggacagccugcuggacggcuacgacaacagacugagacccggcuucggcggccccgugaccgaggugaagaccgacaucuacgugaccagcuucggccccgugagcgacguggagauggaguacaccauggacguguucuucagacagaccuggaucgacaagagacugaaguacgacggccccaucgagauccugagacugaacaacaugauggugaccaagguguggacccccgacaccuucuucagaaacggcaagaagagcgugagccacaacaugaccgcccccaacaagcuguucagaaucaugagaaacggcaccauccuguacaccaugagacugaccaucagcgccgagugccccaugagacugguggacuuccccauggacggccacgccugcccccugaaguucggcagcuacgccuaccccaagagcgagaugaucuacaccuggaccaagggccccgagaagagcguggaggugcccaaggagagcagcagccuggugcaguacgaccugaucggccagaccgugagcagcgagaccaucaagagcaucaccggcgaguacaucgugaugaccguguacuuccaccugagaagaaagaugggcuacuucaugauccagaccuacauccccugcaucaugaccgugauccugagccaggugagcuucuggaucaacaaggagagcgugcccgccagaaccguguucggcaucaccaccgugcugaccaugaccacccugagcaucagcgccagacacagccugcccaaggugagcuacgccaccgccauggacugguucaucgccgugugcuucgccuucguguucagcgcccugaucgaguucgccgccgugaacuacuucaccaacauccagauggagaaggccaagagaaagaccagcaagcccccccaggaggugcccgccgcccccgugcagagagagaagcaccccgaggccccccugcagaacaccaacgccaaccugaacaugagaaagagaaccaacgcccuggugcacagcgagagcgacgugggcaacagaaccgaggugggcaaccacagcagcaagagcagcaccguggugcaggagagcagcaagggcacccccagaagcuaccuggccagcagccccaaccccuucagcagagccaacgccgccgagaccaucagcgccgccagagcccugcccagcgccagccccaccagcaucagaaccggcuacaugcccagaaaggccagcgugggcagcgccagcaccagacacguguucggcagcagacugcagagaaucaagaccaccgugaacaccaucggcgccaccggcaagcugagcgccacccccccccccagcgcccccccccccagcggcagcggcaccagcaagaucgacaaguacgccagaauccuguuccccgugaccuucggcgccuucaacaugguguacugggugguguaccugagcaaggacaccauggagaagagcgagagccugauguaa

SEQ ID NO: 17340 - RNA, 1389 nt, Artificial Sequence
  GABRA5__Homo_sapiens__XP_005268315
auggacaacggcauguucagcggcuucaucaugaucaagaaccugcugcuguucugcaucagcaugaaccugagcagccacuucggcuucagccagaugcccaccagcagcgugaaggacgagaccaacgacaacaucaccaucuucaccagaauccuggacggccugcuggacggcuacgacaacagacugagacccggccugggcgagagaaucacccaggugagaaccgacaucuacgugaccagcuucggccccgugagcgacaccgagauggaguacaccaucgacguguucuucagacagagcuggaaggacgagagacugagauucaagggccccaugcagagacugccccugaacaaccugcuggccagcaagaucuggacccccgacaccuucuuccacaacggcaagaagagcaucgcccacaacaugaccacccccaacaagcugcugagacuggaggacgacggcacccugcuguacaccaugagacugaccaucagcgccgagugccccaugcagcuggaggacuuccccauggacgcccacgccugcccccugaaguucggcagcuacgccuaccccaacagcgaggugguguacguguggaccaacggcagcaccaagagcguggugguggccgaggacggcagcagacugaaccaguaccaccugaugggccagaccgugggcaccgagaacaucagcaccagcaccggcgaguacaccaucaugaccgcccacuuccaccugaagagaaagaucggcuacuucgugauccagaccuaccugcccugcaucaugaccgugauccugagccaggugagcuucuggcugaacagagagagcgugcccgccagaaccguguucggcgugaccaccgugcugaccaugaccacccugagcaucagcgccagaaacagccugcccaagguggccuacgccaccgccauggacugguucaucgccgugugcuacgccuucguguucagcgcccugaucgaguucgccaccgugaacuacuucaccaagagaggcugggccugggacggcaagaaggcccuggaggccgccaagaucaagaagaagagagaggugauccugaacaagagcaccaacgccuucaccaccggcaagaugagccacccccccaacauccccaaggagcagacccccgccggcaccagcaacaccaccagcgugagcgugaagcccagcgaggagaagaccagcgagagcaagaagaccuacaacagcaucagcaagaucgacaagaugagcagaaucguguuccccgugcuguucggcaccuucaaccugguguacugggccaccuaccugaacagagagcccgugaucaagggcgccgccagccccaaguaa

SEQ ID NO: 17341 - RNA, 1362 nt, Artificial Sequence
  GABRA6__Homo_sapiens__NP_000802
auggccagcagccugcccuggcugugcaucauccuguggcuggagaacgcccugggcaagcuggagguggagggcaacuucuacagcgagaacgugagcagaauccuggacaaccugcuggagggcuacgacaacagacugagacccggcuucggcggcgccgugaccgaggugaagaccgacaucuacgugaccagcuucggccccgugagcgacguggagauggaguacaccauggacguguucuucagacagaccuggaccgacgagagacugaaguucggcggccccaccgagauccugagccugaacaaccugauggugagcaagaucuggacccccgacaccuucuucagaaacggcaagaagagcaucgcccacaacaugaccacccccaacaagcuguucagaaucaugcagaacggcaccauccuguacaccaugagacugaccaucaacgccgacugccccaugagacuggugaacuuccccauggacggccacgccugcccccugaaguucggcagcuacgccuaccccaagagcgagaucaucuacaccuggaagaagggcccccuguacagcguggaggugcccgaggagagcagcagccugcugcaguacgaccugaucggccagaccgugagcagcgagaccaucaagagcaacaccggcgaguacgugaucaugaccguguacuuccaccugcagagaaagaugggcuacuucaugauccagaucuacacccccugcaucaugaccgugauccugagccaggugagcuucuggaucaacaaggagagcgugcccgccagaaccguguucggcaucaccaccgugcugaccaugaccacccugagcaucagcgccagacacagccugcccaaggugagcuacgccaccgccauggacugguucaucgccgugugcuucgccuucguguucagcgcccugaucgaguucgccgccgugaacuacuucaccaaccugcagacccagaaggccaagagaaaggcccaguucgccgccccccccaccgugaccaucagcaaggccaccgagccccuggaggccgagaucgugcugcaccccgacagcaaguaccaccugaagaagagaaucaccagccugagccugcccaucgugagcagcagcgaggccaacaaggugcugaccagagcccccauccugcagagcacccccgugaccccccccccccugagccccgccuucggcggcaccagcaagaucgaccaguacagcagaauccuguuccccguggccuucgccggcuucaaccugguguacugggugguguaccugagcaaggacaccauggaggugagcagcagcguggaguaa

SEQ ID NO: 17342 - RNA, 1425 nt, Artificial Sequence
  GABRB1__Homo_sapiens__NP_000803
auguggaccgugcagaacagagagagccugggccugcugagcuuccccgugaugaucaccauggugugcugcgcccacagcaccaacgagcccagcaacaugagcuacgugaaggagaccguggacagacugcugaagggcuacgacaucagacugagacccgacuucggcggcccccccguggacgugggcaugagaaucgacguggccagcaucgacauggugagcgaggugaacauggacuacacccugaccauguacuuccagcagagcuggaaggacaagagacugagcuacagcggcaucccccugaaccugacccuggacaacagaguggccgaccagcugugggugcccgacaccuacuuccugaacgacaagaagagcuucgugcacggcgugaccgugaagaacagaaugaucagacugcaccccgacggcaccgugcuguacggccugagaaucaccaccaccgccgccugcaugauggaccugagaagauacccccuggacgagcagaacugcacccuggagaucgagagcuacggcuacaccaccgacgacaucgaguucuacuggaacggcggcgagggcgccgugaccggcgugaacaagaucgagcugccccaguucagcaucguggacuacaagauggugagcaagaagguggaguucaccaccggcgccuaccccagacugagccugagcuucagacugaagagaaacaucggcuacuucauccugcagaccuacaugcccagcacccugaucaccauccugagcugggugagcuucuggaucaacuacgacgccagcgccgccagaguggcccugggcaucaccaccgugcugaccaugaccaccaucagcacccaccugagagagacccugcccaagauccccuacgugaaggccaucgacaucuaccugaugggcugcuucguguucguguuccuggcccugcuggaguacgccuucgugaacuacaucuucuucggcaagggcccccagaagaagggcgccagcaagcaggaccagagcgccaacgagaagaacaagcuggagaugaacaaggugcagguggacgcccacggcaacauccugcugagcacccuggagaucagaaacgagaccagcggcagcgaggugcugaccagcgugagcgaccccaaggccaccauguacagcuacgacagcgccagcauccaguacagaaagccccugagcagcagagaggccuacggcagagcccuggacagacacggcgugcccagcaagggcagaaucagaagaagagccagccagcugaaggugaagauccccgaccugaccgacgugaacagcaucgacaaguggagcagaauguucuuccccaucaccuucagccuguucaacgugguguacuggcuguacuacgugcacuaa

SEQ ID NO: 17343 - RNA, 1425 nt, Artificial Sequence
  GABRB2__Homo_sapiens__NP_000804
auguggagagugagaaagagaggcuacuucggcaucuggagcuucccccugaucaucgccgccgugugcgcccagagcgugaacgaccccagcaacaugagccuggugaaggagaccguggacagacugcugaagggcuacgacaucagacugagacccgacuucggcggcccccccguggccgugggcaugaacaucgacaucgccagcaucgacauggugagcgaggugaacauggacuacacccugaccauguacuuccagcaggccuggagagacaagagacugagcuacaacgugaucccccugaaccugacccuggacaacagaguggccgaccagcugugggugcccgacaccuacuuccugaacgacaagaagagcuucgugcacggcgugaccgugaagaacagaaugaucagacugcaccccgacggcaccgugcuguacggccugagaaucaccaccaccgccgccugcaugauggaccugagaagauacccccuggacgagcagaacugcacccuggagaucgagagcuacggcuacaccaccgacgacaucgaguucuacuggagaggcgacgacaacgccgugaccggcgugaccaagaucgagcugccccaguucagcaucguggacuacaagcugaucaccaagaaggugguguucagcaccggcagcuaccccagacugagccugagcuucaagcugaagagaaacaucggcuacuucauccugcagaccuacaugcccagcauccugaucaccauccugagcugggugagcuucuggaucaacuacgacgccagcgccgccagaguggcccugggcaucaccaccgugcugaccaugaccaccaucaacacccaccugagagagacccugcccaagauccccuacgugaaggccaucgacauguaccugaugggcugcuucguguucguguucauggcccugcuggaguacgcccuggugaacuacaucuucuucggcagaggcccccagagacagaagaaggccgccgagaaggccgccagcgccaacaacgagaagaugagacuggacgugaacaagauggacccccacgagaacauccugcugagcacccuggagaucaagaacgagauggccaccagcgaggccgugaugggccugggcgaccccagaagcaccaugcuggccuacgacgccagcagcauccaguacagaaaggccggccugcccagacacagcuucggcagaaacgcccuggagagacacguggcccagaagaagagcagacugagaagaagagccagccagcugaagaucaccauccccgaccugaccgacgugaacgccaucgacagauggagcagaaucuucuuccccgugguguucagcuucuucaacaucguguacuggcuguacuacgugaacuaa

SEQ ID NO: 17344 - RNA, 1422 nt, Artificial Sequence
  GABRB3__Homo_sapiens__NP_000805
auguggggccuggccggcggcagacuguucggcaucuucagcgcccccgugcugguggccguggugugcugcgcccagagcgugaacgaccccggcaacaugagcuucgugaaggagaccguggacaagcugcugaagggcuacgacaucagacugagacccgacuucggcggcccccccgugugcgugggcaugaacaucgacaucgccagcaucgacauggugagcgaggugaacauggacuacacccugaccauguacuuccagcaguacuggagagacaagagacuggccuacagcggcaucccccugaaccugacccuggacaacagaguggccgaccagcugugggugcccgacaccuacuuccugaacgacaagaagagcuucgugcacggcgugaccgugaagaacagaaugaucagacugcaccccgacggcaccgugcuguacggccugagaaucaccaccaccgccgccugcaugauggaccugagaagauacccccuggacgagcagaacugcacccuggagaucgagagcuacggcuacaccaccgacgacaucgaguucuacuggagaggcggcgacaaggccgugaccggcguggagagaaucgagcugccccaguucagcaucguggagcacagacuggugagcagaaacgugguguucgccaccggcgccuaccccagacugagccugagcuucagacugaagagaaacaucggcuacuucauccugcagaccuacaugcccagcauccugaucaccauccugagcugggugagcuucuggaucaacuacgacgccagcgccgccagaguggcccugggcaucaccaccgugcugaccaugaccaccaucaacacccaccugagagagacccugcccaagauccccuacgugaaggccaucgacauguaccugaugggcugcuucguguucguguuccuggcccugcuggaguacgccuucgugaacuacaucuucuucggcagaggcccccagagacagaagaagcuggccgagaagaccgccaaggccaagaacgacagaagcaagagcgagagcaacagaguggacgcccacggcaacauccugcugaccagccuggaggugcacaacgagaugaacgaggugagcggcggcaucggcgacaccagaaacagcgccaucagcuucgacaacagcggcauccaguacagaaagcagagcaugcccagagagggccacggcagauuccugggcgacagaagccugccccacaagaagacccaccugagaagaagaagcagccagcugaagaucaagauccccgaccugaccgacgugaacgccaucgacagauggagcagaaucguguuccccuucaccuucagccuguucaaccugguguacuggcuguacuacgugaacuaa

SEQ ID NO: 17345 - RNA, 1521 nt, Artificial Sequence
  GABRE__Homo_sapiens__NP_004952
augcugagcaaggugcugcccgugcugcugggcauccugcugauccugcagagcagaguggagggcccccagaccgagagcaagaacgaggccagcagcagagacgugguguacggcccccagccccagccccuggagaaccagcugcugagcgaggagaccaagagcaccgagaccgagaccggcagcagagugggcaagcugcccgaggccagcagaauccugaacaccauccugagcaacuacgaccacaagcugagacccggcaucggcgagaagcccaccguggugaccguggagaucagcgugaacagccugggcccccugagcauccuggacauggaguacaccaucgacaucaucuucagccagaccugguacgacgagagacugugcuacaacgacaccuucgagagccuggugcugaacggcaacguggugagccagcuguggauccccgacaccuucuucagaaacagcaagagaacccacgagcacgagaucaccaugcccaaccagauggugagaaucuacaaggacggcaaggugcuguacaccaucagaaugaccaucgacgccggcugcagccugcacaugcugagauuccccauggacagccacagcugcccccugagcuucagcagcuucagcuaccccgagaacgagaugaucuacaagugggagaacuucaagcuggagaucaacgagaagaacagcuggaagcuguuccaguucgacuucaccggcgugagcaacaagaccgagaucaucaccacccccgugggcgacuucauggugaugaccaucuucuucaacgugagcagaagauucggcuacguggccuuccagaacuacgugcccagcagcgugaccaccaugcugagcugggugagcuucuggaucaagaccgagagcgcccccgccagaaccagccugggcaucaccagcgugcugaccaugaccacccugggcaccuucagcagaaagaacuuccccagagugagcuacaucaccgcccuggacuucuacaucgccaucugcuucguguucugcuucugcgcccugcuggaguucgccgugcugaacuuccugaucuacaaccagaccaaggcccacgccagccccaagcugagacaccccagaaucaacagcagagcccacgccagaaccagagccagaagcagagccugcgccagacagcaccaggaggccuucgugugccagaucgugaccaccgagggcagcgacggcgaggagagacccagcugcagcgcccagcagccccccagccccggcagccccgagggccccagaagccugugcagcaagcuggccugcugcgaguggugcaagagauucaagaaguacuucugcauggugcccgacugcgagggcagcaccuggcagcagggcagacugugcauccacguguacagacuggacaacuacagcagagugguguuccccgugaccuucuucuucuucaacgugcuguacuggcuggugugccugaaccuguaa

SEQ ID NO: 17346 - RNA, 1398 nt, Artificial Sequence
  GABRG1__Homo_sapiens__NP_775807
augggcccccugaaggccuuccuguucagccccuuccugcugagaagccagagcagaggcgugagacugguguuccugcugcugacccugcaccugggcaacugcguggacaaggccgacgacgaggacgacgaggaccugaccgugaacaagaccugggugcuggcccccaagauccacgagggcgacaucacccagauccugaacagccugcugcagggcuacgacaacaagcugagacccgacaucggcgugagacccaccgugaucgagaccgacguguacgugaacagcaucggccccguggaccccaucaacauggaguacaccaucgacaucaucuucgcccagaccugguucgacagcagacugaaguucaacagcaccaugaaggugcugaugcugaacagcaacauggugggcaagaucuggauccccgacaccuucuucagaaacagcagaaagagcgacgcccacuggaucaccacccccaacagacugcugagaaucuggaacgacggcagagugcuguacacccugagacugaccaucaacgccgagugcuaccugcagcugcacaacuuccccauggacgagcacagcugcccccuggaguucagcagcuacggcuaccccaagaacgagaucgaguacaaguggaagaagcccagcguggagguggccgaccccaaguacuggagacuguaccaguucgccuucgugggccugagaaacagcaccgagaucacccacaccaucagcggcgacuacgugaucaugaccaucuucuucgaccugagcagaagaaugggcuacuucaccauccagaccuacauccccugcauccugaccguggugcugagcugggugagcuucuggaucaacaaggacgccgugcccgccagaaccagccugggcaucaccaccgugcugaccaugaccacccugagcaccaucgccagaaagagccugcccaaggugagcuacgugaccgccauggaccuguucgugagcgugugcuucaucuucguguucgccgcccugauggaguacggcacccugcacuacuucaccagcaaccagaagggcaagaccgccaccaaggacagaaagcugaagaacaaggccagcaugacccccggccugcaccccggcagcacccugauccccaugaacaacaucagcgugccccaggaggacgacuacggcuaccagugccuggagggcaaggacugcgccagcuucuucugcugcuucgaggacugcagaaccggcagcuggagagagggcagaauccacaucagaaucgccaagaucgacagcuacagcagaaucuucuuccccaccgccuucgcccuguucaaccugguguacugggugggcuaccuguaccuguaa

SEQ ID NO: 17347 - RNA, 1404 nt, Artificial Sequence
  GABRG2__Homo_sapiens__NP_000807
augagcagccccaacaucuggagcaccggcagcagcguguacagcacccccguguucagccagaagaugaccguguggauccugcugcugcugagccuguaccccggcuucaccagccagaagagcgacgacgacuacgaggacuacgccagcaacaagaccugggugcugacccccaaggugcccgagggcgacgugaccgugauccugaacaaccugcuggagggcuacgacaacaagcugagacccgacaucggcgugaagcccacccugauccacaccgacauguacgugaacagcaucggccccgugaacgccaucaacauggaguacaccaucgacaucuucuucgcccagaccugguacgacagaagacugaaguucaacagcaccaucaaggugcugagacugaacagcaacauggugggcaagaucuggauccccgacaccuucuucagaaacagcaagaaggccgacgcccacuggaucaccacccccaacagaaugcugagaaucuggaacgacggcagagugcuguacacccugagacugaccaucgacgccgagugccagcugcagcugcacaacuuccccauggacgagcacagcugcccccuggaguucagcagcuacggcuaccccagagaggagaucguguaccaguggaagagaagcagcguggaggugggcgacaccagaagcuggagacuguaccaguucagcuucgugggccugagaaacaccaccgagguggugaagaccaccagcggcgacuacguggugaugagcguguacuucgaccugagcagaagaaugggcuacuucaccauccagaccuacauccccugcacccugaucguggugcugagcugggugagcuucuggaucaacaaggacgccgugcccgccagaaccagccugggcaucaccaccgugcugaccaugaccacccugagcaccaucgccagaaagagccugcccaaggugagcuacgugaccgccauggaccuguucgugagcgugugcuucaucuucguguucagcgcccugguggaguacggcacccugcacuacuucgugagcaacagaaagcccagcaaggacaaggacaagaagaagaagaaccccgcccccaccaucgacaucagacccagaagcgccaccauccagaugaacaacgccacccaccugcaggagagagacgaggaguacggcuacgagugccuggacggcaaggacugcgccagcuucuucugcugcuucgaggacugcagaaccggcgccuggagacacggcagaauccacaucagaaucgccaagauggacagcuacgccagaaucuucuuccccaccgccuucugccuguucaaccugguguacugggugagcuaccuguaccuguaa

SEQ ID NO: 17348 - RNA, 762 nt, Artificial Sequence
  GABRG3__Homo_sapiens__NP_001257802
auggcccccaagcugcugcugcugcugugccuguucagcggccugcacgccagaagcagaaagguggaggaggacgaguacgaggacagcagcagcaaccagaagugggugcuggcccccaagagccaggacaccgacgugacccugauccugaacaagcugcugagagaguacgacaagaagcugagacccgacaucggcaucaagcccaccgugaucgacguggacaucuacgugaacagcaucggccccgugagcagcaucaacauggaguaccagaucgacaucuucuucgcccagaccuggaccgacagcagacugagauucaacagcaccaugaagauccugacccugaacagcaacauggugggccugaucuggauccccgacaccaucuucagaaacagcaagaccgccgaggcccacuggaucaccacccccaaccagcugcugagaaucuggaacgacggcaagauccuguacacccugagacugaccaucaacgccgagugccagcugcagcugcacaacuuccccauggacgagcacagcugcccccugaucuucagcagcuacggcuaccccaaggaggagaugaucuacagauggagaaagaacagcguggaggccgccgaccagaagagcuggagacuguaccaguucgacuucaugggccugagaaacaccaccgagaucgugaccaccagcgccggcagaaaccugcugaaggaggcccagcugagcaaggccagagaggccuaa

SEQ ID NO: 17349 - RNA, 1323 nt, Artificial Sequence
  GABRP__Homo_sapiens__XP_011532807
augaacuacagccugcaccuggccuucgugugccugagccuguucaccgagagaaugugcauccagggcagccaguucaacguggaggugggcagaagcgacaagcugagccugcccggcuucgagaaccugaccgccggcuacaacaaguuccugagacccaacuucggcggcgagcccgugcagaucgcccugacccuggacaucgccagcaucagcagcaucagcgagagcaacauggacuacaccgccaccaucuaccugagacagagauggauggaccagagacugguguucgagggcaacaagagcuucacccuggacgccagacugguggaguuccugugggugcccgacaccuacaucguggagagcaagaagagcuuccugcacgaggugaccgugggcaacagacugaucagacuguucagcaacggcaccgugcuguacgcccugagaaucaccaccaccguggccugcaacauggaccugagcaaguaccccauggacacccagaccugcaagcugcagcuggagagcuggggcuacgacggcaacgacguggaguucaccuggcugagaggcaacgacagcgugagaggccuggagcaccugagacuggcccaguacaccaucgagagauacuucacccuggugaccagaagccagcaggagaccggcaacuacaccagacuggugcugcaguucgagcugagaagaaacgugcuguacuucauccuggagaccuacgugcccagcaccuuccugguggugcugagcugggugagcuucuggaucagccuggacagcgugcccgccagaaccugcaucggcgugaccaccgugcugagcaugaccacccugaugaucggcagcagaaccagccugcccaacaccaacugcuucaucaaggccaucgacguguaccugggcaucugcuucagcuucguguucggcgcccugcuggaguacgccguggcccacuacagcagccugcagcagauggccgccaaggacagaggcaccaccaaggagguggaggaggugagcaucaccaacaucaucaacagcagcaucagcagcuucaagagaaagaucagcuucgccagcaucgagaucagcagcgacaacguggacuacagcgaccugaccaugaagaccagcgacaaguucaaguucguguucagagagaagaugggcagaaucguggacuacuucaccauccagaaccccagcaacguggaccacuacagcaagcugcuguucccccugaucuucaugcuggccaacguguucuacugggccuacuacauguacuucuaa

SEQ ID NO: 17350 - RNA, 1899 nt, Artificial Sequence
  GABRQ__Homo_sapiens__NP_061028
augggcaucagaggcaugcugagagccgccgugauccugcugcugaucagaaccuggcuggccgagggcaacuaccccagccccauccccaaguuccacuucgaguucagcagcgccgugcccgagguggugcugaaccuguucaacugcaagaacugcgccaacgaggccguggugcagaagauccuggacagagugcugagcagauacgacgugagacugagacccaacuucggcggcgcccccgugcccgugagaaucagcaucuacgugaccagcaucgagcagaucagcgagaugaacauggacuacaccaucaccauguucuuccaccagaccuggaaggacagcagacuggccuacuacgagaccacccugaaccugacccuggacuacagaaugcacgagaagcugugggugcccgacugcuacuuccugaacagcaaggacgccuucgugcacgacgugaccguggagaacagaguguuccagcugcaccccgacggcaccgugagauacggcaucagacugaccaccaccgccgccugcagccuggaccugcacaaguuccccauggacaagcaggccugcaaccuggugguggagagcuacggcuacaccguggaggacaucauccuguucugggacgacaacggcaacgccauccacaugaccgaggagcugcacaucccccaguucaccuuccugggcagaaccaucaccagcaaggagguguacuucuacaccggcagcuacaucagacugauccugaaguuccaggugcagagagaggugaacagcuaccuggugcagguguacuggcccaccgugcugaccaccaucaccagcuggaucagcuucuggaugaacuacgacagcagcgccgccagagugaccaucggccugaccagcaugcugauccugaccaccaucgacagccaccugagagacaagcugcccaacaucagcugcaucaaggccaucgacaucuacauccuggugugccuguucuucguguuccugagccugcuggaguacguguacaucaacuaccuguucuacagcagaggccccagaagacagcccagaagacacagaagacccagaagagugaucgccagauacagauaccagcaggugguggugggcaacgugcaggacggccugaucaacguggaggacggcgugagcagccugcccaucacccccgcccaggccccccuggccagccccgagagccugggcagccugaccagcaccagcgagcaggcccagcuggccaccagcgagagccugagcccccugaccagccugagcggccaggccccccuggccaccggcgagagccugagcgaccugcccagcaccagcgagcaggccagacacagcuacggcgugagauucaacggcuuccaggccgacgacagcaucauccccaccgagaucagaaacagaguggaggcccacggccacggcgugacccacgaccacgaggacagcaacgagagccugagcagcgacgagagacacggccacggccccagcggcaagcccaugcugcaccacggcgagaagggcgugcaggaggccggcugggaccuggacgacaacaacgacaagagcgacugccuggccaucaaggagcaguucaagugcgacaccaacagcaccuggggccugaacgacgacgagcugauggcccacggccaggagaaggacagcagcagcgagagcgaggacagcugcccccccagccccggcugcagcuucaccgagggcuucagcuucgaccuguucaaccccgacuacgugcccaagguggacaaguggagcagauuccuguucccccuggccuucggccuguucaacaucguguacuggguguaccacauguacuaa

SEQ ID NO: 17351 - RNA, 1389 nt, Artificial Sequence
  GABRR1__Homo_sapiens__NP_001243632
augcuggccgugcccaacaugagauucggcaucuuccugcugugguggggcugggugcuggccaccgagagcagaaugcacuggcccggcagagaggugcacgagaugagcaagaagggcagccccauccugagaagaagccccgacaucaccaagagcccccugaccaagagcgagcagcugcugagaaucgacgaccacgacuucagcaugagacccggcuucggcggccccgccauccccgugggcguggacgugcagguggagagccuggacagcaucagcgagguggacauggacuucaccaugacccuguaccugagacacuacuggaaggacgagagacugagcuuccccagcaccaacaaccugagcaugaccuucgacggcagacuggugaagaagaucugggugcccgacauguucuucgugcacagcaagagaagcuucauccacgacaccaccaccgacaacgugaugcugagagugcagcccgacggcaaggugcuguacagccugagagugaccgugaccgccaugugcaacauggacuucagcagauucccccuggacacccagaccugcagccuggagaucgagagcuacgccuacaccgaggacgaccugaugcuguacuggaagaagggcaacgacagccugaagaccgacgagagaaucagccugagccaguuccugauccaggaguuccacaccaccaccaagcuggccuucuacagcagcaccggcugguacaacagacuguacaucaacuucacccugagaagacacaucuucuucuuccugcugcagaccuacuuccccgccacccugauggugaugcugagcugggugagcuucuggaucgacagaagagccgugcccgccagagugccccugggcaucaccaccgugcugaccaugagcaccaucaucaccggcgugaacgccagcaugcccagagugagcuacaucaaggccguggacaucuaccugugggugagcuucguguucguguuccugagcgugcuggaguacgccgccgugaacuaccugaccaccgugcaggagagaaaggagcagaagcugagagagaagcugcccugcaccagcggccugcccccccccagaaccgccaugcuggacggcaacuacagcgacggcgaggugaacgaccuggacaacuacaugcccgagaacggcgagaagcccgacagaaugauggugcagcugacccuggccagcgagagaagcagcccccagagaaagagccagagaagcagcuacgugagcaugagaaucgacacccacgccaucgacaaguacagcagaaucaucuuccccgccgccuacauccuguucaaccugaucuacuggagcaucuucagcuaa

SEQ ID NO: 17352 - RNA, 1398 nt, Artificial Sequence
  GABRR2__Homo_sapiens__NP_002034
augcccuacuucaccagacugauccuguuccuguucugccugauggugcugguggagagcagaaagcccaagagaaagagauggaccggccagguggagaugcccaagcccagccaccuguacaagaagaaccuggacgugaccaagaucagaaagggcaagccccagcagcugcugagaguggacgagcacgacuucagcaugagacccgccuucggcggccccgccauccccgugggcguggacgugcagguggagagccuggacagcaucagcgagguggacauggacuucaccaugacccuguaccugagacacuacuggaaggacgagagacuggccuucagcagcgccagcaacaagagcaugaccuucgacggcagacuggugaagaagaucugggugcccgacguguucuucgugcacagcaagagaagcuucacccacgacaccaccaccgacaacaucaugcugagaguguuccccgacggccacgugcuguacagcaugagaaucaccgugaccgccaugugcaacauggacuucagccacuucccccuggacagccagaccugcagccuggagcuggagagcuacgccuacaccgacgaggaccugaugcuguacuggaagaacggcgacgagagccugaagaccgacgagaagaucagccugagccaguuccugauccagaaguuccacaccaccagcagacuggccuucuacagcagcaccggcugguacaacagacuguacaucaacuucacccugagaagacacaucuucuucuuccugcugcagaccuacuuccccgccacccugauggugaugcugagcugggugagcuucuggaucgacagaagagccgugcccgccagagugagccugggcaucaccaccgugcugaccaugaccaccaucaucaccggcgugaacgccagcaugcccagagugagcuacgugaaggccguggacaucuaccugugggugagcuucguguucguguuccugagcgugcuggaguacgccgccgugaacuaccugaccaccgugcaggagagaaaggagagaaagcugagagagaaguuccccugcaugugcggcaugcugcacagcaagaccaugaugcuggacggcagcuacagcgagagcgaggccaacagccuggccggcuaccccagaagccacauccugaccgaggaggagagacaggacaagaucguggugcaccugggccugagcggcgaggccaacgccgccagaaagaagggccugcugaagggccagaccggcuucagaaucuuccagaacacccacgccaucgacaaguacagcagacugaucuuccccgccagcuacaucuucuucaaccugaucuacuggagcguguucagcuaa

SEQ ID NO: 17353 - RNA, 1785 nt, Artificial Sequence
  GAD1__Homo_sapiens__NP_000808
auggccagcagcacccccagcagcagcgccaccagcagcaacgccggcgccgaccccaacaccaccaaccugagacccaccaccuacgacaccuggugcggcguggcccacggcugcaccagaaagcugggccugaagaucugcggcuuccugcagagaaccaacagccuggaggagaagagcagacuggugagcgccuucaaggagagacagagcagcaagaaccugcugagcugcgagaacagcgacagagacgccagauucagaagaaccgagaccgacuucagcaaccuguucgccagagaccugcugcccgccaagaacggcgaggagcagaccgugcaguuccugcuggaggugguggacauccugcugaacuacgugagaaagaccuucgacagaagcaccaaggugcuggacuuccaccacccccaccagcugcuggagggcauggagggcuucaaccuggagcugagcgaccaccccgagagccuggagcagauccugguggacugcagagacacccugaaguacggcgugagaaccggccaccccagauucuucaaccagcugagcaccggccuggacaucaucggccuggccggcgaguggcugaccagcaccgccaacaccaacauguucaccuacgagaucgcccccguguucgugcugauggagcagaucacccugaagaagaugagagagaucgugggcuggagcagcaaggacggcgacggcaucuucagccccggcggcgccaucagcaacauguacagcaucauggccgccagauacaaguacuuccccgaggugaagaccaagggcauggccgccgugcccaagcuggugcuguucaccagcgagcagagccacuacagcaucaagaaggccggcgccgcccugggcuucggcaccgacaacgugauccugaucaagugcaacgagagaggcaagaucauccccgccgacuucgaggccaagauccuggaggccaagcagaagggcuacgugcccuucuacgugaacgccaccgccggcaccaccguguacggcgccuucgaccccauccaggagaucgccgacaucugcgagaaguacaaccuguggcugcacguggacgccgccuggggcggcggccugcugaugagcagaaagcacagacacaagcugaacggcaucgagagagccaacagcgugaccuggaacccccacaagaugaugggcgugcugcugcagugcagcgccauccuggugaaggagaagggcauccugcagggcugcaaccagaugugcgccggcuaccuguuccagcccgacaagcaguacgacgugagcuacgacaccggcgacaaggccauccagugcggcagacacguggacaucuucaaguucuggcugauguggaaggccaagggcaccgugggcuucgagaaccagaucaacaagugccuggagcuggccgaguaccuguacgccaagaucaagaacagagaggaguucgagaugguguucaacggcgagcccgagcacaccaacgugugcuucugguacaucccccagagccugagaggcgugcccgacagcccccagagaagagagaagcugcacaagguggcccccaagaucaaggcccugaugauggagagcggcaccaccauggugggcuaccagccccagggcgacaaggccaacuucuucagaauggugaucagcaaccccgccgccacccagagcgacaucgacuuccugaucgaggagaucgagagacugggccaggaccuguaa

SEQ ID NO: 17354 - RNA, 1758 nt, Artificial Sequence
  GAD2__Homo_sapiens__NP_001127838
auggccagccccggcagcggcuucuggagcuucggcagcgaggacggcagcggcgacagcgagaaccccggcaccgccagagccuggugccagguggcccagaaguucaccggcggcaucggcaacaagcugugcgcccugcuguacggcgacgccgagaagcccgccgagagcggcggcagccagccccccagagccgccgccagaaaggccgccugcgccugcgaccagaagcccugcagcugcagcaagguggacgugaacuacgccuuccugcacgccaccgaccugcugcccgccugcgacggcgagagacccacccuggccuuccugcaggacgugaugaacauccugcugcaguacguggugaagagcuucgacagaagcaccaaggugaucgacuuccacuaccccaacgagcugcugcaggaguacaacugggagcuggccgaccagccccagaaccuggaggagauccugaugcacugccagaccacccugaaguacgccaucaagaccggccaccccagauacuucaaccagcugagcaccggccuggacauggugggccuggccgccgacuggcugaccagcaccgccaacaccaacauguucaccuacgagaucgcccccguguucgugcugcuggaguacgugacccugaagaagaugagagagaucaucggcuggcccggcggcagcggcgacggcaucuucagccccggcggcgccaucagcaacauguacgccaugaugaucgccagauucaagauguuccccgaggugaaggagaagggcauggccgcccugcccagacugaucgccuucaccagcgagcacagccacuucagccugaagaagggcgccgccgcccugggcaucggcaccgacagcgugauccugaucaagugcgacgagagaggcaagaugauccccagcgaccuggagagaagaauccuggaggccaagcagaagggcuucgugcccuuccuggugagcgccaccgccggcaccaccguguacggcgccuucgacccccugcuggccguggccgacaucugcaagaaguacaagaucuggaugcacguggacgccgccuggggcggcggccugcugaugagcagaaagcacaaguggaagcugagcggcguggagagagccaacagcgugaccuggaacccccacaagaugaugggcgugccccugcagugcagcgcccugcuggugagagaggagggccugaugcagaacugcaaccagaugcacgccagcuaccuguuccagcaggacaagcacuacgaccugagcuacgacaccggcgacaaggcccugcagugcggcagacacguggacguguucaagcuguggcugauguggagagccaagggcaccaccggcuucgaggcccacguggacaagugccuggagcuggccgaguaccuguacaacaucaucaagaacagagagggcuacgagaugguguucgacggcaagccccagcacaccaacgugugcuucugguacaucccccccagccugagaacccuggaggacaacgaggagagaaugagcagacugagcaagguggcccccgugaucaaggccagaaugauggaguacggcaccaccauggugagcuaccagccccugggcgacaaggugaacuucuucagaauggugaucagcaaccccgccgccacccaccaggacaucgacuuccugaucgaggagaucgagagacugggccaggaccuguaa

SEQ ID NO: 17355 - RNA, 483 nt, Artificial Sequence
  GADD45B__Homo_sapiens__NP_056490
augacccuggaggagcugguggccugcgacaacgccgcccagaagaugcagaccgugaccgccgccguggaggagcugcugguggccgcccagagacaggacagacugaccgugggcguguacgagagcgccaagcugaugaacguggaccccgacagcguggugcugugccugcuggccaucgacgaggaggaggaggacgacaucgcccugcagauccacuucacccugauccagagcuucugcugcgacaacgacaucaacaucgugagagugagcggcaugcagagacuggcccagcugcugggcgagcccgccgagacccagggcaccaccgaggccagagaccugcacugccugcuggugaccaacccccacaccgacgccuggaagagccacggccugguggagguggccagcuacugcgaggagagcagaggcaacaaccagugggugcccuacaucagccugcaggagagauaa

SEQ ID NO: 17356 - RNA, 480 nt, Artificial Sequence
  GADD45G__Homo_sapiens__NP_006696
augacccuggaggaggugagaggccaggacaccgugcccgagagcaccgccagaaugcagggcgccggcaaggcccugcacgagcugcugcugagcgcccagagacagggcugccugaccgccggcguguacgagagcgccaaggugcugaacguggaccccgacaacgugaccuucugcgugcuggccgccggcgaggaggacgagggcgacaucgcccugcagauccacuucacccugauccaggccuucugcugcgagaacgacaucgacaucgugagagugggcgacgugcagagacuggccgccaucgugggcgccggcgaggaggccggcgcccccggcgaccugcacugcauccugaucagcaaccccaacgaggacgccuggaaggaccccgcccuggagaagcugagccuguucugcgaggagagcagaagcgugaacgacugggugcccagcaucacccugcccgaguaa

SEQ ID NO: 17357 - RNA, 669 nt, Artificial Sequence
  GADD45GIP1__Homo_sapiens__NP_443082
auggccgccagcgugagacaggccagaagccugcugggcguggccgccacccuggcccccggcagcagaggcuacagagccagacccccccccagaagaagacccggccccagauggcccgaccccgaggaccugcugacccccagauggcagcugggccccagauacgccgccaagcaguucgccagauacggcgccgccagcggcguggugcccggcagccuguggcccagccccgagcagcugagagagcuggaggccgaggagagagagugguaccccagccuggccaccaugcaggagagccugagagugaagcagcuggccgaggagcagaagagaagagagagagagcagcacaucgccgagugcauggccaagaugccccagaugaucgugaacuggcagcagcagcagagagagaacugggagaaggcccaggccgacaaggagagaagagccagacugcaggccgaggcccaggagcugcugggcuaccagguggaccccagaagcgccagauuccaggagcugcugcaggaccuggagaagaaggagagaaagagacugaaggaggagaagcagaagagaaagaaggaggccagagccgccgcccuggccgccgccguggcccaggaccccgccgccagcggcgcccccagcagcuaa

SEQ ID NO: 17358 - RNA, 1566 nt, Artificial Sequence
  GADL1__Homo_sapiens__NP_997242
augagcagcgacagcgacagacagugccccguggacggcgacaucgaccagcaggagaugauccccagcaagaagaacgccgugcugguggacggcguggugcugaacggccccaccaccgacgccaaggccggcgagaaguucguggaggaggccugcagacugaucauggaggagguggugcugaaggccaccgacgugaacgagaaggugugcgaguggagaccccccgagcagcugaagcagcugcuggaccuggagaugagagacagcggcgagcccccccacaagcugcuggagcugugcagagacgugauccacuacagcgugaagaccaaccaccccagauucuucaaccagcuguacgccggccuggacuacuacagccugguggccagauucaugaccgaggcccugaaccccagcguguacaccuacgaggugagccccguguuccugcugguggaggaggccgugcugaagaagaugaucgaguucaucggcuggaaggagggcgacggcaucuucaaccccggcggcagcgugagcaacauguacgccaugaaccuggccagauacaaguacugccccgacaucaaggagaagggccugagcggcagccccagacugauccuguucaccagcgccgagugccacuacagcaugaagaaggccgccagcuuccugggcaucggcaccgagaacgugugcuucguggagaccgacggcagaggcaagaugauccccgaggagcuggagaagcagguguggcaggccagaaaggagggcgccgcccccuuccuggugugcgccaccagcggcaccaccgugcugggcgccuucgacccccuggacgagaucgccgacaucugcgagagacacagccuguggcugcacguggacgccagcuggggcggcagcgcccugaugagcagaaagcacagaaagcugcugcacggcauccacagagccgacagcguggccuggaacccccacaagaugcugauggccggcauccagugcugcgcccugcuggugaaggacaagagcgaccugcugaagaagugcuacagcgccaaggccagcuaccuguuccagcaggacaaguucuacgacgugagcuacgacaccggcgacaagagcauccagugcagcagaagacccgacgccuucaaguucuggaugaccuggaaggcccugggcacccugggccuggaggagagagugaacagagcccuggcccugagcagauaccugguggacgagaucaagaagagagagggcuucaagcugcugauggagcccgaguacgccaacaucugcuucugguacaucccccccagccugagagagauggaggagggccccgaguucugggccaagcugaaccugguggcccccgccaucaaggagagaaugaugaagaagggcagccugaugcugggcuaccagccccacagaggcaaggugaacuucuucagacagguggugaucagcccccaggugagcagagaggacauggacuuccugcuggacgagaucgaccugcugggcaaggacauguaa

SEQ ID NO: 17359 - RNA, 351 nt, Artificial Sequence
  GAGE10__Homo_sapiens__NP_001091883
augagcuggagaggcagaagcaccuacagacccagacccagaagauacguggagccccccgagaugaucggccccaugcugcccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcaggugcaccccaagaccggcugcgagugcggcgacggccccgacggccaggagaugggccugcccaaccccgaggaggugaagagacccgaggagggcgagaagcagagccagugcuaa

SEQ ID NO: 17360 - RNA, 354 nt, Artificial Sequence
  GAGE1__Homo_sapiens__NP_001035753
augagcuggagaggcagaagcaccuacuacuggcccagacccagaagauacgugcagccccccgagaugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcagggccacccccagaccggcugcgagugcgaggacggccccgacggccaggagauggacccccccaaccccgaggaggugaagacccccgaggagggcgagggccagagccagugcuaa

SEQ ID NO: 17361 - RNA, 3936 nt, Artificial Sequence
  GAK__Homo_sapiens__NP_005246
augagccugcugcagagcgcccuggacuuccuggccggccccggcagccugggcggcgccagcggcagagaccagagcgacuucgugggccagaccguggagcugggcgagcugagacugagagugagaagagugcuggccgagggcggcuucgccuucguguacgaggcccaggacgugggcagcggcagagaguacgcccugaagagacugcugagcaacgaggaggagaagaacagagccaucauccaggaggugugcuucaugaagaagcugagcggccaccccaacaucgugcaguucugcagcgccgccagcaucggcaaggaggagagcgacaccggccaggccgaguuccugcugcugaccgagcugugcaagggccagcugguggaguuccugaagaagauggagagcagaggcccccugagcugcgacaccgugcugaagaucuucuaccagaccugcagagccgugcagcacaugcacagacagaagccccccaucauccacagagaccugaagguggagaaccugcugcugagcaaccagggcaccaucaagcugugcgacuucggcagcgccaccaccaucagccacuaccccgacuacagcuggagcgcccagagaagagcccugguggaggaggagaucaccagaaacaccacccccauguacagaacccccgagaucaucgaccuguacagcaacuuccccaucggcgagaagcaggacaucugggcccugggcugcauccuguaccugcugugcuucagacagcaccccuucgaggacggcgccaagcugagaaucgugaacggcaaguacagcauccccccccacgacacccaguacaccguguuccacagccugaucagagccaugcugcaggugaaccccgaggagagacugagcaucgccgagguggugcaccagcugcaggagaucgccgccgccagaaacgugaaccccaagagccccaucaccgagcugcuggagcagaacggcggcuacggcagcgccacccugagcagaggcccccccccccccgugggccccgccggcagcggcuacagcggcggccuggcccuggccgaguacgaccagcccuacggcggcuuccuggacauccugagaggcggcaccgagagacuguucaccaaccugaaggacaccagcagcaaggugauccagagcguggccaacuacgccaagggcgaccuggacaucagcuacaucaccagcagaaucgccgugaugagcuuccccgccgagggcguggagagcgcccugaagaacaacaucgaggacgugagacuguuccuggacagcaagcaccccggccacuacgccguguacaaccugagccccagaaccuacagacccagcagauuccacaacagagugagcgagugcggcugggccgccagaagagccccccaccugcacacccuguacaacaucugcagaaacaugcacgccuggcugagacaggaccacaagaacgugugcguggugcacugcauggacggcagagccgccagcgccguggccgugugcagcuuccugugcuucugcagacuguucagcaccgccgaggccgccguguacauguucagcaugaagagaugcccccccggcaucuggcccagccacaagagauacaucgaguacaugugcgacaugguggccgaggagcccaucaccccccacagcaagcccauccuggugagagccguggugaugacccccgugccccuguucagcaagcagagaagcggcugcagacccuucugcgagguguacgugggcgacgagagaguggccagcaccagccaggaguacgacaagaugagagacuucaagaucgaggacggcaaggccgugaucccccugggcgugaccgugcagggcgacgugcugaucgugaucuaccacgccagaagcacccugggcggcagacugcaggccaagauggccagcaugaagauguuccagauccaguuccacaccggcuucgugcccagaaacgccaccaccgugaaguucgccaaguacgaccuggacgccugcgacauccaggagaaguaccccgaccuguuccaggugaaccuggagguggagguggagcccagagacagacccagcagagaggccccccccugggagaacagcagcaugagaggccugaaccccaagauccuguucagcagcagagaggagcagcaggacauccugagcaaguucggcaagcccgagcugcccagacagcccggcagcaccgcccaguacgacgccggcgccggcagccccgaggccgagcccaccgacagcgacagcccccccagcagcagcgccgacgccagcagauuccugcacacccuggacuggcaggaggagaaggaggccgagaccggcgccgagaacgccagcagcaaggagagcgagagcgcccugauggaggacagagacgagagcgaggugagcgacgagggcggcagccccaucagcagcgagggccaggagcccagagccgaccccgagccccccggccuggccgccggccuggugcagcaggaccugguguucgagguggagacccccgccgugcugcccgagcccgugccccaggaggacggcguggaccugcugggccugcacagcgaggugggcgccggccccgccgugcccccccaggccugcaaggcccccagcagcaacaccgaccugcugagcugccugcugggcccccccgaggccgccagccagggcccccccgaggaccugcugagcgaggacccccugcugcuggccagccccgcccccccccugagcgugcagagcacccccagaggcggcccccccgccgccgccgaccccuucggcccccugcugcccagcagcggcaacaacagccagcccugcagcaaccccgaccuguucggcgaguuccugaacagcgacagcgugaccgugccccccagcuuccccagcgcccacagcgcccccccccccagcugcagcgccgacuuccugcaccugggcgaccugcccggcgagcccagcaagaugaccgccagcagcagcaaccccgaccugcugggcggcugggccgccuggaccgagaccgccgccagcgccguggcccccacccccgccaccgagggcccccuguucagccccggcggccagcccgcccccugcggcagccaggccagcuggaccaagagccagaaccccgaccccuucgccgaccugggcgaccugagcagcggccugcagggcagccccgccggcuucccccccggcggcuucauccccaagaccgccaccacccccaagggcagcagcagcuggcagaccagcagaccccccgcccagggcgccagcuggcccccccaggccaagcccccccccaaggccugcacccagcccagacccaacuacgccagcaacuucagcgugaucggcgccagagaggagagaggcgugagagcccccagcuucgcccagaagcccaaggugagcgagaacgacuucgaggaccugcugagcaaccagggcuucagcagcagaagcgacaagaagggccccaagaccaucgccgagaugagaaagcaggaccuggccaaggacaccgacccccugaagcugaagcugcuggacuggaucgagggcaaggagagaaacaucagagcccugcugagcacccugcacaccgugcugugggacggcgagagcagauggacccccgugggcauggccgaccugguggcccccgagcaggugaagaagcacuacagaagagccgugcuggccgugcaccccgacaaggccgccggccagcccuacgagcagcacgccaagaugaucuucauggagcugaacgacgccuggagcgaguucgagaaccagggcagcagaccccuguucuaa

SEQ ID NO: 17362 - RNA, 2058 nt, Artificial Sequence
  GALC__Homo_sapiens__NP_000144
auggccgaguggcugcugagcgccagcuggcagagaagagccaaggccaugaccgccgccgccggcagcgccggcagagccgccgugccccugcugcugugcgcccugcuggcccccggcggcgccuacgugcuggacgacagcgacggccugggcagagaguucgacggcaucggcgccgugagcggcggcggcgccaccagcagacugcuggugaacuaccccgagcccuacagaagccagauccuggacuaccuguucaagcccaacuucggcgccagccugcacauccugaagguggagaucggcggcgacggccagaccaccgacggcaccgagcccagccacaugcacuacgcccuggacgagaacuacuucagaggcuacgagugguggcugaugaaggaggccaagaagagaaaccccaacaucacccugaucggccugcccuggagcuuccccggcuggcugggcaagggcuucgacuggcccuacgugaaccugcagcugaccgccuacuacguggugaccuggaucgugggcgccaagagauaccacgaccuggacaucgacuacaucggcaucuggaacgagagaagcuacaacgccaacuacaucaagauccugagaaagaugcugaacuaccagggccugcagagagugaagaucaucgccagcgacaaccugugggagagcaucagcgccagcaugcugcuggacgccgagcuguucaaggugguggacgugaucggcgcccacuaccccggcacccacagcgccaaggacgccaagcugaccggcaagaagcuguggagcagcgaggacuucagcacccugaacagcgacaugggcgccggcugcuggggcagaauccugaaccagaacuacaucaacggcuacaugaccagcaccaucgccuggaaccugguggccagcuacuacgagcagcugcccuacggcagaugcggccugaugaccgcccaggagcccuggagcggccacuacgugguggagagccccgugugggugagcgcccacaccacccaguucacccagcccggcugguacuaccugaagaccgugggccaccuggagaagggcggcagcuacguggcccugaccgacggccugggcaaccugaccaucaucaucgagaccaugagccacaagcacagcaagugcaucagacccuuccugcccuacuucaacgugagccagcaguucgccaccuucgugcugaagggcagcuucagcgagauccccgagcugcaggugugguacaccaagcugggcaagaccagcgagagauuccuguucaagcagcuggacagccuguggcugcuggacagcgacggcagcuucacccugagccugcacgaggacgagcuguucacccugaccacccugaccaccggcagaaagggcagcuacccccugccccccaagagccagcccuuccccagcaccuacaaggacgacuucaacguggacuaccccuucuucagcgaggcccccaacuucgccgaccagaccggcguguucgaguacuucaccaacaucgaggaccccggcgagcaccacuucacccugagacaggugcugaaccagagacccaucaccugggccgccgacgccagcaacaccaucagcaucaucggcgacuacaacuggaccaaccugaccaucaagugcgacguguacaucgagacccccgacaccggcggcguguucaucgccggcagagugaacaagggcggcauccugaucagaagcgccagaggcaucuucuucuggaucuucgccaacggcagcuacagagugaccggcgaccuggccggcuggaucaucuacgcccugggcagaguggaggugaccgccaagaagugguacacccugacccugaccaucaagggccacuucaccagcggcaugcugaacgacaagagccuguggaccgacauccccgugaacuuccccaagaacggcugggccgccaucggcacccacagcuucgaguucgcccaguucgacaacuuccugguggaggccaccagauaa

SEQ ID NO: 17363 - RNA, 372 nt, Artificial Sequence
  GAL__Homo_sapiens__NP_057057
auggccagaggcagcgcccugcugcuggccagccugcugcuggccgccgcccugagcgccagcgccggccuguggagccccgccaaggagaagagaggcuggacccugaacagcgccggcuaccugcugggcccccacgccgugggcaaccacagaagcuucagcgacaagaacggccugaccagcaagagagagcugagacccgaggacgacaugaagcccggcagcuucgacagaagcauccccgagaacaacaucaugagaaccaucaucgaguuccugagcuuccugcaccugaaggaggccggcgcccuggacagacugcuggaccugcccgccgccgccagcagcgaggacaucgagagaagcuaa

SEQ ID NO: 17364 - RNA, 1179 nt, Artificial Sequence
  GALK1__Homo_sapiens__NP_000145
auggccgcccugagacagccccagguggccgagcugcuggccgaggccagaagagccuucagagaggaguucggcgccgagcccgagcuggccgugagcgcccccggcagagugaaccugaucggcgagcacaccgacuacaaccagggccuggugcugcccauggcccuggagcugaugaccgugcuggugggcagccccagaaaggacggccuggugagccugcugaccaccagcgagggcgccgacgagccccagagacugcaguucccccugcccaccgcccagagaagccuggagcccggcacccccagaugggccaacuacgugaagggcgugauccaguacuaccccgccgccccccugcccggcuucagcgccgugguggugagcagcgugccccugggcggcggccugagcagcagcgccagccuggagguggccaccuacaccuuccugcagcagcugugccccgacagcggcaccaucgccgccagagcccaggugugccagcaggccgagcacagcuucgccggcaugcccugcggcaucauggaccaguucaucagccugaugggccagaagggccacgcccugcugaucgacugcagaagccuggagaccagccuggugccccugagcgaccccaagcuggccgugcugaucaccaacagcaacgugagacacagccuggccagcagcgaguaccccgugagaagaagacagugcgaggagguggccagagcccugggcaaggagagccugagagaggugcagcuggaggagcuggaggccgccagagaccuggugagcaaggagggcuucagaagagccagacacguggugggcgagaucagaagaaccgcccaggccgccgccgcccugagaagaggcgacuacagagccuucggcagacugaugguggagagccacagaagccugagagacgacuacgaggugagcugccccgagcuggaccagcugguggaggccgcccuggccgugcccggcguguacggcagcagaaugaccggcggcggcuucggcggcugcaccgugacccugcuggaggccagcgccgccccccacgccaugagacacauccaggagcacuacggcggcaccgccaccuucuaccugagccaggccgccgacggcgccaaggugcugugccuguaa

SEQ ID NO: 17365 - RNA, 1344 nt, Artificial Sequence
  GALK2__Homo_sapiens__NP_001001556
augcccgugcuguacgacagacugcugaagcugaaggagauguucaacagcaaguucggcagcauccccaaguucuacgugagagcccccggcagagugaacaucaucggcgagcacaucgacuacugcggcuacagcgugcugcccauggccguggagcaggacgugcugaucgccguggagcccgugaagaccuacgcccugcagcuggccaacaccaacccccuguaccccgacuucagcaccagcgccaacaacauccagaucgacaagaccaagccccuguggcacaacuacuuccugugcggccugaagggcauccaggagcacuucggccugagcaaccugaccggcaugaacugccugguggacggcaacaucccccccagcagcggccugagcagcagcagcgcccuggugugcugcgccggccuggugacccugaccgugcugggcagaaaccugagcaagguggagcuggccgagaucugcgccaagagcgagagauacaucggcaccgagggcggcggcauggaccagagcaucagcuuccuggccgaggagggcaccgccaagcugaucgaguucagcccccugagagccaccgacgugaagcugcccagcggcgccguguucgugaucgccaacagcugcguggagaugaacaaggccgccaccagccacuucaacaucagagugauggagugcagacuggccgccaagcugcuggccaaguacaagagccugcagugggacaaggugcugagacuggaggaggugcaggccaagcugggcaucagccuggaggagaugcugcuggugaccgaggacgcccugcaccccgagcccuacaaccccgaggagaucugcagaugccugggcaucagccuggaggagcugagaacccagauccugagccccaacacccaggacgugcugaucuucaagcuguaccagagagccaagcacguguacagcgaggccgccagagugcugcaguucaagaagaucugcgaggaggcccccgagaacauggugcagcugcugggcgagcugaugaaccagagccacaugagcugcagagacauguacgagugcagcugccccgagcuggaccagcugguggacaucugcagaaaguucggcgcccagggcagcagacugaccggcgccggcuggggcggcugcaccgugagcauggugcccgccgacaagcugcccagcuuccuggccaacgugcacaaggccuacuaccagagaagcgacggcagccuggcccccgagaagcagagccuguucgccaccaagcccggcggcggcgcccuggugcugcuggaggccuaa

SEQ ID NO: 17366 - RNA, 1029 nt, Artificial Sequence
  GALM__Homo_sapiens__NP_620156
auggccagcgugaccagagccguguucggcgagcugcccagcggcggcggcaccguggagaaguuccagcugcagagcgaccugcugagaguggacaucaucagcuggggcugcaccaucaccgcccuggaggugaaggacagacagggcagagccagcgacguggugcugggcuucgccgagcuggagggcuaccugcagaagcagcccuacuucggcgccgugaucggcagaguggccaacagaaucgccaagggcaccuucaagguggacggcaaggaguaccaccuggccaucaacaaggagcccaacagccugcacggcggcgugagaggcuucgacaaggugcuguggacccccagagugcugagcaacggcgugcaguucagcagaaucagccccgacggcgaggagggcuaccccggcgagcugaaggugugggugaccuacacccuggacggcggcgagcugaucgugaacuacagagcccaggccagccaggccacccccgugaaccugaccaaccacagcuacuucaaccuggccggccaggccagccccaacaucaacgaccacgaggugaccaucgaggccgacaccuaccugcccguggacgagacccugauccccaccggcgagguggcccccgugcagggcaccgccuucgaccugagaaagcccguggagcugggcaagcaccugcaggacuuccaccugaacggcuucgaccacaacuucugccugaagggcagcaaggagaagcacuucugcgccagagugcaccacgccgccagcggcagagugcuggagguguacaccacccagcccggcgugcaguucuacaccggcaacuuccuggacggcacccugaagggcaagaacggcgccguguaccccaagcacagcggcuucugccuggagacccagaacuggcccgacgccgugaaccagcccagauucccccccgugcugcugagacccggcgaggaguacgaccacaccaccugguucaaguucagcguggccuaa

SEQ ID NO: 17367 - RNA, 1569 nt, Artificial Sequence
  GALNS__Homo_sapiens__NP_000503
auggccgccgugguggccgccaccagaugguggcagcugcugcuggugcugagcgccgccggcaugggcgccagcggcgccccccagccccccaacauccugcugcugcugauggacgacaugggcuggggcgaccugggcguguacggcgagcccagcagagagacccccaaccuggacagaauggccgccgagggccugcuguuccccaacuucuacagcgccaacccccugugcagccccagcagagccgcccugcugaccggcagacugcccaucagaaacggcuucuacaccaccaacgcccacgccagaaacgccuacaccccccaggagaucgugggcggcauccccgacagcgagcagcugcugcccgagcugcugaagaaggccggcuacgugagcaagaucgugggcaaguggcaccugggccacagaccccaguuccacccccugaagcacggcuucgacgagugguucggcagccccaacugccacuucggccccuacgacaacaaggccagacccaacauccccguguacagagacugggagauggugggcagauacuacgaggaguuccccaucaaccugaagaccggcgaggccaaccugacccagaucuaccugcaggaggcccuggacuucaucaagagacaggccagacaccaccccuucuuccuguacugggccguggacgccacccacgcccccguguacgccagcaagcccuuccugggcaccagccagagaggcagauacggcgacgccgugagagagaucgacgacagcaucggcaagauccuggagcugcugcaggaccugcacguggccgacaacaccuucguguucuucaccagcgacaacggcgccgcccugaucagcgcccccgagcagggcggcagcaacggccccuuccugugcggcaagcagaccaccuucgagggcggcaugagagagcccgcccuggccugguggcccggccacgugaccgccggccaggugagccaccagcugggcagcaucauggaccuguucaccaccagccuggcccuggccggccugaccccccccagcgacagagccaucgacggccugaaccugcugcccacccugcugcagggcagacugauggacagacccaucuucuacuacagaggcgacacccugauggccgccacccugggccagcacaaggcccacuucuggaccuggaccaacagcugggagaacuucagacagggcaucgacuucugccccggccagaacgugagcggcgugaccacccacaaccuggaggaccacaccaagcugccccugaucuuccaccugggcagagaccccggcgagagauucccccugagcuucgccagcgccgaguaccaggaggcccugagcagaaucaccagcguggugcagcagcaccaggaggcccuggugcccgcccagccccagcugaacgugugcaacugggccgugaugaacugggccccccccggcugcgagaagcugggcaagugccugaccccccccgagagcauccccaagaagugccuguggagccacuaa

SEQ ID NO: 17368 - RNA, 1746 nt, Artificial Sequence
  GALNT12__Homo_sapiens__NP_078918
auguggggcagaaccgccagaagaagaugccccagagagcugagaagaggcagagaggcccugcuggugcugcuggcccugcuggcccuggccggccugggcagcgugcugagagcccagagaggcgccggcgccggcgccgccgagcccggcccccccagaacccccagacccggcagaagagagcccgugaugcccagaccccccgugcccgccaacgcccugggcgccagaggcgaggccgugagacugcagcugcagggcgaggagcugagacugcaggaggagagcgugagacugcaccagaucaacaucuaccugagcgacagaaucagccugcacagaagacugcccgagagauggaacccccugugcaaggagaagaaguacgacuacgacaaccugcccagaaccagcgugaucaucgccuucuacaacgaggccuggagcacccugcugagaaccguguacagcgugcuggagaccagccccgacauccugcuggaggaggugauccugguggacgacuacagcgacagagagcaccugaaggagagacuggccaacgagcugagcggccugcccaaggugagacugaucagagccaacaagagagagggccuggugagagccagacugcugggcgccagcgccgccagaggcgacgugcugaccuuccuggacugccacugcgagugccacgagggcuggcuggagccccugcugcagagaauccacgaggaggagagcgccguggugugccccgugaucgacgugaucgacuggaacaccuucgaguaccugggcaacagcggcgagccccagaucggcggcuucgacuggagacugguguucaccuggcacaccgugcccgagagagagagaaucagaaugcagagccccguggacgugaucagaagccccaccauggccggcggccuguucgccgugagcaagaaguacuucgaguaccugggcagcuacgacaccggcauggagguguggggcggcgagaaccuggaguucagcuucagaaucuggcagugcggcggcgugcuggagacccaccccugcagccacgugggccacguguuccccaagcaggcccccuacagcagaaacaaggcccuggccaacagcgugagagccgccgagguguggauggacgaguucaaggagcuguacuaccacagaaaccccagagccagacuggagcccuucggcgacgugaccgagagaaagcagcugagagacaagcugcagugcaaggacuucaagugguuccuggagaccguguaccccgagcugcacgugcccgaggacagacccggcuucuucggcaugcugcagaacaagggccugaccgacuacugcuucgacuacaacccccccgacgagaaccagaucgugggccaccaggugauccuguaccugugccacggcaugggccagaaccaguucuucgaguacaccagccagaaggagaucagauacaacacccaccagcccgagggcugcaucgccguggaggccggcauggacacccugaucaugcaccugugcgaggagaccgcccccgagaaccagaaguucauccugcaggaggacggcagccuguuccacgagcagagcaagaagugcgugcaggccgccagaaaggagagcagcgacagcuucgugccccugcugagagacugcaccaacagcgaccaccagaagugguucuucaaggagagaaugcuguaa

SEQ ID NO: 17369 - RNA, 1686 nt, Artificial Sequence
  GALNT13__Homo_sapiens__NP_001288556
augagaagauucguguacugcaagguggugcuggccaccagccugaugugggugcugguggacguguuccugcugcuguacuucagcgagugcaacaagugcgacgacaagaaggagagaagccugcugcccgcccugagagccgugaucagcagaaaccaggagggccccggcgagaugggcaaggccgugcugauccccaaggacgaccaggagaagaugaaggagcuguucaagaucaaccaguucaaccugauggccagcgaccugaucgcccugaacagaagccugcccgacgugagacuggagggcugcaagaccaagguguaccccgacgagcugcccaacaccagcguggugaucguguuccacaacgaggccuggagcacccugcugagaaccguguacagcgugaucaacagaagcccccacuaccugcugagcgaggugauccugguggacgacgccagcgagagagacuuccugaagcugacccuggagaacuacgugaagaaccuggaggugcccgugaagaucaucagaauggaggagagaagcggccugaucagagccagacugagaggcgccgccgccagcaagggccaggugaucaccuuccuggacgcccacugcgagugcacccugggcuggcuggagccccugcuggccagaaucaaggaggacagaaagaccguggugugccccaucaucgacgugaucagcgacgacaccuucgaguacauggccggcagcgacaugaccuacggcggcuucaacuggaagcugaacuucagaugguaccccgugccccagagagagauggacagaagaaagggcgacagaacccugcccgugagaacccccaccauggccggcggccuguucagcaucgacagaaacuacuucgaggagaucggcaccuacgacgccggcauggacaucuggggcggcgagaaccuggagaugagcuucagaaucuggcagugcggcggcagccuggagaucgugaccugcagccacgugggccacguguucagaaaggccacccccuacaccuuccccggcggcaccggccacgugaucaacaagaacaacagaagacuggccgagguguggauggacgaguucaaggacuucuucuacaucaucagccccggcguggugaagguggacuacggcgacgugagcgugagaaagacccugagagagaaccugaagugcaagcccuucagcugguaccuggagaacaucuaccccgacagccagauccccagaagauacuacagccugggcgagaucagaaacguggagaccaaccagugccuggacaacaugggcagaaaggagaacgagaaggugggcaucuucaacugccacggcaugggcggcaaccagguguucagcuacaccgccgacaaggagaucagaaccgacgaccugugccuggacgugagcagacugaacggccccgugaucaugcugaagugccaccacaugagaggcaaccagcugugggaguacgacgccgagagcugccugagcgugaacaagguggccgacggcagccagcaccccaccguggagaccugcaacgacagcacccugcagaaguggcugcugagaaacuacaccagaauggagaucuucagaaacaucuucggcaacagcaccgacuacauccuguaa

SEQ ID NO: 17370 - RNA, 1674 nt, Artificial Sequence
  GALNT14__Homo_sapiens__NP_001240755
augagaagacugaccagaagacuggugcugcccguguucggcgugcuguggaucaccgugcugcuguucuucugggugaccaagagaaagcuggaggugcccaccggccccgaggugcagacccccaagguguggagccuguucuucaagguggccggcaugagccccugggccccccaggugcccgugagccccaccccccccuaccagagaggccaccugcccaccggcggccaccuggccgugugccacuuccccugccugcugcaggaggcccaguuccaccugcagacccagguguuccugcaggugagaugcacccugcugguguacugcaccgaccugccccccaccagcaucaucaucaccuuccacaacgaggccagaagcacccugcugagaaccaucagaagcgugcugaacagaacccccacccaccugaucagagagaucauccugguggacgacuucagcaacgaccccgacgacugcaagcagcugaucaagcugcccaaggugaagugccugagaaacaacgagagacagggccuggugagaagcagaaucagaggcgccgacaucgcccagggcaccacccugaccuuccuggacagccacugcgaggugaacagagacuggcugcagccccugcugcacagagugaaggaggacuacaccagaguggugugccccgugaucgacaucaucaaccuggacaccuucaccuacaucgagagcgccagcgagcugagaggcggcuucgacuggagccugcacuuccagugggagcagcugagccccgagcagaaggccagaagacuggaccccaccgagcccaucagaacccccaucaucgccggcggccuguucgugaucgacaaggccugguucgacuaccugggcaaguacgacauggacauggacaucuggggcggcgagaacuucgagaucagcuucagaguguggaugugcggcggcagccuggagaucgugcccugcagcagagugggccacguguucagaaagaagcaccccuacguguuccccgacggcaacgccaacaccuacaucaagaacaccaagagaaccgccgagguguggauggacgaguacaagcaguacuacuacgccgccagacccuucgcccuggagagacccuucggcaacguggagagcagacuggaccugagaaagaaccugagaugccagagcuucaagugguaccuggagaacaucuaccccgagcugagcauccccaaggagagcagcauccagaagggcaacaucagacagagacagaagugccuggagagccagagacagaacaaccaggagacccccaaccugaagcugagccccugcgccaaggugaagggcgaggacgccaagagccaggugugggccuucaccuacacccagcagauccugcaggaggagcugugccugagcgugaucacccuguuccccggcgcccccguggugcuggugcugugcaagaacggcgacgacagacagcaguggaccaagaccggcagccacaucgagcacaucgccagccaccugugccuggacaccgacauguucggcgacggcaccgagaacggcaaggagaucguggugaaccccugcgagagcagccugaugagccagcacugggacauggugagcagcuaa

SEQ ID NO: 17371 - RNA, 1920 nt, Artificial Sequence
  GALNT15__Homo_sapiens__NP_473451
augcugcugagaaagagauacagacacagacccugcagacugcaguuccugcugcugcugcugaugcugggcugcgugcugaugaugguggccaugcugcaccccccccaccacacccugcaccagaccgugaccgcccaggccagcaagcacagccccgaggccagauacagacuggacuucggcgagagccaggacugggugcuggaggccgaggacgagggcgaggaguacagcccccuggagggccugccccccuucaucagccugagagaggaccagcugcugguggccguggcccugccccaggccagaagaaaccagagccagggcagaagaggcggcagcuacagacugaucaagcagcccagaagacaggacaaggaggcccccaagagagacuggggcgccgacgaggacggcgaggugagcgaggaggaggagcugacccccuucagccuggaccccagaggccugcaggaggcccugagcgccagaaucccccugcagagagcccugcccgaggugagacacccccugugccugcagcagcacccccaggacagccugcccaccgccagcgugauccugugcuuccacgacgaggccuggagcacccugcugagaaccgugcacagcauccuggacaccgugcccagagccuuccugaaggagaucauccugguggacgaccugagccagcagggccagcugaagagcgcccugagcgaguacguggccagacuggagggcgugaagcugcugagaagcaacaagagacugggcgccaucagagccagaaugcugggcgccaccagagccaccggcgacgugcugguguucauggacgcccacugcgagugccaccccggcuggcuggagccccugcugagcagaaucgccggcgacagaagcagaguggugagccccgugaucgacgugaucgacuggaagaccuuccaguacuaccccagcaaggaccugcagagaggcgugcuggacuggaagcuggacuuccacugggagccccugcccgagcacgugagaaaggcccugcagagccccaucagccccaucagaagccccguggugcccggcgaggugguggccauggacagacacuacuuccagaacaccggcgccuacgacagccugaugagccugagaggcggcgagaaccuggagcugagcuucaaggccuggcugugcggcggcagcguggagauccugcccugcagcagagugggccacaucuaccagaaccaggacagccacagcccccuggaccaggaggccacccugagaaacagagugagaaucgccgagaccuggcugggcagcuucaaggagaccuucuacaagcacagccccgaggccuucagccugagcaaggccgagaagcccgacugcauggagagacugcagcugcagagaagacugggcugcagaaccuuccacugguuccuggccaacguguaccccgagcuguaccccagcgagcccagacccagcuucagcggcaagcugcacaacaccggccugggccugugcgccgacugccaggccgagggcgacauccugggcugccccauggugcuggcccccugcagcgacagcagacagcagcaguaccugcagcacaccagcagaaaggagauccacuucggcagcccccagcaccugugcuucgccgugagacaggagcaggugauccugcagaacugcaccgaggagggccuggccauccaccagcagcacugggacuuccaggagaacggcaugaucgugcacauccugagcggcaagugcauggaggccguggugcaggagaacaacaaggaccuguaccugagacccugcgacggcaaggccagacagcaguggagauucgaccagaucaacgccguggacgagagauaa

SEQ ID NO: 17372 - RNA, 1824 nt, Artificial Sequence
  GALNT18__Homo_sapiens__NP_940918
auggugugcaccagaaagaccaagacccuggugagcaccugcgugauccugagcggcaugaccaacaucaucugccugcuguacgugggcugggugaccaacuacaucgccagcguguacgugagaggccaggagcccgcccccgacaagaagcuggaggaggacaagggcgacacccugaagaucaucgagagacuggaccaccuggagaacgugaucaagcagcacauccaggaggcccccgccaagcccgaggaggccgaggccgagcccuucaccgacagcagccuguucgcccacuggggccaggagcugagccccgagggcagaagaguggcccugaagcaguuccaguacuacggcuacaacgccuaccugagcgacagacugccccuggacagaccccugcccgaccugagacccagcggcugcagaaaccugagcuuccccgacagccugcccgaggugagcaucguguucaucuucgugaacgaggcccugagcgugcugcugagaagcauccacagcgccauggagagaacccccccccaccugcugaaggagaucauccugguggacgacaacagcagcaacgaggagcugaaggagaagcugaccgaguacguggacaaggugaacagccagaagcccggcuucaucaagguggugagacacagcaagcaggagggccugaucagaagcagagugagcggcuggagagccgccaccgcccccgugguggcccuguucgacgcccacguggaguucaacgugggcugggccgagcccgugcugaccagaaucaaggagaacagaaagagaaucaucagccccagcuucgacaacaucaaguacgacaacuucgagaucgaggaguacccccuggccgcccagggcuucgacugggagcuguggugcagauaccugaacccccccaaggccugguggaagcuggagaacagcaccgcccccaucagaagccccgcccugaucggcugcuucaucguggacagacaguacuuccaggagaucggccugcuggacgagggcauggagguguacggcggcgagaacguggagcugggcaucagaguguggcagugcggcggcagcguggaggugcugcccugcagcagaaucgcccacaucgagagagcccacaagcccuacaccgaggaccugaccgcccacgugagaagaaacgcccugagaguggccgagguguggauggacgaguucaagagccacguguacauggccuggaacaucccccaggaggacagcggcaucgacaucggcgacaucaccgccagaaaggcccugagaaagcagcugcagugcaagaccuucagaugguaccuggugagcguguaccccgagaugagaauguacagcgacaucaucgccuacggcgugcugcagaacagccugaagaccgaccugugccuggaccagggccccgacaccgagaacgugcccaucauguacaucugccacggcaugaccccccagaacguguacuacaccagcagccagcagauccacgugggcauccugagccccaccguggacgacgacgacaacagaugccugguggacgugaacagcagacccagacugaucgagugcagcuacgccaaggccaagagaaugaagcugcacuggcaguucagccagggcggccccauccagaacagaaagagcaagagaugccuggagcugcaggagaacagcgaccuggaguucggcuuccagcuggugcugcagaagugcagcggccagcacuggagcaucaccaacgugcugagaagccuggccagcuaa

SEQ ID NO: 17373 - RNA, 1680 nt, Artificial Sequence
  GALNT1__Homo_sapiens__XP_005258296
augagaaaguucgccuacugcaagguggugcuggccaccagccugaucugggugcugcuggacauguuccugcugcuguacuucagcgagugcaacaagugcgacgagaagaaggagagaggccugcccgccggcgacgugcuggagcccgugcagaagccccacgagggccccggcgagaugggcaagcccguggugauccccaaggaggaccaggagaagaugaaggagauguucaagaucaaccaguucaaccugauggccagcgagaugaucgcccugaacagaagccugcccgacgugagacuggagggcugcaagaccaagguguaccccgacaaccugcccaccaccagcguggugaucguguuccacaacgaggccuggagcacccugcugagaaccgugcacagcgugaucaacagaagccccagacacaugaucgaggagaucgugcugguggacgacgccagcgagagagacuuccugaagagaccccuggagagcuacgugaagaagcugaaggugcccgugcacgugaucagaauggagcagagaagcggccugaucagagccagacugaagggcgccgccgugagcaagggccaggugaucaccuuccuggacgcccacugcgagugcaccgugggcuggcuggagccccugcuggccagaaucaagcacgacagaagaaccguggugugccccaucaucgacgugaucagcgacgacaccuucgaguacauggccggcagcgacaugaccuacggcggcuucaacuggaagcugaacuucagaugguaccccgugccccagagagagauggacagaagaaagggcgacagaacccugcccgugagaacccccaccauggccggcggccuguucagcaucgacagagacuacuuccaggagaucggcaccuacgacgccggcauggacaucuggggcggcgagaaccuggagaucagcuucagaaucuggcagugcggcggcacccuggagaucgugaccugcagccacgugggccacguguucagaaaggccacccccuacaccuuccccggcggcaccggccagaucaucaacaagaacaacagaagacuggccgagguguggauggacgaguucaagaacuucuucuacaucaucagccccggcgugaccaagguggacuacggcgacaucagcagcagagugggccugagacacaagcugcagugcaagcccuucagcugguaccuggagaacaucuaccccgacagccagauccccagacacuacuucagccugggcgagaucagaaacguggagaccaaccagugccuggacaacauggccagaaaggagaacgagaaggugggcaucuucaacugccacggcaugggcggcaaccagguguucagcuacaccgccaacaaggagaucagaaccgacgaccugugccuggacgugagcaagcugaacggccccgugaccaugcugaagugccaccaccugaagggcaaccagcugugggaguacgaccccgugaagcugacccugcagcacgugaacagcaaccagugccuggacaaggccaccgaggaggacagccaggugcccagcaucagagacugcaacggcagcagaagccagcaguggcugcugagaaacgugacccugcccgagaucuucuaa

SEQ ID NO: 17374 - RNA, 1602 nt, Artificial Sequence
  GALNT2__Homo_sapiens__NP_001278795
auggccgacagagaggacuggaacgagaucgaccccaucaagaagaaggaccugcaccacagcaacggcgaggagaaggcccagagcauggagacccugccccccggcaaggugagauggcccgacuucaaccaggaggccuacgugggcggcaccauggugagaagcggccaggaccccuacgccagaaacaaguucaaccagguggagagcgacaagcugagaauggacagagccauccccgacaccagacacgaccagugccagagaaagcaguggagaguggaccugcccgccaccagcguggugaucaccuuccacaacgaggccagaagcgcccugcugagaaccguggugagcgugcugaagaagagccccccccaccugaucaaggagaucauccugguggacgacuacagcaacgaccccgaggacggcgcccugcugggcaagaucgagaaggugagagugcugagaaacgacagaagagagggccugaugagaagcagagugagaggcgccgacgccgcccaggccaaggugcugaccuuccuggacagccacugcgagugcaacgagcacuggcuggagccccugcuggagagaguggccgaggacagaaccagaguggugagccccaucaucgacgugaucaacauggacaacuuccaguacgugggcgccagcgccgaccugaagggcggcuucgacuggaaccugguguucaagugggacuacaugacccccgagcagagaagaagcagacagggcaaccccguggcccccaucaagacccccaugaucgccggcggccuguucgugauggacaaguucuacuucgaggagcugggcaaguacgacaugaugauggacguguggggcggcgagaaccuggagaucagcuucagaguguggcagugcggcggcagccuggagaucauccccugcagcagagugggccacguguucagaaagcagcaccccuacaccuuccccggcggcagcggcaccguguucgccagaaacaccagaagagccgccgagguguggauggacgaguacaagaacuucuacuacgccgccgugcccagcgccagaaacgugcccuacggcaacauccagagcagacuggagcugagaaagaagcugagcugcaagcccuucaagugguaccuggagaacguguaccccgagcugagagugcccgaccaccaggacaucgccuucggcgcccugcagcagggcaccaacugccuggacacccugggccacuucgccgacggcguggugggcguguacgagugccacaacgccggcggcaaccaggagugggcccugaccaaggagaagagcgugaagcacauggaccugugccugaccgugguggacagagcccccggcagccugaucaagcugcagggcugcagagagaacgacagcagacagaagugggagcagaucgagggcaacagcaagcugagacacgugggcagcaaccugugccuggacagcagaaccgccaagagcggcggccugagcguggaggugugcggccccgcccugagccagcaguggaaguucacccugaaccugcagcaguaa

SEQ ID NO: 17375 - RNA, 1902 nt, Artificial Sequence
  GALNT3__Homo_sapiens__NP_004473
auggcccaccugaagagacuggugaagcugcacaucaagagacacuaccacaagaaguucuggaagcugggcgccgugaucuucuucuucaucaucgugcuggugcugaugcagagagaggugagcgugcaguacagcaaggaggagagcagaauggagagaaacaugaagaacaagaacaagaugcuggaccugaugcuggaggccgugaacaacaucaaggacgccaugcccaagaugcagaucggcgcccccgugagacagaacaucgacgccggcgagagacccugccugcagggcuacuacaccgccgccgagcugaagcccgugcuggacagacccccccaggacagcaacgcccccggcgccagcggcaaggccuucaagaccaccaaccugagcguggaggagcagaaggagaaggagagaggcgaggccaagcacugcuucaacgccuucgccagcgacagaaucagccugcacagagaccugggccccgacaccagaccccccgagugcaucgagcagaaguucaagagaugccccccccugcccaccaccagcgugaucaucguguuccacaacgaggccuggagcacccugcugagaaccgugcacagcgugcuguacagcagccccgccauccugcugaaggagaucauccugguggacgacgccagcguggacgaguaccugcacgacaagcuggacgaguacgugaagcaguucagcaucgugaagaucgugagacagagagagagaaagggccugaucaccgccagacugcugggcgccaccguggccaccgccgagacccugaccuuccuggacgcccacugcgagugcuucuacggcuggcuggagccccugcuggccagaaucgccgagaacuacaccgccguggugagccccgacaucgccagcaucgaccugaacaccuucgaguucaacaagcccagccccuacggcagcaaccacaacagaggcaacuucgacuggagccugagcuucggcugggagagccugcccgaccacgagaagcagagaagaaaggacgagaccuaccccaucaagacccccaccuucgccggcggccuguucagcaucagcaaggaguacuucgaguacaucggcagcuacgacgaggagauggagaucuggggcggcgagaacaucgagaugagcuucagaguguggcagugcggcggccagcuggagaucaugcccugcagcguggugggccacguguucagaagcaagagcccccacagcuuccccaagggcacccaggugaucgccagaaaccaggugagacuggccgagguguggauggacgaguacaaggagaucuucuacagaagaaacaccgacgccgccaagaucgugaagcagaaggccuucggcgaccugagcaagagauucgagaucaagcacagacugcagugcaagaacuucaccugguaccugaacaacaucuaccccgagguguacgugcccgaccugaaccccgugaucagcggcuacaucaagagcgugggccagccccugugccuggacgugggcgagaacaaccagggcggcaagccccugaucauguacaccugccacggccugggcggcaaccaguacuucgaguacagcgcccagcacgagaucagacacaacauccagaaggagcugugccugcacgccgcccagggccuggugcagcugaaggccugcaccuacaagggccacaagaccguggugaccggcgagcagaucugggagauccagaaggaccagcugcuguacaaccccuuccugaagaugugccugagcgccaacggcgagcaccccagccuggugagcugcaaccccagcgacccccugcagaaguggauccugagccagaacgacuaa

SEQ ID NO: 17376 - RNA, 1737 nt, Artificial Sequence
  GALNT4__Homo_sapiens__NP_003765
auggccgugagauggaccugggccggcaagagcugccugcugcuggccuuccugaccguggccuacaucuucguggagcugcuggugagcaccuuccacgccagcgccggcgccggcagagccagagagcugggcagcagaagacugagcgaccugcagaagaacaccgaggaccugagcagaccccuguacaagaagccccccgccgacagcagagcccugggcgaguggggcaaggccagcaagcugcagcugaacgaggacgagcugaagcagcaggaggagcugaucgagagauacgccaucaacaucuaccugagcgacagaaucagccugcacagacacaucgaggacaagagaauguacgagugcaagagccagaaguucaacuacagaacccugcccaccaccagcgugaucaucgccuucuacaacgaggccuggagcacccugcugagaaccauccacagcgugcuggagaccagccccgccgugcugcugaaggagaucauccugguggacgaccugagcgacagaguguaccugaagacccagcuggagaccuacaucagcaaccuggacagagugagacugaucagaaccaacaagagagagggccuggugagagccagacugaucggcgccaccuucgccaccggcgacgugcugaccuuccuggacugccacugcgagugcaacagcggcuggcuggagccccugcuggagagaaucggcagagacgagaccgccguggugugccccgugaucgacaccaucgacuggaacaccuucgaguucuacaugcagaucggcgagcccaugaucggcggcuucgacuggagacugaccuuccaguggcacagcgugcccaagcaggagagagacagaagaaucagcagaaucgaccccaucagaagccccaccauggccggcggccuguucgccgugagcaagaaguacuuccaguaccugggcaccuacgacaccggcauggagguguggggcggcgagaaccuggagcugagcuucagaguguggcagugcggcggcaagcuggagauccaccccugcagccacgugggccacguguuccccaagagagcccccuacgccagacccaacuuccugcagaacaccgccagagccgccgagguguggauggacgaguacaaggagcacuucuacaacagaaacccccccgccagaaaggaggccuacggcgacaucagcgagagaaagcugcugagagagagacugagaugcaagagcuucgacugguaccugaagaacguguuccccaaccugcacgugcccgaggacagacccggcuggcacggcgccaucagaagcagaggcaucagcagcgagugccuggacuacaacagccccgacaacaaccccaccggcgccaaccugagccuguucggcugccacggccagggcggcaaccaguucuucgaguacaccagcaacaaggagaucagauucaacagcgugaccgagcugugcgccgaggugcccgagcagaagaacuacgugggcaugcagaacugccccaaggacggcuuccccgugcccgccaacaucaucuggcacuucaaggaggacggcaccaucuuccacccccacagcggccugugccugagcgccuacagaacccccgagggcagacccgacgugcagaugagaaccugcgacgcccuggacaagaaccagaucuggagcuucgagaaguaa

SEQ ID NO: 17377 - RNA, 2823 nt, Artificial Sequence
  GALNT5__Homo_sapiens__NP_055383
augaacagaaucagaaaguucuucagaggcagcggcagagugcuggccuucaucuucguggccagcgugaucuggcugcuguucgacauggccgcccugagacugagcuucagcgagaucaacaccagagugaucaaggaggacaucgugagaagagagagaaucggcuucagagugcagcccgaccagggcaagaucuucuacagcagcaucaaggagaugaagcccccccugagaggccacggcaagggcgccuggggcaaggagaacgugagaaagaccgaggagagcgugcugaagguggagguggaccuggaccagacccagagagagagaaagaugcagaacgcccugggcagaggcaagguggugccccuguggcaccccgcccaccugcagacccugcccgugacccccaacaagcagaagaccgacggcagaggcaccaagcccgaggccagcagccaccagggcacccccaagcagaccaccgcccagggcgcccccaagaccagcuucaucgccgccaagggcacccagguggugaagaucagcgugcacaugggcagagugagccugaagcaggagcccagaaagagccacagccccagcagcgacaccagcaagcuggccgccgagagagaccugaacgugaccaucagccugagcaccgacagacccaagcagagaagccaggccguggccaacgagagagcccaccccgccagcaccgccgugcccaagagcggcgaggccauggcccugaacaagaccaagacccagagcaaggaggugaacgccaacaagcacaaggccaacaccagccugcccuuccccaaguucaccgugaacagcaacagacugagaaagcagagcaucaacgagaccccccugggcagccugagcaaggacgacggcgccagaggcgcccacggcaagaagcugaacuucagcgagagccaccuggugaucaucaccaaggaggaggagcagaaggccgaccccaaggaggugagcaacagcaagaccaagaccaucuuccccaaggugcugggcaagagccagagcaagcacaucagcagaaacagaagcgagaugagcagcagcagccuggccccccacagagugccccugagccagaccaaccacgcccugaccggcggccuggagcccgccaagaucaacaucaccgccaaggcccccagcaccgaguacaaccagagccacaucaaggcccugcugcccgaggacagcggcacccaccaggugcugagaaucgacgugacccugagccccagagaccccaaggcccccggccaguucggcagacccgugguggugccccacggcaaggagaaggaggccgagagaagauggaaggagggcaacuucaacguguaccugagcgaccugauccccguggacagagccaucgaggacaccagacccgccggcugcgccgagcagcuggugcacaacaaccugcccaccaccagcgugaucaugugcuucguggacgagguguggagcacccugcugagaagcgugcacagcgugaucaacagaagccccccccaccugaucaaggagauccugcugguggacgacuucagcaccaaggacuaccugaaggacaaccuggacaaguacaugagccaguuccccaaggugagaauccugagacugaaggagagacacggccugaucagagccagacuggccggcgcccagaacgccaccggcgacgugcugaccuuccuggacagccacguggagugcaacgugggcuggcuggagccccugcuggagagaguguaccugagcagaaagaagguggccugccccgugaucgaggugaucaacgacaaggacaugagcuacaugaccguggacaacuuccagagaggcaucuucguguggcccaugaacuucggcuggagaaccaucccccccgacgugaucgccaagaacagaaucaaggagaccgacaccaucagaugccccgugauggccggcggccuguucagcaucgacaagagcuacuucuucgagcugggcaccuacgaccccggccuggacguguggggcggcgagaacauggagcugagcuucaagguguggaugugcggcggcgagaucgagaucauccccugcagcagagugggccacaucuucagaaacgacaaccccuacagcuuccccaaggacagaaugaagaccguggagagaaaccuggugagaguggccgagguguggcuggacgaguacaaggagcuguucuacggccacggcgaccaccugaucgaccagggccuggacgugggcaaccugacccagcagagagagcugagaaagaagcugaagugcaagagcuucaagugguaccuggagaacguguuccccgaccugagagcccccaucgugagagccagcggcgugcugaucaacguggcccugggcaagugcaucagcaucgagaacaccaccgugauccuggaggacugcgacggcagcaaggagcugcagcaguucaacuacaccuggcugagacugaucaagugcggcgaguggugcaucgcccccauccccgacaagggcgccgugagacugcaccccugcgacaacagaaacaagggccugaaguggcugcacaagagcaccagcguguuccaccccgagcuggugaaccacaucguguucgagaacaaccagcagcugcugugccuggagggcaacuucagccagaagauccugaagguggccgccugcgaccccgugaagcccuaccagaaguggaaguucgagaaguacuacgaggccuaa

SEQ ID NO: 17378 - RNA, 1869 nt, Artificial Sequence
  GALNT6__Homo_sapiens__XP_006719277
augagacugcugagaagaagacacaugccccugagacuggccauggugggcugcgccuucgugcuguuccuguuccugcugcacagagacgugagcagcagagaggaggccaccgagaagcccuggcugaagagccuggugagcagaaaggaccacgugcuggaccugaugcuggaggccaugaacaaccugagagacagcaugcccaagcugcagaucagagcccccgaggcccagcagacccuguucagcaucaaccagagcugccugcccggcuucuacacccccgccgagcugaagcccuucugggagagacccccccaggaccccaacgcccccggcgccgacggcaaggccuuccagaagagcaaguggaccccccuggagacccaggagaaggaggagggcuacaagaagcacugcuucaacgccuucgccagcgacagaaucagccugcagagaagccugggccccgacaccagaccccccgagugcguggaccagaaguucagaagaugccccccccuggccaccaccagcgugaucaucguguuccacaacgaggccuggagcacccugcugagaaccguguacagcgugcugcacaccacccccgccauccugcugaaggagaucauccugguggacgacgccagcaccgaggagcaccugaaggagaagcuggagcaguacgugaagcagcugcagguggugagaguggugagacaggaggagagaaagggccugaucaccgccagacugcugggcgccagcguggcccaggccgaggugcugaccuuccuggacgcccacugcgagugcuuccacggcuggcuggagccccugcuggccagaaucgccgaggacaagaccgugguggugagccccgacaucgugaccaucgaccugaacaccuucgaguucgccaagcccgugcagagaggcagagugcacagcagaggcaacuucgacuggagccugaccuucggcugggagacccugcccccccacgagaagcagagaagaaaggacgagaccuaccccaucaagagccccaccuucgccggcggccuguucagcaucagcaagagcuacuucgagcacaucggcaccuacgacaaccagauggagaucuggggcggcgagaacguggagaugagcuucagaguguggcagugcggcggccagcuggagaucauccccugcagcguggugggccacguguucagaaccaagagcccccacaccuuccccaagggcaccagcgugaucgccagaaaccaggugagacuggccgagguguggauggacagcuacaagaagaucuucuacagaagaaaccugcaggccgccaagauggcccaggagaagagcuucggcgacaucagcgagagacugcagcugagagagcagcugcacugccacaacuucagcugguaccugcacaacguguaccccgagauguucgugcccgaccugacccccaccuucuacggcgccaucaagaaccugggcaccaaccagugccuggacgugggcgagaacaacagaggcggcaagccccugaucauguacagcugccacggccugggcggcaaccaguacuucgaguacaccacccagagagaccugagacacaacaucgccaagcagcugugccugcacgugagcaagggcgcccugggccugggcagcugccacuucaccggcaagaacagccaggugcccaaggacgaggagugggagcuggcccaggaccagcugaucagaaacagcggcagcggcaccugccugaccagccaggacaagaagcccgccauggcccccugcaaccccagcgacccccaccagcuguggcuguucguguaa

SEQ ID NO: 17379 - RNA, 1974 nt, Artificial Sequence
  GALNT7__Homo_sapiens__NP_059119
augagacugaagaucggcuucauccugagaagccugcugguggugggcagcuuccugggccugguggugcuguggagcagccugacccccagacccgacgaccccagcccccugagcagaaugagagaggacagagacgugaacgaccccaugcccaacagaggcggcaacggccuggcccccggcgaggacagauucaagcccguggugcccuggccccacguggagggcguggagguggaccuggagagcaucagaagaaucaacaaggccaagaacgagcaggagcaccacgccggcggcgacagccagaaggacaucaugcagagacaguaccugaccuucaagccccagaccuucaccuaccacgaccccgugcugagacccggcauccugggcaacuucgagcccaaggagcccgagccccccggcguggugggcggccccggcgagaaggccaagccccuggugcugggccccgaguucaagcaggccauccaggccagcaucaaggaguucggcuucaacaugguggccagcgacaugaucagccuggacagaagcgugaacgaccugagacaggaggagugcaaguacuggcacuacgacgagaaccugcugaccagcagcguggugaucguguuccacaacgagggcuggagcacccugaugagaaccgugcacagcgugaucaagagaacccccagaaaguaccuggccgagaucgugcugaucgacgacuucagcaacaaggagcaccugaaggagaagcuggacgaguacaucaagcuguggaacggccuggugaagguguucagaaacgagagaagagagggccugauccaggccagaagcaucggcgcccagaaggccaagcugggccaggugcugaucuaccuggacgcccacugcgagguggccgugaacugguacgccccccugguggcccccaucagcaaggacagaaccaucugcaccgugccccugaucgacgugaucaacggcaacaccuacgagaucaucccccagggcggcggcgacgaggacggcuacgccagaggcgccugggacuggagcaugcuguggaagagagugccccugaccccccaggagaagagacugagaaagaccaagaccgagcccuacagaagccccgccauggccggcggccuguucgccaucgagagagaguucuucuucgagcugggccuguacgaccccggccugcagaucuggggcggcgagaacuucgagaucagcuacaagaucuggcagugcggcggcaagcugcuguucgugcccugcagcagagugggccacaucuacagacuggagggcuggcagggcaaccccccccccaucuacgugggcagcagccccacccugaagaacuacgugagagugguggagguguggugggacgaguacaaggacuacuucuacgccagcagacccgagagccaggcccugcccuacggcgacaucagcgagcugaagaaguucagagaggaccacaacugcaagagcuucaagugguucauggaggagaucgccuacgacaucaccagccacuacccccugccccccaagaacguggacuggggcgagaucagaggcuucgagaccgccuacugcaucgacagcaugggcaagaccaacggcggcuucguggagcugggccccugccacagaaugggcggcaaccagcuguucagaaucaacgaggccaaccagcugaugcaguacgaccagugccugaccaagggcgccgacggcagcaaggugaugaucacccacugcaaccugaacgaguucaaggaguggcaguacuucaagaaccugcacagauucacccacauccccagcggcaagugccuggacagaagcgaggugcugcaccagguguucaucagcaacugcgacagcagcaagaccacccagaagugggagaugaacaacauccacagcguguaa

SEQ ID NO: 17380 - RNA, 1914 nt, Artificial Sequence
  GALNT8__Homo_sapiens__NP_059113
augauguucuggagaaagcugcccaaggcccuguucaucggccugacccuggccaucgccgugaaccugcugcugguguucagcagcaagggcacccugcagaaccuguucaccggcggccugcacagagagcugccccugcaccugaacaagagauacggcgccgugaucaagagacugagccaccuggagguggagcugcaggaccugaaggagagcaugaagcuggcccugagacagcaggagaacgugaacagcacccugaagagagccaaggacgaggugagaccccugcugaaggccauggagaccaaggugaacgagaccaagaagcacaagacccagaugaagcuguucccccacagccagcuguucagacaguggggcgaggaccugagcgaggcccagcagaaggccgcccaggaccuguucagaaaguucggcuacaacgccuaccugagcaaccagcugccccugaacagaaccauccccgacaccagagacuacagaugccugagaaagaccuaccccagccagcugcccagccugagcgugauccugaucuucgugaacgaggcccugagcaucauccagagagccaucaccagcaucaucaacagaacccccagcagacugcugaaggagaucauccugguggacgacuucagcagcaacggcgagcugaaggugcaccuggacgagaagaucaagcuguacaaccagaaguaccccggccugcugaagaucaucagacaccccgagagaaagggccuggcccaggccagaaacaccggcugggaggccgccaccgccgacgugguggccauccuggacgcccacaucgaggugaacgugggcugggccgagcccauccuggccagaauccaggaggacagaaccgugaucgugagccccguguucgacaacaucagauucgacaccuucaagcuggacaaguacgagcuggccguggacggcuucaacugggagcuguggugcagauacgacgcccugccccaggccuggaucgaccugcacgacgugaccgcccccgugaagagccccagcaucaugggcauccuggccgccaacagacacuuccugggcgagaucggcagccuggacggcggcaugcugaucuacggcggcgagaacguggagcugagccugagaguguggcagugcggcggcaagguggagauccugcccugcagcagaaucgcccaccuggagagacaccacaagcccuacgcccuggaccugaccgccgcccugaagagaaacgcccugagaguggccgagaucuggauggacgagcacaagcacaugguguaccuggccuggaacaucccccugcagaacagcggcaucgacuucggcgacgugagcagcagaauggcccugagagagaagcugaagugcaagaccuucgacugguaccugaagaacguguacccccugcugaagccccugcacaccaucgugggcuacggcagaaugaagaaccugcuggacgagaacgugugccuggaccagggccccgugcccggcaacacccccaucauguacuacugccacgaguucagcagccagaacguguacuaccaccugaccggcgagcuguacgugggccagcugaucgccgaggccagcgccagcgacagaugccugaccgaccccggcaaggccgagaagcccacccuggagcccugcagcaaggccgccaagaacagacugcacaucuacugggacuucaagcccggcggcgccgugaucaacagagacaccaagagaugccuggagaugaagaaggaccugcugggcagccacgugcuggugcugcagaccugcagcacccaggugugggagauccagcacaccgugagagacuggggccagaccaacagccaguaa

SEQ ID NO: 17381 - RNA, 1812 nt, Artificial Sequence
  GALNT9__Homo_sapiens__NP_001116108
auggccguggccagaaagaucagaacccugcugaccgugaacauccugguguucgugggcaucgugcuguucagcguguacugcagacugcagggcagaagccaggagcuggugagaaucgugagcggcgacagaagagugagaagcagacacgccaaggugggcacccugggcgacagagaggccauccugcagagacuggaccaccuggaggaggugguguacaaccagcugaacggccuggccaagcccaucggccugguggagggccccggcggccugggccagggcggccuggccgccacccugagagacgacggccaggaggccgagggcaaguacgaggaguacggcuacaacgcccagcugagcgacagaaucagccuggacagaagcauccccgacuacagacccagaaagugcagacagaugagcuacgcccaggaccugccccaggugagcgugguguucaucuucgugaacgaggcccugagcgugauccugagaagcgugcacagcguggugaaccacacccccagccagcugcugaaggaggugauccugguggacgacaacagcgacaacguggagcugaaguucaaccuggaccaguacgugaacaagagauaccccggccuggugaagaucgugagaaacagcagaagagagggccugaucagagccagacugcagggcuggaaggccgccaccgcccccguggugggcuucuucgacgcccacguggaguucaacaccggcugggccgagcccgcccugagcagaaucagagaggacagaagaagaaucgugcugcccgccaucgacaacaucaaguacagcaccuucgaggugcagcaguacgccaacgccgcccacggcuacaacuggggccuguggugcauguacaucauccccccccaggacuggcuggacagaggcgacgagagcgcccccaucagaacccccgccaugaucggcugcagcuucgugguggacagagaguacuucggcgacaucggccugcuggaccccggcauggagguguacggcggcgagaacguggagcugggcaugagaguguggcagugcggcggcagcauggaggugcugcccugcagcagaguggcccacaucgagagaaccagaaagcccuacaacaacgacaucgacuacuacgccaagagaaacgcccugagagccgccgagguguggauggacgacuucaagagccacguguacauggccuggaacauccccaugagcaaccccggcguggacuucggcgacgugagcgagagacuggcccugagacagagacugaagugcagaagcuucaagugguaccuggagaacguguaccccgagaugagaguguacaacaacacccugaccuacggcgaggugagaaacagcaaggccagcgccuacugccuggaccagggcgccgaggacggcgacagagccauccuguaccccugccacggcaugagcagccagcuggugagauacagcgccgacggccugcugcagcugggcccccugggcagcaccgccuuccugcccgacagcaagugccugguggacgacggcaccggcagaaugcccacccugaagaagugcgaggacguggccagacccacccagagacugugggacuucacccagagcggccccaucgugagcagagccaccggcagaugccuggagguggagaugagcaaggacgccaacuucggccugagacugguggugcagagaugcagcggccagaaguggaugaucagaaacuggaucaagcacgccagacacuaa

SEQ ID NO: 17382 - RNA, 1806 nt, Artificial Sequence
  GALNTL6__Homo_sapiens__NP_001030017
augaagagaaagcagaagagauuccugcagaugacccugcuguucaccguggcccugaucuuccugcccaacgugggccuguggagccuguacaaggacaagcaccuggugaagagcgccgagcccggcgagcagcagaccuucccccugggccugggcgacggccaguucuacagcuggaccgacggccugagaagaaaggacuggcacgacuacgagagcauccagaaggaggccaugagaagcggcaagggcgagcacggcaagcccuacccccugaccgaggaggaccacgacgacagcgccuacagagagaacggcuucaacaucuucgugagcaacaacaucgcccuggagagaagccugcccgacaucagacacgccaacugcaagcacaagauguaccuggagagacugcccaacaccagcaucaucauccccuuccacaacgagggcuggaccagccugcugagaaccauccacagcaucaucaacagaacccccggcagccugaucgccgagaucauccugguggacgacuucagcgagagagagcaccugaaggacaagcuggaggaguacauggccagauucagcaaggugagaaucgugagaaccaagaagagagagggccugaucagaaccagacugcugggcgccagcauggccagaggcgaggugcugaccuuccuggacagccacugcgaggugaacgugaacuggcugcccccccugcugaaccagaucgcccugaaccacaagaccaucgugugccccaugaucgacgugaucgaccacaaccacuucggcuacgaggcccaggccggcgacgccaugagaggcgccuucgacugggagauguacuacaagagaauccccaucccccccgagcugcagagagccgaccccagcgaccccuucgagagccccgugauggccggcggccuguucgccguggacagaaagugguucugggagcugggcggcuacgaccccggccuggagaucuggggcggcgagcaguacgagaucagcuucaagguguggaugugcggcggcgagauguucgacgugcccugcagcagagugggccacaucuacagaaaguacgugcccuacaaggugcccagcggcaccagccuggccagaaaccugaagagaguggccgagaccuggauggacgaguucgccgaguacaucuaccagagaagacccgaguacagacaccugagcaccggcgacaucagcgcccagaaggagcugagaaagcagcugaagugcaaggacuucaagugguucauggccgccguggccugggacgugcccaaguacuacccccccguggagcccccccccgccgccuggggcgagaucagaaacguggccgccaaccugugcguggacagcaagcacggcgccaccggcaccgagcugagacuggacaucugcgugaaggacggcagcgagagaaccuggagccacgagcagcuguucaccuucggcuggagagaggacaucagacccggcgagccccugcacaccagaaaguucugcuucgacgccaucagccacaacagccccgugacccuguacgacugccacggcaugaagggcaaccagcuguggggcuacagaaaggacagaacccuguuccaccccgugagcaacagcugcauggacugcaaccccgccgagaagaagaucuucauggccagaugcgacccccugagcgagacccagcaguggaucuucgagcacaucaacaugaccgugcuggagaaguucaaccaccacgccaacagcuaa

SEQ ID NO: 17383 - RNA, 150 nt, Artificial Sequence
  GALP__Homo_sapiens__NP_001139018
auggccccccccagcgugccccuggugcugcugcuggugcugcugcugagccuggccgagacccccgccagcgcccccgcccacagaagcagcaccuuccccaagugggugaccaagaccgagagaggcagacagccccugagaagcuaa

SEQ ID NO: 17384 - RNA, 1050 nt, Artificial Sequence
  GALR1__Homo_sapiens__NP_001471
auggagcuggccgugggcaaccugagcgagggcaacgccagcuggcccgagccccccgcccccgagcccggcccccuguucggcaucggcguggagaacuucgugacccuggugguguucggccugaucuucgcccugggcgugcugggcaacagccuggugaucaccgugcuggccagaagcaagcccggcaagcccagaagcaccaccaaccuguucauccugaaccugagcaucgccgaccuggccuaccugcuguucugcauccccuuccaggccaccguguacgcccugcccaccugggugcugggcgccuucaucugcaaguucauccacuacuucuucaccgugagcaugcuggugagcaucuucacccuggccgccaugagcguggacagauacguggccaucgugcacagcagaagaagcagcagccugagagugagcagaaacgcccugcugggcgugggcugcaucugggcccugagcaucgccauggccagccccguggccuaccaccagggccuguuccaccccagagccagcaaccagaccuucugcugggagcaguggcccgaccccagacacaagaaggccuacguggugugcaccuucguguucggcuaccugcugccccugcugcugaucugcuucugcuacgccaaggugcugaaccaccugcacaagaagcugaagaacaugagcaagaagagcgaggccagcaagaagaagaccgcccagaccgugcugguggugguggugguguucggcaucagcuggcugccccaccacaucauccaccugugggccgaguucggcguguucccccugacccccgccagcuuccuguucagaaucaccgcccacugccuggccuacagcaacagcagcgugaaccccaucaucuacgccuuccugagcgagaacuucagaaaggccuacaagcagguguucaagugccacaucagaaaggacagccaccugagcgacaccaaggagagcaagagcagaaucgacaccccccccagcaccaacugcacccacguguaa

SEQ ID NO: 17385 - RNA, 1164 nt, Artificial Sequence
  GALR2__Homo_sapiens__NP_003848
augaacgugagcggcugccccggcgccggcaacgccagccaggccggcggcggcggcggcuggcaccccgaggccgugaucgugccccugcuguucgcccugaucuuccuggugggcaccgugggcaacacccuggugcuggccgugcugcugagaggcggccaggccgugagcaccaccaaccuguucauccugaaccugggcguggccgaccugugcuucauccugugcugcgugcccuuccaggccaccaucuacacccuggacggcuggguguucggcagccugcugugcaaggccgugcacuuccugaucuuccugaccaugcacgccagcagcuucacccuggccgccgugagccuggacagauaccuggccaucagauacccccugcacagcagagagcugagaacccccagaaacgcccuggccgccaucggccugaucuggggccugagccugcuguucagcggccccuaccugagcuacuacagacagagccagcuggccaaccugaccgugugccaccccgccuggagcgcccccagaagaagagccauggacaucugcaccuucguguucagcuaccugcugcccgugcuggugcugggccugaccuacgccagaacccugagauaccuguggagagccguggaccccguggccgccggcagcggcgccagaagagccaagagaaaggugaccagaaugauccugaucguggccgcccuguucugccugugcuggaugccccaccacgcccugauccugugcgugugguucggccaguucccccugaccagagccaccuacgcccugagaauccugagccaccuggugagcuacgccaacagcugcgugaaccccaucguguacgcccuggugagcaagcacuucagaaagggcuucagaaccaucugcgccggccugcugggcagagcccccggcagagccagcggcagagugugcgccgccgccagaggcacccacagcggcagcgugcuggagagagagagcagcgaccugcugcacaugagcgaggccgccggcgcccugagacccugccccggcgccagccagcccugcauccuggagcccugccccggccccagcuggcagggccccaaggccggcgacagcauccugaccguggacguggccuaa

SEQ ID NO: 17386 - RNA, 1107 nt, Artificial Sequence
  GALR3__Homo_sapiens__XP_011528770
auggccgacgcccagaacaucagccuggacagccccggcagcgugggcgccguggccgugcccgugguguucgcccugaucuuccugcugggcaccgugggcaacggccuggugcuggccgugcugcugcagcccggccccagcgccuggcaggagcccggcagcaccaccgaccuguucauccugaaccuggccguggccgaccugugcuucauccugugcugcgugcccuuccaggccaccaucuacacccuggacgccuggcuguucggcgcccuggugugcaaggccgugcaccugcugaucuaccugaccauguacgccagcagcuucacccuggccgccgugagcguggacagauaccuggccgugagacacccccugagaagcagagcccugagaacccccagaaacgccagagccgccgugggccugguguggcugcuggccgcccuguucagcgcccccuaccugagcuacuacggcaccgugagauacggcgcccuggagcugugcgugcccgccugggaggacgccagaagaagagcccuggacguggccaccuucgccgccggcuaccugcugcccguggccguggugagccuggccuacggcagaacccugagauuccugugggccgccgugggccccgccggcgccgccgccgccgaggccagaagaagagccaccggcagagccggcagagccaugcuggccguggccgcccuguacgcccugugcuggggcccccaccacgcccugauccugugcuucugguacggcagauucgccuucagccccgccaccuacgccugcagacuggccagccacugccuggccuacgccaacagcugccugaacccccugguguacgcccuggccagcagacacuucagagccagauucagaagacuguggcccugcggcagaagaagaagacacagagccagaagagcccugagaagagugagacccgccagcagcggcccccccggcugccccggcgacgccagacccagcggcagacugcuggccggcggcggccagggccccgagcccagagagggccccgugcacggcggcgaggccgccagaggccccgaguaa

SEQ ID NO: 17387 - RNA, 1140 nt, Artificial Sequence
  GALT__Homo_sapiens__NP_000146
augagcagaagcggcaccgacccccagcagagacagcaggccagcgaggccgacgccgccgccgccaccuucagagccaacgaccaccagcacaucagauacaacccccugcaggacgagugggugcuggugagcgcccacagaaugaagagacccuggcagggccagguggagccccagcugcugaagaccgugcccagacacgacccccugaacccccugugccccggcgccaucagagccaacggcgaggugaacccccaguacgacagcaccuuccuguucgacaacgacuuccccgcccugcagcccgacgcccccagccccggccccagcgaccacccccuguuccaggccaagagcgccagaggcgugugcaaggugaugugcuuccaccccuggagcgacgugacccugccccugaugagcgugcccgagaucagagccgugguggacgccugggccagcgugaccgaggagcugggcgcccaguaccccugggugcagaucuucgagaacaagggcgccaugaugggcugcagcaacccccacccccacugccaggugugggccagcagcuuccugcccgacaucgcccagagagaggagagaagccagcaggccuacaagagccagcacggcgagccccugcugauggaguacagcagacaggagcugcugagaaaggagagacuggugcugaccagcgagcacuggcuggugcuggugcccuucugggccaccuggcccuaccagacccugcugcugcccagaagacacgugagaagacugcccgagcugacccccgccgagagagacgaccuggccagcaucaugaagaagcugcugaccaaguacgacaaccuguucgagaccagcuuccccuacagcaugggcuggcacggcgcccccaccggcagcgaggccggcgccaacuggaaccacuggcagcugcacgcccacuacuaccccccccugcugagaagcgccaccgugagaaaguucauggugggcuacgagaugcuggcccaggcccagagagaccugacccccgagcaggccgccgagagacugagagcccugcccgaggugcacuaccaccugggccagaaggacagagagaccgccaccaucgccuaa

SEQ ID NO: 17388 - RNA, 711 nt, Artificial Sequence
  GAMT__Homo_sapiens__NP_000147
augagcgcccccagcgccacccccaucuucgcccccggcgagaacugcagccccgccuggggcgccgcccccgccgccuacgacgccgccgacacccaccugagaauccugggcaagcccgugauggagagaugggagacccccuacaugcacgcccuggccgccgccgccagcagcaagggcggcagagugcuggaggugggcuucggcauggccaucgccgccagcaaggugcaggaggcccccaucgacgagcacuggaucaucgagugcaacgacggcguguuccagagacugagagacugggcccccagacagacccacaaggugaucccccugaagggccugugggaggacguggcccccacccugcccgacggccacuucgacggcauccuguacgacaccuacccccugagcgaggagaccuggcacacccaccaguucaacuucaucaagaaccacgccuucagacugcugaagcccggcggcgugcugaccuacugcaaccugaccagcuggggcgagcugaugaagagcaaguacagcgacaucaccaucauguucgaggagacccaggugcccgcccugcuggaggccggcuucagaagagagaacaucagaaccgaggugauggcccuggugccccccgccgacugcagauacuacgccuucccccagaugaucaccccccuggugaccaagggcuaa

SEQ ID NO: 17389 - RNA, 2544 nt, Artificial Sequence
  GANAB__Homo_sapiens__NP_001265123
augaccagauucagaaucgacgagcuggagcccagaagacccagauacagagugcccgacgugcugguggccgacccccccaucgccagacugagcgugagcggcagagacgagaacagcguggagcugaccauggccgagggccccuacaagaucauccugaccgccagacccuucagacuggaccugcuggaggacagaagccugcugcugagcgugaacgccagaggccugcuggaguucgagcaccagagagcccccagagugagccagggcagcaaggaccccgccgagggcgacggcgcccagcccgaggagacccccagagacggcgacaagcccgaggagacccagggcaaggccgagaaggacgagcccggcgccugggaggagaccuucaagacccacagcgacagcaagcccuacggccccaugagcgugggccuggacuucagccugcccggcauggagcacguguacggcauccccgagcacgccgacaaccugagacugaaggugaccgagggcggcgagcccuacagacuguacaaccuggacguguuccaguacgagcuguacaaccccauggcccuguacggcagcgugcccgugcugcuggcccacaacccccacagagaccugggcaucuucuggcugaacgccgccgagaccuggguggacaucagcagcaacaccgccggcaagacccuguucggcaagaugauggacuaccugcagggcagcggcgagaccccccagaccgacgugagauggaugagcgagaccggcaucaucgacguguuccugcugcugggccccagcaucagcgacguguucagacaguacgccagccugaccggcacccaggcccugcccccccuguucagccugggcuaccaccagagcagauggaacuacagagacgaggccgacgugcuggagguggaccagggcuucgacgaccacaaccugcccugcgacgugaucuggcuggacaucgagcacgccgacggcaagagauacuucaccugggaccccagcagauucccccagcccagaaccaugcuggagagacuggccagcaagagaagaaagcugguggccaucguggacccccacaucaagguggacagcggcuacagagugcacgaggagcugagaaaccugggccuguacgugaagaccagagacggcagcgacuacgagggcuggugcuggcccggcagcgccggcuaccccgacuucaccaaccccaccaugagagccuggugggccaacauguucagcuacgacaacuacgagggcagcgcccccaaccuguucguguggaacgacaugaacgagcccagcguguucaacggccccgaggugaccaugcugaaggacgcccagcacuacggcggcugggagcacagagacgugcacaacaucuacggccuguacgugcacauggccaccgccgacggccugagacagagaagcggcggcauggagagacccuucgugcuggccagagccuucuucgccggcagccagagauucggcgccguguggaccggcgacaacaccgccgagugggaccaccugaagaucagcauccccaugugccugagccugggccuggugggccugagcuucugcggcgccgacgugggcggcuucuucaagaaccccgagcccgagcugcuggugagaugguaccagaugggcgccuaccagcccuucuucagagcccacgcccaccuggacaccggcagaagagagcccuggcugcugcccagccagcacaacgacaucaucagagacgcccugggccagagauacagccugcugcccuucugguacacccugcuguaccaggcccacagagagggcauccccgugaugagaccccugugggugcaguacccccaggacgugaccaccuucaacaucgacgaccaguaccugcugggcgacgcccugcuggugcaccccgugagcgacagcggcgcccacggcgugcagguguaccugcccggccagggcgaggugugguacgacauccagagcuaccagaagcaccacggcccccagacccuguaccugcccgugacccugagcagcauccccguguuccagagaggcggcaccaucgugcccagauggaugagagugagaagaagcagcgagugcaugaaggacgaccccaucacccuguucguggcccugagcccccagggcaccgcccagggcgagcuguuccuggacgacggccacaccuucaacuaccagaccagacaggaguuccugcugagaagauucagcuucagcggcaacacccuggugagcagcagcgccgaccccgagggccacuucgagacccccaucuggaucgagagaguggugaucaucggcgccggcaagcccgccgccguggugcugcagaccaagggcagccccgagagcagacugagcuuccagcacgaccccgagaccagcgugcuggugcugagaaagcccggcaucaacguggccagcgacuggagcauccaccugagauaa

SEQ ID NO: 17390 - RNA, 849 nt, Artificial Sequence
  GANC__Homo_sapiens__NP_001288339
auggaggccgccgugaaggaggagaucagccuggaggacgaggccguggacaagaacaucuucagagacugcaacaagaucgccuucuacagaagacagaagcaguggcugagcaagaagagcaccuaccaggcccugcuggacagcgugaccaccgacgaggacagcaccagauuccagaucaucaacgaggccagcaaggugagaugccaggaccagagccccaccacccuggacgccuucaagggcaaggagaccaccgugcaggaggagacccaggaccugagcaccagacagcaccuggcccagaaggaggccgaggagcccgacaagcagggccagaucaccugggacaucagcaacguggcccccaagaccgagaacuucgaggaccugcuggagcagacccccugcagcgccugccugcagggcuucaccagagacaacaccagcagcagcuucagcgaggacgccggcaucagccugagcaccagcgugaagcugccccuggccagcagcagcaagcccaacgagaacgaggcccugcccaaccagccccccagccagcagaucagacacaacuacagacugcuggccagcaccgugagcgccgagauggccagaaacagacagcugaucugggagcuggccagacagagcgaggcccaccuggacagacccguggugcugggcgagcaggccagcgcccagagagagguggccagcauccugugcagaaagagcgugcuggccaucaaccagcuggccgccaccguggagggcaccaucagcgugcugcagcaguucaacgagcugcuggaccacccccuggaccccggcagaagcuaa

SEQ ID NO: 17391 - RNA, 1794 nt, Artificial Sequence
  GAN__Homo_sapiens__NP_071324
auggccgagggcagcgccgugagcgacccccagcacgccgccagacugcugagagcccugagcagcuucagagaggagagcagauucugcgacgcccaccuggugcuggacggcgaggagauccccgugcagaagaacauccuggccgccgccagccccuacaucagaaccaagcugaacuacaacccccccaaggacgacggcagcaccuacaagaucgagcuggagggcaucagcgugauggugaugagagagauccuggacuacaucuucagcggccagaucagacugaacgaggacaccauccaggacguggugcaggccgccgaccugcugcugcugaccgaccugaagacccugugcugcgaguuccuggagggcugcaucgccgccgagaacugcaucggcaucagagacuucgcccugcacuacugccugcaccacgugcacuaccuggccaccgaguaccuggagacccacuucagagacgugagcagcaccgaggaguuccuggagcugagcccccagaagcugaaggaggugaucagccuggagaagcugaacgugggcaacgagagauacguguucgaggccgugaucagauggaucgcccacgacaccgagaucagaaaggugcacaugaaggacgugaugagcgcccugugggugagcggccuggacagcagcuaccugagagagcagaugcugaacgagccccuggugagagagaucgugaaggagugcagcaacaucccccugagccagccccagcagggcgaggccaugcuggccaacuucaagcccagaggcuacagcgagugcaucgugaccgugggcggcgaggagagagugagcagaaagcccaccgccgccaugagaugcaugugcccccuguacgaccccaacagacagcuguggaucgagcuggccccccugagcaugcccagaaucaaccacggcgugcugagcgccgagggcuuccuguucguguucggcggccaggacgagaacaagcagacccugagcagcggcgagaaguacgaccccgacgccaacaccuggaccgcccugccccccaugaacgaggccagacacaacuucggcaucguggagaucgacggcaugcuguacauccugggcggcgaggacggcgagaaggagcugaucagcauggagugcuacgacaucuacagcaagaccuggaccaagcagcccgaccugaccauggugagaaagaucggcugcuacgccgccaugaagaagaagaucuacgccaugggcggcggcagcuacggcaagcuguucgagagcguggagugcuacgaccccagaacccagcaguggaccgccaucugcccccugaaggagagaagauucggcgccguggccugcggcguggccauggagcuguacguguucggcggcgugagaagcagagaggacgcccagggcagcgagauggugaccugcaagagcgaguucuaccacgacgaguucaagagauggaucuaccugaacgaccagaaccugugcauccccgccagcagcagcuucguguacggcgccgugcccaucggcgccagcaucuacgugaucggcgaccuggacaccggcaccaacuacgacuacgugagagaguucaagagaagcaccggcaccuggcaccacaccaagccccugcugcccagcgaccugagaagaaccggcugcgccgcccugagaaucgccaacugcaagcuguucagacugcagcugcagcagggccuguucagaaucagagugcacagccccuaa

SEQ ID NO: 17392 - RNA, 825 nt, Artificial Sequence
  GAP43__Homo_sapiens__NP_001123536
augaccaagagcugcagcgagcugugccaccccgcccugcacuuccugcccugccugggcggccugagaaagaaccugcagagagccgugagacccagccccuacagccugggcuuccugaccuucuggaucagcagaguggagaagaacgacgacgaccagaagaucgagcaggacggcaucaagcccgaggacaaggcccacaaggccgccaccaagauccaggccagcuucagaggccacaucaccagaaagaagcugaagggcgagaagaaggacgacgugcaggccgccgaggccgaggccaacaagaaggacgaggcccccguggccgacggcguggagaagaagggcgagggcaccaccaccgccgaggccgcccccgccaccggcagcaagcccgacgagcccggcaaggccggcgagacccccagcgaggagaagaagggcgagggcgacgccgccaccgagcaggccgccccccaggcccccgccagcagcgaggagaaggccggcagcgccgagaccgagagcgccaccaaggccagcaccgacaacagccccagcagcaaggccgaggacgcccccgccaaggaggagcccaagcaggccgacgugcccgccgccgugaccgccgccgccgccaccacccccgccgccgaggacgccgccgccaaggccaccgcccagccccccaccgagaccggcgagagcagccaggccgaggagaacaucgaggccguggacgagaccaagcccaaggagagcgccagacaggacgagggcaaggaggaggagcccgaggccgaccaggagcacgccuaa

SEQ ID NO: 17393 - RNA, 882 nt, Artificial Sequence
  GAPDH__Homo_sapiens__NP_001243728
augguguacauguuccaguacgacagcacccacggcaaguuccacggcaccgugaaggccgagaacggcaagcuggugaucaacggcaaccccaucaccaucuuccaggagagagaccccagcaagaucaaguggggcgacgccggcgccgaguacgugguggagagcaccggcguguucaccaccauggagaaggccggcgcccaccugcagggcggcgccaagagagugaucaucagcgcccccagcgccgacgcccccauguucgugaugggcgugaaccacgagaaguacgacaacagccugaagaucaucagcaacgccagcugcaccaccaacugccuggccccccuggccaaggugauccacgacaacuucggcaucguggagggccugaugaccaccgugcacgccaucaccgccacccagaagaccguggacggccccagcggcaagcuguggagagacggcagaggcgcccugcagaacaucauccccgccagcaccggcgccgccaaggccgugggcaaggugauccccgagcugaacggcaagcugaccggcauggccuucagagugcccaccgccaacgugagcgugguggaccugaccugcagacuggagaagcccgccaaguacgacgacaucaagaagguggugaagcaggccagcgagggcccccugaagggcauccugggcuacaccgagcaccagguggugagcagcgacuucaacagcgacacccacagcagcaccuucgacgccggcgccggcaucgcccugaacgaccacuucgugaagcugaucagcugguacgacaacgaguucggcuacagcaacagagugguggaccugauggcccacauggccagcaaggaguaa

SEQ ID NO: 17394 - RNA, 1227 nt, Artificial Sequence
  GAPDHS__Homo_sapiens__NP_055179
augagcaagagagacaucgugcugaccaacgugaccguggugcagcugcugagacagcccugccccgugaccagagccccccccccccccgagcccaaggccgagguggagccccagccccagcccgagcccacccccgugagagaggagaucaagccccccccccccccccugcccccccaccccgccacccccccccccaagauggugagcguggccagagagcugaccgugggcaucaacggcuucggcagaaucggcagacuggugcugagagccugcauggagaagggcgugaaggugguggccgugaacgaccccuucaucgaccccgaguacaugguguacauguucaaguacgacagcacccacggcagauacaagggcagcguggaguucagaaacggccagcuggugguggacaaccacgagaucagcguguaccagugcaaggagcccaagcagauccccuggagagccgugggcagccccuacgugguggagagcaccggcguguaccugagcauccaggccgccagcgaccacaucagcgccggcgcccagagaguggugaucagcgcccccagccccgacgcccccauguucgugaugggcgugaacgagaacgacuacaaccccggcagcaugaacaucgugagcaacgccagcugcaccaccaacugccuggccccccuggccaaggugauccacgagagauucggcaucguggagggccugaugaccaccgugcacagcuacaccgccacccagaagaccguggacggccccagcagaaaggccuggagagacggcagaggcgcccaccagaacaucauccccgccagcaccggcgccgccaaggccgugaccaaggugauccccgagcugaagggcaagcugaccggcauggccuucagagugcccacccccgacgugagcgugguggaccugaccugcagacuggcccagcccgcccccuacagcgccaucaaggaggccgugaaggccgccgccaagggccccauggccggcauccuggccuacaccgaggacgagguggugagcaccgacuuccugggcgacacccacagcagcaucuucgacgccaaggccggcaucgcccugaacgacaacuucgugaagcugaucagcugguacgacaacgaguacggcuacagccacagagugguggaccugcugagauacauguucagcagagacaaguaa

SEQ ID NO: 17395 - RNA, 654 nt, Artificial Sequence
  GAR1__Homo_sapiens__NP_061856
augagcuucagaggcggcggcagaggcggcuucaacagaggcggcggcggcggcggcuucaacagaggcggcagcagcaaccacuucagaggcggcggcggcggcggcggcggcggcaacuucagaggcggcggcagaggcggcuucggcagaggcggcggcagaggcggcuucaacaagggccaggaccagggcccccccgagagaguggugcugcugggcgaguuccugcaccccugcgaggacgacaucgugugcaagugcaccaccgacgagaacaaggugcccuacuucaacgcccccguguaccuggagaacaaggagcagaucggcaagguggacgagaucuucggccagcugagagacuucuacuucagcgugaagcugagcgagaacaugaaggccagcagcuucaagaagcugcagaaguucuacaucgaccccuacaagcugcugccccugcagagauuccugcccagaccccccggcgagaagggcccccccagaggcggcggcagaggcggcagaggcggcggcagaggcggcggcggcagaggcggcggcagaggcggcggcuucagaggcggcagaggcggcggcggcggcggcuucagaggcggcagaggcggcggcuucagaggcagaggccacuaa

SEQ ID NO: 17396 - RNA, 2631 nt, Artificial Sequence
  GAREM__Homo_sapiens__NP_001229338
auggaccccgcccccagccugggcugcagccugaaggacgugaaguggagcagcguggccgugccccuggaccugcuggugagcaccuacagacugccccagaucgccagacuggacaacggcgagugcguggagggccugagagagaacgacuaccugcugauccacagcugcagacaguggaccaccaucaccgcccacagccuggaggagggccacuacgugaucggccccaagaucgagauccccgugcacuacgccggccaguucaagcugcuggagcaggacagagacaucaaggagcccgugcaguacuucaacagcguggaggagguggccaaggccuuccccgagagaguguacgugauggaggacaucaccuucaacgugaagguggccagcggcgagugcaacgaggacaccgagguguacaacaucacccugugcaccggcgacgagcugacccugaugggccaggccgagauccuguacgccaagaccuucaaggagaagagcagacugaacaccaucuucaagaagaucggcaagcugaacagcaucagcaagcugggcaagggcaagaugcccugccugaucugcaugaaccacagaaccaacgagagcaucagccugcccuuccagugcaagggcagauucagcaccagaagcccccuggagcugcagaugcaggagggcgagcacaccaucagaaacaucguggagaagaccagacugcccgugaacgugaccgugcccagccccccccccagaaaccccuacgaccugcacuucaucagagagggccacagauacaaguucgugaacauccagaccaagaccgugguggugugcugcgugcugagaaacaacaagauccugcccaugcacuucccccugcaccugaccgugcccaaguucagccugcccgagcaccuggugaagggcgagagcuggcccgagacccuggugcaccacuggcugggcaucugccaggagcaguucgacaucgacgaguacagcagagccgugagagacgugaagaccgacuggaacgaggagugcaagagccccaagaagggcagaugcagcggccacaaccacgugcccaacagccugagcuacgccagagacgagcugacccagagcuuccacagacugagcgugugcguguacggcaacaaccugcacggcaacagcgaggugaaccugcacggcugcagagaccugggcggcgacugggcccccuucccccacgacauccugcccuaccaggacagcggcgacagcggcagcgacuaccuguuccccgaggccagcgaggagagcgccggcauccccggcaagagcgagcugcccuacgaggagcuguggcuggaggagggcaagcccagccaccagccccugaccagaagccugagcgagaagaacagaugcgaccaguucagaggcagcgugagaagcaagugcgccaccagcccccugcccauccccggcacccugggcgccgccgugaagagcagcgacaccgcccugccccccccccccgugccccccaagagcgaggccgugagagaggagugcagacugcugaacgccccccccgugccccccagaagcgccaagccccugagcaccagccccagcaucccccccagaaccgugaagcccgccagacagcagaccagaagccccagccccacccugagcuacuacagcagcggccugcacaacaucagcgugaccaagaccgacaccaaccccagcgagagcacccccgugagcugcuaccccugcaacagagugaagaccgacagcguggaccugaagagccccuucggcagccccagcgccgaggccgugagcagcagacugagcuggcccaaccacuacagcggcgccagcgagagccagaccagaagcgacuuccugcuggaccccagcagaagcuacagcuaccccagacagaagacccccggcacccccaagagaaacugccccgcccccuucgacuucgacggcugcgagcugcuggccagccccaccagccccgugaccgccgaguucagcagcagcgugagcggcugccccaagagcgccagcuacagccuggagagcaccgacgugaagagccuggccgccggcgugaccaagcagagcaccagcugccccgcccugccccccagagcccccaagcugguggaggagaagguggccagcgagaccagcccccugccccugaagaucgacggcgccgaggaggaccccaagagcggcagccccgaccugagcgaggaccaguacuucgugaagaagggcaugcaggacaucuucagcgccagcuaccccuucagcagcccccugcaccugcagcuggcccccagaagcugcggcgacggcagccccuggcagccccccgccgaccugagcggccugagcaucgaggaggugagcaagagccugagauucaucggccugagcgaggacgugaucagcuucuucgugaccgagaagaucgacggcaaccugcuggugcagcugaccgaggagauccugagcgaggacuucaagcugagcaagcugcaggugaagaagaucaugcaguucaucaacggcuggagacccaagaucuaa

SEQ ID NO: 17397 - RNA, 2976 nt, Artificial Sequence
  GARNL3__Homo_sapiens__NP_001273708
augaagagcagcgugagcgaggaccugggcugcagaagaggcgacuucagcagaaagcacuacggcagcguggagcugcugaucagcagcgacgccgacggcgccauccagagagccggcagauucagaguggagaacggcagcagcgacgagaacgccaccgcccugcccggcaccuggagaagaaccgacgugcaccuggagaaccccgaguaccacaccagaugguacuucaaguacuuccugggccaggugcaccagaacuacaucggcaacgacgccgagaagagccccuucuuccugagcgugacccugagcgaccagaacaaccagagagugccccaguacagagccauccuguggagaaagaccggcacccagaagaucugccugcccuacagccccaccaagacccugagcgugaagagcauccugagcgccaugaaccuggacaaguucgagaagggccccagagagaucuuccaccccgagauccagaaggaccugcuggugcuggaggagcaggagggcagcgugaacuucaaguucggcgugcuguucgccaaggacggccagcugaccgacgacgagauguucagcaacgagaucggcagcgagcccuuccagaaguuccugaaccugcugggcgacaccaucacccugaagggcuggaccggcuacagaggcggccuggacaccaagaacgacaccaccggcauccacagcguguacaccguguaccagggccacgagaucauguuccacgugagcaccaugcugcccuacagcaaggagaacaagcagcagguggagagaaagagacacaucggcaacgacaucgugaccaucguguuccaggagggcgaggagagcagccccgccuucaagcccagcaugaucagaagccacuucacccacaucuucgcccuggugagauacaaccagcagaacgacaacuacagacugaagaucuucagcgaggagagcgugccccuguucggccccccccugcccaccccccccguguucaccgaccaccaggaguucagagacuuccugcuggugaagcugaucaacggcgagaaggccacccuggagacccccaccuucgcccagaagagaagaagaacccuggacaugcugaucagaagccugcaccaggaccugaugcccgaccugcacaagaacaugcugaacagaagaagcuucagcgacgugcugcccgagagccccaagagcgccagaaagaaggaggaggccagacaggccgaguucgugagaaucggccaggcccugaagcugaagagcaucgugagaggcgacgcccccagcagccuggccgccagcggcaucugcaagaaggagcccugggagccccagugcuucugcagcaacuucccccacgaggccgugugcgccgaccccuggggccaggcccugcuggugagcaccgacgccggcgugcugcugguggacgacgaccugcccagcgugcccguguucgacagaacccugcccgugaagcagaugcacgugcuggagacccuggaccugcuggugcugagagccgacaagggcaaggacgccagacuguucguguucagacugagcgcccugcagaagggccuggagggcaagcaggccggcaagagcagaagcgacugcagagagaacaagcuggagaagaccaagggcugccaccuguacgccaucaacacccaccacagcagagagcugagaaucgugguggccaucagaaacaagcugcugcugaucaccagaaagcacaacaagcccagcggcgugaccagcaccagccugcugagcccccugagcgagagccccguggaggaguuccaguacaucagagagaucugccugagcgacagccccauggugaugacccugguggacggccccgccgaggagagcgacaaccugaucugcguggccuacagacaccaguucgacguggugaacgagagcaccggcgaggccuucagacugcaccacguggaggccaacagagugaacuucguggccgccaucgacguguacgaggacggcgaggccggccugcugcugugcuacaacuacagcugcaucuacaagaaggugugccccuucaacggcggcagcuuccuggugcagcccagcgccagcgacuuccaguucugcuggaaccaggcccccuacgccaucgugugcgccuuccccuaccugcuggccuucaccaccgacagcauggagaucagacugguggugaacggcaaccuggugcacaccgccguggugccccagcugcagcugguggccagcagaagcgacaucuacuucaccgccaccgccgccgugaacgaggugagcagcggcggcagcagcaagggcgccagcgccagaaacagcccccagaccccccccggcagagacacccccguguuccccagcagccugggcgagggcgagauccagagcaagaaccuguacaagaucccccugagaaaccuggugggcagaagcaucgagagaccccugaagagcccccuggugagcaaggugaucaccccccccacccccaucagcgugggccuggccgccauccccgugacccacagccugagccugagcagaauggagaucaaggagaucgccagcagaaccagaagagagcugcugggccugagcgacgagggcggccccaagagcgagggcgcccccaaggccaagagcaagcccagaaagagacuggaggagagccagggcggccccaagcccggcgccgugagaagcagcagcagcgacagaauccccagcggcagccuggagagcgccagcaccagcgaggccaaccccgagggccacagcgccagcagcgaccaggaccccguggccgacagagagggcagccccgugagcggcagcagccccuuccagcugaccgccuucagcgacgaggacaucaucgaccugaaguaa

SEQ ID NO: 17398 - RNA, 2220 nt, Artificial Sequence
  GARS__Homo_sapiens__NP_002038
augcccagccccagacccgugcugcugagaggcgccagagccgcccugcugcugcugcugccccccagacugcuggccagacccagccugcugcugagaagaagccugagcgccgccagcugcccccccaucagccugcccgccgccgccagcagaagcagcauggacggcgccggcgccgaggaggugcuggccccccugagacuggccgugagacagcagggcgaccuggugagaaagcugaaggaggacaaggccccccagguggacguggacaaggccguggccgagcugaaggccagaaagagagugcuggaggccaaggagcuggcccugcagcccaaggacgacaucguggacagagccaagauggaggacacccugaagagaagauucuucuacgaccaggccuucgccaucuacggcggcgugagcggccuguacgacuucggccccgugggcugcgcccugaagaacaacaucauccagaccuggagacagcacuucauccaggaggagcagauccuggagaucgacugcaccaugcugacccccgagcccgugcugaagaccagcggccacguggacaaguucgccgacuucauggugaaggacgugaagaacggcgagugcuucagagccgaccaccugcugaaggcccaccugcagaagcugaugagcgacaagaagugcagcguggagaagaagagcgagauggagagcgugcuggcccagcuggacaacuacggccagcaggagcuggccgaccuguucgugaacuacaacgugaagagccccaucaccggcaacgaccugagcccccccgugagcuucaaccugauguucaagaccuucaucggccccggcggcaacaugcccggcuaccugagacccgagaccgcccagggcaucuuccugaacuucaagagacugcuggaguucaaccagggcaagcugcccuucgccgccgcccagaucggcaacagcuucagaaacgagaucagccccagaagcggccugaucagagugagagaguucaccauggccgagaucgagcacuucguggaccccagcgagaaggaccaccccaaguuccagaacguggccgaccugcaccuguaccuguacagcgccaaggcccaggugagcggccagagcgccagaaagaugagacugggcgacgccguggagcagggcgugaucaacaacaccgugcugggcuacuucaucggcagaaucuaccuguaccugaccaaggugggcaucagccccgacaagcugagauucagacagcacauggagaacgagauggcccacuacgccugcgacugcugggacgccgagagcaagaccagcuacggcuggaucgagaucgugggcugcgccgacagaagcugcuacgaccugagcugccacgccagagccaccaaggugccccugguggccgagaagccccugaaggagcccaagaccgugaacguggugcaguucgagcccagcaagggcgccaucggcaaggccuacaagaaggacgccaagcuggugauggaguaccuggccaucugcgacgagugcuacaucaccgagauggagaugcugcugaacgagaagggcgaguucaccaucgagaccgagggcaagaccuuccagcugaccaaggacaugaucaacgugaagagauuccagaagacccuguacguggaggagguggugcccaacgugaucgagcccagcuucggccugggcagaaucauguacaccguguucgagcacaccuuccacgugagagagggcgacgagcagagaaccuucuucagcuuccccgccgugguggcccccuucaagugcagcgugcugccccugagccagaaccaggaguucaugcccuucgugaaggagcugagcgaggcccugaccagacacggcgugagccacaagguggacgacagcagcggcagcaucggcagaagauacgccagaaccgacgagaucggcguggccuucggcgugaccaucgacuucgacaccgugaacaagaccccccacaccgccacccugagagacagagacagcaugagacagaucagagccgagaucagcgagcugcccagcaucgugcaggaccuggccaacggcaacaucaccugggccgacguggaggccagauacccccuguucgagggccaggagaccggcaagaaggagaccaucgaggaguaa

SEQ ID NO: 17399 - RNA, 1302 nt, Artificial Sequence
  GART__Homo_sapiens__NP_780294
auggccgccagagugcugaucaucggcagcggcggcagagagcacacccuggccuggaagcuggcccagagccaccacgugaagcaggugcugguggcccccggcaacgccggcaccgccugcagcgagaagaucagcaacaccgccaucagcaucagcgaccacaccgcccuggcccaguucugcaaggagaagaagaucgaguucgugguggugggccccgaggccccccuggccgccggcaucgugggcaaccugagaagcgccggcgugcagugcuucggccccaccgccgaggccgcccagcuggagagcagcaagagauucgccaaggaguucauggacagacacggcauccccaccgcccaguggaaggccuucaccaagcccgaggaggccugcagcuucauccugagcgccgacuuccccgcccugguggugaaggccagcggccuggccgccggcaagggcgugaucguggccaagagcaaggaggaggccugcaaggccgugcaggagaucaugcaggagaaggccuucggcgccgccggcgagaccaucgugaucgaggagcugcuggacggcgaggaggugagcugccugugcuucaccgacggcaagaccguggcccccaugccccccgcccaggaccacaagagacugcuggagggcgacggcggccccaacaccggcggcaugggcgccuacugccccgccccccaggugagcaacgaccugcugcugaagaucaaggacaccgugcugcagagaaccguggacggcaugcagcaggagggcacccccuacaccggcauccuguacgccggcaucaugcugaccaagaacggccccaaggugcuggaguucaacugcagauucggcgaccccgagugccaggugauccugccccugcugaagagcgaccuguacgaggugauccagagcacccuggacggccugcugugcaccagccugcccguguggcuggagaaccacaccgcccugaccguggugauggccagcaagggcuaccccggcgacuacaccaagggcguggagaucaccggcuuccccgaggcccaggcccugggccuggagguguuccacgccggcaccgcccugaagaacggcaagguggugacccacggcggcagagugcuggccgugaccgccaucagagagaaccugaucagcgcccuggaggaggccaagaagggccuggccgccaucaaguucgagggcgccaucuacagaaaggacgugggcuucagagccaucgccuuccugcagcagcccagauaa

SEQ ID NO: 17400 - RNA, 1038 nt, Artificial Sequence
  GAS1__Homo_sapiens__NP_002039
augguggccgcccugcugggcggcggcggcgaggccagaggcggcaccgugcccggcgccuggcugugccugauggcccugcugcagcugcugggcagcgcccccagaggcagcggccuggcccacggcagaagacugaucugcuggcaggcccugcugcagugccagggcgagcccgagugcagcuacgccuacaaccaguacgccgaggccugcgcccccgugcuggcccagcacggcggcggcgacgcccccggcgccgccgccgccgccuuccccgccagcgccgccagcuucagcagcagauggagaugccccagccacugcaucagcgcccugauccagcugaaccacaccagaagaggccccgcccuggaggacugcgacugcgcccaggacgagaacugcaagagcaccaagagagccaucgagcccugccugcccagaaccagcggcggcggcgccggcggccccggcgccggcggcgugaugggcugcaccgaggccagaagaagaugcgacagagacagcagaugcaaccuggcccugagcagauaccugaccuacugcggcaagguguucaacggccugagaugcaccgacgagugcagaaccgugaucgaggacaugcuggccaugcccaaggccgcccugcugaacgacugcgugugcgacggccuggagagacccaucugcgagagcgugaaggagaacauggccagacugugcuucggcgccgagcugggcaacggccccggcagcagcggcagcgacggcggccuggacgacuacuacgacgaggacuacgacgacgagcagagaaccggcggcgccggcggcgagcagccccuggacgacgacgacggcgugccccacccccccagacccggcagcggcgccgccgccagcggcggcagaggcgaccugcccuacggccccggcagaagaagcagcggcggcggcggcagacuggcccccagaggcgccuggaccccccuggccagcauccugcugcugcugcugggcccccuguucuaa

SEQ ID NO: 17401 - RNA, 942 nt, Artificial Sequence
  GAS2__Homo_sapiens__NP_001137302
augugcaccgcccugagccccaaggugagaagcggccccggccugagcgacaugcaccaguacagccaguggcuggccagcagacacgaggccaaccugcugcccaugaaggaggaccuggcccuguggcugaccaaccugcugggcaaggagaucaccgccgagaccuucauggagaagcuggacaacggcgcccugcugugccagcuggccgagaccaugcaggagaaguucaaggagagcauggacgccaacaagcccaccaagaaccugccccugaagaagauccccugcaagaccagcgcccccagcggcagcuucuucgccagagacaacaccgccaacuuccugagcuggugcagagaccugggcguggacgagaccugccuguucgagagcgagggccuggugcugcacaagcagcccagagaggugugccugugccugcuggagcugggcagaaucgccgccagauacggcguggagccccccggccugaucaagcuggagaaggagaucgagcaggaggagacccugagcgcccccagccccagccccagccccagcagcaagagcagcggcaagaagagcaccggcaaccugcuggacgacgccgugaagagaaucagcgaggacccccccugcaagugccccaacaaguucugcguggagagacugagccagggcagauacagagugggcgagaagauccuguucaucagaaugcugcacaacaagcacgugauggugagagugggcggcggcugggagaccuucgccggcuaccugcugaagcacgaccccugcagaaugcugcagaucagcagaguggacggcaagaccagccccauccagagcaagagccccacccugaaggacaugaaccccgacaacuaccugguggugagcgccagcuacaaggccaagaaggagaucaaguaa

SEQ ID NO: 17402 - RNA, 1365 nt, Artificial Sequence
  GAS2L1__Homo_sapiens__NP_001265659
auggccgaccccguggccggcaucgccggcagcgccgccaagagcgugagacccuucagaagcagcgaggccuacguggaggccaugaaggaggaccuggccgaguggcugaacgcccuguacggccugggccugcccggcggcggcgacggcuuccugaccggccuggccaccggcaccacccugugccagcacgccaacgccgugaccgaggccgccagagcccuggccgccgccagacccgccagaggcguggccuuccaggcccacagcguggugcccggcagcuucauggccagagacaacguggccaccuucaucggcuggugcagaguggagcugggcgugcccgaggugcugauguucgagaccgaggaccuggugcugagaaagaacgagaagagcguggugcugugccugcuggagguggccagaagaggcgccagacugggccugcuggcccccagacuggugcaguucgagcaggagaucgagagagagcugagagccgccccccccgcccccaacgcccccgccgccggcgaggacaccaccgagaccgcccccgcccccggcacccccgccagaggccccagaaugacccccagcgaccugagaaaccuggacgagcuggugagagagauccugggcagaugcaccugccccgaccaguuccccaugaucaaggugagcgagggcaaguacagagugggcgacagcagccugcugaucuucgugagagugcugagaagccacgugauggugagagugggcggcggcugggacacccuggagcacuaccuggacaagcacgaccccugcagaugcagcagcaccgcccacagacccccccagcccagagugugcaccuucagcccccagagagugagccccaccaccagccccagacccgccagccccgugcccggcagcgagagaagaggcagcagacccgagaugacccccgugagccugagaagcaccaaggagggccccgagaccccccccagcagcagcagcagcagccugagcgugcugggcggcaagugcggccagcccggcgacagcggcagaaccgccaacggccugcccggccccagaagccaggcccugagcagcagcagcgacgagggcagccccugccccggcaugggcggcccccuggacgcccccggcagcccccuggccugcaccgagcccagcagaaccugggccagaggcagaauggacacccagcccgacagaaagcccagcagaauccccacccccagaggccccagaagacccagcggccccgccgagcugggcaccuggcacgcccugcacagcgugacccccagagccgagcccgacagcuggauguaa

SEQ ID NO: 17403 - RNA, 2037 nt, Artificial Sequence
  GAS6__Homo_sapiens__NP_000811
auggcccccagccugagccccggccccgccgcccugagaagagccccccagcugcugcugcugcugcuggccgccgagugcgcccuggccgcccugcugcccgccagagaggccacccaguuccugagacccagacagagaagagccuuccagguguucgaggaggccaagcagggccaccuggagagagagugcguggaggagcugugcagcagagaggaggccagagagguguucgagaacgaccccgagaccgacuacuucuaccccagauaccuggacugcaucaacaaguacggcagccccuacaccaagaacagcggcuucgccaccugcgugcagaaccugcccgaccagugcacccccaaccccugcgacagaaagggcacccaggccugccaggaccugaugggcaacuucuucugccugugcaaggccggcuggggcggcagacugugcgacaaggacgugaacgagugcagccaggagaacggcggcugccugcagaucugccacaacaagcccggcagcuuccacugcagcugccacagcggcuucgagcugagcagcgacggcagaaccugccaggacaucgacgagugcgccgacagcgaggccugcggcgaggccagaugcaagaaccugcccggcagcuacagcugccugugcgacgagggcuucgccuacagcagccaggagaaggccugcagagacguggacgagugccugcagggcagaugcgagcaggugugcgugaacagccccggcagcuacaccugccacugcgacggcagaggcggccugaagcugagccaggacauggacaccugcgaggacauccugcccugcgugcccuucagcguggccaagagcgugaagagccuguaccugggcagaauguucagcggcacccccgugaucagacugagauucaagagacugcagcccaccagacugguggccgaguucgacuucagaaccuucgaccccgagggcauccugcuguucgccggcggccaccaggacagcaccuggaucgugcuggcccugagagccggcagacuggagcugcagcugagauacaacggcgugggcagagugaccagcagcggccccgugaucaaccacggcauguggcagaccaucagcguggaggagcuggccagaaaccuggugaucaaggugaacagagacgccgugaugaagaucgccguggccggcgaccuguuccagcccgagagaggccuguaccaccugaaccugaccgugggcggcauccccuuccacgagaaggaccuggugcagcccaucaaccccagacuggacggcugcaugagaagcuggaacuggcugaacggcgaggacaccaccauccaggagaccgugaaggugaacaccagaaugcagugcuucagcgugaccgagagaggcagcuucuaccccggcagcggcuucgccuucuacagccuggacuacaugagaaccccccuggacgugggcaccgagagcaccugggagguggaggugguggcccacaucagacccgccgccgacaccggcgugcuguucgcccugugggcccccgaccugagagccgugccccugagcguggcccugguggacuaccacagcaccaagaagcugaagaagcagcugguggugcuggccguggagcacaccgcccuggcccugauggagaucaaggugugcgacggccaggagcacguggugaccgugagccugagagacggcgaggccacccuggagguggacggcaccagaggccagagcgaggugagcgccgcccagcugcaggagagacuggccgugcuggagagacaccugagaagccccgugcugaccuucgccggcggccugcccgacgugcccgugaccagcgcccccgugaccgccuucuacagaggcugcaugacccuggaggugaacagaagacugcuggaccuggacgaggccgccuacaagcacagcgacaucaccgcccacagcugcccccccguggagcccgccgccgccuaa

SEQ ID NO: 17404 - RNA, 1239 nt, Artificial Sequence
  GAS7__Homo_sapiens__NP_001124303
auggugccccccccccccggcgaggagagccagaccgugauccugccccccggcuggcagagcuaccugagcccccagggcagaagauacuacgugaacaccaccaccaacgagaccaccugggagagacccagcagcagccccggcauccccgccagccccggcagccacagaagcagccugccccccaccgugaacggcuaccacgccagcggcacccccgcccacccccccgagaccgcccacaugagcgugagaaagagcaccggcgacagccagaaccugggcagcagcagccccagcaagaagcagagcaaggagaacaccaucaccaucaacugcgugaccuucccccaccccgacaccaugcccgagcagcagcugcugaagcccaccgaguggagcuacugcgacuacuucugggccgacaagaaggacccccagggcaacggcaccguggccggcuucgagcugcugcugcagaagcagcugaagggcaagcagaugcagaaggagaugagcgaguucaucagagagagaaucaagaucgaggaggacuacgccaagaaccuggccaagcugagccagaacagccuggccagccaggaggagggcagccugggcgaggccugggcccaggugaagaagagccuggccgacgaggccgaggugcaccugaaguucagcgccaagcugcacagcgagguggagaagccccugaugaacuucagagagaacuucaagaaggacaugaagaagugcgaccaccacaucgccgaccugagaaagcagcuggccagcagauacgccagcguggagaaggccagaaaggcccugaccgagagacagagagaccuggagaugaagacccagcagcuggagaucaagcugagcaacaagaccgaggaggacaucaagaaggccagaagaaagagcacccaggccggcgacgaccugaugagaugcguggaccuguacaaccaggcccagagcaagugguucgaggagauggugaccaccacccuggagcuggagagacuggagguggagagaguggagaugaucagacagcaccugugccaguacacccagcugagacacgagaccgacauguucaaccagagcaccguggagcccguggaccagcugcugagaaagguggaccccgccaaggacagagagcugugggugagagagcacaagaccggcaacaucagacccguggacauggagaucuaa

SEQ ID NO: 17405 - RNA, 861 nt, Artificial Sequence
  GAS8__Homo_sapiens__NP_001273137
augaagaugcugagagacgagcuggaccugagaagaaagaccgagcugcacgagguggaggagagaaagaacggccagauccacacccugaugcagagacacgaggaggccuucaccgacaucaagaacuacuacaacgacaucacccugaacaaccuggcccugaucaacagccugaaggagcagauggaggacaugagaaagaaggaggaccaccuggagagagagauggccgaggugagcggccagaacaagagacuggccgacccccugcagaaggccagagaggagaugagcgagaugcagaagcagcuggccaacuacgagagagacaagcagauccugcugugcaccaaggccagacugaaggugagagagaaggagcugaaggaccugcagugggagcacgaggugcuggagcagagauucaccaaggugcagcaggagagagacgagcuguacagaaaguucaccgccgccauccaggaggugcagcagaagaccggcuucaagaaccuggugcuggagagaaagcugcaggcccugagcgccgccguggagaagaaggaggugcaguucaacgaggugcuggccgccagcaaccuggaccccgccgcccugacccuggugagcagaaagcuggaggacgugcuggagagcaagaacagcaccaucaaggaccugcaguacgagcuggcccaggugugcaaggcccacaacgaccugcugagaaccuacgaggccaagcugcuggccuucggcaucccccuggacaacgugggcuucaagccccuggagaccgccgugaucggccagacccugggccagggccccgccggccuggugggcacccccaccuaa

SEQ ID NO: 17406 - RNA, 306 nt, Artificial Sequence
  GAST__Homo_sapiens__NP_000796
augcagagacugugcguguacgugcugaucuucgcccuggcccuggccgccuucagcgaggccagcuggaagcccagaagccagcagcccgacgccccccugggcaccggcgccaacagagaccuggagcugcccuggcuggagcagcagggccccgccagccaccacagaagacagcugggcccccagggccccccccaccugguggccgaccccagcaagaagcagggccccuggcuggaggaggaggaggaggccuacggcuggauggacuucggcagaagaagcgccgaggacgagaacuaa

SEQ ID NO: 17407 - RNA, 1242 nt, Artificial Sequence
  GATA1__Homo_sapiens__NP_002040
auggaguuccccggccugggcagccugggcaccagcgagccccugccccaguucguggaccccgcccuggugagcagcacccccgagagcggcguguucuuccccagcggccccgagggccuggacgccgccgccagcagcaccgcccccagcaccgccaccgccgccgccgccgcccuggccuacuacagagacgccgaggccuacagacacagccccguguuccagguguacccccugcugaacugcauggagggcauccccggcggcagccccuacgccggcugggccuacggcaagaccggccuguaccccgccagcaccgugugccccaccagagaggacagccccccccaggccguggaggaccuggacggcaagggcagcaccagcuuccuggagacccugaagaccgagagacugagccccgaccugcugacccugggccccgcccugcccagcagccugcccgugcccaacagcgccuacggcggccccgacuucagcagcaccuucuucagccccaccggcagcccccugaacagcgccgccuacagcagccccaagcugagaggcacccugccccugccccccugcgaggccagagagugcgugaacugcggcgccaccgccaccccccuguggagaagagacagaaccggccacuaccugugcaacgccugcggccuguaccacaagaugaacggccagaacagaccccugaucagacccaagaagagacugaucgugagcaagagagccggcacccagugcaccaacugccagaccaccaccaccacccuguggagaagaaacgccagcggcgaccccgugugcaacgccugcggccuguacuacaagcugcaccaggugaacagaccccugaccaugagaaaggacggcauccagaccagaaacagaaaggccagcggcaagggcaagaagaagagaggcagcagccugggcggcaccggcgccgccgagggccccgccggcggcuucauggugguggccggcggcagcggcagcggcaacugcggcgagguggccagcggccugacccugggcccccccggcaccgcccaccuguaccagggccugggccccguggugcugagcggccccgugagccaccugaugcccuuccccggcccccugcugggcagccccaccggcagcuuccccaccggccccaugccccccaccaccagcaccaccgugguggccccccugagcagcuaa

SEQ ID NO: 17408 - RNA, 1443 nt, Artificial Sequence
  GATA2__Homo_sapiens__NP_001139133
auggagguggcccccgagcagcccagauggauggcccaccccgccgugcugaacgcccagcaccccgacagccaccaccccggccuggcccacaacuacauggagcccgcccagcugcugccccccgacgagguggacguguucuucaaccaccuggacagccagggcaaccccuacuacgccaaccccgcccacgccagagccagagugagcuacagccccgcccacgccagacugaccggcggccagaugugcagaccccaccugcugcacagccccggccugcccuggcuggacggcggcaaggccgcccugagcgccgccgccgcccaccaccacaaccccuggaccgugagccccuucagcaagaccccccugcaccccagcgccgccggcggccccggcggcccccugagcguguaccccggcgccggcggcggcagcggcggcggcagcggcagcagcguggccagccugacccccaccgccgcccacagcggcagccaccuguucggcuucccccccaccccccccaaggaggugagccccgaccccagcaccaccggcgccgccagccccgccagcagcagcgccggcggcagcgccgccagaggcgaggacaaggacggcgugaaguaccaggugagccugaccgagagcaugaagauggagagcggcagcccccugagacccggccuggccaccaugggcacccagcccgccacccaccaccccauccccaccuaccccagcuacgugcccgccgccgcccacgacuacagcagcggccuguuccaccccggcggcuuccugggcggccccgccagcagcuucacccccaagcagagaagcaaggccagaagcugcagcgagggcagagagugcgugaacugcggcgccaccgccaccccccuguggagaagagacggcaccggccacuaccugugcaacgccugcggccuguaccacaagaugaacggccagaacagaccccugaucaagcccaagagaagacugagcgccgccagaagagccggcaccugcugcgccaacugccagaccaccaccaccacccuguggagaagaaacgccaacggcgaccccgugugcaacgccugcggccuguacuacaagcugcacaacgugaacagaccccugaccaugaagaaggagggcauccagaccagaaacagaaagaugagcaacaagagcaagaagagcaagaagggcgccgagugcuucgaggagcugagcaagugcaugcaggagaagagcagccccuucagcgccgccgcccuggccggccacauggcccccgugggccaccugccccccuucagccacagcggccacauccugcccacccccacccccauccaccccagcagcagccugagcuucggccacccccaccccagcagcauggugaccgccaugggcuaa

SEQ ID NO: 17409 - RNA, 1332 nt, Artificial Sequence
  GATA3__Homo_sapiens__NP_002042
auggaggugaccgccgaccagcccagaugggugagccaccaccaccccgccgugcugaacggccagcaccccgacacccaccaccccggccugagccacagcuacauggacgccgcccaguacccccugcccgaggagguggacgugcuguucaacaucgacggccagggcaaccacgugccccccuacuacggcaacagcgugagagccaccgugcagagauacccccccacccaccacggcagccaggugugcagacccccccugcugcacggcagccugcccuggcuggacggcggcaaggcccugggcagccaccacaccgccagccccuggaaccugagccccuucagcaagaccagcauccaccacggcagccccggcccccugagcguguacccccccgccagcagcagcagccugagcggcggccacgccagcccccaccuguucaccuucccccccaccccccccaaggacgugagccccgaccccagccugagcacccccggcagcgccggcagcgccagacaggacgagaaggagugccugaaguaccaggugccccugcccgacagcaugaagcuggagagcagccacagcagaggcagcaugaccgcccugggcggcgccagcagcagcacccaccaccccaucaccaccuacccccccuacgugcccgaguacagcagcggccuguucccccccagcagccugcugggcggcagccccaccggcuucggcugcaagagcagacccaaggccagaagcagcaccggcagagagugcgugaacugcggcgccaccagcaccccccuguggagaagagacggcaccggccacuaccugugcaacgccugcggccuguaccacaagaugaacggccagaacagaccccugaucaagcccaagagaagacugagcgccgccagaagagccggcaccagcugcgccaacugccagaccaccaccaccacccuguggagaagaaacgccaacggcgaccccgugugcaacgccugcggccuguacuacaagcugcacaacaucaacagaccccugaccaugaagaaggagggcauccagaccagaaacagaaagaugagcagcaagagcaagaagugcaagaaggugcacgacagccuggaggacuuccccaagaacagcagcuucaaccccgccgcccugagcagacacaugagcagccugagccacaucagccccuucagccacagcagccacaugcugaccacccccacccccaugcacccccccagcagccugagcuucggcccccaccaccccagcagcauggugaccgccaugggcuaa

SEQ ID NO: 17410 - RNA, 1329 nt, Artificial Sequence
  GATA4__Homo_sapiens__NP_002043
auguaccagagccuggccauggccgccaaccacggccccccccccggcgccuacgaggccggcggccccggcgccuucaugcacggcgccggcgccgccagcagccccguguacgugcccacccccagagugcccagcagcgugcugggccugagcuaccugcagggcggcggcgccggcagcgccagcggcggcgccagcggcggcagcagcggcggcgccgccagcggcgccggccccggcacccagcagggcagccccggcuggagccaggccggcgccgacggcgccgccuacacccccccccccgugagccccagauucagcuuccccggcaccaccggcagccuggccgccgccgccgccgccgccgccgccagagaggccgccgccuacagcagcggcggcggcgccgccggcgccggccuggccggcagagagcaguacggcagagccggcuucgccggcagcuacagcagccccuaccccgccuacauggccgacgugggcgccagcugggccgccgccgccgccgccagcgccggccccuucgacagccccgugcugcacagccugcccggcagagccaaccccgccgccagacaccccaaccuggacauguucgacgacuucagcgagggcagagagugcgugaacugcggcgccaugagcaccccccuguggagaagagacggcaccggccacuaccugugcaacgccugcggccuguaccacaagaugaacggcaucaacagaccccugaucaagccccagagaagacugagcgccagcagaagagugggccugagcugcgccaacugccagaccaccaccaccacccuguggagaagaaacgccgagggcgagcccgugugcaacgccugcggccuguacaugaagcugcacggcgugcccagaccccuggccaugagaaaggagggcauccagaccagaaagagaaagcccaagaaccugaacaagagcaagacccccgccgcccccagcggcagcgagagccugccccccgccagcggcgccagcagcaacagcagcaacgccaccaccagcagcagcgaggagaugagacccaucaagaccgagcccggccugagcagccacuacggccacagcagcagcgugagccagaccuucagcgugagcgccaugagcggccacggccccagcauccaccccgugcugagcgcccugaagcugagcccccagggcuacgccagccccgugagccagagcccccagaccagcagcaagcaggacagcuggaacagccuggugcuggccgacagccacggcgacaucaucaccgccuaa

SEQ ID NO: 17411 - RNA, 1194 nt, Artificial Sequence
  GATA5__Homo_sapiens__XP_006723762
auguaccagagccuggcccuggccgccagccccagacaggccgccuacgccgacagcggcagcuuccugcacgcccccggcgccggcagccccauguucgugccccccgccagagugcccagcaugcugagcuaccugagcggcugcgagcccagcccccagccccccgagcuggccgccagacccggcugggcccagaccgccaccgccgacagcagcgccuucggccccggcagcccccacccccccgccgcccacccccccggcgccaccgccuuccccuucgcccacagccccagcggccccggcagcggcggcagcgccggcggcagagacggcagcgccuaccagggcgcccugcugcccagagagcaguucgccgccccccugggcagacccgugggcaccagcuacagcgccaccuaccccgccuacgugagccccgacguggcccagagcuggaccgccggccccuucgacggcagcgugcugcacggccugcccggcagaagacccaccuucgugagcgacuuccuggaggaguuccccggcgagggcagagagugcgugaacugcggcgcccugagcaccccccuguggagaagagacggcaccggccacuaccugugcaacgccugcggccuguaccacaagaugaacggcgugaacagaccccuggugagaccccagaagagacugagcagcagcagaagagccggccugugcugcaccaacugccacaccaccaacaccacccuguggagaagaaacagcgagggcgagcccgugugcaacgccugcggccuguacaugaagcugcacggcgugcccagaccccuggccaugaagaaggagagcauccagaccagaaagagaaagcccaagaccaucgccaaggccagaggcagcagcggcagcaccagaaacgccagcgccagccccagcgccguggccagcaccgacagcagcgccgccaccagcaaggccaagcccagccuggccagccccgugugccccggccccagcauggccccccaggccagcggccaggaggacgacagccuggcccccggccaccuggaguucaaguucgagcccgaggacuucgccuuccccagcaccgcccccagcccccaggccggccugagaggcgcccugagacaggaggccuggugcgcccuggcccuggccuaa

SEQ ID NO: 17412 - RNA, 1788 nt, Artificial Sequence
  GATA6__Homo_sapiens__NP_005248
auggcccugaccgacggcggcuggugccugcccaagagauucggcgccgccggcgccgacgccagcgacagcagagccuuccccgccagagagcccagcaccccccccagccccaucagcagcagcagcagcagcugcagcagaggcggcgagagaggccccggcggcgccagcaacugcggcaccccccagcuggacaccgaggccgccgccggcccccccgccagaagccugcugcugagcagcuacgccagccaccccuucggcgccccccacggccccagcgcccccggcguggccggccccggcggcaaccugagcagcugggaggaccugcugcuguucaccgaccuggaccaggccgccaccgccagcaagcugcuguggagcagcagaggcgccaagcugagccccuucgcccccgagcagcccgaggagauguaccagacccuggccgcccugagcagccagggccccgccgccuacgacggcgcccccggcggcuucgugcacagcgccgccgccgccgccgccgccgccgccgccgccagcagccccguguacgugcccaccaccagagugggcagcaugcugcccggccugcccuaccaccugcagggcagcggcagcggccccgccaaccacgccggcggcgccggcgcccaccccggcuggccccaggccagcgccgacagcccccccuacggcagcggcggcggcgccgccggcggcggcgccgccggccccggcggcgccggcagcgccgccgcccacgugagcgccagauuccccuacagccccagcccccccauggccaacggcgccgccagagagcccggcggcuacgccgccgccggcagcggcggcgccggcggcgugagcggcggcggcagcagccuggccgccaugggcggcagagagccccaguacagcagccugagcgccgccagaccccugaacggcaccuaccaccaccaccaccaccaccaccaccaccaccccagccccuacagccccuacgugggcgccccccugacccccgccuggcccgccggccccuucgagacccccgugcugcacagccugcagagcagagccggcgccccccugcccgugcccagaggccccagcgccgaccugcuggaggaccugagcgagagcagagagugcgugaacugcggcagcauccagaccccccuguggagaagagacggcaccggccacuaccugugcaacgccugcggccuguacagcaagaugaacggccugagcagaccccugaucaagccccagaagagagugcccagcagcagaagacugggccugagcugcgccaacugccacaccaccaccaccacccuguggagaagaaacgccgagggcgagcccgugugcaacgccugcggccuguacaugaagcugcacggcgugcccagaccccuggccaugaagaaggagggcauccagaccagaaagagaaagcccaagaacaucaacaagagcaagaccugcagcggcaacagcaacaacagcauccccaugacccccaccagcaccagcagcaacagcgacgacugcagcaagaacaccagccccaccacccagcccaccgccagcggcgccggcgcccccgugaugaccggcgccggcgagagcaccaaccccgagaacagcgagcugaaguacagcggccaggacggccuguacaucggcgugagccuggccagccccgccgaggugaccagcagcgugagacccgacagcuggugcgcccuggcccuggccuaa

SEQ ID NO: 17413 - RNA, 810 nt, Artificial Sequence
  GATAD1__Homo_sapiens__NP_066990
augccccugggccugaagcccaccugcagcgugugcaagaccaccagcagcagcauguggaagaagggcgcccagggcgagauccugugccaccacugcaccggcagaggcggcgccggcagcggcggcgccggcagcggcgccgccggcggcaccggcggcagcggcggcggcggcuucggcgccgccaccuucgccagcaccagcgccacccccccccagagcaacggcggcggcggcggcaagcagagcaagcaggagauccacagaagaagcgccagacugagaaacaccaaguacaagagcgcccccgccgccgagaagaaggugagcaccaagggcaagggcagaagacacaucuucaagcugaagaaccccaucaaggcccccgagagcgugagcaccaucaucaccgccgagagcaucuucuacaagggcguguacuaccagaucggcgacguggugagcgugaucgacgagcaggacggcaagcccuacuacgcccagaucagaggcuucauccaggaccaguacugcgagaagagcgccgcccugaccuggcugauccccacccugagcagccccagagaccaguucgaccccgccagcuacaucaucggccccgaggaggaccugcccagaaagauggaguaccuggaguucgugugccacgcccccagcgaguacuucaagagcagaagcagccccuuccccaccgugcccaccagacccgagaagggcuacaucuggacccacgugggccccacccccgccaucaccaucaaggagagcguggccaaccaccuguaa

SEQ ID NO: 17414 - RNA, 1905 nt, Artificial Sequence
  GATAD2A__Homo_sapiens__NP_001287875
augaccgaggaggccugcagaaccagaagccagaagagagcccuggagagagaccccaccgaggacgacguggagagcaagaagaucaagauggagagaggccugcuggccagcgaccugaacaccgacggcgacaugagagugacccccgagcccggcgccggccccacccagggccugcugagagccaccgaggccaccgccauggccaugggcagaggcgagggccuggugggcgacggccccguggacaugagaaccagccacagcgacaugaagagcgagagaagaccccccagccccgacgugaucgugcugagcgacaacgagcagcccagcagccccagagugaacggccugaccaccguggcccugaaggagaccagcaccgaggcccugaugaagagcagccccgaggagagagagagaaugaucaagcagcugaaggaggagcugagacuggaggaggccaagcuggugcugcugaagaagcugagacagagccagauccagaaggaggccaccgcccagaagcccaccggcagcgugggcagcaccgugaccaccccccccccccuggugagaggcacccagaacauccccgccggcaagcccagccugcagaccagcagcgccagaaugcccggcagcgugaucccccccccccuggugagaggcggccagcaggccagcagcaagcugggcccccaggccagcagccagguggugaugcccccccuggugagaggcgcccagcagauccacagcaucagacagcacagcagcaccggcccccccccccugcugcuggcccccagagccagcgugcccagcgugcagauccagggccagagaaucauccagcagggccugaucagaguggccaacgugcccaacaccagccugcuggugaacaucccccagcccacccccgccagccugaagggcaccaccgccaccagcgcccaggccaacagcacccccaccagcguggccagcguggugaccagcgccgagagccccgccagcagacaggccgccgccaagcuggcccugagaaagcagcuggagaagacccugcuggagauccccccccccaagccccccgcccccgagaugaacuuccugcccagcgccgccaacaacgaguucaucuaccuggugggccuggaggagguggugcagaaccugcuggagacccaggccggcagaaugagcgccgccaccgugcugagcagagagcccuacaugugcgcccagugcaagaccgacuucaccugcagauggagagaggagaagagcggcgccaucaugugcgagaacugcaugaccaccaaccagaagaaggcccugaagguggagcacaccagcagacugaaggccgccuucgugaaggcccugcagcaggagcaggagaucgagcagagacugcugcagcagggcaccgcccccgcccaggccaaggccgagcccaccgccgccccccaccccgugcugaagcaggugaucaagcccagaagaaagcuggccuucagaagcggcgaggccagagacuggagcaacggcgccgugcugcaggccagcagccagcugagcagaggcagcgccaccacccccagaggcgugcugcacaccuucagccccagccccaagcugcagaacagcgccagcgccaccgcccuggugagcagaaccggcagacacagcgagagaaccgugagcgccggcaagggcagcgccaccagcaacuggaagaagaccccccugagcaccggcggcacccuggccuucgugagccccagccuggccgugcacaagagcagcagcgccguggacagacagagagaguaccugcuggacaugaucccccccagaagcaucccccagagcgccaccuggaaguaa

SEQ ID NO: 17415 - RNA, 1782 nt, Artificial Sequence
  GATAD2B__Homo_sapiens__XP_006711532
auggacagaaugaccgaggacgcccugagacugaaccugcugaagagaagccuggaccccgccgacgagagagacgacgugcuggccaagagacugaagauggagggccacgaggccauggagagacugaagaugcuggcccugcugaagagaaaggaccuggccaaccuggaggugccccacgagcugcccaccaagcaggacggcagcggcgugaagggcuacgaggagaagcugaacggcaaccugagaccccacggcgacaacagaaccgccggcagacccggcaaggagaacaucaacgacgagcccguggacaugagcgccagaagaagcgagcccgagagaggcagacugacccccagccccgacaucaucgugcugagcgacaacgaggccagcagccccagaagcagcagcagaauggaggagagacugaaggccgccaaccuggagauguucaagggcaagggcaucgaggagagacagcagcugaucaagcagcugagagacgagcugagacuggaggaggccagacuggugcugcugaagaagcugagacagagccagcugcagaaggagaacguggugcagaagacccccguggugcagaacgccgccagcaucgugcagcccagccccgcccacgugggccagcagggccugagcaagcugcccagcagacccggcgcccagggcguggagccccagaaccugagaacccugcagggccacagcgugaucagaagcgccaccaacaccacccugccccacaugcugaugagccagagagugaucgcccccaaccccgcccagcugcagggccagagaggcccccccaagcccggccuggugagaaccaccacccccaacaugaaccccgccaucaacuaccagccccagagcagcagcagcgugcccugccagagaaccaccagcagcgccaucuacaugaaccuggccagccacauccagcccggcaccgugaacagagugagcagcccccugcccagccccagcgccaugaccgacgccgccaacagccaggccgccgccaagcuggcccugagaaagcagcuggagaagacccugcuggagauccccccccccaagccccccgccccccugcugcacuuccugcccagcgccgccaacagcgaguucaucuacauggugggccuggaggagguggugcagagcgugaucgacagccagggcaagagcugcgccagccugcugagaguggagcccuucgugugcgcccagugcagaaccgacuucaccccccacuggaagcaggagaagaacggcaagauccugugcgagcagugcaugaccagcaaccagaagaaggcccugaaggccgagcacaccaacagacugaagaacgccuucgugaaggcccugcagcaggagcaggagaucgagcagagacugcagcagcaggccgcccugagccccaccaccgcccccgccgugagcagcgugagcaagcaggagaccaucaugagacaccacacccugagacaggccccccagccccagagcagccugcagagaggcauccccaccagcgccagaagcaugcugagcaacuucgcccaggccccccagcugagcgugcccggcggccugcugggcaugcccggcgugaacaucgccuaccugaacaccggcaucggcggccacaagggccccagccuggccgacagacagagagaguaccugcuggacaugaucccccccagaagcaucagccagagcaucagcggccagaaguaa

SEQ ID NO: 17416 - RNA, 1674 nt, Artificial Sequence
  GATB__Homo_sapiens__NP_004555
auggccgcccccaugcugagauggggcugcagaggcagaagaugggccuucgccagaguggacggcggcagcugccacagaagaggcgcccccaccggcagcaccagcaaccagaucagaggcgagagcagcguggcccagcagccccugcacaccgcccagaagaccagaaagggcgagcacaagugggccgccguggugggccuggagauccacgcccagaucagcagcaacagcaagcuguucagcggcagccaggugagauucagcgccccccccaacagccuggugagcuucuucgacgccagccugcccggcacccugcccgugcugaacagaagaugcguggaggccgccgugaugaccggccuggcccugaacugccacaucaacaagaagagccuguucgacagaaagcacuacuucuacgccgaccugcccgccggcuaccagaucacccagcagagacugcccaucgccgugaacggcagccugaucuacggcgugugcgccggcaagaagcagagccaggugauccccaagaccgugagaaucaagcagauccagcuggagcaggacagcggcaagagccugcacgacaaccugagaagccagacccugaucgaccugaacagagccggcgugggccugcuggagguggugcuggagcccgacaugagcugcggcgaggaggccgccaccgccgugagagagcugcagcugauccugcaggcccugggcaccagccaggccaacauggccgagggccagcugagaguggacgccaacaucagcgugcaccaccccggcgagccccugggcgugagaaccgaggugaagaaccugaacagcaucagauuccuggccaaggccaucgacuacgagauccagagacagaucaacgagcuggagaacggcggcgagauccugaacgagaccagaagcuuccaccacaagcugggcugcaccaugagcaugagagacaaggagggcaagcaggacuacagauucaugcccgagcccaaccugcccccccuggugcuguacgacgccaccagccugcccgccggcgccgacccccagcaggugaucaacaucgaccagaucagagagacccugcccgagcugcccagcgugaccagagagaagcuggugcagcaguacggcaugcugcuggagcacagcuucacccugcugaacgaggugggccugcuggaguucuuccagaacgugaucaaggagaccagagccgagcccaagaaggugaccagcugggugcugaacaccuuccugggcuaccugaagcagcagaaccuggccgugagcgagagccccgugacccccagcgcccuggccgagcugcuggaccugcuggacagcagaaccaucagcagcagcgccgccaagcagguguucgaggagcuguggaagagagagggcaagacccccggccagaucgugagcgagaagcagcuggagcugaugcaggaccagggcgcccuggagcagcugugccacagcgugauggaggcccacccccagguggugauggacgugaagaacagaaaccccagagccaucaacaagcugaucggccuggugagaaaggccacccagagcagagccgaccccgugaugaucaaggagauccuggagaagaagcugagccuguaa

SEQ ID NO: 17417 - RNA, 1272 nt, Artificial Sequence
  GATM__Homo_sapiens__NP_001473
augcugagagugagaugccugagaggcggcagcagaggcgccgaggccgugcacuacaucggcagcagacugggcagaacccugaccggcugggugcagagaaccuuccagagcacccaggccgccaccgccagcagcagaaacagcugcgccgccgacgacaaggccaccgagccccugcccaaggacugccccgugagcagcuacaacgagugggacccccuggaggaggugaucgugggcagagccgagaacgccugcgugccccccuucaccaucgaggugaaggccaacaccuacgagaaguacuggcccuucuaccagaagcagggcggccacuacuuccccaaggaccaccugaagaaggccguggccgagaucgaggagaugugcaacauccugaagaccgagggcgugaccgugagaagacccgaccccaucgacuggagccugaaguacaagacccccgacuucgagagcaccggccuguacagcgccaugcccagagacauccugaucguggugggcaacgagaucaucgaggcccccauggccuggagaagcagauucuucgaguacagagccuacagaagcaucaucaaggacuacuuccacagaggcgccaaguggaccaccgcccccaagcccaccauggccgacgagcuguacaaccaggacuaccccauccacagcguggaggacagacacaagcuggccgcccagggcaaguucgugaccaccgaguucgagcccugcuucgacgccgccgacuucaucagagccggcagagacaucuucgcccagagaagccaggugaccaacuaccugggcaucgaguggaugagaagacaccuggcccccgacuacagagugcacaucaucagcuucaaggaccccaaccccaugcacaucgacgccaccuucaacaucaucggccccggcaucgugcugagcaaccccgacagacccugccaccagaucgaccuguucaagaaggccggcuggaccaucaucaccccccccacccccaucauccccgacgaccacccccuguggaugagcagcaaguggcugagcaugaacgugcugaugcuggacgagaagagagugaugguggacgccaacgaggugcccauccagaagauguucgagaagcugggcaucaccaccaucaaggugaacaucagaaacgccaacagccugggcggcggcuuccacugcuggaccugcgacgugagaagaagaggcacccugcagagcuaccuggacuaa

SEQ ID NO: 17418 - RNA, 2784 nt, Artificial Sequence
  GBA2__Homo_sapiens__NP_065995
augggcacccaggaccccggcaacaugggcaccggcgugcccgccagcgagcagaucagcugcgccaaggaggacccccagguguacugccccgaggagaccggcggcaccaaggacgugcaggugaccgacugcaagagccccgaggacagcagaccccccaaggagaccgacugcugcaaccccgaggacagcggccagcugauggugagcuacgagggcaaggccaugggcuaccaggugccccccuucggcuggagaaucugccuggcccacgaguucaccgagaagagaaagcccuuccaggccaacaacgugagccugagcaacaugaucaagcacaucggcaugggccugagauaccugcaguggugguacagaaagacccacguggagaagaagacccccuucaucgacaugaucaacagcgugccccugagacagaucuacggcugcccccugggcggcaucggcggcggcaccaucaccagaggcuggagaggccaguucugcagauggcagcugaaccccggcauguaccagcacagaaccgugaucgccgaccaguucaccgugugccugagaagagagggccagaccguguaccagcaggugcugagccuggagagacccagcgugcugagaagcuggaacuggggccugugcggcuacuucgccuucuaccacgcccuguaccccagagccuggaccguguaccagcugcccggccagaacgugacccugaccugcagacagaucacccccauccugccccacgacuaccaggacagcagccugcccgugggcguguucgugugggacguggagaacgagggcgacgaggcccuggacgugagcaucauguucagcaugagaaacggccugggcggcggcgacgacgcccccggcggccuguggaacgagcccuucugccuggagagaagcggcgagaccgugagaggccugcugcugcaccaccccacccugcccaaccccuacaccauggccguggccgccagagugaccgccgccaccaccgugacccacaucaccgccuucgaccccgacagcaccggccagcagguguggcaggaccugcugcaggacggccagcuggacagccccaccggccagagcacccccacccagaagggcgugggcaucgccggcgccgugugcgugagcagcaagcugagacccagaggccagugcagacuggaguucagccuggccugggacaugcccagaaucauguucggcgccaagggccaggugcacuacagaagauacaccagauucuucggccaggacggcgacgccgcccccgcccugagccacuacgcccugugcagauacgccgagugggaggagagaaucagcgccuggcagagccccgugcuggacgacagaagccugcccgccugguacaagagcgcccuguucaacgagcuguacuuccuggccgacggcggcaccguguggcuggaggugcuggaggacagccugcccgaggagcugggcagaaacaugugccaccugagacccacccugagagacuacggcagauucggcuaccuggagggccaggaguacagaauguacaacaccuacgacgugcacuucuacgccagcuucgcccugaucaugcuguggcccaagcuggagcugagccugcaguacgacauggcccuggccacccugagagaggaccugaccagaagaagauaccugaugagcggcgugauggcccccgugaagagaagaaacgugaucccccacgacaucggcgaccccgacgacgagcccuggcugagagugaacgccuaccugauccacgacaccgccgacuggaaggaccugaaccugaaguucgugcugcagguguacagagacuacuaccugaccggcgaccagaacuuccugaaggacauguggcccgugugccuggccgugauggagagcgagaugaaguucgacaaggaccacgacggccugaucgagaacggcggcuacgccgaccagaccuacgacggcugggugaccaccggccccagcgccuacugcggcggccuguggcuggccgccguggccgugauggugcagauggccgcccugugcggcgcccaggacauccaggacaaguucagcagcauccugagcagaggccaggaggccuacgagagacugcuguggaacggcagauacuacaacuacgacagcagcagcagaccccagagcagaagcgugaugagcgaccagugcgccggccagugguuccugaaggccugcggccugggcgagggcgacaccgagguguuccccacccagcacguggugagagcccugcagaccaucuucgagcugaacgugcaggccuucgccggcggcgccaugggcgccgugaacggcaugcagccccacggcgugcccgacaagagcagcgugcagagcgacgaggugugggugggcgugguguacggccuggccgccaccaugauccaggagggccugaccugggagggcuuccagaccgccgagggcugcuacagaaccgugugggagagacugggccuggccuuccagacccccgaggccuacugccagcagagaguguucagaagccuggccuacaugagaccccugagcaucugggccaugcagcuggcccugcagcagcagcagcacaagaaggccagcuggcccaaggugaagcagggcaccggccugagaaccggccccauguucggccccaaggaggccauggccaaccugagccccgaguaa

SEQ ID NO: 17419 - RNA, 1350 nt, Artificial Sequence
  GBA__Homo_sapiens__NP_001165282
auggagcugagcaugggccccauccaggccaaccacaccggcaccggccugcugcugacccugcagcccgagcagaaguuccagaaggugaagggcuucggcggcgccaugaccgacgccgccgcccugaacauccuggcccugagcccccccgcccagaaccugcugcugaagagcuacuucagcgaggagggcaucggcuacaacaucaucagagugcccauggccagcugcgacuucagcaucagaaccuacaccuacgccgacacccccgacgacuuccagcugcacaacuucagccugcccgaggaggacaccaagcugaagaucccccugauccacagagcccugcagcuggcccagagacccgugagccugcuggccagccccuggaccagccccaccuggcugaagaccaacggcgccgugaacggcaagggcagccugaagggccagcccggcgacaucuaccaccagaccugggccagauacuucgugaaguuccuggacgccuacgccgagcacaagcugcaguucugggccgugaccgccgagaacgagcccagcgccggccugcugagcggcuaccccuuccagugccugggcuucacccccgagcaccagagagacuucaucgccagagaccugggccccacccuggccaacagcacccaccacaacgugagacugcugaugcuggacgaccagagacugcugcugccccacugggccaagguggugcugaccgaccccgaggccgccaaguacgugcacggcaucgccgugcacugguaccuggacuuccuggcccccgccaaggccacccugggcgagacccacagacuguuccccaacaccaugcuguucgccagcgaggccugcgugggcagcaaguucugggagcagagcgugagacugggcagcugggacagaggcaugcaguacagccacagcaucaucaccaaccugcuguaccacguggugggcuggaccgacuggaaccuggcccugaaccccgagggcggccccaacugggugagaaacuucguggacagccccaucaucguggacaucaccaaggacaccuucuacaagcagcccauguucuaccaccugggccacuucagcaaguucauccccgagggcagccagagagugggccugguggccagccagaagaacgaccuggacgccguggcccugaugcaccccgacggcagcgccguggugguggugcugaacagaagcagcaaggacgugccccugaccaucaaggaccccgccgugggcuuccuggagaccaucagccccggcuacagcauccacaccuaccuguggagaagacaguaa

SEQ ID NO: 17420 - RNA, 744 nt, Artificial Sequence
  GBAS__Homo_sapiens__NP_001189398
auggccgccagagugcugagagccagaggcgccgccugggccggcggccugcugcagagagccgcccccugcagccugcugcccagacugagaaccuggaccagcagcagcaacagaagcagagaggacagcuggcugaagagccuguucgugagaaagguggaccccagaaaggacgcccacagcaaccugcuggccaagaaggagaccagcaaccuguacaagcugcaguucaagagaugcugccagagauucaccaagaucaacaccacccuggugcugugguggggccugggcaccagaggcauggccagcagaaccaagcuggaguuccuggaguucagaaaggccagaagcgacaugcugcugagcagaaagaaccagcugcugcuggaguucagcuucuggaacgagcccgugcccagaagcggccccaacaucuacgagcugagaagcuaccagcugagacccggcaccaugaucgaguggggcaacuacugggccagagccaucagauucagacaggacggcaacgaggccgugggcggcuucuucagccagaucggccagcuguacauggugcaccaccugugggccuacagagaccugcagaccagagaggacaucagaaacgccgccuggcacaagcacggcugggaggagcugguguacuacaccgugccccugauccaggagauggagagcagaaucaugaucccccugaagaccagcccccugcaguaa

SEQ ID NO: 17421 - RNA, 2109 nt, Artificial Sequence
  GBE1__Homo_sapiens__NP_000149
auggccgcccccaugacccccgccgccagacccgaggacuacgaggccgcccugaacgccgcccuggccgacgugcccgagcuggccagacugcuggagaucgaccccuaccugaagcccuacgccguggacuuccagagaagauacaagcaguucagccagauccugaagaacaucggcgagaacgagggcggcaucgacaaguucagcagaggcuacgagagcuucggcgugcacagaugcgccgacggcggccuguacugcaaggagugggcccccggcgccgagggcguguuccugaccggcgacuucaacggcuggaaccccuucagcuaccccuacaagaagcuggacuacggcaagugggagcuguacaucccccccaagcagaacaagagcgugcuggugccccacggcagcaagcugaagguggugaucaccagcaagagcggcgagauccuguacagaaucagccccugggccaaguacguggugagagagggcgacaacgugaacuacgacuggauccacugggaccccgagcacagcuacgaguucaagcacagcagacccaagaagcccagaagccugagaaucuacgagagccacgugggcaucagcagccacgagggcaagguggccagcuacaagcacuucaccugcaacgugcugcccagaaucaagggccugggcuacaacugcauccagcugauggccaucauggagcacgccuacuacgccagcuucggcuaccagaucaccagcuucuucgccgccagcagcagauacggcacccccgaggagcugcaggagcugguggacaccgcccacagcaugggcaucaucgugcugcuggacguggugcacagccacgccagcaagaacagcgccgacggccugaacauguucgacggcaccgacagcugcuacuuccacagcggccccagaggcacccacgaccugugggacagcagacuguucgccuacagcagcugggaggugcugagauuccugcugagcaacaucagaugguggcuggaggaguacagauucgacggcuucagauucgacggcgugaccagcaugcuguaccaccaccacggcgugggccagggcuucagcggcgacuacagcgaguacuucggccugcagguggacgaggacgcccugaccuaccugaugcuggccaaccaccuggugcacacccugugccccgacagcaucaccaucgccgaggacgugagcggcaugcccgcccugugcagccccaucagccagggcggcggcggcuucgacuacagacuggccauggccauccccgacaaguggauccagcugcugaaggaguucaaggacgaggacuggaacaugggcgacaucguguacacccugaccaacagaagauaccuggagaagugcaucgccuacgccgagagccacgaccaggcccuggugggcgacaagagccuggccuucuggcugauggacgccgagauguacaccaacaugagcgugcugacccccuucacccccgugaucgacagaggcauccagcugcacaagaugaucagacugaucacccacggccugggcggcgagggcuaccugaacuucaugggcaacgaguucggccaccccgaguggcuggacuuccccagaaagggcaacaacgagagcuaccacuacgccagaagacaguuccaccugaccgacgacgaccugcugagauacaaguuccugaacaacuucgacagagacaugaacagacuggaggagagauacggcuggcuggccgccccccaggccuacgugagcgagaagcacgagggcaacaagaucaucgccuucgagagagccggccugcuguucaucuucaacuuccaccccagcaagagcuacaccgacuacagagugggcaccgcccugcccggcaaguucaagaucgugcuggacagcgacgccgccgaguacggcggccaccagagacuggaccacagcaccgacuucuucagcgaggccuucgagcacaacggcagacccuacagccugcugguguacauccccagcagaguggcccugauccugcagaacguggaccugcccaacuaa

SEQ ID NO: 17422 - RNA, 5580 nt, Artificial Sequence
  GBF1__Homo_sapiens__NP_004184
augguggacaagaacaucuacaucauccagggcgagaucaacaucguggugggcgccaucaagagaaacgccagauggagcacccacaccccccuggacgaggagagagacccccugcugcacagcuucggccaccugaaggaggugcugaacagcaucaccgagcugagcgagaucgagcccaacguguuccugagacccuuccuggaggugaucagaagcgaggacaccaccggccccaucaccggccuggcccugaccagcgugaacaaguuccugagcuacgcccugaucgaccccacccacgagggcaccgccgagggcauggagaacauggccgacgccgugacccacgccagauucgugggcaccgaccccgccagcgacgagguggugcugaugaagauccugcaggugcugagaacccugcugcugacccccgugggcgcccaccugaccaacgagagcgugugcgagaucaugcagagcugcuucagaaucugcuucgagaugagacugagcgagcugcugagaaagagcgccgagcacacccugguggacauggugcagcugcuguucaccagacugccccaguucaaggaggagcccaagaacuacgugggcaccaacaugaagaagcugaagaugagagccggcggcaugagcgacagcagcaaguggaagaagcagaagagaagccccagaccccccagacacaugaccaaggugacccccggcagcgagcugcccacccccaacggcaccacccugagcagcaaccugaccggcggcaugcccuucaucgacgugcccacccccaucagcagcgccagcagcgaggccgccagcgccguggugagccccagcaccgacagcggccuggaguucagcagccagaccaccagcaaggaggaccugaccgaccuggagcagcccggcagccccggcuacagcaccgccaccgagcccggcagcagcgagcugggcgugcccgagcagcccgaccugcaggagggcacccacguggagaagagccagagcgccagcguggagagcauccccgaggugcuggaggagugcaccagccccgccgaccacagcgacagcgccagcgugcacgacauggacuacgugaaccccagaggcgugagauucacccagagcagccagaaggagggcaccgcccuggugcccuacggccugcccugcaucagagagcuguucagauuccugaucagccugaccaacccccacgacagacacaacagcgaggugaugauccacaugggccugcaccugcugaccguggcccuggagagcgcccccguggcccagugccagacccugcugggccugaucaaggacgagaugugcagacaccuguuccagcugcugagcaucgagagacugaaccuguacgccgccagccugagagugugcuuccugcuguucgagagcaugagagagcaccugaaguuccagauggagauguacaucaagaagcugauggagaucaucaccguggagaaccccaagaugcccuacgagaugaaggagauggcccuggaggccaucgugcagcuguggagaauccccagcuucgugaccgagcuguacaucaacuacgacugcgacuacuacugcagcaaccuguucgaggagcugaccaagcugcugagcaagaacgccuuccccgugagcggccagcuguacaccacccaccugcugagccuggacgcccugcugaccgugaucgacagcaccgaggcccacugccaggccaaggugcugaacagccugacccagcaggagaagaaggagaccgccagacccagcugcgagaucguggacggcaccagagaggccagcaacaccgagagaaccgccagcgacggcaaggccgugggcauggccagcgacauccccggccugcaccugcccggcggcggcagacugccccccgagcacggcaagagcggcugcagcgaccuggaggaggccguggacagcggcgccgacaagaaguucgccagaaagccccccagauucagcugccugcugcccgaccccagagagcugaucgagaucaagaacaagaagaagcugcugaucaccggcaccgagcaguucaaccagaagcccaagaagggcauccaguuccugcaggagaagggccugcugaccauccccauggacaacaccgagguggcccaguggcugagagagaaccccagacuggacaagaagaugaucggcgaguucgugagcgacagaaagaacaucgaccugcuggagagcuucgugagcaccuucagcuuccagggccugagacuggacgaggcccugagacuguaccuggaggccuucagacugcccggcgaggcccccgugauccagagacugcuggaggccuucaccgagagauggaugaacugcaacggcagccccuucgccaacagcgacgccugcuucagccuggccuacgccgugaucaugcugaacaccgaccagcacaaccacaacgugagaaagcagaacgcccccaugacccuggaggaguucagaaagaaccugaagggcgugaacggcggcaaggacuucgagcaggacauccuggaggacauguaccacgccaucaagaacgaggagaucgugaugcccgaggagcagaccggccuggugagagagaacuacguguggaacgugcugcugcacagaggcgccacccccgagggcaucuuccugagagugcccaccgccagcuacgaccuggaccuguucaccaugaccuggggccccaccaucgccgcccugagcuacguguucgacaagagccuggaggagaccaucauccagaaggccaucagcggcuucagaaagugcgccaugaucagcgcccacuacggccugagcgacguguucgacaaccugaucaucagccugugcaaguucaccgcccugagcagcgagagcaucgagaaccugcccagcguguucggcagcaaccccaaggcccacaucgccgccaagaccguguuccaccuggcccacagacacggcgacauccugagagagggcuggaagaacaucauggaggccaugcugcagcuguucagagcccagcugcugcccaaggccaugaucgagguggaggacuucguggaccccaacggcaagaucagccugcagagagaggagacccccagcaacagaggcgagagcaccgugcugagcuucgugagcuggcugacccugagcggccccgagcagagcagcgugagaggccccagcaccgagaaccaggaggccaagagaguggcccuggagugcaucaagcagugcgaccccgagaagaugaucaccgagagcaaguuccugcagcuggagagccugcaggagcugaugaaggcccuggugagcgugacccccgacgaggagaccuacgacgaggaggacgccgccuucugccuggagaugcugcugagaaucgugcuggagaacagagacagagugggcugcguguggcagaccgugagagaccaccuguaccaccugugcgugcaggcccaggacuucugcuuccugguggagagagccguggugggccugcugagacuggccaucagacugcugagaagagaggagaucagcgcccaggugcugcugagccugagaauccugcugcugaugaagcccagcgugcugagcagagugagccaccagguggccuacggccugcacgagcugcugaagaccaacgccgccaacauccacagcggcgacgacugggccacccuguucacccugcuggagugcaucggcagcggcgugaagccccccgccgcccugcaggccaccgccagagccgacgcccccgacgccggcgcccagagcgacagcgagcugcccagcuaccaccagaacgacgugagccuggacagaggcuacaccagcgacagcgagguguacaccgaccacggcagacccggcaagauccacagaagcgccaccgacgccgacguggugaacagcggcuggcugguggugggcaaggacgacguggacaacagcaagcccggccccagcagacccggccccagcccccugaucaaccaguacagccugaccgugggccuggaccugggcccccacgacaccaagagccugcugaagugcguggagagccugagcuucaucgugagagacgccgcccacaucacccccgacaacuucgagcugugcgugaagacccugagaaucuucguggaggccagccugaacggcggcugcaagagccaggagaagagaggcaagagccacaaguacgacagcaagggcaacagauucaagaagaagagcaaggagggcagcaugcugagaagacccagaaccagcagccagcacgccagcagaggcggccagagcgacgacgacgaggacgagggcgugcccgccagcuaccacaccgugagccugcaggugagccaggaccugcuggaccugaugcacacccugcacaccagagccgccagcaucuacagcagcugggccgaggagcagagacaccuggagaccggcggccagaagaucgaggccgacagcagaacccugugggcccacugcuggugcccccugcugcagggcaucgccugccugugcugcgacgccagaagacaggugagaaugcaggcccugaccuaccugcagagagcccugcuggugcacgaccugcagaagcuggacgcccuggagugggagagcugcuucaacaaggugcuguucccccugcugaccaagcugcuggagaacaucagccccgccgacgugggcggcauggaggagaccagaaugagagccagcacccugcugagcaagguguuccugcagcaccugagcccccugcugagccugagcaccuucgccgcccuguggcugaccauccuggacuucauggacaaguacaugcacgccggcagcagcgaccugcugagcgaggccauccccgagagccugaagaacaugcugcuggugauggacaccgccgagaucuuccacagcgccgacgccagaggcggcggccccagcgcccugugggagaucaccugggagagaaucgacugcuuccugccccaccugagagacgagcuguucaagcagaccgugauccaggaccccaugcccauggagccccagggccagaagccccuggccagcgcccaccugaccagcgccgccggcgacaccagaacccccggccacccccccccccccgagauccccagcgagcugggcgccugcgacuucgagaagcccgagagccccagagccgccagcagcagcagccccggcagccccguggccagcagccccagcagacugagccccacccccgacggcccccccccccuggcccagcccccccugauccugcagccccuggccagcccccugcaggugggcgugccccccaugacccugcccaucauccugaaccccgcccugaucgaggccaccagccccgugccccugcuggccacccccagacccaccgaccccauccccaccagcgaggugaacuaa

SEQ ID NO: 17423 - RNA, 885 nt, Artificial Sequence
  GBGT1__Homo_sapiens__NP_001269558
augcacagaagaagacuggcccugggccugggcuucugccugcuggccggcaccagccugagcgugcuguggguguaccuggagaacuggcugcccgugagcuacgugcccuacuaccugcccugccccgagaucuucaacaugaagcugcacuacaagagagagaagccccugcagcccgugguguggagccaguacccccagcccaagcugcuggagcacagacccacccagcugcugacccugacccccuggcuggcccccaucgugagcgagggcaccuucaaccccgagcugcugcagcacaucuaccagccccugaaccugaccaucggcgugaccguguucgccgugggcaaccccagcuggagccagcccagaagcagcagcugcgugggcaccggcugcaccaccaccagcagccugaccacccugcagcccuuccccggcagcagaugggugcccaccggcuucagcgcccccagccccagcagagugacccccaccggcagaagacaccccugcgccggcuggagacccagcgccagcacccugcugagaggccugaccggcagauggaccaccagcagcgcccugauguggaccuggugcuucggcaccagaggcgcccugagacccugggagaccugguggcugcccuucacccaggccaccacccccuuccccgccagcagcagccccaugagcgccggcguguucccccugccccuguggcagaccgccaagggcaccagcaucauggugggccagagcagcggcggcagauggcccggcuacaugagccugcugggcgccgccaccuggcccagcuggagaaccagacccauggccagcuggcugcccggcggcagaaaggccaccuaa

SEQ ID NO: 17424 - RNA, 1092 nt, Artificial Sequence
  GBX1__Homo_sapiens__NP_001092304
augcagagagccggcggcggcagcgcccccggcggcaacggcggcggcggcggcggcggccccggcaccgccuucagcaucgacagccugaucggcccccccccccccagaagcggccaccugcuguacaccggcuaccccauguucaugcccuacagaccccuggugcugccccaggcccuggcccccgccccccugcccgccggccugcccccccuggccccccuggccagcuucgccggcagacugaccaacaccuucugcgccggccugggccaggccgugcccagcaugguggcccugaccaccgcccugcccagcuucgccgagccccccgacgccuucuacggcccccaggagcuggccgccgccgccgccgccgccgccgccaccgccgccagaaacaaccccgagcccggcggcagaagacccgagggcggccuggaggccgacgagcugcugcccgccagagagaagguggccgagccccccccccccccccccccccacuucagcgagaccuuccccagccugcccgccgagggcaagguguacagcagcgacgaggagaagcuggaggccagcgccggcgaccccgccggcagcgagcaggaggaggagggcagcggcggcgacagcgaggacgacggcuuccuggacagcagcgccggcggccccggcgcccugcugggccccaagcccaagcugaagggcagccugggcaccggcgccgaggagggcgcccccgugaccgccggcgugaccgcccccggcggcaagagcagaagaagaagaaccgccuucaccagcgagcagcugcuggagcuggagaaggaguuccacugcaagaaguaccugagccugaccgagagaagccagaucgcccacgcccugaagcugagcgaggugcaggugaagaucugguuccagaacagaagagccaaguggaagagaaucaaggccggcaacgugagcagcagaagcggcgagcccgugagaaaccccaagaucguggugcccauccccgugcacgugaacagauucgccgugagaagccagcaccagcagauggagcagggcgccagacccuaa

SEQ ID NO: 17425 - RNA, 1047 nt, Artificial Sequence
  GBX2__Homo_sapiens__NP_001476
augagcgccgccuucccccccagccugaugaugaugcagagaccccugggcagcagcaccgccuucagcaucgacagccugaucggcagccccccccagcccagccccggccacuucguguacaccggcuaccccauguucaugcccuacagacccguggugcugccccccccccccccccccccccccgcccugccccaggccgcccugcagcccgcccugccccccgcccacccccaccaccagauccccagccugcccaccggcuucugcagcagccuggcccagggcauggcccugaccagcacccugauggccacccugcccggcggcuucagcgccagcccccagcaccaggaggccgccgccgccagaaaguucgccccccagccccugcccggcggcggcaacuucgacaaggccgaggcccugcaggccgacgccgaggacggcaagggcuuccuggccaaggagggcagccugcuggccuucagcgccgccgagaccgugcaggccagccuggugggcgccgugagaggccagggcaaggacgagagcaagguggaggacgaccccaagggcaaggaggagagcuucagccuggagagcgacguggacuacagcagcgacgacaaccugaccggccaggccgcccacaaggaggaggaccccggccacgcccuggaggagaccccccccagcagcggcgccgccggcagcaccaccagcaccggcaagaacagaagaagaagaaccgccuucaccagcgagcagcugcuggagcuggagaaggaguuccacugcaagaaguaccugagccugaccgagagaagccagaucgcccacgcccugaagcugagcgaggugcaggugaagaucugguuccagaacagaagagccaaguggaagagagugaaggccggcaacgccaacagcaagaccggcgagcccagcagaaaccccaagaucguggugcccauccccgugcacgugagcagauucgccaucagaagccagcaccagcagcuggagcaggccagacccuaa

SEQ ID NO: 17426 - RNA, 654 nt, Artificial Sequence
  GCA__Homo_sapiens__NP_036330
auggccuaccccggcuacggcggcggcuucggcaacuucagcauccaggugcccggcaugcagaugggccagcccgugcccgagaccggccccgccauccugcuggacggcuacagcggccccgccuacagcgacaccuacagcagcgccggcgacagcguguacaccuacuucagcgccguggccggccaggacggcgagguggacgccgaggagcugcagagaugccugacccagagcggcaucaacggcaccuacagccccuucagccuggagaccugcagaaucaugaucgccaugcuggacagagaccacaccggcaagaugggcuucaacgccuucaaggagcugugggccgcccugaacgccuggaaggagaacuucaugaccguggaccaggacggcagcggcaccguggagcaccacgagcugagacaggccaucggccugaugggcuacagacugagcccccagacccugaccaccaucgugaagagauacagcaagaacggcagaaucuucuucgacgacuacguggccugcugcgugaagcugagagcccugaccgacuucuucagaaagagagaccaccugcagcagggcagcgccaacuucaucuacgacgacuuccugcagggcaccauggccaucuaa

SEQ ID NO: 17427 - RNA, 2328 nt, Artificial Sequence
  GCC1__Homo_sapiens__NP_078799
auggagaaguucggcaugaacuucggcggcggccccagcaagaaggaccugcuggagaccaucgagacccagaagaagcagcugcugcaguaccaggccagacugaaggacguggugagagccuacaagagccugcugaaggagaaggaggcccuggaggccagcaucaaggugcugagcgugagccacgaggccgacgugggccuggccggcgugcagcugcccggccugaccuuccccgacagcguggacgacagaugcagcacccacagcgaggacagcaccggcaccgccaccagccuggacaccgccgccagccugaccagcaccaagggcgaguucggcguggaggacgacagacccgccagaggcccccccccccccaagagcgaggaggccagcuggagcgagagcggcgugagcagcagcagcggcgacggccccuucgccggcggcgagguggacaagagacugcaccagcugaagacccagcuggccacccugaccagcagccuggccaccgugacccaggagaagagcagaauggaggccagcuaccuggccgacaagaagaagaugaagcaggaccuggaggacgccagcaacaaggccgaggaggagagagccagacuggagggcgagcugaagggccugcaggagcagaucgccgagaccaaggccagacugaucacccagcagcacgacagagcccaggagcagagcgaccacgcccugaugcugagagagcugcagaagcugcugcaggaggagagaacccagagacaggaccuggagcugagacuggaggagaccagagaggcccuggccggcagagccuacgccgccgagcagauggagggcuucgagcugcagaccaagcagcugaccagagagguggaggagcugaagagcgagcugcaggccaucagagacgagaagaaccagcccgaccccagacugcaggagcugcaggaggaggccgccagacugaagagccacuuccaggcccagcugcagcaggagaugagaaagaccgcccuggccgaggaccagcugagacagcagagccagguggaggagcagagaguggccgcccuggagaaccagaucagcgaggugagcgagcugcugggcaccuacgagaaggccaagcagaaggaccagcuggccauccagaagcugaaggagagaauccugcagcuggaccuggagaacaagacccuggcccuggccgccagcagcagaagcccccuggacagccacggcgaggagagcagccuggacgugaacgugcugaaggacaagauggagaagcugaagagacugcugcagguggccgccagaaagagccaggugacccuggacguggagaagcugugcgaccuggagaucaugcccagcagcgaggccgccgacggcgagaaggccaccgcccuguacuaccagcaggagcugaagcagcugaaggaggaguucgagagauacaagaugagagcccagguggugcugaagagcaagaacaccaaggacggcaaccugggcaaggagcuggaggccgcccaggagcagcuggccgagcugaaggagaaguacaucagccugagacugagcugcgaggagcuggagcaccagcaccagcaggaggccgacgacuggaagcaggagcuggccagacugcagcagcugcacagacaggagcuggagagaugccagcuggacuucagagacagaacccugaagcuggaggaggagcugcacaagcagagagacagagcccuggccgugcugaccgagaaggaccuggagcuggagcagcugagaagcguggcccuggccagcggccugcccggcagaagaagccccgugggcggcggcggccccggcgaccccgccgacaccagcagcagcgacagccugacccaggcccugcagcuggccgccgccaacgagcccaccuucuuccuguacgccgagcagcuggccagaaaggagguggagaucaccagccugagaaagcagaagcacagacuggagguggaggugcaccagcugcaggacagacugcuggaggagggcgagagacacagagaggagguggccgcccugcagagccacaucgagaagaacaucagagaccagagcagagagggcgccaaccuggaguaccugaagaacaucaucuacagauuccugacccugcccgacagccugggcagacagcagacccugaccgccauccugaccauccugcacuucagccccgaggagaagcaggugaucaugagacugcccaccagcgccagcugguggcccagcggcaagagauaa

SEQ ID NO: 17428 - RNA, 1317 nt, Artificial Sequence
  GCDH__Homo_sapiens__NP_000150
auggcccugagaggcgugagcgugagacugcugagcagaggccccggccugcacgugcugagaaccugggugagcagcgccgcccagaccgagaagggcggcagaacccagagccagcuggccaagagcagcagacccgaguucgacuggcaggacccccuggugcuggaggagcagcugaccaccgacgagauccugaucagagacaccuucagaaccuacugccaggagagacugaugcccagaauccugcuggccaacagaaacgagguguuccacagagagaucaucagcgagaugggcgagcugggcgugcugggccccaccaucaagggcuacggcugcgccggcgugagcagcguggccuacggccugcuggccagagagcuggagagaguggacagcggcuacagaagcgccaugagcgugcagagcagccuggugaugcaccccaucuacgccuacggcagcgaggagcagagacagaaguaccugccccagcuggccaagggcgagcugcugggcugcuucggccugaccgagcccaacagcggcagcgaccccagcagcauggagaccagagcccacuacaacagcagcaacaagagcuacacccugaacggcaccaagaccuggaucaccaacagccccauggccgaccuguucguggugugggccagaugcgaggacggcugcaucagaggcuuccugcuggagaagggcaugagaggccugagcgcccccagaauccagggcaaguucagccugagagccagcgccaccggcaugaucaucauggacggcguggaggugcccgaggagaacgugcugcccggcgccagcagccugggcggccccuucggcugccugaacaacgccagauacggcaucgccuggggcgugcugggcgccagcgaguucugccugcacaccgccagacaguacgcccuggacagaaugcaguucggcgugccccuggccagaaaccagcugauccagaagaagcuggccgacaugcugaccgagaucacccugggccugcacgccugccugcagcugggcagacugaaggaccaggacaaggccgcccccgagauggugagccugcugaagagaaacaacugcggcaaggcccuggacaucgccagacaggccagagacaugcugggcggcaacggcaucagcgacgaguaccacgugaucagacacgccaugaaccuggaggccgugaacaccuacgagggcacccacgacauccacgcccugauccugggcagagccaucaccggcauccaggccuucaccgccagcaaguaa

SEQ ID NO: 17429 - RNA, 2346 nt, Artificial Sequence
  GCFC2__Homo_sapiens__NP_003194
auggcccacagacccaagagaaccuucagacagagagccgccgacagcagcgacagcgacggcgccgaggagagccccgccgagcccggcgcccccagagagcugcccgugcccggcagcgccgaggaggagccccccagcggcggcggcagagcccagguggccggccugccccacagagugagaggccccagaggcagaggcagagugugggccagcagcagaagagccaccaaggccgcccccagagccgacgagggcagcgagagcagaacccuggacgugagcaccgacgaggaggacaagauccaccacagcagcgagagcaaggacgaccagggccugagcagcgacagcagcagcagccugggcgagaaggagcugagcagcaccgugaagauccccgacgccgccuucauccaggccgccagaagaaagagagagcuggccagagcccaggacgacuacaucagccuggacgugcagcacaccagcagcaucagcggcaugaagagagagagcgaggacgaccccgagagcgagcccgacgaccacgagaagagaauccccuucacccugagaccccagacccugagacagagaauggccgaggagagcaucagcagaaacgaggagaccagcgaggagagccaggaggacgagaagcaggacaccugggagcagcagcagaugagaaaggccgugaagaucaucgaggagagagacaucgaccugagcugcggcaacggcagcagcaaggugaagaaguucgacaccagcaucagcuucccccccgugaaccuggagaucaucaagaagcagcugaacaccagacugacccugcugcaggagacccacagaagccaccugagagaguacgagaaguacgugcaggacgugaagagcagcaagagcaccauccagaaccuggagagcagcagcaaccaggcccugaacugcaaguucuacaagagcaugaagaucuacguggagaaccugaucgacugccugaacgagaagaucaucaacauccaggagaucgagagcagcaugcacgcccugcugcugaagcaggccaugaccuucaugaagagaagacaggacgagcugaagcacgagagcaccuaccugcagcagcugagcagaaaggacgagaccagcaccagcggcaacuucagcguggacgagaagacccaguggauccuggaggagaucgagagcagaagaaccaagagaagacaggccagagugcugagcggcaacugcaaccaccaggagggcaccagcagcgacgacgagcugcccagcgccgagaugaucgacuuccagaagagccagggcgacauccugcagaagcagaagaagguguucgaggaggugcaggacgacuucugcaacauccagaacauccugcugaaguuccagcaguggagagagaaguuccccgacagcuacuacgaggccuucaucagccugugcauccccaagcugcugaacccccugaucagagugcagcugaucgacuggaacccccugaagcuggagagcaccggccugaaggagaugcccugguucaagagcguggaggaguucauggacagcagcguggaggacagcaagaaggagagcagcagcgacaagaaggugcugagcgccaucaucaacaagaccaucauccccagacugaccgacuucguggaguuccugugggacccccugagcaccagccagaccaccagccugaucacccacugcagagugauccuggaggagcacagcaccugcgagaacgaggugagcaagagcagacaggaccugcugaagagcaucgugagcagaaugaagaaggccguggaggacgacguguucaucccccuguaccccaagagcgccguggagaacaagaccagcccccacagcaaguuccaggagagacaguucuggagcggccugaagcuguucagaaacauccugcuguggaacggccugcugaccgacgacacccugcaggagcugggccugggcaagcugcugaacagauaccugaucaucgcccugcugaacgccacccccggccccgacguggugaagaagugcaaccagguggccgccugccugcccgagaagugguucgagaacagcgccaugagaaccagcaucccccagcuggagaacuucauccaguuccugcugcagagcgcccacaagcugagcagaagcgaguucagagacgagguggaggagaucauccugauccuggugaagaucaaggcccugaaccaggccgagagcuucaucggcgagcaccaccuggaccaccugaagagccugaucaaggaggacuaa

SEQ ID NO: 17430 - RNA, 543 nt, Artificial Sequence
  GCG__Homo_sapiens__NP_002045
augaagagcaucuacuucguggccggccuguucgugaugcuggugcagggcagcuggcagagaagccugcaggacaccgaggagaagagcagaagcuucagcgccagccaggccgacccccugagcgaccccgaccagaugaacgaggacaagagacacagccagggcaccuucaccagcgacuacagcaaguaccuggacagcagaagagcccaggacuucgugcaguggcugaugaacaccaagagaaacagaaacaacaucgccaagagacacgacgaguucgagagacacgccgagggcaccuucaccagcgacgugagcagcuaccuggagggccaggccgccaaggaguucaucgccuggcuggugaagggcagaggcagaagagacuuccccgaggagguggccaucguggaggagcugggcagaagacacgccgacggcagcuucagcgacgagaugaacaccauccuggacaaccuggccgccagagacuucaucaacuggcugauccagaccaagaucaccgacagaaaguaa

SEQ ID NO: 17431 - RNA, 1434 nt, Artificial Sequence
  GCGR__Homo_sapiens__XP_006722340
augccccccugccagccccagagaccccugcugcugcugcugcugcugcuggccugccagccccaggugcccagcgcccaggugauggacuuccuguucgagaaguggaagcuguacggcgaccagugccaccacaaccugagccugcugcccccccccaccgagcuggugugcaacagaaccuucgacaaguacagcugcuggcccgacacccccgccaacaccaccgccaacaucagcugccccugguaccugcccuggcaccacaaggugcagcacagauucguguucaagagaugcggccccgacggccagugggugagaggccccagaggccagcccuggagagacgccagccagugccagauggacggcgaggagaucgaggugcagaaggagguggccaagauguacagcagcuuccaggugauguacaccgugggcuacagccugagccugggcgcccugcugcuggcccuggccauccugggcggccugagcaagcugcacugcaccagaaacgccauccacgccaaccuguucgccagcuucgugcugaaggccagcagcgugcuggugaucgacggccugcugagaaccagauacagccagaagaucggcgacgaccugagcgugagcaccuggcugagcgacggcgccguggccggcugcagaguggccgccguguucaugcaguacggcaucguggccaacuacugcuggcugcugguggagggccuguaccugcacaaccugcugggccuggccacccugcccgagagaagcuucuucagccuguaccugggcaucggcuggggcgcccccaugcuguucguggugcccugggccguggugaagugccuguucgagaacgugcagugcuggaccagcaacgacaacaugggcuucugguggauccugagauuccccguguuccuggccauccugaucaacuucuucaucuucgugagaaucgugcagcugcugguggccaagcugagagccagacagaugcaccacaccgacuacaaguucagacuggccaagagcacccugacccugaucccccugcugggcgugcacgaggugguguucgccuucgugaccgacgagcacgcccagggcacccugagaagcgccaagcuguucuucgaccuguuccugagcagcuuccagggccugcugguggccgugcuguacugcuuccugaacaaggaggugcagagcgagcugagaagaagauggcacagauggagacugggcaaggugcugugggaggagagaaacaccagcaaccacagagccagcagcagccccggccacggcccccccagcaaggagcugcaguucggcagaggcggcggcagccaggacagcagcgccgagaccccccuggccggcggccugcccagacuggccgagagccccuucuaa

SEQ ID NO: 17432 - RNA, 753 nt, Artificial Sequence
  GCH1__Homo_sapiens__NP_001019195
auggagaagggccccgugagagcccccgccgagaagcccagaggcgccagaugcagcaacggcuuccccgagagagacccccccagacccggccccagcagacccgccgagaagccccccagacccgaggccaagagcgcccagcccgccgacggcuggaagggcgagagacccagaagcgaggaggacaacgagcugaaccugcccaaccuggccgccgccuacagcagcauccugagcagccugggcgagaacccccagagacagggccugcugaagacccccuggagagccgccagcgccaugcaguucuucaccaagggcuaccaggagaccaucagcgacgugcugaacgacgccaucuucgacgaggaccacgacgagauggugaucgugaaggacaucgacauguucagcaugugcgagcaccaccuggugcccuucgugggcaaggugcacaucggcuaccugcccaacaagcaggugcugggccugagcaagcuggccagaaucguggagaucuacagcagaagacugcaggugcaggagagacugaccaagcagaucgccguggccaucaccgaggcccugagacccgccggcgugggcguggugguggaggccacccacaugugcauggugaugagaggcgugcagaagaugaacagcaagaccgugaccagcaccaugcugggcguguucagagaggaccccaagaccagagaggaguuccugacccugaucagaagcuaa

SEQ ID NO: 17433 - RNA, 255 nt, Artificial Sequence
  GCHFR__Homo_sapiens__NP_005249
augcccuaccugcugaucagcacccagaucagaauggaggugggccccaccauggugggcgacgagcagagcgaccccgagcugaugcagcaccugggcgccagcaagagaagagcccugggcaacaacuucuacgaguacuacguggacgacccccccagaaucgugcuggacaagcuggagagaagaggcuucagagugcugagcaugaccggcgugggccagacccugguguggugccugcacaaggaguaa

SEQ ID NO: 17434 - RNA, 1425 nt, Artificial Sequence
  GC__Homo_sapiens__NP_000574
augaagagagugcuggugcugcugcuggccguggccuucggccacgcccuggagagaggcagagacuacgagaagaacaaggugugcaaggaguucagccaccugggcaaggaggacuucaccagccugagccuggugcuguacagcagaaaguuccccagcggcaccuucgagcaggugagccagcuggugaaggagguggugagccugaccgaggccugcugcgccgagggcgccgaccccgacugcuacgacaccagaaccagcgcccugagcgccaagagcugcgagagcaacagccccuuccccgugcaccccggcaccgccgagugcugcaccaaggagggccuggagagaaagcugugcauggccgcccugaagcaccagccccaggaguuccccaccuacguggagcccaccaacgacgagaucugcgaggccuucagaaaggaccccaaggaguacgccaaccaguucaugugggaguacagcaccaacuacggccaggccccccugagccugcuggugagcuacaccaagagcuaccugagcauggugggcagcugcugcaccagcgccagccccaccgugugcuuccugaaggagagacugcagcugaagcaccugagccugcugaccacccugagcaacagagugugcagccaguacgccgccuacggcgagaagaagagcagacugagcaaccugaucaagcuggcccagaaggugcccaccgccgaccuggaggacgugcugccccuggccgaggacaucaccaacauccugagcaagugcugcgagagcgccagcgaggacugcauggccaaggagcugcccgagcacaccgugaagcugugcgacaaccugagcaccaagaacagcaaguucgaggacugcugccaggagaagaccgccauggacguguucgugugcaccuacuucaugcccgccgcccagcugcccgagcugcccgacguggagcugcccaccaacaaggacgugugcgaccccggcaacaccaaggugauggacaaguacaccuucgagcugagcagaagaacccaccugcccgagguguuccugagcaaggugcuggagcccacccugaagagccugggcgagugcugcgacguggaggacagcaccaccugcuucaacgccaagggcccccugcugaagaaggagcugagcagcuucaucgacaagggccaggagcugugcgccgacuacagcgagaacaccuucaccgaguacaagaagaagcuggccgagagacugaaggccaagcugcccgacgccacccccaccgagcuggccaagcuggugaacaagcacagcgacuucgccagcaacugcugcagcaucaacagccccccccuguacugcgacagcgagaucgacgccgagcugaagaacauccuguaa

SEQ ID NO: 17435 - RNA, 1398 nt, Artificial Sequence
  GCK__Homo_sapiens__NP_000153
augcuggacgacagagccagaauggaggccgccaagaaggagaagguggagcagauccuggccgaguuccagcugcaggaggaggaccugaagaaggugaugagaagaaugcagaaggagauggacagaggccugagacuggagacccacgaggaggccagcgugaagaugcugcccaccuacgugagaagcacccccgagggcagcgaggugggcgacuuccugagccuggaccugggcggcaccaacuucagagugaugcuggugaaggugggcgagggcgaggagggccaguggagcgugaagaccaagcaccagauguacagcauccccgaggacgccaugaccggcaccgccgagaugcuguucgacuacaucagcgagugcaucagcgacuuccuggacaagcaccagaugaagcacaagaagcugccccugggcuucaccuucagcuuccccgugagacacgaggacaucgacaagggcauccugcugaacuggaccaagggcuucaaggccagcggcgccgagggcaacaacguggugggccugcugagagacgccaucaagagaagaggcgacuucgagauggacgugguggccauggugaacgacaccguggccaccaugaucagcugcuacuacgaggaccaccagugcgaggugggcaugaucgugggcaccggcugcaacgccugcuacauggaggagaugcagaacguggagcugguggagggcgacgagggcagaaugugcgugaacaccgaguggggcgccuucggcgacagcggcgagcuggacgaguuccugcuggaguacgacagacugguggacgagagcagcgccaaccccggccagcagcuguacgagaagcugaucggcggcaaguacaugggcgagcuggugagacuggugcugcugagacugguggacgagaaccugcuguuccacggcgaggccagcgagcagcugagaaccagaggcgccuucgagaccagauucgugagccagguggagagcgacaccggcgacagaaagcagaucuacaacauccugagcacccugggccugagacccagcaccaccgacugcgacaucgugagaagagccugcgagagcgugagcaccagagccgcccacaugugcagcgccggccuggccggcgugaucaacagaaugagagagagcagaagcgaggacgugaugagaaucaccgugggcguggacggcagcguguacaagcugcaccccagcuucaaggagagauuccacgccagcgugagaagacugacccccagcugcgagaucaccuucaucgagagcgaggagggcagcggcagaggcgccgcccuggugagcgccguggccugcaagaaggccugcaugcugggccaguaa

SEQ ID NO: 17436 - RNA, 1878 nt, Artificial Sequence
  GCKR__Homo_sapiens__NP_001477
augcccggcaccaagagauuccagcacgugaucgagacccccgagcccggcaagugggagcugagcggcuacgaggccgccgugcccaucaccgagaagagcaacccccugacccaggaccuggacaaggccgacgccgagaacaucgugagacugcugggccagugcgacgccgagaucuuccaggaggagggccaggcccugagcaccuaccagagacuguacagcgagagcauccugaccaccauggugcagguggccggcaaggugcaggaggugcugaaggagcccgacggcggccugguggugcugagcggcggcggcaccagcggcagaauggccuuccugaugagcgugagcuucaaccagcugaugaagggccugggccagaagccccuguacaccuaccugaucgccggcggcgacagaagcgugguggccagcagagagggcaccgaggacagcgcccugcacggcaucgaggagcugaagaagguggccgccggcaagaagagagugaucgugaucggcaucagcgugggccugagcgcccccuucguggccggccagauggacugcugcaugaacaacaccgccguguuccugcccgugcuggugggcuucaaccccgugagcauggccagaaacgaccccaucgaggacuggagcagcaccuucagacagguggccgagagaaugcagaagaugcaggagaagcagaaggccuucgugcugaaccccgccaucggccccgagggccugagcggcagcagcagaaugaagggcggcagcgccaccaagauccugcuggagacccugcugcuggccgcccacaagaccguggaccagggcaucgccgccagccagagaugccugcuggagauccugagaaccuucgagagagcccaccaggugaccuacagccagagccccaagaucgccacccugaugaagagcgugagcaccagccuggagaagaagggccacguguaccuggugggcuggcagacccugggcaucaucgccaucauggacggcguggagugcauccacaccuucggcgccgacuucagagacgugagaggcuuccugaucggcgaccacagcgacauguucaaccagaaggccgagcugaccaaccagggcccccaguucaccuucagccaggaggacuuccugaccagcauccugcccagccugaccgagaucgacaccgugguguucaucuucacccuggacgacaaccugaccgaggugcagaccaucguggagcaggugaaggagaagaccaaccacauccaggcccuggcccacagcaccgugggccagacccugcugaucccccugaagaagcuguuccccagcaucaucagcaucaccuggccccugcuguucuucgaguacgagggcaacuucauccagaaguuccagagagagcugagcaccaagugggugcugaacaccgugagcaccggcgcccacgugcugcugggcaagauccugcagaaccacaugcuggaccugagaaucagcaacagcaagcuguucuggagagcccuggccaugcugcagagauucagcggccagagcaaggccagaugcaucgagagccugcugagagccauccacuucccccagccccugagcgacgacaucagagccgcccccaucagcugccacgugcagguggcccacgagaaggagcaggugauccccaucgcccugcugagccugcuguucagaugcagcaucaccgaggcccaggcccaccuggccgccgcccccagcgugugcgaggccgugagaagcgcccuggccggccccggccagaagagaaccgccgacccccuggagauccuggagcccgacgugcaguaa

SEQ ID NO: 17437 - RNA, 1914 nt, Artificial Sequence
  GCLC__Homo_sapiens__NP_001489
augggccugcugagccagggcagcccccugagcugggaggagaccaagagacacgccgaccacgugagaagacacggcauccugcaguuccugcacaucuaccacgccgugaaggacagacacaaggacgugcugaaguggggcgacgagguggaguacaugcuggugagcuucgaccacgagaacaagaaggugagacuggugcugagcggcgagaaggugcuggagacccugcaggagaagggcgagagaaccaaccccaaccaccccacccuguggagacccgaguacggcagcuacaugaucgagggcacccccggccagcccuacggcggcaccaugagcgaguucaacaccguggaggccaacaugagaaagagaagaaaggaggccaccagcauccuggaggagaaccaggcccugugcaccaucaccagcuuccccagacugggcugccccggcuucacccugcccgaggugaagcccaaccccguggagggcggcgccagcaagagccuguucuuccccgacgaggccaucaacaagcaccccagauucagcacccugaccagaaacaucagacacagaagaggcgagaagguggugaucaacgugcccaucuucaaggacaagaacacccccagccccuucaucgagaccuucaccgaggacgacgaggccagcagagccagcaagcccgaccacaucuacauggacgccaugggcuucggcaugggcaacugcugccugcaggugaccuuccaggccugcagcaucagcgaggccagauaccuguacgaccagcuggccaccaucugccccaucgugauggcccugagcgccgccagccccuucuacagaggcuacgugagcgacaucgacugcagauggggcgugaucagcgccagcguggacgacagaaccagagaggagagaggccuggagccccugaagaacaacaacuacagaaucagcaagagcagauacgacagcaucgacagcuaccugagcaagugcggcgagaaguacaacgacaucgaccugaccaucgacaaggagaucuacgagcagcugcugcaggagggcaucgaccaccugcuggcccagcacguggcccaccuguucaucagagacccccugacccuguucgaggagaagauccaccuggacgacgccaacgagagcgaccacuucgagaacauccagagcaccaacuggcagaccaugagauucaagccccccccccccaacagcgacaucggcuggagaguggaguucagacccauggaggugcagcugaccgacuucgagaacagcgccuacgugguguucguggugcugcugaccagagugauccugagcuacaagcuggacuuccugaucccccugagcaagguggacgagaacaugaagguggcccagaagagagacgccgugcugcagggcauguucuacuucagaaaggacaucugcaagggcggcaacgccgugguggacggcugcggcaaggcccagaacagcaccgagcuggccgccgaggaguacacccugaugagcaucgacaccaucaucaacggcaaggagggcguguuccccggccugauccccauccugaacagcuaccuggagaacauggagguggacguggacaccagaugcagcauccugaacuaccugaagcugaucaagaagagagccagcggcgagcugaugaccguggccagauggaugagagaguucaucgccaaccaccccgacuacaagcaggacagcgugaucaccgacgagaugaacuacagccugauccugaagugcaaccagaucgccaacgagcugugcgagugccccgagcugcugggcagcgccuucagaaaggugaaguacagcggcagcaagaccgacagcagcaacuaa

SEQ ID NO: 17438 - RNA, 1311 nt, Artificial Sequence
  GCM1__Homo_sapiens__NP_003634
auggagcccgacgacuucgacagcgaggacaaggagauccugagcugggacaucaacgacgugaagcugccccagaacgugaagaagaccgacugguuccaggaguggcccgacagcuacgccaagcacaucuacagcagcgaggacaagaacgcccagagacaccugagcagcugggccaugagaaacaccaacaaccacaacagcagaauccugaagaagagcugccugggcgugguggugugcggcagagacugccuggccgaggagggcagaaagaucuaccugagacccgccaucugcgacaaggccagacagaagcagcagagaaagagaugccccaacugcgacggcccccugaagcugauccccugcagaggccacggcggcuuccccgugaccaacuucuggagacacgacggcagauucaucuucuuccagagcaagggcgagcacgaccaccccaagcccgagaccaagcuggaggccgaggccagaagagccaugaagaaggugaacaccgcccccagcagcgugagccugagccugaagggcagcaccgagaccagaagccugcccggcgagacccagagccagggcagccugccccugaccuggagcuuccaggagggcgugcagcugcccggcagcuacagcggccaccugaucgccaacaccccccagcagaacagccugaacgacugcuucagcuucagcaagagcuacggccugggcggcaucaccgaccugaccgaccagaccagcaccguggaccccaugaagcuguacgagaagagaaagcugagcagcagcagaaccuacagcagcggcgaccugcugccccccagcgccagcggcguguacagcgaccacggcgaccugcaggccuggagcaagaacgccgcccugggcagaaaccaccuggccgacaacugcuacagcaacuaccccuucccccugaccagcuggcccugcagcuucagccccagccagaacagcagcgagcccuucuaccagcagcugccccuggagccccccgccgccaagaccggcugccccccccuguggcccaaccccgccggcaaccuguacgaggagaaggugcacguggacuucaacagcuacgugcagagccccgccuaccacagcccccaggaggaccccuuccuguucaccuacgccagccacccccaccagcaguacagccugcccagcaagagcagcaagugggacuucgaggaggagaugaccuaccugggccuggaccacugcaacaacgacaugcugcugaaccugugcccccugagauaa

SEQ ID NO: 17439 - RNA, 1521 nt, Artificial Sequence
  GCM2__Homo_sapiens__XP_011513293
augcccgccgccgccgugcaggaggccgugggcgugugcagcuacggcaugcagcugagcugggacaucaacgacccccagaugccccaggagcuggcccuguucgaccaguucagagaguggcccgacggcuacgugagauucaucuacagcagcgacgagaagaaggcccagagacaccugagcggcugggccaugagaaacaccaacaaccacaacggccacauccugaagaagagcugccugggcgugguggugugcacccaggccugcacccugcccgacggcagcagacugcagcugagacccgccaucugcgacaaggccagacugaagcagcagaagaaggccugccccaacugccacagcgcccuggagcugauccccugcagaggccacagcggcuaccccgugaccaacuucuggagacuggacggcaacgccaucuucuuccaggccaagggcgugcacgaccaccccagacccgagagcaagagcgagaccgaggccagaagaagcgccaucaagagacagauggccagcuucuaccagccccagaagaagagaaucagagagagcgaggccgaggagaaccaggacagcagcggccacuucagcaacauccccccccuggagaaccccgaggacuucgacaucgugaccgagaccagcuuccccauccccggccagcccugccccagcuuccccaagagcgacguguacaaggccaccugcgaccuggccaccuuccagggcgacaagaugccccccuuccagaaguacagcagccccagaaucuaccugcccagaccccccugcagcuacgagcuggccaaccccggcuacaccaacagcagccccuaccccacccuguacaaggacagcaccagcauccccaacgacaccgacugggugcaccugaacacccugcagugcaacgugaacagcuacagcagcuacgagagaagcuucgacuucaccaacaagcagcacggcuggaagcccgcccugggcaagcccagccugguggagagaaccaaccacggccaguuccaggccauggccaccagacccuacuacaaccccgagcugcccugcagauaccugaccacccccccccccggcgcccccgcccugcagaccgugaucaccaccaccaccaaggugagcuaccaggccuaccagccccccgccaugaaguacagcgacagcgugagagaggugaagagccugagcagcugcaacuacgcccccgaggacaccggcaugagcguguaccccgagcccuggggcccccccgugaccgugaccagagccgccagccccagcggccccccccccaugaagaucgccggcgacugcagagccaucagacccaccguggccaucccccacgagcccgugagcagcagaaccgacgaggccgagaccugggacgugugccugagcggccugggcagcgccgugagcuacagcgacagagugggccccuucuucaccuacaacaacgaggacuucuaa

SEQ ID NO: 17440 - RNA, 8016 nt, Artificial Sequence
  GCN1L1__Homo_sapiens__NP_006827
auggccgccgacacccaggugagcgagacccugaagagauucgccggcaaggugaccaccgccagcgugaaggagagaagagagauccugagcgagcugggcaagugcguggccggcaaggaccugcccgagggcgccgugaagggccugugcaagcuguucugccugacccugcacagauacagagacgccgccagcagaagagcccugcaggccgccauccagcagcuggccgaggcccagcccgaggccaccgccaagaaccugcugcacagccugcagagcagcggcaucggcagcaaggccggcgugcccagcaagagcagcggcagcgccgcccugcuggcccugaccuggaccugccugcuggugagaaucguguuccccagcagagccaagagacagggcgacaucuggaacaagcugguggaggugcagugccugcugcugcuggaggugcugggcggcagccacaagcacgccguggacggcgccgugaagaagcugaccaagcuguggaaggagaaccccggccugguggagcaguaccugagcgccauccugagccuggagcccaaccagaacuacgccggcaugcugggccugcuggugcaguucugcaccagccacaaggagauggacguggugagccagcacaagagcgcccugcuggacuucuacaugaagaacauccugaugagcaaggugaagccccccaaguaccugcuggacagcugcgccccccugcugagauaccugagccacagcgaguucaaggaccugauccugcccaccauccagaagagccugcugagaagccccgagaacgugaucgagaccaucagcagccugcuggccagcgugacccuggaccugagccaguacgccauggacaucgugaagggccuggccggccaccugaagagcaacagccccagacugauggacgaggccgugcuggcccugagaaaccuggccagacagugcagcgacagcagcgccauggagagccugaccaagcaccuguucgccauccugggcggcagcgagggcaagcugaccgugguggcccagaagaugagcgugcugagcggcaucggcagcgugagccaccacguggugagcggccccagcagccaggugcugaacggcaucguggccgagcuguucauccccuuccugcagcaggaggugcacgagggcacccuggugcacgccgugagcgugcuggcccuguggugcaacagauucaccauggaggugcccaagaagcugaccgagugguucaagaaggccuucagccugaagaccagcaccagcgccgugagacacgccuaccugcagugcaugcuggccagcuacagaggcgacacccugcugcaggcccuggaccugcugccccugcugauccagaccguggagaaggccgccagccagagcacccaggugcccaccaucaccgagggcguggccgccgcccugcugcugcugaagcugagcguggccgacagccaggccgaggccaagcugagcagcuucuggcagcugaucguggacgagaagaagcagguguucaccagcgagaaguuccuggugauggccagcgaggacgcccugugcaccgugcugcaccugaccgagagacuguuccuggaccacccccacagacugaccggcaacaaggugcagcaguaccacagagcccugguggccgugcugcugagcagaaccuggcacgugagaagacaggcccagcagaccgugagaaagcugcugagcagccugggcggcuucaagcuggcccacggccugcuggaggagcugaagaccgugcugagcagccacaaggugcugccccuggaggcccuggugaccgacgccggcgaggugaccgaggccggcaaggccuacgugccccccagagugcugcaggaggcccugugcgugaucagcggcgugcccggccugaagggcgacgugaccgacaccgagcagcuggcccaggagaugcugaucaucagccaccaccccagccugguggccgugcagagcggccuguggcccgcccugcuggccagaaugaagaucgaccccgaggccuucaucaccagacaccuggaccagaucauccccagaaugaccacccagagcccccugaaccagagcagcaugaacgccaugggcagccugagcgugcugagccccgacagagugcugccccagcugaucagcaccaucaccgccagcgugcagaaccccgcccugagacuggugaccagagaggaguucgccaucaugcagacccccgccggcgagcuguacgacaagagcaucauccagagcgcccagcaggacagcaucaagaaggccaacaugaagagagagaacaaggccuacagcuucaaggagcagaucaucgagcuggagcugaaggaggagaucaagaagaagaagggcaucaaggaggaggugcagcugaccagcaagcagaaggagaugcugcaggcccagcuggacagagaggcccaggugagaagaagacugcaggagcuggacggcgagcuggaggccgcccugggccugcuggacaucauccuggccaagaaccccagcggccugacccaguacauccccgugcugguggacagcuuccugccccugcugaagagcccccuggccgcccccagaaucaagaaccccuuccugagccuggccgccugcgugaugcccagcagacugaaggcccugggcacccuggugagccacgugacccugagacugcugaagcccgagugcgugcuggacaagagcuggugccaggaggagcugagcguggccgugaagagagccgugaugcugcugcacacccacaccaucaccagcagagugggcaagggcgagcccggcgccgccccccugagcgcccccgccuucagccugguguuccccuuccugaagauggugcugaccgagaugccccaccacagcgaggaggaggaggaguggauggcccagauccugcagauccugaccgugcaggcccagcugagagccagccccaacaccccccccggcagaguggacgagaacggccccgagcugcugcccagaguggccaugcugagacugcugaccugggugaucggcaccggcagccccagacugcaggugcuggccagcgacacccugaccacccugugcgccagcagcagcggcgacgacggcugcgccuucgccgagcaggaggagguggacgugcugcugugcgcccugcagagccccugcgccagcgugagagagaccgugcugagaggccugauggagcugcacauggugcugcccgcccccgacaccgacgagaagaacggccugaaccugcugagaagacuguggguggugaaguucgacaaggaggaggagaucagaaagcuggccgagagacuguggagcaugaugggccuggaccugcagcccgaccugugcagccugcugaucgacgacgugaucuaccacgaggccgccgugagacaggccggcgccgaggcccugagccaggccguggccagauaccagagacaggccgccgaggugaugggcagacugauggagaucuaccaggagaagcuguacagacccccccccgugcuggacgcccugggcagagugaucagcgagagcccccccgaccagugggaggccagaugcggccuggcccuggcccugaacaagcugagccaguaccuggacagcagccaggugaagccccuguuccaguucuucgugcccgacgcccugaacgacagacaccccgacgugagaaagugcaugcuggacgccgcccuggccacccugaacacccacggcaaggagaacgugaacagccugcugcccguguucgaggaguuccugaagaacgcccccaacgacgccagcuacgacgccgugagacagagcgugguggugcugaugggcagccuggccaagcaccuggacaagagcgaccccaaggugaagcccaucguggccaagcugaucgccgcccugagcacccccagccagcaggugcaggagagcguggccagcugccugcccccccuggugcccgccaucaaggaggacgccggcggcaugauccagagacugaugcagcagcugcuggagagcgacaaguacgccgagagaaagggcgccgccuacggccuggccggccuggugaagggccugggcauccugagccugaagcagcaggagaugauggccgcccugaccgacgccauccaggacaagaagaacuucagaagaagagagggcgcccuguucgccuucgagaugcugugcaccaugcugggcaagcuguucgagcccuacguggugcacgugcugccccaccugcugcugugcuucggcgacggcaaccaguacgugagagaggccgccgacgacugcgccaaggccgugaugagcaaccugagcgcccacggcgugaagcuggugcugcccagccugcuggccgcccuggaggaggagagcuggagaaccaaggccggcagcguggagcugcugggcgccauggccuacugcgcccccaagcagcugagcagcugccugcccaacaucgugcccaagcugaccgaggugcugaccgacagccacgugaaggugcagaaggccggccagcaggcccugagacagaucggcagcgugaucagaaaccccgagauccuggccaucgcccccgugcugcuggacgcccugaccgaccccagcagaaagacccagaagugccugcagacccugcuggacaccaaguucgugcacuucaucgacgcccccagccuggcccugaucaugcccaucgugcagagagccuuccaggacagaagcaccgacaccagaaagauggccgcccagaucaucggcaacauguacagccugaccgaccagaaggaccuggcccccuaccugcccagcgugacccccggccugaaggccagccugcuggaccccgugcccgaggugagaaccgugagcgccaaggcccugggcgccauggugaagggcaugggcgagagcugcuucgaggaccugcugcccuggcugauggagacccugaccuacgagcagagcagcguggacagaagcggcgccgcccagggccuggccgaggugauggccggccugggcguggagaagcuggagaagcugaugcccgagaucguggccaccgccagcaagguggacaucgccccccacgugagagacggcuacaucaugauguucaacuaccugcccaucaccuucggcgacaaguucacccccuacgugggccccaucauccccugcauccugaaggcccuggccgacgagaacgaguucgugagagacaccgcccugagagccggccagagagugaucagcauguacgccgagaccgccaucgcccugcugcugccccagcuggagcagggccuguucgacgaccuguggagaaucagauucagcagcgugcagcugcugggcgaccugcuguuccacaucagcggcgugaccggcaagaugaccaccgagaccgccagcgaggacgacaacuucggcaccgcccagagcaacaaggccaucaucaccgcccugggcguggagagaagaaacagagugcuggccggccuguacaugggcagaagcgacacccagcugguggugagacaggccagccugcacguguggaagaucguggugagcaacacccccagaacccugagagagauccugcccacccuguucggccugcugcugggcuuccuggccagcaccugcgccgacaagagaaccaucgccgccagaacccugggcgaccuggugagaaagcugggcgagaagauccugcccgagaucauccccauccuggaggagggccugagaagccagaagagcgacgagagacagggcgugugcaucggccugagcgagaucaugaagagcaccagcagagacgccgugcuguacuucagcgagagccuggugcccaccgccagaaaggcccugugcgacccccuggaggaggugagagaggccgccgccaagaccuucgagcagcugcacagcaccaucggccaccaggcccuggaggacauccugcccuuccugcugaagcagcuggacgacgaggaggugagcgaguucgcccuggacggccugaagcaggugauggccaucaagagcagaguggugcugcccuaccuggugcccaagcugaccaccccccccgugaacaccagagugcuggccuuccugagcagcguggccggcgacgcccugaccagacaccugggcgugauccugcccgccgugaugcuggcccugaaggagaagcugggcacccccgacgagcagcuggagauggccaacugccaggccgugauccugagcguggaggacgacaccggccacagaaucaucaucgaggaccugcuggaggccaccagaagccccgaggugggcaugagacaggccgccgccaucauccugaacaucuacugcagcagaagcaaggccgacuacaccagccaccugagaagccuggugagcggccugaucagacuguucaacgacagcagccccguggugcuggaggagagcugggacgcccugaacgccaucaccaagaagcuggacgccggcaaccagcuggcccugaucgaggagcugcacaaggagaucagacugaucggcaacgagagcaagggcgagcacgugcccggcuucugccugcccaagaagggcgugaccagcauccugcccgugcugagagagggcgugcugaccggcagccccgagcagaaggaggaggccgccaaggcccugggccuggugaucagacugaccagcgccgacgcccugagacccagcguggugagcaucaccggcccccugaucagaauccugggcgacagauucagcuggaacgugaaggccgcccugcuggagacccugagccugcugcuggccaaggugggcaucgcccugaagcccuuccugccccagcugcagaccaccuucaccaaggcccugcaggacagcaacagaggcgugagacugaaggccgccgacgcccugggcaagcugaucagcauccacaucaagguggacccccuguucaccgagcugcugaacggcaucagagccauggaggaccccggcgugagagacaccaugcugcaggcccugagauucgugauccagggcgccggcgccaagguggacgccgugaucagaaagaacaucgugagccugcugcugagcaugcugggccacgacgaggacaacaccagaaucagcagcgccggcugccugggcgagcugugcgccuuccugaccgaggaggagcugagcgccgugcugcagcagugccugcuggccgacgugagcggcaucgacuggauggugagacacggcagaagccuggcccugagcguggccgugaacguggcccccggcagacugugcgccggcagauacagcagcgacgugcaggagaugauccugagcagcgccaccgccgacagaauccccaucgccgugagcggcgugagaggcaugggcuuccugaugagacaccacaucgagaccggcggcggccagcugcccgccaagcugagcagccuguucgugaagugccugcagaaccccagcagcgacaucagacugguggccgagaagaugaucuggugggccaacaaggacccccugcccccccuggacccccaggccaucaagcccauccugaaggcccugcuggacaacaccaaggacaagaacaccguggugagagccuacagcgaccaggccaucgugaaccugcugaagaugagacagggcgaggagguguuccagagccugagcaagauccuggacguggccagccuggaggugcugaacgaggugaacagaagaagccugaagaagcuggccagccaggccgacagcaccgagcagguggacgacaccauccugaccuaa

SEQ ID NO: 17441 - RNA, 1287 nt, Artificial Sequence
  GCNT1__Homo_sapiens__XP_006717115
augcugagaacccugcugagaagaagacuguucagcuaccccaccaaguacuacuucauggugcuggugcugagccugaucaccuucagcgugcugagaauccaccagaagcccgaguucgugagcgugagacaccuggagcuggccggcgagaaccccagcagcgacaucaacugcaccaaggugcugcagggcgacgugaacgagauccagaaggugaagcuggagauccugaccgugaaguucaagaagagacccagauggacccccgacgacuacaucaacaugaccagcgacugcagcagcuucaucaagagaagaaaguacaucguggagccccugagcaaggaggaggccgaguuccccaucgccuacagcaucguggugcaccacaagaucgagaugcuggacagacugcugagagccaucuacaugccccagaacuucuacugcauccacguggacaccaagagcgaggacagcuaccuggccgccgugaugggcaucgccagcugcuucagcaacguguucguggccagcagacuggagagcgugguguacgccagcuggagcagagugcaggccgaccugaacugcaugaaggaccuguacgccaugagcgccaacuggaaguaccugaucaaccugugcggcauggacuuccccaucaagaccaaccuggagaucgugagaaagcugaagcugcugaugggcgagaacaaccuggagaccgagagaaugcccagccacaaggaggagagauggaagaagagauacgagguggugaacggcaagcugaccaacaccggcaccgugaagaugcugcccccccuggagaccccccuguucagcggcagcgccuacuucguggugagcagagaguacgugggcuacgugcugcagaacgagaagauccagaagcugauggagugggcccaggacaccuacagccccgacgaguaccugugggccaccauccagagaauccccgaggugcccggcagccugcccgccagccacaaguacgaccugagcgacaugcaggccguggccagauucgugaaguggcaguacuucgagggcgacgugagcaagggcgcccccuacccccccugcgacggcgugcacgugagaagcgugugcaucuucggcgccggcgaccugaacuggaugcugagaaagcaccaccuguucgccaacaaguucgacguggacguggaccuguucgccauccagugccuggacgagcaccugagacacaaggcccuggagacccugaagcacuaa

SEQ ID NO: 17442 - RNA, 1203 nt, Artificial Sequence
  GCNT2__Homo_sapiens__NP_001482
augccccugagcaugagauaccuguucaucaucagcgugagcagcgugaucaucuucaucguguucagcguguucaacuucggcggcgaccccagcuuccagagacugaacaucagcgacccccugagacugacccaggugugcaccagcuucaucaacggcaagaccagauuccuguggaagaacaagcugaugauccacgagaagagcagcugcaaggaguaccugacccagagccacuacaucaccgccccccugagcaaggaggaggccgacuucccccuggccuacaucauggugauccaccaccacuucgacaccuucgccagacuguucagagccaucuacaugccccagaacaucuacugcgugcacguggacgagaaggccaccaccgaguucaaggacgccguggagcagcugcugagcugcuuccccaacgccuuccuggccagcaagauggagcccgugguguacggcggcaucagcagacugcaggccgaccugaacugcaucagagaccugagcgccuucgaggugagcuggaaguacgugaucaacaccugcggccaggacuucccccugaagaccaacaaggagaucgugcaguaccugaagggcuucaagggcaagaacaucacccccggcgugcugccccccgcccacgccaucggcagaaccaaguacgugcaccaggagcaccugggcaaggagcugagcuacgugaucagaaccaccgcccugaagcccccccccccccacaaccugaccaucuacuucggcagcgccuacguggcccugagcagagaguucgccaacuucgugcugcacgaccccagagccguggaccugcugcaguggagcaaggacaccuucagccccgacgagcacuucugggugacccugaacagaauccccggcgugcccggcagcaugcccaacgccagcuggaccggcaaccugagagccaucaaguggagcgacauggaggacagacacggcggcugccacggccacuacgugcacggcaucugcaucuacggcaacggcgaccugaaguggcuggugaacagccccagccuguucgccaacaaguucgagcugaacaccuacccccugaccguggagugccuggagcugagacacagagagagaacccugaaccagagcgagaccgccauccagcccagcugguacuucuaa

SEQ ID NO: 17443 - RNA, 1317 nt, Artificial Sequence
  GCNT3__Homo_sapiens__NP_004742
auggugcaguggaagagacugugccagcugcacuaccugugggcccugggcugcuacaugcugcuggccaccguggcccugaagcugagcuucagacugaagugcgacagcgaccaccugggccuggagagcagagagagccagagccaguacugcagaaacauccuguacaacuuccugaagcugcccgccaagagaagcaucaacugcagcggcgugaccagaggcgaccaggaggccgugcugcaggccauccugaacaaccuggaggugaagaagaagagagagcccuucaccgacacccacuaccugagccugaccagagacugcgagcacuucaaggccgagagaaaguucauccaguucccccugagcaaggaggagguggaguuccccaucgccuacagcauggugauccacgagaagaucgagaacuucgagagacugcugagagccguguacgccccccagaacaucuacugcgugcacguggacgagaagagccccgagaccuucaaggaggccgugaaggccaucaucagcugcuuccccaacguguucaucgccagcaagcuggugagagugguguacgccagcuggagcagagugcaggccgaccugaacugcauggaggaccugcugcagagcagcgugcccuggaaguacuuccugaacaccugcggcaccgacuuccccaucaagagcaacgccgagauggugcaggcccugaagaugcugaacggcagaaacagcauggagagcgaggugccccccaagcacaaggagaccagauggaaguaccacuucgagguggugagagacacccugcaccugaccaacaagaagaaggaccccccccccuacaaccugaccauguucaccggcaacgccuacaucguggccagcagagacuucgugcagcacgugcugaagaaccccaagagccagcagcugaucgagugggugaaggacaccuacagccccgacgagcaccugugggccacccugcagagagccagauggaugcccggcagcgugcccaaccaccccaaguacgacaucagcgacaugaccagcaucgccagacuggugaaguggcagggccacgagggcgacaucgacaagggcgcccccuacgcccccugcagcggcauccaccagagagccaucugcguguacggcgccggcgaccugaacuggaugcugcagaaccaccaccugcuggccaacaaguucgaccccaagguggacgacaacgcccugcagugccuggaggaguaccugagauacaaggccaucuacggcaccgagcuguaa

SEQ ID NO: 17444 - RNA, 1293 nt, Artificial Sequence
  GCNT7__Homo_sapiens__NP_542182
augagccagcugagagccaccaagagcggccugguggugagagccgugaucugcaucuucaucuuccuguaccugagaaaccccacccccgccgagagcgaggaggagcccgcccagcccgaggugguggagugcggcuucuaccccgacgagcugugcagcgcccuguucgagggcaagggcgccgccccccagaucgccaaguucugcaagaccccccacaagagcgagauccacgcccaccugcacacccccggcaacugcagcagaaucagcagaggccugcacuucaucaccagaccccugagcgccgaggagggcgacuucagccuggccuacaucaucaccauccacaaggagcuggccauguucgugcagcugcugagagccaucuacgugccccagaacguguacugcauccacguggacgagaaggcccccaugaaguacaagaccgccgugcagacccuggugaacugcuucgagaacguguucaucagcagcaagaccgagaagguggccuacgccggcuucaccagacugcaggccgacaucaacugcaugaaggugcuggugcacagcaaguuccaguggaacuacgugaucaaccugugcggccaggacuuccccaucaagaccaacagagagaucauccacuacaucagaagcaaguggagcgacaagaacaucacccccggcgugauccagccccugcacaucaagagcaagaccagccagagccaccuggaguucgugcccaagggcagcaucuacgccccccccaacaacagauucaaggacaagcccccccacaaccugaccaucuacuucggcagcgccuacuacgugcugaccagaaaguucguggaguucauccugaccgacauccacgccaaggacaugcugcaguggagcaaggacaucagaagccccgagcagcacuacugggugacccugaacagacugaaggacgcccccggcgccacccccaacgccggcugggagggcaacgugagagccaucaagagaaagagcgaggagggcaacgugcacgacggcugcaagggcagauacguggaggacaucugcguguacggccccggcgaccugcccuggcugauccagagccccagccuguucgccaacaaguucgagcccagcaccgacccccugguggugaccugccuggagagaagacacagacugcaggugcugagacaggccgaggugcccaucgagccccacuggcacuuccagcagcagagccacuucaacaugagacugaacagauaa

SEQ ID NO: 17445 - RNA, 1653 nt, Artificial Sequence
  GCOM1__Homo_sapiens__NP_001018100
augcugagaagcaccagcaccgugacccugcugagcggcggcgccgccagaacccccggcgcccccagcagaagagccaacgugugcagacugagacugaccgugccccccgagagccccgugcccgagcagugcgagaagaagaucgagagaaaggagcagcugcuggaccugagcaacggcgagcccaccagaaagcugccccagggcgugguguacggcguggugagaagaagcgaccagaaccagcagaaggagauggugguguacggcuggagcaccagccagcugaaggaggagaugaacuacaucaaggacgugagagccacccuggagaaggugagaaagagaauguacggcgacuacgacgagaugagacagaagaucagacagcugacccaggagcugagcgugagccacgcccagcaggaguaccuggagaaccacauccagacccagagcagcgcccuggacagauucaacgccaugaacagcgcccuggccagcgacagcaucggccugcagaagacccugguggacgugacccuggagaacagcaacaucaaggaccagaucagaaaccugcagcagaccuacgaggccagcauggacaagcugagagagaagcagagacagcuggagguggcccagguggagaaccagcugcugaagaugaagguggagagcagccaggaggccaacgccgaggugaugagagagaugaccaagaagcuguacagccaguacgaggagaagcugcaggaggagcagagaaagcacagcgccgagaaggaggcccugcuggaggagaccaacagcuuccugaaggccaucgaggaggccaacaagaagaugcaggccgccgagaucagccuggaggagaaggaccagagaaucggcgagcuggacagacugaucgagagaauggagaaggagagacaccagcugcagcugcagcugcuggagcacgagaccgagaugagcggcgagcugaccgacagcgacaaggagagauaccagcagcuggaggaggccagcgccagccugagagagagaaucagacaccuggacgacauggugcacugccagcagaagaaggugaagcagaugguggaggagaucgagagccugaagaagaagcugcagcagaagcagcugcugauccugcagcugcuggagaagaucagcuuccuggagggcgagaacaacgagcugcagagcagacuggacuaccugaccgagacccaggccaagaccgagguggagaccagagagaucggcgugggcugcgaccugcugcccagacugcccuucagacagaacgacagcagcagccacugccagaagagcggcagccccaucagcagcgaggagagaagaagaagagacaagcagcaccuggacgacaucaccgccgccagacugcugccccugcaccacaugcccacccagcugcugagcaucgaggagagccuggcccugcagaagcagcagaagcagaacuacgaggagaugcaggccaagcuggccgcccagaagcuggccgagagacugaacaucaagaugagaagcuacaaccccgagggcgagagcagcggcagauacagagaggugagagacgaggacgacgacuggagcagcgacgaguucuaa

SEQ ID NO: 17446 - RNA, 543 nt, Artificial Sequence
  GCSAM__Homo_sapiens__NP_001177188
augggcaacagccugcugagagagaacagcuucagaagacagcagaacacccaggagaugcccuggaacgugagaaugcagagccccaagcagagaaccagcagaugcugggaccaccacaucgccgagggcugcuucugccugcccuggaagaagauccugaucuucgagaagagacaggacagccagaacgagaacgagagaaugagcagcacccccauccaggacaacguggaccagaccuacagcgaggagcugugcuacacccugaucaaccacagagugcugugcaccagacccagcggcaacagcgccgaggaguacuacgagaacgugcccugcaaggccgagagacccagagagagccugggcggcaccgagaccgaguacagccugcugcacaugcccagcaccgaccccagacacgccagaagccccgaggacgaguacgagcugcugaugccccacagaaucagcagccacuuccugcagcagcccagaccccugauggcccccagcgagacccaguucagccaccuguaa

SEQ ID NO: 17447 - RNA, 348 nt, Artificial Sequence
  GCSAML__Homo_sapiens__NP_001268764
augggcaacuaccugcugagaaagcugagacaggagaugaccaccuucgagagaaagcugcaggaccaggacaagaagagccaggaggugagcagcaccagcaaccaggagaacgagaacggcagcggcagcgaggaggugugcuacaccgugaucaaccacaucccccaccagagaagcagccugagcagcaacgacgacggcuacgagaacaucgacagccugaccagaaaggugagacaguucagagagagaagcgagaccgaguacgcccugcugagaaccagcgugagcagacccugcagcugcacccacgagcacgacuacgaggugguguucccccacuaa

SEQ ID NO: 17448 - RNA, 522 nt, Artificial Sequence
  GCSH__Homo_sapiens__NP_004474
auggcccugagaguggugagaagcgugagagcccugcugugcacccugagagccgugcccagccccgccgcccccugcccccccagacccuggcagcugggcgugggcgccgugagaacccugagaaccggccccgcccugcugagcgugagaaaguucaccgagaagcacgagugggugaccaccgagaacggcaucggcaccgugggcaucagcaacuucgcccaggaggcccugggcgacgugguguacugcagccugcccgaggugggcaccaagcugaacaagcaggacgaguucggcgcccuggagagcgugaaggccgccagcgagcuguacagcccccugagcggcgaggugaccgagaucaacgaggcccuggccgagaaccccggccuggugaacaagagcugcuacgaggacggcuggcugaucaagaugacccugagcaaccccagcgagcuggacgagcugaugagcgaggaggccuacgagaaguacaucaagagcaucgaggaguaa

SEQ ID NO: 17449 - RNA, 1416 nt, Artificial Sequence
  GDA__Homo_sapiens__NP_001229434
augugcgccgcccagaugcccccccuggcccacaucuucagaggcaccuucgugcacagcaccuggaccugccccauggaggugcugagagaccaccugcugggcgugagcgacagcggcaagaucguguuccuggaggaggccagccagcaggagaagcuggccaaggaguggugcuucaagcccugcgagaucagagagcugagccaccacgaguucuucaugcccggccugguggacacccacauccacgccagccaguacagcuucgccggcagcagcaucgaccugccccugcuggaguggcugaccaaguacaccuuccccgccgagcacagauuccagaacaucgacuucgccgaggagguguacaccagaguggugagaagaacccugaagaacggcaccaccaccgccugcuacuucgccaccauccacaccgacagcagccugcugcuggccgacaucaccgacaaguucggccagagagccuucgugggcaaggugugcauggaccugaacgacaccuuccccgaguacaaggagaccaccgaggagagcaucaaggagaccgagagauucgugagcgagaugcugcagaagaacuacagcagagugaagcccaucgugacccccagauucagccugagcugcagcgagacccugaugggcgagcugggcaacaucgccaagaccagagaccugcacauccagagccacaucagcgagaacagagacgagguggaggccgugaagaaccuguaccccagcuacaagaacuacaccagcguguacgacaagaacaaccugcugaccaacaagaccgugauggcccacggcugcuaccugagcgccgaggagcugaacguguuccacgagagaggcgccagcaucgcccacugccccaacagcaaccugagccugagcagcggcuuccugaacgugcuggaggugcugaagcacgaggugaagaucggccugggcaccgacguggccggcggcuacagcuacagcaugcuggacgccaucagaagagccgugauggugagcaacauccugcugaucaacaaggugaacgagaagagccugacccugaaggagguguucagacuggccacccugggcggcagccaggcccugggccuggacggcgagaucggcaacuucgaggugggcaaggaguucgacgccauccugaucaaccccaaggccagcgacagccccaucgaccuguucuacggcgacuucuucggcgacaucagcgaggccgugauccagaaguuccuguaccugggcgacgacagaaacaucgaggagguguacgugggcggcaagcagguggugcccuucagcagcagcgugaaggagaccauccaccugcccgccagcagcccccaccccccccccuuccccuaa

SEQ ID NO: 17450 - RNA, 873 nt, Artificial Sequence
  GDAP1__Homo_sapiens__NP_001035808
augagacugaacagcaccggcgaggugcccgugcugauccacggcgagaacaucaucugcgaggccacccagaucaucgacuaccuggagcagaccuuccuggacgagagaacccccagacugaugcccgacaaggagagcauguacuaccccagagugcagcacuacagagagcugcuggacagccugcccauggacgccuacacccacggcugcauccugcaccccgagcugaccguggacagcaugauccccgccuacgccaccaccagaaucagaagccagaucggcaacaccgagagcgagcugaagaagcuggccgaggagaaccccgaccugcaggaggccuacaucgccaagcagaagagacugaagagcaagcugcuggaccacgacaacgugaaguaccugaagaagauccuggacgagcuggagaaggugcuggaccagguggagaccgagcugcagagaagaaacgaggagacccccgaggagggccagcagcccuggcugugcggcgagagcuucacccuggccgacgugagccuggccgugacccugcacagacugaaguuccugggcuucgccagaagaaacuggggcaacggcaagagacccaaccuggagaccuacuacgagagagugcugaagagaaagaccuucaacaaggugcugggccacgugaacaacauccugaucagcgccgugcugcccaccgccuucagaguggccaagaagagagcccccaaggugcugggcaccacccugguggugggccugcuggccggcgugggcuacuucgccuucaugcuguucagaaagagacugggcagcaugauccuggccuucagacccagacccaacuacuucuaa

SEQ ID NO: 17451 - RNA, 996 nt, Artificial Sequence
  GDE1__Homo_sapiens__NP_057725
auguggcugugggaggaccagggcggccugcugggccccuucagcuuccugcugcuggugcugcugcuggugaccagaagccccgugaacgccugccugcugaccggcagccuguucgugcugcugagaguguucagcuucgagcccgugcccagcugcagagcccugcaggugcugaagcccagagacagaaucagcgccaucgcccacagaggcggcagccacgacgcccccgagaacacccuggccgccaucagacaggccgccaagaacggcgccaccggcguggagcuggacaucgaguucaccagcgacggcauccccgugcugaugcacgacaacaccguggacagaaccaccgacggcaccggcagacugugcgaccugaccuucgagcagaucagaaagcugaaccccgccgccaaccacagacugagaaacgacuuccccgacgagaagauccccacccugagagaggccguggccgagugccugaaccacaaccugaccaucuucuucgacgugaagggccacgcccacaaggccaccgaggcccugaagaagauguacauggaguucccccagcuguacaacaacagcguggugugcagcuuccugcccgaggugaucuacaagaugagacagaccgacagagacgugaucaccgcccugacccacagacccuggagccugagccacaccggcgacggcaagcccagauacgacaccuucuggaagcacuucaucuucgugaugauggacauccugcuggacuggagcaugcacaacauccugugguaccugugcggcaucagcgccuuccugaugcagaaggacuucgugagccccgccuaccugaagaaguggagcgccaagggcauccagguggugggcuggaccgugaacaccuucgacgagaagagcuacuacgagagccaccugggcagcagcuacaucaccgacagcaugguggaggacugcgagccccacuucuaa

SEQ ID NO: 17452 - RNA, 1437 nt, Artificial Sequence
  GDF10__Homo_sapiens__NP_004953
auggcccacgugcccgccagaaccagccccggccccggcccccagcugcugcugcugcugcugccccuguuccugcugcugcugagagacguggccggcagccacagagcccccgccuggagcgcccugcccgccgccgccgacggccugcagggcgacagagaccugcagagacaccccggcgacgccgccgccacccugggccccagcgcccaggacaugguggccgugcacaugcacagacuguacgagaaguacagcagacagggcgccagacccggcggcggcaacaccgugagaagcuucagagccagacuggaggugguggaccagaaggccguguacuucuucaaccugaccagcaugcaggacagcgagaugauccugaccgccaccuuccacuucuacagcgagccccccagauggcccagagcccuggaggugcugugcaagcccagagccaagaacgccagcggcagaccccugccccugggcccccccaccagacagcaccugcuguucagaagccugagccagaacaccgccacccagggccugcugagaggcgccauggcccuggcccccccccccagaggccuguggcaggccaaggacaucagccccaucgugaaggccgccagaagagacggcgagcugcugcugagcgcccagcuggacagcgaggagagagaccccggcgugcccagacccagccccuacgcccccuacauccugguguacgccaacgaccuggccaucagcgagcccaacagcguggccgugacccugcagagauacgaccccuuccccgccggcgaccccgagcccagagccgcccccaacaacagcgccgaccccagagugagaagagccgcccaggccaccggcccccugcaggacaacgagcugcccggccuggacgagagaccccccagagcccacgcccagcacuuccacaagcaccagcuguggcccagccccuucagagcccugaagcccagacccggcagaaaggacagaagaaagaagggccaggagguguucauggccgccagccaggugcuggacuucgacgagaagaccaugcagaaggccagaagaaagcagugggacgagcccagagugugcagcagaagauaccugaagguggacuucgccgacaucggcuggaacgaguggaucaucagccccaagagcuucgacgccuacuacugcgccggcgccugcgaguuccccaugcccaagaucgugagacccagcaaccacgccaccauccagagcaucgugagagccgugggcaucauccccggcauccccgagcccugcugcgugcccgacaagaugaacagccugggcgugcuguuccuggacgagaacagaaacguggugcugaagguguaccccaacaugagcguggacaccugcgccugcagauaa

SEQ ID NO: 17453 - RNA, 1224 nt, Artificial Sequence
  GDF11__Homo_sapiens__XP_006719257
auggugcuggccgccccccugcugcugggcuuccugcugcuggcccuggagcugagacccagaggcgaggccgccgagggccccgccgccgccgccgccgccgccgccgccgccgccgccgccggcgugggcggcgagagaagcagcagacccgcccccagcguggcccccgagcccgacggcugccccgugugcguguggagacagcacagcagagagcugagacuggagagcaucaagagccagauccugagcaagcugagacugaaggaggcccccaacaucagcagagagguggugaagcagcugcugcccaaggcccccccccugcagcagauccuggaccugcacgacuuccagggcgacgcccugcagcccgaggacuuccuggaggaggacgaguaccacgccaccaccgagaccgugaucagcauggcccaggagaccgaccccgccgugcagaccgacggcagcccccugugcugccacuuccacuucagccccaaggugauguucaccaaggugcugaaggcccagcuguggguguaccugagacccgugcccagacccgccaccguguaccugcagauccugagacugaagccccugaccggcgagggcaccgccggcggcggcggcggcggcagaagacacaucagaaucagaagccugaagaucgagcugcacagcagaagcggccacuggcagagcaucgacuucaagcaggugcugcacagcugguucagacagccccagagcaacuggggcaucgagaucaacgccuucgaccccagcggcaccgaccuggccgugaccagccugggccccggcgccgagggccugcaccccuucauggagcugagagugcuggagaacaccaagagaagcagaagaaaccugggccuggacugcgacgagcacagcagcgagagcagaugcugcagauacccccugaccguggacuucgaggccuucggcugggacuggaucaucgcccccaagagauacaaggccaacuacugcagcggccagugcgaguacauguucaugcagaaguacccccacacccaccuggugcagcaggccaaccccagaggcagcgccggccccugcugcacccccaccaagaugagccccaucaacaugcuguacuucaacgacaagcagcagaucaucuacggcaagauccccggcauggugguggacagaugcggcugcagcuaa

SEQ ID NO: 17454 - RNA, 927 nt, Artificial Sequence
  GDF15__Homo_sapiens__NP_004855
augcccggccaggagcugagaaccgugaacggcagccagaugcugcuggugcugcuggugcugagcuggcugccccacggcggcgcccugagccuggccgaggccagcagagccagcuuccccggccccagcgagcugcacagcgaggacagcagauucagagagcugagaaagagauacgaggaccugcugaccagacugagagccaaccagagcugggaggacagcaacaccgaccuggugcccgcccccgccgugagaauccugacccccgaggugagacugggcagcggcggccaccugcaccugagaaucagcagagccgcccugcccgagggccugcccgaggccagcagacugcacagagcccuguucagacugagccccaccgccagcagaagcugggacgugaccagaccccugagaagacagcugagccuggccagaccccaggcccccgcccugcaccugagacugagccccccccccagccagagcgaccagcugcuggccgagagcagcagcgccagaccccagcuggagcugcaccugagaccccaggccgccagaggcagaagaagagccagagccagaaacggcgaccacugcccccugggccccggcagaugcugcagacugcacaccgugagagccagccuggaggaccugggcugggccgacugggugcugagccccagagaggugcaggugaccaugugcaucggcgccugccccagccaguucagagccgccaacaugcacgcccagaucaagaccagccugcacagacugaagcccgacaccgugcccgcccccugcugcgugcccgccagcuacaaccccauggugcugauccagaagaccgacaccggcgugagccugcagaccuacgacgaccugcuggccaaggacugccacugcaucuaa

SEQ ID NO: 17455 - RNA, 1119 nt, Artificial Sequence
  GDF1__Homo_sapiens__NP_001483
augccccccccccagcagggccccugcggccaccaccugcugcugcugcuggcccugcugcugcccagccugccccugaccagagcccccgugccccccggccccgccgccgcccugcugcaggcccugggccugagagacgagccccagggcgcccccagacugagacccgugccccccgugauguggagacuguucagaagaagagacccccaggagaccagaagcggcagcagaagaaccagccccggcgugacccugcagcccugccacguggaggagcugggcguggccggcaacaucgugagacacauccccgacagaggcgcccccaccagagccagcgagcccgccagcgccgccggccacugccccgaguggaccgugguguucgaccugagcgccguggagcccgccgagagacccagcagagccagacuggagcugagauucgccgccgccgccgccgccgcccccgagggcggcugggagcugagcguggcccaggccggccagggcgccggcgccgaccccggccccgugcugcugagacagcuggugcccgcccugggcccccccgugagagccgagcugcugggcgccgccugggccagaaacgccagcuggcccagaagccugagacuggcccuggcccugagacccagagcccccgccgccugcgccagacuggccgaggccagccugcugcuggugacccuggaccccagacugugccacccccuggccagacccagaagagacgccgagcccgugcugggcggcggccccggcggcgccugcagagccagaagacuguacgugagcuucagagaggugggcuggcacagaugggugaucgcccccagaggcuuccuggccaacuacugccagggccagugcgcccugcccguggcccugagcggcagcggcggcccccccgcccugaaccacgccgugcugagagcccugaugcacgccgccgcccccggcgccgccgaccugcccugcugcgugcccgccagacugagccccaucagcgugcuguucuucgacaacagcgacaacguggugcugagacaguacgaggacauggugguggacgagugcggcugcagauaa

SEQ ID NO: 17456 - RNA, 1290 nt, Artificial Sequence
  GDF2__Homo_sapiens__NP_057288
augugccccggcgcccuguggguggcccugccccugcugagccugcuggccggcagccugcagggcaagccccugcagagcuggggcagaggcagcgccggcggcaacgcccacagcccccugggcgugcccggcggcggccugcccgagcacaccuucaaccugaagauguuccuggagaacgugaagguggacuuccugagaagccugaaccugagcggcgugcccagccaggacaagaccagaguggagcccccccaguacaugaucgaccuguacaacagauacaccagcgacaagagcaccacccccgccagcaacaucgugagaagcuucagcauggaggacgccaucagcaucaccgccaccgaggacuuccccuuccagaagcacauccugcuguucaacaucagcauccccagacacgagcagaucaccagagccgagcugagacuguacgugagcugccagaaccacguggaccccagccacgaccugaagggcagcguggugaucuacgacgugcuggacggcaccgacgccugggacagcgccaccgagaccaagaccuuccuggugagccaggacauccaggacgagggcugggagacccuggaggugagcagcgccgugaagagaugggugagaagcgacagcaccaagagcaagaacaagcuggaggugaccguggagagccacagaaagggcugcgacacccuggacaucagcgugccccccggcagcagaaaccugcccuucuucgugguguucagcaacgaccacagcagcggcaccaaggagaccagacuggagcugagagagaugaucagccacgagcaggagagcgugcugaagaagcugagcaaggacggcagcaccgaggccggcgagagcagccacgaggaggacaccgacggccacguggccgccggcagcacccuggccagaagaaagagaagcgccggcgccggcagccacugccagaagaccagccugagagugaacuucgaggacaucggcugggacagcuggaucaucgcccccaaggaguacgaggccuacgagugcaagggcggcugcuucuucccccuggccgacgacgugacccccaccaagcacgccaucgugcagacccuggugcaccugaaguuccccaccaaggugggcaaggccugcugcgugcccaccaagcugagccccaucagcgugcuguacaaggacgacaugggcgugcccacccugaaguaccacuacgagggcaugagcguggccgagugcggcugcagauaa

SEQ ID NO: 17457 - RNA, 1095 nt, Artificial Sequence
  GDF3__Homo_sapiens__NP_065685
augcugagauuccugcccgaccuggccuucagcuuccugcugauccuggcccugggccaggccgugcaguuccaggaguacguguuccugcaguuccugggccuggacaaggcccccagcccccagaaguuccagcccgugcccuacauccugaagaagaucuuccaggacagagaggccgccgccaccaccggcgugagcagagaccugugcuacgugaaggagcugggcgugagaggcaacgugcugagauuccugcccgaccagggcuucuuccuguaccccaagaagaucagccaggccagcagcugccugcagaagcugcuguacuucaaccugagcgccaucaaggagagagagcagcugacccuggcccagcugggccuggaccugggccccaacagcuacuacaaccugggccccgagcuggagcuggcccuguuccuggugcaggagccccacguguggggccagaccacccccaagcccggcaagauguucgugcugagaagcgugcccuggccccagggcgccgugcacuucaaccugcuggacguggccaaggacuggaacgacaaccccagaaagaacuucggccuguuccuggagauccuggugaaggaggacagagacagcggcgugaacuuccagcccgaggacaccugcgccagacugagaugcagccugcacgccagccugcugguggugacccugaaccccgaccagugccaccccagcagaaagagaagagccgccauccccgugcccaagcugagcugcaagaaccugugccacagacaccagcuguucaucaacuucagagaccugggcuggcacaaguggaucaucgcccccaagggcuucauggccaacuacugccacggcgagugccccuucagccugaccaucagccugaacagcagcaacuacgccuucaugcaggcccugaugcacgccguggaccccgagaucccccaggccgugugcauccccaccaagcugagccccaucagcaugcuguaccaggacaacaacgacaacgugauccugagacacuacgaggacauggugguggacgagugcggcugcggcuaa

SEQ ID NO: 17458 - RNA, 1506 nt, Artificial Sequence
  GDF5__Homo_sapiens__NP_001306067
augagacugcccaagcugcugaccuuccugcugugguaccuggccuggcuggaccuggaguucaucugcaccgugcugggcgcccccgaccugggccagagaccccagggcaccagacccggccuggccaaggccgaggccaaggagagacccccccuggccagaaacguguucagacccggcggccacagcuacggcggcggcgccaccaacgccaacgccagagccaagggcggcaccggccagaccggcggccugacccagcccaagaaggacgagcccaagaagcugccccccagacccggcggccccgagcccaagcccggccaccccccccagaccagacaggccaccgccagaaccgugacccccaagggccagcugcccggcggcaaggccccccccaaggccggcagcgugcccagcagcuuccugcugaagaaggccagagagcccggcccccccagagagcccaaggagcccuucagacccccccccaucaccccccacgaguacaugcugagccuguacagaacccugagcgacgccgacagaaagggcggcaacagcagcgugaagcuggaggccggccuggccaacaccaucaccagcuucaucgacaagggccaggacgacagaggccccguggugagaaagcagagauacguguucgacaucagcgcccuggagaaggacggccugcugggcgccgagcugagaauccugagaaagaagcccagcgacaccgccaagcccgccgcccccggcggcggcagagccgcccagcugaagcugagcagcugccccagcggcagacagcccgccgcccugcuggacgugagaagcgugcccggccuggacggcagcggcugggagguguucgacaucuggaagcuguucagaaacuucaagaacagcgcccagcugugccuggagcuggaggccugggagagaggcagagccguggaccugagaggccugggcuucgacagagccgccagacaggugcacgagaaggcccuguuccugguguucggcagaaccaagaagagagaccuguucuucaacgagaucaaggccagaagcggccaggacgacaagaccguguacgaguaccuguucagccagagaagaaagagaagagccccccuggccaccagacagggcaagagacccagcaagaaccugaaggccagaugcagcagaaaggcccugcacgugaacuucaaggacaugggcugggacgacuggaucaucgccccccuggaguacgaggccuuccacugcgagggccugugcgaguucccccugagaagccaccuggagcccaccaaccacgccgugauccagacccugaugaacagcauggaccccgagagcaccccccccaccugcugcgugcccaccagacugagccccaucagcauccuguucaucgacagcgccaacaacgugguguacaagcaguacgaggacauggugguggagagcugcggcugcagauaa

SEQ ID NO: 17459 - RNA, 1368 nt, Artificial Sequence
  GDF6__Homo_sapiens__NP_001001557
auggacacccccagagugcugcugagcgccguguuccugaucagcuuccugugggaccugcccggcuuccagcaggccagcaucagcagcagcagcagcagcgccgagcugggcagcaccaagggcaugagaagcagaaaggagggcaagaugcagagagcccccagagacagcgacgccggcagagagggccaggagccccagcccagaccccaggacgagcccagagcccagcagcccagagcccaggagccccccggcagaggccccagaguggugccccacgaguacaugcugagcaucuacagaaccuacagcaucgccgagaagcugggcaucaacgccagcuucuuccagagcagcaagagcgccaacaccaucaccagcuucguggacagaggccuggacgaccugagccacaccccccugagaagacagaaguaccuguucgacgugagcaugcugagcgacaaggaggagcuggugggcgccgagcugagacuguucagacaggcccccagcgcccccuggggcccccccgccggcccccugcacgugcagcuguuccccugccugagcccccugcugcuggacgccagaacccuggacccccagggcgccccccccgccggcugggagguguucgacguguggcagggccugagacaccagcccuggaagcagcugugccuggagcugagagccgccuggggcgagcuggacgccggcgaggccgaggccagagccagaggcccccagcagccccccccccccgaccugagaagccugggcuucggcagaagagugagacccccccaggagagagcccugcuggugguguucaccagaagccagagaaagaaccuguucgccgagaugagagagcagcugggcagcgccgaggccgccggccccggcgccggcgccgagggcagcuggcccccccccagcggcgcccccgacgccagacccuggcugcccagccccggcagaagaagaagaagaaccgccuucgccagcagacacggcaagagacacggcaagaagagcagacugagaugcagcaagaagccccugcacgugaacuucaaggagcugggcugggacgacuggaucaucgccccccuggaguacgaggccuaccacugcgagggcgugugcgacuucccccugagaagccaccuggagcccaccaaccacgccaucauccagacccugaugaacagcauggaccccggcagcaccccccccagcugcugcgugcccaccaagcugacccccaucagcauccuguacaucgacgccggcaacaacgugguguacaagcaguacgaggacauggugguggagagcugcggcugcagauaa

SEQ ID NO: 17460 - RNA, 1353 nt, Artificial Sequence
  GDF7__Homo_sapiens__NP_878248
auggaccugagcgccgccgccgcccugugccuguggcugcugagcgccugcagacccagagacggccuggaggccgccgccgugcugagagccgccggcgccggccccgugagaagccccggcggcggcggcggcggcggcggcggcggcagaacccuggcccaggccgccggcgccgccgccgugcccgccgccgccgugcccagagccagagccgccagaagagccgccggcagcggcuucagaaacggcagcguggugccccaccacuucaugaugagccuguacagaagccuggccggcagagcccccgccggcgccgccgccgugagcgccagcggccacggcagagccgacaccaucaccggcuucaccgaccaggccacccaggacgagagcgccgccgagaccggccagagcuuccuguucgacgugagcagccugaacgacgccgacgagguggugggcgccgagcugagagugcugagaagaggcagccccgagagcggccccggcagcuggaccagccccccccugcugcugcugagcaccugccccggcgccgccagagcccccagacugcuguacagcagagccgccgagccccuggugggccagagaugggaggccuucgacguggccgacgccaugagaagacacagaagagagcccagaccccccagagccuucugccugcugcugagagccguggccggccccgugcccagcccccuggcccugagaagacugggcuucggcuggcccggcggcggcggcagcgccgccgaggagagagccgugcugguggugagcagcagaacccagagaaaggagagccuguucagagagaucagagcccaggccagagcccugggcgccgcccuggccagcgagccccugcccgaccccggcaccggcaccgccagccccagagccgugaucggcggcagaagaagaagaagaaccgcccuggccggcaccagaaccgcccagggcagcggcggcggcgccggcagaggccacggcagaagaggcagaagcagaugcagcagaaagccccugcacguggacuucaaggagcugggcugggacgacuggaucaucgccccccuggacuacgaggccuaccacugcgagggccugugcgacuucccccugagaagccaccuggagcccaccaaccacgccaucauccagacccugcugaacagcauggcccccgacgccgcccccgccagcugcugcgugcccgccagacugagccccaucagcauccuguacaucgacgccgccaacaacgugguguacaagcaguacgaggacauggugguggaggccugcggcugcagauaa

SEQ ID NO: 17461 - RNA, 1365 nt, Artificial Sequence
  GDF9__Homo_sapiens__XP_011541610
auggccagacccaacaaguuccugcugugguucugcugcuucgccuggcugugcuuccccaucagccugggcagccaggccagcggcggcgaggcccagaucgccgccagcgccgagcuggagagcggcgccaugcccuggagccugcugcagcacaucgacgagagagacagagccggccugcugcccgcccuguucaaggugcugagcgugggcagaggcggcagccccagacugcagcccgacagcagagcccugcacuacaugaagaagcuguacaagaccuacgccaccaaggagggcauccccaagagcaacagaagccaccuguacaacaccgugagacuguucacccccugcaccagacacaagcaggcccccggcgaccaggugaccggcauccugcccagcguggagcugcuguucaaccuggacagaaucaccaccguggagcaccugcugaagagcgugcugcuguacaacaucaacaacagcgugagcuucagcagcgccgugaagugcgugugcaaccugaugaucaaggagcccaagagcagcagcagaacccugggcagagcccccuacagcuucaccuucaacagccaguucgaguucggcaagaagcacaaguggauccagaucgacgugaccagccugcugcagccccugguggccagcaacaagagaagcauccacaugagcaucaacuucaccugcaugaaggaccagcuggagcaccccagcgcccagaacggccuguucaacaugacccuggugagccccagccugauccuguaccugaacgacaccagcgcccaggccuaccacagcugguacagccugcacuacaagagaagacccagccagggccccgaccaggagagaagccugagcgccuaccccgugggcgaggaggccgccgaggacggcagaagcagccaccacagacacagaagaggccaggagaccgugagcagcgagcugaagaagccccugggccccgccagcuucaaccugagcgaguacuucagacaguuccugcugccccagaacgagugcgagcugcacgacuucagacugagcuucagccagcugaagugggacaacuggaucguggccccccacagauacaaccccagauacugcaagggcgacugccccagagccgugggccacagauacggcagccccgugcacaccauggugcagaacaucaucuacgagaagcuggacagcagcgugcccagacccagcugcgugcccgccaaguacagcccccugagcgugcugaccaucgagcccgacggcagcaucgccuacaaggaguacgaggacaugaucgccaccaagugcaccugcagauaa

SEQ ID NO: 17462 - RNA, 1344 nt, Artificial Sequence
  GDI1__Homo_sapiens__NP_001484
auggacgaggaguacgacgugaucgugcugggcaccggccugaccgagugcauccugagcggcaucaugagcgugaacggcaagaaggugcugcacauggacagaaaccccuacuacggcggcgagagcagcagcaucaccccccuggaggagcuguacaagagauuccagcugcuggagggcccccccgagagcaugggcagaggcagagacuggaacguggaccugauccccaaguuccugauggccaacggccagcuggugaagaugcugcuguacaccgaggugaccagauaccuggacuucaaggugguggagggcagcuucguguacaagggcggcaagaucuacaaggugcccagcaccgagaccgaggcccuggccagcaaccugaugggcauguucgagaagagaagauucagaaaguuccugguguucguggccaacuucgacgagaacgaccccaagaccuucgagggcguggacccccagaccaccagcaugagagacguguacagaaaguucgaccugggccaggacgugaucgacuucaccggccacgcccuggcccuguacagaaccgacgacuaccuggaccagcccugccuggagaccgugaacagaaucaagcuguacagcgagagccuggccagauacggcaagagccccuaccuguacccccuguacggccugggcgagcugccccagggcuucgccagacugagcgccaucuacggcggcaccuacaugcugaacaagcccguggacgacaucaucauggagaacggcaagguggugggcgugaagagcgagggcgagguggccagaugcaagcagcugaucugcgaccccagcuacauccccgacagagugagaaaggccggccaggugaucagaaucaucugcauccugagccaccccaucaagaacaccaacgacgccaacagcugccagaucaucaucccccagaaccaggugaacagaaagagcgacaucuacgugugcaugaucagcuacgcccacaacguggccgcccagggcaaguacaucgccaucgccagcaccaccguggagaccaccgaccccgagaaggagguggagcccgcccuggagcugcuggagcccaucgaccagaaguucguggccaucagcgaccuguacgagcccaucgacgacggcugcgagagccagguguucugcagcugcagcuacgacgccaccacccacuucgagaccaccugcaacgacaucaaggacaucuacaagagaauggccggcaccgccuucgacuucgagaacaugaagagaaagcagaacgacguguucggcgaggccgagcaguaa

SEQ ID NO: 17463 - RNA, 1203 nt, Artificial Sequence
  GDI2__Homo_sapiens__NP_001108628
augaacgaggaguacgacgugaucgugcugggcaccggccugaccgagugcauccugagcggcaucaugagcgugaacggcaagaaggugcugcacauggacagaaaccccuacuacggcggcgagagcgccagcaucaccccccuggaggaccuguacaagagauucaagauccccggcagcccccccgagagcaugggcagaggcagagacuggaacguggaccugauccccaaguuccugauggccaacggccugaugggccuguucgagaagagaagauucagaaaguuccugguguacguggccaacuucgacgagaaggaccccagaaccuucgagggcaucgaccccaagaagaccaccaugagagacguguacaagaaguucgaccugggccaggacgugaucgacuucaccggccacgcccuggcccuguacagaaccgacgacuaccuggaccagcccugcuacgagaccaucaacagaaucaagcuguacagcgagagccuggccagauacggcaagagccccuaccuguacccccuguacggccugggcgagcugccccagggcuucgccagacugagcgccaucuacggcggcaccuacaugcugaacaagcccaucgaggagaucaucgugcagaacggcaaggugaucggcgugaagagcgagggcgagaucgccagaugcaagcagcugaucugcgaccccagcuacgugaaggacagaguggagaaggugggccaggugaucagagugaucugcauccugagccaccccaucaagaacaccaacgacgccaacagcugccagaucaucaucccccagaaccaggugaacagaaagagcgacaucuacgugugcaugaucagcuucgcccacaacguggccgcccagggcaaguacaucgccaucgugagcaccaccguggagaccaaggagcccgagaaggagaucagacccgcccuggagcugcuggagcccaucgagcagaaguucgugagcaucagcgaccugcuggugcccaaggaccugggcaccgagagccagaucuucaucagcagaaccuacgacgccaccacccacuucgagaccaccugcgacgacaucaagaacaucuacaagagaaugaccggcagcgaguucgacuucgaggagaugaagagaaagaagaacgacaucuacggcgaggacuaa

SEQ ID NO: 17464 - RNA, 687 nt, Artificial Sequence
  GDNF__Homo_sapiens__NP_001177397
augcagagccugcccaacagcaacggcgccgccgccggcagagacuucaagaugaagcugugggacgugguggccgugugccuggugcugcugcacaccgccagcgccuucccccugcccgccggcaagagaccccccgaggcccccgccgaggacagaagccugggcagaagaagagcccccuucgcccugagcagcgacagcaacaugcccgaggacuaccccgaccaguucgacgacgugauggacuucauccaggccaccaucaagagacugaagagaagccccgacaagcagauggccgugcugcccagaagagagagaaacagacaggccgccgccgccaaccccgagaacagcagaggcaagggcagaagaggccagagaggcaagaacagaggcugcgugcugaccgccauccaccugaacgugaccgaccugggccugggcuacgagaccaaggaggagcugaucuucagauacugcagcggcagcugcgacgccgccgagaccaccuacgacaagauccugaagaaccugagcagaaacagaagacuggugagcgacaaggugggccaggccugcugcagacccaucgccuucgacgacgaccugagcuuccuggacgacaaccugguguaccacauccugagaaagcacagcgccaagagaugcggcugcaucuaa

SEQ ID NO: 17465 - RNA, 957 nt, Artificial Sequence
  GDPD3__Homo_sapiens__NP_077283
augagccugcugcuguacuacgcccugcccgcccugggcagcuacgccaugcugagcaucuucuuccugagaagaccccaccugcugcacacccccagagcccccaccuucagaaucagacugggcgcccacagaggcggcagcggcgagcugcuggagaacaccauggaggccauggagaacagcauggcccagagaagcgaccugcuggagcuggacugccagcugaccagagacagaguggugguggugagccacgacgagaaccugugcagacagagcggccugaacagagacgugggcagccuggacuucgaggaccugccccuguacaaggagaagcuggagguguacuucagccccggccacuucgcccacggcagcgacagaagaauggugagacuggaggaccuguuccagagauuccccagaacccccaugagcguggagaucaagggcaagaacgaggagcugaucagagagaucgccggccuggugagaagauacgacagaaacgagaucaccaucugggccagcgagaagagcagcgugaugaagaagugcaaggccgccaaccccgagaugccccugagcuucaccaucagcagaggcuucugggugcugcugagcuacuaccugggccugcugcccuucauccccauccccgagaaguucuucuucugcuuccugcccaacaucaucaacagaaccuacuuccccuucagcugcagcugccugaaccagcugcuggccguggugagcaaguggcugaucaugagaaagagccugaucagacaccuggaggagagaggcgugcaggugguguucuggugccugaacgaggagagcgacuucgaggccgccuucagcgugggcgccaccggcgugaucaccgacuaccccaccgcccugagacacuaccuggacaaccacggccccgccgccagaaccagcuaa

SEQ ID NO: 17466 - RNA, 1818 nt, Artificial Sequence
  GDPD5__Homo_sapiens__NP_110419
auggugagacaccagccccugcaguacuacgagccccagcugugccugagcugccugaccggcaucuacggcugcagauggaagagauaccagagaagccacgacgacaccacccccugggagagacugugguuccugcugcugaccuucaccuucggccugacccugaccuggcuguacuucuggugggaggugcacaacgacuacgacgaguucaacugguaccuguacaacagaaugggcuacuggagcgacuggcccgugcccauccuggugaccaccgccgccgccuucgccuacaucgccggccugcuggugcuggcccugugccacaucgccgugggccagcagaugaaccugcacuggcugcacaagaucggccugguggugauccuggccagcaccgugguggccaugagcgccguggcccagcugugggaggacgagugggaggugcugcugaucagccugcagggcaccgcccccuuccugcacgugggcgccguggccgccgugaccaugcugagcuggaucguggccggccaguucgccagagccgagagaaccagcagccaggugaccauccugugcaccuucuucaccgugguguucgcccuguaccuggccccccugaccaucagcagccccugcaucauggagaagaaggaccugggccccaagcccgcccugaucggccacagaggcgcccccaugcuggcccccgagcacacccugaugagcuucagaaaggcccuggagcagaagcuguacggccugcaggccgacaucaccaucagccuggacggcgugcccuuccugaugcacgacaccacccugagaagaaccaccaacguggaggaggaguuccccgagcuggccagaagacccgccagcaugcugaacuggaccacccugcagagacugaacgccggccagugguuccugaagaccgaccccuucuggaccgccagcagccugagccccagcgaccacagagaggcccagaaccagagcaucugcagccuggccgagcugcuggagcuggccaagggcaacgccacccugcugcugaaccugagagacccccccagagagcaccccuacagaagcagcuucaucaacgugacccuggaggccgugcugcacagcggcuucccccagcaccaggugauguggcugcccagcagacagagaccccuggugagaaagguggcccccggcuuccagcagaccagcggcagcaaggaggccguggccagccugagaagaggccacauccagagacugaaccugagauacacccaggugagcagacaggagcugagagacuacgccagcuggaaccugagcgugaaccuguacaccgugaacgcccccuggcuguucagccugcuguggugcgccggcgugcccagcgugaccagcgacaacagccacgcccugagccaggugcccagcccccuguggaucaugccccccgacgaguacugccugaugugggugaccgccgaccuggugagcuucacccugaucgugggcaucuucgugcugcagaaguggagacugggcggcaucagaagcuacaaccccgagcagaucaugcugagcgccgccgugagaagaaccagcagagacgugagcaucaugaaggagaagcugaucuucagcgagaucagcgacggcguggaggugagcgacgugcugagcgugugcagcgacaacagcuacgacaccuacgccaacagcaccgccacccccgugggccccagaggcggcggcagccacaccaagacccugaucgagagaagcggcagauaa

SEQ ID NO: 17467 - RNA, 891 nt, Artificial Sequence
  GEM__Homo_sapiens__NP_859053
augacccugaacaacgugaccaugagacagggcaccgugggcaugcagccccagcagcagagauggagcauccccgccgacggcagacaccugauggugcagaaggagccccaccaguacagccacagaaacagacacagcgccacccccgaggaccacugcagaagaagcuggagcagcgacagcaccgacagcgugaucagcagcgagagcggcaacaccuacuacagaguggugcugaucggcgagcagggcgugggcaagagcacccuggccaacaucuucgccggcgugcacgacagcauggacagcgacugcgaggugcugggcgaggacaccuacgagagaacccugaugguggacggcgagagcgccaccaucauccugcuggacaugugggagaacaagggcgagaacgaguggcugcacgaccacugcaugcaggugggcgacgccuaccugaucguguacagcaucaccgacagagccagcuucgagaaggccagcgagcugagaauccagcugagaagagccagacagaccgaggacauccccaucauccuggugggcaacaagagcgaccuggugagaugcagagaggugagcgugagcgagggcagagccugcgccgugguguucgacugcaaguucaucgagaccagcgccgccgugcagcacaacgugaaggagcuguucgagggcaucgugagacaggugagacugagaagagacagcaaggagaagaacgagagaagacuggccuaccagaagagaaaggagagcaugcccagaaaggccagaagauucuggggcaagaucguggccaagaacaacaagaacauggccuucaagcugaagagcaagagcugccacgaccugagcgugcuguaa

SEQ ID NO: 17468 - RNA, 798 nt, Artificial Sequence
  GEMIN2__Homo_sapiens__NP_001009182
augagaagagccgagcuggccggccugaagaccauggccugggugcccgccgagagcgccguggaggagcugaugcccagacugcugcccguggagcccugcgaccugaccgagggcuucgaccccagcgugccccccagaaccccccaggaguaccugagaagagugcagaucgaggccgcccagugccccgacguggugguggcccagaucgaccccaagaagcugaagagaaagcagagcgugaacaucagccugagcggcugccagcccgcccccgagggcuacagccccacccugcaguggcagcagcagcagguggcccaguucagcaccgugagacagaacgugaacaagcacagaagccacuggaagagccagcagcuggacagcaacgugaccaugcccaagagcgaggacgaggagggcuggaagaaguucugccugggcgagaagcugugcgccgacggcgccgugggccccgccaccaacgagagccccggcaucgacuacgugcaggccaccgugaccagcgugcuggaguaccugagcaacugguucggcgagagagacuucacccccgagcugggcagauggcuguacgcccugcuggccugccuggagaagccccugcugcccgaggcccacagccugaucagacagcuggccagaagaugcagcgaggugagacugcugguggacagcaaggacgacgagagagugcccgcccugaaccugcugaucugccuggugagcagauacuucgaccagagagaccuggccgacgagcccagcuaa

SEQ ID NO: 17469 - RNA, 3177 nt, Artificial Sequence
  GEMIN4__Homo_sapiens__NP_056536
auggaccugggcccccugaacaucugcgaggagaugaccauccugcacggcggcuuccugcuggccgagcagcuguuccaccccaaggcccuggccgagcugaccaagagcgacugggagagagugggcagacccaucguggaggcccugagagagaucagcagcgccgccgcccacagccagcccuucgccuggaagaagaaggcccugaucaucaucugggccaaggugcugcagccccaccccgugacccccagcgacaccgagaccagauggcaggaggaccuguucuucagcgugggcaacaugauccccaccaucaaccacaccauccuguucgagcugcugaagagccuggaggccagcggccuguucauccagcugcugauggcccugcccaccaccaucugccacgccgagcuggagagauuccuggagcacgugaccguggacaccagcgccgaggacguggccuucuuccuggacguguggugggaggugaugaagcacaagggccacccccaggacccccugcugagccaguucagcgccauggcccacaaguaccugcccgcccuggacgaguucccccacccccccaagagacugagaagcgaccccgacgccugccccaccaugccccugcuggccaugcugcugagaggccugacccagauccagagcagaauccugggccccggcagaaagugcugcgcccuggccaaccuggccgacaugcugaccguguucgcccugaccgaggacgacccccaggaggugagcgccaccguguaccuggacaagcuggccaccgugaucagcguguggaacagcgacacccagaaccccuaccaccagcaggcccuggccgagaaggugaaggaggccgagagagacgugagccugaccagccuggccaagcugcccagcgagaccaucuucgugggcugcgaguuccugcaccaccugcugagagaguggggcgaggagcugcaggccgugcugagaagcagccagggcaccagcuacgacagcuacagacugugcgacagccugaccagcuucagccagaacgccacccuguaccugaacagaaccagccugagcaaggaggacagacagguggugagcgagcuggccgagugcgugagagacuuccugagaaagaccagcaccgugcugaagaacagagcccuggaggacaucaccgccagcaucgccauggccgugauccagcagaagauggacagacacauggaggugugcuacaucuucgccagcgagaagaagugggccuucagcgacgaguggguggccugccugggcagcaacagagcccuguucagacagcccgaccuggugcugagacugcuggagaccgugaucgacgugagcaccgccgacagagccauccccgagagccagaucagacaggugauccaccugauccuggagugcuacgccgaccugagccugcccggcaagaacaaggugcuggccggcauccugagaagcuggggcagaaagggccugagcgagaagcugcuggccuacguggagggcuuccaggaggaccugaacaccaccuucaaccagcugacccagagcgccagcgagcagggccuggccaaggccguggccagcguggccagacuggugaucgugcaccccgaggugaccgugaagaagaugugcagccuggccguggugaaccugggcacccacaaguuccuggcccagauccugaccgccuuccccgcccugagauucguggaggagcagggccccaacagcagcgccaccuucauggugagcugccugaaggagaccguguggaugaaguucagcacccccaaggaggagaagcaguuccuggagcugcugaacugccugaugagccccgugaagccccagggcauccccguggccgcccugcuggagcccgacgaggugcugaaggaguucgugcugcccuuccugagacuggacguggaggagguggaccugagccugagaaucuucauccagacccuggaggccaacgccugcagagaggaguacuggcugcagaccugcagccccuucccccugcuguucagccugugccagcugcuggacagauucagcaaguacuggcagcugcccaaggagaagagaugccugagccuggacagaaaggaccuggccauccacauccuggagcugcugugcgagaucgugagcgccaacgccgagaccuucagccccgacguguggaucaagagccugagcuggcugcacagaaagcuggagcagcuggacuggaccgugggccugagacugaagagcuucuucgagggccacuucaagugcgaggugcccgccacccuguucgagaucugcaagcugagcgaggacgaguggaccagccaggcccaccccggcuacggcgccggcaccggccugcuggccuggauggagugcugcugcgugagcagcggcaucagcgagagaaugcugagccugcuggugguggacgugggcaaccccgaggaggugagacuguucagcaagggcuuccugguggcccuggugcaggugaugcccuggugcagcccccaggaguggcagagacugcaccagcugaccagaagacugcuggagaagcagcugcugcacgugcccuacagccuggaguacauccaguucgugccccugcugaaccugaagcccuucgcccaggagcugcagcugagcgugcuguuccugagaaccuuccaguuccugugcagccacagcugcagagacuggcugccccuggagggcuggaaccacguggugaagcugcugugcggcagccugaccagacugcuggacagcgugagagccauccaggccgccggccccugggugcagggccccgagcaggaccugacccaggaggcccuguucguguacacccagguguucugccacgcccugcacaucauggccaugcugcaccccgaggugugcgagccccuguacgugcuggcccuggagacccugaccugcuacgagacccugagcaagaccaaccccagcgugagcagccugcugcagagagcccacgagcagagauuccugaagagcaucgccgagggcaucggccccgaggagagaagacagacccugcugcagaagaugagcagcuucuaa

SEQ ID NO: 17470 - RNA, 504 nt, Artificial Sequence
  GEMIN6__Homo_sapiens__NP_079051
augagcgaguggaugaagaagggcccccuggaguggcaggacuacaucuacaaggaggugagagugaccgccagcgagaagaacgaguacaagggcugggugcugaccaccgaccccgugagcgccaacaucgugcuggugaacuuccuggaggacggcagcaugagcgugaccggcaucaugggccacgccgugcagaccguggagaccaugaacgagggcgaccacagagugagagagaagcugaugcaccuguucaccagcggcgacugcaaggccuacagccccgaggaccuggaggagagaaagaacagccugaagaaguggcuggagaagaaccacauccccaucaccgagcagggcgacgcccccagaacccugugcguggccggcgugcugaccaucgacccccccuacggccccgagaacugcagcagcagcaacgagaucauccugagcagagugcaggaccugaucgagggccaccugaccgccagccaguaa

SEQ ID NO: 17471 - RNA, 2727 nt, Artificial Sequence
  GEN1__Homo_sapiens__NP_872431
augggcgugaacgaccuguggcagauccuggagcccgugaagcagcacaucccccugagaaaccugggcggcaagaccaucgccguggaccugagccugugggugugcgaggcccagaccgugaagaagaugaugggcagcgugaugaagccccaccugagaaaccuguucuucagaaucagcuaccugacccagauggacgugaagcugguguucgugauggagggcgagccccccaagcugaaggccgacgugaucagcaagagaaaccagagcagauacggcagcagcggcaagagcuggagccagaagaccggcagaagccacuucaagagcgugcugagagagugccugcacaugcuggagugccugggcauccccugggugcaggccgccggcgaggccgaggccaugugcgccuaccugaacgccggcggccacguggacggcugccugaccaacgacggcgacaccuuccuguacggcgcccagaccguguacagaaacuucaccaugaacaccaaggacccccacguggacugcuacaccaugagcagcaucaagagcaagcugggccuggacagagacgcccuggugggccuggccauccugcugggcugcgacuaccugcccaagggcgugcccggcgugggcaaggagcaggcccugaagcugauccagauccugaagggccagagccugcugcagagauucaacagauggaacgagaccagcugcaacagcagcccccagcugcuggugaccaagaagcuggcccacugcagcgugugcagccaccccggcagccccaaggaccacgagagaaacggcugcagacugugcaagagcgacaaguacugcgagccccacgacuacgaguacugcugccccugcgaguggcacagaaccgagcacgacagacagcugaacgagguggagaacaacaucaagaagaaggccugcugcugcgagggcuuccccuuccacgaggugauccaggaguuccugcugaacaaggacaagcuggugaaggugaucagauaccagagacccgaccugcugcuguuccagagauucacccuggagaagauggaguggcccaaccacuacgccugcgagaagcugcuggugcugcugacccacuacgacaugaucgagagaaagcugggcagcagaaacagcaaccagcugcagcccaucagaaucgugaagaccagaaucagaaacggcgugcacugcuucgagaucgagugggagaagcccgagcacuacgccauggaggacaagcagcacggcgaguucgcccugcugaccaucgaggaggagagccuguucgaggccgccuaccccgagaucguggccguguaccagaagcagaagcuggagaucaagggcaagaagcagaagagaaucaagcccaaggagaacaaccugcccgagcccgacgaggugaugagcuuccagagccacaugacccugaagcccaccugcgagaucuuccacaagcagaacagcaagcugaacagcggcaucagccccgaccccacccugccccaggagagcaucagcgccagccugaacagccugcugcugcccaagaacacccccugccugaacgcccaggagcaguucaugagcagccugagaccccuggccauccagcagaucaaggccgugagcaagagccugaucagcgagagcagccagcccaacaccagcagccacaacaucagcgugaucgccgaccugcaccugagcaccaucgacugggagggcaccagcuucagcaacagccccgccauccagagaaacaccuucagccacgaccugaagagcgagguggagagcgagcugagcgccauccccgacggcuucgagaacauccccgagcagcugagcugcgagagcgagagauacaccgccaacaucaagaaggugcuggacgaggacagcgacggcaucagccccgaggagcaccugcugagcggcaucaccgaccugugccugcaggaccugccccugaaggagagaaucuucaccaagcugagcuacccccaggacaaccugcagcccgacgugaaccugaagacccugagcauccugagcgugaaggagagcugcaucgccaacagcggcagcgacugcaccagccaccugagcaaggaccugcccggcaucccccugcagaacgagagcagagacagcaagauccugaagggcgaccagcugcugcaggaggacuacaaggugaacaccagcgugcccuacagcgugagcaacaccguggugaagaccugcaacgugagaccccccaacaccgcccuggaccacagcagaaagguggacaugcagaccaccagaaagauccugaugaagaagagcgugugccuggacagacacagcagcgacgagcagagcgcccccguguucggcaaggccaaguacaccacccagagaaugaagcacagcagccagaagcacaacagcagccacuucaaggagagcggccacaacaagcugagcagccccaagauccacaucaaggagaccgagcagugcgugagaagcuacgagaccgccgagaacgaggagagcugcuuccccgacagcaccaagagcagccugagcagccugcagugccacaagaaggagaacaacagcggcaccugccuggacagcccccugccccugagacagagacugaagcugagauuccagagcaccuaa

SEQ ID NO: 17472 - RNA, 984 nt, Artificial Sequence
  GET4__Homo_sapiens__NP_057033
auggccgccgccgccgccauggccgagcaggagagcgccagaaacggcggcagaaacagaggcggcgugcagagaguggagggcaagcugagagccagcguggagaagggcgacuacuacgaggcccaccagauguacagaacccuguucuucagauacaugagccagagcaagcacaccgaggccagagagcugauguacagcggcgcccugcuguucuucagccacggccagcagaacagcgccgccgaccugagcaugcuggugcuggagagccuggagaaggccgagguggagguggccgacgagcugcuggagaaccuggccaagguguucagccugauggaccccaacagccccgagagagugaccuucgugagcagagcccugaaguggagcagcggcggcagcggcaagcugggccaccccagacugcaccagcugcuggcccugacccuguggaaggagcagaacuacugcgagagcagauaccacuuccugcacagcgccgacggcgagggcugcgccaacaugcugguggaguacagcaccagcagaggcuucagaagcgagguggacauguucguggcccaggccgugcugcaguuccugugccugaagaacaagagcagcgccagcgugguguucaccaccuacacccagaagcaccccagcaucgaggacggcccccccuucguggagccccugcugaacuucaucugguuccugcugcuggccguggacggcggcaagcugaccguguucaccgugcugugcgagcaguaccagcccagccugagaagagaccccauguacaacgaguaccuggacagaaucggccagcuguucuucggcgugccccccaagcagaccagcagcuacggcggccugcugggcaaccugcugaccagccugaugggcagcagcgagcaggaggacggcgaggagagccccagcgacggcagccccaucgagcuggacuaa

SEQ ID NO: 17473 - RNA, 1296 nt, Artificial Sequence
  GFAP__Homo_sapiens__NP_001124491
auggagagaagaagaaucaccagcgccgccagaagaagcuacgugagcagcggcgagaugauggugggcggccuggcccccggcagaagacugggccccggcaccagacugagccuggccagaaugccccccccccugcccaccagaguggacuucagccuggccggcgcccugaacgccggcuucaaggagaccagagccagcgagagagccgagaugauggagcugaacgacagauucgccagcuacaucgagaaggugagauuccuggagcagcagaacaaggcccuggccgccgagcugaaccagcugagagccaaggagcccaccaagcuggccgacguguaccaggccgagcugagagagcugagacugagacuggaccagcugaccgccaacagcgccagacuggagguggagagagacaaccuggcccaggaccuggccaccgugagacagaagcugcaggacgagaccaaccugagacuggaggccgagaacaaccuggccgccuacagacaggaggccgacgaggccacccuggccagacuggaccuggagagaaagaucgagagccuggaggaggagaucagauuccugagaaagauccacgaggaggaggugagagagcugcaggagcagcuggccagacagcaggugcacguggagcuggacguggccaagcccgaccugaccgccgcccugaaggagaucagaacccaguacgaggccauggccagcagcaacaugcacgaggccgaggagugguacagaagcaaguucgccgaccugaccgacgccgccgccagaaacgccgagcugcugagacaggccaagcacgaggccaacgacuacagaagacagcugcagagccugaccugcgaccuggagagccugagaggcaccaacgagagccuggagagacagaugagagagcaggaggagagacacgugagagaggccgccagcuaccaggaggcccuggccagacuggaggaggagggccagagccugaaggacgagauggccagacaccugcaggaguaccaggaccugcugaacgugaagcuggcccuggacaucgagaucgccaccuacagaaagcugcuggagggcgaggagaacagaaucaccauccccgugcagaccuucagcaaccugcagaucagaggcggcaagagcaccaaggacggcgagaaccacaaggugaccagauaccugaagagccugaccaucagagugauccccauccaggcccaccagaucgugaacggcaccccccccgccagaggcuaa

SEQ ID NO: 17474 - RNA, 618 nt, Artificial Sequence
  GFER__Homo_sapiens__NP_005253
auggccgcccccggcgagagaggcagauuccacggcggcaaccuguucuuccugcccggcggcgccagaagcgagaugauggacgaccuggccaccgacgccagaggcagaggcgccggcagaagagacgccgccgccagcgccagcacccccgcccaggcccccaccagcgacagccccguggccgaggacgccagcagaagaagacccugcagagccugcguggacuucaagaccuggaugagaacccagcagaagagagacaccaaguucagagaggacugcccccccgacagagaggagcugggcagacacagcugggccgugcugcacacccuggccgccuacuaccccgaccugcccacccccgagcagcagcaggacauggcccaguucauccaccuguucagcaaguucuaccccugcgaggagugcgccgaggaccugagaaagagacugugcagaaaccaccccgacaccagaaccagagccugcuucacccaguggcugugccaccugcacaacgaggugaacagaaagcugggcaagcccgacuucgacugcagcaagguggacgagagauggagagacggcuggaaggacggcagcugcgacuaa

SEQ ID NO: 17475 - RNA, 855 nt, Artificial Sequence
  GFI1B__Homo_sapiens__NP_001128503
augcccagaagcuuccuggugaagagcaagaaggcccacaccuaccaccagcccagagugcaggaggacgagccccuguggccccccgcccugacccccgugcccagagaccaggcccccagcaacagccccgugcugagcacccuguuccccaaccagugccuggacuggaccaaccugaagagagagcccgagcuggagcaggaccagaaccuggccagaauggcccccgcccccgagggccccaucgugcugagcagaccccaggacggcgacagcccccugagcgacagcccccccuucuacaagcccagcuucagcugggacacccuggccaccaccuacggccacagcuacagacaggcccccagcaccaugcagagcgccuuccuggagcacagcgugagccuguacggcagcccccuggugcccagcaccgagcccgcccuggacuucagccugagauacagccccggcauggacgccuaccacugcgugaagugcaacaaggagagaagcuucgagugcagaaugugcggcaaggccuucaagagaagcagcacccugagcacccaccugcugauccacagcgacaccagacccuaccccugccaguucugcggcaagagauuccaccagaagagcgacaugaagaagcacaccuacauccacaccggcgagaagccccacaagugccaggugugcggcaaggccuucagccagagcagcaaccugaucacccacagcagaaagcacaccggcuucaagcccuucagcugcgagcugugcaccaagggcuuccagagaaagguggaccugagaagacacagagagagccagcacaaccugaaguaa

SEQ ID NO: 17476 - RNA, 1269 nt, Artificial Sequence
  GFI1__Homo_sapiens__XP_011539548
augcccagaagcuuccuggugaagagcaagaaggcccacagcuaccaccagcccagaagccccggccccgacuacagccugagacuggagaacgugcccgcccccagcagagccgacagcaccagcaacgccggcggcgccaaggccgagcccagagacagacugagccccgagagccagcugaccgaggcccccgacagagccagcgccagccccgacagcugcgagggcagcgugugcgagagaagcagcgaguucgaggacuucuggagaccccccagccccagcgccagccccgccagcgagaagagcaugugccccagccuggacgaggcccagcccuucccccugcccuucaagcccuacagcuggagcggccuggccggcagcgaccugagacaccuggugcagagcuacagacccugcggcgcccuggagagaggcgccggccugggccuguucugcgagcccgcccccgagcccggccaccccgccgcccuguacggccccaagagagccgccggcggcgccggcgccggcgcccccggcagcugcagcgccggcgccggcgccaccgccggccccggccugggccuguacggcgacuucggcagcgccgccgccggccuguacgagagacccaccgccgccgccggccugcuguaccccgagagaggccacggccugcacgccgacaagggcgccggcgugaagguggagagcgagcugcugugcaccagacugcugcugggcggcggcagcuacaagugcaucaagugcagcaagguguucagcaccccccacggccuggaggugcacgugagaagaagccacagcggcaccagacccuucgccugcgagaugugcggcaagaccuucggccacgccgugagccuggagcagcacaaggccgugcacagccaggagagaagcuucgacugcaagaucugcggcaagagcuucaagagaagcagcacccugagcacccaccugcugauccacagcgacaccagacccuaccccugccaguacugcggcaagagauuccaccagaagagcgacaugaagaagcacaccuucauccacaccggcgagaagccccacaagugccaggugugcggcaaggccuucagccagagcagcaaccugaucacccacagcagaaagcacaccggcuucaagcccuucggcugcgaccugugcggcaagggcuuccagagaaagguggaccugagaagacacagagagacccagcacggccugaaguaa

SEQ ID NO: 17477 - RNA, 2256 nt, Artificial Sequence
  GFM1__Homo_sapiens__NP_079272
augagacugcugggcgccgccgccguggccgcccugggcagaggcagagcccccgccagccugggcuggcagagaaagcaggugaacuggaaggccugcagauggagcagcagcggcgugauccccaacgagaagaucagaaacaucggcaucagcgcccacaucgacagcggcaagaccacccugaccgagagagugcuguacuacaccggcagaaucgccaagaugcacgaggugaagggcaaggacggcgugggcgccgugauggacagcauggagcuggagagacagagaggcaucaccauccagagcgccgccaccuacaccauguggaaggacgugaacaucaacaucaucgacacccccggccacguggacuucaccaucgagguggagagagcccugagagugcuggacggcgccgugcuggugcugugcgccgugggcggcgugcagugccagaccaugaccgugaacagacagaugaagagauacaacgugcccuuccugaccuucaucaacaagcuggacagaaugggcagcaaccccgccagagcccugcagcagaugagaagcaagcugaaccacaacgccgccuucaugcagauccccaugggccuggagggcaacuucaagggcaucguggaccugaucgaggagagagccaucuacuucgacggcgacuucggccagaucgugagauacggcgagauccccgccgagcugagagccgccgccaccgaccacagacaggagcugaucgagugcguggccaacagcgacgagcagcugggcgagauguuccuggaggagaagauccccagcaucagcgaccugaagcuggccaucagaagagccacccugaagagaagcuucacccccguguuccugggcagcgcccugaagaacaagggcgugcagccccugcuggacgccgugcuggaguaccugcccaaccccagcgaggugcagaacuacgccauccugaacaaggaggacgacagcaaggagaagaccaagauccugaugaacagcagcagagacaacagccaccccuucgugggccuggccuucaagcuggaggugggcagauucggccagcugaccuacgugagaagcuaccagggcgagcugaagaagggcgacaccaucuacaacaccagaaccagaaagaaggugagacugcagagacuggccagaaugcacgccgacaugauggaggacguggaggagguguacgccggcgacaucugcgcccuguucggcaucgacugcgccagcggcgacaccuucaccgacaaggccaacagcggccugagcauggagagcauccacgugcccgaccccgugaucagcaucgccaugaagcccagcaacaagaacgaccuggagaaguucagcaagggcaucggcagauucaccagagaggaccccaccuucaagguguacuucgacaccgagaacaaggagaccgugaucagcggcaugggcgagcugcaccuggagaucuacgcccagagacuggagagagaguacggcugccccugcaucaccggcaagcccaagguggccuucagagagaccaucaccgcccccgugcccuucgacuucacccacaagaagcagagcggcggcgccggccaguacggcaaggugaucggcgugcuggagccccuggaccccgaggacuacaccaagcuggaguucagcgacgagaccuucggcagcaacauccccaagcaguucgugcccgccguggagaagggcuuccuggacgccugcgagaagggcccccugagcggccacaagcugagcggccugagauucgugcugcaggacggcgcccaccacaugguggacagcaacgagaucagcuucaucagagccggcgagggcgcccugaagcaggcccuggccaacgccacccugugcauccuggagcccaucauggccguggaggugguggcccccaacgaguuccagggccaggugaucgccggcaucaacagaagacacggcgugaucaccggccaggacggcguggaggacuacuucacccuguacgccgacgugccccugaacgacauguucggcuacagcaccgagcugagaagcugcaccgagggcaagggcgaguacaccauggaguacagcagauaccagcccugccugcccagcacccaggaggacgugaucaacaaguaccuggaggccaccggccagcugcccgugaagaagggcaaggccaagaacuaa

SEQ ID NO: 17478 - RNA, 2100 nt, Artificial Sequence
  GFPT1__Homo_sapiens__NP_001231639
augugcggcaucuucgccuaccugaacuaccacgugcccagaaccagaagagagauccuggagacccugaucaagggccugcagagacuggaguacagaggcuacgacagcgccggcgugggcuucgacggcggcaacgacaaggacugggaggccaacgccugcaagauccagcugaucaagaagaagggcaaggugaaggcccuggacgaggaggugcacaagcagcaggacauggaccuggacaucgaguucgacgugcaccugggcaucgcccacaccagaugggccacccacggcgagcccagccccgugaacagccacccccagagaagcgacaagaacaacgaguucaucgugauccacaacggcaucaucaccaacuacaaggaccugaagaaguuccuggagagcaagggcuacgacuucgagagcgagaccgacaccgagaccaucgccaagcuggugaaguacauguacgacaacagagagagccaggacaccagcuucaccacccugguggagagagugauccagcagcuggagggcgccuucgcccugguguucaagagcgugcacuuccccggccaggccgugggcaccagaagaggcagcccccugcugaucggcgugagaagcgagcacaagcugagcaccgaccacauccccauccuguacagaaccgccagaacccagaucggcagcaaguucaccagauggggcagccagggcgagagaggcaaggacaagaagggcagcugcaaccugagcagaguggacagcaccaccugccuguuccccguggaggagaaggccguggaguacuacuucgccagcgacgccagcgccgugaucgagcacaccaacagagugaucuuccuggaggacgacgacguggccgccgugguggacggcagacugagcauccacagaaucaagagaaccgccggcgaccaccccggcagagccgugcagacccugcagauggagcugcagcagaucaugaagggcaacuucagcagcuucaugcagaaggagaucuucgagcagcccgagagcguggugaacaccaugagaggcagagugaacuucgacgacuacaccgugaaccugggcggccugaaggaccacaucaaggagauccagagaugcagaagacugauccugaucgccugcggcaccagcuaccacgccggcguggccaccagacaggugcuggaggagcugaccgagcugcccgugaugguggagcuggccagcgacuuccuggacagaaacacccccguguucagagacgacgugugcuucuuccugagccagagcggcgagaccgccgacacccugaugggccugagauacugcaaggagagaggcgcccugaccgugggcaucaccaacaccgugggcagcagcaucagcagagagaccgacugcggcgugcacaucaacgccggccccgagaucggcguggccagcaccaaggccuacaccagccaguucgugagccuggugauguucgcccugaugaugugcgacgacagaaucagcaugcaggagagaagaaaggagaucaugcugggccugaagagacugcccgaccugaucaaggaggugcugagcauggacgacgagauccagaagcuggccaccgagcuguaccaccagaagagcgugcugaucaugggcagaggcuaccacuacgccaccugccuggagggcgcccugaagaucaaggagaucaccuacaugcacagcgagggcauccuggccggcgagcugaagcacggcccccuggcccugguggacaagcugaugcccgugaucaugaucaucaugagagaccacaccuacgccaagugccagaacgcccugcagcaggugguggccagacagggcagacccguggugaucugcgacaaggaggacaccgagaccaucaagaacaccaagagaaccaucaaggugccccacagcguggacugccugcagggcauccugagcgugaucccccugcagcugcuggccuuccaccuggccgugcugagaggcuacgacguggacuuccccagaaaccuggccaagagcgugaccguggaguaa

SEQ ID NO: 17479 - RNA, 2049 nt, Artificial Sequence
  GFPT2__Homo_sapiens__NP_005101
augugcggcaucuucgccuacaugaacuacagagugcccagaaccagaaaggagaucuucgagacccugaucaagggccugcagagacuggaguacagaggcuacgacagcgccggcguggccaucgacggcaacaaccacgaggugaaggagagacacauccagcuggugaagaagagaggcaaggugaaggcccuggacgaggagcuguacaagcaggacagcauggaccugaagguggaguucgagacccacuucggcaucgcccacaccagaugggccacccacggcgugcccagcgccgugaacagccacccccagagaagcgacaagggcaacgaguucguggugauccacaacggcaucaucaccaacuacaaggaccugagaaaguuccuggagagcaagggcuacgaguucgagagcgagaccgacaccgagaccaucgccaagcugaucaaguacguguucgacaacagagagaccgaggacaucaccuucagcacccugguggagagagugauccagcagcuggagggcgccuucgcccugguguucaagagcgugcacuaccccggcgaggccguggccaccagaagaggcagcccccugcugaucggcgugagaagcaaguacaagcugagcaccgagcagauccccauccuguacagaaccugcacccuggagaacgugaagaacaucugcaagaccagaaugaagagacuggacagcagcgccugccugcacgccgugggcgacaaggccguggaguucuucuucgccagcgacgccagcgccaucaucgagcacaccaacagagugaucuuccuggaggacgacgacaucgccgccguggccgacggcaagcugagcauccacagagugaagagaagcgccagcgacgaccccagcagagccauccagacccugcagauggagcugcagcagaucaugaagggcaacuucagcgccuucaugcagaaggagaucuucgagcagcccgagagcguguucaacaccaugagaggcagagugaacuucgagaccaacaccgugcugcugggcggccugaaggaccaccugaaggagaucagaagaugcagaagacugaucgugaucggcugcggcaccagcuaccacgccgccguggccaccagacaggugcuggaggagcugaccgagcugcccgugaugguggagcuggccagcgacuuccuggacagaaacacccccguguucagagacgacgugugcuucuucaucagccagagcggcgagaccgccgacacccugcuggcccugagauacugcaaggacagaggcgcccugaccgugggcgugaccaacaccgugggcagcagcaucagcagagagaccgacugcggcgugcacaucaacgccggccccgagaucggcguggccagcaccaaggccuacaccagccaguucaucagccuggugauguucggccugaugaugagcgaggacagaaucagccugcagaacagaagacaggagaucaucagaggccugagaagccugcccgagcugaucaaggaggugcugagccuggaggagaagauccacgaccuggcccuggagcuguacacccagagaagccugcuggugaugggcagaggcuacaacuacgccaccugccuggagggcgcccugaagaucaaggagaucaccuacaugcacagcgagggcauccuggccggcgagcugaagcacggcccccuggcccugaucgacaagcagaugcccgugaucauggugaucaugaaggaccccugcuucgccaagugccagaacgcccugcagcaggugaccgccagacagggcagacccaucauccugugcagcaaggacgacaccgagagcagcaaguucgccuacaagaccaucgagcugccccacaccguggacugccugcagggcauccugagcgugaucccccugcagcugcugagcuuccaccuggccgugcugagaggcuacgacguggacuuccccagaaaccuggccaagagcgugaccguggaguaa

SEQ ID NO: 17480 - RNA, 1383 nt, Artificial Sequence
  GFRA1__Homo_sapiens__NP_001138925
auguuccuggccacccuguacuucgcccugccccugcuggaccugcugcugagcgccgaggugagcggcggcgacagacuggacugcgugaaggccagcgaccagugccugaaggagcagagcugcagcaccaaguacagaacccugagacagugcguggccggcaaggagaccaacuucagccuggccagcggccuggaggccaaggacgagugcagaagcgccauggaggcccugaagcagaagagccuguacaacugcagaugcaagagaggcaugaagaaggagaagaacugccugagaaucuacuggagcauguaccagagccugcagggcaacgaccugcuggaggacagccccuacgagcccgugaacagcagacugagcgacaucuucagaguggugcccuucaucagcguggagcacauccccaagggcaacaacugccuggacgccgccaaggccugcaaccuggacgacaucugcaagaaguacagaagcgccuacaucacccccugcaccaccagcgugagcaacgacgugugcaacagaagaaagugccacaaggcccugagacaguucuucgacaaggugcccgccaagcacagcuacggcaugcuguucugcagcugcagagacaucgccugcaccgagagaagaagacagaccaucgugcccgugugcagcuacgaggagagagagaagcccaacugccugaaccugcaggacagcugcaagaccaacuacaucugcagaagcagacuggccgacuucuucaccaacugccagcccgagagcagaagcgugagcagcugccugaaggagaacuacgccgacugccugcuggccuacagcggccugaucggcaccgugaugacccccaacuacaucgacagcagcagccugagcguggcccccuggugcgacugcagcaacagcggcaacgaccuggaggagugccugaaguuccugaacuucuucaaggacaacaccugccugaagaacgccauccaggccuucggcaacggcagcgacgugaccguguggcagcccgccuuccccgugcagaccaccaccgccaccaccaccaccgcccugagagugaagaacaagccccugggccccgccggcagcgagaacgagauccccacccacgugcugccccccugcgccaaccugcaggcccagaagcugaagagcaacgugagcggcaacacccaccugugcaucagcaacggcaacuacgagaaggagggccugggcgccagcagccacaucaccaccaagagcauggccgccccccccagcugcggccugagcccccugcuggugcugguggugaccgcccugagcacccugcugagccugaccgagaccagcuaa

SEQ ID NO: 17481 - RNA, 996 nt, Artificial Sequence
  GFRA2__Homo_sapiens__NP_001158511
augauccuggccaacguguucugccuguucuucuuccugggcaccggcgccgaccccguggugagcgccaagagcaaccacugccuggacgccgccaaggccugcaaccugaacgacaacugcaagaagcugagaagcagcuacaucagcaucugcaacagagagaucagccccaccgagagaugcaacagaagaaagugccacaaggcccugagacaguucuucgacagagugcccagcgaguacaccuacagaaugcuguucugcagcugccaggaccaggccugcgccgagagaagaagacagaccauccugcccagcugcagcuacgaggacaaggagaagcccaacugccuggaccugagaggcgugugcagaaccgaccaccugugcagaagcagacuggccgacuuccacgccaacugcagagccagcuaccagaccgugaccagcugccccgccgacaacuaccaggccugccugggcagcuacgccggcaugaucggcuucgacaugacccccaacuacguggacagcagccccaccggcaucguggugagccccuggugcagcugcagaggcagcggcaacauggaggaggagugcgagaaguuccugagagacuucaccgagaaccccugccugagaaacgccauccaggccuucggcaacggcaccgacgugaacgugagccccaagggccccagcuuccaggccacccaggcccccagaguggagaagacccccagccugcccgacgaccugagcgacagcaccagccugggcaccagcgugaucaccaccugcaccagcgugcaggagcagggccugaaggccaacaacagcaaggagcugagcaugugcuucaccgagcugaccaccaacaucauccccggcagcaacaaggugaucaagcccaacagcggccccagcagagccagacccagcgccgcccugaccgugcugagcgugcugaugcugaagcuggcccuguaa

SEQ ID NO: 17482 - RNA, 1203 nt, Artificial Sequence
  GFRA3__Homo_sapiens__NP_001487
auggugagaccccugaaccccagaccccugccccccguggugcugaugcugcugcugcugcugccccccagcccccugccccuggccgccggcgacccccugcccaccgagagcagacugaugaacagcugccugcaggccagaagaaagugccaggccgaccccaccugcagcgccgccuaccaccaccuggacagcugcaccagcagcaucagcaccccccugcccagcgaggagcccagcgugcccgccgacugccuggaggccgcccagcagcugagaaacagcagccugaucggcugcaugugccacagaagaaugaagaaccagguggccugccuggacaucuacuggaccgugcacagagccagaagccugggcaacuacgagcuggacgugagccccuacgaggacaccgugaccagcaagcccuggaagaugaaccugagcaagcugaacaugcugaagcccgacagcgaccugugccugaaguucgccaugcugugcacccugaacgacaagugcgacagacugagaaaggccuacggcgaggccugcagcggcccccacugccagagacacgugugccugagacagcugcugaccuucuucgagaaggccgccgagccccacgcccagggccugcugcugugccccugcgcccccaacgacagaggcugcggcgagagaagaagaaacaccaucgcccccaacugcgcccugccccccguggcccccaacugccuggagcugagaagacugugcuucagcgacccccugugcagaagcagacugguggacuuccagacccacugccaccccauggacauccugggcaccugcgccaccgagcagagcagaugccugagagccuaccugggccugaucggcaccgccaugacccccaacuucgugagcaacgugaacaccagcguggcccugagcugcaccugcagaggcagcggcaaccugcaggaggagugcgagaugcuggagggcuucuucagccacaaccccugccugaccgaggccaucgccgccaagaugagauuccacagccagcuguucagccaggacuggccccaccccaccuucgccgugauggcccaccagaacgagaaccccgccgugagaccccagcccugggugcccagccuguucagcugcacccugccccugauccugcugcugagccugugguaa

SEQ ID NO: 17483 - RNA, 810 nt, Artificial Sequence
  GFRA4__Homo_sapiens__NP_071422
auggugagaugccugggccccgcccugcugcugcugcugcugcugggcagcgccagcagcgugggcggcaacagaugcguggacgccgccgaggccugcaccgccgacgccagaugccagagacugagaagcgaguacguggcccagugccugggcagagccgcccagggcggcugccccagagccagaugcagaagagcccugagaagauucuucgccagaggcccccccgcccugacccacgcccugcuguucugccccugcgccggccccgccugcgccgagagaagaagacagaccuucgugcccagcugcgccuucagcggccccggccccgccccccccagcugccuggagccccugaacuucugcgagagaagcagagugugcagacccagacugcuggccuuccaggugagcugcacccccgcccccagcgcccccgacggcugccugcuggaccagggcgccagaugccugagagccuacgccggccuggugggcaccgccgugacccccaacuacguggacaacgugagcgccagaguggcccccuggugcgacugcggcgccagcggcaacagaagagaggacugcgaggccuucagaggccuguucaccagaaacagaugccuggacggcgccauccaggccuucgccagcggcuggccccccgugcugcuggaccagcugaacccccagggcgaccccgagcacagccugcugcaggugagcagcaccggcagagcccuggagagaagaagccugcugagcauccugcccgugcuggcccugcccgcccugcuguaa

SEQ ID NO: 17484 - RNA, 1659 nt, Artificial Sequence
  GGA1__Homo_sapiens__NP_001001560
auggagcccgccauggagcccgagacccuggaggccagaaucaacagagccaccaacccccugaacaaggagcuggacugggccagcaucaacggcuucugcgagcagcugaacgaggacuucgagggccccccccuggccaccagacugcuggcccacaagauccagagcccccaggagugggaggccauccaggcccugaccgugcuggagaccugcaugaagagcugcggcaagagauuccacgacgaggugggcaaguucagauuccugaacgagcugaucaagguggugagccccaaguaccugggcagcagaaccagcgagaaggugaagaacaagauccuggagcugcuguacagcuggaccgugggccugcccgaggaggugaagaucgccgaggccuaccagaugcugaagaagcagggcaucgugaagagcgaccccaagcugcccgacgacaccaccuucccccugcccccccccagacccaagaacgugaucuucgaggacgaggagaagagcaagaugcuggccagacugcugaagagcagccaccccgaggaccugagagccgccaacaagcugaucaaggagauggugcaggaggaccagaagagaauggagaagaucagcaagagagugaacgccaucgaggaggugaacaacaacgugaagcugcugaccgagauggugaugagccacagccagggcggcgccgccgccggcagcagcgaggaccugaugaaggagcuguaccagagaugcgagagaaugagacccacccuguucagacuggccagcgacaccgaggacaacgacgaggcccugggccugagcgaccccaccccccccagcggccccagccuggacggcaccggcuggaacagcuuccagagcagcgacgccaccgagccccccgcccccgcccuggcccaggcccccagcauggagagcagaccccccgcccagaccagccugcccgccagcagcggccuggacgaccuggaccugcugggcaagacccugcugcagcagagccugccccccgagagccagcaggugagaugggagaagcagcagcccacccccagacugacccugagagaccugcagaacaagagcagcagcugcagcagccccagcagcagcgccaccagccugcugcacaccgugagccccgagccccccagacccccccagcagcccgugcccaccgagcugagccuggccagcaucaccgugccccuggagagcaucaagcccagcaacauccugcccgugaccguguacgaccagcacggcuucagaauccuguuccacuucgccagagacccccugcccggcagaagcgacgugcugguggugguggugagcaugcugagcaccgccccccagcccaucagaaacaucguguuccagagcgccgugcccaaggugaugaaggugaagcugcagccccccagcggcaccgagcugcccgccuucaaccccaucgugcaccccagcgccaucacccaggugcugcugcuggccaacccccagaaggagaaggugagacugagauacaagcugaccuucaccaugggcgaccagaccuacaacgagaugggcgacguggaccaguuccccccccccgagaccuggggcagccuguaa

SEQ ID NO: 17485 - RNA, 1779 nt, Artificial Sequence
  GGA3__Homo_sapiens__NP_001166175
auggcccugcccgaggaggccaagaucaaggacgccuaccacaugcugaagagacagggcaucgugcagagcgacccccccauccccguggacagaacccugauccccagccccccccccagacccaagaaccccguguucgacgacgaggagaagagcaagcugcuggccaagcugcugaagagcaagaaccccgacgaccugcaggaggccaacaagcugaucaagagcauggugaaggaggacgaggccagaauccagaaggugaccaagagacugcacacccuggaggaggugaacaacaacgugagacugcugagcgagaugcugcugcacuacagccaggaggacagcagcgacggcgacagagagcugaugaaggagcuguucgaccagugcgagaacaagagaagaacccuguucaagcuggccagcgagaccgaggacaacgacaacagccugggcgacauccugcaggccagcgacaaccugagcagagugaucaacagcuacaagaccaucaucgagggccaggugaucaacggcgagguggccacccugacccugcccgacagcgagggcaacagccagugcagcaaccagggcacccugaucgaccuggccgagcuggacaccaccaacagccugagcagcgugcuggcccccgcccccaccccccccagcagcggcauccccauccugcccccccccccccaggccagcggcccccccagaagcagaagcagcagccaggccgaggccacccugggccccagcagcaccagcaacgcccugagcuggcuggacgaggagcugcugugccugggccuggccgaccccgcccccaacgugccccccaaggagagcgccggcaacagccaguggcaccugcugcagagagagcagagcgaccuggacuucuucagccccagacccggcaccgccgccugcggcgccagcgacgccccccugcugcagcccagcgcccccagcagcagcagcagccaggccccccugcccccccccuuccccgcccccguggugcccgccagcgugcccgcccccagcgccggcagcagccuguucagcaccggcguggcccccgcccuggcccccaagguggagcccgccgugcccggccaccacggccuggcccugggcaacagcgcccugcaccaccuggacgcccuggaccagcugcuggaggaggccaaggugaccagcggccuggugaagcccaccaccagcccccugauccccaccaccacccccgccagaccccugcugcccuucagcaccggccccggcagcccccuguuccagccccugagcuuccagagccagggcagcccccccaagggccccgagcugagccuggccagcauccacgugccccuggagagcaucaagcccagcagcgcccugcccgugaccgccuacgacaagaacggcuucagaauccuguuccacuucgccaaggagugcccccccggcagacccgacgugcugguggugguggugagcaugcugaacaccgccccccugcccgugaagagcaucgugcugcaggccgccgugcccaagagcaugaaggugaagcugcagccccccagcggcaccgagcugagccccuucagccccauccagccccccgccgccaucacccaggugaugcugcuggccaacccccugaagaagcaggugcugagcuuccugggcaaggccugccugcagcccuggggccaggccauccugcugaccaccagcugccuggccuaa

SEQ ID NO: 17486 - RNA, 462 nt, Artificial Sequence
  GGACT__Homo_sapiens__NP_149101
auggcccugguguucguguacggcacccugaagagaggccagcccaaccacagagugcugagagacggcgcccacggcagcgccgccuucagagccagaggcagaacccuggagcccuacccccuggugaucgccggcgagcacaacauccccuggcugcugcaccugcccggcagcggcagacugguggagggcgagguguacgccguggacgagagaaugcugagauuccuggacgacuucgagagcugccccgcccuguaccagagaaccgugcugagagugcagcugcuggaggacagagcccccggcgccgaggagccccccgcccccaccgccgugcagugcuucguguacagcagagccaccuucccccccgagugggcccagcugccccaccacgacagcuacgacagcgagggcccccacggccugagauacaaccccagagagaacagauaa

SEQ ID NO: 17487 - RNA, 501 nt, Artificial Sequence
  GGCT__Homo_sapiens__NP_001186744
auggccaacagcggcugcaaggacgugaccggccccgacgaggagagcuuccuguacuucgccuacggcagcaaccugcugaccgagagaauccaccugagaaaccccagcgccgccuucuucugcguggccagacugcaggacuucaagcuggacuucggcaacagccagggcaagaccagccagaccuggcacggcggcaucgccaccaucuuccagagccccggcgacgagguguggggcgugguguggaagaugaacaagagcaaccugaacagccuggacgaguggagaaagaagagacacaccgccuuccagaaccagggcaaccaccccugcaagcacaagaccagaaugugggacagagaccccaagauccccgugcagaaccugagccuggcccugugcuggcaggcccagagcggccacggcaccugcaacagacuguucgccugggugcagaagaagauggugugcagauggagcaucaagagaagcuaa

SEQ ID NO: 17488 - RNA, 2277 nt, Artificial Sequence
  GGCX__Homo_sapiens__NP_000812
auggccgugagcgccggcagcgccagaaccagccccagcagcgacaaggugcagaaggacaaggccgagcugaucagcggccccagacaggacagcagaaucggcaagcugcugggcuucgaguggaccgaccugagcagcuggagaagacuggugacccugcugaacagacccaccgaccccgccagccuggccguguucagauuccuguucggcuuccugauggugcuggacaucccccaggagagaggccugagcagccuggacagaaaguaccuggacggccuggacgugugcagauucccccugcuggacgcccugagaccccugccccuggacuggauguaccugguguacaccaucauguuccugggcgcccugggcaugaugcugggccugugcuacagaaucagcugcgugcuguuccugcugcccuacugguacguguuccugcuggacaagaccagcuggaacaaccacagcuaccuguacggccugcuggccuuccagcugaccuucauggacgccaaccacuacuggagcguggacggccugcugaacgcccacagaagaaacgcccacgugccccuguggaacuacgccgugcugagaggccagaucuucaucguguacuucaucgccggcgugaagaagcuggacgccgacuggguggagggcuacagcauggaguaccugagcagacacuggcuguucagccccuucaagcugcugcugagcgaggagcugaccagccugcugguggugcacuggggcggccugcugcuggaccugagcgccggcuuccugcuguucuucgacgugagcagaagcaucggccuguucuucgugagcuacuuccacugcaugaacagccagcuguucagcaucggcauguucagcuacgugaugcuggccagcagcccccuguucugcagccccgaguggcccagaaagcuggugagcuacugccccagaagacugcagcagcugcugccccugaaggccgccccccagcccagcgugagcugcguguacaagagaagcagaggcaagagcggccagaagcccggccugagacaccagcugggcgccgccuucacccugcuguaccugcuggagcagcuguuccugcccuacagccacuuccugacccagggcuacaacaacuggaccaacggccuguacggcuacagcugggacaugauggugcacagcagaagccaccagcacgugaagaucaccuacagagacggcagaaccggcgagcugggcuaccugaaccccggcguguucacccagagcagaagauggaaggaccacgccgacaugcugaagcaguacgccaccugccugagcagacugcugcccaaguacaacgugaccgagccccagaucuacuucgacaucugggugagcaucaacgacagauuccagcagagaaucuucgaccccagaguggacaucgugcaggccgccuggagccccuuccagagaaccagcugggugcagccccugcugauggaccugagccccuggagagccaagcugcaggagaucaagagcagccuggacaaccacaccgaggugguguucaucgccgacuuccccggccugcaccuggagaacuucgugagcgaggaccugggcaacaccagcauccagcugcugcagggcgaggugaccguggagcugguggccgagcagaagaaccagacccugagagagggcgagaagaugcagcugcccgccggcgaguaccacaagguguacaccaccagccccagccccagcugcuacauguacguguacgugaacaccaccgagcuggcccuggagcaggaccuggccuaccugcaggagcugaaggagaagguggagaacggcagcgagaccggcccccugccccccgagcugcagccccugcuggagggcgaggugaagggcggccccgagcccaccccccuggugcagaccuuccugagaagacagcagagacugcaggagaucgagagaagaagaaacacccccuuccacgagagauucuucagauuccugcugagaaagcuguacguguucagaagaagcuuccugaugaccugcaucagccugagaaaccugauccugggcagacccagccuggagcagcuggcccaggaggugaccuacgccaaccugagacccuucgaggccgugggcgagcugaaccccagcaacaccgacagcagccacagcaacccccccgagagcaaccccgaccccgugcacagcgaguucuaa

SEQ ID NO: 17489 - RNA, 957 nt, Artificial Sequence
  GGH__Homo_sapiens__NP_003869
auggccagccccggcugccugcugugcgugcugggccugcugcugugcggcgccgccagccuggagcugagcagaccccacggcgacaccgccaagaagcccaucaucggcauccugaugcagaagugcagaaacaaggugaugaagaacuacggcagauacuacaucgccgccagcuacgugaaguaccuggagagcgccggcgccagaguggugcccgugagacuggaccugaccgagaaggacuacgagauccuguucaagagcaucaacggcauccuguuccccggcggcagcguggaccugagaagaagcgacuacgccaagguggccaagaucuucuacaaccugagcauccagagcuucgacgacggcgacuacuuccccguguggggcaccugccugggcuucgaggagcugagccugcugaucagcggcgagugccugcugaccgccaccgacaccguggacguggccaugccccugaacuucaccggcggccagcugcacagcagaauguuccagaacuuccccaccgagcugcugcugagccuggccguggagccccugaccgccaacuuccacaaguggagccugagcgugaagaacuucaccaugaacgagaagcugaagaaguucuucaacgugcugaccaccaacaccgacggcaagaucgaguucaucagcaccauggagggcuacaaguaccccguguacggcgugcaguggcaccccgagaaggcccccuacgaguggaagaaccuggacggcaucagccacgcccccaacgccgugaagaccgccuucuaccuggccgaguucuucgugaacgaggccagaaagaacaaccaccacuucaagagcgagagcgaggaggagaaggcccugaucuaccaguucagccccaucuacaccggcaacaucagcagcuuccagcagugcuacaucuucgacuaa

SEQ ID NO: 17490 - RNA, 2094 nt, Artificial Sequence
  GGNBP2__Homo_sapiens__NP_079111
auggccagacugguggccgugugcagagacggcgaggaggaguuccccuucgagagaagacagaucccccuguacaucgacgacacccugaccauggugauggaguuccccgacaacgugcugaaccuggacggccaccagaacaacggcgcccagcugaagcaguucauccagagacacggcaugcugaagcagcaggaccugagcaucgccaugguggugaccagcagagaggugcugagcgcccugagccagcuggugcccugcgugggcugcagaagaagcguggagagacuguucagccagcugguggagagcggcaaccccgcccuggagccccugaccgugggccccaagggcgugcugagcgugaccagaagcugcaugaccgacgccaagaagcuguacacccuguucuacgugcacggcagcaagcugaacgacaugaucgacgccauccccaagagcaagaagaacaagagaugccagcugcacagccuggacacccacaagcccaagccccugggcggcugcuggauggacgugugggagcugaugagccaggagugcagagacgagguggugcugaucgacagcagcugccugcuggagacccuggagaccuaccugagaaagcacagauucugcaccgacugcaagaacaaggugcugagagccuacaacauccugaucggcgagcuggacugcagcaaggagaagggcuacugcgccgcccuguacgagggccugagaugcugcccccacgagagacacauccacgugugcugcgagaccgacuucaucgcccaccugcugggcagagccgagcccgaguucgccggcggcagaagagagagacacgccaagaccaucgacaucgcccaggaggaggugcugaccugccugggcauccaccuguacgagagacugcacagaaucuggcagaagcugagagccgaggagcagaccuggcagaugcuguucuaccugggcguggacgcccugagaaagagcuucgagaugaccguggagaaggugcagggcaucagcagacuggagcagcugugcgaggaguucagcgaggaggagagagugagagagcugaagcaggagaagaagagacagaagagaaagaacagaagaaagaacaagugcgugugcgacauccccaccccccugcagaccgccgacgagaaggaggugagccaggagaaggagaccgacuucaucgagaacagcagcugcaaggccugcggcagcaccgaggacggcaacaccugcguggaggugaucgugaccaacgagaacaccagcugcaccugccccagcagcggcaaccugcugggcagccccaagaucaagaagggccugagcccccacugcaacggcagcgacugcggcuacagcagcagcauggagggcagcgagaccggcagcagagagggcagcgacguggccugcaccgagggcaucugcaaccacgacgagcacggcgacgacagcugcgugcaccacugcgaggacaaggaggacgacggcgacagcugcguggagugcugggccaacagcgaggagaacgacaccaagggcaagaacaagaagaagaagaagaagagcaagauccugaagugcgacgagcacauccagaagcugggcagcugcaucaccgaccccggcaacagagagaccagcggcaacaccaugcacaccguguuccacagagacaagaccaaggacacccaccccgagagcugcugcagcagcgagaagggcggccagccccugcccugguucgagcacagaaagaacgugccccaguucgccgagcccaccgagacccuguucggccccgacagcggcaagggcgccaagagccugguggagcugcuggacgagagcgagugcaccagcgacgaggagaucuucaucagccaggacgagauccagagcuucauggccaacaaccagagcuucuacagcaacagagagcaguacagacagcaccugaaggagaaguucaacaaguacugcagacugaacgaccacaagagacccaucugcagcggcuggcugaccaccgccggcgccaacuaa

SEQ ID NO: 17491 - RNA, 1959 nt, Artificial Sequence
  GGN__Homo_sapiens__NP_689870
augggcaaccugcagagcgagcccagcgccggcggcggcagcagaaaggugcagcccagcgacagagcccccgacagcagaagaaccagccugguggagcccgagaugaccagccaggccaugagacugaccagaggccugggcgugugguuccccggcagcgccaccccccccggccugauggugcccagagagccccaggccagccccagcacccugccccugacccuggagagacccagccccgugaugcccccccccgaggaggccgccgccgugagcgcccccccccccgcccccgccggcacccugcugcccggccccagcaaguggcagaagcccgccggcacccccgugcccagaaucagaagacugcuggaggccagccacagaggccagggcgacccccccagccugagaccccugaagcccccccccccccccagacagcugagcgugaaggacaccgugcccagagcccccagccaguucccccccccccuggagaccuggaagcccccccccccccugcccagcgagagacagcccgccgacagaagaaucacccccgcccuggccacccccgccagcccccccaccgagagccaggccggccccagaaaccagggccagaccgccggcagagccagaggcggcgcccccccccacgccggcgagggcgagauggcccagcccgccgacagcgagagcggccugagccugcugugcaagaucaccuucaagagcagacccagccuggccccccccgccgccagcagcagccuggccgccaaggccagccugggcggcggcggcggcggcggccuguucgccgccagcggcgccaucagcuacgccgaggugcugaagcagggcccccugccccccggcgccgccagaccccugggcgaggugagcagaggcgcccaggaggccgagggcggcgacggcgacggcgagggcugcagcggcccccccagcgcccccgccagccaggccagagcccugccccccccccccuacaccaccuuccccggcagcaagcccaaguucgacugggugagcgcccccgacggccccgagagacacuucagauucaacggcgccggcggcggcaucggcgcccccagaagaagagccgccgcccugagcggccccuggggcagccccccccccccccccgagcagauccacagcgcccccggccccagaagacccgcccccgcccugcuggccccccccaccuucaucuuccccgcccccaccaacggcgagcccaugagacccggcccccccggccugcaggagcugcccccccugcccccccccacccccccccccacccugcagccccccgcccugcagcccaccccccugcccguggcccccccccugacccccggccugggccacaaggagagcgcccuggcccccaccgccgcccccgcccugccccccgcccuggccgccgaccaggcccccgcccccagccccgcccccgcccccaccguggccgagcccagcccccccgugagcgcccccgcccccgccgccgcccccaucaagaccagaaccagaagaaacaagggcagcagagccgccagaggcgccaccagaaaggacggccugcacggcgacggccccagagagagagccaccgccaccgugcccgacagcagcggcggcggcggcggcggcagcggcgccagccagaccggcgccgccaacaccagagccgccagacacuggcugcccuuccaggugcugaacagcugccccugcaagugcuacugccaccaccagcccagacacagaagacugcccagaaacgugagcgccuggcugagcaccagcaccaaccaccugggcgagccccccuggguggccaccaucaagcugagcggcagccugguggccaagcuggagcacuacgaccugcaggccacccacagcaacuaa

SEQ ID NO: 17492 - RNA, 903 nt, Artificial Sequence
  GGPS1__Homo_sapiens__NP_001032354
auggagaagacccaggagaccgugcagagaauccugcuggagcccuacaaguaccugcugcagcugcccggcaagcaggugagaaccaagcugagccaggccuucaaccacuggcugaaggugcccgaggacaagcugcagaucaucaucgaggugaccgagaugcugcacaacgccagccugcugaucgacgacaucgaggacaacagcaagcugagaagaggcuuccccguggcccacagcaucuacggcauccccagcgugaucaacagcgccaacuacguguacuuccugggccuggagaaggugcugacccuggaccaccccgacgccgugaagcuguucaccagacagcugcuggagcugcaccagggccagggccuggacaucuacuggagagacaacuacaccugccccaccgaggaggaguacaaggccauggugcugcagaagaccggcggccuguucggccuggccgugggccugaugcagcuguucagcgacuacaaggaggaccugaagccccugcugaacacccugggccuguucuuccagaucagagacgacuacgccaaccugcacagcaaggaguacagcgagaacaagagcuucugcgaggaccugaccgagggcaaguucagcuuccccaccauccacgccaucuggagcagacccgagagcacccaggugcagaacauccugagacagagaaccgagaacaucgacaucaagaaguacugcgugcacuaccuggaggacgugggcagcuucgaguacaccagaaacacccugaaggagcuggaggccaaggccuacaagcagaucgacgccagaggcggcaaccccgagcugguggcccuggugaagcaccugagcaagauguucaaggaggagaacgaguaa

SEQ ID NO: 17493 - RNA, 1710 nt, Artificial Sequence
  GGT1__Homo_sapiens__NP_038347
augaagaagaagcugguggugcugggccugcuggccguggugcuggugcuggugaucgugggccugugccuguggcugcccagcgccagcaaggagcccgacaaccacguguacaccagagccgccguggccgccgacgccaagcagugcagcaagaucggcagagacgcccugagagacggcggcagcgccguggacgccgccaucgccgcccugcugugcgugggccugaugaacgcccacagcaugggcaucggcggcggccuguuccugaccaucuacaacagcaccaccagaaaggccgaggugaucaacgccagagagguggcccccagacuggccuucgccaccauguucaacagcagcgagcagagccagaagggcggccugagcguggccgugcccggcgagaucagaggcuacgagcuggcccaccagagacacggcagacugcccugggccagacuguuccagcccagcauccagcuggccagacagggcuuccccgugggcaagggccuggccgccgcccuggagaacaagagaaccgugaucgagcagcagcccgugcugugcgagguguucugcagagacagaaaggugcugagagagggcgagagacugacccugccccagcuggccgacaccuacgagacccuggccaucgagggcgcccaggccuucuacaacggcagccugaccgcccagaucgugaaggacauccaggccgccggcggcaucgugaccgccgaggaccugaacaacuacagagccgagcugaucgagcacccccugaacaucagccugggcgacguggugcuguacaugcccagcgccccccugagcggccccgugcuggcccugauccugaacauccugaagggcuacaacuucagcagagagagcguggagagccccgagcagaagggccugaccuaccacagaaucguggaggccuucagauucgccuacgccaagagaacccugcugggcgaccccaaguucguggacgugaccgagguggugagaaacaugaccagcgaguucuucgccgcccagcugagagcccagaucagcgacgacaccacccaccccaucagcuacuacaagcccgaguucuacacccccgacgacggcggcaccgcccaccugagcgugguggccgaggacggcagcgccgugagcgccaccagcaccaucaaccuguacuucggcagcaaggugagaagccccgugagcggcauccuguucaacaacgagauggacgacuucagcagccccagcaucaccaacgaguucggcgugccccccagccccgccaacuucauccagcccggcaagcagccccugagcagcaugugccccaccaucauggugggccaggacggccaggugagaaugguggugggcgccgccggcggcacccagaucaccaccgccaccgcccuggccaucaucuacaaccugugguucggcuacgacgugaagagagccguggaggagcccagacugcacaaccagcugcugcccaacgugaccaccguggagagaaacaucgaccaggccgugaccgccgcccuggagaccagacaccaccacacccagaucgccagcaccuucaucgccguggugcaggccaucgugagaaccgccggcggcugggccgccgccagcgacagcagaaagggcggcgagcccgccggcuacuaa

SEQ ID NO: 17494 - RNA, 678 nt, Artificial Sequence
  GGT2__Homo_sapiens__XP_011528923
augaccagcgaguucuucgccgcccagcugagaagccagaucagcgaccacaccacccaccccaucagcuacuacaagcccgaguucuacacccccgacgacggcggcaccgcccaccugagcgugguggccgaggacggcagcgccgugagcgccaccagcaccaucaaccuguacuucggcagcaaggugugcagccccgugagcggcauccuguucaacaacgaguggaccaccagcgcccugcccgccuucaccaacgaguucggcgccccccccagccccgccaacuucauccagcccggcaagcagccccugcugagcaugugccugaccaucauggugggccaggacggccaggugagaaugguggugggcgccgccggcggcacccagaucaccaccgacaccgcccuggccaucaucuacaaccugugguucggcuacgacgugaagagagccguggaggagcccagacugcacaacaagcugcugcccaacgugaccaccguggagagaaacaucgaccaggccgugaccgccgcccuggagaccagacaccaccacacccagaucgccagcaccuucaucgccguggugcaggccaucgugagaaccgccggcggcugggccgccgccagcgacagcagaaagggcggcgagcccgccggcuacuaa

SEQ ID NO: 17495 - RNA, 1764 nt, Artificial Sequence
  GGT5__Homo_sapiens__NP_001093251
auggccagaggcuacggcgccaccgugagccuggugcugcugggccugggccuggcccuggccgugaucgugcuggccguggugcugagcagacaccaggcccccugcggcccccaggccuucgcccacgccgccguggccgccgacagcaaggugugcagcgacaucggcagagccauccugcagcagcagggcagccccguggacgccaccaucgccgcccuggugugcaccagcguggugaacccccagagcaugggccugggcggcggcgugaucuucaccaucuacaacgugaccaccggcaagguggaggugaucaacgccagagagaccgugcccgccagccacgcccccagccugcuggaccagugcgcccaggcccugccccugggcaccggcgcccaguggaucggcgugcccggcgagcugagaggcuacgccgaggcccacagaagacacggcagacugcccugggcccagcuguuccagcccaccaucgcccugcugagaggcggccacgugguggcccccgugcugagcagauuccugcacaacagcauccugagacccagccugcaggccagcacccugagacagcuguucuucaacggcaccgagccccugagaccccaggacccccugcccuggcccgcccuggccaccacccuggagaccguggccaccgagggcguggagguguucuacaccggcagacugggccagaugcugguggaggacaucgccaaggagggcagccagcugacccugcaggaccuggccaaguuccagcccgaggugguggacgcccuggaggugccccugggcgacuacacccuguacagcccccccccccccgccggcggcgccauccugagcuucauccugaacgugcugagaggcuucaacuucagcaccgagagcauggccagacccgagggcagagugaacguguaccaccaccugguggagacccugaaguucgccaagggccagagauggagacugggcgaccccagaagccaccccaagcugcagaacgccagcagagaccugcugggcgagacccuggcccagcugaucagacagcagaucgacggcagaggcgaccaccagcugagccacuacagccuggccgaggccuggggccacggcaccggcaccagccacgugagcgugcugggcgaggacggcagcgccguggccgccaccagcaccaucaacacccccuucggcgccaugguguacagccccagaaccggcaucauccugaacaacgagcugcuggaccugugcgagagaugccccagaggcagcggcaccacccccagccccgccgugagcggcgacagagugggcggcgcccccggcagaugcuggccccccgugcccggcgagagaagccccagcagcauggugcccagcauccugaucaacaaggcccagggcagcaagcuggugaucggcggcgccggcggcgagcugaucaucagcgccguggcccaggccaucaugagcaagcuguggcugggcuucgaccugagagccgccaucgccgcccccauccugcacgugaacagcaagggcugcguggaguacgagcccaacuucagccaggaggugcagagaggccugcaggacagaggccagaaccagacccagagacccuucuuccugaacguggugcaggccgugagccaggagggcgccugcguguacgccgugagcgaccugagaaagagcggcgaggccgccggcuacuaa

SEQ ID NO: 17496 - RNA, 678 nt, Artificial Sequence
  GGTLC1__Homo_sapiens__XP_005260922
augaccagcgaguucuucagcgcccagcugagagcccagaucagcgacgacaccacccaccccaucagcuacuacaagcccgaguucuacaugcccgacgacggcggcaccgcccaccugagcgugguggccgaggacggcagcgccgugagcgccaccagcaccaucaaccuguacuucggcagcaaggugagaagccccgugagcggcauccugcugaacaacgagauggacgacuucagcagcaccagcaucaccaacgaguucggcgugccccccagccccgccaacuucauccagcccggcaagcagccccugagcagcaugugccccaccaucauggugggccaggacggccaggugagaaugguggugggcgccgccggcggcacccagaucaccauggccaccgcccuggccaucaucuacaaccugugguucggcuacgacgugaagugggccguggaggagcccagacugcacaaccagcugcugcccaacgugaccaccguggagagaaacaucgaccaggaggugaccgccgcccuggagaccagacaccaccacacccagaucaccagcaccuucaucgccguggugcaggccaucgugagaauggccggcggcugggccgccgccagcgacagcagaaagggcggcgagcccgccggcuacuaa

SEQ ID NO: 17497 - RNA, 654 nt, Artificial Sequence
  GH1__Homo_sapiens__NP_000506
auggccaccggcagcagaaccagccugcugcuggccuucggccugcugugccugcccuggcugcaggagggcagcgccuuccccaccaucccccugagcagacuguucgacaacgccaugcugagagcccacagacugcaccagcuggccuucgacaccuaccaggaguucgaggaggccuacauccccaaggagcagaaguacagcuuccugcagaacccccagaccagccugugcuucagcgagagcauccccacccccagcaacagagaggagacccagcagaagagcaaccuggagcugcugagaaucagccugcugcugauccagagcuggcuggagcccgugcaguuccugagaagcguguucgccaacagccugguguacggcgccagcgacagcaacguguacgaccugcugaaggaccuggaggagggcauccagacccugaugggcagacuggaggacggcagccccagaaccggccagaucuucaagcagaccuacagcaaguucgacaccaacagccacaacgacgacgcccugcugaagaacuacggccugcuguacugcuucagaaaggacauggacaagguggagaccuuccugagaaucgugcagugcagaagcguggagggcagcugcggcuucuaa

SEQ ID NO: 17498 - RNA, 654 nt, Artificial Sequence
  GH2__Homo_sapiens__NP_002050
auggccgccggcagcagaaccagccugcugcuggccuucggccugcugugccugagcuggcugcaggagggcagcgccuuccccaccaucccccugagcagacuguucgacaacgccaugcugagagccagaagacuguaccagcuggccuacgacaccuaccaggaguucgaggaggccuacauccugaaggagcagaaguacagcuuccugcagaacccccagaccagccugugcuucagcgagagcauccccacccccagcaacagagugaagacccagcagaagagcaaccuggagcugcugagaaucagccugcugcugauccagagcuggcuggagcccgugcagcugcugagaagcguguucgccaacagccugguguacggcgccagcgacagcaacguguacagacaccugaaggaccuggaggagggcauccagacccugauguggagacuggaggacggcagccccagaaccggccagaucuucaaccagagcuacagcaaguucgacaccaagagccacaacgacgacgcccugcugaagaacuacggccugcuguacugcuucagaaaggacauggacaagguggagaccuuccugagaaucgugcagugcagaagcguggagggcagcugcggcuucuaa

SEQ ID NO: 17499 - RNA, 1038 nt, Artificial Sequence
  GHITM__Homo_sapiens__NP_055209
augcuggccgccagacuggugugccugagaacccugcccagcagaguguuccaccccgccuucaccaaggccagccccguggugaagaacagcaucaccaagaaccaguggcugcugacccccagcagagaguacgccaccaagaccagaaucggcaucagaagaggcagaaccggccaggagcugaaggaggccgcccuggagcccagcauggagaagaucuucaagaucgaccagaugggcagaugguucguggccggcggcgccgccgugggccugggcgcccugugcuacuacggccugggccugagcaacgagaucggcgccaucgagaaggccgugaucuggccccaguacgugaaggacagaauccacagcaccuacauguaccuggccggcagcaucggccugaccgcccugagcgccaucgccaucagcagaacccccgugcugaugaacuucaugaugagaggcagcugggugaccaucggcgugaccuucgccgccauggugggcgccggcaugcuggugagaagcauccccuacgaccagagccccggccccaagcaccuggccuggcugcugcacagcggcgugaugggcgccgugguggccccccugaccauccugggcggcccccugcugaucagagccgccugguacaccgccggcaucgugggcggccugagcaccguggccaugugcgcccccagcgagaaguuccugaacaugggcgccccccugggcgugggccugggccugguguucgugagcagccugggcagcauguuccugccccccaccaccguggccggcgccacccuguacagcguggccauguacggcggccuggugcuguucagcauguuccugcuguacgacacccagaaggugaucaagagagccgaggugagccccauguacggcgugcagaaguacgaccccaucaacagcaugcugagcaucuacauggacacccugaacaucuucaugagaguggccaccaugcuggccaccggcggcaacagaaagaaguaa

SEQ ID NO: 17500 - RNA, 327 nt, Artificial Sequence
  GHRH__Homo_sapiens__XP_011527089
augccccuguggguguucuucuucgugauccugacccugagcaacagcagccacugcagccccccccccccccugacccugagaaugagaagauacgccgacgccaucuucaccaacagcuacagaaaggugcugggccagcugagcgccagaaagcugcugcaggacaucaugagcagacagcagggcgagagcaaccaggagagaggcgccagagccagacugggcagacagguggacagcaugugggccgagcagaagcagauggagcuggagagcauccugguggcccugcugcagaagcacagcagaaacagccagggcuaa

SEQ ID NO: 17501 - RNA, 1938 nt, Artificial Sequence
  GHR__Homo_sapiens__NP_001229328
augaacuggggccccaccggcauggaccuguggcagcugcugcugacccuggcccuggccggcagcagcgacgccuucagcggcagcgaggccaccgccgccauccugagcagagcccccuggagccugcagagcgugaaccccggccugaagaccaacagcagcaaggagcccaaguucaccaagugcagaagccccgagagagagaccuucagcugccacuggaccgacgaggugcaccacggcaccaagaaccugggccccauccagcuguucuacaccagaagaaacacccaggaguggacccaggaguggaaggagugccccgacuacgugagcgccggcgagaacagcugcuacuucaacagcagcuucaccagcaucuggauccccuacugcaucaagcugaccagcaacggcggcaccguggacgagaagugcuucagcguggacgagaucgugcagcccgacccccccaucgcccugaacuggacccugcugaacgugagccugaccggcauccacgccgacauccaggugagaugggaggcccccagaaacgccgacauccagaagggcuggauggugcuggaguacgagcugcaguacaaggaggugaacgagaccaaguggaagaugauggaccccauccugaccaccagcgugcccguguacagccugaagguggacaaggaguacgaggugagagugagaagcaagcagagaaacagcggcaacuacggcgaguucagcgaggugcuguacgugacccugccccagaugagccaguucaccugcgaggaggacuucuacuuccccuggcugcugaucaucaucuucggcaucuucggccugaccgugaugcuguucguguuccuguucagcaagcagcagagaaucaagaugcugauccugccccccgugcccgugcccaagaucaagggcaucgaccccgaccugcugaaggagggcaagcuggaggaggugaacaccauccuggccauccacgacagcuacaagcccgaguuccacagcgacgacagcuggguggaguucaucgagcuggacaucgacgagcccgacgagaagaccgaggagagcgacaccgacagacugcugagcagcgaccacgagaagagccacagcaaccugggcgugaaggacggcgacagcggcagaaccagcugcugcgagcccgacauccuggagaccgacuucaacgccaacgacauccacgagggcaccagcgagguggcccagccccagagacugaagggcgaggccgaccugcugugccuggaccagaagaaccagaacaacagccccuaccacgacgccugccccgccacccagcagcccagcgugauccaggccgagaagaacaagccccagccccugcccaccgagggcgccgagagcacccaccaggccgcccacauccagcugagcaaccccagcagccugagcaacaucgacuucuacgcccaggugagcgacaucacccccgccggcagcguggugcugagccccggccagaagaacaaggccggcaugagccagugcgacaugcaccccgagauggugagccugugccaggagaacuuccugauggacaacgccuacuucugcgaggccgacgccaagaagugcauccccguggccccccacaucaagguggagagccacauccagcccagccugaaccaggaggacaucuacaucaccaccgagagccugaccaccgccgccggcagacccggcaccggcgagcacgugcccggcagcgagaugcccgugcccgacuacaccagcauccacaucgugcagagcccccagggccugauccugaacgccaccgcccugccccugcccgacaaggaguuccugagcagcugcggcuacgugagcaccgaccagcugaacaagaucaugcccuaa

SEQ ID NO: 17502 - RNA, 1272 nt, Artificial Sequence
  GHRHR__Homo_sapiens__NP_000814
auggacagaagaauguggggcgcccacguguucugcgugcugagcccccugcccaccgugcugggccacaugcaccccgagugcgacuucaucacccagcugagagaggacgagagcgccugccugcaggccgccgaggagaugcccaacaccacccugggcugccccgccaccugggacggccugcugugcuggcccaccgccggcagcggcgagugggugacccugcccugccccgacuucuucagccacuucagcagcgagagcggcgccgugaagagagacugcaccaucaccggcuggagcgagcccuucccccccuaccccguggccugccccgugccccuggagcugcuggccgaggaggagagcuacuucagcaccgugaagaucaucuacaccgugggccacagcaucagcaucguggcccuguucguggccaucaccauccugguggcccugagaagacugcacugccccagaaacuacgugcacacccagcuguucaccaccuucauccugaaggccggcgccguguuccugaaggacgccgcccuguuccacagcgacgacaccgaccacugcagcuucagcaccgugcugugcaaggugagcguggccgccagccacuucgccaccaugaccaacuucagcuggcugcuggccgaggccguguaccugaacugccugcuggccagcaccagccccagcagcagaagagccuucugguggcuggugcuggccggcuggggccugcccgugcuguucaccggcaccugggugagcugcaagcuggccuucgaggacaucgccugcugggaccuggacgacaccagccccuacugguggaucaucaagggccccaucgugcugagcgugggcgugaacuucggccuguuccugaacaucaucagaauccuggugagaaagcuggagcccgcccagggcagccugcacacccagagccaguacuggagacugagcaagagcacccuguuccugaucccccuguucggcauccacuacaucaucuucaacuuccugcccgacaacgccggccugggcaucagacugccccuggagcugggccugggcagcuuccagggcuucaucguggccauccuguacugcuuccugaaccaggaggugagaaccgagaucagcagaaaguggcacggccacgaccccgagcugcugcccgccuggagaaccagagccaaguggaccacccccagcagaagcgccgccaaggugcugaccagcaugugcuaa

SEQ ID NO: 17503 - RNA, 318 nt, Artificial Sequence
  GHRL__Homo_sapiens__NP_001128416
auguucaccugcugguggagcuaccugagaagcacccuggccgccgugcccggcgaggccagcagagugcagcagagaaaggagagcaagaagccccccgccaagcugcagcccagagcccuggccggcuggcugagacccgaggacggcggccaggccgagggcgccgaggacgagcuggaggugagauucaacgcccccuucgacgugggcaucaagcugagcggcgugcaguaccagcagcacagccaggcccugggcaaguuccugcaggacauccugugggaggaggccaaggaggcccccgccgacaaguaa

SEQ ID NO: 17504 - RNA, 870 nt, Artificial Sequence
  GHSR__Homo_sapiens__NP_004113
auguggaacgccacccccagcgaggagcccggcuucaaccugacccuggccgaccuggacugggacgccagccccggcaacgacagccugggcgacgagcugcugcagcuguuccccgccccccugcuggccggcgugaccgccaccugcguggcccuguucguggugggcaucgccggcaaccugcugaccaugcugguggugagcagauucagagagcugagaaccaccaccaaccuguaccugagcagcauggccuucagcgaccugcugaucuuccugugcaugccccuggaccuggugagacuguggcaguacagacccuggaacuucggcgaccugcugugcaagcuguuccaguucgugagcgagagcugcaccuacgccaccgugcugaccaucaccgcccugagcguggagagauacuucgccaucugcuucccccugagagccaaggugguggugaccaagggcagagugaagcuggugaucuucgugaucugggccguggccuucugcagcgccggccccaucuucgugcuggugggcguggagcacgagaacggcaccgaccccugggacaccaacgagugcagacccaccgaguucgccgugagaagcggccugcugaccgugauggugugggugagcagcaucuucuucuuccugcccguguucugccugaccgugcuguacagccugaucggcagaaagcuguggagaagaagaagaggcgacgccguggugggcgccagccugagagaccagaaccacaagcagaccgugaagaugcugggcggcagccagagagcccugagacugagccuggccggccccauccugagccugugccugcugcccagccuguaa

SEQ ID NO: 17505 - RNA, 687 nt, Artificial Sequence
  GID8__Homo_sapiens__NP_060366
augagcuacgccgagaagcccgacgagaucaccaaggacgaguggauggagaagcugaacaaccugcacgugcagagagccgacaugaacagacugaucaugaacuaccuggugaccgagggcuucaaggaggccgccgagaaguucagaauggagagcggcaucgagcccagcguggaccuggagacccuggacgagagaaucaagaucagagagaugauccugaagggccagauccaggaggccaucgcccugaucaacagccugcaccccgagcugcuggacaccaacagauaccuguacuuccaccugcagcagcagcaccugaucgagcugaucagacagagagagaccgaggccgcccuggaguucgcccagacccagcuggccgagcagggcgaggagagcagagagugccugaccgagauggagagaacccuggcccugcuggccuucgacagccccgaggagagccccuucggcgaccugcugcacaccaugcagagacagaagguguggagcgaggugaaccaggccgugcuggacuacgagaacagagagagcacccccaagcuggccaagcugcugaagcugcugcugugggcccagaacgagcuggaccagaagaaggugaaguaccccaagaugaccgaccugagcaagggcgugaucgaggagcccaaguaa

SEQ ID NO: 17506 - RNA, 1254 nt, Artificial Sequence
  GIF__Homo_sapiens__NP_005133
auggccugguucgcccuguaccugcugagccugcugugggccaccgccggcaccagcacccagacccagagcagcugcagcgugcccagcgcccaggagccccuggugaacggcauccaggugcugauggagaacagcgugaccagcagcgccuaccccaaccccagcauccugaucgccaugaaccuggccggcgccuacaaccugaaggcccagaagcugcugaccuaccagcugaugagcagcgacaacaacgaccugaccaucggccagcugggccugaccaucauggcccugaccagcagcugcagagaccccggcgacaaggugagcauccugcagagacagauggagaacugggcccccagcagccccaacgccgaggccagcgccuucuacggccccagccuggccauccuggcccugugccagaagaacagcgaggccacccugcccaucgccgugagauucgccaagacccugcuggccaacagcagccccuucaacguggacaccggcgccauggccacccuggcccugaccugcauguacaacaagauccccgugggcagcgaggagggcuacagaagccuguucggccaggugcugaaggacaucguggagaagaucagcaugaagaucaaggacaacggcaucaucggcgacaucuacagcaccggccuggccaugcaggcccugagcgugacccccgagcccagcaagaaggaguggaacugcaagaagaccaccgacaugauccugaacgagaucaagcagggcaaguuccacaaccccaugagcaucgcccagauccugcccagccugaagggcaagaccuaccuggacgugccccaggugaccugcagccccgaccacgaggugcagcccacccugcccagcaaccccggccccggccccaccagcgccagcaacaucaccgugaucuacaccaucaacaaccagcugagaggcguggagcugcuguucaacgagaccaucaacgugagcgugaagagcggcagcgugcugcugguggugcuggaggaggcccagagaaagaaccccauguucaaguucgagaccaccaugaccagcuggggccugguggugagcagcaucaacaacaucgccgagaacgugaaccacaagaccuacuggcaguuccugagcggcgugaccccccugaacgagggcguggccgacuacauccccuucaaccacgagcacaucaccgccaacuucacccaguacuaa

SEQ ID NO: 17507 - RNA, 3108 nt, Artificial Sequence
  GIGYF1__Homo_sapiens__XP_005250589
auggccgccgagacccugaacuucggccccgaguggcugagagcccugagcggcggcggcagcguggccagccccccccccagccccgccaugcccaaguacaagcuggccgacuacagauacggcagagaggagaugcuggcccuguacgugaaggagaacaaggugcccgaggagcugcaggacaaggaguucgccgccgugcugcaggacgagccccugcagccccuggcccuggagccccugaccgaggaggagcagagaaacuucagccugagcgugaacagcguggccgugcugagacugaugggcaagggcgccggccccccccuggccggcaccagcagaggcagaggcagcaccagaagcagaggcagaggcagaggcgacagcugcuucuaccagagaagcaucgaggagggcgacggcgccuucggcagaagccccagagagauccagagaagccagagcugggacgacagaggcgagagaagauucgagaagagcgccagaagagacggcgccagaugcggcuucgaggagggcggcgccggccccagaaaggagcacgccagaagcgacagcgagaacuggagaagccugagagaggagcaggaggaggaggaggagggcagcuggagacugggcgccggccccagaagagacggcgacagauggagaagcgccagccccgacggcggccccagaagcgccggcuggagagagcacggcgagagaagaagaaaguucgaguucgaccugagaggcgacagaggcggcugcggcgaggaggagggcagaggcggcggcggcagcagccaccugagaagaugcagagcccccgagggcuucgaggaggacaaggacggccugcccgaguggugccuggacgacgaggacgaggagaugggcaccuucgacgccagcggcgccuuccugccccugaagaagggccccaaggagcccauccccgaggagcaggagcuggacuuccagggccuggaggaggaggaggagcccagcgagggccuggaggaggagggccccgaggccggcggcaaggagcugaccccccugcccccccaggaggagaagagcagcagccccagcccccugcccacccugggcccccuguggggcaccaacggcgacggcgacgagaccgccgagaaggagccccccgccgccgaggacgacaucagaggcauccagcugagccccggcgugggcagcagcgccggcccccccggcgaccuggaggacgacgagggccugaagcaccugcagcaggaggccgagaagcugguggccagccugcaggacagcagccuggaggaggagcaguucaccgccgccaugcagacccagggccugagacacagcgccgccgccaccgcccugccccugagccacggcgccgccagaaagugguucuacaaggacccccagggcgagauccagggccccuucaccacccaggagauggccgagugguuccaggccggcuacuucagcaugagccugcuggugaagagaggcugcgacgagggcuuccagccccugggcgaggugaucaagauguggggcagagugcccuucgcccccggccccagcccccccccccugcugggcaacauggaccaggagagacugaagaagcagcaggagcuggccgccgccgcccuguaccagcagcugcagcaccagcaguuccugcagcuggugagcagcagacagcugccccagugcgcccugagagagaaggccgcccugggcgaccugaccccccccccccccccccccccccagcagcagcagcagcagcugaccgccuuccugcagcagcugcaggcccugaagccccccagaggcggcgaccagaaccugcugcccaccaugagcagaagccugagcgugcccgacagcggcagacugugggacgugcacaccagcgccagcagccagagcggcggcgaggccagccugugggacauccccaucaacagcagcacccagggccccauccuggagcagcugcagcugcagcacaaguuccaggagagaagagagguggagcugagagccaagagagaggaggaggagagaaagagaagagaggagaagagaagacagcagcagcaggaggagcagaagagaagacaggaggaggaggagcuguucagaagaaagcacgugagacagcaggagcugcugcugaagcugcugcagcagcagcaggccgugcccgugccccccgcccccagcagcccccccccccugugggccggccuggccaagcagggccugagcaugaagacccugcuggagcugcagcuggagggcgagagacagcugcacaagcagcccccccccagagagcccgccagagcccaggcccccaaccacagagugcagcugggcggccugggcaccgccccccugaaccagugggugagcgaggccggcccccuguggggcggccccgacaagagcggcggcggcagcagcggccugggccugugggaggacacccccaagagcggcggcagccuggugagaggccugggccugaagaacagcagaagcagccccagccugagcgacagcuacagccaccugagcggcagacccaucagaaagaagaccgaggaggaggagaagcugcugaagcugcugcagggcauccccagaccccaggacggcuucacccaguggugcgagcagaugcugcacacccugagcgccaccggcagccuggacgugcccauggccguggccauccugaaggagguggagagccccuacgacgugcacgacuacaucagaagcugccugggcgacacccuggaggccaaggaguucgccaagcaguuccuggagagaagagccaagcagaaggccagccagcagagacagcagcagcaggaggccuggcugagcagcgccagccugcagaccgccuuccaggccaaccacagcaccaagcugggccccggcgagggcagcaaggccaagagaagagcccugaugcugcacagcgaccccagcauccugggcuacagccugcacggcagcagcggcgagaucgagagcguggacgacuacuaa

SEQ ID NO: 17508 - RNA, 3900 nt, Artificial Sequence
  GIGYF2__Homo_sapiens__NP_001096616
auggccgccgagacccagacccugaacuucggccccgaguggcugagagcccugagcagcggcggcagcaucaccagccccccccugagccccgcccugcccaaguacaagcuggccgacuacagauacggcagagaggagaugcuggcccuguuccugaaggacaacaagauccccagcgaccugcuggacaaggaguuccugcccauccugcaggaggagccccugcccccccuggcccuggugcccuucaccgaggaggagcagagaaacuucagcaugagcgugaacagcgccgccgugcugagacugaccggcagaggcggcggcggcaccguggugggcgcccccagaggcagaagcagcagcagaggcagaggcagaggcagaggcgagugcggcuucuaccagagaagcuucgacgagguggagggcguguucggcagaggcggcggcagagagaugcacagaagccagagcugggaggagagaggcgacagaagauucgagaagcccggcagaaaggacgugggcagacccaacuucgaggagggcggccccaccagcgugggcagaaagcacgaguucaucagaagcgagagcgagaacuggagaaucuucagagaggagcagaacggcgaggacgaggacggcggcuggagacuggccggcagcagaagagacggcgagagauggagaccccacagccccgacggccccagaagcgccggcuggagagagcacauggagagaagaagaagauucgaguucgacuucagagacagagacgacgagagaggcuacagaagagugagaagcggcagcggcagcaucgacgacgacagagacagccugcccgaguggugccuggaggacgccgaggaggagaugggcaccuucgacagcagcggcgccuuccugagccugaagaaggugcagaaggagcccauccccgaggagcaggagauggacuucagacccguggacgagggcgaggagugcagcgacagcgagggcagccacaacgaggaggccaaggagcccgacaagaccaacaagaaggagggcgagaagaccgacagagugggcguggaggccagcgaggagaccccccagaccagcagcagcagcgccagacccggcacccccagcgaccaccagagccaggaggccagccaguucgagagaaaggacgagcccaagaccgagcagaccgagaaggccgaggaggagaccagaauggagaacagccugcccgccaaggugcccagcagaggcgacgagaugguggccgacgugcagcagccccugagccagauccccagcgacaccgccagcccccugcugauccugcccccccccgugcccaaccccagccccacccugagacccguggagacccccguggugggcgcccccggcaugggcagcgugagcaccgagcccgacgacgaggagggccugaagcaccuggagcagcaggccgagaagaugguggccuaccugcaggacagcgcccuggacgacgagagacuggccagcaagcugcaggagcacagagccaagggcgugagcaucccccugaugcacgaggccaugcagaagugguacuacaaggacccccagggcgagauccagggccccuucaacaaccaggagauggccgagugguuccaggccggcuacuucaccaugagccugcuggugaagagagccugcgacgagagcuuccagccccugggcgacaucaugaagauguggggcagagugcccuucagccccggccccgccccccccccccacaugggcgagcuggaccaggagagacugaccagacagcaggagcugaccgcccuguaccagaugcagcaccugcaguaccagcaguuccugauccagcagcaguacgcccaggugcuggcccagcagcagaaggccgcccugagcagccagcagcagcagcagcuggcccugcugcugcagcaguuccagacccugaagaugagaaucagcgaccagaacaucauccccagcgugaccagaagcgugagcgugcccgacaccggcagcaucugggagcugcagcccaccgccagccagcccaccgugugggagggcggcagcgugugggaccugccccuggacaccaccacccccggccccgcccuggagcagcugcagcagcuggagaaggccaaggccgccaagcuggagcaggagagaagagaggccgagaugagagccaagagagaggaggaggagagaaagagacaggaggagcugagaagacagcaggaggagauccugagaagacagcaggaggaggagagaaagagaagagaggaggaggagcuggccagaagaaagcaggaggaggcccugagaagacagagagagcaggagaucgcccugagaagacagagagaggaggaggagagacagcagcaggaggaggcccugagaagacuggaggagagaagaagagaggaggaggagagaagaaagcaggaggagcugcugagaaagcaggaggaggaggccgccaagugggccagagaggaggaggaggcccagagaagacuggaggagaacagacugagaauggaggaggaggccgccagacugagacacgaggaggaggagagaaagagaaaggagcuggaggugcagagacagaaggagcugaugagacagagacagcagcagcaggaggcccugagaagacugcagcagcagcagcagcagcagcagcuggcccagaugaagcugcccagcagcagcaccuggggccagcagagcaacaccaccgccugccagagccaggccacccugagccuggccgagauccagaagcuggaggaggagagagagagacagcugagagaggagcagagaagacagcagagagagcugaugaaggcccugcagcagcagcagcagcagcagcagcagaagcugagcggcuggggcaacgugagcaagcccagcggcaccaccaagagccugcuggagauccagcaggaggaggccagacagaugcagaagcagcagcagcagcagcagcagcaccagcagcccaacagagccagaaacaacacccacagcaaccugcacaccagcaucggcaacagcguguggggcagcaucaacaccggcccccccaaccagugggccagcgaccuggugagcagcaucuggagcaacgccgacaccaagaacagcaacaugggcuucugggacgacgccgugaaggaggugggccccagaaacagcaccaacaagaacaagaacaacgccagccugagcaagagcgugggcgugagcaacagacagaacaagaagguggaggaggaggagaagcugcugaagcuguuccagggcgugaacaaggcccaggacggcuucacccaguggugcgagcagaugcugcacgcccugaacaccgccaacaaccuggacgugcccaccuucgugagcuuccugaaggagguggagagccccuacgaggugcacgacuacaucagagccuaccugggcgacaccagcgaggccaaggaguucgccaagcaguuccuggagagaagagccaagcagaaggccaaccagcagagacagcagcagcagcugccccagcagcagcagcagcagcccccccagcagcccccccagcagccccagcagcaggacagcguguggggcaugaaccacagcacccugcacagcguguuccagaccaaccagagcaacaaccagcagagcaacuucgaggccgugcagagcggcaagaagaagaagaagcagaagauggugagagccgaccccagccugcugggcuucagcgugaacgccagcagcgagagacugaacaugggcgagaucgagacccuggacgacuacuaa

SEQ ID NO: 17509 - RNA, 924 nt, Artificial Sequence
  GIMAP5__Homo_sapiens__NP_060854
augggcggcuuccagagaggcaaguacggcaccauggccgagggcagaagcgaggacaaccugagcgccaccccccccgcccugagaaucauccuggugggcaagaccggcugcggcaagagcgccaccggcaacagcauccugggccagcccguguucgagagcaagcugagagcccagagcgugaccagaaccugccaggugaagaccggcaccuggaacggcagaaaggugcuggugguggacacccccagcaucuucgagagccaggccgacacccaggagcuguacaagaacaucggcgacugcuaccugcugagcgcccccggcccccacgugcugcugcuggugauccagcugggcagauucaccgcccaggacaccguggccaucagaaaggugaaggagguguucggcaccggcgccaugagacacguggugauccuguucacccacaaggaggaccugggcggccaggcccuggacgacuacguggccaacaccgacaacugcagccugaaggaccuggugagagagugcgagagaagauacugcgccuucaacaacuggggcagcguggaggagcagagacagcagcaggccgagcugcuggccgugaucgagagacugggcagagagagagagggcagcuuccacagcaacgaccuguuccuggacgcccagcugcugcagagaaccggcgccggcgccugccaggaggacuacagacaguaccaggccaagguggaguggcagguggagaagcacaagcaggagcugagagagaacgagagcaacugggccuacaaggcccugcugagagugaagcaccugaugcugcugcacuacgagaucuucguguuccugcugcugugcagcauccuguucuucaucaucuuccuguucaucuuccacuacaucuaa

SEQ ID NO: 17510 - RNA, 903 nt, Artificial Sequence
  GIMAP7__Homo_sapiens__NP_694968
auggccgagagcgaggacagaagccugagaaucgugcuggugggcaagaccggcagcggcaagagcgccaccgccaacaccauccugggcgaggagaucuucgacagcagaaucgccgcccaggccgugaccaagaacugccagaaggccagcagagaguggcagggcagagaccugcuggugguggacacccccggccuguucgacaccaaggagagccuggacaccaccugcaaggagaucagcagaugcaucaucagcagcugccccggcccccacgccaucgugcuggugcugcugcugggcagauacaccgaggaggagcagaagaccguggcccugaucaaggccguguucggcaagagcgccaugaagcacauggugauccuguucaccagaaaggaggagcuggagggccagagcuuccacgacuucaucgccgacgccgacgugggccugaagagcaucgugaaggagugcggcaacagaugcugcgccuucagcaacagcaagaagaccagcaaggccgagaaggagagccaggugcaggagcugguggagcugaucgagaagauggugcagugcaacgagggcgccuacuucagcgacgacaucuacaaggacaccgaggagagacugaagcagagagaggaggugcugagaaagaucuacaccgaccagcugaacgaggagaucaagcugguggaggaggacaagcacaagagcgaggaggagaaggagaaggagaucaagcugcugaagcugaaguacgacgagaagaucaagaacaucagagaggaggccgagagaaacaucuucaaggacguguucaacagaaucuggaagaugcugagcgagaucuggcacagauuccugagcaagugcaaguucuacagcagcuaa

SEQ ID NO: 17511 - RNA, 1998 nt, Artificial Sequence
  GIMAP8__Homo_sapiens__XP_005250007
augagcgagcagagcugccagaugagcgagcugagacugcugcugcugggcaagugcagaagcggcaagagcgccaccggcaacgccauccugggcaagcacguguucaagagcaaguucagcgaccagaccgugaucaagaugugccagagagagagcugggugcugagagagagaaaggugguggugaucgacacccccgaccuguucagcagcaucgccugcgccgaggacaagcagagaaacauccagcacugccuggagcugagcgcccccagccugcacgcccugcugcuggugaucgccaucggccacuucaccagagaggacgaggagaccgccaagggcauccagcagguguucggcgccgaggccagaagacacaucaucaucguguucaccagaaaggacgaccugggcgacgaccugcugcaggacuucaucgagaagaacaagccccugaagcagcuggugcaggacuacgagggcagauacugcaucuucaacaacaagaccaacagcaaggacgagcagaucacccaggugcuggagcugcugagaaagguggagagccuggugaacaccaacggcggccccuaccacgugaacuucaagaccgagggcagcagauuccaggacugcgugaacgaggccgccagccaggagggcgacaagccccagggccccagagagagacagcugcagagcaccggccccgagcagaaccccggcaccagcgagcugaccgugcugcuggugggcaagagaggcgccggcaagagcgccgccggcaacagcauccugggcagacaggccuuccagaccggcuucagcgagcagagcgugacccagagcuuccugagcgagagcagaagcuggagaaagaagaaggugagcaucaucgacgcccccgacaucagcagccugaagaacaucgacagcgaggugagaaagcacaucugcaccggcccccacgccuuccugcuggugaccccccugggcuucuacaccaagaacgacgaggccgugcugagcaccauccagaacaacuucggcgagaaguucuucgaguacaugaucauccugcugaccagaaaggaggaccugggcgaccaggaccuggacaccuuccugagaaacagcaacaaggcccuguacggccugauccagaagugcaagaacagauacagcgccuucaacuacagagccaccggcgaggaggagcagagacaggccgacgagcugcuggagaagaucgagagcauggugcaccagaacggcaacaagcacugcguguucagagagaaggagacccugaacaucgugcuggugggcagaagcggcaccggcaagagcgccaccggcaacagcauccugggcagccugguguucaccagcagacugagagcccagcccgugaccaagaccagccagagcggcagaagaaccugggacggccaggaggugguggugguggacacccccagcuucaaccagaugcuggacguggagaaggaccccagcagacuggaggaggaggugaagagaugccugagcugcugcgagaagggcgacaccuucuucgugcugguguuccagcugggcagauucaccgaggaggacaagaccgccguggccaagcuggaggccaucuucggcgccgacuucaccaaguacgccaucaugcuguucaccagaaaggaggaccugggcgccggcaaccuggaggacuucaugaagaacagcgacaacaaggcccugagaagaaucuucaagaagugcggcagaagagugugcgccuucaacaacaaggagaccggccaggcccaggagacccaggugaaggcccugcugaccaaggugaacgaccugagaaaggagagcggcuggagcggcuacccccacacccaggagaacgugagcaagcugaucaagaacgugcaggagaugagccaggccgagaagcugcugaagaaccugaucggcauccugcaguaa

SEQ ID NO: 17512 - RNA, 1569 nt, Artificial Sequence
  GIN1__Homo_sapiens__NP_060146
auggugagaagcggcaagaacggcgaccugcaccugaagcagaucgccuacuacaagagaaccggcgaguaccacagcaccacccugcccagcgagagaagcggcaucagaagagccgccaagaaguucguguucaaggagaagaagcuguucuacgugggcaaggacagaaagcagaacagacuggugaucgugagcgaggaggagaagaagaaggugcugagagagugccacgagaacgacagcggcgcccaccacggcaucagcagaacccugacccugguggagagcaacuacuacuggaccagcgugaccaacgacgugaagcaguggguguacgccugccagcacugccagguggccaagaacaccgugaucguggcccccaagcagcaccugcugaagguggagaaccccuggagccuggugaccguggaccugaugggccccuuccacaccagcaacagaagccacguguacgccaucaucaugaccgaccuguucaccaaguggaucgugauccugccccugugcgacgugagcgccagcgaggugagcaaggccaucaucaacaucuucuuccuguacggccccccccagaagaucaucauggaccagagagacgaguucauccagcagaucaacaucgagcuguacagacuguucggcaucaagcagaucgugaucagccacaccagcggcaccgugaaccccaccgagagcacccccaacaccaucaaggccuuccugagcaagcacugcgccgaccaccccaacaacugggacgaccaccugagcgccgugagcuucgccuucaacgugacccaccuggagcccaccaagaacacccccuacuuccagauguucagcagaaaccccuacaugcccgagaccagcgacagccugcacgagguggacggcgacaacaccagcauguucgccaagauccuggacgccaucaaggaggccgacaagaucauggagaacaagaccaccagccugggccagauggagaacaacaaccuggacgagcugaacaagagcaagaucaucgugaagaagaagcccaagcagcugaaccccuuccaccugaaggugggccacgaggugcugagacagagaaagaacugguggaaggacggcagauuccagagcgagugggugggccccugcgugaucgacuacaucaccgagagcggcugcgccgugcugagagacaacaccggcgugagacugaagagacccaucaagaugagccaccugaagcccuacaucagagagagcagcgagcaggagagccuguaccugcugcagggcagcgugguggccgaccacgacuacaucggccugcccgagauccccaucggcgccuaccaggccaacauccugguggaggacgccaccaucggcaucguggacaacgagcugcugaccagcagcaaggacagagagcugcuggaguacagaaacaccaagaucagcccccugaucgacgaccacagcagccuggagaagcagaccuucagccugcuggacagcagcaaccaggugcuggaguaccugagcuaa

SEQ ID NO: 17513 - RNA, 591 nt, Artificial Sequence
  GINS1__Homo_sapiens__NP_066545
auguucugcgagaaggccauggagcugaucagagagcugcacagagcccccgagggccagcugcccgccuucaacgaggacggccugagacaggugcuggaggagaugaaggcccuguacgagcagaaccagagcgacgugaacgaggccaagagcggcggcagaagcgaccugauccccaccaucaaguucagacacugcagccugcugagaaacagaagaugcaccguggccuaccuguacgacagacugcugagaaucagagcccugagaugggaguacggcagcgugcugcccaacgcccugagauuccacauggccgccgaggagauggagugguucaacaacuacaagagaagccuggccaccuacaugagaagccugggcggcgacgagggccuggacaucacccaggacaugaagccccccaagagccuguacaucgaggugagaugccugaaggacuacggcgaguucgagguggacgacggcaccagcgugcugcugaagaagaacagccagcacuuccugcccagauggaagugcgagcagcugaucagacagggcgugcuggagcacauccugagcuaa

SEQ ID NO: 17514 - RNA, 558 nt, Artificial Sequence
  GINS2__Homo_sapiens__NP_057179
auggacgccgccgagguggaguuccuggccgagaaggagcuggugaccaucauccccaacuucagccuggacaagaucuaccugaucggcggcgaccugggccccuucaaccccggccugcccguggaggugccccuguggcuggccaucaaccugaagcagagacagaagugcagacugcugccccccgaguggauggacguggagaagcuggagaagaugagagaccacgagagaaaggaggagaccuucacccccaugcccagccccuacuacauggagcugaccaagcugcugcugaaccacgccagcgacaacauccccaaggccgacgagaucagaacccuggugaaggacaugugggacaccagaaucgccaagcugagagugagcgccgacagcuucgugagacagcaggaggcccacgccaagcuggacaaccugacccugauggagaucaacaccagcggcaccuuccugacccaggcccugaaccacauguacaagcugagaaccaaccugcagccccuggagagcacccagagccaggacuucuaa

SEQ ID NO: 17515 - RNA, 1002 nt, Artificial Sequence
  GIPC1__Homo_sapiens__NP_005707
augccccugggccugggcagaagaaagaaggcccccccccugguggagaacgaggaggccgagcccggcagaggcggccugggcgugggcgagcccggcccccugggcggcggcggcagcggcggcccccagaugggccugcccccccccccccccgcccugagacccagacugguguuccacacccagcuggcccacggcagccccaccggcagaaucgagggcuucaccaacgugaaggagcuguacggcaagaucgccgaggccuucagacugcccaccgccgaggugauguucugcacccugaacacccacaagguggacauggacaagcugcugggcggccagaucggccuggaggacuucaucuucgcccacgugaagggccagagaaaggagguggagguguucaagagcgaggacgcccugggccugaccaucaccgacaacggcgccggcuacgccuucaucaagagaaucaaggagggcagcgugaucgaccacauccaccugaucagcgugggcgacaugaucgaggccaucaacggccagagccugcugggcugcagacacuacgagguggccagacugcugaaggagcugcccagaggcagaaccuucacccugaagcugaccgagcccagaaaggccuucgacaugaucagccagagaagcgccggcggcagacccggcagcggcccccagcugggcaccggcagaggcacccugagacugagaagcagaggccccgccaccguggaggaccugcccagcgccuucgaggagaaggccaucgagaagguggacgaccugcuggagagcuacaugggcaucagagacaccgagcuggccgccaccaugguggagcugggcaaggacaagagaaaccccgacgagcuggccgaggcccuggacgagagacugggcgacuucgccuuccccgacgaguucguguucgacguguggggcgccaucggcgacgccaaggugggcagauacuaa

SEQ ID NO: 17516 - RNA, 939 nt, Artificial Sequence
  GIPC3__Homo_sapiens__NP_573568
auggagggcgccgccgccagagaggccagaggcaccgagacccccagagccagcgcccccccccccgcccccagcgagccccccgccgcccccagagccagacccagacugguguucagaacccagcuggcccacggcagccccaccggcaagaucgagggcuucaccaacgugagagagcuguacgccaagaucgccgaggccuucggcaucgcccccaccgagauccuguucugcacccugaacagccacaagguggacaugcagaagcugcugggcggccagaucggccuggaggacuucaucuucgcccacgugagaggcgagaccaaggagguggaggugaccaagaccgaggacgcccugggccugaccaucaccgacaacggcgccggcuacgccuucaucaagagaaucaaggagggcagcaucaucaacagaaucgaggccgugugcgugggcgacagcaucgaggccaucaacgaccacagcaucgugggcugcagacacuacgagguggccaagaugcugagagagcugcccaagagccagcccuucacccugagacuggugcagcccaagagagccuucgacaugaucggccagagaagcagaagcagcaagugccccguggaggccaaggugaccagcggcagagagacccugagacugagaagcggcggcgccgccaccguggaggaggcccccagcgaguucgaggaggaggccagcagaaagguggacgaccugcuggagagcuacaugggcaucagagaccccgagcuggccagcaccaugguggagaccagcaagaagaccgccagcgcccaggaguucgccagaugccuggacagcgugcugggcgaguucgccuuccccgacgaguucgugguggaggugugggccgccaucggcgaggccagagaggccugcggcuaa

SEQ ID NO: 17517 - RNA, 462 nt, Artificial Sequence
  GIP__Homo_sapiens__NP_004114
augguggccaccaagaccuucgcccugcugcugcugagccuguuccuggccgugggccugggcgagaagaaggagggccacuucagcgcccugcccagccugcccgugggcagccacgccaaggugagcagcccccagcccagaggccccagauacgccgagggcaccuucaucagcgacuacagcaucgccauggacaagauccaccagcaggacuucgugaacuggcugcuggcccagaagggcaagaagaacgacuggaagcacaacaucacccagagagaggccagagcccuggagcuggccagccaggccaacagaaaggaggaggaggccguggagccccagagcagccccgccaagaaccccagcgacgaggaccugcugagagaccugcugauccaggagcugcuggccugccugcuggaccagaccaaccugugcagacugagaagcagauaa

SEQ ID NO: 17518 - RNA, 1401 nt, Artificial Sequence
  GIPR__Homo_sapiens__NP_000155
augaccaccagccccauccugcagcugcugcugagacugagccugugcggccugcugcugcagagagccgagaccggcagcaagggccagaccgccggcgagcuguaccagagaugggagagauacagaagagagugccaggagacccuggccgccgccgagccccccagcggccuggccugcaacggcagcuucgacauguacgugugcugggacuacgccgcccccaacgccaccgccagagccagcugccccugguaccugcccuggcaccaccacguggccgccggcuucgugcugagacagugcggcagcgacggccaguggggccuguggagagaccacacccagugcgagaaccccgagaagaacgaggccuuccuggaccagagacugauccuggagagacugcaggugauguacaccgugggcuacagccugagccuggccacccugcugcuggcccugcugauccugagccuguucagaagacugcacugcaccagaaacuacauccacaucaaccuguucaccagcuucaugcugagagccgccgccauccugagcagagacagacugcugcccagacccggccccuaccugggcgaccaggcccuggcccuguggaaccaggcccuggccgccugcagaaccgcccagaucgugacccaguacugcgugggcgccaacuacaccuggcugcugguggagggcguguaccugcacagccugcuggugcuggugggcggcagcgaggagggccacuucagauacuaccugcugcugggcuggggcgcccccgcccuguucgugauccccugggugaucgugagauaccuguacgagaacacccagugcugggagagaaacgaggugaaggccaucugguggaucaucagaacccccauccugaugaccauccugaucaacuuccugaucuucaucagaauccugggcauccugcugagcaagcugagaaccagacagaugagaugcagagacuacagacugagacuggccagaagcacccugacccuggugccccugcugggcgugcacgaggugguguucgcccccgugaccgaggagcaggccagaggcgcccugagauucgccaagcugggcuucgagaucuuccugagcagcuuccagggcuuccuggugagcgugcuguacugcuucaucaacaaggaggugcagagcgagaucagaagaggcuggcaccacugcagacugagaagaagccugggcgaggagcagagacagcugcccgagagagccuucagagcccugcccagcggcagcggccccggcgaggugcccaccagcagaggccugagcagcggcacccugcccggccccggcaacgaggccagcagagagcuggagagcuacugcuaa

SEQ ID NO: 17519 - RNA, 2313 nt, Artificial Sequence
  GIT1__Homo_sapiens__NP_001078923
augagcagaaagggccccagagccgaggugugcgccgacugcagcgcccccgaccccggcugggccagcaucagcagaggcgugcuggugugcgacgagugcugcagcgugcacagaagccugggcagacacaucagcaucgugaagcaccugagacacagcgccuggccccccacccugcugcagauggugcacacccuggccagcaacggcgccaacagcaucugggagcacagccugcuggaccccgcccaggugcagagcggcagaagaaaggccaacccccaggacaaggugcaccccaucaagagcgaguucaucagagccaaguaccagaugcuggccuucgugcacaagcugcccugcagagacgacgacggcgugaccgccaaggaccugagcaagcagcugcacagcagcgugagaaccggcaaccuggagaccugccugagacugcugagccugggcgcccaggccaacuucuuccaccccgagaagggcaccaccccccugcacguggccgccaaggccggccagacccugcaggccgagcugcuggugguguacggcgccgaccccggcagccccgacgugaacggcagaacccccaucgacuacgccagacaggccggccaccacgagcuggccgagagacugguggagugccaguacgagcugaccgacagacuggccuucuaccugugcggcagaaagcccgaccacaagaacggccacuacaucaucccccagauggccgacagaagcagacagaagugcaugagccagagccuggaccugagcgagcuggccaaggccgccaagaagaagcugcaggcccugagcaacagacuguucgaggagcuggccauggacguguacgacgagguggacagaagagagaacgacgccguguggcuggccacccagaaccacagcacccuggugaccgagagaagcgccgugcccuuccugcccgugaaccccgaguacagcgccaccagaaaccagggcagacagaagcuggccagauucaacgccagagaguucgccacccugaucaucgacauccugagcgaggccaagagaagacagcagggcaagagccugagcagccccaccgacaaccuggagcugagccugagaagccagagcgaccuggacgaccagcacgacuacgacagcguggccagcgacgaggacaccgaccaggagccccugagaagcaccggcgccaccagaagcaacagagccagaagcauggacagcagcgaccugagcgacggcgccgugacccugcaggaguaccuggagcugaagaaggcccuggccaccagcgaggccaaggugcagcagcugaugaaggugaacagcagccugagcgacgagcugagaagacugcagagagagauccacaagcugcaggccgagaaccugcagcugagacagccccccggccccgugcccacccccccccugcccagcgagagagccgagcacacccccauggcccccggcggcagcacccacagaagagacagacaggccuucagcauguacgagcccggcagcgcccugaagcccuucggcggcccccccggcgacgagcugaccaccagacugcagcccuuccacagcaccgagcuggaggacgacgccaucuacagcgugcacgugcccgccggccuguacagaaucagaaagggcgugagcgccagcgccgugcccuucacccccagcagcccccugcugagcugcagccaggagggcagcagacacaccagcaagcugagcagacacggcagcggcgccgacagcgacuacgagaacacccagagcggcgacccccugcugggccuggagggcaagagauuccuggagcugggcaaggaggaggacuuccaccccgagcuggagagccuggacggcgaccuggaccccggccugcccagcaccgaggacgugauccugaagaccgagcaggugaccaagaacauccaggagcugcugagagccgcccaggaguucaagcacgacagcuucgugcccugcagcgagaagauccaccuggccgugaccgagauggccagccuguuccccaagagacccgcccuggagcccgugagaagcagccugagacugcugaacgccagcgccuacagacugcagagcgagugcagaaagaccgugccccccgagcccggcgcccccguggacuuccagcugcugacccagcaggugauccagugcgccuacgacaucgccaaggccgccaagcagcuggugaccaucaccaccagagagaagaagcaguaa

SEQ ID NO: 17520 - RNA, 2046 nt, Artificial Sequence
  GIT2__Homo_sapiens__NP_001128685
augagcaagagacugagaagcagcgaggugugcgccgacugcagcggccccgaccccagcugggccagcgugaacagaggcaccuuccugugcgacgagugcugcagcgugcacagaagccugggcagacacaucagccaggugagacaccugaagcacacccccuggccccccacccugcugcagaugguggagacccuguacaacaacggcgccaacagcaucugggagcacagccugcuggaccccgccagcaucaugagcggcagaagaaaggccaacccccaggacaaggugcaccccaacaaggccgaguucaucagagccaaguaccagaugcuggccuucgugcacagacugcccugcagagacgacgacagcgugaccgccaaggaccugagcaagcagcugcacagcagcgugagaaccggcaaccuggagaccugccugagacugcugagccugggcgcccaggccaacuucuuccaccccgagaagggcaacaccccccugcacguggccagcaaggccggccagauccugcaggccgagcugcuggccguguacggcgccgaccccggcacccaggacagcagcggcaagacccccguggacuacgccagacagggcggccaccacgagcuggccgagagacugguggagauccaguacgagcugaccgacagacuggccuucuaccugugcggcagaaagcccgaccacaagaacggccagcacuucaucaucccccagauggccgacagaagacugagccuggaccugagcgagcuggccaaggccgccaagaagaagcugcagagccugagcaaccaccuguucgaggagcuggccauggacguguacgacgagguggacagaagagagaccgacgccguguggcuggccacccagaaccacagcgcccuggugaccgagaccaccguggugcccuuccugcccgugaaccccgaguacagcagcaccagaaaccagggcagacagaagcuggccagauucaacgcccacgaguucgccacccuggugaucgacauccugagcgacgccaagagaagacagcagggcagcagccugagcggcagcaaggacaacguggagcugauccugaagaccaucaacaaccagcacagcguggagagccaggacaacgaccagcccgacuacgacagcguggccagcgacgaggacaccgaccuggagaccaccgccagcaagaccaacagacagaagcugcagacccugcagagcgagaacagcaaccugagaaagcaggccaccaccaacguguaccaggugcagaccggcagcgaguacaccgacaccagcaaccacagcagccugaagagaagacccagcgccagaggcagcagacccaugagcauguacgagaccggcagcggccagaagcccuaccugcccaugggcgaggccagcagacccgaggagagcagaaugagacugcagcccuuccccgcccacgccagcagacuggagaagcagaacagcacccccgagagcgacuacgacaacacccccaacgacauggagcccgacggcaugggcagcagcagaaagggcagacagagaagcaugguguggcccggcgacggccuggugcccgacaccgccgagccccacguggcccccagccccacccugcccagcaccgaggacgugaucagaaagaccgagcagaucaccaagaacauccaggagcugcugagagccgcccaggagaacaagcacgacagcuacauccccugcagcgagagaauccacguggccgugaccgagauggccgcccuguuccccaagaagcccaagagcgacauggugagaaccagccugagacugcugaccagcagcgccuacagacugcagagcgagugcaagaagacccugcccggcgaccccggcagccccaccgacgugcagcuggugacccagcaggugauccagugcgccuacgacaucgccaaggccgccaagcagcuggugaccaucaccaccaaggagaacaacaacuaa

SEQ ID NO: 17521 - RNA, 1149 nt, Artificial Sequence
  GJA1__Homo_sapiens__NP_000156
augggcgacuggagcgcccugggcaagcugcuggacaaggugcaggccuacagcaccgccggcggcaagguguggcugagcgugcuguucaucuucagaauccugcugcugggcaccgccguggagagcgccuggggcgacgagcagagcgccuucagaugcaacacccagcagcccggcugcgagaacgugugcuacgacaagagcuuccccaucagccacgugagauucugggugcugcagaucaucuucgugagcgugcccacccugcuguaccuggcccacguguucuacgugaugagaaaggaggagaagcugaacaagaaggaggaggagcugaagguggcccagaccgacggcgugaacguggacaugcaccugaagcagaucgagaucaagaaguucaaguacggcaucgaggagcacggcaaggugaagaugagaggcggccugcugagaaccuacaucaucagcauccuguucaagagcaucuucgagguggccuuccugcugauccagugguacaucuacggcuucagccugagcgccguguacaccugcaagagagaccccugcccccaccagguggacugcuuccugagcagacccaccgagaagaccaucuucaucaucuucaugcugguggugagccuggugagccuggcccugaacaucaucgagcuguucuacguguucuucaagggcgugaaggacagagugaagggcaagagcgaccccuaccacgccaccagcggcgcccugagccccgccaaggacugcggcagccagaaguacgccuacuucaacggcugcagcagccccaccgccccccugagccccaugagcccccccggcuacaagcuggugaccggcgacagaaacaacagcagcugcagaaacuacaacaagcaggccagcgagcagaacugggccaacuacagcgccgagcagaacagaaugggccaggccggcagcaccaucagcaacagccacgcccagcccuucgacuuccccgacgacaaccagaacagcaagaagcuggccgccggccacgagcugcagccccuggccaucguggaccagagacccagcagcagagccagcagcagagccagcagcagacccagacccgacgaccuggagaucuaa

SEQ ID NO: 17522 - RNA, 1308 nt, Artificial Sequence
  GJA3__Homo_sapiens__NP_068773
augggcgacuggagcuuccugggcagacugcuggagaacgcccaggagcacagcaccgugaucggcaagguguggcugaccgugcuguucaucuucagaauccuggugcugggcgccgccgccgaggacguguggggcgacgagcagagcgacuucaccugcaacacccagcagcccggcugcgagaacgugugcuacgacagagccuuccccaucagccacaucagauucugggcccugcagaucaucuucgugagcacccccacccugaucuaccugggccacgugcugcacaucgugagaauggaggagaagaagaaggagagagaggaggaggagcagcugaagagagagagccccagccccaaggagcccccccaggacaaccccagcagcagagacgacagaggcagagugagaauggccggcgcccugcugagaaccuacguguucaacaucaucuucaagacccuguucgaggugggcuucaucgccggccaguacuuccuguacggcuucgagcugaagccccuguacagaugcgacagauggcccugccccaacaccguggacugcuucaucagcagacccaccgagaagaccaucuucaucaucuucaugcuggccguggccugcgccagccugcugcugaacaugcuggagaucuaccaccugggcuggaagaagcugaagcagggcgugaccagcagacugggccccgacgccagcgaggccccccugggcaccgccgacccccccccccugccccccagcagcagaccccccgccguggccaucggcuucccccccuacuacgcccacaccgccgccccccugggccaggccagagccgugggcuaccccggcgcccccccccccgccgccgacuucaagcugcuggcccugaccgaggccagaggcaagggccagagcgccaagcuguacaacggccaccaccaccugcugaugaccgagcagaacugggccaaccaggccgccgagagacagccccccgcccugaaggccuaccccgccgccagcacccccgccgcccccagccccgugggcagcagcagccccccccuggcccacgaggccgaggccggcgccgccccccugcugcuggacggcagcggcagcagccuggagggcagcgcccuggccggcacccccgaggaggaggagcaggccgugaccaccgccgcccagaugcaccagcccccccugccccugggcgaccccggcagagccagcaaggccagcagagccagcagcggcagagccagacccgaggaccuggccaucuaa

SEQ ID NO: 17523 - RNA, 1284 nt, Artificial Sequence
  GJA8__Homo_sapiens__XP_011507719
augggcgacuggagcuuccugggcaacauccuggaggaggugaacgagcacagcaccgugaucggcagaguguggcugaccgugcuguucaucuucagaauccugauccugggcaccgccgccgaguucguguggggcgacgagcagagcgacuucgugugcaacacccagcagcccggcugcgagaacgugugcuacgacgaggccuuccccaucagccacaucagacugugggugcugcagaucaucuucgugagcacccccagccugauguacgugggccacgccgugcacuacgugagaauggaggagaagagaaagagcagagaggccgaggagcugggccagcaggccggcaccaacggcggccccgaccagggcagcgugaagaagagcagcggcagcaagggcaccaagaaguucagacuggagggcacccugcugagaaccuacaucugccacaucaucuucaagacccuguucgaggugggcuucaucgugggccacuacuuccuguacggcuucagaauccugccccuguacagaugcagcagauggcccugccccaacgugguggacugcuucgugagcagacccaccgagaagaccaucuucauccuguucaugcugagcguggccagcgugagccuguuccugaacgugauggagcugggccaccugggccugaagggcaucagaagcgcccugaagagacccguggagcagccccugggcgagauccccgagaagagccugcacagcaucgccgugagcagcauccagaaggccaagggcuaccagcugcuggaggaggagaagaucgugagccacuacuucccccugaccgaggugggcaugguggagaccagcccccugcccgccaagcccuucaaccaguucgaggagaagaucagcaccggcccccugggcgaccugagcagaggcuaccaggagacccugcccagcuacgcccaggugggcgcccaggagguggagggcgagggcccccccgccgaggagggcgccgagcccgaggugggcgagaagaaggaggaggccgagagacugaccaccgaggagcaggagaagguggccgugcccgagggcgagaagguggagacccccggcguggacaaggagggcgagaaggaggagccccagagcgagaaggugagcaagcagggccugcccgccgagaagacccccagccugugccccgagcugaccaccgacgacgccagaccccugagcagacugagcaaggccagcagcagagccagauaa

SEQ ID NO: 17524 - RNA, 852 nt, Artificial Sequence
  GJB1__Homo_sapiens__NP_000157
augaacuggaccggccuguacacccugcugagcggcgugaacagacacagcaccgccaucggcagaguguggcugagcgugaucuucaucuucagaaucauggugcuggugguggccgccgagagcguguggggcgacgagaagagcagcuucaucugcaacacccugcagcccggcugcaacagcgugugcuacgaccaguucuuccccaucagccacgugagacuguggagccugcagcugauccuggugagcacccccgcccugcugguggccaugcacguggcccaccagcagcacaucgagaagaagaugcugagacuggagggccacggcgacccccugcaccuggaggaggugaagagacacaaggugcacaucagcggcacccugugguggaccuacgugaucagcgugguguucagacugcuguucgaggccguguucauguacguguucuaccugcuguaccccggcuacgccauggugagacuggugaagugcgacguguaccccugccccaacaccguggacugcuucgugagcagacccaccgagaagaccguguucaccguguucaugcuggccgccagcggcaucugcaucauccugaacguggccgaggugguguaccugaucaucagagccugcgccagaagagcccagagaagaagcaacccccccagcagaaagggcagcggcuucggccacagacugagccccgaguacaagcagaacgagaucaacaagcugcugagcgagcaggacggcagccugaaggacauccugagaagaagccccggcaccggcgccggccuggccgagaagagcgacagaugcagcgccugcuaa

SEQ ID NO: 17525 - RNA, 681 nt, Artificial Sequence
  GJB2__Homo_sapiens__NP_003995
auggacuggggcacccugcagaccauccugggcggcgugaacaagcacagcaccagcaucggcaagaucuggcugaccgugcuguucaucuucagaaucaugauccuggugguggccgccaaggagguguggggcgacgagcaggccgacuucgugugcaacacccugcagcccggcugcaagaacgugugcuacgaccacuacuuccccaucagccacaucagacugugggcccugcagcugaucuucgugagcacccccgcccugcugguggccaugcacguggccuacagaagacacgagaagaagagaaaguucaucaagggcgagaucaagagcgaguucaaggacaucgaggagaucaagacccagaaggugagaaucgagggcagccugugguggaccuacaccagcagcaucuucuucagagugaucuucgaggccgccuucauguacguguucuacgugauguacgacggcuucagcaugcagagacuggugaagugcaacgccuggcccugccccaacaccguggacugcuucgugagcagacccaccgagaagaccguguucaccguguucaugaucgccgugagcggcaucugcauccugcugaacgugaccgagcugugcuaccugcugaucagauacugcagcggcaagagcaagaagcccguguaa

SEQ ID NO: 17526 - RNA, 786 nt, Artificial Sequence
  GJB6__Homo_sapiens__NP_001103691
auggacuggggcacccugcacaccuucaucggcggcgugaacaagcacagcaccagcaucggcaagguguggaucaccgugaucuucaucuucagagugaugauccuggugguggccgcccaggagguguggggcgacgagcaggaggacuucgugugcaacacccugcagcccggcugcaagaacgugugcuacgaccacuucuuccccgugagccacaucagacugugggcccugcagcugaucuucgugagcacccccgcccugcugguggccaugcacguggccuacuacagacacgagaccaccagaaaguucagaagaggcgagaagagaaacgacuucaaggacaucgaggacaucaagaagcagaaggugagaaucgagggcagccugugguggaccuacaccagcagcaucuucuucagaaucaucuucgaggccgccuucauguacguguucuacuuccuguacaacggcuaccaccugcccugggugcugaagugcggcaucgaccccugccccaaccugguggacugcuucaucagcagacccaccgagaagaccguguucaccaucuucaugaucagcgccagcgugaucugcaugcugcugaacguggccgagcugugcuaccugcugcugaaggugugcuucagaagaagcaagagagcccagacccagaagaaccaccccaaccacgcccugaaggagagcaagcagaacgagaugaacgagcugaucagcgacagcggccagaacgccaucaccggcuuccccagcuaa

SEQ ID NO: 17527 - RNA, 1191 nt, Artificial Sequence
  GJC1__Homo_sapiens__NP_001073852
augagcuggagcuuccugaccagacugcuggaggagauccacaaccacagcaccuucgugggcaagaucuggcugaccgugcugaucguguucagaaucgugcugaccgccgugggcggcgagagcaucuacuacgacgagcagagcaaguucgugugcaacaccgagcagcccggcugcgagaacgugugcuacgacgccuucgccccccugagccacgugagauucuggguguuccagaucauccugguggccacccccagcgugauguaccugggcuacgccauccacaagaucgccaagauggagcacggcgaggccgacaagaaggccgccagaagcaagcccuacgccaugagauggaagcagcacagagcccuggaggagaccgaggaggacaacgaggaggaccccaugauguaccccgagauggagcuggagagcgacaaggagaacaaggagcagagccagcccaagcccaagcacgacggcagaagaagaaucagagaggacggccugaugaagaucuacgugcugcagcugcuggccagaaccguguucgaggugggcuuccugaucggccaguacuuccuguacggcuuccaggugcaccccuucuacgugugcagcagacugcccugcccccacaagaucgacugcuucaucagcagacccaccgagaagaccaucuuccugcugaucauguacggcgugaccggccugugccugcugcugaacaucugggagaugcugcaccugggcuucggcaccaucagagacagccugaacagcaagagaagagagcuggaggaccccggcgccuacaacuaccccuucaccuggaacacccccagcgccccccccggcuacaacaucgccgugaagcccgaccagauccaguacaccgagcugagcaacgccaagaucgccuacaagcagaacaaggccaacaccgcccaggagcagcaguacggcagccacgaggagaaccugcccgccgaccuggaggcccugcagagagagaucagaauggcccaggagagacuggaccuggccgugcaggccuacagccaccagaacaacccccacggccccagagagaagaaggccaaggugggcagcaaggccggcagcaacaagagcaccgccagcagcaagagcggcgacggcaagaccagcguguggaucuaa

SEQ ID NO: 17528 - RNA, 1320 nt, Artificial Sequence
  GJC2__Homo_sapiens__NP_065168
augaccaacaugagcuggagcuuccugaccagacugcuggaggagauccacaaccacagcaccuucgugggcaagguguggcugaccgugcuggugguguucagaaucgugcugaccgccgugggcggcgaggccaucuacagcgacgagcaggccaaguucaccugcaacaccagacagcccggcugcgacaacgugugcuacgacgccuucgccccccugagccacgugagauucuggguguuccagaucguggugaucagcacccccagcgugauguaccugggcuacgccgugcacagacuggccagagccagcgagcaggagagaagaagagcccugagaagaagacccggccccagaagagcccccagagcccaccugccccccccccacgccggcuggcccgagcccgccgaccugggcgaggaggagcccaugcugggccugggcgaggaggaggaggaggaggagaccggcgccgccgagggcgccggcgaggaggccgaggaggccggcgccgaggaggccugcaccaaggccgugggcgccgacggcaaggccgccggcacccccggccccaccggccagcacgacggcagaagaagaauccagagagagggccugaugagaguguacguggcccagcugguggccagagccgccuucgagguggccuuccuggugggccaguaccugcuguacggcuucgaggugagacccuucuuccccugcagcagacagcccugcccccacgugguggacugcuucgugagcagacccaccgagaagaccguguuccugcuggugauguacguggugagcugccugugccugcugcugaaccugugcgagauggcccaccugggccugggcagcgcccaggacgccgugagaggcagaagaggcccccccgccagcgcccccgcccccgcccccagacccccccccugcgccuuccccgccgccgccgccggccuggccugcccccccgacuacagccugguggugagagccgccgagagagccagagcccacgaccagaaccuggccaaccuggcccugcaggcccugagagacggcgccgccgccggcgacagagacagagacagcagccccugcgugggccugcccgccgccagcagaggcccccccagagccggcgcccccgccagcagaaccggcagcgccaccagcgccggcaccgugggcgagcagggcagacccggcacccacgagagacccggcgccaagcccagagccggcagcgagaagggcagcgccagcagcagagacggcaagaccaccguguggaucuaa

SEQ ID NO: 17529 - RNA, 840 nt, Artificial Sequence
  GJC3__Homo_sapiens__NP_853516
augugcggcagauuccugagaagacugcuggccgaggagagcagaagaagcacccccgugggcagacugcugcugcccgugcugcugggcuucagacuggugcugcuggccgccagcggccccggcguguacggcgacgagcagagcgaguucgugugccacacccagcagcccggcugcaaggccgccugcuucgacgccuuccacccccugagcccccugagauucuggguguuccaggugauccugguggccgugcccagcgcccuguacaugggcuucacccuguaccacgugaucuggcacugggagcugagcggcaagggcaaggaggaggagacccugauccagggcagagagggcaacaccgacgugcccggcgccggcagccugagacugcugugggccuacguggcccagcugggcgccagacuggugcuggagggcgccgcccugggccugcaguaccaccuguacggcuuccagaugcccagcagcuucgccugcagaagagagcccugccugggcagcaucaccugcaaccugagcagacccagcgagaagaccaucuuccugaagaccauguucggcgugagcggcuucugccugcuguucaccuuccuggagcuggugcugcugggccugggcagaugguggagaaccuggaagcacaagagcagcagcagcaaguacuuccugaccagcgagagcaccagaagacacaagaaggccaccgacagccugcccgugguggagaccaaggagcaguuccaggaggccgugcccggcagaagccuggcccaggagaagcagagacccgugggccccagagacgccuaa

SEQ ID NO: 17530 - RNA, 966 nt, Artificial Sequence
  GJD2__Homo_sapiens__NP_065711
augggcgaguggaccauccuggagagacugcuggaggccgccgugcagcagcacagcaccaugaucggcagaauccugcugaccgugguggugaucuucagaauccugaucguggccaucgugggcgagaccguguacgacgacgagcagaccauguucgugugcaacacccugcagcccggcugcaaccaggccugcuacgacagagccuuccccaucagccacaucagauacuggguguuccagaucaucauggugugcacccccagccugugcuucaucaccuacagcgugcaccagagcgccaagcagagagagagaagauacagcaccguguuccuggcccuggacagagacccccccgagagcaucggcggccccggcggcaccggcggcggcggcagcggcggcggcaagagagaggacaagaagcugcagaacgccaucgugaacggcgugcugcagaacaccgagaacaccagcaaggagaccgagcccgacugccuggaggugaaggagcugaccccccaccccagcggccugagaaccgccagcaagagcaagcugagaagacaggagggcaucagcagauucuacaucauccaggugguguucagaaacgcccuggagaucggcuuccuggugggccaguacuuccuguacggcuucagcgugcccggccuguacgagugcaacagauaccccugcaucaaggagguggagugcuacgugagcagacccaccgagaagaccguguuccugguguucauguucgccgugagcggcaucugcguggugcugaaccuggccgagcugaaccaccugggcuggagaaagaucaagcuggccgugagaggcgcccaggccaagagaaagagcaucuacgagaucagaaacaaggaccugcccagagugagcgugcccaacuucggcagaacccagagcagcgacagcgccuacguguaa

SEQ ID NO: 17531 - RNA, 885 nt, Artificial Sequence
  GJD3__Homo_sapiens__NP_689343
augggcgagugggccuuccugggcagccugcuggacgccgugcagcugcagagcccccuggugggcagacuguggcugguggugaugcugaucuucagaauccuggugcuggccaccgugggcggcgccguguucgaggacgagcaggaggaguucgugugcaacacccugcagcccggcugcagacagaccugcuacgacagagccuuccccgugagccacuacagauucuggcuguuccacauccugcugcugagcgccccccccgugcuguucgugguguacagcaugcacagagccggcaaggaggccggcggcgccgaggccgccgcccagugcgcccccggccugcccgaggcccagugcgcccccugcgcccugagagccagaagagccagaagaugcuaccugcugagcguggcccugagacugcuggccgagcugaccuuccugggcggccaggcccugcuguacggcuucagaguggccccccacuucgccugcgccggcccccccugcccccacaccguggacugcuucgugagcagacccaccgagaagaccguguucgugcuguucuacuucgccgugggccugcugagcgcccugcugagcguggccgagcugggccaccugcuguggaagggcagacccagagccggcgagagagacaacagaugcaacagagcccacgaggaggcccagaagcugcugccccccccccccccccccccccccccccccgcccugcccagcagaagacccggccccgagcccugcgccccccccgccuacgcccaccccgcccccgccagccugagagagugcggcagcggcagaggcaaggccagccccgccaccggcagaagagaccuggccaucuaa

SEQ ID NO: 17532 - RNA, 1575 nt, Artificial Sequence
  GK__Homo_sapiens__NP_000158
auggccgccagcaagaaggccgugcugggcccccuggugggcgccguggaccagggcaccagcagcaccagauuccugguguucaacagcaagaccgccgagcugcugagccaccaccagguggagaucaagcaggaguuccccagagagggcuggguggagcaggaccccaaggagauccugcacagcguguacgagugcaucgagaagaccugcgagaagcugggccagcugaacaucgacaucagcaacaucaaggccaucggcgugagcaaccagagagagaccaccguggugugggacaagaucaccggcgagccccuguacaacgccgugguguggcuggaccugagaacccagagcaccguggagagccugagcaagagaauccccggcaacaacaacuucgugaagagcaagaccggccugccccugagcaccuacuucagcgccgugaagcugagauggcugcuggacaacgugagaaaggugcagaaggccguggaggagaagagagcccuguucggcaccaucgacagcuggcugaucuggagccugaccggcggcgugaacggcggcgugcacugcaccgacgugaccaacgccagcagaaccaugcuguucaacauccacagccuggagugggacaagcagcugugcgaguucuucggcauccccauggagauccugcccaacgugagaagcagcagcgagaucuacggccugaugaaggccggcgcccuggagggcgugcccaucagcggcugccugggcgaccagagcgccgcccuggugggccagaugugcuuccagaucggccaggccaagaacaccuacggcaccggcugcuuccugcugugcaacaccggccacaagugcguguucagcgaccacggccugcugaccaccguggccuacaagcugggcagagacaagcccguguacuacgcccuggagggcagcguggccaucgccggcgccgugaucagauggcugagagacaaccugggcaucaucaagaccagcgaggagaucgagaagcuggccaaggaggugggcaccagcuacggcugcuacuucgugcccgccuucagcggccuguacgcccccuacugggagcccagcgccagaggcaucaucugcggccugacccaguucaccaacaagugccacaucgccuucgccgcccuggaggccgugugcuuccagaccagagagauccuggacgccaugaacagagacugcggcaucccccugagccaccugcagguggacggcggcaugaccagcaacaagauccugaugcagcugcaggccgacauccuguacauccccguggugaagcccagcaugcccgagaccaccgcccugggcgccgccauggccgccggcgccgccgagggcgugggcguguggagccuggagcccgaggaccugagcgccgugaccauggagagauucgagccccagaucaacgccgaggagagcgagaucagauacagcaccuggaagaaggccgugaugaagagcaugggcugggugaccacccagagccccgagagcggcauccccuaa

SEQ ID NO: 17533 - RNA, 600 nt, Artificial Sequence
  GKN1__Homo_sapiens__NP_062563
augcuggccuacagcagcgugcacugcuucagagaggacaagaugaaguucaccaucguguucgccggccugcugggcguguuccuggcccccgcccuggccaacuacaacaucaacgugaacgacgacaacaacaacgccggcagcggccagcagagcgugagcgugaacaacgagcacaacguggccaacguggacaacaacaacggcugggacagcuggaacagcaucugggacuacggcaacggcuucgccgccaccagacuguuccagaagaagaccugcaucgugcacaagaugaacaaggaggugaugcccagcauccagagccuggacgcccuggugaaggagaagaagcugcagggcaagggccccggcggccccccccccaagggccugauguacagcgugaaccccaacaagguggacgaccugagcaaguucggcaagaacaucgccaacaugugcagaggcauccccaccuacauggccgaggagaugcaggaggccagccuguucuucuacagcggcaccugcuacaccaccagcgugcuguggaucguggacaucagcuucugcggcgacaccguggagaacuaa

SEQ ID NO: 17534 - RNA, 555 nt, Artificial Sequence
  GKN2__Homo_sapiens__NP_872342
augaagauccugguggccuuccugguggugcugaccaucuucggcauccagagccacggcuacgagguguucaacaucaucagccccagcaacaacggcggcaacgugcaggagaccgugaccaucgacaacgagaagaacaccgccaucaucaacauccacgccggcagcugcagcagcaccaccaucuucgacuacaagcacggcuacaucgccagcagagugcugagcagaagagccugcuucauccugaagauggaccaccagaacauccccccccugaacaaccugcagugguacaucuacgagaagcaggcccuggacaacauguucagcagcaaguacaccugggugaaguacaacccccuggagagccugaucaaggacguggacugguuccugcugggcagccccaucgagaagcugugcaagcacaucccccuguacaagggcgaggugguggagaacacccacaacgugggcgccggcggcugcgccaaggccggccugcugggcauccugggcaucagcaucugcgccgacauccacguguaa

SEQ ID NO: 17535 - RNA, 1290 nt, Artificial Sequence
  GLA__Homo_sapiens__NP_000160
augcagcugagaaaccccgagcugcaccugggcugcgcccuggcccugagauuccuggcccuggugagcugggacauccccggcgccagagcccuggacaacggccuggccagaacccccaccaugggcuggcugcacugggagagauucaugugcaaccuggacugccaggaggagcccgacagcugcaucagcgagaagcuguucauggagauggccgagcugauggugagcgagggcuggaaggacgccggcuacgaguaccugugcaucgacgacugcuggauggccccccagagagacagcgagggcagacugcaggccgacccccagagauucccccacggcaucagacagcuggccaacuacgugcacagcaagggccugaagcugggcaucuacgccgacgugggcaacaagaccugcgccggcuuccccggcagcuucggcuacuacgacaucgacgcccagaccuucgccgacuggggcguggaccugcugaaguucgacggcugcuacugcgacagccuggagaaccuggccgacggcuacaagcacaugagccuggcccugaacagaaccggcagaagcaucguguacagcugcgaguggccccuguacauguggcccuuccagaagcccaacuacaccgagaucagacaguacugcaaccacuggagaaacuucgccgacaucgacgacagcuggaagagcaucaagagcauccuggacuggaccagcuucaaccaggagagaaucguggacguggccggccccggcggcuggaacgaccccgacaugcuggugaucggcaacuucggccugagcuggaaccagcaggugacccagauggcccugugggccaucauggccgccccccuguucaugagcaacgaccugagacacaucagcccccaggccaaggcccugcugcaggacaaggacgugaucgccaucaaccaggacccccugggcaagcagggcuaccagcugagacagggcgacaacuucgaggugugggagagaccccugagcggccuggccugggccguggccaugaucaacagacaggagaucggcggccccagaagcuacaccaucgccguggccagccugggcaagggcguggccugcaaccccgccugcuucaucacccagcugcugcccgugaagagaaagcugggcuucuacgaguggaccagcagacugagaagccacaucaaccccaccggcaccgugcugcugcagcuggagaacaccaugcagaugagccugaaggaccugcuguaa

SEQ ID NO: 17536 - RNA, 2034 nt, Artificial Sequence
  GLB1__Homo_sapiens__NP_000395
augcccggcuuccuggugagaauccugccccugcugcuggugcugcugcugcugggccccaccagaggccugagaaacgccacccagagaauguucgagaucgacuacagcagagacagcuuccugaaggacggccagcccuucagauacaucagcggcagcauccacuacagcagagugcccagauucuacuggaaggacagacugcugaagaugaagauggccggccugaacgccauccagaccuacgugcccuggaacuuccacgagcccuggcccggccaguaccaguucagcgaggaccacgacguggaguacuuccugagacuggcccacgagcugggccugcuggugauccugagacccggccccuacaucugcgccgagugggagaugggcggccugcccgccuggcugcuggagaaggagagcauccugcugagaagcagcgaccccgacuaccuggccgccguggacaaguggcugggcgugcugcugcccaagaugaagccccugcuguaccagaacggcggccccgugaucaccgugcagguggagaacgaguacggcagcuacuucgccugcgacuucgacuaccugagauuccugcagaagagauucagacaccaccugggcgacgacguggugcuguucaccaccgacggcgcccacaagaccuuccugaagugcggcgcccugcagggccuguacaccaccguggacuucggcaccggcagcaacaucaccgacgccuuccugagccagagaaagugcgagcccaagggcccccugaucaacagcgaguucuacaccggcuggcuggaccacuggggccagccccacagcaccaucaagaccgaggccguggccagcagccuguacgacauccuggccagaggcgccagcgugaaccuguacauguucaucggcggcaccaacuucgccuacuggaacggcgccaacagccccuacgccgcccagcccaccagcuacgacuacgacgccccccugagcgaggccggcgaccugaccgagaaguacuucgcccugagaaacaucauccagaaguucgagaaggugcccgagggccccaucccccccagcacccccaaguucgccuacggcaaggugacccuggagaagcugaagaccgugggcgccgcccuggacauccugugccccagcggccccaucaagagccuguacccccugaccuucauccaggugaagcagcacuacggcuucgugcuguacagaaccacccugccccaggacugcagcaaccccgccccccugagcagcccccugaacggcgugcacgacagagccuacguggccguggacggcaucccccagggcgugcuggagagaaacaacgugaucacccugaacaucaccggcaaggccggcgccacccuggaccugcugguggagaacaugggcagagugaacuacggcgccuacaucaacgacuucaagggccuggugagcaaccugacccugagcagcaacauccugaccgacuggaccaucuucccccuggacaccgaggacgccgugagaagccaccugggcggcuggggccacagagacagcggccaccacgacgaggccugggcccacaacagcagcaacuacacccugcccgccuucuacaugggcaacuucagcauccccagcggcauccccgaccugccccaggacaccuucauccaguuccccggcuggaccaagggccagguguggaucaacggcuucaaccugggcagauacuggcccgccagaggcccccagcugacccuguucgugccccagcacauccugaugaccagcgcccccaacaccaucaccgugcuggagcuggagugggcccccugcagcagcgacgaccccgagcugugcgccgugaccuucguggacagacccgugaucggcagcagcgugaccuacgaccaccccagcaagcccguggagaagagacugaugcccccccccccccagaagaacaaggacagcuggcuggaccacguguaa

SEQ ID NO: 17537 - RNA, 1644 nt, Artificial Sequence
  GLCCI1__Homo_sapiens__NP_612435
augagcaccgccagcagcagcagcagcagcagcagcagccagaccccccacccccccagccagagaaugagaagaagcgccgccggcagcccccccgccguggccgccgccggcagcggcaacggcgccggcggcggcggcggcgugggcugcgcccccgccgccggcgccggcagacugcugcagcccaucagagccaccgugcccuaccagcugcugagaggcagccagcacagccccaccagaccccccguggccgccgccgccgccagccugggcagccugcccggccccggcgccgccagaggccccagccccagcagccccaccccccccgccgccgccgcccccgccgagcaggcccccagagccaagggcagacccagaagaagccccgagagccacagaagaagcagcagccccgagagaagaagccccggcagccccgugugcagagccgacaaggccaagagccagcaggugagaaccagcagcaccaucagaagaaccagcagccuggacaccaucaccggccccuaccugaccggccaguggcccagagacccccacgugcacuaccccagcugcaugaaggacaaggccacccagacccccagcugcugggccgaggagggcgccgagaagagaagccaccagagaagcgccagcuggggcagcgccgaccagcugaaggagcagaucgccaagcugagacagcagcugcagagaagcaagcagagcagcagacacagcaaggagaaggacagacagagcccccugcacggcaaccacaucaccaucagccacacccaggccaccggcagcagaagcgugcccaugccccugagcaacaucagcgugcccaagagcagcgugagcagagugcccugcaacguggagggcaucagccccgagcuggagaagguguucaucaaggagaacaacggcaaggaggaggugagcaagccccuggacauccccgacggcagaagagccccccugcccgcccacuacagaagcagcagcaccagaagcaucgacacccagacccccagcgugcaggagagaagcagcagcugcagcagccacagccccugcgugagccccuucugcccccccgagagccaggacggcagccccugcagcaccgaggaccugcuguacgacagagacaaggacagcggcagcagcagcccccugcccaaguacgccagcagccccaagcccaacaacagcuacauguucaagagagagccccccgagggcugcgagagagugaagguguucgaggagauggccagcagacagcccaucagcgccccccuguucagcugccccgacaagaacaaggugaacuucauccccaccggcagcgccuucugccccgugaagcugcugggcccccugcugcccgccagcgaccugaugcugaagaacagccccaacagcggccagagcagcgcccuggccacccugaccguggagcagcugagcagcagagugagcuucaccagccugagcgacgacaccagcaccgccggcagcauggaggccagcgugcagcagcccagccagcagcagcagcugcugcaggagcugcagggcgaggaccacaucagcgcccagaacuacgugaucaucuaa

SEQ ID NO: 17538 - RNA, 1854 nt, Artificial Sequence
  GLCE__Homo_sapiens__XP_005254355
augagaugccuggccgccagagugaacuacaagacccugaucaucaucugcgcccuguucacccuggugaccgugcugcuguggaacaagugcagcagcgacaaggccauccaguuccccagaagaagcagcagcggcuucagaguggacggcuucgagaagagagccgccgccagcgagagcaacaacuacaugaaccacguggccaagcagcagagcgaggaggccuucccccaggagcagcagaaggccccccccguggugggcggcuucaacagcaacgugggcagcaaggugcugggccugaaguacgaggagaucgacugccugaucaacgacgagcacaccaucaagggcagaagagagggcaacgagguguuccugcccuucaccuggguggagaaguacuucgacguguacggcaagguggugcaguacgacggcuacgacagauucgaguucagccacagcuacagcaagguguacgcccagagagcccccuaccaccccgacggcguguucaugagcuucgagggcuacaacguggaggugagagacagagugaagugcaucagcggcguggagggcgugccccugagcacccaguggggcccccagggcuacuucuaccccauccagaucgcccaguacggccugagccacuacagcaagaaccugaccgagaagcccccccacaucgagguguacgagaccgccgaggacagagacaagaacaagcccaacgacuggaccgugcccaagggcugcuucauggccaacguggccgacaagagcagauucaccaacgugaagcaguucaucgcccccgagaccagcgagggcgugagccugcagcugggcaacaccaaggacuucaucaucagcuucgaccugaaguuccugaccaacggcagcgugagcguggugcuggagaccaccgagaagaaccagcuguucaccauccacuacgugagcaacgcccagcugaucgccuucaaggagagagacaucuacuacggcaucggccccagaaccagcuggagcaccgugaccagagaccuggugaccgaccugagaaagggcgugggccugagcaacaccaaggccgugaagcccaccaagaucaugcccaagaagguggugagacugaucgccaagggcaagggcuuccuggacaacaucaccaucagcaccaccgcccacauggccgccuucuucgccgccagcgacuggcuggugagaaaccaggacgagaagggcggcuggcccaucauggugaccagaaagcugggcgagggcuucaagagccuggagcccggcugguacagcgccauggcccagggccaggccaucagcacccuggugagagccuaccugcugaccaaggaccacaucuuccugaacagcgcccugagagccaccgcccccuacaaguuccugagcgagcagcacggcgugaaggccguguucaugaacaagcacgacugguacgaggaguaccccaccacccccagcagcuucgugcugaacggcuucauguacagccugaucggccuguacgaccugaaggagaccgccggcgagaagcugggcaaggaggccagaagccuguacgagagaggcauggagagccugaaggccaugcugccccuguacgacaccggcagcggcaccaucuacgaccugagacacuucaugcugggcaucgcccccaaccuggccagaugggacuaccacaccacccacaucaaccagcugcagcugcugagcaccaucgacgagagccccguguucaaggaguucgugaagagauggaagagcuaccugaagggcagcagagccaagcacaacuaa

SEQ ID NO: 17539 - RNA, 3063 nt, Artificial Sequence
  GLDC__Homo_sapiens__NP_000161
augcagagcugcgccagagccuggggccugagacugggcagaggcgugggcggcggcagaagacuggccggcggcagcggccccugcugggcccccagaagcagagacagcagcagcggcggcggcgacagcgccgccgccggcgccagcagacugcuggagagacugcugcccagacacgacgacuucgccagaagacacaucggccccggcgacaaggaccagagagagaugcugcagacccugggccuggccagcaucgacgagcugaucgagaagaccgugcccgccaacaucagacugaagagaccccugaagauggaggaccccgugugcgagaacgagauccuggccacccugcacgccaucagcagcaagaaccagaucuggagaagcuacaucggcaugggcuacuacaacugcagcgugccccagaccauccugagaaaccugcuggagaacagcggcuggaucacccaguacacccccuaccagcccgaggugagccagggcagacuggagagccugcugaacuaccagaccauggugugcgacaucaccggccuggacauggccaacgccagccugcuggacgagggcaccgccgccgccgaggcccugcagcugugcuacagacacaacaagagaagaaaguuccugguggaccccagaugccacccccagaccaucgccguggugcagaccagagccaaguacaccggcgugcugaccgagcugaagcugcccugcgagauggacuucagcggcaaggacgugagcggcgugcuguuccaguaccccgacaccgagggcaagguggaggacuucaccgagcugguggagagagcccaccagagcggcagccuggccugcugcgccaccgaccugcuggcccugugcauccugagaccccccggcgaguucggcguggacaucgcccugggcagcagccagagauucggcgugccccugggcuacggcggcccccacgccgccuucuucgccgugagagagagccuggugagaaugaugcccggcagaauggugggcgugaccagagacgccaccggcaaggagguguacagacuggcccugcagaccagagagcagcacaucagaagagacaaggccaccagcaacaucugcaccgcccaggcccugcuggccaacauggccgccauguucgccaucuaccacggcagccacggccuggagcacaucgccagaagagugcacaacgccacccugauccugagcgagggccugaagagagccggccaccagcugcagcacgaccuguucuucgacacccugaagauccagugcggcugcagcgugaaggaggugcugggcagagccgcccagagacagaucaacuucagacuguucgaggacggcacccugggcaucagccuggacgagaccgugaacgagaaggaccuggacgaccugcuguggaucuucggcugcgagagcagcgccgagcugguggccgagagcaugggcgaggagugcagaggcauccccggcagcguguucaagagaaccagccccuuccugacccaccagguguucaacagcuaccacagcgagaccaacaucgugagauacaugaagaagcuggagaacaaggacaucagccuggugcacagcaugaucccccugggcagcugcaccaugaagcugaacagcagcagcgagcuggcccccaucaccuggaaggaguucgccaacauccaccccuucgugccccuggaccaggcccagggcuaccagcagcuguucagagagcuggagaaggaccugugcgagcugaccggcuacgaccaggugugcuuccagcccaacagcggcgcccagggcgaguacgccggccuggccaccaucagagccuaccugaaccagaagggcgagggccacagaaccgugugccugauccccaagagcgcccacggcaccaaccccgccagcgcccacauggccggcaugaagauccagcccguggagguggacaaguacggcaacaucgacgccgugcaccugaaggccaugguggacaagcacaaggagaaccuggccgccaucaugaucaccuaccccagcaccaacggcguguucgaggagaacaucagcgacgugugcgaccugauccaccagcacggcggccagguguaccuggacggcgccaacaugaacgcccaggugggcaucugcagacccggcgacuucggcagcgacgugagccaccugaaccugcacaagaccuucugcaucccccacggcggcggcggccccggcaugggccccaucggcgugaagaagcaccuggcccccuuccugcccaaccaccccgugaucagccugaagagaaacgaggacgccugccccgugggcaccgugagcgccgcccccuggggcagcagcagcauccugcccaucagcugggccuacaucaagaugaugggcggcaagggccugaagcaggccaccgagaccgccauccugaacgccaacuacauggccaagagacuggagacccacuacagaauccuguucagaggcgccagaggcuacgugggccacgaguucauccuggacaccagacccuucaagaagagcgccaacaucgaggccguggacguggccaagagacugcaggacuacggcuuccacgcccccaccaugagcuggcccguggccggcacccugaugguggagcccaccgagagcgaggacaaggccgagcuggacagauucugcgacgccaugaucagcaucagacaggagaucgccgacaucgaggagggcagaaucgaccccagagugaacccccugaagaugagcccccacagccugaccugcgugaccagcagccacugggacagacccuacagcagagagguggccgccuucccccugcccuucgugaagcccgagaacaaguucuggcccaccaucgccagaaucgacgacaucuacggcgaccagcaccuggugugcaccugcccccccauggagguguacgagagccccuucagcgagcagaagagagccagcagcuaa

SEQ ID NO: 17540 - RNA, 1656 nt, Artificial Sequence
  GLDN__Homo_sapiens__NP_861454
auggccagaggcgccgagggcggcagaggcgacgccggcuggggccugagaggcgcccuggccgccguggcccugcugagcgcccugaacgccgccggcaccguguucgcccugugccaguggagaggccugagcagcgcccugagagcccuggaggcccagagaggcagagagcagagagaggacagcgcccugagaagcuuccuggccgagcugagcagagcccccagaggcgccagcgcccccccccaggaccccgccagcagcgccagaaacaagagaagccacagcggcgagcccgccccccacaucagagccgagagccacgacaugcugaugaugaugaccuacagcauggugcccaucagagugaugguggaccugugcaacagcaccaagggcaucugccugaccggccccagcggcccccccggcccccccggcgccggcggccugcccggccacaacggccuggacggccagcccggcccccagggccccaagggcgagaagggcgccaacggcaagagaggcaagaugggcauccccggcgccgccggcaaccccggcgagagaggcgagaagggcgaccacggcgagcugggccugcagggcaacgagggcccccccggccagaagggcgagaagggcgacaagggcgacgugagcaacgacgugcugcuggccggcgccaagggcgaccagggcccccccggcccccccggcccccccggcccccccggcccccccggcccccccggcagcagaagagccaagggccccagacagcccagcauguucaacggccagugccccggcgagaccugcgccauccccaacgacgacacccuggugggcaaggccgacgagaaggccagcgagcaccacagcccccaggccgagagcaugaucaccagcaucggcaaccccgugcaggugcugaaggugaccgagaccuucggcaccuggaucagagagagcgccaacaagagcgacgacagaaucugggugaccgagcacuucagcggcaucauggugaaggaguucaaggaccagcccagccugcugaacggcagcuacaccuucauccaccugcccuacuacuuccacggcugcggccacgugguguacaacaacagccuguacuaccacaagggcggcagcaacacccuggugagauucgaguucggccaggagaccagccagacccugaagcuggagaacgcccuguacuucgacagaaaguaccuguucgccaacagcaagaccuacuucaaccuggccguggacgagaagggccuguggaucaucuacgccagcagcguggacggcagcagcauccugguggcccagcuggacgagagaaccuucagcguggugcagcacgugaacaccaccuaccccaagagcaaggccggcaacgccuucaucgccagaggcauccuguacgugaccgacaccaaggacaugagagugaccuucgccuucgaccugcugggcggcaagcagaucaacgccaacuucgaccugagaaccagccagagcgugcuggccaugcuggccuacaacaugagagaccagcaccuguacagcugggaggacggccaccugaugcuguaccccgugcaguuccugagcaccacccugaaccaguaa

SEQ ID NO: 17541 - RNA, 2097 nt, Artificial Sequence
  GLE1__Homo_sapiens__NP_001003722
augcccagcgagggcagaugcugggagacccugaaggcccugagaagcagcgacaagggcagacugugcuacuacagagacuggcugcugagaagagaggacgugcuggaggagugcaugagccugcccaagcugagcagcuacagcggcugggugguggagcacgugcugccccacaugcaggagaaccagccccugagcgagaccagccccagcagcaccagcgccagcgcccuggaccagcccagcuucgugcccaagagccccgacgccagcagcgccuucagccccgccagccccgccacccccaacggcaccaagggcaaggacgagagccagcacaccgagagcauggugcugcagagcagcagaggcaucaagguggagggcugcgugagaauguacgagcuggugcacagaaugaagggcaccgagggccugagacuguggcaggaggagcaggagagaaaggugcaggcccugagcgagauggccagcgagcagcugaagagauucgacgaguggaaggagcugaagcagcacaaggaguuccaggaccugagagaggugauggagaagagcagcagagaggcccugggccaccaggagaagcugaaggccgagcacagacacagagccaagauccugaaccugaagcugagagaggccgagcagcagagagugaagcaggccgagcaggagagacugagaaaggaggagggccagaucagacugagagcccuguacgcccugcaggaggagaugcugcagcugagccagcagcuggacgccagcgagcagcacaaggcccugcugaagguggaccuggccgccuuccagaccagaggcaaccagcugugcagccugaucagcggcaucaucagagccagcagcgagagcagcuaccccaccgccgagagccaggccgaggccgagagagcccugagagagaugagagaccugcugaugaaccugggccaggagaucaccagagccugcgaggacaagagaagacaggacgaggaggaggcccaggugaagcugcaggaggcccagaugcagcagggccccgaggcccacaaggagccccccgcccccagccagggccccggcggcaagcagaacgaggaccugcaggugaaggugcaggacaucaccaugcagugguaccagcagcugcaggacgccagcaugcagugcgugcugaccuucgagggccugaccaacagcaaggacagccaggccaagaagaucaagauggaccugcagaaggccgccaccauccccgugagccagaucagcaccaucgccggcagcaagcugaaggagaucuucgacaagauccacagccugcugagcggcaagcccgugcagagcggcggcagaagcgugagcgugacccugaacccccagggccuggacuucgugcaguacaagcuggccgagaaguucgugaagcagggcgaggaggagguggccagccaccacgaggccgccuuccccaucgccgugguggccagcggcaucugggagcugcaccccagagugggcgaccugauccuggcccaccugcacaagaagugccccuacagcgugcccuucuaccccaccuucaaggagggcauggcccuggaggacuaccagagaaugcugggcuaccaggugaaggacagcaagguggagcagcaggacaacuuccugaagagaaugagcggcaugaucagacuguacgccgccaucauccagcugagauggcccuacggcaacagacaggagauccacccccacggccugaaccacggcuggagauggcuggcccagauccugaacauggagccccugagcgacgugaccgccacccugcuguucgacuuccuggaggugugcggcaacgcccugaugaagcaguaccaggugcaguucuggaagaugcugauccugaucaaggaggacuacuuccccagaaucgaggccaucaccagcagcggccagaugggcagcuucaucagacugaagcaguuccuggagaagugccugcagcacaaggacauccccgugcccaagggcuuccugaccagcagcuucuggagaagcuaa

SEQ ID NO: 17542 - RNA, 3579 nt, Artificial Sequence
  GLG1__Homo_sapiens__NP_001139138
auggccgccugcggcagagugagaagaauguucagacugagcgccgcccugcaccugcugcugcuguucgccgccggcgccgagaagcugcccggccagggcgugcacagccagggccagggccccggcgccaacuucgugagcuucgugggccaggccggcggcggcggccccgccggccagcagcugccccagcugccccagagcagccagcugcagcagcagcagcagcagcagcagcagcagcagcagccccagcccccccagccccccuuccccgccggcggcccccccgccagaagaggcggcgccggcgccggcggcggcuggaagcuggccgaggaggagagcugcagagaggacgugaccagagugugccccaagcacaccuggagcaacaaccuggccgugcuggagugccugcaggacgugagagagcugcuguggaacuacaagcugaaccugaccaccgaccccaaguucgagagcguggccagagaggugugcaagagcaccaucaccgagaucaaggagugcgccgacgagcccgugggcaagggcuacauggugagcugccugguggaccacagaggcaacaucaccgaguaccagugccaccaguacaucaccaagaugaccgccaucaucuucagcgacuacagacugaucugcggcuucauggacgacugcaagaacgacaucaacauccugaagugcggcagcaucagacugggcgagaaggacgcccacagccagggcgagguggugagcugccuggagaagggccuggugaaggaggccgaggagagagagcccaagauccaggugagcgagcugugcaagaaggccauccugagaguggccgagcugagcagcgacgacuuccaccuggacagacaccuguacuucgccugcagagacgacagagagagauucugcgagaacacccaggccggcgagggcagaguguacaagugccuguucaaccacaaguucgaggagagcaugagcgagaagugcagagaggcccugaccaccagacagaagcugaucgcccaggacuacaaggugagcuacagccuggccaagagcugcaagagcgaccugaagaaguacagaugcaacguggagaaccugcccagaagcagagaggccagacugagcuaccugcugaugugccuggagagcgccgugcacagaggcagacaggugagcagcgagugccagggcgagaugcuggacuacagaagaaugcugauggaggacuucagccugagccccgagaucauccugagcugcagaggcgagaucgagcaccacugcagcggccugcacagaaagggcagaacccugcacugccugaugaagguggugagaggcgagaagggcaaccugggcaugaacugccagcaggcccugcagacccugauccaggagaccgaccccggcgccgacuacagaaucgacagagcccugaacgaggccugcgagagcgugauccagaccgccugcaagcacaucagaagcggcgaccccaugauccugagcugccugauggagcaccuguacaccgagaagaugguggaggacugcgagcacagacugcuggagcugcaguacuucaucagcagagacuggaagcuggaccccgugcuguacagaaagugccagggcgacgccagcagacugugccacacccacggcuggaacgagaccagcgaguucaugccccagggcgccguguucagcugccuguacagacacgccuacagaaccgaggagcagggcagaagacugagcagagagugcagagccgaggugcagagaauccugcaccagagagccauggacgugaagcuggaccccgcccugcaggacaagugccugaucgaccugggcaaguggugcagcgagaagaccgagaccggccaggagcuggagugccugcaggaccaccuggacgaccuggugguggagugcagagacaucgugggcaaccugaccgagcuggagagcgaggacauccagaucgaggcccugcugaugagagccugcgagcccaucauccagaacuucugccacgacguggccgacaaccagaucgacagcggcgaccugauggagugccugauccagaacaagcaccagaaggacaugaacgagaagugcgccaucggcgugacccacuuccagcuggugcagaugaaggacuucagauucagcuacaaguucaagauggccugcaaggaggacgugcugaagcugugccccaacaucaagaagaagguggacguggugaucugccugagcaccaccgugagaaacgacacccugcaggaggccaaggagcacagagugagccugaagugcagaagacagcugagaguggaggagcuggagaugaccgaggacaucagacuggagcccgaccuguacgaggccugcaagagcgacaucaagaacuucugcagcgccgugcaguacggcaacgcccagaucaucgagugccugaaggagaacaagaagcagcugagcaccagaugccaccagaagguguucaagcugcaggagaccgagaugauggaccccgagcuggacuacacccugaugagagugugcaagcagaugaucaagagauucugccccgaggccgacagcaagaccaugcugcagugccugaagcagaacaagaacagcgagcugauggaccccaagugcaagcagaugaucaccaagagacagaucacccagaacaccgacuacagacugaaccccaugcugagaaaggccugcaaggccgacauccccaaguucugccacggcauccugaccaaggccaaggacgacagcgagcuggagggccaggugaucagcugccugaagcugagauacgccgaccagagacugagcagcgacugcgaggaccagaucagaaucaucauccaggagagcgcccuggacuacagacuggacccccagcugcagcugcacugcagcgacgagaucagcagccugugcgccgaggaggccgccgcccaggagcagaccggccagguggaggagugccugaaggugaaccugcugaagaucaagaccgagcugugcaagaaggaggugcugaacaugcugaaggagagcaaggccgacaucuucguggaccccgugcugcacaccgccugcgcccuggacaucaagcaccacugcgccgccaucacccccggcagaggcagacagaugagcugccugauggaggcccuggaggacaagagagugagacugcagcccgagugcaagaagagacugaacgacagaaucgagauguggagcuacgccgccaagguggcccccgccgacggcuucagcgaccuggccaugcaggugaugaccagccccagcaagaacuacauccugagcgugaucagcggcagcaucugcauccuguuccugaucggccugaugugcggcagaaucaccaagagagugaccagagagcugaaggacagacugcaguacagaagcgagaccauggccuacaagggccugguguggagccaggacgugaccggcagccccgccuaa

SEQ ID NO: 17543 - RNA, 3198 nt, Artificial Sequence
  GLI1__Homo_sapiens__NP_001161081
auguucaacagcaugacccccccccccaucagcagcuacggcgagcccugcugccugagaccccugcccagccagggcgcccccagcgugggcaccgaggugaagcugaccaagaagagagcccugagcaucagcccccugagcgacgccagccuggaccugcagaccgugaucagaaccagccccagcagccugguggccuucaucaacagcagaugcaccagccccggcggcagcuacggccaccugagcaucggcaccaugagccccagccugggcuuccccgcccagaugaaccaccagaagggccccagccccagcuucggcgugcagcccugcggcccccacgacagcgccagaggcggcaugaucccccacccccagagcagaggccccuuccccaccugccagcugaagagcgagcuggacaugcuggugggcaagugcagagaggagccccuggagggcgacaugagcagccccaacagcaccggcauccaggacccccugcugggcaugcuggacggcagagaggaccuggagagagaggagaagagagagcccgagagcguguacgagaccgacugcagaugggacggcugcagccaggaguucgacagccaggagcagcuggugcaccacaucaacagcgagcacauccacggcgagagaaaggaguucgugugccacuggggcggcugcagcagagagcugagacccuucaaggcccaguacaugcugguggugcacaugagaagacacaccggcgagaagccccacaagugcaccuucgagggcugcagaaagagcuacagcagacuggagaaccugaagacccaccugagaagccacaccggcgagaagcccuacaugugcgagcacgagggcugcagcaaggccuucagcaacgccagcgacagagccaagcaccagaacagaacccacagcaacgagaagcccuacgugugcaagcugcccggcugcaccaagagauacaccgaccccagcagccugagaaagcacgugaagaccgugcacggccccgacgcccacgugaccaagagacacagaggcgacggcccccugcccagagcccccagcaucagcaccguggagcccaagagagagagagagggcggccccaucagagaggagagcagacugaccgugcccgagggcgccaugaagccccagcccagccccggcgcccagagcagcugcagcagcgaccacagccccgccggcagcgccgccaacaccgacagcggcguggagaugaccggcaacgccggcggcagcaccgaggaccugagcagccuggacgagggccccugcaucgccggcaccggccugagcacccugagaagacuggagaaccugagacuggaccagcugcaccagcugagacccaucggcaccagaggccugaagcugcccagccugagccacaccggcaccaccgugagcagaagagugggcccccccgugagccuggagagaagaagcagcagcagcagcagcaucagcagcgccuacaccgugagcagaagaagcagccuggccagccccuucccccccggcagcccccccgagaacggcgccagcagccugcccggccugaugcccgcccagcacuaccugcugagagccagauacgccagcgccagaggcggcggcaccagccccaccgccgccagcagccuggacagaaucggcggccugcccaugccccccuggagaagcagagccgaguaccccggcuacaaccccaacgccggcgugaccagaagagccagcgaccccgcccaggccgccgacagacccgcccccgccagagugcagagauucaagagccugggcugcgugcacaccccccccaccguggccggcggcggccagaacuucgaccccuaccugcccaccagcguguacagcccccagccccccagcaucaccgagaacgccgccauggacgccagaggccugcaggaggagcccgaggugggcaccagcauggugggcagcggccugaaccccuacauggacuucccccccaccgacacccugggcuacggcggccccgagggcgccgccgccgagcccuacggcgccagaggccccggcagccugccccugggccccggcccccccaccaacuacggccccaaccccugcccccagcaggccagcuaccccgaccccacccaggagaccuggggcgaguuccccagccacagcggccuguaccccggccccaaggcccugggcggcaccuacagccagugccccagacuggagcacuacggccaggugcaggugaagcccgagcagggcugccccgugggcagcgacagcaccggccuggcccccugccugaacgcccaccccagcgagggccccccccacccccagccccuguucagccacuacccccagcccagccccccccaguaccugcagagcggccccuacacccagcccccccccgacuaccugcccagcgagcccagacccugccuggacuucgacagccccacccacagcaccggccagcugaaggcccagcuggugugcaacuacgugcagagccagcaggagcugcugugggagggcggcggcagagaggacgcccccgcccaggagcccagcuaccagagccccaaguuccugggcggcagccaggugagccccagcagagccaaggcccccgugaacaccuacggccccggcuucggccccaaccugcccaaccacaagagcggcagcuaccccacccccagccccugccacgagaacuucguggugggcgccaacagagccagccacagagccgccgccccccccagacugcugcccccccugcccaccugcuacggcccccugaaggugggcggcaccaaccccagcugcggccaccccgaggugggcagacugggcggcggccccgcccuguaccccccccccgagggccaggugugcaacccccuggacagccuggaccuggacaacacccagcuggacuucguggccauccuggacgagccccagggccugagccccccccccagccacgaccagagaggcagcagcggccacacccccccccccagcggcccccccaacauggccgugggcaacaugagcgugcugcugagaagccugcccggcgagaccgaguuccugaacagcagcgccuaa

SEQ ID NO: 17544 - RNA, 4761 nt, Artificial Sequence
  GLI2__Homo_sapiens__NP_005261
auggagaccagcgccagcgccaccgccagcgagaagcaggaggccaagagcggcauccuggaggccgccggcuuccccgaccccggcaagaaggccagcccccuggugguggccgccgccgccgccgccgccguggccgcccagggcgugccccagcaccugcugccccccuuccacgccccccugcccaucgacaugagacaccaggagggcagauaccacuacgagccccacagcgugcacggcgugcacggcccccccgcccugagcggcagccccgugaucagcgacaucagccugaucagacugagcccccaccccgccggccccggcgagagccccuucaacgccccccaccccuacgugaacccccacauggagcacuaccugagaagcgugcacagcagccccacccugagcaugaucagcgccgccagaggccugagccccgccgacguggcccaggagcaccugaaggagagaggccuguucggccugcccgcccccggcaccacccccagcgacuacuaccaccagaugacccugguggccggccaccccgcccccuacggcgaccugcugaugcagagcggcggcgccgccagcgccccccaccugcacgacuaccugaaccccguggacgugagcagauucagcagccccagagugacccccagacugagcagaaagagagcccugagcaucagcccccugagcgacgccagccuggaccugcagagaaugaucagaaccagccccaacagccugguggccuacaucaacaacagcagaagcagcagcgccgccagcggcagcuacggccaccugagcgccggcgcccugagccccgccuucaccuucccccaccccaucaaccccguggccuaccagcagauccugagccagcagagaggccugggcagcgccuucggccacacccccccccugauccagcccagccccaccuuccuggcccagcagcccauggcccugaccagcaucaacgccacccccacccagcugagcagcagcagcaacugccugagcgacaccaaccagaacaagcagagcagcgagagcgccgugagcagcaccgugaaccccguggccauccacaagagaagcaaggugaagaccgagcccgagggccugagacccgccagcccccuggcccugacccagggccaggugagcggccacggcagcugcggcugcgcccugccccugagccaggagcagcuggccgaccugaaggaggaccuggacagagacgacugcaagcaggaggccgagguggugaucuacgagaccaacugccacugggaggacugcaccaaggaguacgacacccaggagcagcuggugcaccacaucaacaacgagcacauccacggcgagaagaaggaguucgugugcagauggcaggccugcaccagagagcagaagcccuucaaggcccaguacaugcugguggugcacaugagaagacacaccggcgagaagccccacaagugcaccuucgagggcugcagcaaggccuacagcagacuggagaaccugaagacccaccugagaagccacaccggcgagaagcccuacgugugcgagcacgagggcugcaacaaggccuucagcaacgccagcgacagagccaagcaccagaacagaacccacagcaacgagaagcccuacaucugcaagauccccggcugcaccaagagauacaccgaccccagcagccugagaaagcacgugaagaccgugcacggccccgacgcccacgugaccaagaagcagagaaacgacgugcaccugagaaccccccugcugaaggagaacggcgacagcgaggccggcaccgagcccggcggccccgagagcaccgaggccagcagcaccagccaggccguggaggacugccugcacgugagagccaucaagaccgagagcagcggccugugccagagcagccccggcgcccagagcagcugcagcagcgagcccagcccccugggcagcgcccccaacaacgacagcggcguggagaugcccggcaccggccccggcagccugggcgaccugaccgcccuggacgacaccccccccggcgccgacaccagcgcccuggccgcccccagcgccggcggccugcagcugagaaagcacaugaccaccaugcacagauucgagcagcugaagaaggagaagcugaagagccugaaggacagcugcagcugggccggccccaccccccacaccagaaacaccaagcugcccccccugcccggcagcggcagcauccuggagaacuucagcggcagcggcggcggcggccccgccggccugcugcccaaccccagacugagcgagcugagcgccagcgaggugaccaugcugagccagcugcaggagagaagagacagcagcaccagcaccgugagcagcgccuacaccgugagcagaagaagcagcggcaucagccccuacuucagcagcagaagaagcagcgaggccagcccccugggcgccggcagaccccacaacgccagcagcgccgacagcuacgaccccaucagcaccgacgccagcagaagaagcagcgaggccagccagugcagcggcggcagcggccugcugaaccugacccccgcccagcaguacagccugagagccaaguacgccgccgccaccggcggccccccccccaccccccugcccggccuggagagaaugagccugagaaccagacuggcccugcuggacgcccccgagagaacccugcccgccggcugccccagaccccugggccccagaagaggcagcgacggccccaccuacggccacggccacgccggcgccgcccccgccuucccccacgaggcccccggcggcggcgccagaagagccagcgaccccgugagaagacccgacgcccugagccugcccagagugcagagauuccacagcacccacaacgugaaccccggcccccugccccccugcgccgacagaagaggccugagacugcagagccaccccagcaccgacggcggccuggccagaggcgccuacagccccagaccccccagcaucagcgagaacguggccauggaggccguggccgccggcguggacggcgccggccccgaggccgaccugggccugcccgaggacgaccuggugcugcccgacgacguggugcaguacaucaaggcccacgccagcggcgcccuggacgagggcaccggccagguguaccccaccgagagcaccggcuucagcgacaaccccagacugcccagccccggccugcacggccagagaagaaugguggccgccgacagcaacgugggccccagcgcccccaugcugggcggcugccagcugggcuucggcgcccccagcagccugaacaagaacaacaugcccgugcaguggaacgaggugagcagcggcaccguggacgcccuggccagccaggugaagcccccccccuucccccagggcaaccuggccguggugcagcagaagcccgccuucggccaguaccccggcuacagcccccagggccugcaggccagccccggcggccuggacagcacccagccccaccugcagcccagaagcggcgcccccagccagggcauccccagagugaacuacaugcagcagcugagacagcccguggccggcagccagugccccggcaugaccaccaccaugagcccccacgccugcuacggccaggugcacccccagcugagccccagcaccaucagcggcgcccugaaccaguucccccagagcugcagcaacaugcccgccaagcccggccaccugggccacccccagcagaccgagguggcccccgaccccaccaccaugggcaacagacacagagagcugggcgugcccgacagcgcccuggccggcgugccccccccccaccccgugcagagcuacccccagcagagccaccaccuggccgccagcaugagccaggagggcuaccaccaggugcccagccugcugcccgccagacagcccggcuucauggagccccagaccggccccaugggcguggccaccgccggcuucggccuggugcagcccagacccccccuggagcccagccccaccggcagacacagaggcgugagagccgugcagcagcagcuggccuacgccagagccaccggccacgccauggccgccaugcccagcagccaggagaccgccgaggccgugcccaagggcgccaugggcaacaugggcagcgugcccccccagccccccccccaggacgccggcggcgcccccgaccacagcaugcuguacuacuacggccagauccacauguacgagcaggacggcggccuggagaaccugggcagcugccaggugaugagaagccagcccccccagccccaggccugccaggacagcauccagccccagccccugcccagccccggcgugaaccaggugagcagcaccguggacagccagcugcuggaggccccccagaucgacuucgacgccaucauggacgacggcgaccacagcagccuguucagcggcgcccugagccccagccugcugcacagccugagccagaacagcagcagacugaccacccccagaaacagccugacccugcccagcauccccgccggcaucagcaacauggccgugggcgacaugagcagcaugcugaccagccuggccgaggagagcaaguuccugaacaugaugaccuaa

SEQ ID NO: 17545 - RNA, 4743 nt, Artificial Sequence
  GLI3__Homo_sapiens__XP_011513575
auggaggcccagagccacagcagcaccaccaccgagaagaagaagguggagaacagcaucgugaagugcagcaccagaaccgacgugagcgagaaggccguggccagcagcaccaccagcaacgaggacgagagccccggccagaccuaccacagagagagaagaaacgccaucaccaugcagccccagaacgugcagggccugagcaaggugagcgaggagcccagcaccagcagcgacgagagagccagccugaucaagaaggagauccacggcagccugccccacguggccgagcccagcgugcccuacagaggcaccguguucgccauggaccccagaaacggcuacauggagccccacuaccaccccccccaccuguuccccgccuuccacccccccgugcccaucgacgccagacaccacgagggcagauaccacuacgaccccagccccauccccccccugcacaugaccagcgcccugagcagcagccccaccuaccccgaccugcccuucaucagaaucagcccccacagaaaccccaccgccgccagcgagagccccuucagccccccccaccccuacaucaaccccuacauggacuacaucagaagccugcacagcagccccagccugagcaugaucagcgccaccagaggccugagccccaccgacgccccccacgccggcgugagccccgccgaguacuaccaccagauggcccugcugaccggccagagaagccccuacgccgacaucauccccagcgccgccaccgccggcaccggcgccauccacauggaguaccugcacgccauggacagcaccagauucagcagccccagacugagcgccagacccagcagaaagagaacccugagcaucagcccccugagcgaccacagcuucgaccugcagaccaugaucagaaccagccccaacagccuggugaccauccugaacaacagcagaagcagcagcagcgccagcggcagcuacggccaccugagcgccagcgccaucagccccgcccugagcuucaccuacagcagcgcccccgugagccugcacaugcaccagcagauccugagcagacagcagagccugggcagcgccuucggccacagccccccccugauccaccccgcccccaccuuccccacccagagacccauccccggcauccccaccgugcugaaccccgugcaggugagcagcggccccagcgagagcagccagaacaagcccaccagcgagagcgccgugagcagcaccggcgaccccaugcacaacaagagaagcaagaucaagcccgacgaggaccugcccagccccggcgccagaggccagcaggagcagcccgagggcaccacccuggugaaggaggagggcgacaaggacgagagcaagcaggagcccgaggugaucuacgagaccaacugccacugggagggcugcgccagagaguucgacacccaggagcagcuggugcaccacaucaacaacgaccacauccacggcgagaagaaggaguucgugugcagauggcuggacugcagcagagagcagaagcccuucaaggcccaguacaugcugguggugcacaugagaagacacaccggcgagaagccccacaagugcaccuucgagggcugcaccaaggccuacagcagacuggagaaccugaagacccaccugagaagccacaccggcgagaagcccuacgugugcgagcacgagggcugcaacaaggccuucagcaacgccagcgacagagccaagcaccagaacagaacccacagcaacgagaagcccuacgugugcaagauccccggcugcaccaagagauacaccgaccccagcagccugagaaagcacgugaagaccgugcacggccccgaggcccacgugaccaagaagcagagaggcgacauccaccccagaccccccccccccagagacagcggcagccacagccagagcagaagccccggcagacccacccagggcgcccugggcgagcagcaggaccugagcaacaccaccagcaagagagaggagugccugcaggugaagaccgugaaggccgagaagcccaugaccagccagcccagccccggcggccagagcagcugcagcagccagcagagccccaucagcaacuacagcaacagcggccuggagcugccccugaccgacggcggcagcaucggcgaccugagcgccaucgacgagacccccaucauggacagcaccaucagcaccgccaccaccgcccuggcccugcaggccagaagaaaccccgccggcaccaaguggauggagcacgugaagcuggagagacugaagcaggugaacggcauguuccccagacugaaccccauccugccccccaaggcccccgccgugagcccccugaucggcaacggcacccagagcaacaacaccugcagccugggcggccccaugacccugcugcccggcagaagcgaccugagcggcguggacgugaccaugcugaacaugcugaacagaagagacagcagcgccagcaccaucagcagcgccuaccugagcagcagaagaagcagcggcaucagccccugcuucagcagcagaagaagcagcgaggccagccaggccgagggcagaccccagaacgugagcguggccgacagcuacgaccccaucagcaccgacgccagcagaagaagcagcgaggccagccagagcgacggccugcccagccugcugagccugacccccgcccagcaguacagacugaaggccaaguacgccgccgccaccggcggccccccccccaccccccugcccaacauggagagaaugagccugaagaccagacuggcccugcugggcgacgcccuggagcccggcguggcccugccccccgugcacgcccccagaagaugcagcgacggcggcgcccacggcuacggcagaagacaccugcagccccacgacgcccccggccacggcgugagaagagccagcgaccccgugagaaccggcagcgagggccuggcccugcccagagugcccagauucagcagccugagcagcugcaacccccccgccauggccaccagcgccgagaagagaagccuggugcugcagaacuacaccagacccgagggcggccagagcagaaacuuccacagcagccccugcccccccagcaucaccgagaacgugacccuggagagccugaccauggacgccgacgccaaccugaacgacgaggacuuccugcccgacgacguggugcaguaccugaacagccagaaccaggccggcuacgagcagcacuuccccagcgcccugcccgacgacagcaaggugccccacggccccggcgacuucgacgcccccggccugcccgacagccacgccggccagcaguuccacgcccuggagcagcccugccccgagggcagcaagaccgaccugcccauccaguggaacgaggugagcagcggcagcgccgaccugagcagcagcaagcugaagugcggccccagacccgccgugccccagaccagagccuucggcuucugcaacggcaugguggugcacccccagaacccccugagaagcggccccgccggcggcuaccagacccugggcgagaacagcaaccccuacggcggccccgagcaccugaugcugcacaacagccccggcagcggcaccagcggcaacgccuuccacgagcagcccugcaaggccccccaguacggcaacugccugaacagacagcccguggcccccggcgcccuggacggcgccugcggcgccggcauccaggccagcaagcugaagagcacccccaugcagggcagcggcggccagcugaacuucggccugcccguggcccccaacgagagcgccggcagcauggugaacggcaugcagaaccaggaccccgugggccagggcuaccuggcccaccagcugcugggcgacagcaugcagcaccccggcgccggcagacccggccagcagaugcugggccagaucagcgccaccagccacaucaacaucuaccagggccccgagagcugccugcccggcgcccacggcaugggcagccagcccagcagccuggccguggugagaggcuaccagcccugcgccagcuucggcggcagcagaagacaggccaugcccagagacagccuggcccugcagagcggccagcugagcgacaccagccagaccugcagagugaacggcaucaagauggagaugaagggccagccccacccccugugcagcaaccugcagaacuacagcggccaguucuacgaccagaccgugggcuucagccagcaggacaccaaggccggcagcuucagcaucagcgacgccagcugccugcugcagggcaccagcgccaagaacagcgagcugcugagccccggcgccaaccaggugaccagcaccguggacagccuggacagccacgaccuggagggcgugcagaucgacuucgacgccaucaucgacgacggcgaccacagcagccugaugagcggcgcccugagccccagcaucauccagaaccugagccacagcagcagcagacugaccacccccagagccagccugcccuuccccgcccugagcaugagcaccaccaacauggccaucggcgacaugagcagccugcugaccagccuggccgaggagagcaaguuccuggccgugaugcaguaa

SEQ ID NO: 17546 - RNA, 801 nt, Artificial Sequence
  GLIPR1__Homo_sapiens__NP_006842
augagagugacccuggccaccaucgccuggauggugagcuucgugagcaacuacagccacaccgccaacauccugcccgacaucgagaacgaggacuucaucaaggacugcgugagaauccacaacaaguucagaagcgaggugaagcccaccgccagcgacaugcuguacaugaccugggaccccgcccuggcccagaucgccaaggccugggccagcaacugccaguucagccacaacaccagacugaagcccccccacaagcugcaccccaacuucaccagccugggcgagaacaucuggaccggcagcgugcccaucuucagcgugagcagcgccaucaccaacugguacgacgagauccaggacuacgacuucaagaccagaaucugcaagaaggugugcggccacuacacccagguggugugggccgacagcuacaaggugggcugcgccgugcaguucugccccaaggugagcggcuucgacgcccugagcaacggcgcccacuucaucugcaacuacggccccggcggcaacuaccccaccuggcccuacaagagaggcgccaccugcagcgccugccccaacaacgacaagugccuggacaaccugugcgugaacagacagagagaccaggugaagagauacuacagcgugguguaccccggcuggcccaucuaccccagaaacagauacaccagccuguuccugaucgugaacagcgugauccugauccugagcgugaucaucaccauccuggugcagcacaaguaccccaaccuggugcugcuggacuaa

SEQ ID NO: 17547 - RNA, 387 nt, Artificial Sequence
  GLIPR2__Homo_sapiens__NP_001273939
augggcaagagcgccagcaagcaguuccacaacgaggugcugaaggcccacaacgaguacagacagaagcacggcgugcccccccugaagcugugcaagaaccugaacagagaggcccagcaguacagcgaggcccuggccagcaccagaauccugaagcacagccccgagagcagcagaggccagugcggcgagaaccuggccugggccagcuacgaccagaccggccacuucaccgccaugguguggaagaacaccaagaagaugggcgugggcaaggccagcgccagcgacggcagcagcuucgugguggccagauacuuccccgccggcaacguggugaacgagggcuucuucgaggagaacgugcugccccccaagaaguaa

SEQ ID NO: 17548 - RNA, 1575 nt, Artificial Sequence
  GLIS2__Homo_sapiens__NP_001305847
augcacagccuggacgagccccuggaccugaagcugagcaucaccaagcugagagccgccagagagaagagagagagaacccugggcguggugagacccagagcccugcacagagagcugggccugguggacgacagccccacccccggcagccccggcagcccccccagcggcuuccugcugaacagcaaguuccccgagaagguggagggcagauucagcgccgccccccugguggaccugagccugagcccccccagcggccuggacagccccaacggcagcagcagccugagccccgagagacagggcaacggcgaccugccccccgugcccagcgccagcgacuuccagccccugagauaccuggacggcgugcccagcagcuuccaguucuuccugccccugggcagcggcggcgcccugcaccugcccgccagcagcuuccugaccccccccaaggacaagugccugagccccgaccugccccugcccaagcagcuggugugcagaugggccaagugcaaccagcuguucgagcugcugcaggaccugguggaccacgugaacgacuaccacgugaagcccgagaaggacgccggcuacugcugccacugggagggcugcgccagacacggcagaggcuucaacgccagauacaagaugcugauccacaucagaacccacaccaacgagaagccccacagaugccccaccugcagcaagagcuucagcagacuggagaaccugaagauccacaacagaagccacaccggcgagaagcccuacgugugccccuacgagggcugcaacaagagauacagcaacagcagcgacagauucaagcacaccagaacccacuacguggacaagcccuacuacugcaagaugcccggcugccacaagagauacaccgaccccagcagccugagaaagcacaucaaggcccacggccacuucgugagccacgagcagcaggagcugcugcagcugagacccccccccaagcccccccugcccgcccccgacggcggccccuacgugagcggcgcccagaucaucauccccaaccccgccgcccuguucggcggccccggccugcccggccugccccugccccuggcccccggcccccuggaccugagcgcccuggccugcggcaacggcggcggcagcggcggcggcggcggcaugggccccggccugcccggccccgugcugccccugaaccuggccaagaacccccugcugcccagccccuucggcgccggcggccugggccugcccguggugagccugcuggccggcgccgccggcggcaaggccgagggcgagaagggcagaggcagcgugcccaccagagcccugggcauggagggccacaagaccccccuggagagaaccgagagcagcugcagcagacccagccccgacggccugccccugcugcccggcaccgugcuggaccugagcaccggcgugaacagcgccgccagcagccccgaggcccuggcccccggcuggguggugaucccccccggcagcgugcugcugaagcccgccguggugaacuaa

SEQ ID NO: 17549 - RNA, 1719 nt, Artificial Sequence
  GLIS3__Homo_sapiens__XP_006716794
augaacggcagaagcugcagcaugagccugcacagaaccagcggcaccccccagggccccagaauggugagcggccaccacauccccgccaucagagcccacagcggcacccccggccccagccccugcggcagcaccagcagccccaccauggccagccuggccaacaaccugcaccugaagaugcccagcggcggcggcauggccccccagaacaacguggccgagagcagaauccaccugcccgcccugagccccagaagacagaugcugaccaacggcaagcccagauuccaggugacccaggccggcggcaugagcggcagccacacccugaagcccaagcagcaggaguucggcagccccuucccccccaaccccggcaagggcgcccugggcuucggcccccagugcaagagcaucggcaagggcagcugcaacaaccugguggugaccagcagccccaugauggugcagagacugggccugaucagcccccccgccagccaggugagcaccgccugcaaccagaucagccccagccugcagagagccaugaacgccgccaaccugaacaucccccccagcgacaccagaagccugaucagcagagagagccuggccagcaccacccugagccugaccgagagccagagcgccagcagcaugaagcaggaguggagccagggcuacagagcccugcccagccugagcaaccacggcagccagaacggccuggaccugggcgaccugcugagccugccccccggcaccagcaugagcagcaacagcgugagcaacagccugcccagcuaccuguucggcaccgagagcagccacagccccuaccccagccccagacacagcagcaccagaagccacagcgccagaagcaagaagagagcccugagccugagcccccugagcgacggcaucggcaucgacuucaacaccaucaucagaaccagccccaccagccugguggccuacaucaacggcagcagagccagccccgccaaccugagcccccagcccgagguguacggccacuuccugggcgugagaggcagcugcaucccccagcccagacccgugcccggcagccagaagggcgugcugguggcccccggcggccuggcccugcccgccuacggcgaggacggcgcccuggagcacgagagaaugcagcagcuggagcacggcggccugcagcccggccuggugaaccacaugguggugcagcacggccugcccggccccgacagccagagcgccggccuguucaagaccgagagacuggaggaguuccccggcagcaccguggaccugccccccgcccccccccugcccccccugccccccccccccggcccccccccccccuaccacgcccacgcccaccugcaccaccccgagcugggcccccacgcccagcagcuggcccugccccaggccacccuggacgacgacggcgagauggacggcaucggcggcaagcacugcugcagauggaucgacugcagcgcccuguacgaccagcaggaggagcuggugagacacaucgagaaggugcacaucgaccagagaaagggcgaggacuucaccugcuucugggccggcugccccagaagauacaagcccuucaacgccagauacaagcugcugauccacaugagagugcacagcggcgagaagcccaacaagugcaccgccgccuaa

SEQ ID NO: 17550 - RNA, 1785 nt, Artificial Sequence
  GLMN__Homo_sapiens__XP_011538848
auggccguggaggagcugcagagcaucaucaagagaugccagauccuggaggagcaggacuucaaggaggaggacuucggccuguuccagcuggccggccagagaugcaucgaggagggccacaccgaccagcugcuggagaucauccagaacgagaagaacaaggugaucaucaagaacaugggcuggaaccuggugggccccguggugagaugccugcugugcaaggacaaggaggacagcaagagaaagguguacuuccugaucuucgaccugcuggugaagcugugcaaccccaaggagcugcugcugggccugcuggagcugaucgaggagcccagcggcaagcagaucagccagagcauccugcugcugcugcagccccugcagaccgugauccagaagcugcacaacaaggccuacagcaucggccuggcccugagcacccuguggaaccagcugagccugcugcccgugcccuacagcaaggagcagauccagauggacgacuacggccugugccagugcugcaaggcccugaucgaguucaccaagcccuucguggaggaggugaucgacaacaaggagaacagccuggagaacgagaagcugaaggacgagcugcugaaguucugcuucaagagccugaagugcccccugcugaccgcccaguucuucgagcagagcgaggagggcggcaacgaccccuucagauacuucgccagcgagaucaucggcuuccugagcgccaucggccaccccuuccccaagaugaucuucaaccacggcagaaagaagagaaccuggaacuaccuggaguucgaggaggaggagaacaagcagcuggccgacagcauggccagccuggccuaccugguguucgugcagggcauccacaucgaccagcugcccauggugcugagcccccuguaccugcugcaguucaacaugggccacaucgagguguuccugcagagaaccgaggagagcgugaucagcaagggccuggagcugcuggagaacagccugcugagaaucgaggacaacagccugcuguaccaguaccuggagaucaagagcuuccugaccgugccccagggccuggugaaggugaugacccugugccccaucgagacccugagaaagaagagccuggccaugcugcagcuguacaucaacaagcuggacagccagggcaaguacacccuguucagaugccugcugaacaccagcaaccacagcggcguggaggccuucaucauccagaacaucaagaaccagaucgacaugagccugaagagaaccagaaacaacaagugguucaccggcccccagcugaucagccugcuggaccuggugcuguuccugcccgagggcgccgagaccgaccugcugcagaacagcgacagaaucauggccagccugaaccugcugagauaccuggugaucaaggacaacgagaacgacaaccagaccggccuguggaccgagcugggcaacaucgagaacaacuuccugaagccccugcacaucggccugaacaugagcaaggcccacuacgaggccgagaucaagaacagccaggaggcccagaagagcaaggaccugugcagcaucaccgugagcggcgaggagauccccaacaugccccccgagaugcagcugaaggugcugcacagcgcccuguucaccuucgaccugaucgagagcgugcuggccagaguggaggagcugaucgagaucaagaccaagagcaccagcgaggagaacaucggcaucaaguaa

SEQ ID NO: 17551 - RNA, 555 nt, Artificial Sequence
  GLO1__Homo_sapiens__NP_006699
auggccgagccccagccccccagcggcggccugaccgacgaggccgcccugagcugcugcagcgacgccgaccccagcaccaaggacuuccugcugcagcagaccaugcugagagugaaggaccccaagaagagccuggacuucuacaccagagugcugggcaugacccugauccagaagugcgacuuccccaucaugaaguucagccuguacuuccuggccuacgaggacaagaacgacauccccaaggagaaggacgagaagaucgccugggcccugagcagaaaggccacccuggagcugacccacaacuggggcaccgaggacgacgagacccagagcuaccacaacggcaacagcgaccccagaggcuucggccacaucggcaucgccgugcccgacguguacagcgccugcaagagauucgaggagcugggcgugaaguucgugaagaagcccgacgacggcaagaugaagggccuggccuucauccaggaccccgacggcuacuggaucgagauccugaaccccaacaagauggccacccugauguaa

SEQ ID NO: 17552 - RNA, 897 nt, Artificial Sequence
  GLOD4__Homo_sapiens__NP_057164
auggccgccagaagagcccugcacuucguguucaaggugggcaacagauuccagaccgccagauucuacagagacgugcugggcaugaaggugcugagacacgaggaguucgaggagggcugcaaggccgccugcaacggccccuacgacggcaaguggagcaagaccauggugggcuucggccccgaggacgaccacuucguggccgagcugaccuacaacuacggcgugggcgacuacaagcugggcaacgacuucaugggcaucacccuggccagcagccaggccgugagcaacgccagaaagcuggaguggccccugaccgagguggccgagggcguguucgagaccgaggcccccggcggcuacaaguucuaccugcagaacagaagccugccccagagcgaccccgugcugaaggugacccuggccgugagcgaccugcagaagagccugaacuacuggugcaaccugcugggcaugaagaucuacgagaaggacgaggagaagcagagagcccugcugggcuacgccgacaaccagugcaagcuggagcugcagggcgugaagggcggcguggaccacgccgccgccuucggcagaaucgccuucagcugcccccagaaggagcugcccgaccuggaggaccugaugaagagagagaaccagaagauccugaccccccuggugagccuggacacccccggcaaggccaccgugcagguggugauccuggccgaccccgacggccacgagaucugcuucgugggcgacgaggccuucagagagcugagcaagauggaccccgagggcagcaagcugcuggacgacgccauggccgccgacaagagcgacgagugguucgccaagcacaacaagcccaaggccagcggcuaa

SEQ ID NO: 17553 - RNA, 1392 nt, Artificial Sequence
  GLP1R__Homo_sapiens__NP_002053
auggccggcgcccccggcccccugagacuggcccugcugcugcugggcauggugggcagagccggccccagaccccagggcgccaccgugagccugugggagaccgugcagaaguggagagaguacagaagacagugccagagaagccugaccgaggaccccccccccgccaccgaccuguucugcaacagaaccuucgacgaguacgccugcuggcccgacggcgagcccggcagcuucgugaacgugagcugccccugguaccugcccugggccagcagcgugccccagggccacguguacagauucugcaccgccgagggccuguggcugcagaaggacaacagcagccugcccuggagagaccugagcgagugcgaggagagcaagagaggcgagagaagcagccccgaggagcagcugcuguuccuguacaucaucuacaccgugggcuacgcccugagcuucagcgcccuggugaucgccagcgccauccugcugggcuucagacaccugcacugcaccagaaacuacauccaccugaaccuguucgccagcuucauccugagagcccugagcguguucaucaaggacgccgcccugaaguggauguacagcaccgccgcccagcagcaccagugggacggccugcugagcuaccaggacagccugagcugcagacugguguuccugcugaugcaguacugcguggccgccaacuacuacuggcugcugguggagggcguguaccuguacacccugcuggccuucagcgugcugagcgagcaguggaucuucagacuguacgugagcaucggcuggggcgugccccugcuguucguggugcccuggggcaucgugaaguaccuguacgaggacgagggcugcuggaccagaaacagcaacaugaacuacuggcugaucaucagacugcccauccuguucgccaucggcgugaacuuccugaucuucgugagagugaucugcaucguggugagcaagcugaaggccaaccugaugugcaagaccgacaucaagugcagacuggccaagagcacccugacccugaucccccugcugggcacccacgaggugaucuucgccuucgugauggacgagcacgccagaggcacccugagauucaucaagcuguucaccgagcugagcuucaccagcuuccagggccugaugguggccauccuguacugcuucgugaacaacgaggugcagcuggaguucagaaagagcugggagagauggagacuggagcaccugcacauccagagagacagcagcaugaagccccugaagugccccaccagcagccugagcagcggcgccaccgccggcagcagcauguacaccgccaccugccaggccagcugcagcuaa

SEQ ID NO: 17554 - RNA, 1662 nt, Artificial Sequence
  GLP2R__Homo_sapiens__NP_004237
augaagcugggcagcagcagagccggccccggcagaggcagcgccggccugcugcccggcgugcacgagcugcccaugggcauccccgcccccuggggcaccagcccccugagcuuccacagaaagugcagccugugggcccccggcagacccuuccugacccuggugcugcuggugagcaucaagcaggugaccggcagccugcuggaggagaccaccagaaagugggcccaguacaagcaggccugccugagagaccugcugaaggagcccagcggcaucuucugcaacggcaccuucgaccaguacgugugcuggccccacagcagccccggcaacgugagcgugcccugccccagcuaccugcccugguggagcgaggagagcagcggcagagccuacagacacugccuggcccagggcaccuggcagaccaucgagaacgccaccgacaucuggcaggacgacagcgagugcagcgagaaccacagcuucaagcagaacguggacagauacgcccugcugagcacccugcagcugauguacaccgugggcuacagcuucagccugaucagccuguuccuggcccugacccugcugcuguuccugagaaagcugcacugcaccagaaacuacauccacaugaaccuguucgccagcuucauccugagaacccuggccgugcuggugaaggacgugguguucuacaacagcuacagcaagagacccgacaacgagaacggcuggaugagcuaccugagcgagaugagcaccagcugcagaagcgugcaggugcugcugcacuacuucgugggcgccaacuaccuguggcugcugguggagggccuguaccugcacacccugcuggagcccaccgugcugcccgagagaagacuguggcccagauaccugcugcugggcugggccuuccccgugcuguucguggugcccuggggcuucgccagagcccaccuggagaacaccggcugcuggaccaccaacggcaacaagaagaucugguggaucaucagaggccccaugaugcugugcgugaccgugaacuucuucaucuuccugaagauccugaagcugcugaucagcaagcugaaggcccaccagaugugcuucagagacuacaaguacagacuggccaagagcacccuggugcugaucccccugcugggcgugcacgagauccuguucagcuucaucaccgacgaccagguggagggcuucgccaagcugaucagacuguucauccagcugacccugagcagcuuccacggcuuccugguggcccugcaguacggcuucgccaacggcgaggugaaggccgagcugagaaaguacugggugagauuccugcuggccagacacagcggcugcagagccugcgugcugggcaaggacuucagauuccugggcaagugccccaagaagcugagcgagggcgacggcgccgagaagcugagaaagcugcagcccagccugaacagcggcagacugcugcaccuggccaugagaggccugggcgagcugggcgcccagccccagcaggaccacgccagauggcccagaggcagcagccugagcgagugcagcgagggcgacgugaccauggccaacaccauggaggagauccuggaggagagcgagaucuaa

SEQ ID NO: 17555 - RNA, 1350 nt, Artificial Sequence
  GLRA1__Homo_sapiens__NP_000162
auguacagcuucaacacccugagacuguaccugugggagaccaucguguucuucagccuggccgccagcaaggaggccgaggccgccagaagcgcccccaagcccaugagccccagcgacuuccuggacaagcugaugggcagaaccagcggcuacgacgccagaaucagacccaacuucaagggcccccccgugaacgugagcugcaacaucuucaucaacagcuucggcagcaucgccgagaccaccauggacuacagagugaacaucuuccugagacagcaguggaacgaccccagacuggccuacaacgaguaccccgacgacagccuggaccuggaccccagcaugcuggacagcaucuggaagcccgaccuguucuucgccaacgagaagggcgcccacuuccacgagaucaccaccgacaacaagcugcugagaaucagcagaaacggcaacgugcuguacagcaucagaaucacccugacccuggccugccccauggaccugaagaacuuccccauggacgugcagaccugcaucaugcagcuggagagcuucggcuacaccaugaacgaccugaucuucgaguggcaggagcagggcgccgugcagguggccgacggccugacccugccccaguucauccugaaggaggagaaggaccugagauacugcaccaagcacuacaacaccggcaaguucaccugcaucgaggccagauuccaccuggagagacagaugggcuacuaccugauccagauguacauccccagccugcugaucgugauccugagcuggaucagcuucuggaucaacauggacgccgcccccgccagagugggccugggcaucaccaccgugcugaccaugaccacccagagcagcggcagcagagccagccugcccaaggugagcuacgugaaggccaucgacaucuggauggccgugugccugcuguucguguucagcgcccugcuggaguacgccgccgugaacuucgugagcagacagcacaaggagcugcugagauucagaagaaagagaagacaccacaaggaggacgaggccggcgagggcagauucaacuucagcgccuacggcaugggccccgccugccugcaggccaaggacggcaucagcgugaagggcgccaacaacagcaacaccaccaaccccccccccgcccccagcaagagccccgaggagaugagaaagcuguucauccagagagccaagaagaucgacaagaucagcagaaucggcuuccccauggccuuccugaucuucaacauguucuacuggaucaucuacaagaucgugagaagagaggacgugcacaaccaguaa

SEQ ID NO: 17556 - RNA, 1359 nt, Artificial Sequence
  GLRA2__Homo_sapiens__NP_001112357
augaacagacagcuggugaacauccugaccgcccuguucgccuucuuccuggagaccaaccacuucagaaccgccuucugcaaggaccacgacagcagaagcggcaagcagcccagccagacccugagccccagcgacuuccuggacaagcugaugggcagaaccagcggcuacgacgccagaaucagacccaacuucaagggcccccccgugaacgugaccugcaacaucuucaucaacagcuucggcagcgugaccgagaccaccauggacuacagagugaacaucuuccugagacagcaguggaacgacagcagacuggccuacagcgaguaccccgacgacagccuggaccuggaccccagcaugcuggacagcaucuggaagcccgaccuguucuucgccaacgagaagggcgccaacuuccacgacgugaccaccgacaacaagcugcugagaaucagcaagaacggcaaggugcuguacagcaucagacugacccugacccugagcugccccauggaccugaagaacuuccccauggacgugcagaccugcaccaugcagcuggagagcuucggcuacaccaugaacgaccugaucuucgaguggcugagcgacggccccgugcagguggccgagggccugacccugccccaguucauccugaaggaggagaaggagcugggcuacugcaccaagcacuacaacaccggcaaguucaccugcaucgaggugaaguuccaccuggagagacagaugggcuacuaccugauccagauguacauccccagccugcugaucgugauccugagcugggugagcuucuggaucaacauggacgccgcccccgccagaguggcccugggcaucaccaccgugcugaccaugaccacccagagcagcggcagcagagccagccugcccaaggugagcuacgugaaggccaucgacaucuggauggccgugugccugcuguucguguucgccgcccugcuggaguacgccgccgugaacuucgugagcagacagcacaaggaguuccugagacugagaagaagacagaagagacagaacaaggaggaggacgugaccagagagagcagauucaacuucagcggcuacggcaugggccacugccugcaggugaaggacggcaccgccgugaaggccacccccgccaacccccugccccagccccccaaggacggcgacgccaucaagaagaaguucguggacagagccaagagaaucgacaccaucagcagagccgccuucccccuggccuuccugaucuucaacaucuucuacuggaucaccuacaagaucaucagacacgaggacgugcacaagaaguaa

SEQ ID NO: 17557 - RNA, 1350 nt, Artificial Sequence
  GLRA3__Homo_sapiens__NP_001036008
auggcccacgugagacacuucagaacccuggugagcggcuucuacuucugggaggccgcccugcugcugagccugguggccaccaaggagaccgacagcgccagaagcagaagcgcccccaugagccccagcgacuuccuggacaagcugaugggcagaaccagcggcuacgacgccagaaucagacccaacuucaagggcccccccgugaacgugaccugcaacaucuucaucaacagcuucggcagcaucgccgagaccaccauggacuacagagugaacaucuuccugagacagaaguggaacgaccccagacuggccuacagcgaguaccccgacgacagccuggaccuggaccccagcaugcuggacagcaucuggaagcccgaccuguucuucgccaacgagaagggcgccaacuuccacgaggugaccaccgacaacaagcugcugagaaucuucaagaacggcaacgugcuguacagcaucagacugacccugacccugagcugccccauggaccugaagaacuuccccauggacgugcagaccugcaucaugcagcuggagagcuucggcuacaccaugaacgaccugaucuucgaguggcaggacgaggcccccgugcagguggccgagggccugacccugccccaguuccugcugaaggaggagaaggaccugagauacugcaccaagcacuacaacaccggcaaguucaccugcaucgaggugagauuccaccuggagagacagaugggcuacuaccugauccagauguacauccccagccugcugaucgugauccugagcugggugagcuucuggaucaacauggacgccgcccccgccagaguggcccugggcaucaccaccgugcugaccaugaccacccagagcagcggcagcagagccagccugcccaaggugagcuacgugaaggccaucgacaucuggauggccgugugccugcuguucguguucagcgcccugcuggaguacgccgccgugaacuucgugagcagacagcacaaggagcugcugagauucagaagaaagagaaagaacaaggacgacgaggugagagagagcagauucagcuucaccgccuacggcaugggccccugccugcaggccaaggacggcaugacccccaagggccccaaccaccccgugcaggugaugcccaagagccccgacgagaugagaaagguguucaucgacagagccaagaagaucgacaccaucagcagagccugcuucccccuggccuuccugaucuucaacaucuucuacugggugaucuacaagauccugagacacgaggacauccaccagcagcaggacuaa

SEQ ID NO: 17558 - RNA, 1494 nt, Artificial Sequence
  GLRB__Homo_sapiens__NP_001159532
augaaguuccugcugaccaccgccuuccugauccugaucagccuguggguggaggaggccuacagcaaggagaagagcagcaagaagggcaagggcaagaagaagcaguaccugugccccagccagcagagcgccgaggaccuggccagagugcccgccaacagcaccagcaacauccugaacagacugcuggugagcuacgaccccagaaucagacccaacuucaagggcauccccguggacgugguggugaacaucuucaucaacagcuucggcagcauccaggagaccaccauggacuacagagugaacaucuuccugagacagaaguggaacgaccccagacugaagcugcccagcgacuucagaggcagcgacgcccugaccguggaccccaccauguacaagugccuguggaagcccgaccuguucuucgccaacgagaagagcgccaacuuccacgacgugacccaggagaacauccugcuguucaucuucagagacggcgacgugcuggugagcaugagacugagcaucacccugagcugcccccuggaccugacccuguuccccauggacacccagagaugcaagaugcagcuggagagcuucggcuacaccaccgacgaccugagauucaucuggcagagcggcgaccccgugcagcuggagaagaucgcccugccccaguucgacaucaagaaggaggacaucgaguacggcaacugcaccaaguacuacaagggcaccggcuacuacaccugcguggaggugaucuucacccugagaagacaggugggcuucuacaugaugggcguguacgcccccacccugcugaucguggugcugagcuggcugagcuucuggaucaaccccgacgccagcgccgccagagugccccugggcaucuucagcgugcugagccuggccagcgagugcaccacccuggccgccgagcugcccaaggugagcuacgugaaggcccuggacguguggcugaucgccugccugcuguucggcuucgccagccugguggaguacgccguggugcaggugaugcugaacaaccccaagagaguggaggccgagaaggccagaaucgccaaggccgagcaggccgacggcaagggcggcaacguggccaagaagaacaccgugaacggcaccggcacccccgugcacaucagcacccugcaggugggcgagaccagaugcaagaaggugugcaccagcaagagcgaccugagaagcaacgacuucagcaucgugggcagccugcccagagacuucgagcugagcaacuacgacugcuacggcaagcccaucgaggugaacaacggccugggcaagagccaggccaagaacaacaagaagcccccccccgccaagcccgugauccccaccgccgccaagagaaucgaccuguacgccagagcccuguuccccuucugcuuccuguucuucaacgugaucuacuggagcaucuaccuguaa

SEQ ID NO: 17559 - RNA, 498 nt, Artificial Sequence
  GLRX2__Homo_sapiens__NP_057150
augaaccccagagacaagcaggugagcagauucagcccccugaaggacguguacaccuggguggcccuggccggcauccagagaagcggcagccccggcagaaccagaagcgccgccagaagaauggagagcaacaccagcagcagccuggagaaccuggccaccgcccccgugaaccagauccaggagaccaucagcgacaacugcguggugaucuucagcaagaccagcugcagcuacugcaccauggccaagaagcuguuccacgacaugaacgugaacuacaaggugguggagcuggaccugcuggaguacggcaaccaguuccaggacgcccuguacaagaugaccggcgagagaaccgugcccagaaucuucgugaacggcaccuucaucggcggcgccaccgacacccacagacugcacaaggagggcaagcugcugccccuggugcaccagugcuaccugaagaagagcaagagaaaggaguuccaguaa

SEQ ID NO: 17560 - RNA, 1008 nt, Artificial Sequence
  GLRX3__Homo_sapiens__NP_006532
auggccgccggcgccgccgaggccgccguggccgccguggaggaggugggcagcgccggccaguucgaggagcugcugagacugaaggccaagagccugcugguggugcacuucugggcccccugggccccccagugcgcccagaugaacgaggugauggccgagcuggccaaggagcugccccaggugagcuucgugaagcuggaggccgagggcgugcccgaggugagcgagaaguacgagaucagcagcgugcccaccuuccuguucuucaagaacagccagaagaucgacagacuggacggcgcccacgcccccgagcugaccaagaaggugcagagacacgccagcagcggcagcuuccugcccagcgccaacgagcaccugaaggaggaccugaaccugagacugaagaagcugacccacgccgcccccugcaugcuguucaugaagggcaccccccaggagcccagaugcggcuucagcaagcagaugguggagauccugcacaagcacaacauccaguucagcagcuucgacaucuucagcgacgaggaggugagacagggccugaaggccuacagcagcuggcccaccuacccccagcuguacgugagcggcgagcugaucggcggccuggacaucaucaaggagcuggaggccagcgaggagcuggacaccaucugccccaaggcccccaagcuggaggagagacugaaggugcugaccaacaaggccagcgugaugcuguucaugaagggcaacaagcaggaggccaagugcggcuucagcaagcagauccuggagauccugaacagcaccggcguggaguacgagaccuucgacauccuggaggacgaggaggugagacagggccugaaggccuacagcaacuggcccaccuacccccagcuguacgugaagggcgagcuggugggcggccuggacaucgugaaggagcugaaggagaacggcgagcugcugcccauccugagaggcgagaacuaa

SEQ ID NO: 17561 - RNA, 474 nt, Artificial Sequence
  GLRX5__Homo_sapiens__NP_057501
augagcggcagccugggcagagccgccgccgcccugcugagauggggcagaggcgccggcggcggcggccuguggggccccggcgugagagccgccggcagcggcgccggcggcggcggcagcgccgagcagcuggacgcccuggugaagaaggacaagguggugguguuccugaagggcacccccgagcagccccagugcggcuucagcaacgccguggugcagauccugagacugcacggcgugagagacuacgccgccuacaacgugcuggacgaccccgagcugagacagggcaucaaggacuacagcaacuggcccaccaucccccagguguaccugaacggcgaguucgugggcggcugcgacauccugcugcagaugcaccagaacggcgaccugguggaggagcugaagaagcugggcauccacagcgcccugcuggacgagaagaaggaccaggacagcaaguaa

SEQ ID NO: 17562 - RNA, 321 nt, Artificial Sequence
  GLRX__Homo_sapiens__NP_001230588
auggcccaggaguucgugaacugcaagauccagcccggcaagguggugguguucaucaagcccaccugccccuacugcagaagagcccaggagauccugagccagcugcccaucaagcagggccugcuggaguucguggacaucaccgccaccaaccacaccaacgagauccaggacuaccugcagcagcugaccggcgccagaaccgugcccagaguguucaucggcaaggacugcaucggcggcugcagcgaccuggugagccugcagcagagcggcgagcugcugaccagacugaagcagaucggcgcccugcaguaa

SEQ ID NO: 17563 - RNA, 1809 nt, Artificial Sequence
  GLS2__Homo_sapiens__NP_037399
augagaagcaugaaggcccugcagaaggcccugagcagagccggcagccacugcggcagaggcggcuggggccaccccagcagaagcccccugcugggcggcggcgugagacaccaccugagcgaggccgccgcccagggcagagagaccccccacagccaccagccccagcaccaggaccacgacagcagcgagagcggcaugcugagcagacugggcgaccugcuguucuacaccaucgccgagggccaggagagaauccccauccacaaguucaccaccgcccugaaggccaccggccugcagaccagcgaccccagacugagagacugcaugagcgagaugcacagaguggugcaggagagcagcagcggcggccugcuggacagagaccuguucagaaagugcgugagcagcaacaucgugcugcugacccaggccuucagaaagaaguucgugauccccgacuucgaggaguucaccggccacguggacagaaucuucgaggacgugaaggagcugaccggcggcaagguggccgccuacaucccccagcuggccaagagcaaccccgaccuguggggcgugagccugugcaccguggacggccagagacacagcgugggccacaccaagauccccuucugccugcagagcugcgugaagccccugaccuacgccaucagcaucagcacccugggcaccgacuacgugcacaaguucgugggcaaggagcccagcggccugagauacaacaagcugagccugaacgaggagggcaucccccacaaccccauggugaacgccggcgccaucguggugagcagccugaucaagauggacugcaacaaggccgagaaguucgacuucgugcugcaguaccugaacaagauggccggcaacgaguacaugggcuucagcaacgccaccuuccagagcgagaaggagaccggcgacagaaacuacgccaucggcuacuaccugaaggagaagaagugcuuccccaagggcguggacaugauggccgcccuggaccuguacuuccagcugugcagcguggaggugaccugcgagagcggcagcgugauggccgccacccuggccaacggcggcaucugccccaucaccggcgagagcgugcugagcgccgaggccgugagaaacacccugagccugaugcacagcugcggcauguacgacuucagcggccaguucgccuuccacgugggccugcccgccaagagcgccgugagcggcgccauccugcugguggugcccaacgugaugggcaugaugugccugagccccccccuggacaagcugggcaacagccacagaggcaccagcuucugccagaagcuggugagccuguucaacuuccacaacuacgacaaccugagacacugcgccagaaagcuggaccccagaagagagggcgccgagaucagaaacaagaccguggugaaccugcuguucgccgccuacagcggcgacgugagcgcccugagaagauucgcccugagcgccauggacauggagcagaaggacuacgacagcagaaccgcccugcacguggccgccgccgagggccacaucgagguggugaaguuccugaucgaggccugcaaggugaaccccuucgccaaggacagauggggcaacaucccccuggacgacgccgugcaguucaaccaccuggagguggugaagcugcugcaggacuaccaggacagcuacacccugagcgagacccaggccgaggccgccgccgaggcccugagcaaggagaaccuggagagcaugguguaa

SEQ ID NO: 17564 - RNA, 1797 nt, Artificial Sequence
  GLS__Homo_sapiens__NP_001243239
augaugagacugagaggcagcggcaugcugagagaccugcugcugagaagccccgccggcgugagcgccacccugagaagagcccagccccuggugacccugugcagaagacccagaggcggcggcagacccgccgccggccccgccgccgccgccagacugcaccccugguggggcggcggcggcuggcccgccgagccccuggccagaggccugagcagcagccccagcgagauccugcaggagcugggcaagggcagcacccacccccagcccggcgugagcccccccgccgcccccgccgcccccggccccaaggacggccccggcgagaccgacgccuucggcaacagcgagggcaaggagcugguggccagcggcgagaacaagaucaagcagggccugcugcccagccuggaggaccugcuguucuacaccaucgccgagggccaggagaagauccccgugcacaaguucaucaccgcccugaagagcaccggccugagaaccagcgaccccagacugaaggagugcauggacaugcugagacugacccugcagaccaccagcgacggcgugaugcuggacaaggaccuguucaagaagugcgugcagagcaacaucgugcugcugacccaggccuucagaagaaaguucgugauccccgacuucaugagcuucaccagccacaucgacgagcuguacgagagcgccaagaagcagagcggcggcaagguggccgacuacaucccccagcuggccaaguucagccccgaccuguggggcgugagcgugugcaccguggacggccagagacacagcaccggcgacaccaaggugcccuucugccugcagagcugcgugaagccccugaaguacgccaucgccgugaacgaccugggcaccgaguacgugcacagauacgugggcaaggagcccagcggccugagauucaacaagcuguuccugaacgaggacgacaagccccacaaccccauggugaacgccggcgccaucguggugaccagccugaucaagcagggcgugaacaacgccgagaaguucgacuacgugaugcaguuccugaacaagauggccggcaacgaguacgugggcuucagcaacgccaccuuccagagcgagagagagagcggcgacagaaacuucgccaucggcuacuaccugaaggagaagaagugcuuccccgagggcaccgacauggugggcauccuggacuucuacuuccagcugugcagcaucgaggugaccugcgagagcgccagcgugauggccgccacccuggccaacggcggcuucugccccaucaccggcgagagagugcugagccccgaggccgugagaaacacccugagccugaugcacagcugcggcauguacgacuucagcggccaguucgccuuccacgugggccugcccgccaagagcggcguggccggcggcauccugcugguggugcccaacgugaugggcaugaugugcuggagccccccccuggacaagaugggcaacagcgugaagggcauccacuucugccacgaccuggugagccugugcaacuuccacaacuacgacaaccugagacacuucgccaagaagcuggaccccagaagagagggcggcgaccagagacacagcuucggcccccuggacuacgagagccugcagcaggagcuggcccugaaggagaccguguggaagaaggugagccccgagagcaacgaggacaucagcaccaccgugguguacagaauggagagccugggcgagaagagcuaa

SEQ ID NO: 17565 - RNA, 801 nt, Artificial Sequence
  GLT1D1__Homo_sapiens__NP_653270
augagacugcuguuccuggccgugcugagaccccacaccggcaacgccgugaccgcccagagagugagagcccaccuggaggccgccggccacgugugcgugcugaaggacgccuucgacuucgagagcagaagcgagaucgccaaccugauccuggccgagaacugcgaggccgcccuggcccugcaccuguacagaggcggcagacugcugcagggccacagaauccccuucggcgugaucuucggcggcaccgacgugaacgaggacgccaaccaggccgagaagaacaccgugaugggcagagugcuggaggaggccagauucgccguggccuucaccgagagcaugaaggagauggcccaggcccaguggguggaccccguguucaccagagaggugaaggccaaggugaagagagccgccggcgugagacugaucggcgagaugccccaggaggaccugcacgccguggugaagaacugcuucgccguggugaacagcagcgugagcgagggcaugagcgccgccauccuggaggccauggaccuggaggugcccgugcuggccagaaacauccccggcaacgccgccguggugaagcacgaggugaccggccugcuguucagcaacccccaggaguucgugcaccuggccaagagacuggugagcgaccccgcccuggagaaggagaucguggugaacggcagagaguacgugagaauguaccacagcuggcagguggagagagacaccuaccagcagcugaucagaaagcuggagggcagcaccgaggacuaa

SEQ ID NO: 17566 - RNA, 831 nt, Artificial Sequence
  GLT6D1__Homo_sapiens__XP_011516939
augaacagcaagagaaugcugcugcuggugcuguucgccuucagccugaugcugguggagagauacuucagaaaccaccagguggaggagcugagacugagcgacugguuccaccccagaaagagacccgacgugaucaccaagaccgacuggcuggcccccgugcugugggagggcaccuucgacagaagagugcuggagaagcacuacagaagaagaaacaucaccgugggccuggccguguucgccaccggcagauucgccgaggaguaccugagacccuuccugcacagcgccaacaagcacuucaugaccggcuacagagugaucuucuacaucaugguggacgccuucuucaagcugcccgacaucgagcccagcccccugagaaccuucaaggccuucaaggugggcaccgagagaugguggcuggacggcccccuggugcacgugaagagccugggcgagcacaucgccagccacauccaggacgagguggacuuccuguucagcauggccgccaaccagguguuccagaacgaguucggcguggagacccugggcccccugguggcccagcugcacgccuggugguacuucagaaacaccaagaacuuccccuacgagagaagacccaccagcgccgccugcauccccuucggccagggcgacuucuacuacggcaaccugauggugggcggcaccccccacaacauccuggacuucaucaaggaguaccugaacggcgugauccacgacaucaagaacggccugaacagcaccuacgagaagcaccugaacaaguacuucuaccugaacaagcccaccuaa

SEQ ID NO: 17567 - RNA, 1116 nt, Artificial Sequence
  GLT8D1__Homo_sapiens__NP_001010983
augagcuucagaaaggugaacaucaucauccuggugcuggccguggcccuguuccugcuggugcugcaccacaacuuccugagccugagcagccugcugagaaacgaggugaccgacagcggcaucgugggcccccagcccaucgacuucgugcccaacgcccugagacacgccguggacggcagacaggaggagauccccguggugaucgccgccagcgaggacagacugggcggcgccaucgccgccaucaacagcauccagcacaacaccagaagcaacgugaucuucuacaucgugacccugaacaacaccgccgaccaccugagaagcuggcugaacagcgacagccugaagagcaucagauacaagaucgugaacuucgaccccaagcugcuggagggcaaggugaaggaggaccccgaccagggcgagagcaugaagccccugaccuucgccagauucuaccugcccauccuggugcccagcgccaagaaggccaucuacauggacgacgacgugaucgugcagggcgacauccuggcccuguacaacaccgcccugaagcccggccacgccgccgccuucagcgaggacugcgacagcgccagcaccaagguggugaucagaggcgccggcaaccaguacaacuacaucggcuaccuggacuacaagaaggagagaaucagaaagcugagcaugaaggccagcaccugcagcuucaaccccggcguguucguggccaaccugaccgaguggaagagacagaacaucaccaaccagcuggagaaguggaugaagcugaacguggaggagggccuguacagcagaacccuggccggcagcaucaccacccccccccugcugaucguguucuaccagcagcacagcaccaucgaccccauguggaacgugagacaccugggcagcagcgccggcaagagauacagcccccaguucgugaaggccgccaagcugcugcacuggaacggccaccugaagcccuggggcagaaccgccagcuacaccgacgugugggagaagugguacauccccgaccccaccggcaaguucaaccugaucagaagauacaccgagaucagcaacaucaaguaa

SEQ ID NO: 17568 - RNA, 4683 nt, Artificial Sequence
  GLTSCR1__Homo_sapiens__XP_005258890
auggacgacgaggacggcagaugccugcuggacgugaucugcgacccccaggcccugaacgacuuccugcacggcagcgagaagcuggacagcgacgaccugcuggacaaccccggcgaggcccagagcgccuucuacgagggccccggccugcacgugcaggaggccagcggcaaccaccugaaccccgagcccaaccagcccgcccccagcguggaccuggacuuccuggaggacgacauccugggcagccccgccaccggcggcggcggcggcggcagcggcggcgccgaccagcccugcgacauccugcagcagagccugcaggaggccaacaucaccgagcagacccuggaggccgaggccgagcuggaccugggccccuuccagcugcccacccugcagcccgccgacggcggcgccggccccaccggcgccggcggcgccgccgccguggccgccggcccccaggcccuguuccccggcagcaccgaccugcugggccugcagggcccccccaccgugcugacccaccaggcccuggugcccccccaggacguggugaacaaggcccugagcgugcagcccuuccugcagcccgugggccugggcaacgugacccugcagcccauccccggccugcagggccugcccaacggcagccccggcggcgccaccgccgccacccugggccuggcccccauccagguggugggccagcccgugauggcccugaacacccccaccagccagcugcuggccaagcaggugcccgugagcggcuaccuggccagcgccgccggccccagcgagcccgugacccuggccagcgccggcgugagcccccagggcgccggccuggugauccagaagaaccugagcgccgccguggccaccacccugaacggcaacagcguguucggcggcgccggcgccgccagcgcccccaccggcacccccagcggccagccccuggccguggcccccggccugggcagcagcccccuggugcccgcccccaacgugauccugcacagaacccccacccccauccagcccaagcccgccggcgugcugccccccaagcuguaccagcugacccccaagcccuucgcccccgccggcgccacccugaccauccagggcgagcccggcgcccugccccagcagcccaaggccccccagaaccugaccuucauggccgccggcaaggccggccagaacguggugcugagcggcuuccccgcccccgcccugcaggccaacguguucaagcagccccccgccaccaccaccggcgccgcccccccccagccccccggcgcccugagcaagcccaugagcgugcaccugcugaaccagggcagcagcaucgugauccccgcccagcacaugcugcccggccagaaccaguuccugcugcccggcgcccccgccgugcagcugccccagcagcugagcgcccugcccgccaacgugggcggccagauccuggccgccgccgccccccacaccggcggccagcugaucgccaaccccauccugaccaaccagaaccuggccggcccccugagccugggccccgugcuggccccccacagcggcgcccacagcgcccacauccugagcgccgcccccauccaggugggccagcccgcccuguuccagaugcccgugagccuggccgccggcagccugcccacccagagccagcccgcccccgccggccccgccgccaccaccgugcugcagggcgugacccugccccccagcgccguggccaugcugaacacccccgacggccuggugcagcccgccacccccgccgccgccaccggcgaggccgcccccgugcugaccgugcagcccgccccccaggccccccccgccgugagcaccccccugccccugggccugcagcagccccaggcccagcagcccccccaggcccccaccccccaggccgccgcccccccccaggccaccaccccccagcccagccccggccuggccagcagccccgagaagaucgugcugggccagccccccagcgccacccccaccgccauccugacccaggacagccugcagauguuccugccccaggagagaagccagcagccccugagcgccgagggcccccaccugagcgugcccgccagcgugaucgugagcgcccccccccccgcccaggaccccgcccccgccacccccguggccaagggcgccggccugggcccccaggcccccgacagccaggccagccccgcccccgccccccagauccccgccgccgccccccugaagggccccggccccagcagcagccccagccugccccaccaggccccccugggcgacagcccccaccugcccagcccccaccccaccagaccccccagcagaccccccagcagaccccagagcgugagcagaccccccagcgagcccccccugcaccccugcccccccccccaggccccccccacccugcccggcaucuucgugauccagaaccagcugggcgugcccccccccgccagcaaccccgcccccaccgcccccggccccccccagcccccccugagaccccagagccagccccccgagggcccccugccccccgccccccaccugccccccagcagcaccagcagcgccguggccagcagcagcgagaccagcagcagacugcccgcccccacccccagcgacuuccagcugcaguucccccccagccagggcccccacaagagccccacccccccccccacccugcaccuggugcccgagcccgccgccccccccccccccccccccagaaccuuccagauggugaccacccccuuccccgcccugccccagcccaaggcccugcuggagagauuccaccaggugcccagcggcaucauccugcagaacaaggccggcggcgcccccgccgccccccagaccagcaccagccugggcccccugaccagccccgccgccagcgugcuggugagcggccaggcccccagcggcacccccaccgcccccagccacgcccccgcccccgcccccauggccgccaccggccugcccccccugcugcccgccgagaacaaggccuucgccagcaaccugcccacccugaacguggccaaggccgccagcagcggccccggcaagcccagcggccugcaguacgagagcaagcugagcggccugaagaagccccccacccugcagcccagcaaggaggccugcuuccuggagcaccugcacaagcaccagggcagcgugcugcaccccgacuacaagaccgccuuccccagcuucgaggacgcccugcacagacugcugcccuaccacguguaccagggcgcccugcccagccccagcgacuaccacaagguggacgaggaguucgagaccgugagcacccagcugcugaagagaacccaggccaugcugaacaaguacagacugcugcugcuggaggagagcagaagagugagccccagcgccgagauggugaugaucgacagaauguucauccaggaggagaagaccacccuggcccuggacaagcagcuggccaaggagaagcccgacgaguacgugagcagcagcagaagccugggccugcccaucgccgccagcagcgagggccacagacugcccggccacggcccccugagcagcagcgcccccggcgccagcacccagccccccccccaccugcccaccaagcuggugaucagacacggcggcgccggcggcagccccagcgugaccugggccagagccagcagcagccugagcagcagcagcagcagcagcagcgccgccagcagccuggacgccgacgaggacggccccaugcccagcagaaacagaccccccaucaagaccuacgaggccagaagcagaaucggccugaagcugaagaucaagcaggaggccggccugagcaagguggugcacaacaccgcccuggaccccgugcaccagcccccccccccccccgccacccugaagguggccgagcccccccccagacccccccccccccccccccccaccggccagaugaacggcaccguggaccaccccccccccgccgcccccgagagaaagccccugggcaccgccccccacugccccagacugccccugagaaagaccuacagagagaacgugggcggccccggcgcccccgagggcacccccgccggcagagccagaggcggcagccccgccccccugcccgccaagguggacgaggccaccagcggccugaucagagagcuggccgccguggaggacgagcuguaccagagaaugcugaagggccccccccccgagcccgccgccagcgccgcccagggcaccggcgaccccgacugggaggcccccggccugccccccgccaagagaagaaagagcgagagccccgacguggaccaggccagcuucagcagcgacagcccccaggacgacacccugaccgagcaccugcagagcgccaucgacagcauccugaaccugcagcaggcccccggcagaacccccgcccccagcuacccccacgccgccagcgccggcacccccgccagcccccccccccugcacagacccgaggccuacccccccagcagccacaacggcggccugggcgccagaacccugaccagauaa

SEQ ID NO: 17569 - RNA, 1437 nt, Artificial Sequence
  GLTSCR2__Homo_sapiens__NP_056525
auggccgccggcggcagcggcgugggcggcaagagaagcagcaagagcgacgccgacagcggcuuccugggccugagacccaccagcguggaccccgcccugagaagaagaagaagaggccccagaaacaagaagagaggcuggagaagacuggcccaggagccccugggccuggagguggaccaguuccuggaggacgugagacugcaggagagaaccagcggcggccugcugagcgaggcccccaacgagaagcuguucuucguggacaccggcagcaaggagaagggccugaccaagaagagaaccaaggugcagaagaagagccugcugcugaagaagccccugagaguggaccugauccuggagaacaccagcaaggugcccgcccccaaggacgugcuggcccaccaggugcccaacgccaagaagcugagaagaaaggagcagcugugggagaagcuggccaagcagggcgagcugcccagagaggugagaagagcccaggccagacugcugaaccccagcgccaccagagccaagcccggcccccaggacaccguggagagacccuucuacgaccugugggccagcgacaacccccuggacagaccccuggugggccaggacgaguucuuccuggagcagaccaagaagaagggcgugaagagacccgccagacugcacaccaagcccagccaggcccccgccguggagguggcccccgccggcgccagcuacaaccccagcuucgaggaccaccagacccugcugagcgccgcccacgagguggagcugcagagacagaaggaggccgagaagcuggagagacagcuggcccugcccgccaccgagcaggccgccacccaggagagcaccuuccaggagcugugcgagggccugcuggaggagagcgacggcgagggcgagcccggccagggcgagggccccgaggccggcgacgccgaggugugccccacccccgccagacuggccaccaccgagaagaagaccgagcagcagagaagaagagagaaggccgugcacagacugagagugcagcaggccgcccugagagccgccagacugagacaccaggagcuguucagacugagaggcaucaaggcccagguggcccugagacuggccgagcuggccagaagacagagaagaagacaggccagaagagaggccgaggccgacaagcccagaagacugggcagacugaaguaccaggcccccgacaucgacgugcagcugagcagcgagcugaccgacagccugagaacccugaagcccgagggcaacauccugagagacagauucaagagcuuccagagaagaaacaugaucgagcccagagagagagccaaguucaagagaaaguacaaggugaagcugguggagaagagagccuucagagagauccagcuguaa

SEQ ID NO: 17570 - RNA, 1677 nt, Artificial Sequence
  GLUD1__Homo_sapiens__NP_005262
auguacagauaccugggcgaggcccugcugcugagcagagccggccccgccgcccugggcagcgccagcgccgacagcgccgcccugcugggcugggccagaggccagcccgccgccgccccccagcccggccuggcccuggccgccagaagacacuacagcgaggccguggccgacagagaggacgaccccaacuucuucaagaugguggagggcuucuucgacagaggcgccagcaucguggaggacaagcugguggaggaccugagaaccagagagagcgaggagcagaagagaaacagagugagaggcauccugagaaucaucaagcccugcaaccacgugcugagccugagcuuccccaucagaagagacgacggcagcugggaggugaucgagggcuacagagcccagcacagccagcacagaacccccugcaagggcggcaucagauacagcaccgacgugagcguggacgaggugaaggcccuggccagccugaugaccuacaagugcgccgugguggacgugcccuucggcggcgccaaggccggcgugaagaucaaccccaagaacuacaccgacaacgagcuggagaagaucaccagaagauucaccauggagcuggccaagaagggcuucaucggccccggcaucgacgugcccgcccccgacaugagcaccggcgagagagagaugagcuggaucgccgacaccuacgccagcaccaucggccacuacgacaucaacgcccacgccugcgugaccggcaagcccaucagccagggcggcauccacggcagaaucagcgccaccggcagaggcguguuccacggcaucgagaacuucaucaacgaggccagcuacaugagcauccugggcaugacccccggcuucggcgacaagaccuucguggugcagggcuucggcaacgugggccugcacagcaugagauaccugcacagauucggcgccaagugcaucgccgugggcgagagcgacggcagcaucuggaaccccgacggcaucgaccccaaggagcuggaggacuucaagcugcagcacggcagcauccugggcuuccccaaggccaagcccuacgagggcagcauccuggaggccgacugcgacauccugauccccgccgccagcgagaagcagcugaccaagagcaacgcccccagagugaaggccaagaucaucgccgagggcgccaacggccccaccacccccgaggccgacaagaucuuccuggagagaaacaucauggugauccccgaccuguaccugaacgccggcggcgugaccgugagcuacuucgaguggcugaagaaccugaaccacgugagcuacggcagacugaccuucaaguacgagagagacagcaacuaccaccugcugaugagcgugcaggagagccuggagagaaaguucggcaagcacggcggcaccauccccaucgugcccaccgccgaguuccaggacagaaucagcggcgccagcgagaaggacaucgugcacagcggccuggccuacaccauggagagaagcgccagacagaucaugagaaccgccaugaaguacaaccugggccuggaccugagaaccgccgccuacgugaacgccaucgagaagguguucaagguguacaacgaggccggcgugaccuucaccuaa

SEQ ID NO: 17571 - RNA, 1677 nt, Artificial Sequence
  GLUD2__Homo_sapiens__NP_036216
auguacagauaccuggccaaggcccugcugcccagcagagccggccccgccgcccugggcagcgccgccaaccacagcgccgcccugcugggcagaggcagaggccagcccgccgccgccagccagcccggccuggcccuggccgccagaagacacuacagcgagcugguggccgacagagaggacgaccccaacuucuucaagaugguggagggcuucuucgacagaggcgccagcaucguggaggacaagcuggugaaggaccugagaacccaggagagcgaggagcagaagagaaacagagugagaggcauccugagaaucaucaagcccugcaaccacgugcugagccugagcuuccccaucagaagagacgacggcagcugggaggugaucgagggcuacagagcccagcacagccagcacagaacccccugcaagggcggcaucagauacagcaccgacgugagcguggacgaggugaaggcccuggccagccugaugaccuacaagugcgccgugguggacgugcccuucggcggcgccaaggccggcgugaagaucaaccccaagaacuacaccgagaacgagcuggagaagaucaccagaagauucaccauggagcuggccaagaagggcuucaucggccccggcguggacgugcccgcccccgacaugaacaccggcgagagagagaugagcuggaucgccgacaccuacgccagcaccaucggccacuacgacaucaacgcccacgccugcgugaccggcaagcccaucagccagggcggcauccacggcagaaucagcgccaccggcagaggcguguuccacggcaucgagaacuucaucaacgaggccagcuacaugagcauccugggcaugacccccggcuucagagacaagaccuucguggugcagggcuucggcaacgugggccugcacagcaugagauaccugcacagauucggcgccaagugcaucgccgugggcgagagcgacggcagcaucuggaaccccgacggcaucgaccccaaggagcuggaggacuucaagcugcagcacggcagcauccugggcuuccccaaggccaagcccuacgagggcagcauccuggagguggacugcgacauccugauccccgccgccaccgagaagcagcugaccaagagcaacgcccccagagugaaggccaagaucaucgccgagggcgccaacggccccaccacccccgaggccgacaagaucuuccuggagagaaacauccuggugauccccgaccuguaccugaacgccggcggcgugaccgugagcuacuucgaguggcugaagaaccugaaccacgugagcuacggcagacugaccuucaaguacgagagagacagcaacuaccaccugcugcugagcgugcaggagagccuggagagaaaguucggcaagcacggcggcaccauccccaucgugcccaccgccgaguuccaggacagcaucagcggcgccagcgagaaggacaucgugcacagcgcccuggccuacaccauggagagaagcgccagacagaucaugcacaccgccaugaaguacaaccugggccuggaccugagaaccgccgccuacgugaacgccaucgagaagguguucaagguguacagcgaggccggcgugaccuucaccuaa

SEQ ID NO: 17572 - RNA, 1122 nt, Artificial Sequence
  GLUL__Homo_sapiens__XP_006711341
augaccaccagcgccagcagccaccugaacaagggcaucaagcagguguacaugagccugccccagggcgagaaggugcaggccauguacaucuggaucgacggcaccggcgagggccugagaugcaagaccagaacccuggacagcgagcccaagugcguggaggagcugcccgaguggaacuucgacggcagcagcacccugcagagcgagggcagcaacagcgacauguaccuggugcccgccgccauguucagagaccccuucagaaaggaccccaacaagcuggugcugugcgagguguucaaguacaacagaagacccgccgagaccaaccugagacacaccugcaagagaaucauggacauggugagcaaccagcaccccugguucggcauggagcaggaguacacccugaugggcaccgacggccaccccuucggcuggcccagcaacggcuuccccggcccccagggccccuacuacugcggcgugggcgccgacagagccuacggcagagacaucguggaggcccacuacagagccugccuguacgccggcgugaagaucgccggcaccaacgccgaggugaugcccgcccagugggaguuccagaucggccccugcgagggcaucagcaugggcgaccaccuguggguggccagauucauccugcacagagugugcgaggacuucggcgugaucgccaccuucgaccccaagcccauccccggcaacuggaacggcgccggcugccacaccaacuucagcaccaaggccaugagagaggagaacggccugaaguacaucgaggaggccaucgagaagcugagcaagagacaccaguaccacaucagagccuacgaccccaagggcggccuggacaacgccagaagacugaccggcuuccacgagaccagcaacaucaacgacuucagcgccggcguggccaacagaagcgccagcaucagaauccccagaaccgugggccaggagaagaagggcuacuucgaggacagaagacccagcgccaacugcgaccccuucagcgugaccgaggcccugaucagaaccugccugcugaacgagaccggcgacgagcccuuccaguacaagaacuaa

SEQ ID NO: 17573 - RNA, 492 nt, Artificial Sequence
  GLYAT__Homo_sapiens__NP_005829
augaugcugccccugcagggcgcccagaugcugcagaugcuggagaagagccugagaaagagccugcccgccagccugaagguguacggcaccguguuccacaucaaccacggcaaccccuucaaccugaaggccgugguggacaaguggcccgacuucaacaccgugguggugugcccccaggagcaggacaugaccgacgaccuggaccacuacaccaacaccuaccagaucuacagcaaggacccccagaacugccaggaguuccugggcagccccgagcugaucaacuggaagcagcaccugcagauccagagcagccagcccagccugaacgaggccauccagaaccuggccgccaucaagagcuucaaggugaagcagacccagagaauccuguacauggccgccgagaccgccaaggagcugacccccuuccugcugaagagcaagauccugagccccaacggcggcaagcccaaggccauguaa

SEQ ID NO: 17574 - RNA, 867 nt, Artificial Sequence
  GLYATL3__Homo_sapiens__NP_001010904
augcuggugcugaacugcagcaccaagcugcugauccuggagaagaugcugaagagcugcuuccccgagagccugaagguguacggcgccgugaugaacaucaacagaggcaaccccuuccagaaggagguggugcuggacagcuggcccgacuucaaggccgugaucaccagaagacagagagaggccgagaccgacaaccuggaccacuacaccaacgccuacgccguguucuacaaggacgugagagccuacagacagcugcuggaggagugcgacguguucaacugggaccagguguuccagauccagggccugcagagcgagcuguacgacgugagcaaggccguggccaacagcaagcagcugaacaucaagcugaccagcuucaaggccgugcacuucagccccgugagcagccugcccgacaccagcuuccugaagggccccagccccagacugaccuaccugagcguggccaacgccgaccugcugaacagaaccuggagcagaggcggcaacgagcagugccugagauacaucgccaaccugaucagcugcuuccccagcgugugcgugagagacgagaagggcaaccccgugagcuggagcaucaccgaccaguucgccaccaugugccacggcuacacccugcccgagcacagaagaaagggcuacagcagacugguggcccugacccuggccagaaagcugcagagcagaggcuuccccagccagggcaacgugcuggacgacaacaccgccagcaucagccugcugaagagccugcacgccgaguuccugcccugcagauuccacagacugauccugacccccgccaccuucagcggccugccccaccuguaa

SEQ ID NO: 17575 - RNA, 705 nt, Artificial Sequence
  GLYCTK__Homo_sapiens__NP_001138423
auggccgccgcccugcaggugcugcccagacuggccagagccccccugcacccccugcuguggagaggcagcguggccagacuggccagcagcauggcccuggccgagcaggccagacagcuguucgagagcgccgugggcgccgugcugcccggccccaugcugcacagagcccugagccuggaccccggcggcagacagcugaaggugagagacagaaacuuccagcugagacagaaccuguaccuggugggcuucggcaaggccgugcugggcauggccgccgccgccgaggagcugcugggccagcaccuggugcagggcgugaucagcgugcccaagggcaucagagccgccauggagagagccggcaagcaggagaugcugcugaagccccacagcagagugcagguguucgagggcgccgaggacaaccugcccgacagagacgcccugagagccgcccuggccauccagcagcuggccgagggccugaccgccgacgaccugcugcuggugcugaucagcggcggcgagccccaccccgugagaugcggcggcggccccugcggcggcgacugccaguggccccacagaggccaguucccccagugcgccagacugcccgccuacccccagagccugagaccccccugcagccccgccaccuucugcgaggacugcgccgugagcggcagacuguaa

SEQ ID NO: 17576 - RNA, 582 nt, Artificial Sequence
  GM2A__Homo_sapiens__NP_000396
augcagagccugaugcaggccccccugcugaucgcccugggccugcugcuggccgcccccgcccaggcccaccugaagaagcccagccagcugagcagcuucagcugggacaacugcgacgagggcaaggaccccgccgugaucagaagccugacccuggagcccgaccccaucaucgugcccggcaacgugacccugagcgugaugggcagcaccagcgugccccugagcagcccccugaagguggaccuggugcuggagaaggagguggccggccuguggaucaagauccccugcaccgacuacaucggcagcugcaccuucgagcacuucugcgacgugcuggacaugcugauccccaccggcgagcccugccccgagccccugagaaccuacggccugcccugccacugccccuucaaggagggcaccuacagccugcccaagagcgaguucguggugcccgaccuggagcugcccagcuggcugaccaccggcaacuacagaaucgagagcgugcugagcagcagcggcaagagacugggcugcaucaagaucgccgccagccugaagggcaucuaa

SEQ ID NO: 17577 - RNA, 1548 nt, Artificial Sequence
  GMCL1__Homo_sapiens__NP_848526
augggcagccugagcagcagagugcugagacagcccagacccgcccuggcccagcaggcccagggcgccagagccggcggcagcgccagaagacccgacaccggcgacgacgccgccggccacggcuucugcuacugcgccggcagccacaagagaaagagaagcagcggcagcuucugcuacugccaccccgacagcgagaccgacgaggacgaggaggagggcgacgagcagcagagacugcugaacacccccagaagaaagaagcugaagagcaccagcaaguacaucuaccagacccuguuccugaacggcgagaacagcgacaucaagaucugcgcccugggcgaggaguggagccugcacaagaucuaccugugccagagcggcuacuucagcagcauguucagcggcagcuggaaggagagcagcaugaacaucaucgagcuggagauccccgaccagaacaucgacguggaggcccugcagguggccuucggcagccuguacagagacgacgugcugaucaagcccagcagagugguggccauccuggccgccgccugccugcugcagcuggacggccugauccagcagugcggcgagaccaugaaggagaccgugaacgugaagaccgugugcggcuacuacaccagcgccggcaccuacggccuggacagcgugaagaagaagugccuggaguggcugcugaacaaccugaugacccaccagaacguggagcuguucaaggagcugagcaucaacgugaugaagcagcugaucggcagcagcaaccuguucgugaugcagguggagauggacaucuacaccgcccugaagaaguggauguuccugcagcuggugcccagcuggaacggcagccugaagcagcugcugaccgagaccgacgugugguucagcaagcagagaaaggacuucgagggcauggccuuccuggagaccgagcagggcaagcccuucgugagcguguucagacaccugagacugcaguacaucaucagcgaccuggccagcgccagaaucaucgagcaggacgccguggugcccagcgaguggcugagcagcguguacaagcagcagugguucgccaugcugagagccgagcaggacagcgaggugggcccccaggagaucaacaaggaggagcuggagggcaacagcaugagaugcggcagaaagcuggccaaggacggcgaguacugcuggagauggaccggcuucaacuucggcuucgaccugcuggugaccuacaccaacagauacaucaucuucaagagaaacacccugaaccagcccugcagcggcagcgugagccugcagcccagaagaagcaucgccuucagacugagacuggccagcuucgacagcagcggcaagcugaucugcagcagaaccaccggcuaccagauccugacccuggagaaggaccaggagcagguggugaugaaccuggacagcagacugcugaucuucccccuguacaucugcugcaacuuccuguacaucagccccgagaagaagaacuaa

SEQ ID NO: 17578 - RNA, 1029 nt, Artificial Sequence
  GMDS__Homo_sapiens__NP_001240775
augugcaagauggacggcagcuaccuggccgaguuccugcuggagaagggcuacgaggugcacggcaucgugagaagaagcagcagcuucaacaccggcagaaucgagcaccuguacaagaacccccaggcccacaucgagggcaacaugaagcugcacuacggcgaccugaccgacagcaccugccuggugaagaucaucaacgaggugaagcccaccgagaucuacaaccugggcgcccagagccacgugaagaucagcuucgaccuggccgaguacaccgccgacguggacggcgugggcacccugagacugcuggacgccgugaagaccugcggccugaucaacagcgugaaguucuaccaggccagcaccagcgagcuguacggcaaggugcaggagaucccccagaaggagaccacccccuucuaccccagaagccccuacggcgccgccaagcuguacgccuacuggaucguggugaacuucagagaggccuacaaccuguucgccgugaacggcauccuguucaaccacgagagccccagaagaggcgccaacuucgugaccagaaagaucagcagaagcguggccaagaucuaccugggccagcuggagugcuucagccugggcaaccuggacgccaagagagacuggggccacgccaaggacuacguggaggccauguggcugaugcugcagaacgacgagcccgaggacuucgugaucgccaccggcgaggugcacagcgugagagaguucguggagaagagcuuccugcacaucggcaagaccaucgugugggagggcaagaacgagaacgaggugggcagaugcaaggagaccggcaaggugcacgugaccguggaccugaaguacuacagacccaccgagguggacuuccugcagggcgacugcaccaaggccaagcagaagcugaacuggaagcccagaguggccuucgacgagcuggugagagagauggugcacgccgacguggagcugaugagaaccaaccccaacgccuaa

SEQ ID NO: 17579 - RNA, 429 nt, Artificial Sequence
  GMFB__Homo_sapiens__NP_004115
augagcgagagccugguggugugcgacguggccgaggaccugguggagaagcugagaaaguucagauucagaaaggagaccaacaacgccgccaucaucaugaagaucgacaaggacaagagacugguggugcuggacgaggagcuggagggcaucagccccgacgagcugaaggacgagcugcccgagagacagcccagauucaucguguacagcuacaaguaccagcacgacgacggcagagugagcuacccccugugcuucaucuucagcagccccgugggcugcaagcccgagcagcagaugauguacgccggcagcaagaacaagcuggugcagaccgccgagcugaccaagguguucgagaucagaaacaccgaggaccugaccgaggaguggcugagagagaagcugggcuucuuccacuaa

SEQ ID NO: 17580 - RNA, 429 nt, Artificial Sequence
  GMFG__Homo_sapiens__NP_004868
augagcgacagccugguggugugcgagguggaccccgagcugaccgagaagcugagaaaguucagauucagaaaggagaccgacaacgccgccaucaucaugaagguggacaaggacagacagaugguggugcuggaggaggaguuccagaacaucagccccgaggagcugaagauggagcugcccgagagacagcccagauucgugguguacagcuacaaguacgugcacgacgacggcagagugagcuacccccugugcuucaucuucagcagccccgugggcugcaagcccgagcagcagaugauguacgccggcagcaagaacagacuggugcagaccgccgagcugaccaagguguucgagaucagaaccaccgacgaccugaccgaggccuggcugcaggagaagcugagcuucuucagauaa

SEQ ID NO: 17581 - RNA, 2826 nt, Artificial Sequence
  GMIP__Homo_sapiens__NP_001275927
auggacgccgccgagcccggccugccccccggccccgagggcagaaagagauacagcgacaucuucagaagccuggacaaccuggagaucagccugggcaacgugacccuggagaugcuggccggcgacccccugcugagcgaggaccccgagcccgacaagacccccaccgccaccgugaccaacgaggccagcugcuggagcggccccagccccgagggccccgugccccugaccggcgaggagcuggaccugagacugaucagaaccaagggcggcguggacgccgcccuggaguacgccaagaccuggagcagauacgccaaggagcugcuggccuggaccgagaagagagccagcuacgagcuggaguucgccaagagcaccaugaagaucgccgaggccggcaaggugagcauccagcagcagagccacaugccccugcaguacaucuacacccuguuccuggagcacgaccugagccugggcacccuggccauggagaccguggcccagcagaagagagacuacuaccagccccuggccgccaagagaaccgagaucgagaaguggagaaaggaguucaaggagcaguggaugaaggagcagaagagaaugaacgaggccgugcaggcccugagaagagcccagcugcaguacgugcagagaagcgaggaccugagagccagaagccagggcagccccgaggacagcgccccccaggccagccccggccccagcaagcagcaggagagaagaagaagaagcagagaggaggcccaggccaaggcccaggaggccgaggcccuguaccaggccugcgugagagaggccaacgccagacagcaggaccuggagaucgccaagcagagaaucgugagccacgugagaaagcugguguuccagggcgacgaggugcugagaagagugacccugagccuguucggccugagaggcgcccaggccgagagaggccccagagccuucgccgcccuggccgagugcugcgcccccuucgagcccggccagagauaccaggaguucgugagagcccugagacccgaggccccccccccccccccccccgccuucagcuuccaggaguuccugcccagccugaacagcagcccccuggacaucagaaagaagcugagcggcccccugccccccagacuggacgagaacagcgccgagcccggccccugggaggaccccggcaccggcuggagauggcagggccccacccccggcagcgacguggacagcgugggcggcggcagcgagagcagaagccuggacagccccaccagcagccccgaccugggcgacggccuggagaacggccugggcagccccuucggcaaguggacccugagcagcgccgcccagacccaccagcugagaagacugagaggccccgccaagugcagagagugcgaggccuucauggugagcggcaccgagugcgaggagugcuuccugaccugccacaagagaugccuggagacccugcugauccugugcggccacagaagacugcccgccagaaccccccuguucggcguggacuuccugcagcugcccagagacuuccccgaggaggugcccuucguggugaccaagugcaccgccgagaucgagcacagagcccuggacgugcagggcaucuacagagugagcggcagcagagugagaguggagagacugugccaggccuucgagaacggcagagcccugguggagcugagcggcaacagcccccacgacgugagcagcgugcugaagagauuccugcaggagcugaccgagcccgugauccccuuccaccuguacgacgccuucaucagccuggccaagacccugcacgccgaccccggcgacgaccccggcacccccagccccagccccgaggugaucagaagccugaagacccugcuggugcagcugcccgacagcaacuacaacacccugagacaccugguggcccaccuguucagaguggccgccagauucauggagaacaagaugagcgccaacaaccugggcaucguguucggccccacccugcugagaccccccgacggccccagagccgccagcgccauccccgugaccugccugcuggacagcggccaccaggcccagcugguggaguuccugaucgugcacuacgagcagaucuucggcauggacgagcugccccaggccaccgagccccccccccaggacagcagccccgcccccggcccccugaccaccagcagccagcccccccccccccaccuggaccccgacagccagccccccgugcuggccagcgaccccggccccgacccccagcaccacagcacccuggagcagcaccccaccgccacccccaccgagauccccaccccccagagcgaccagagagaggacguggccgaggacaccaaggacggcggcggcgaggugagcagccagggccccgaggacagccugcugggcacccagagcagaggccacuucagcagacagcccgugaaguaccccagaggcggcgugagacccgugacccaccagcugagcagccuggcccugguggccagcaagcugugcgaggagacccccaucaccagcgugcccagaggcagccugagaggcagaggccccagccccgccgccgccagccccgagggcagcccccugagaagaaccccccugcccaagcacuucgagaucacccaggagaccgccagacugcugagcaagcuggacagcgaggccgugcccagagccaccugcugccccgacgugcagcccgaggaggccgaggaccaccuguaa

SEQ ID NO: 17582 - RNA, 510 nt, Artificial Sequence
  GML__Homo_sapiens__XP_011515271
auggagcccggcagcagacugcugagagaggugaugcugcuguucgcccugcugcuggccauggagcugccccugguggccgccagcgccaccaugagagcccaguggaccuacagccugagaugccacgacugcgccgugaucaacgacuucaacugccccaacaucagagugugccccuaccacaucagaagaugcaugaccaucagcaucagaaucaacagcagagagcugcugguguacaagaacugcaccaacaacugcaccuucguguacgccgccgagcagccccccgaggcccccggcaagaucuucaagaccaacagcuucuacugggugugcugcugcaacagcauggugugcaacgccggcggccccaccaaccuggagagagacaugcugcccgacgaggugaccgaggaggagcugcccgagggcaccgugagacugggcgugagcaagcugcugcugagcuucgccagcaucaucgugagcaacauccugcccuaa

SEQ ID NO: 17583 - RNA, 630 nt, Artificial Sequence
  GMNN__Homo_sapiens__XP_005249216
augaaccccagcaugaagcagaagcaggaggagaucaaggagaacaucaagaacagcagcgugcccagaagaacccugaagaugauccagcccagcgccagcggcagccuggugggcagagagaacgagcugagcgccggccugagcaagagaaagcacagaaacgaccaccugaccagcaccaccagcagccccggcgugaucgugcccgagagcagcgagaacaagaaccugggcggcgugacccaggagagcuucgaccugaugaucaaggagaaccccagcagccaguacuggaaggagguggccgagaagagaagaaaggcccuguacgaggcccugaaggagaacgagaagcugcacaaggagaucgagcagaaggacaacgagaucgccagacugaagaaggagaacaaggagcuggccgagguggccgagcacgugcaguacauggccgagcugaucgagagacugaacggcgagccccuggacaacuucgagagccuggacaaccaggaguucgacagcgaggaggagaccguggaggacagccugguggaggacagcgagaucggcaccugcgccgagggcaccgugagcagcagcaccgacgccaagcccugcaucuaa

SEQ ID NO: 17584 - RNA, 1263 nt, Artificial Sequence
  GMPPA__Homo_sapiens__NP_995319
augcugaaggccgugauccugaucggcggcccccagaagggcaccagauucagaccccugagcuucgaggugcccaagccccuguuccccguggccggcgugcccaugauccagcaccacaucgaggccugcgcccaggugcccggcaugcaggagauccugcugaucggcuucuaccagcccgacgagccccugacccaguuccuggaggccgcccagcaggaguucaaccugcccgugagauaccugcaggaguucgccccccugggcaccggcggcggccuguaccacuucagagaccagauccuggccggcagccccgaggccuucuucgugcugaacgccgacgugugcagcgacuucccccugagcgccaugcuggaggcccacagaagacagagacaccccuuccugcugcugggcaccaccgccaacagaacccagagccugaacuacggcugcaucguggagaacccccagacccacgaggugcugcacuacguggagaagcccagcaccuucaucagcgacaucaucaacugcggcaucuaccuguucagccccgaggcccugaagccccugagagacguguuccagagaaaccagcaggacggccagcuggaggacagccccggccuguggcccggcgccggcaccaucagacuggagcaggacguguucagcgcccuggccggccagggccagaucuacgugcaccugaccgacggcaucuggagccagaucaagagcgccggcagcgcccuguacgccagcagacuguaccugagcagauaccaggacacccaccccgagagacuggccaagcacacccccggcggccccuggaucagaggcaacguguacauccaccccaccgccaagguggcccccagcgccgugcugggccccaacgugagcaucggcaagggcgugaccgugggcgagggcgugagacugagagagagcaucgugcugcacggcgccacccugcaggagcacaccugcgugcugcacagcaucgugggcuggggcagcaccgugggcagaugggccagaguggagggcacccccagcgaccccaaccccaacgaccccagagccagaauggacagcgagagccuguucaaggacggcaagcugcugcccgccaucaccauccugggcugcagagugagaauccccgccgaggugcugauccugaacagcaucgugcugccccacaaggagcugagcagaagcuucaccaaccagaucauccuguaa

SEQ ID NO: 17585 - RNA, 1164 nt, Artificial Sequence
  GMPPB__Homo_sapiens__NP_037466
augaaggcccugauccuggugggcggcuacggcaccagacugagaccccugacccugagcacccccaagccccugguggacuucugcaacaagcccauccugcugcaccagguggaggcccuggccgccgccggcguggaccacgugauccuggccgugagcuacaugagccaggugcuggagaaggagaugaaggcccaggagcagagacugggcaucagaaucagcaugagccacgaggaggagccccugggcaccgccggcccccuggcccuggccagagaccugcugagcgagaccgccgaccccuucuucgugcugaacagcgacgugaucugcgacuuccccuuccaggccauggugcaguuccacagacaccacggccaggagggcagcauccuggugaccaagguggaggagcccagcaaguacggcgugguggugugcgaggccgacaccggcagaauccacagauucguggagaagccccagguguucgugagcaacaagaucaacgccggcauguacauccugagccccgccgugcugagaagaauccagcugcagcccaccagcaucgagaaggagguguuccccaucauggccaaggagggccagcuguacgccauggagcugcagggcuucuggauggacaucggccagcccaaggacuuccugaccggcaugugccuguuccugcagagccugagacagaagcagcccgagagacugugcagcggccccggcaucgugggcaacgugcugguggaccccagcgccagaaucggccagaacugcagcaucggccccaacgugagccugggccccggcguggugguggaggacggcgugugcaucagaagaugcaccgugcugagagacgccagaaucagaagccacagcuggcuggagagcugcaucgugggcuggagaugcagagugggccagugggugagccugugggccggccugggcggcgagagaggcggcgagugcgccugccugcccgacaaggccuacccccugcuggaggugagaauggagaacgugaccgugcugggcgaggacgugaucgugaacgacgagcuguaccugaacggcgccagcgugcugccccacaagagcaucggcgagagcgugcccgagcccagaaucaucauguaa

SEQ ID NO: 17586 - RNA, 1047 nt, Artificial Sequence
  GMPR2__Homo_sapiens__NP_001002000
augccccacaucgacaacgacgugaagcuggacuucaaggacgugcugcugagacccaagagaagcacccugaagagcagaagcgagguggaccugaccagaagcuucagcuucagaaacagcaagcagaccuacagcggcgugcccaucaucgccgccaacauggacaccgugggcaccuucgagauggccaaggugcugugcaaguucagccuguucaccgccgugcacaagcacuacagccuggugcaguggcaggaguucgccggccagaaccccgacugccuggagcaccuggccgccagcagcggcaccggcagcagcgacuucgagcagcuggagcagauccuggaggccaucccccaggugaaguacaucugccuggacguggccaacggcuacagcgagcacuucguggaguucgugaaggacgugagaaagagauucccccagcacaccaucauggccggcaacguggugaccggcgagaugguggaggagcugauccugagcggcgccgacaucaucaaggugggcaucggccccggcagcgugugcaccaccagaaagaagaccggcgugggcuacccccagcugagcgccgugauggagugcgccgacgccgcccacggccugaagggccacaucaucagcgacggcggcugcagcugccccggcgacguggccaaggccuucggcgccggcgccgacuucgugaugcugggcggcaugcuggccggccacagcgagagcggcggcgagcugaucgagagagacggcaagaaguacaagcuguucuacggcaugagcagcgagauggccaugaagaaguacgccggcggcguggccgaguacagagccagcgagggcaagaccguggaggugcccuucaagggcgacguggagcacaccaucagagacauccugggcggcaucagaagcaccugcaccuacgugggcgccgccaagcugaaggagcugagcagaagaaccaccuucaucagagugacccagcaggugaaccccaucuucagcgaggccugcuaa

SEQ ID NO: 17587 - RNA, 1038 nt, Artificial Sequence
  GMPR__Homo_sapiens__NP_006868
augcccagaaucgacgccgaccugaagcuggacuucaaggacgugcugcugagacccaagagaagcagccugaagagcagagccgagguggaccuggagagaaccuucaccuucagaaacagcaagcagaccuacagcggcauccccaucaucguggccaacauggacaccgugggcaccuucgagauggccgccgugaugagccagcacagcauguucaccgccauccacaagcacuacagccuggacgacuggaagcuguucgccaccaaccaccccgagugccugcagaacguggccgugagcagcggcagcggccagaacgaccuggagaagaugaccagcauccuggaggccgugccccaggugaaguucaucugccuggacguggccaacggcuacagcgagcacuucguggaguucgugaagcuggugagagccaaguuccccgagcacaccaucauggccggcaacguggugaccggcgagaugguggaggagcugauccugagcggcgccgacaucaucaaggugggcgugggccccggcagcgugugcaccaccagaaccaagaccggcgugggcuacccccagcugagcgccgugaucgagugcgccgacagcgcccacggccugaagggccacaucaucagcgacggcggcugcaccugccccggcgacguggccaaggccuucggcgccggcgccgacuucgugaugcugggcggcauguucagcggccacaccgagugcgccggcgagguguucgagagaaacggcagaaagcugaagcuguucuacggcaugagcagcgacaccgccaugaacaagcacgccggcggcguggccgaguacagagccagcgagggcaagaccguggaggugcccuacaagggcgacguggagaacaccauccuggacauccugggcggccugagaagcaccugcaccuacgugggcgccgccaagcugaaggagcugagcagaagagccaccuucaucagagugacccagcagcacaacaccguguucagcuaa

SEQ ID NO: 17588 - RNA, 2082 nt, Artificial Sequence
  GMPS__Homo_sapiens__NP_003866
auggcccugugcaacggcgacagcaagcuggagaacgccggcggcgaccugaaggacggccaccaccacuacgagggcgccguggugauccuggacgccggcgcccaguacggcaaggugaucgacagaagagugagagagcuguucgugcagagcgagaucuucccccuggagacccccgccuucgccaucaaggagcagggcuucagagccaucaucaucagcggcggccccaacagcguguacgccgaggacgcccccugguucgaccccgccaucuucaccaucggcaagcccgugcugggcaucugcuacggcaugcagaugaugaacaagguguucggcggcaccgugcacaagaagagcgugagagaggacggcguguucaacaucagcguggacaacaccugcagccuguucagaggccugcagaaggaggagguggugcugcugacccacggcgacagcguggacaagguggccgacggcuucaaggugguggccagaagcggcaacaucguggccggcaucgccaacgagagcaagaagcuguacggcgcccaguuccaccccgaggugggccugaccgagaacggcaaggugauccugaagaacuuccuguacgacaucgccggcugcagcggcaccuucaccgugcagaacagagagcuggagugcaucagagagaucaaggagagagugggcaccagcaaggugcuggugcugcugagcggcggcguggacagcaccgugugcaccgcccugcugaacagagcccugaaccaggagcaggugaucgccgugcacaucgacaacggcuucaugagaaagagagagagccagagcguggaggaggcccugaagaagcugggcauccaggugaaggugaucaacgccgcccacagcuucuacaacggcaccaccacccugcccaucagcgacgaggacagaacccccagaaagagaaucagcaagacccugaacaugaccaccagccccgaggagaagagaaagaucaucggcgacaccuucgugaagaucgccaacgaggugaucggcgagaugaaccugaagcccgaggagguguuccuggcccagggcacccugagacccgaccugaucgagagcgccagccugguggccagcggcaaggccgagcugaucaagacccaccacaacgacaccgagcugaucagaaagcugagagaggagggcaaggugaucgagccccugaaggacuuccacaaggacgaggugagaauccugggcagagagcugggccugcccgaggagcuggugagcagacaccccuuccccggccccggccuggccaucagagugaucugcgccgaggagcccuacaucugcaaggacuuccccgagaccaacaacauccugaagaucguggccgacuucagcgccagcgugaagaagccccacacccugcugcagagagugaaggccugcaccaccgaggaggaccaggagaagcugaugcagaucaccagccugcacagccugaacgccuuccugcugcccaucaagaccgugggcgugcagggcgacugcagaagcuacagcuacgugugcggcaucagcagcaaggacgagcccgacugggagagccugaucuuccuggccagacugauccccagaaugugccacaacgugaacagagugguguacaucuucggcccccccgugaaggagccccccaccgacgugacccccaccuuccugaccaccggcgugcugagcacccugagacaggccgacuucgaggcccacaacauccugagagagagcggcuacgccggcaagaucagccagaugcccgugauccugaccccccugcacuucgacagagacccccugcagaagcagcccagcugccagagaagcguggugaucagaaccuucaucaccagcgacuucaugaccggcauccccgccacccccggcaacgagauccccguggagguggugcugaagauggugaccgagaucaagaagauccccggcaucagcagaaucauguacgaccugaccagcaagccccccggcaccaccgagugggaguaa

SEQ ID NO: 17589 - RNA, 1080 nt, Artificial Sequence
  GNA11__Homo_sapiens__NP_002058
augacccuggagagcaugauggccugcugccugagcgacgaggugaaggagagcaagagaaucaacgccgagaucgagaagcagcugagaagagacaagagagacgccagaagagagcugaagcugcugcugcugggcaccggcgagagcggcaagagcaccuucaucaagcagaugagaaucauccacggcgccggcuacagcgaggaggacaagagaggcuucaccaagcugguguaccagaacaucuucaccgccaugcaggccaugaucagagccauggagacccugaagauccuguacaaguacgagcagaacaaggccaacgcccugcugaucagagagguggacguggagaaggugaccaccuucgagcaccaguacgugagcgccaucaagacccugugggaggaccccggcauccaggagugcuacgacagaagaagagaguaccagcugagcgacagcgccaaguacuaccugaccgacguggacagaaucgccacccugggcuaccugcccacccagcaggacgugcugagagugagagugcccaccaccggcaucaucgaguaccccuucgaccuggagaacaucaucuucagaaugguggacgugggcggccagagaagcgagagaagaaaguggauccacugcuucgagaacgugaccagcaucauguuccugguggcccugagcgaguacgaccaggugcugguggagagcgacaacgagaacagaauggaggagagcaaggcccuguucagaaccaucaucaccuaccccugguuccagaacagcagcgugauccuguuccugaacaagaaggaccugcuggaggacaagauccuguacagccaccugguggacuacuuccccgaguucgacggcccccagagagacgcccaggccgccagagaguucauccugaagauguucguggaccugaaccccgacagcgacaagaucaucuacagccacuucaccugcgccaccgacaccgagaacaucagauucguguucgccgccgugaaggacaccauccugcagcugaaccugaaggaguacaaccugguguaa

SEQ ID NO: 17590 - RNA, 918 nt, Artificial Sequence
  GNA12__Homo_sapiens__NP_001269369
auggcccccagagccggccugggcgccggcccccugcugcugagaagcagagccgacugggugugcggcggcugggaggccgcccugagcgcccccccccccuucugcaccgccuggguggagagaaccggccuggugcacuuccugagagagggcggccacggcgccugcuucccccuggcccugcugcaccccggcagcguggugagcuuccagaugaucuacccccugaucgugcugccccugugcgccagcuggcacuggggccugaucagaaagggcaucgugcuguucuggggcgagagcgugaaguacuuccuggacaaccuggacagaaucggccagcugaacuacuuccccagcaagcaggacauccugcuggccagaaaggccaccaagggcaucguggagcacgacuucgugaucaagaagauccccuucaagaugguggacgugggcggccagagaagccagagacagaagugguuccagugcuucgacggcaucaccagcauccuguucauggugagcagcagcgaguacgaccaggugcugauggaggacagaagaaccaacagacugguggagagcaugaacaucuucgagaccaucgugaacaacaagcuguucuucaacgugagcaucauccuguuccugaacaagauggaccugcugguggagaaggugaagaccgugagcaucaagaagcacuuccccgacuucagaggcgacccccacagacuggaggacgugcagagauaccuggugcagugcuucgacagaaagagaagaaacagaagcaagccccuguuccaccacuucaccaccgccaucgacaccgagaacgugagauucguguuccacgccgugaaggacaccauccugcaggagaaccugaaggacaucaugcugcaguaa

SEQ ID NO: 17591 - RNA, 849 nt, Artificial Sequence
  GNA13__Homo_sapiens__NP_001269354
augagagugcugguggacgccagagagaagcugcacauccccuggggcgacaacagcaaccagcagcacggcgacaagaugaugagcuucgacaccagagcccccauggccgcccagggcaugguggagaccagaguguuccugcaguaccugcccgccaucagagcccugugggccgacagcggcauccagaacgccuacgacagaagaagagaguuccagcugggcgagagcgugaaguacuuccuggacaaccuggacaagcugggcgagcccgacuacauccccagccagcaggacauccugcuggccagaagacccaccaagggcauccacgaguacgacuucgagaucaagaacgugcccuucaagaugguggacgugggcggccagagaagcgagagaaagagaugguucgagugcuucgacagcgugaccagcauccuguuccuggugagcagcagcgaguucgaccaggugcugauggaggacagacugaccaacagacugaccgagagccugaacaucuucgagaccaucgugaacaacagaguguucagcaacgugagcaucauccuguuccugaacaagaccgaccugcuggaggagaaggugcagaucgugagcaucaaggacuacuuccuggaguucgagggcgacccccacugccugagagacgugcagaaguuccugguggagugcuucagaaacaagagaagagaccagcagcagaagccccuguaccaccacuucaccaccgccaucaacaccgagaacaucagacugguguucagagacgugaaggacaccauccugcacgacaaccugaagcagcugaugcugcaguaa

SEQ ID NO: 17592 - RNA, 1068 nt, Artificial Sequence
  GNA14__Homo_sapiens__NP_004288
auggccggcugcugcugccugagcgccgaggagaaggagagccagagaaucagcgccgagaucgagagacagcugagaagagacaagaaggacgccagaagagagcugaagcugcugcugcugggcaccggcgagagcggcaagagcaccuucaucaagcagaugagaaucauccacggcagcggcuacagcgacgaggacagaaagggcuucaccaagcugguguaccagaacaucuucaccgccaugcaggccaugaucagagccauggacacccugagaauccaguacgugugcgagcagaacaaggagaacgcccagaucaucagagagguggagguggacaaggugagcaugcugagcagagagcagguggaggccaucaagcagcuguggcaggaccccggcauccaggagugcuacgacagaagaagagaguaccagcugagcgacagcgccaaguacuaccugaccgacaucgacagaaucgccacccccagcuucgugcccacccagcaggacgugcugagagugagagugcccaccaccggcaucaucgaguaccccuucgaccuggagaacaucaucuucagaaugguggacgugggcggccagagaagcgagagaagaaaguggauccacugcuucgagagcgugaccagcaucaucuuccugguggcccugagcgaguacgaccaggugcuggccgagugcgacaacgagaacagaauggaggagagcaaggcccuguucaagaccaucaucaccuaccccugguuccugaacagcagcgugauccuguuccugaacaagaaggaccugcuggaggagaagaucauguacagccaccugaucagcuacuuccccgaguacaccggccccaagcaggacgugagagccgccagagacuucauccugaagcuguaccaggaccagaaccccgacaaggagaaggugaucuacagccacuucaccugcgccaccgacaccgacaacaucagauucguguucgccgccgugaaggacaccauccugcagcugaaccugagagaguucaaccugguguaa

SEQ ID NO: 17593 - RNA, 1125 nt, Artificial Sequence
  GNA15__Homo_sapiens__NP_002059
auggccagaagccugaccuggagaugcugccccuggugccugaccgaggacgagaaggccgccgccagaguggaccaggagaucaacagaauccugcuggagcagaagaagcaggacagaggcgagcugaagcugcugcugcugggccccggcgagagcggcaagagcaccuucaucaagcagaugagaaucauccacggcgccggcuacagcgaggaggagagaaagggcuucagaccccugguguaccagaacaucuucgugagcaugagagccaugaucgaggccauggagagacugcagauccccuucagcagacccgagagcaagcaccacgccagccuggugaugagccaggaccccuacaaggugaccaccuucgagaagagauacgccgccgccaugcaguggcuguggagagacgccggcaucagagccugcuacgagagaagaagagaguuccaccugcuggacagcgccguguacuaccugagccaccuggagagaaucaccgaggagggcuacgugcccaccgcccaggacgugcugagaagcagaaugcccaccaccggcaucaacgaguacugcuucagcgugcagaagaccaaccugagaaucguggacgugggcggccagaagagcgagagaaagaaguggauccacugcuucgagaacgugaucgcccugaucuaccuggccagccugagcgaguacgaccagugccuggaggagaacaaccaggagaacagaaugaaggagagccuggcccuguucggcaccauccuggagcugcccugguucaagagcaccagcgugauccuguuccugaacaagaccgacauccuggaggagaagauccccaccagccaccuggccaccuacuuccccagcuuccagggccccaagcaggacgccgaggccgccaagagauucauccuggacauguacaccagaauguacaccggcugcguggacggccccgagggcagcaagaagggcgccagaagcagaagacuguucagccacuacaccugcgccaccgacacccagaacaucagaaagguguucaaggacgugagagacagcgugcuggccagauaccuggacgagaucaaccugcuguaa

SEQ ID NO: 17594 - RNA, 909 nt, Artificial Sequence
  GNAI1__Homo_sapiens__NP_001243343
augaagaucauccacgaggccggcuacagcgaggaggagugcaagcaguacaaggccgugguguacagcaacaccauccagagcaucaucgccaucaucagagccaugggcagacugaagaucgacuucggcgacagcgccagagccgacgacgccagacagcuguucgugcuggccggcgccgccgaggagggcuucaugaccgccgagcuggccggcgugaucaagagacuguggaaggacagcggcgugcaggccugcuucaacagaagcagagaguaccagcugaacgacagcgccgccuacuaccugaacgaccuggacagaaucgcccagcccaacuacauccccacccagcaggacgugcugagaaccagagugaagaccaccggcaucguggagacccacuucaccuucaaggaccugcacuucaagauguucgacgugggcggccagagaagcgagagaaagaaguggauccacugcuucgagggcgugaccgccaucaucuucugcguggcccugagcgacuacgaccuggugcuggccgaggacgaggagaugaacagaaugcacgagagcaugaagcuguucgacagcaucugcaacaacaagugguucaccgacaccagcaucauccuguuccugaacaagaaggaccuguucgaggagaagaucaagaagagcccccugaccaucugcuaccccgaguacgccggcagcaacaccuacgaggaggccgccgccuacauccagugccaguucgaggaccugaacaagagaaaggacaccaaggagaucuacacccacuucaccugcgccaccgacaccaagaacgugcaguucguguucgacgccgugaccgacgugaucaucaagaacaaccugaaggacugcggccuguucuaa

SEQ ID NO: 17595 - RNA, 957 nt, Artificial Sequence
  GNAI2__Homo_sapiens__NP_001159897
augagaggcgccggcgagagcggcaagagcaccaucgugaagcagaugaagaucauccacgaggacggcuacagcgaggaggagugcagacaguacagagccgugguguacagcaacaccauccagagcaucauggccaucgugaaggccaugggcaaccugcagaucgacuucgccgaccccagcagagccgacgacgccagacagcuguucgcccugagcugcaccgccgaggagcagggcgugcugcccgacgaccugagcggcgugaucagaagacugugggccgaccacggcgugcaggccugcuucggcagaagcagagaguaccagcugaacgacagcgccgccuacuaccugaacgaccuggagagaaucgcccagagcgacuacauccccacccagcaggacgugcugagaaccagagugaagaccaccggcaucguggagacccacuucaccuucaaggaccugcacuucaagauguucgacgugggcggccagagaagcgagagaaagaaguggauccacugcuucgagggcgugaccgccaucaucuucugcguggcccugagcgccuacgaccuggugcuggccgaggacgaggagaugaacagaaugcacgagagcaugaagcuguucgacagcaucugcaacaacaagugguucaccgacaccagcaucauccuguuccugaacaagaaggaccuguucgaggagaagaucacccacagcccccugaccaucugcuuccccgaguacaccggcgccaacaaguacgacgaggccgccagcuacauccagagcaaguucgaggaccugaacaagagaaaggacaccaaggagaucuacacccacuucaccugcgccaccgacaccaagaacgugcaguucguguucgacgccgugaccgacgugaucaucaagaacaaccugaaggacugcggccuguucuaa

SEQ ID NO: 17596 - RNA, 525 nt, Artificial Sequence
  GNAL__Homo_sapiens__NP_001248373
auguucgacgugggcggccagagagacgagagaagaaaguggauccagugcuucaacgacgugaccgccaucaucuacguggccgccugcagcagcuacaacauggugaucagagaggacaacaacaccaacagacugagagagagccuggaccuguucgagagcaucuggaacaacagauggcugagaaccaucagcaucauccuguuccugaacaagcaggacaugcuggccgagaaggugcuggccggcaagagcaagaucgaggacuacuuccccgaguacgccaacuacaccgugcccgaggacgccacccccgacgccggcgaggaccccaaggugaccagagccaaguucuucaucagagaccuguuccugagaaucagcaccgccaccggcgacggcaagcacuacugcuacccccacuucaccugcgccguggacaccgagaacaucagaagaguguucaacgacugcagagacaucauccagagaaugcaccugaagcaguacgagcugcuguaa

SEQ ID NO: 17597 - RNA, 1065 nt, Artificial Sequence
  GNAO1__Homo_sapiens__NP_066268
augggcugcacccugagcgccgaggagagagccgcccuggagagaagcaaggccaucgagaagaaccugaaggaggacggcaucagcgccgccaaggacgugaagcugcugcugcugggcgccggcgagagcggcaagagcaccaucgugaagcagaugaagaucauccacgaggacggcuucagcggcgaggacgugaagcaguacaagcccgugguguacagcaacaccauccagagccuggccgccaucgugagagccauggacacccugggcaucgaguacggcgacaaggagagaaaggccgacgccaagauggugugcgacguggugagcagaauggaggacaccgagcccuucagcgccgagcugcugagcgccaugaugagacuguggggcgacagcggcauccaggagugcuucaacagaagcagagaguaccagcugaacgacagcgccaaguacuaccuggacagccuggacagaaucggcgccgccgacuaccagcccaccgagcaggacauccugagaaccagagugaagaccaccggcaucguggagacccacuucaccuucaagaaccugcacuucagacuguucgacgugggcggccagagaagcgagagaaagaaguggauccacugcuucgaggacgugaccgccaucaucuucugcguggcccugagcggcuacgaccaggugcugcacgaggacgagaccaccaacagaaugcacgagagccugaugcuguucgacagcaucugcaacaacaaguucuucaucgacaccagcaucauccuguuccugaacaagaaggaccuguucggcgagaagaucaagaagagcccccugaccaucugcuuccccgaguacaccggccccaacaccuacgaggacgccgccgccuacauccaggcccaguucgagagcaagaacagaagccccaacaaggagaucuacugccacaugaccugcgccaccgacaccaacaacauccaggugguguucgacgccgugaccgacaucaucaucgccaacaaccugagaggcugcggccuguacuaa

SEQ ID NO: 17598 - RNA, 1080 nt, Artificial Sequence
  GNAQ__Homo_sapiens__NP_002063
augacccuggagagcaucauggccugcugccugagcgaggaggccaaggaggccagaagaaucaacgacgagaucgagagacagcugagaagagacaagagagacgccagaagagagcugaagcugcugcugcugggcaccggcgagagcggcaagagcaccuucaucaagcagaugagaaucauccacggcagcggcuacagcgacgaggacaagagaggcuucaccaagcugguguaccagaacaucuucaccgccaugcaggccaugaucagagccauggacacccugaagauccccuacaaguacgagcacaacaaggcccacgcccagcuggugagagagguggacguggagaaggugagcgccuucgagaaccccuacguggacgccaucaagagccuguggaacgaccccggcauccaggagugcuacgacagaagaagagaguaccagcugagcgacagcaccaaguacuaccugaacgaccuggacagaguggccgaccccgccuaccugcccacccagcaggacgugcugagagugagagugcccaccaccggcaucaucgaguaccccuucgaccugcagagcgugaucuucagaaugguggacgugggcggccagagaagcgagagaagaaaguggauccacugcuucgagaacgugaccagcaucauguuccugguggcccugagcgaguacgaccaggugcugguggagagcgacaacgagaacagaauggaggagagcaaggcccuguucagaaccaucaucaccuaccccugguuccagaacagcagcgugauccuguuccugaacaagaaggaccugcuggaggagaagaucauguacagccaccugguggacuacuuccccgaguacgacggcccccagagagacgcccaggccgccagagaguucauccugaagauguucguggaccugaaccccgacagcgacaagaucaucuacagccacuucaccugcgccaccgacaccgagaacaucagauucguguucgccgccgugaaggacaccauccugcagcugaaccugaaggaguacaaccugguguaa

SEQ ID NO: 17599 - RNA, 1185 nt, Artificial Sequence
  GNAS__Homo_sapiens__NP_000507
augggcugccugggcaacagcaagaccgaggaccagagaaacgaggagaaggcccagagagaggccaacaagaagaucgagaagcagcugcagaaggacaagcagguguacagagccacccacagacugcugcugcugggcgccggcgagagcggcaagagcaccaucgugaagcagaugagaauccugcacgugaacggcuucaacggcgagggcggcgaggaggacccccaggccgccagaagcaacagcgacggcgagaaggccaccaaggugcaggacaucaagaacaaccugaaggaggccaucgagaccaucguggccgccaugagcaaccuggugccccccguggagcuggccaaccccgagaaccaguucagaguggacuacauccugagcgugaugaacgugcccgacuucgacuucccccccgaguucuacgagcacgccaaggcccugugggaggacgagggcgugagagccugcuacgagagaagcaacgaguaccagcugaucgacugcgcccaguacuuccuggacaagaucgacgugaucaagcaggccgacuacgugcccagcgaccaggaccugcugagaugcagagugcugaccagcggcaucuucgagaccaaguuccagguggacaaggugaacuuccacauguucgacgugggcggccagagagacgagagaagaaaguggauccagugcuucaacgacgugaccgccaucaucuucgugguggccagcagcagcuacaacauggugaucagagaggacaaccagaccaacagacugcaggaggcccugaaccuguucaagagcaucuggaacaacagauggcugagaaccaucagcgugauccuguuccugaacaagcaggaccugcuggccgagaaggugcuggccggcaagagcaagaucgaggacuacuuccccgaguucgccagauacaccacccccgaggacgccacccccgagcccggcgaggaccccagagugaccagagccaaguacuucaucagagacgaguuccugagaaucagcaccgccagcggcgacggcagacacuacugcuacccccacuucaccugcgccguggacaccgagaacaucagaagaguguucaacgacugcagagacaucauccagagaaugcaccugagacaguacgagcugcuguaa

SEQ ID NO: 17600 - RNA, 1053 nt, Artificial Sequence
  GNAT1__Homo_sapiens__NP_653082
augggcgccggcgccagcgccgaggagaagcacagcagagagcuggagaagaagcugaaggaggacgccgagaaggacgccagaaccgugaagcugcugcugcugggcgccggcgagagcggcaagagcaccaucgugaagcagaugaagaucauccaccaggacggcuacagccuggaggagugccuggaguucaucgccaucaucuacggcaacacccugcagagcauccuggccaucgugagagccaugaccacccugaacauccaguacggcgacagcgccagacaggacgacgccagaaagcugaugcacauggccgacaccaucgaggagggcaccaugcccaaggagaugagcgacaucauccagagacuguggaaggacagcggcauccaggccugcuucgagagagccagcgaguaccagcugaacgacagcgccggcuacuaccugagcgaccuggagagacuggugacccccggcuacgugcccaccgagcaggacgugcugagaagcagagugaagaccaccggcaucaucgagacccaguucagcuucaaggaccugaacuucagaauguucgacgugggcggccagagaagcgagagaaagaaguggauccacugcuucgagggcgugaccugcaucaucuucaucgccgcccugagcgccuacgacauggugcugguggaggacgacgaggugaacagaaugcacgagagccugcaccuguucaacagcaucugcaaccacagauacuucgccaccaccagcaucgugcuguuccugaacaagaaggacguguucuucgagaagaucaagaaggcccaccugagcaucugcuuccccgacuacgacggccccaacaccuacgaggacgccggcaacuacaucaaggugcaguuccuggagcugaacaugagaagagacgugaaggagaucuacagccacaugaccugcgccaccgacacccagaacgugaaguucguguucgacgccgugaccgacaucaucaucaaggagaaccugaaggacugcggccuguucuaa

SEQ ID NO: 17601 - RNA, 1065 nt, Artificial Sequence
  GNAT3__Homo_sapiens__NP_001095856
augggcagcggcaucagcagcgagagcaaggagagcgccaagagaagcaaggagcuggagaagaagcugcaggaggacgccgagagagacgccagaaccgugaagcugcugcugcugggcgccggcgagagcggcaagagcaccaucgugaagcagaugaagaucauccacaagaacggcuacagcgagcaggagugcauggaguucaaggccgugaucuacagcaacacccugcagagcauccuggccaucgugaaggccaugaccacccugggcaucgacuacgugaaccccagaagcgccgaggaccagagacagcuguacgccauggccaacacccuggaggacggcggcaugaccccccagcuggccgaggugaucaagagacuguggagagaccccggcauccaggccugcuucgagagagccagcgaguaccagcugaacgacagcgccgccuacuaccugaacgaccuggacagaaucaccgccagcggcuacgugcccaacgagcaggacgugcugcacagcagagugaagaccaccggcaucaucgagacccaguucagcuucaaggaccugcacuucagaauguucgacgugggcggccagagaagcgagagaaagaaguggauccacugcuucgagggcgugaccugcaucaucuucugcgccgcccugagcgccuacgacauggugcugguggaggacgaggaggugaacagaaugcacgagagccugcaccuguucaacagcaucugcaaccacaaguacuucagcaccaccagcaucgugcuguuccugaacaagaaggacaucuuccaggagaaggugaccaaggugcaccugagcaucugcuuccccgaguacaccggccccaacaccuucgaggacgccggcaacuacaucaagaaccaguuccuggaccugaaccugaagaaggaggacaaggagaucuacagccacaugaccugcgccaccgacacccagaacgugaaguucguguucgacgccgugaccgacaucaucaucaaggagaaccugaaggacugcggccuguucuaa

SEQ ID NO: 17602 - RNA, 1068 nt, Artificial Sequence
  GNAZ__Homo_sapiens__NP_002064
augggcugcagacagagcagcgaggagaaggaggccgccagaagaagcagaagaaucgacagacaccugagaagcgagagccagagacagagaagagagaucaagcugcugcugcugggcaccagcaacagcggcaagagcaccaucgugaagcagaugaagaucauccacagcggcggcuucaaccuggaggccugcaaggaguacaagccccugaucaucuacaacgccaucgacagccugaccagaaucaucagagcccuggccgcccugagaaucgacuuccacaaccccgacagagccuacgacgccgugcagcuguucgcccugaccggccccgccgagagcaagggcgagaucacccccgagcugcugggcgugaugagaagacugugggccgaccccggcgcccaggccugcuucagcagaagcagcgaguaccaccuggaggacaacgccgccuacuaccugaacgaccuggagagaaucgccgccgccgacuacauccccaccguggaggacauccugagaagcagagacaugaccaccggcaucguggagaacaaguucaccuucaaggagcugaccuucaagaugguggacgugggcggccagagaagcgagagaaagaaguggauccacugcuucgagggcgugaccgccaucaucuucugcguggagcugagcggcuacgaccugaagcuguacgaggacaaccagaccagcagaauggccgagagccugagacuguucgacagcaucugcaacaacaacugguucaucaacaccagccugauccuguuccugaacaagaaggaccugcuggccgagaagaucagaagaaucccccugaccaucugcuuccccgaguacaagggccagaacaccuacgaggaggccgccguguacauccagagacaguucgaggaccugaacagaaacaaggagaccaaggagaucuacagccacuucaccugcgccaccgacaccagcaacauccaguucguguucgacgccgugaccgacgugaucauccagaacaaccugaaguacaucggccugugcuaa

SEQ ID NO: 17603 - RNA, 984 nt, Artificial Sequence
  GNB1L__Homo_sapiens__NP_443730
augaccgcccccugccccccccccccccccgacccccaguucgugcugagaggcacccagagccccgugcacgcccugcacuucugcgagggcgcccaggcccagggcagaccccugcuguucagcggcagccagagcggccuggugcacaucuggagccugcagaccagaagagccgugaccacccuggacggccacggcggccagugcgugaccuggcugcagacccugccccagggcagacagcugcugagccagggcagagaccugaagcugugccugugggaccuggccgagggcagaagcgccgugguggacagcgugugccuggagagcgugggcuucugcagaagcagcauccuggccggcggccagcccagauggacccuggccgugcccggcagaggcagcgacgaggugcagauccuggagaugcccagcaagaccagcgugugcgcccugaagcccaaggccgacgccaagcugggcaugcccaugugccugagacuguggcaggccgacugcagcagcagaccccugcugcuggccggcuacgaggacggcagcguggugcugugggacgugagcgagcagaaggugugcagcagaaucgccugccacgaggagcccgugauggaccuggacuucgacagccagaaggccagaggcaucagcggcagcgccggcaaggcccuggccguguggagccuggacuggcagcaggcccugcaggugagaggcacccacgagcugaccaaccccggcaucgccgaggugaccaucagacccgacagaaagauccuggccaccgccggcugggaccacagaaucagaguguuccacuggagaaccaugcagccccuggccgugcuggccuuccacagcgccgccgugcagugcguggccuucaccgccgacggccugcuggccgccggcagcaaggaccagagaaucagccuguggagccuguaccccagagccuaa

SEQ ID NO: 17604 - RNA, 954 nt, Artificial Sequence
  GNB2L1__Homo_sapiens__NP_006089
augaccgagcagaugacccugagaggcacccugaagggccacaacggcugggugacccagaucgccaccaccccccaguuccccgacaugauccugagcgccagcagagacaagaccaucaucauguggaagcugaccagagacgagaccaacuacggcaucccccagagagcccugagaggccacagccacuucgugagcgacguggugaucagcagcgacggccaguucgcccugagcggcagcugggacggcacccugagacugugggaccugaccaccggcaccaccaccagaagauucgugggccacaccaaggacgugcugagcguggccuucagcagcgacaacagacagaucgugagcggcagcagagacaagaccaucaagcuguggaacacccugggcgugugcaaguacaccgugcaggacgagagccacagcgagugggugagcugcgugagauucagccccaacagcagcaaccccaucaucgugagcugcggcugggacaagcuggugaagguguggaaccuggccaacugcaagcugaagaccaaccacaucggccacaccggcuaccugaacaccgugaccgugagccccgacggcagccugugcgccagcggcggcaaggacggccaggccaugcugugggaccugaacgagggcaagcaccuguacacccuggacggcggcgacaucaucaacgcccugugcuucagccccaacagauacuggcugugcgccgccaccggccccagcaucaagaucugggaccuggagggcaagaucaucguggacgagcugaagcaggaggugaucagcaccagcagcaaggccgagcccccccagugcaccagccuggccuggagcgccgacggccagacccuguucgccggcuacaccgacaaccuggugagaguguggcaggugaccaucggcaccagauaa

SEQ ID NO: 17605 - RNA, 1023 nt, Artificial Sequence
  GNB3__Homo_sapiens__NP_002066
augggcgagauggagcagcugagacaggaggccgagcagcugaagaagcagaucgccgacgccagaaaggccugcgccgacgugacccuggccgagcuggugagcggccuggagguggugggcagagugcagaugagaaccagaagaacccugagaggccaccuggccaagaucuacgccaugcacugggccaccgacagcaagcugcuggugagcgccagccaggacggcaagcugaucgugugggacagcuacaccaccaacaaggugcacgccaucccccugagaagcagcugggugaugaccugcgccuacgcccccagcggcaacuucguggccugcggcggccuggacaacaugugcagcaucuacaaccugaagagcagagagggcaacgugaaggugagcagagagcugagcgcccacaccggcuaccugagcugcugcagauuccuggacgacaacaacaucgugaccagcagcggcgacaccaccugcgcccugugggacaucgagaccggccagcagaagaccguguucgugggccacaccggcgacugcaugagccuggccgugagccccgacuucaaccuguucaucagcggcgccugcgacgccagcgccaagcugugggacgugagagagggcaccugcagacagaccuucaccggccacgagagcgacaucaacgccaucugcuucuuccccaacggcgaggccaucugcaccggcagcgacgacgccagcugcagacuguucgaccugagagccgaccaggagcugaucugcuucagccacgagagcaucaucugcggcaucaccagcguggccuucagccugagcggcagacugcuguucgccggcuacgacgacuucaacugcaacgugugggacagcaugaagagcgagagagugggcauccugagcggccacgacaacagagugagcugccugggcgugaccgccgacggcauggccguggccaccggcagcugggacagcuuccugaagaucuggaacuaa

SEQ ID NO: 17606 - RNA, 1023 nt, Artificial Sequence
  GNB4__Homo_sapiens__XP_006713784
augagcgagcuggagcagcugagacaggaggccgagcagcugagaaaccagauccaggacgccagaaaggccugcaacgacgccacccuggugcagaucaccagcaacauggacagcgugggcagaauccagaugagaaccagaagaacccugagaggccaccuggccaagaucuacgccaugcacuggggcuacgacagcagacugcuggugagcgccagccaggacggcaagcugaucaucugggacagcuacaccaccaacaagaugcacgccaucccccugagaagcagcugggugaugaccugcgccuacgcccccagcggcaacuacguggccugcggcggccuggacaacaucugcagcaucuacaaccugaagaccagagagggcaacgugagagugagcagagagcugcccggccacaccggcuaccugagcugcugcagauuccuggacgacagccagaucgugaccagcagcggcgacaccaccugcgcccugugggacaucgagaccgcccagcagaccaccaccuucaccggccacagcggcgacgugaugagccugagccugagccccgacaugagaaccuucgugagcggcgccugcgacgccagcagcaagcugugggacaucagagacggcaugugcagacagagcuucaccggccacgugagcgacaucaacgccgugagcuucuuccccaacggcuacgccuucgccaccggcagcgacgacgccaccugcagacuguucgaccugagagccgaccaggagcugcugcuguacagccacgacaacaucaucugcggcaucaccagcguggccuucagcaagagcggcagacugcugcuggccggcuacgacgacuucaacugcaacgugugggacacccugaagggcgacagagccggcgugcuggccggccacgacaacagagugagcugccugggcgugaccgacgacggcauggccguggccaccggcagcugggacagcuuccugagaaucuggaacuaa

SEQ ID NO: 17607 - RNA, 1062 nt, Artificial Sequence
  GNB5__Homo_sapiens__NP_006569
auggccaccgagggccugcacgagaacgagacccuggccagccugaagagcgaggccgagagccugaagggcaagcuggaggaggagagagccaagcugcacgacguggagcugcaccagguggccgagagaguggaggcccugggccaguucgugaugaagaccagaagaacccugaagggccacggcaacaaggugcugugcauggacuggugcaaggacaagagaagaaucgugagcagcagccaggacggcaaggugaucgugugggacagcuucaccaccaacaaggagcacgccgugaccaugcccugcaccugggugauggccugcgccuacgcccccagcggcugcgccaucgccugcggcggccuggacaacaagugcagcguguacccccugaccuucgacaagaacgagaacauggccgccaagaagaagagcguggccaugcacaccaacuaccugagcgccugcagcuucaccaacagcgacaugcagauccugaccgccagcggcgacggcaccugcgcccugugggacguggagagcggccagcugcugcagagcuuccacggccacggcgccgacgugcugugccuggaccuggcccccagcgagaccggcaacaccuucgugagcggcggcugcgacaagaaggccauggugugggacaugagaagcggccagugcgugcaggccuucgagacccacgagagcgacaucaacagcgugagauacuaccccagcggcgacgccuucgccagcggcagcgacgacgccaccugcagacuguacgaccugagagccgacagagagguggccaucuacagcaaggagagcaucaucuucggcgccagcagcguggacuucagccugagcggcagacugcuguucgccggcuacaacgacuacaccaucaacgugugggacgugcugaagggcagcagagugagcauccuguucggccacgagaacagagugagcacccugagagugagccccgacggcaccgccuucugcagcggcagcugggaccacacccugagagugugggccuaa

SEQ ID NO: 17608 - RNA, 2262 nt, Artificial Sequence
  GNE__Homo_sapiens__NP_001121699
auggagaccuacggcuaccugcagagagagagcugcuuccagggcccccacgagcuguacuucaagaaccugagcaagagaaacaagcagaucauggagaagaacggcaacaacagaaagcugagagugugcguggccaccugcaacagagccgacuacagcaagcuggcccccaucauguucggcaucaagaccgagcccgaguucuucgagcuggacgugguggugcugggcagccaccugaucgacgacuacggcaacaccuacagaaugaucgagcaggacgacuucgacaucaacaccagacugcacaccaucgugagaggcgaggacgaggccgccaugguggagagcgugggccuggcccuggugaagcugcccgacgugcugaacagacugaagcccgacaucaugaucgugcacggcgacagauucgacgcccuggcccuggccaccagcgccgcccugaugaacaucagaauccugcacaucgagggcggcgaggugagcggcaccaucgacgacagcaucagacacgccaucaccaagcuggcccacuaccacgugugcugcaccagaagcgccgagcagcaccugaucagcaugugcgaggaccacgacagaauccugcuggccggcugccccagcuacgacaagcugcugagcgccaagaacaaggacuacaugagcaucaucagaauguggcugggcgacgacgugaagagcaaggacuacaucguggcccugcagcaccccgugaccaccgacaucaagcacagcaucaagauguucgagcugacccuggacgcccugaucagcuucaacaagagaacccuggugcuguuccccaacaucgacgccggcagcaaggagauggugagagugaugagaaagaagggcaucgagcaccaccccaacuucagagccgugaagcacgugcccuucgaccaguucauccagcugguggcccacgccggcugcaugaucggcaacagcagcugcggcgugagagaggugggcgccuucggcacccccgugaucaaccugggcaccagacagaucggcagagagaccggcgagaacgugcugcacgugagagacgccgacacccaggacaagauccugcaggcccugcaccugcaguucggcaagcaguaccccugcagcaagaucuacggcgacggcaacgccgugcccagaauccugaaguuccugaagagcaucgaccugcaggagccccugcagaagaaguucugcuucccccccgugaaggagaacaucagccaggacaucgaccacauccuggagacccugagcgcccuggccguggaccugggcggcaccaaccugagaguggccaucgugagcaugaagggcgagaucgugaagaaguacacccaguucaaccccaagaccuacgaggagagaaucaaccugauccugcagaugugcguggaggccgccgccgaggccgugaagcugaacugcagaauccugggcgugggcaucagcaccggcggcagagugaaccccagagagggcaucgugcugcacagcaccaagcugauccaggaguggaacagcguggaccugagaaccccccugagcgacacccugcaccugcccguguggguggacaacgacggcaacugcgccgcccuggccgagagaaaguucggccagggcaagggccuggagaacuucgugacccugaucaccggcaccggcaucggcggcggcaucauccaccagcacgagcugauccacggcagcagcuucugcgccgccgagcugggccaccugguggugagccuggacggccccgacugcagcugcggcagccacggcugcaucgaggccuacgccagcggcauggcccugcagagagaggccaagaagcugcacgacgaggaccugcugcugguggagggcaugagcgugcccaaggacgaggccgugggcgcccugcaccugauccaggccgccaagcugggcaacgccaaggcccagagcauccugagaaccgccggcaccgcccugggccugggcguggugaacauccugcacaccaugaaccccagccuggugauccugagcggcgugcuggccagccacuacauccacaucgugaaggacgugaucagacagcaggcccugagcagcgugcaggacguggacgugguggugagcgaccugguggaccccgcccugcugggcgccgccagcauggugcuggacuacaccaccagaagaaucuacuaa

SEQ ID NO: 17609 - RNA, 207 nt, Artificial Sequence
  GNG10__Homo_sapiens__NP_001017998
augagcagcggcgccagcgccagcgcccugcagagacugguggagcagcugaagcuggaggccggcguggagagaaucaaggugagccaggccgccgccgagcugcagcaguacugcaugcagaacgccugcaaggacgcccugcuggugggcgugcccgccggcagcaaccccuucagagagcccagaagcugcgcccugcuguaa

SEQ ID NO: 17610 - RNA, 222 nt, Artificial Sequence
  GNG11__Homo_sapiens__NP_004117
augcccgcccugcacaucgaggaccugcccgagaaggagaagcugaagauggagguggagcagcugagaaaggaggugaagcugcagagacagcaggugagcaagugcagcgaggagaucaagaacuacaucgaggagagaagcggcgaggacccccuggugaagggcauccccgaggacaagaaccccuucaaggagaagggcagcugcgugaucagcuaa

SEQ ID NO: 17611 - RNA, 216 nt, Artificial Sequence
  GNG2__Homo_sapiens__XP_011535148
auggccagcaacaacaccgccagcaucgcccaggccagaaagcugguggagcagcugaagauggaggccaacaucgacagaaucaaggugagcaaggccgccgccgaccugauggccuacugcgaggcccacgccaaggaggacccccugcugacccccgugcccgccagcgagaaccccuucagagagaagaaguucuucugcgccauccuguaa

SEQ ID NO: 17612 - RNA, 228 nt, Artificial Sequence
  GNG4__Homo_sapiens__NP_004476
augaaggagggcaugagcaacaacagcaccaccagcaucagccaggccagaaaggccguggagcagcugaagauggaggccugcauggacagagugaaggugagccaggccgccgccgaccugcuggccuacugcgaggcccacgugagagaggacccccugaucauccccgugcccgccagcgagaaccccuucagagagaagaaguucuucugcaccauccuguaa

SEQ ID NO: 17613 - RNA, 207 nt, Artificial Sequence
  GNG7__Homo_sapiens__NP_443079
augagcgccaccaacaacaucgcccaggccagaaagcugguggagcagcugagaaucgaggccggcaucgagagaaucaaggugagcaaggccgccagcgaccugaugagcuacugcgagcagcacgccagaaacgacccccugcuggugggcgugcccgccagcgagaaccccuucaaggacaagaagcccugcaucauccuguaa

SEQ ID NO: 17614 - RNA, 213 nt, Artificial Sequence
  GNG8__Homo_sapiens__NP_150283
augagcaacaacauggccaagaucgccgaggccagaaagaccguggagcagcugaagcuggaggugaacaucgacagaaugaaggugagccaggccgccgccgagcugcuggccuucugcgagacccacgccaaggacgacccccuggugacccccgugcccgccgccgagaaccccuucagagacaagagacuguucugcgugcugcuguaa

SEQ ID NO: 17615 - RNA, 225 nt, Artificial Sequence
  GNGT1__Homo_sapiens__NP_068774
augcccgugaucaacaucgaggaccugaccgagaaggacaagcugaagauggagguggaccagcugaagaaggaggugacccuggagagaaugcuggugagcaagugcugcgaggaggugagagacuacguggaggagagaagcggcgaggacccccuggugaagggcauccccgaggacaagaaccccuucaaggagcugaagggcggcugcgugaucagcuaa

SEQ ID NO: 17616 - RNA, 210 nt, Artificial Sequence
  GNGT2__Homo_sapiens__XP_006721882
auggcccaggaccugagcgagaaggaccugcugaagauggagguggagcagcugaagaaggaggugaagaacaccagaauccccaucagcaaggccggcaaggagaucaaggaguacguggaggcccaggccggcaacgaccccuuccugaagggcauccccgaggacaagaaccccuucaaggagaagggcggcugccugaucagcuaa

SEQ ID NO: 17617 - RNA, 1824 nt, Artificial Sequence
  GNL1__Homo_sapiens__NP_005266
augcccagaaagaagcccuucagcgugaagcagaagaagaagcagcugcaggacaagagagagagaaagagaggccugcaggacggccugagaagcagcagcaacagcagaagcggcagcagagagagaagagaggagcagaccgacaccagcgacggcgagagcgugacccaccacaucagaagacugaaccagcagcccagccagggccugggccccagaggcuacgaccccaacagauacagacugcacuucgagagagacagcagagaggagguggagagaagaaagagagccgccagagagcaggugcugcagcccgugagcgccgagcugcuggagcuggacaucagagagguguaccagcccggcagcgugcuggacuuccccagaagaccccccuggagcuacgagaugagcaaggagcagcugaugagccaggaggagagaagcuuccaggacuaccugggcaagauccacggcgccuacagcagcgagaagcugagcuacuucgagcacaaccuggagaccuggagacagcuguggagagugcuggagaugagcgacaucgugcugcugaucaccgacaucagacaccccguggugaacuucccccccgcccuguacgaguacgugaccggcgagcugggccuggcccuggugcuggugcugaacaagguggaccuggccccccccgcccuggugguggccuggaagcacuacuuccaccagcacuacccccagcugcacguggugcuguucaccagcuuccccagagaccccagaaccccccaggaccccagcagcgugcugaagaagagcagaagaagaggcagaggcuggaccagagcccugggccccgagcagcugcugagagccugcgaggccaucaccgugggcaagguggaccugagcagcuggagagagaagaucgccagagacguggccggcgccaccuggggcaacggcagcggcgaggaggaggaggaggaggacggccccgccgugcugguggagcagcagaccgacagcgccauggagcccaccggccccacccaggagagauacaaggacggcguggugaccaucggcugcgugggcuuccccaacgugggcaagagcagccugaucaacggccuggugggcagaaagguggugagcgugagcagaacccccggccacaccagauacuuccagaccuacuuccugacccccagcgugaagcugugcgacugccccggccugaucuuccccagccugcugcccagacagcugcaggugcuggccggcaucuaccccaucgcccagauccaggagcccuacaccgccgugggcuaccuggccagcagaauccccgugcaggcccugcugcaccugagacaccccgaggccgaggaccccagcgccgagcaccccuggugcgccugggacaucugcgaggccugggccgagaagagaggcuacaagaccgccaaggccgccagaaacgacguguacagagccgccaacagccugcugagacuggccguggacggcagacugagccugugcuuccacccccccggcuacagcgagcagaagggcaccugggagagccaccccgagaccaccgagcugguggugcugcagggcagagugggccccgccggcgacgaggaggaggaggaggaggaggagcugagcagcagcugcgaggaggagggcgaggaggacagagacgccgacgaggagggcgagggcgacgaggagacccccaccagcgcccccggcagcagccuggccggcagaaaccccuacgcccugcugggcgaggacgagugcuaa

SEQ ID NO: 17618 - RNA, 1650 nt, Artificial Sequence
  GNL3__Homo_sapiens__NP_055181
augaagagacccaagcugaagaaggccagcaagagaaugaccugccacaagagauacaagauccagaagaaggugagagagcaccacagaaagcugagaaaggaggccaagaagagaggccacaagaagcccagaaaggaccccggcgugcccaacagcgcccccuucaaggaggcccugcugagagaggccgagcugagaaagcagagacuggaggagcugaagcagcagcagaagcuggacagacagaaggagcuggagaagaagagaaagcuggagaccaaccccgacaucaagcccagcaacguggagcccauggagaaggaguucggccugugcaagaccgagaacaaggccaagagcggcaagcagaacagcaagaagcuguacugccaggagcugaagaaggugaucgaggccagcgacguggugcuggaggugcuggacgccagagacccccugggcugcagaugcccccagguggaggaggccaucgugcagagcggccagaagaagcuggugcugauccugaacaagagcgaccuggugcccaaggagaaccuggagagcuggcugaacuaccugaagaaggagcugcccaccgugguguucagagccagcaccaagcccaaggacaagggcaagaucaccaagagagugaaggccaagaagaacgccgcccccuucagaagcgaggugugcuucggcaaggagggccuguggaagcugcugggcggcuuccaggagaccugcagcaaggccaucagagugggcgugaucggcuuccccaacgugggcaagagcagcaucaucaacagccugaagcaggagcagaugugcaacgugggcgugagcaugggccugaccagaagcaugcagguggugccccuggacaagcagaucaccaucaucgacagccccagcuucaucgugagcccccugaacagcagcagcgcccuggcccugagaagccccgccagcaucgagguggugaagcccauggaggccgccagcgccauccugagccaggccgacgccagacagguggugcugaaguacaccgugcccggcuacagaaacagccuggaguucuucaccgugcuggcccagagaagaggcaugcaccagaagggcggcauccccaacguggagggcgccgccaagcugcuguggagcgaguggaccggcgccagccuggccuacuacugccacccccccaccagcuggacccccccccccuacuucaacgagagcaucgugguggacaugaagagcggcuucaaccuggaggagcuggagaagaacaacgcccagagcaucagagccaucaagggcccccaccuggccaacagcauccuguuccagagcagcggccugaccaacggcaucaucgaggagaaggacauccacgaggagcugcccaagagaaaggagagaaagcaggaggagagagaggacgacaaggacagcgaccaggagaccguggacgaggagguggacgagaacagcagcggcauguucgccgccgaggagaccggcgaggcccugagcgaggagaccaccgccggcgagcagagcaccagaagcuucauccuggacaagaucaucgaggaggacgacgccuacgacuucagcaccgacuacguguaa

SEQ ID NO: 17619 - RNA, 1749 nt, Artificial Sequence
  GNL3L__Homo_sapiens__NP_061940
augaugaagcugagacacaagaacaagaagcccggcgagggcagcaagggccacaagaagaucagcuggcccuacccccagcccgccaagcagaacggcaagaaggccaccagcaaggugcccagcgccccccacuucgugcaccccaacgaccacgccaacagagaggccgagcugaagaagaaguggguggaggagaugagagagaagcagcaggccgccagagagcaggagagacagaagagaagaaccaucgagagcuacugccaggacgugcugagaagacaggaggaguucgagcacaaggaggaggugcugcaggagcugaacauguucccccagcuggacgacgaggccaccagaaaggccuacuacaaggaguucagaaaggugguggaguacagcgacgugauccuggaggugcuggacgccagagacccccugggcugcagaugcuuccagauggaggaggccgugcugagagcccagggcaacaagaagcuggugcuggugcugaacaagaucgaccuggugcccaaggaggugguggagaaguggcuggacuaccugagaaacgagcugcccaccguggccuucaaggccagcacccagcaccaggugaagaaccugaacagaugcagcgugcccguggaccaggccagcgagagccugcugaagagcaaggccugcuucggcgccgagaaccugaugagagugcugggcaacuacugcagacugggcgaggugagaacccacaucagagugggcguggugggccugcccaacgugggcaagagcagccugaucaacagccugaagagaagcagagccugcagcgugggcgccgugcccggcaucaccaaguucaugcaggagguguaccuggacaaguucaucagacugcuggacgcccccggcaucgugcccggccccaacagcgaggugggcaccauccugagaaacugcgugcacgugcagaagcuggccgaccccgugacccccguggagaccauccugcagagaugcaaccuggaggagaucagcaacuacuacggcgugagcggcuuccagaccaccgagcacuuccugaccgccguggcccacagacugggcaagaagaagaagggcggccuguacagccaggagcaggccgccaaggccgugcuggccgacugggugagcggcaagaucagcuucuacauccccccccccgccacccacacccugcccacccaccugagcgccgagaucgugaaggagaugaccgagguguucgacaucgaggacaccgagcaggccaacgaggacaccauggagugccuggccaccggcgagagcgacgagcugcugggcgacaccgacccccuggagauggagaucaagcugcugcacagccccaugaccaagaucgccgacgccaucgagaacaagaccaccguguacaagaucggcgaccugaccggcuacugcaccaaccccaacagacaccagaugggcugggccaagagaaacguggaccacagacccaagagcaacagcaugguggacgugugcagcguggacagaagaagcgugcugcagagaaucauggagaccgacccccugcagcagggccaggcccuggccagcgcccugaagaacaagaagaagaugcagaagagagccgacaagaucgccagcaagcugagcgacagcaugaugagcgcccuggaccugagcggcaacgccgacgacggcgugggcgacuaa

SEQ ID NO: 17620 - RNA, 519 nt, Artificial Sequence
  GNLY__Homo_sapiens__NP_001289687
auggccaccugggcccugcugcugcuggccgccaugcugcugggcaaccccggccuggaggugagcgugagccccaagggcaagaacaccagcggcagagagagcggcuucggcugggccaucuggauggagggccugguguucagcagacugagccccgaguacuacgaccuggccagagcccaccugagagacgaggagaagagcugccccugccuggcccaggagggcccccagggcgaccugcugaccaagacccaggagcugggcagagacuacagaaccugccugaccaucgugcagaagcugaagaagaugguggacaagcccacccagagaagcgugagcaacgccgccaccagagugugcagaaccggcagaagcagauggagagacgugugcagaaacuucaugagaagauaccagagcagagugacccagggccugguggccggcgagaccgcccagcagaucugcgaggaccugagacugugcauccccagcaccggcccccuguaa

SEQ ID NO: 17621 - RNA, 888 nt, Artificial Sequence
  GNMT__Homo_sapiens__NP_061833
augguggacagcguguacagaaccagaagccugggcguggccgccgagggccugcccgaccaguacgccgacggcgaggccgccagaguguggcagcuguacaucggcgacaccagaagcagaaccgccgaguacaaggccuggcugcugggccugcugagacagcacggcugccagagagugcuggacguggccugcggcaccggcguggacagcaucaugcugguggaggagggcuucagcgugaccagcguggacgccagcgacaagaugcugaaguacgcccugaaggagagauggaacagaagacacgagcccgccuucgacaagugggugaucgaggaggccaacuggaugacccuggacaaggacgugccccagagcgccgagggcggcuucgacgccgugaucugccugggcaacagcuucgcccaccugcccgacugcaagggcgaccagagcgagcacagacuggcccugaagaacaucgccagcauggugagagccggcggccugcuggugaucgaccacagaaacuacgaccacauccugagcaccggcugcgccccccccggcaagaacaucuacuacaagagcgaccugaccaaggacgugaccaccagcgugcugaucgugaacaacaaggcccacauggugacccuggacuacaccgugcaggugcccggcgccggccaggacggcagccccggccugagcaaguucagacugagcuacuacccccacugccuggccagcuucaccgagcugcugcaggccgccuucggcggcaagugccagcacagcgugcugggcgacuucaagcccuacaagcccggccagaccuacauccccugcuacuucauccacgugcugaagagaaccgacuaa

SEQ ID NO: 17622 - RNA, 2043 nt, Artificial Sequence
  GNPAT__Homo_sapiens__NP_055051
auggagagcagcagcagcagcaacagcuacuucagcgugggccccaccagccccagcgccguggugcugcuguacagcaaggagcugaagaagugggacgaguucgaggacauccuggaggagagaagacacgugagcgaccugaaguucgccaugaagugcuacaccccccugguguacaagggcaucacccccugcaagcccaucgacaucaagugcagcgugcugaacagcgaggagauccacuacgugaucaagcagcugagcaaggagagccugcagagcguggacgugcugagagaggaggugagcgagauccuggacgagaugagccacaagcugagacugggcgccaucagauucugcgccuucacccugagcaagguguucaagcagaucuucagcaaggugugcgugaacgaggagggcauccagaagcugcagagagccauccaggagcaccccguggugcugcugcccagccacagaagcuacaucgacuuccugaugcugagcuuccugcuguacaacuacgaccugcccgugcccgugaucgccgccggcauggacuuccugggcaugaagauggugggcgagcugcugagaaugagcggcgccuucuucaugagaagaaccuucggcggcaacaagcuguacugggccguguucagcgaguacgugaagaccaugcugagaaacggcuacgcccccguggaguucuuccuggagggcaccagaagcagaagcgccaagacccugacccccaaguucggccugcugaacaucgugauggagcccuucuucaagagagagguguucgacaccuaccuggugcccaucagcaucagcuacgacaagauccuggaggagacccuguacguguacgagcugcugggcgugcccaagcccaaggagagcaccaccggccugcugaaggccagaaagauccugagcgagaacuucggcagcauccacguguacuucggcgaccccgugagccugagaagccuggccgccggcagaaugagcagaagcagcuacaaccuggugcccagauacaucccccagaagcagagcgaggacaugcacgccuucgugaccgagguggccuacaagauggagcugcugcagaucgagaacauggugcugagccccuggacccugaucguggccgugcugcugcagaacagacccagcauggacuucgacgcccugguggagaagacccuguggcugaagggccugacccaggccuucggcggcuuccugaucuggcccgacaacaagcccgccgaggagguggugcccgccagcauccugcugcacagcaacaucgccagccuggugaaggaccaggugauccugaagguggacagcggcgacagcgaggugguggacggccugaugcugcagcacaucacccugcugaugugcagcgccuacagaaaccagcugcugaacaucuucgugagacccagccugguggccguggcccugcagaugacccccggcuucagaaaggaggacguguacagcugcuucagauuccugagagacguguucgccgacgaguucaucuuccugcccggcaacacccugaaggacuucgaggagggcugcuaccugcugugcaagagcgaggccauccaggugaccaccaaggacauccuggugaccgagaagggcaacaccgugcuggaguuccuggugggccuguucaagcccuucguggagagcuaccagaucaucugcaaguaccugcugagcgaggaggaggaccacuucagcgaggagcaguaccuggccgccgugagaaaguucaccagccagcugcuggaccagggcaccagccagugcuacgacgugcugagcagcgacgugcagaagaacgcccuggccgccugcgugagacugggcgugguggagaagaagaagaucaacaacaacugcaucuucaacgugaacgagcccgccaccaccaagcuggaggagaugcugggcugcaagacccccaucggcaagcccgccaccgccaagcuguaa

SEQ ID NO: 17623 - RNA, 957 nt, Artificial Sequence
  GNPDA1__Homo_sapiens__XP_005268405
augagcagcuucuggagcgacuaccuguuccccuucgugcuguggggcaagcugaagacccagagaggcagccagagcaaggacaagaugaagcugaucauccuggagcacuacagccaggccagcgagugggccgccaaguacaucagaaacagaaucauccaguucaaccccggccccgagaaguacuucacccugggccugcccaccggcagcaccccccugggcugcuacaagaagcugaucgaguacuacaagaacggcgaccugagcuucaaguacgugaagaccuucaacauggacgaguacgugggccugcccagagaccaccccgagagcuaccacagcuucauguggaacaacuucuucaagcacaucgacauccaccccgagaacacccacauccuggacggcaacgccguggaccugcaggccgagugcgacgccuucgaggagaagaucaaggccgccggcggcaucgagcuguucgugggcggcaucggccccgacggccacaucgccuucaacgagcccggcagcagccuggugagcagaaccagagugaagacccuggccauggacaccauccuggccaacgccagauucuucgacggcgagcugaccaaggugcccaccauggcccugaccgugggcgugggcaccgugauggacgccagagaggugaugauccugaucaccggcgcccacaaggccuucgcccuguacaaggccaucgaggagggcgugaaccacauguggaccgugagcgccuuccagcagcaccccagaaccguguucgugugcgacgaggacgccacccuggagcugaaggugaagaccgugaaguacuucaagggccugaugcuggugcacaacaagcugguggacccccuguacagcaucaaggagaaggagaccgagaagagccagagcagcaagaagcccuacagcgacuaa

SEQ ID NO: 17624 - RNA, 729 nt, Artificial Sequence
  GNPDA2__Homo_sapiens__NP_001257809
augagacuggugauccuggacaacuacgaccuggccagcgagugggccgccaaguacaucugcaacagaaucauccaguucaagcccggccaggacagauacuucacccugggccugcccaccggccugcccagaaaccaccccgagagcuaccacagcuacauguggaacaacuucuucaagcacaucgacaucgaccccaacaacgcccacauccuggacggcaacgccgccgaccugcaggccgagugcgacgccuucgagaacaagaucaaggaggccggcggcaucgaccuguucgugggcggcaucggccccgacggccacaucgccuucaacgagcccggcagcagccuggugagcagaaccagacugaagacccuggccauggacaccauccuggccaacgccaaguacuucgacggcgaccugagcaaggugcccaccauggcccugaccgugggcgugggcaccgugauggacgccagagaggugaugauccugaucaccggcgcccacaaggccuucgcccuguacaaggccaucgaggagggcgugaaccacauguggaccgugagcgccuuccagcagcaccccagaaccaucuucgugugcgacgaggacgccacccuggagcugagagugaagaccgugaaguacuucaagggccugaugcacgugcacaacaagcugguggacccccuguucagcaugaaggacggcaacuaa

SEQ ID NO: 17625 - RNA, 3771 nt, Artificial Sequence
  GNPTAB__Homo_sapiens__NP_077288
augcuguucaagcugcugcagagacagaccuacaccugccugagccacagauacggccuguacgugugcuuccugggcgugguggugaccaucgugagcgccuuccaguucggcgagguggugcuggaguggagcagagaccaguaccacgugcuguucgacagcuacagagacaacaucgccggcaagagcuuccagaacagacugugccugcccaugcccaucgacgugguguacaccugggugaacggcaccgaccuggagcugcugaaggagcugcagcaggugagagagcagauggaggaggagcagaaggccaugagagagauccugggcaagaacaccaccgagcccaccaagaagagcgagaagcagcuggagugccugcugacccacugcaucaaggugcccaugcuggugcuggaccccgcccugcccgccaacaucacccugaaggaccugcccagccuguaccccagcuuccacagcgccagcgacaucuucaacguggccaagcccaagaaccccagcaccaacgugagcguggugguguucgacagcaccaaggacguggaggacgcccacagcggccugcugaagggcaacagcagacagaccguguggagaggcuaccugaccaccgacaaggaggugcccggccuggugcugaugcaggaccuggccuuccugagcggcuucccccccaccuucaaggagaccaaccagcugaagaccaagcugcccgagaaccugagcagcaaggugaagcugcugcagcuguacagcgaggccagcguggcccugcugaagcugaacaaccccaaggacuuccaggagcugaacaagcagaccaagaagaacaugaccaucgacggcaaggagcugaccaucagccccgccuaccugcugugggaccugagcgccaucagccagagcaagcaggacgaggacaucagcgccagcagauucgaggacaacgaggagcugagauacagccugagaagcaucgagagacacgcccccugggugagaaacaucuucaucgugaccaacggccagauccccagcuggcugaaccuggacaaccccagagugaccaucgugacccaccaggacguguucagaaaccugagccaccugcccaccuucagcagccccgccaucgagagccacauccacagaaucgagggccugagccagaaguucaucuaccugaacgacgacgugauguucggcaaggacguguggcccgacgacuucuacagccacagcaagggccagaagguguaccugaccuggcccgugcccaacugcgccgagggcugccccggcagcuggaucaaggacggcuacugcgacaaggccugcaacaacagcgccugcgacugggacggcggcgacugcagcggcaacagcggcggcagcagauacaucgccggcggcggcggcaccggcagcaucggcgugggccagcccuggcaguucggcggcggcaucaacagcgugagcuacugcaaccagggcugcgccaacagcuggcuggccgacaaguucugcgaccaggccugcaacgugcugagcugcggcuucgacgccggcgacugcggccaggaccacuuccacgagcuguacaaggugauccugcugcccaaccagacccacuacaucauccccaagggcgagugccugcccuacuucagcuucgccgagguggccaagagaggcguggagggcgccuacagcgacaaccccaucaucagacacgccagcaucgccaacaaguggaagaccauccaccugaucaugcacagcggcaugaacgccaccaccauccacuucaaccugaccuuccagaacaccaacgacgaggaguucaagaugcagaucaccguggagguggacaccagagagggccccaagcugaacagcaccgcccagaagggcuacgagaaccuggugagccccaucacccugcugcccgaggccgagauccuguucgaggacauccccaaggagaagagauuccccaaguucaagagacacgacgugaacagcaccagaagagcccaggaggaggugaagaucccccuggugaacaucagccugcugcccaaggacgcccagcugagccugaacacccuggaccugcagcuggagcacggcgacaucacccugaagggcuacaaccugagcaagagcgcccugcugagaagcuuccugaugaacagccagcacgccaagaucaagaaccaggccaucaucaccgacgagaccaacgacagccugguggccccccaggagaagcaggugcacaagagcauccugcccaacagccugggcgugagcgagagacugcagagacugaccuuccccgccgugagcgugaaggugaacggccacgaccagggccagaaccccccccuggaccuggagaccaccgccagauucagaguggagacccacacccagaagaccaucggcggcaacgugaccaaggagaagccccccagccugaucgugccccuggagagccagaugaccaaggagaagaagaucaccggcaaggagaaggagaacagcagaauggaggagaacgccgagaaccacaucggcgugaccgaggugcugcugggcagaaagcugcagcacuacaccgacagcuaccugggcuuccugcccugggagaagaagaaguacuuccaggaccugcuggacgaggaggagagccugaagacccagcuggccuacuucaccgacagcaagaacaccggcagacagcugaaggacaccuucgccgacagccugagauacgugaacaagauccugaacagcaaguucggcuucaccagcagaaaggugcccgcccacaugccccacaugaucgacagaaucgugaugcaggagcugcaggacauguuccccgaggaguucgacaagaccagcuuccacaaggugagacacagcgaggacaugcaguucgccuucagcuacuucuacuaccugaugagcgccgugcagccccugaacaucagccagguguucgacgagguggacaccgaccagagcggcgugcugagcgacagagagaucagaacccuggccaccagaauccacgagcugccccugagccugcaggaccugaccggccuggagcacaugcugaucaacugcagcaagaugcugcccgccgacaucacccagcugaacaacaucccccccacccaggagagcuacuacgaccccaaccugccccccgugaccaagagccuggugaccaacugcaagcccgugaccgacaagauccacaaggccuacaaggacaagaacaaguacagauucgagaucaugggcgaggaggagaucgccuucaagaugaucagaaccaacgugagccacguggugggccagcuggacgacaucagaaagaaccccagaaaguucgugugccugaacgacaacaucgaccacaaccacaaggacgcccagaccgugaaggccgugcugagagacuucuacgagagcauguuccccauccccagccaguucgagcugcccagagaguacagaaacagauuccugcacaugcacgagcugcaggaguggagagccuacagagacaagcugaaguucuggacccacugcgugcuggccacccugaucauguucaccaucuucagcuucuucgccgagcagcugaucgcccugaagagaaagaucuuccccagaagaagaauccacaaggaggccagccccaacagaaucagaguguaa

SEQ ID NO: 17626 - RNA, 918 nt, Artificial Sequence
  GNPTG__Homo_sapiens__NP_115909
auggccgccggccuggccagacugcugcugcugcugggccugagcgccggcggccccgcccccgccggcgccgccaagaugaaggugguggaggagcccaacgccuucggcgugaacaaccccuuccugccccaggccagcagacugcaggccaagagagaccccagccccgugagcggccccgugcaccuguucagacugagcggcaagugcuucagccugguggagagcaccuacaaguacgaguucugccccuuccacaacgugacccagcacgagcagaccuucagauggaacgccuacagcggcauccugggcaucuggcacgagugggagaucgccaacaacaccuucaccggcauguggaugagagacggcgacgccugcagaagcagaagcagacagagcaagguggagcuggccugcggcaagagcaacagacuggcccacgugagcgagcccagcaccugcguguacgcccugaccuucgagaccccccuggugugccacccccacgcccugcugguguaccccacccugcccgaggcccugcagagacagugggaccagguggagcaggaccuggccgacgagcugaucaccccccagggccacgagaagcugcugagaacccuguucgaggacgccggcuaccugaagacccccgaggagaacgagcccacccagcuggagggcggccccgacagccugggcuucgagacccuggagaacugcagaaaggcccacaaggagcugagcaaggagaucaagagacugaagggccugcugacccagcacggcauccccuacaccagacccaccgagaccagcaaccuggagcaccugggccacgagacccccagagccaagagccccgagcagcugagaggcgaccccggccugagaggcagccuguaa

SEQ ID NO: 17627 - RNA, 291 nt, Artificial Sequence
  GNRH1__Homo_sapiens__NP_000816
augugccugagaaugaagcccauccagaagcugcuggccggccugauccugcugaccuggugcguggagggcugcagcagccagcacuggagcuacggccugagacccggcggcaagagagacgccgagaaccugaucgacagcuuccaggagaucgugaaggaggugggccagcuggccgagacccagagauucgagugcaccacccaccagcccagaagcccccugagagaccugaagggcgcccuggagagccugaucgaggaggagaccggccagaagaagaucuaa

SEQ ID NO: 17628 - RNA, 342 nt, Artificial Sequence
  GNRH2__Homo_sapiens__NP_847901
auggccagcagcagaagaggccugcugcugcugcugcugcugaccgcccaccugggccccagcgaggcccagcacuggagccacggcugguaccccggcggcaagagagcccugagcagcgcccaggacccccagaacgcccugagaccccccgccggcagccccgugcagaccgcccacggccugcccagcgacgcccuggccccccuggacgacagcaugcccugggagggcagaaccaccgcccaguggagccugcacagaaagagacaccuggccagaacccugcugaccgccgccagagagcccagacccgccccccccagcagcaacaagguguaa

SEQ ID NO: 17629 - RNA, 987 nt, Artificial Sequence
  GNRHR__Homo_sapiens__NP_000397
auggccaacagcgccagccccgagcagaaccagaaccacugcagcgccaucaacaacagcaucccccugaugcagggcaaccugcccacccugacccugagcggcaagaucagagugaccgugaccuucuuccuguuccugcugagcgccaccuucaacgccagcuuccugcugaagcugcagaaguggacccagaagaaggagaagggcaagaagcugagcagaaugaagcugcugcugaagcaccugacccuggccaaccugcuggagacccugaucgugaugccccuggacggcauguggaacaucaccgugcagugguacgccggcgagcugcugugcaaggugcugagcuaccugaagcuguucagcauguacgcccccgccuucaugaugguggugaucagccuggacagaagccuggccaucaccagaccccuggcccugaagagcaacagcaaggugggccagagcauggugggccuggccuggauccugagcagcguguucgccggcccccagcuguacaucuucagaaugauccaccuggccgacagcagcggccagaccaagguguucagccagugcgugacccacugcagcuucagccagugguggcaccaggccuucuacaacuucuucaccuucagcugccuguucaucaucccccuguucaucaugcugaucugcaacgccaagaucaucuucacccugaccagagugcugcaccaggacccccacgagcugcagcugaaccagagcaagaacaacauccccagagccagacugaagacccugaagaugaccguggccuucgccaccagcuucaccgugugcuggacccccuacuacgugcugggcaucugguacugguucgaccccgagaugcugaacagacugagcgaccccgugaaccacuucuucuuccuguucgccuuccugaaccccugcuucgacccccugaucuacggcuacuucagccuguaa

SEQ ID NO: 17630 - RNA, 1659 nt, Artificial Sequence
  GNS__Homo_sapiens__NP_002067
augagacugcugccccuggcccccggcagacugagaagaggcagccccagacaccugcccagcugcagccccgcccugcugcugcuggugcugggcggcugccugggcguguucggcguggccgccggcaccagaagacccaacguggugcugcugcugaccgacgaccaggacgaggugcugggcggcaugaccccccugaagaagaccaaggcccugaucggcgagaugggcaugaccuucagcagcgccuacgugcccagcgcccugugcugccccagcagagccagcauccugaccggcaaguacccccacaaccaccacguggugaacaacacccuggagggcaacugcagcagcaagagcuggcagaagauccaggagcccaacaccuuccccgccauccugagaagcaugugcggcuaccagaccuucuucgccggcaaguaccugaacgaguacggcgcccccgacgccggcggccuggagcacgugccccugggcuggagcuacugguacgcccuggagaagaacagcaaguacuacaacuacacccugagcaucaacggcaaggccagaaagcacggcgagaacuacagcguggacuaccugaccgacgugcuggccaacgugagccuggacuuccuggacuacaagagcaacuucgagcccuucuucaugaugaucgccacccccgccccccacagccccuggaccgccgccccccaguaccagaaggccuuccagaacguguucgcccccagaaacaagaacuucaacauccacggcaccaacaagcacuggcugaucagacaggccaagacccccaugaccaacagcagcauccaguuccuggacaacgccuucagaaagagauggcagacccugcugagcguggacgaccugguggagaagcuggugaagagacuggaguucaccggcgagcugaacaacaccuacaucuucuacaccagcgacaacggcuaccacaccggccaguucagccugcccaucgacaagagacagcuguacgaguucgacaucaaggugccccugcuggugagaggccccggcaucaagcccaaccagaccagcaagaugcugguggccaacaucgaccugggccccaccauccuggacaucgccggcuacgaccugaacaagacccagauggacggcaugagccugcugcccauccugagaggcgccagcaaccugaccuggagaagcgacgugcugguggaguaccagggcgagggcagaaacgugaccgaccccaccugccccagccugagccccggcgugagccagugcuuccccgacugcgugugcgaggacgccuacaacaacaccuacgccugcgugagaaccaugagcgcccuguggaaccugcaguacugcgaguucgacgaccaggagguguucguggagguguacaaccugaccgccgaccccgaccagaucaccaacaucgccaagaccaucgaccccgagcugcugggcaagaugaacuacagacugaugaugcugcagagcugcagcggccccaccugcagaacccccggcguguucgaccccggcuacagauucgaccccagacugauguucagcaacagaggcagcgugagaaccagaagauucagcaagcaccugcuguaa

SEQ ID NO: 17631 - RNA, 2304 nt, Artificial Sequence
  GOLGA1__Homo_sapiens__NP_002068
auguucgccaagcugaagaagaagaucgccgaggagaccgccguggcccagagacccggcggcgccaccagaauccccagaagcgugagcaaggagagcguggccagcaugggcgccgacagcggcgacgacuucgccagcgacggcagcagcagcagagaggaccugagcagccagcugcugagaagaaacgagcagaucagaaagcuggaggccagacugagcgacuacgccgagcaggugagaaaccugcagaagaucaaggagaagcuggagaucgcccuggagaagcaccaggacagcagcaugagaaaguuccaggagcagaacgagaccuuccaggccaacagagccaagauggccgagggccuggcccuggcccuggccagaaaggaccaggaguggagcgagaagauggaccagcuggagaaggagaagaacauccugaccgcccagcugcaggagaugaagaaccagagcaugaaccuguuccagagaagagacgagauggacgagcuggagggcuuccagcagcaggagcugagcaagaucaagcacaugcugcugaagaaggaggagagccugggcaagauggagcaggagcuggaggccagaaccagagagcugagcagaacccaggaggagcugaugaacagcaaccagaugagcagcgaccugagccagaagcuggaggagcugcagagacacuacagcacccuggaggagcagagagaccacgugaucgccagcaagaccggcgccgagagcaagaucaccgcccuggagcagaaggagcaggagcugcaggcccugauccagcagcugagcaucgaccugcagaaggugaccgccgagacccaggagaaggaggacgugaucacccaccugcaggagaagguggccagccuggagaagagacuggagcagaaccugagcggcgaggagcacgugcaggagcugcugaaggagaagacccuggccgagcagaaccuggaggacaccagacagcagcugcuggccgccagaagcagccaggccaaggccaucaacacccuggagaccagagugagagagcuggagcagacccugcaggccagcgaggagcagcugcagcagagcaagggcaucguggccgcccaggagacccagauccaggagcuggccgccgccaaccaggagagcagccacgugcagcagcaggcccuggcccuggagcagcaguuccuggagagaacccaggcccuggaggcccagaucguggcccuggagagaaccagagccgccgaccagaccaccgccgagcagggcaugagacagcuggagcaggagaacgccgcccugaaggagugcagaaacgaguacgagagaagccugcagaaccaccaguucgagcugaagaagcugaaggaggaguggagccagagagagaucgugagcguggccauggcccaggcccuggaggaggugagaaagcagagagaggaguuccagcagcaggccgccaaccugaccgccaucaucgacgagaaggagcagaaccugagagagaagaccgaggugcugcugcagaaggagcaggagauccugcagcuggagagaggccacaacagcgcccugcugcagauccaccagcugcaggccgagcuggaggcccugagaacccugaaggccgaggaggccgccgugguggccgagcaggaggaccugcugagacugagaggcccccugcaggccgaggcccugagcgugaacgagagccacgugaccagcagagccaugcaggaccccguguuccagcugcccaccgccggcagaacccccaacggcgaggugggcgccauggaccugacccagcugcagaaggagaagcaggaccuggagcagcagcugcuggagaagaacaagaccaucaagcagaugcagcagagaaugcuggagcugagaaagacccugcagaaggagcugaagaucagacccgacaacgagcuguucgaggugagagagaagcccggccccgagauggccaacauggcccccagcgugaccaacaacaccgaccugaccgacgccagagagaucaacuucgaguaccugaagcacguggugcugaaguucaugagcugcagagagagcgaggccuuccaccugaucaaggccgugagcgugcugcugaacuucagccaggaggaggagaacaugcugaaggagacccuggaguacaagaugagcugguucggcagcaagcccgcccccaagggcagcaucagacccagcaucagcaaccccagaauccccuggagcuaa

SEQ ID NO: 17632 - RNA, 3009 nt, Artificial Sequence
  GOLGA2__Homo_sapiens__NP_004477
auguggccccagcccagacugccccccagacccgccaugagcgaggagaccagacagagcaagcuggccgccgccaagaagaagcugagagaguaccagcagagaaacagccccggcgugcccaccggcgccaagaagaagaagaagaucaagaacggcagcaaccccgagaccaccaccagcggcggcugccacagccccgaggacacccccaaggacaacgccgccacccugcagcccagcgacgacaccgugcugcccggcggcgugcccagccccggcgccagccugaccagcauggccgccagccagaaccacgacgccgacaacgugcccaaccugauggacgagaccaagaccuucagcagcaccgagagccugagacagcugagccagcagcugaacggccuggugugcgagagcgccaccugcgugaacggcgagggccccgccagcagcgccaaccugaaggaccuggagagcagauaccagcagcuggccguggcccuggacagcagcuacgugaccaacaagcagcugaacaucaccaucgagaagcugaagcagcagaaccaggagaucaccgaccagcuggaggaggagaagaaggagugccaccagaagcagggcgcccugagagagcagcugcaggugcacauccagaccaucggcauccuggugagcgagaaggccgagcugcagaccgcccuggcccacacccagcacgccgccagacagaaggagggcgagagcgaggaccuggccagcagacugcaguacagcagaagaagagugggcgagcuggagagagcccugagcgccgugagcacccagcagaagaaggccgacagauacaacaaggagcugaccaaggagagagacgcccugagacuggagcuguacaagaacacccagagcaacgaggaccugaagcaggagaagagcgagcuggaggagaagcugagagugcuggugaccgagaaggccggcaugcagcugaaccuggaggagcugcagaagaagcuggagaugaccgagcugcugcugcagcaguucagcagcagaugcgaggcccccgacgccaaccagcagcugcagcaggccauggaggagagagcccagcuggaggcccaccugggccaggugauggagagcgugagacagcugcagauggagagagacaaguacgccgagaaccugaagggcgagagcgccauguggagacagagaaugcagcagaugagcgagcaggugcacacccugagagaggagaaggagugcagcaugagcagagugcaggagcuggagaccagccuggccgagcugagaaaccagauggccgagccccccccccccgagccccccgccggccccagcgagguggagcagcagcugcaggccgaggccgagcaccugagaaaggagcuggagggccuggccggccagcugcaggcccaggugcaggacaacgagggccugagcagacugaacagagagcaggaggagagacugcuggagcuggagagagccgccgagcuguggggcgagcaggccgaggccagaagacagauccuggagaccaugcagaacgacagaaccaccaucagcagagcccugagccagaacagagagcugaaggagcagcuggccgagcugcagagcggcuucgugaagcugaccaacgagaacauggagaucaccagcgcccugcagagcgagcagcacgugaagagagagcugggcaagaagcugggcgagcugcaggagaagcugagcgagcugaaggagaccguggagcugaagagccaggaggcccagagccugcagcagcagagagaccaguaccugggccaccugcagcaguacguggccgccuaccagcagcugaccagcgagaaggaggugcugcacaaccagcugcugcugcagacccagcugguggaccagcugcagcagcaggaggcccagggcaaggccguggccgagauggccagacaggagcugcaggagacccaggagagacuggaggccgccacccagcagaaccagcagcugagagcccagcugagccugauggcccaccccggcgagggcgacggccuggacagagaggaggaggaggacgaggaggaggaggaggaggaggccguggccgugccccagcccaugcccagcauccccgaggaccuggagagcagagaggccaugguggccuucuucaacagcgccguggccagcgccgaggaggagcaggccagacugagaggccagcugaaggagcagagagugagaugcagaagacuggcccaccugcuggccagcgcccagaaggagcccgaggccgccgcccccgcccccggcaccggcggcgacagcgugugcggcgagacccacagagcccugcagggcgccauggagaagcugcagagcagauucauggagcugaugcaggagaaggccgaccugaaggagagaguggaggagcuggagcacagaugcauccagcugagcggcgagaccgacaccaucggcgaguacaucgcccuguaccagagccagagagccgugcugaaggagagacacagagagaaggaggaguacaucagcagacuggcccaggacaaggaggagaugaaggugaagcugcuggagcugcaggagcuggugcugagacuggugggcgacagaaacgaguggcacggcagauuccuggccgccgcccagaaccccgccgacgagcccaccagcggcgcccccgccccccaggagcugggcgccgccaaccagcagggcgaccugugcgaggugagccuggccggcagcguggagcccgcccagggcgaggccagagagggcagccccagagacaaccccaccgcccagcagaucaugcagcugcugagagagaugcagaaccccagagagagacccggccugggcagcaaccccugcauccccuucuucuacagagccgacgagaacgacgaggugaagaucaccgugaucuaa

SEQ ID NO: 17633 - RNA, 3405 nt, Artificial Sequence
  GOLGA3__Homo_sapiens__NP_001166028
auggacggcgccagcgccgagcaggacggccugcaggaggacagaagccacagcggccccagcagccugcccgaggccccccugaagccccccggcccccuggugccccccgaccagcaggacaaggugcagugcgccgaggugaacagagccagcaccgagggcgagagccccgacggccccggccagggcggccugugccagaacggccccaccccccccuuccccgacccccccagcagccuggaccccaccaccagccccgugggccccgacgccagccccggcguggccggcuuccacgacaaccugagaaagagccagggcaccagcgccgagggcagcgugagaaaggaggcccugcagagccugagacugagccugcccaugcaggagacccagcugugcagcaccgacagcccccugccccuggagaaggaggagcaggugagacugcaggccagaaaguggcuggaggagcagcugaagcaguacagagugaagagacagcaggagagaagcagccagcccgccaccaagaccagacuguucagcacccuggaccccgagcugaugcugaaccccgagaaccugcccagagccagcacccuggccaugaccaaggaguacagcuuccugagaaccagcgugcccagaggccccaaggugggcagccugggccugcccgcccaccccagagagaagaagaccagcaagagcagcaagaucagaagccuggccgacuacagaaccgaggacagcaacgccggcaacagcggcggcaacgugcccgcccccgacagcaccaagggcagccugaagcagaacagaagcagcgccgccagcguggugagcgagaucagccugagccccgacaccgacgacagacuggagaacaccagccuggccggcgacagcgugagcgagguggacggcaacgacagcgacagcagcagcuacagcagcgccagcaccagaggcaccuacggcauccugagcaagaccgugggcacccaggacacccccuacauggugaacggccaggagauccccgccgacacccugggccaguuccccagcaucaaggacgugcugcaggccgccgccgccgagcaccaggaccagggccaggaggugaacggcgaggugagaagcagaagagacagcaucugcagcagcgugagccuggagagcagcgccgccgagacccaggaggagaugcugcaggugcugaaggagaagaugagacuggagggccagcuggaggcccugagccuggaggccagccaggcccugaaggagaaggccgagcugcaggcccagcuggccgcccugagcaccaagcugcaggcccagguggagugcagccacagcagccagcagagacaggacagccugagcagcgagguggacacccugaagcagagcugcugggaccuggagagagccaugaccgaccugcagaacaugcuggaggccaagaacgccagccuggccagcagcaacaacgaccugcagguggccgaggagcaguaccagagacugauggccaagguggaggacaugcagagaagcaugcugagcaaggacaacaccgugcacgaccugagacagcagaugaccgcccugcagagccagcugcagcaggugcagcuggagagaaccacccugaccagcaagcugaaggccagccaggccgagaucagcagccugcagagcgugagacagugguaccagcagcagcuggcccuggcccaggaggccagagugagacugcagggcgagauggcccacauccaggugggccagaugacccaggccggccugcuggagcaccugaagcuggagaacgugagccugagccagcagcugaccgagacccagcacagaagcaugaaggagaagggcagaaucgccgcccagcugcagggcaucgaggccgacaugcuggaccaggaggccgccuucaugcagauccaggaggccaagaccaugguggaggaggaccugcagagaagacuggaggaguucgagggcgagagagagagacugcagagaauggccgacagcgccgccagccuggagcagcagcuggagcaggugaagcugacccugcugcagagagaccagcagcuggaggcccugcagcaggagcaccuggaccugaugaagcagcugacccugacccaggaggcccugcagagcagagagcagagccuggacgcccugcagacccacuacgacgagcugcaggccagacugggcgagcugcagggcgaggccgccagcagagaggacaccaucugccugcugcagaacgagaagaucauccuggaggccgcccugcaggccgccaagagcggcaaggaggagcuggacagaggcgccagaagacuggaggagggcaccgaggagaccagcgagacccuggagaagcugagagaggagcuggccaucaagagcggccagguggagcaccugcagcaggagaccgccgcccugaagaagcagaugcagaagaucaaggagcaguuccugcagcagaaggugaugguggaggccuacagaagagacgccaccagcaaggaccagcugaucagcgagcugaaggccaccagaaagagacuggacagcgagcugaaggagcugagacaggagcugaugcaggugcacggcgagaagagaaccgccgaggccgagcugagcagacugcacagagagguggcccaggugagacagcacauggccgaccuggagggccaccugcagagcgcccagaaggagagagacgagauggagacccaccugcagagccugcaguucgacaaggagcagaugguggccgugaccgaggccaacgaggcccugaagaagcagaucgaggagcugcagcaggaggccagaaaggccaucaccgagcagaagcagaagaugagaagacugggcagcgaccugaccagcgcccagaaggagaugaagaccaagcacaaggccuacgagaacgccgugggcauccugagcagaagacugcaggaggcccuggccgccaaggaggccgccgacgccgagcugggccagcugagagcccagggcggcagcagcgacagcagccuggcccugcacgagagaauccaggcccuggaggccgagcugcaggccgugagccacagcaagacccugcuggagaaggagcugcaggaggugaucgcccugaccagccaggagcuggaggagagcagagagaaggugcuggagcuggaggacgaggugagacccggccaccugcuguggagacagagaggcgccggccacgugagccccggccacgccgccaccagagagaccagaagaaccaagcugcacagagugcccagcguggccaccuucggcguggccaccuucuaa

SEQ ID NO: 17634 - RNA, 6732 nt, Artificial Sequence
  GOLGA4__Homo_sapiens__NP_001166184
auguucaagaagcugaagcagaagaucagcgaggagcagcagcagcugcagcaggcccuggcccccgcccaggccagcagcaacagcagcacccccaccagaaugagaagcagaaccagcagcuucaccgagcagcuggacgagggcacccccaacagagagaacgccagcacccacgccagcaagagccccgacagcgugaacggcagcgagcccagcaucccccagagcggcgacacccagagcuucgcccagaagcugcagcugagagugcccagcguggagagccuguucagaagccccaucaaggagagccuguucagaagcagcagcaaggagagccuggugagaaccagcagcagagagagccugaacagacuggaccuggacagcagcaccgccagcuucgacccccccagcgacauggacagcgaggccgaggaccuggugggcaacagcgacagccugaacaaggagcagcugauccagagacugagaagaauggagagaagccugagcagcuacagaggcaaguacagcgagcuggugaccgccuaccagaugcugcagagagagaagaagaagcugcagggcauccugagccagagccaggacaagagccugagaagaaucgccgagcugagagaggagcugcagauggaccagcaggccaagaagcaccugcaggaggaguucgacgccagccuggaggagaaggaccaguacaucagcgugcugcagacccaggugagccugcugaagcagagacugagaaacggccccaugaacguggacgugcugaagccccugccccagcuggagccccaggccgagguguucaccaaggaggagaaccccgagagcgacggcgagcccgugguggaggacggcaccagcgugaagacccuggagacccugcagcagagagugaagagacaggagaaccugcugaagagaugcaaggagaccauccagagccacaaggagcagugcacccugcugaccagcgagaaggaggcccugcaggagcagcuggacgagagacugcaggagcuggagaagaucaaggaccugcacauggccgagaagaccaagcugaucacccagcugagagacgccaagaaccugaucgagcagcuggagcaggacaagggcauggugaucgccgagaccaagagacagaugcacgagacccuggagaugaaggaggaggagaucgcccagcugagaagcagaaucaagcagaugaccacccagggcgaggagcugagagagcagaaggagaagagcgagagagccgccuucgaggagcuggagaaggcccugagcaccgcccagaagaccgaggaggccagaagaaagcugaaggccgagauggacgagcagaucaagaccaucgagaagaccagcgaggaggagagaaucagccugcagcaggagcugagcagagugaagcaggaggugguggacgugaugaagaagagcagcgaggagcagaucgccaagcugcagaagcugcacgagaaggagcuggccagaaaggagcaggagcugaccaagaagcugcagaccagagagagagaguuccaggagcagaugaagguggcccuggagaagagccagagcgaguaccugaagaucagccaggagaaggagcagcaggagagccuggcccuggaggagcuggagcugcagaagaaggccauccugaccgagagcgagaacaagcugagagaccugcagcaggaggccgagaccuacagaaccagaauccuggagcuggagagcagccuggagaagagccugcaggagaacaagaaccagagcaaggaccuggccgugcaccuggaggccgagaagaacaagcacaacaaggagaucaccgugaugguggagaagcacaagaccgagcuggagagccugaagcaccagcaggacgcccuguggaccgagaagcugcaggugcugaagcagcaguaccagaccgagauggagaagcugagagagaagugcgagcaggagaaggagacccugcugaaggacaaggagaucaucuuccaggcccacaucgaggagaugaacgagaagacccuggagaagcuggacgugaagcagaccgagcuggagagccugagcagcgagcugagcgaggugcugaaggccagacacaagcuggaggaggagcugagcgugcugaaggaccagaccgacaagaugaagcaggagcuggaggccaagauggacgagcagaagaaccaccaccagcagcagguggacagcaucaucaaggagcacgaggugagcauccagagaaccgagaaggcccugaaggaccagaucaaccagcuggagcugcugcugaaggagagagacaagcaccugaaggagcaccaggcccacguggagaaccuggaggccgacaucaagagaagcgagggcgagcugcagcaggccagcgccaagcuggacguguuccagagcuaccagagcgccacccacgagcagaccaaggccuacgaggagcagcuggcccagcugcagcagaagcugcuggaccuggagaccgagagaauccugcugaccaagcagguggccgagguggaggcccagaagaaggacgugugcaccgagcuggacgcccacaagauccaggugcaggaccugaugcagcagcuggagaagcagaacagcgagauggagcagaaggugaagagccugacccagguguacgagagcaagcuggaggacggcaacaaggagcaggagcagaccaagcagauccugguggagaaggagaacaugauccugcagaugagagagggccagaagaaggagaucgagauccugacccagaagcugagcgccaaggaggacagcauccacauccugaacgaggaguacgagaccaaguucaagaaccaggagaagaagauggagaaggugaagcagaaggccaaggagaugcaggagacccugaagaagaagcugcuggaccaggaggccaagcugaagaaggagcuggagaacaccgcccuggagcugagccagaaggagaagcaguucaacgccaagaugcuggagauggcccaggccaacagcgccggcaucagcgacgccgugagcagacuggagaccaaccagaaggagcagaucgagagccugaccgaggugcacagaagagagcugaacgacgugaucagcaucugggagaagaagcugaaccagcaggccgaggagcugcaggagauccacgagauccagcugcaggagaaggagcaggagguggccgagcugaagcagaagauccugcuguucggcugcgagaaggaggagaugaacaaggagaucaccuggcugaaggaggagggcgugaagcaggacaccacccugaacgagcugcaggagcagcugaagcagaagagcgcccacgugaacagccuggcccaggacgagaccaagcugaaggcccaccuggagaagcuggagguggaccugaacaagagccugaaggagaacaccuuccugcaggagcagcugguggagcugaagaugcuggccgaggaggacaagagaaaggugagcgagcugaccagcaagcugaagaccaccgacgaggaguuccagagccugaagagcagccacgagaagagcaacaagagccuggaggacaagagccuggaguucaagaagcugagcgaggagcuggccauccagcuggacaucugcugcaagaagaccgaggcccugcuggaggccaagaccaacgagcugaucaacaucagcagcagcaagaccaacgccauccugagcagaaucagccacugccagcacagaaccaccaaggugaaggaggcccugcugaucaagaccugcaccgugagcgagcuggaggcccagcugagacagcugaccgaggagcagaacacccugaacaucagcuuccagcaggccacccaccagcuggaggagaaggagaaccagaucaagagcaugaaggccgacaucgagagccuggugaccgagaaggaggcccugcagaaggagggcggcaaccagcagcaggccgccagcgagaaggagagcugcaucacccagcugaagaaggagcugagcgagaacaucaacgccgugacccugaugaaggaggagcugaaggagaagaagguggagaucagcagccugagcaagcagcugaccgaccugaacgugcagcugcagaacagcaucagccugagcgagaaggaggccgccaucagcagccugagaaagcaguacgacgaggagaagugcgagcugcuggaccaggugcaggaccugagcuucaagguggacacccugagcaaggagaagaucagcgcccuggagcagguggacgacuggagcaacaaguucagcgaguggaagaagaaggcccagagcagauucacccagcaccagaacaccgugaaggagcugcagauccagcuggagcugaagagcaaggaggccuacgagaaggacgagcagaucaaccugcugaaggaggagcuggaccagcagaacaagagauucgacugccugaagggcgagauggaggacgacaagagcaagauggagaagaaggagagcaaccuggagaccgagcugaagagccagaccgccagaaucauggagcuggaggaccacaucacccagaagaccaucgagaucgagagccugaacgaggugcugaagaacuacaaccagcagaaggacaucgagcacaaggagcuggugcagaagcugcagcacuuccaggagcugggcgaggagaaggacaacagagugaaggaggccgaggagaagauccugacccuggagaaccagguguacagcaugaaggccgagcuggagaccaagaagaaggagcuggagcacgugaaccugagcgugaagagcaaggaggaggagcugaaggcccuggaggacagacuggagagcgagagcgccgccaagcuggccgagcugaagagaaaggccgagcagaagaucgccgccaucaagaagcagcugcugagccagauggaggagaaggaggagcaguacaagaagggcaccgagagccaccugagcgagcugaacaccaagcugcaggagagagagagagaggugcacauccuggaggagaagcugaagagcguggagagcagccagagcgagacccugaucgugcccagaagcgccaagaacguggccgccuacaccgagcaggaggaggccgacagccagggcugcgugcagaagaccuacgaggagaagaucagcgugcugcagagaaaccugaccgagaaggagaagcugcugcagagagugggccaggagaaggaggagaccgugagcagccacuucgagaugagaugccaguaccaggagagacugaucaagcuggagcacgccgaggccaagcagcacgaggaccagagcaugaucggccaccugcaggaggagcuggaggagaagaacaagaaguacagccugaucguggcccagcacguggagaaggagggcggcaagaacaacauccaggccaagcagaaccuggagaacguguucgacgacgugcagaagacccugcaggagaaggagcugaccugccagauccuggagcagaagaucaaggagcuggacagcugccuggugagacagaaggaggugcacagaguggagauggaggagcugaccagcaaguacgagaagcugcaggcccugcagcagauggacggcagaaacaagcccaccgagcugcuggaggagaacaccgaggagaagagcaagagccaccuggugcagcccaagcugcugagcaacauggaggcccagcacaacgaccuggaguucaagcuggccggcgccgagagagagaagcagaagcugggcaaggagaucgugagacugcagaaggaccugagaaugcugagaaaggagcaccagcaggagcuggagauccugaagaaggaguacgaccaggagagagaggagaagaucaagcaggagcaggaggaccuggagcugaagcacaacagcacccugaagcagcugaugagagaguucaacacccagcuggcccagaaggagcaggagcuggagaugaccaucaaggagaccaucaacaaggcccaggagguggaggccgagcugcuggagagccaccaggaggagaccaaccagcugcugaagaagaucgccgagaaggacgacgaccugaagagaaccgccaagagauacgaggagauccuggacgccagagaggaggagaugaccgccaaggugagagaccugcagacccagcuggaggagcugcagaagaaguaccagcagaagcuggagcaggaggagaaccccggcaacgacaacacccagcuggcccagaagaccacccugaucagcgacagcaagcugaaggagcaggaguucagagagcagauccacaaccuggaggacagacugaagaaguacgagaagaacguguacgccaccaccgugggcacccccuacaagggcggcaaccuguaccacaccgacgugagccuguucggcgagcccaccgaguucgaguaccugagaaaggugcuguucgaguacaugaugggcagagagaccaagaccauggccaaggugaucaccaccgugcugaaguuccccgacgaccagacccagaagauccuggagagagaggacgccagacugaugagcuggcugagaagcagcagcuaa

SEQ ID NO: 17635 - RNA, 2196 nt, Artificial Sequence
  GOLGA5__Homo_sapiens__NP_005104
augagcugguucguggaccuggccggcaaggccgaggaccugcugaacagaguggaccagggcgccgccaccgcccugagcagaaaggacaacgccagcaacaucuacagcaagaacaccgacuacaccgagcugcaccagcagaacaccgaccugaucuaccagaccggccccaagagcaccuacaucagcagcgccgccgacaacaucagaaaccagaaggccaccauccuggccggcaccgccaacgugaaggugggcagcagaacccccguggaggccagccaccccguggagaacgccagcgugcccagacccagcagccacuucgugagaagaaagaagagcgagcccgacgacgagcugcuguucgacuuccugaacagcagccagaaggagcccaccggcagaguggagaucagaaaggagaagggcaagacccccguguuccagagcagccagaccagcagcgugagcagcgugaaccccagcgugaccaccaucaagaccaucgaggagaacagcuucggcagccagacccacgaggccgccagcaacagcgacagcagccacgagggccaggaggagagcagcaaggagaacgugagcagcaacgccgccugccccgaccacacccccacccccaacgacgacggcaagagccacgagcugagcaaccugagacuggagaaccagcugcugagaaacgaggugcagagccugaaccaggagauggccagccugcugcagagaagcaaggagacccaggaggagcugaacaaggccagagccagaguggagaaguggaacgccgaccacagcaagagcgacagaaugaccagaggccugagagcccagguggacgaccugaccgaggccguggccgccaaggacagccagcuggccgugcugaaggugagacugcaggaggccgaccagcugcugagcaccagaaccgaggcccuggaggcccugcagagcgagaagagcagaaucaugcaggaccagagcgagggcaacagccugcagaaccaggcccugcagacccugcaggagagacugcacgaggccgacgccacccugaagagagagcaggagagcuacaagcagaugcagagcgaguucgccgccagacugaacaagguggagauggagagacagaaccuggccgaggccaucacccuggccgagagaaaguacagcgacgagaagaagagaguggacgagcugcagcagcaggugaagcuguacaagcugaaccuggagagcagcaagcaggagcugaucgacuacaagcagaaggccaccagaauccugcagagcaaggagaagcugaucaacagccugaaggagggcagcggcuucgagggccuggacagcagcaccgccagcagcauggagcuggaggagcugagacacgagaaggagaugcagagagaggagauccagaagcugaugggccagauccaccagcugagaagcgagcugcaggacauggaggcccagcaggugaacgaggccgagagcgccagagagcagcugcaggaccugcacgaccagaucgccggccagaaggccagcaagcaggagcuggagaccgagcuggagagacugaagcaggaguuccacuacaucgaggaggaccuguacagaaccaagaacacccugcagagcagaaucaaggacagagacgaggagauccagaagcugagaaaccagcugaccaacaagacccugagcaacagcagccagagcgagcuggagaacagacugcaccagcugaccgagacccugauccagaagcagaccaugcuggagagccugagcaccgagaagaacagccugguguuccagcuggagagacuggagcagcagaugaacagcgccagcggcagcagcagcaacggcagcagcaucaacaugagcggcaucgacaacggcgagggcaccagacugagaaacgugcccgugcuguucaacgacaccgagaccaaccuggccggcauguacggcaaggugagaaaggccgccagcagcaucgaccaguucagcaucagacugggcaucuuccugagaagauaccccaucgccagaguguucgugaucaucuacauggcccugcugcaccugugggugaugaucgugcugcugaccuacacccccgagaugcaccacgaccagcccuacggcaaguaa

SEQ ID NO: 17636 - RNA, 1812 nt, Artificial Sequence
  GOLGA8B__Homo_sapiens__NP_001018861
auggccgaggagaccggccagagcaagcuggccgccgccaagaagaaguucaaggaguacuggcagagaaacagacccggcgugcccgccgccgccaagagaaacaccaaggccaacggcagcagccccgagaccgccgccagcggcggcugccacagcagcgaggccagcagcagcgccagcagcagccugcacgccagacagagccccugccaggagcaggccgccgugcugaacagcagaagcaucaagaucagcagacugaacgacaccaucaagagccugaagcagcagaagaagcagguggagcaccagcuggaggaggagaagaaggccaacaacgagaagcagaaggccgagagagagcuggagggccagauccagagacugaacaccgagaagaagaagcugaacaccgaccuguaccacaugaagcacagccugagauacuucgaggaggagagcaaggaccuggccggcagacugcagagaagcagccagagaaucggcgagcuggaguggagccugugcgccguggccgccacccagaagaagaagcccgacggcuucagcagcagaagcaaggcccugcugaagagacagcuggagcagagcaucagagagcagauccugcugaagggccacgugacccagcugaaggagagccugaaggaggugcagcuggagagagaccaguacgccgagcagaucaagggcgagagagcccaguggcagcagagaaugagaaagaugagccaggaggugugcacccugaaggaggagaagaagcacgacacccacagaguggaggagcuggagagaagccugagcagacugaagaaccagauggccgagccccugccccccgacgcccccgccgugagcagcgagguggagcugcaggaccugagaaaggagcuggagagaguggccggcgagcugcaggcccagguggagaacaaccagugcaucagccugcugaacagaggccagaaggagagacugagagagcaggaggagagacugcaggagcagcaggagagacugagagagagagagaagagacugcagcagcuggccgagccccagagcgaccuggaggagcugaagcacgagaacaagagcgcccugcagcuggagcagcaggugaaggagcugcaggagaagcugggccaggugauggagacccugaccagcgccgagaaggagcccgaggccgccgugcccgccagcggcaccggcggcgagagcagcggccugauggaccugcuggaggagaaggccgaccugagagagcacguggagaagcuggagcugggcuucauccaguacagaagagagagaugccaccagaaggugcacagacugcugaccgagcccggcgacagcgccaaggacgccagccccggcggcggccaccaccaggccggccccggccagggcggcgaggagggcgaggccgccggcgccgccggcgacggcguggccgccugcggcagcuacagcgagggccacggcaaguuccuggccgccgccagaaaccccgccgccgagcccagccccggcgcccccgccccccaggagcugggcgccgccgacaagcacggcgaccugugcgaggccagccugaccaacagcguggagcccgcccagggcgaggccagagagggcagcagccaggacaaccccaccgcccagcccgugcugcagcugcugggcgagaugcaggaccaccaggagcaccccggccugggcagcaacugcugcgugcccugcuucugcugggccuggcugcccagaagaagaagauaa

SEQ ID NO: 17637 - RNA, 9810 nt, Artificial Sequence
  GOLGB1__Homo_sapiens__NP_001243415
augcugagcagacugagcggccuggccaacguggugcugcacgagcugagcggcgacgacgacaccgaccagaacaugagagccccccuggaccccgagcugcaccaggagagcgacauggaguucaacaacaccacccaggaggacgugcaggagagacuggccuacgccgagcagcuggugguggagcugaaggacaucaucagacagaaggacgugcagcugcagcagaaggacgaggcccugcaggaggagagaaaggccgccgacaacaagaucaagaagcugaagcugcacgccaaggccaagcugaccagccugaacaaguacaucgaggagaugaaggcccagggcggcaccgugcugcccaccgagccccagagcgaggagcagcugagcaagcacgacaagagcagcaccgaggaggagauggagaucgagaagaucaagcacaagcugcaggagaaggaggagcugaucagcacccugcaggcccagcugacccaggcccaggccgagcagcccgcccagagcagcaccgagauggaggaguucgugaugaugaagcagcagcugcaggagaaggaggaguucaucagcacccugcaggcccagcugagccagacccaggccgagcaggccgcccagcugagcagcaugcagcagguggugagagagaaggacgccagauucgagacccaggugagacugcacgaggacgagcugcugcagcuggugacccaggccgacguggagaccgagaugcagcagaagcugagagugcugcagagaaagcuggaggagcacgaggagagccuggugggcagagcccaggugguggaccugcugcagcaggagcugaccgccgccgagcagagaaaccagauccugagccagcagcugcagcagauggaggccgagcacaacacccugagaaacaccguggagaccgagagagaggagagcaagauccugcuggagaagauggagcuggagguggccgagagaaagcugagcuuccacaaccugcaggaggagaugcaccaccugcuggagcaguucgagcaggccggccaggcccaggccgagcuggagagcagauacagcgcccuggagcagaagcacaaggccgagauggaggagaagaccagccacauccugagccugcagaagaccggccaggagcugcagagcgccugcgacgcccugaaggaccagaacagcaagcugcugcaggacaagaacgagcaggccgugcagagcgcccagaccauccagcagcuggaggaccagcugcagcagaagagcaaggagaucagccaguuccugaacagacugccccugcagcagcacgagaccgccagccagaccagcuuccccgacguguacaacgagggcacccaggccgugaccgaggagaacaucgccagccugcagaagagagugguggagcuggagaacgagaagggcgcccugcugcugagcagcaucgagcuggaggagcugaaggccgagaacgagaagcugagcagccagaucacccugcuggaggcccagaacagaaccggcgaggccgacagagaggugagcgagaucagcaucguggacaucgccaacaagagaagcagcagcgccgaggagagcggccaggacgugcuggagaacaccuucagccagaagcacaaggagcugagcgugcugcugcuggagaugaaggaggcccaggaggagaucgccuuccugaagcugcagcugcagggcaagagagccgaggaggccgaccacgaggugcuggaccagaaggagaugaagcagauggagggcgagggcaucgcccccaucaagaugaagguguuccuggaggacaccggccaggacuucccccugaugcccaacgaggagagcagccugcccgccguggagaaggagcaggccagcaccgagcaccagagcagaaccagcgaggagaucagccugaacgacgccggcguggagcugaagagcaccaagcaggacggcgacaagagccugagcgccgugcccgacaucggccagugccaccaggacgagcuggagagacugaagagccagauccuggagcuggagcugaacuuccacaaggcccaggagaucuacgagaagaaccuggacgagaaggccaaggagaucagcaaccugaaccagcugaucgaggaguucaagaagaacgccgacaacaacagcagcgccuucaccgcccugagcgaggagagagaccagcugcugagccaggugaaggagcugagcauggugaccgagcugagagcccaggugaagcagcuggagaugaaccuggccgaggccgagagacagagaagacuggacuacgagagccagaccgcccacgacaaccugcugaccgagcagauccacagccugagcaucgaggccaagagcaaggacgugaagaucgaggugcugcagaacgagcuggacgacgugcagcugcaguucagcgagcagagcacccugaucagaagccugcagagccagcugcagaacaaggagagcgaggugcuggagggcgccgagagagugagacacaucagcagcaagguggaggagcugagccaggcccugagccagaaggagcuggagaucaccaagauggaccagcugcugcuggagaagaagagagacguggagacccugcagcagaccaucgaggagaaggaccagcaggugaccgagaucagcuucagcaugaccgagaagauggugcagcugaacgaggagaaguucagccugggcguggagaucaagacccugaaggagcagcugaaccugcugagcagagccgaggaggccaagaaggagcagguggaggaggacaacgaggugagcagcggccugaagcagaacuacgacgagaugagccccgccggccagaucagcaaggaggagcugcagcacgaguucgaccugcugaagaaggagaacgagcagagaaagagaaagcugcaggccgcccugaucaacagaaaggagcugcugcagagagugagcagacuggaggaggagcuggccaaccugaaggacgagagcaagaaggagaucccccugagcgagaccgagagaggcgagguggaggaggacaaggagaacaaggaguacagcgagaagugcgugaccagcaagugccaggagaucgagaucuaccugaagcagaccaucagcgagaaggagguggagcugcagcacaucagaaaggaccuggaggagaagcuggccgccgaggagcaguuccaggcccuggugaagcagaugaaccagacccugcaggacaagaccaaccagaucgaccugcugcaggccgagaucagcgagaaccaggccaucauccagaagcugaucaccagcaacaccgacgccagcgacggcgacagcguggcccuggugaaggagaccguggugaucagcccccccugcaccggcagcagcgagcacuggaagcccgagcuggaggagaagauccuggcccuggagaaggagaaggagcagcugcagaagaagcugcaggaggcccugaccagcagaaaggccauccugaagaaggcccaggagaaggagagacaccugagagaggagcugaagcagcagaaggacgacuacaacagacugcaggagcaguucgacgagcagagcaaggagaacgagaacaucggcgaccagcugagacagcugcagauccaggugagagagagcaucgacggcaagcugcccagcaccgaccagcaggagagcugcagcagcacccccggccuggaggagccccuguucaaggccaccgagcagcaccacacccagcccgugcuggagagcaaccugugccccgacuggcccagccacagcgaggacgccagcgcccugcagggcggcaccagcguggcccagaucaaggcccagcugaaggagaucgaggccgagaagguggagcuggagcugaaggugagcagcaccaccagcgagcugaccaagaagagcgaggagguguuccagcugcaggagcagaucaacaagcagggccuggagaucgagagccugaagaccgugagccacgaggccgaggugcacgccgagagccugcagcagaagcuggagagcagccagcugcagaucgccggccuggagcaccugagagagcugcagcccaagcuggacgagcugcagaagcugaucagcaagaaggaggaggacgugagcuaccugagcggccagcugagcgagaaggaggccgcccugaccaagauccagaccgagaucaucgagcaggaggaccugaucaaggcccugcacacccagcuggagaugcaggccaaggagcacgacgagagaaucaagcagcugcagguggagcugugcgagaugaagcagaagcccgaggagaucggcgaggagagcagagccaagcagcagauccagagaaagcugcaggccgcccugaucagcagaaaggaggcccugaaggagaacaagagccugcaggaggagcugagccuggccagaggcaccaucgagagacugaccaagagccuggccgacguggagagccaggugagcgcccagaacaaggagaaggacaccgugcugggcagacuggcccugcugcaggaggagagagacaagcugaucaccgagauggacagaagccugcuggagaaccagagccugagcagcagcugcgagagccugaagcuggcccuggagggccugaccgaggacaaggagaagcuggugaaggagaucgagagccugaagagcagcaagaucgccgagagcaccgaguggcaggagaagcacaaggagcugcagaaggaguacgagauccugcugcagagcuacgagaacgugagcaacgaggccgagagaauccagcacgugguggaggccgugagacaggagaagcaggagcuguacggcaagcugagaagcaccgaggccaacaagaaggagaccgagaagcagcugcaggaggccgagcaggagauggaggagaugaaggagaagaugagaaaguucgccaagagcaagcagcagaagauccuggagcuggaggaggagaacgacagacugagagccgaggugcaccccgccggcgacaccgccaaggagugcauggagacccugcugagcagcaacgccagcaugaaggaggagcuggagagagugaagauggaguacgagacccugagcaagaaguuccagagccugaugagcgagaaggacagccugagcgaggaggugcaggaccugaagcaccagaucgagggcaacgugagcaagcaggccaaccuggaggccaccgagaagcacgacaaccagaccaacgugaccgaggagggcacccagagcauccccggcgagaccgaggagcaggacagccugagcaugagcaccagacccaccugcagcgagagcgugcccagcgccaagagcgccaaccccgccgugagcaaggacuucagcagccacgacgagaucaacaacuaccugcagcagaucgaccagcugaaggagagaaucgccggccuggaggaggagaagcagaagaacaaggaguucagccagacccuggagaacgagaagaacacccugcugagccagaucagcaccaaggacggcgagcugaagaugcugcaggaggaggugaccaagaugaaccugcugaaccagcagauccaggaggagcugagcagagugaccaagcugaaggagaccgccgaggaggagaaggacgaccuggaggagagacugaugaaccagcuggccgagcugaacggcagcaucggcaacuacugccaggacgugaccgacgcccagaucaagaacgagcugcuggagagcgagaugaagaaccugaagaagugcgugagcgagcuggaggaggagaagcagcagcuggugaaggagaagaccaagguggagagcgagaucagaaaggaguaccuggagaagauccagggcgcccagaaggagcccggcaacaagagccacgccaaggagcugcaggagcugcugaaggagaagcagcaggaggugaagcagcugcagaaggacugcaucagauaccaggagaagaucagcgcccuggagagaaccgugaaggcccuggaguucgugcagaccgagagccagaaggaccuggagaucaccaaggagaaccuggcccaggccguggagcacagaaagaaggcccaggccgagcuggccagcuucaaggugcugcuggacgacacccagagcgaggccgccagagugcuggccgacaaccugaagcugaagaaggagcugcagagcaacaaggagagcgugaagagccagaugaagcagaaggacgaggaccuggagagaagacuggagcaggccgaggagaagcaccugaaggagaagaagaacaugcaggagaagcuggacgcccugagaagagagaaggugcaccuggaggagaccaucggcgagauccaggugacccugaacaagaaggacaaggaggugcagcagcugcaggagaaccuggacagcaccgugacccagcuggccgccuucaccaagagcaugagcagccugcaggacgacagagacagagugaucgacgaggccaagaagugggagagaaaguucagcgacgccauccagagcaaggaggaggagaucagacugaaggaggacaacugcagcgugcugaaggaccagcugagacagaugagcauccacauggaggagcugaagaucaacaucagcagacuggagcacgacaagcagaucugggagagcaaggcccagaccgaggugcagcugcagcagaaggugugcgacacccugcagggcgagaacaaggagcugcugagccagcuggaggagaccagacaccuguaccacagcagccagaacgagcuggccaagcuggagagcgagcugaagagccugaaggaccagcugaccgaccugagcaacagccuggagaagugcaaggagcagaagggcaaccuggagggcaucaucagacagcaggaggccgacauccagaacagcaaguucagcuacgagcagcuggagaccgaccugcaggccagcagagagcugaccagcagacugcacgaggagaucaacaugaaggagcagaagaucaucagccugcugagcggcaaggaggaggccauccagguggccaucgccgagcugagacagcagcacgacaaggagaucaaggagcuggagaaccugcugagccaggaggaggaggagaacaucgugcuggaggaggagaacaagaaggccguggacaagaccaaccagcugauggagacccugaagaccaucaagaaggagaacauccagcagaaggcccagcuggacagcuucgugaagagcaugagcagccugcagaacgacagagacagaaucgugggcgacuaccagcagcuggaggagagacaccugagcaucauccuggagaaggaccagcugauccaggaggccgccgccgagaacaacaagcugaaggaggagaucagaggccugagaagccacauggacgaccugaacagcgagaacgccaagcuggacgccgagcugauccaguacagagaggaccugaaccaggugaucaccaucaaggacagccagcagaagcagcugcuggaggugcagcugcagcagaacaaggagcuggagaacaaguacgccaagcuggaggagaagcugaaggagagcgaggaggccaacgaggaccugagaagaagcuucaacgcccugcaggaggagaagcaggaccugagcaaggagaucgagagccugaaggugagcaucagccagcugaccagacaggugaccgcccugcaggaggagggcacccugggccuguaccacgcccagcugaaggugaaggaggaggaggugcacagacugagcgcccuguucagcagcagccagaagagaaucgccgagcuggaggaggagcuggugugcgugcagaaggaggccgccaagaaggugggcgagaucgaggacaagcugaagaaggagcugaagcaccugcaccacgacgccggcaucaugagaaacgagaccgagaccgccgaggagagaguggccgagcuggccagagaccugguggagauggagcagaagcugcugauggugaccaaggagaacaagggccugaccgcccagauccagagcuucggcagaagcaugagcagccugcagaacagcagagaccacgccaacgaggagcuggacgagcugaagagaaaguacgacgccagccugaaggagcuggcccagcugaaggagcagggccugcugaacagagagagagacgcccugcugagcgagaccgccuucagcaugaacagcaccgaggagaacagccugagccaccuggagaagcugaaccagcagcugcugagcaaggacgagcagcugcugcaccugagcagccagcuggaggacagcuacaaccaggugcagagcuucagcaaggccauggccagccugcagaacgagagagaccaccuguggaacgagcuggagaaguucagaaagagcgaggagggcaagcagagaagcgccgcccagcccagcaccagccccgccgaggugcagagccugaagaaggccaugagcagccugcagaacgacagagacagacugcugaaggagcugaagaaccugcagcagcaguaccugcagaucaaccaggagaucaccgagcugcacccccugaaggcccagcugcaggaguaccaggacaagaccaaggccuuccagaucaugcaggaggagcugagacaggagaaccugagcuggcagcacgagcugcaccagcugagaauggagaagagcagcugggagauccacgagagaagaaugaaggagcaguaccugauggccaucagcgacaaggaccagcagcugagccaccugcagaaccugaucagagagcugagaagcagcagcagccagacccagccccugaaggugcaguaccagagacaggccagccccgagaccagcgccagccccgacggcagccagaaccugguguacgagaccgagcugcugagaacccagcugaacgacagccugaaggagauccaccagaaggagcugagaauccagcagcugaacagcaacuucagccagcugcuggaggagaagaacacccugagcauccagcugugcgacaccagccagagccugagagagaaccagcagcacuacggcgaccugcugaaccacugcgccgugcuggagaagcaggugcaggagcugcaggccgugagcaaggagaagggcccccugaacaucgacguggcccccggcgccccccaggagaagaacggcgugcacagaaagagcgaccccgaggagcugagagagccccagcagagcuucagcgaggcccagcagcagcugugcaacaccagacaggaggugaacgagcugagaaagcugcuggaggaggagagagaccagagaguggccgccgagaacgcccugagcguggccgaggagcagaucagaagacuggagcacagcgagugggacagcagcagaacccccaucaucggcagcugcggcacccaggagcaggcccugcugaucgaccugaccagcaacagcugcagaagaaccagaagcggcgugggcuggaagagagugcugagaagccugugccacagcagaaccagagugccccugcuggccgccaucuacuuccugaugauccacgugcugcugauccugugcuucaccggccaccuguaa

SEQ ID NO: 17638 - RNA, 1206 nt, Artificial Sequence
  GOLM1__Homo_sapiens__NP_808800
augaugggccugggcaacggcagaagaagcaugaagagccccccccuggugcuggccgcccugguggccugcaucaucgugcugggcuucaacuacuggaucgccagcagcagaagcguggaccugcagaccagaaucauggagcuggagggcagagugagaagagccgccgccgagagaggcgccguggagcugaagaagaacgaguuccagggcgagcuggagaagcagagagagcagcuggacaagauccagagcagccacaacuuccagcuggagagcgugaacaagcuguaccaggacgagaaggccgugcuggugaacaacaucaccaccggcgagagacugaucagagugcugcaggaccagcugaagacccugcagagaaacuacggcagacugcagcaggacgugcugcaguuccagaagaaccagaccaaccuggagagaaaguucagcuacgaccugagccagugcaucaaccagaugaaggaggugaaggagcagugcgaggagagaaucgaggaggugaccaagaagggcaacgaggccguggccagcagagaccugagcgagaacaacgaccagagacagcagcugcaggcccugagcgagccccagcccagacugcaggccgccggccugccccacaccgaggugccccagggcaagggcaacgugcugggcaacagcaagagccagacccccgcccccagcagcgagguggugcuggacagcaagagacagguggagaaggaggagaccaacgagauccagguggugaacgaggagccccagagagacagacugccccaggagcccggcagagagcaggugguggaggacagacccgugggcggcagaggcuucggcggcgccggcgagcugggccagaccccccaggugcaggccgcccugagcgugagccaggagaaccccgagauggagggccccgagagagaccagcuggugauccccgacggccaggaggaggagcaggaggccgccggcgagggcagaaaccagcagaagcugagaggcgaggacgacuacaacauggacgagaacgaggccgagagcgagaccgacaagcaggccgcccuggccggcaacgacagaaacaucgacguguucaacguggaggaccagaagagagacaccaucaaccugcuggaccagagagagaagagaaaccacacccuguaa

SEQ ID NO: 17639 - RNA, 897 nt, Artificial Sequence
  GOLPH3__Homo_sapiens__NP_071413
augaccagccugacccagagaagcagcggccuggugcagagaagaaccgaggccagcagaaacgccgccgacaaggagagagccgccggcggcggcgccggcagcagcgaggacgacgcccagagcagaagagacgagcaggacgacgacgacaagggcgacagcaaggagaccagacugacccugauggaggaggugcugcugcugggccugaaggacagagagggcuacaccagcuucuggaacgacugcaucagcagcggccugagaggcugcaugcugaucgagcuggcccugagaggcagacugcagcuggaggccugcggcaugagaagaaagagccugcugaccagaaaggugaucugcaagagcgacgcccccaccggcgacgugcugcuggacgaggcccugaagcacgugaaggagacccagccccccgagaccgugcagaacuggaucgagcugcugagcggcgagaccuggaacccccugaagcugcacuaccagcugagaaacgugagagagagacuggccaagaaccugguggagaagggcgugcugaccaccgagaagcagaacuuccugcuguucgacaugaccacccacccccugaccaacaacaacaucaagcagagacugaucaagaaggugcaggaggccgugcuggacaagugggugaacgacccccacagaauggacagaagacugcuggcccugaucuaccuggcccacgccagcgacgugcuggagaacgccuucgccccccugcuggacgagcaguacgaccuggccaccaagagagugagacagcugcuggaccuggaccccgagguggagugccugaaggccaacaccaacgaggugcugugggccgugguggccgccuucaccaaguaa

SEQ ID NO: 17640 - RNA, 399 nt, Artificial Sequence
  GOLT1A__Homo_sapiens__NP_940849
augaucagcaucaccgaguggcagaagaucggcgugggcaucaccggcuucggcaucuucuucauccuguucggcacccugcuguacuucgacagcgugcugcuggccuucggcaaccugcuguuccugaccggccugagccugaucaucggccugagaaagaccuucugguucuucuuccagagacacaagcugaagggcaccagcuuccugcugggcggcguggugaucgugcugcugagauggccccugcugggcauguuccuggagaccuacggcuucuucagccuguucaagggcuucuuccccguggccuucggcuuccugggcaacgugugcaacauccccuuccugggcgcccuguucagaagacugcagggcaccagcagcaugguguaa

SEQ ID NO: 17641 - RNA, 417 nt, Artificial Sequence
  GOLT1B__Homo_sapiens__NP_057156
augaucagccugaccgacacccagaagaucggcaugggccugaccggcuucggcguguucuuccuguucuucggcaugauccuguucuucgacaaggcccugcuggccaucggcaacgugcuguucguggccggccuggccuucgugaucggccuggagagaaccuucagauucuucuuccagaagcacaagaugaaggccaccggcuucuuccugggcggcguguucguggugcugaucggcuggccccugaucggcaugaucuucgagaucuacggcuucuuccugcuguucagaggcuucuuccccgugguggugggcuucaucagaagagugcccgugcugggcagccugcugaaccugcccggcaucagaagcuucguggacaaggugggcgagagcaacaacaugguguaa

SEQ ID NO: 17642 - RNA, 6723 nt, Artificial Sequence
  GON4L__Homo_sapiens__NP_001269787
augcugcccugcaagaagagaagaaccaccgugaccgagagccugcagcacaagggcaaccaggaggagaacaacguggaccuggagagcgccgugaagcccgagagcgaccaggugaaggaccugagcagcgugagccugagcugggaccccagccacggcagaguggccggcuucgaggugcagagccugcaggacgccggcaaccagcugggcauggaggacaccagccugagcagcggcaugcugacccagaacaccaacgugcccauccuggagggcguggacguggccaucagccagggcaucacccugcccagccuggagagcuuccacccccugaacauccacaucggcaagggcaagcugcacgccaccggcagcaagagaggcaagaagaugacccugagacccggccccgugacccaggaggacagaugcgaccaccugacccugaaggagcccuucagcggcgagcccagcgaggaggugaaggaggagggcggcaagccccagaugaacagcgagggcgagauccccagccugcccagcggcagccagagcgccaagcccgugagccagcccagaaagagcacccagcccgacgugugcgccagcccccaggagaagccccugagaacccuguuccaccagcccgaggaggagaucgaggacggcggccuguucauccccauggaggagcaggacaacgaggagagcgagaagagaagaaagaagaagaagggcaccaagagaaagagagacggcagaggccaggagggcacccuggccuacgaccugaagcuggacgacaugcuggacagaacccuggaggacggcgccaagcagcacaaccugaccgccgugaacgugagaaacauccugcacgaggugaucaccaacgagcacgugguggccaugaugaaggccgccaucagcgagaccgaggacaugcccauguucgagcccaagaugaccagaagcaagcugaaggaggugguggagaagggcguggugauccccaccuggaacaucagccccaucaagaaggccaacgagaucaagcccccccaguucguggacauccaccuggaggaggacgacagcagcgacgaggaguaccagcccgacgacgaggaggaggacgagaccgccgaggagagccugcuggagagcgacguggagagcaccgccagcagccccagaggcgccaagaagagcagacugagacagagcagcgagaugaccgagaccgacgaggagagcggcauccugagcgaggccgagaaggugaccacccccgccaucagacacaucagcgccgagguggugcccaugggccccccccccccccccaagcccaagcagaccagagacagcaccuucauggagaagcugcacgccguggacgaggagcuggccagcagccccgugugcauggacagcuuccagcccauggacgacagccugaucgccuucagaaccagaagcaagaugccccugaaggacgugccccugggccagcuggaggccgagcugcaggcccccgacaucacccccgacauguacgaccccaacaccgccgacgacgaggacuggaagauguggcugggcggccugaugaacgacgacgugggcaacgaggacgaggccgacgacgacgacgaccccgaguacaacuuccuggaggaccuggacgagcccgacaccgaggacuucagaaccgacagagccgugagaaucaccaagaaggaggugaacgagcugauggaggagcuguucgagaccuuccaggacgagaugggcuucagcaacauggaggacgacggccccgaggaggaggagugcguggccgagcccagacccaacuucaacaccccccaggcccugagauucgaggagccccuggccaaccugcugaacgagcagcacagaaccgugaaggagcuguucgagcagcugaagaugaagaagagcagcgccaagcagcugcaggagguggagaaggugaagccccagagcgagaaggugcaccagacccugauccuggaccccgcccagagaaagagacugcagcagcagaugcagcagcacgugcagcugcugacccagauccaccugcuggccaccugcaaccccaaccugaaccccgaggccaccaccaccagaaucuuccugaaggagcugggcaccuucgcccagagcagcaucgcccugcaccaccaguacaaccccaaguuccagacccuguuccagcccugcaaccugaugggcgccaugcagcugaucgaggacuucagcacccacgugagcaucgacugcagcccccacaagaccgugaagaagaccgccaacgaguuccccugccugcccaagcagguggccuggauccuggccaccagcaagguguucauguaccccgagcugcugcccgugugcagccugaaggccaagaacccccaggacaagaucguguucaccaaggccgaggacaaccugcuggcccugggccugaagcacuucgagggcaccgaguuccccaacccccugaucagcaaguaccugcugaccugcaagaccgcccaccagcugaccgugagaaucaagaaccugaacaugaacagagcccccgacaacaucaucaaguucuacaagaagaccaagcagcugcccgugcugggcaagugcugcgaggagauccagccccaccaguggaagccccccaucgagagagaggagcacagacugcccuucuggcugaaggccagccugcccagcauccaggaggagcugagacacauggccgacggcgccagagaggugggcaacaugaccggcaccaccgagaucaacagcgacagaagccuggagaaggacaaccuggagcugggcagcgagagcagauacccccugcugcugcccaagggcguggugcugaagcugaagcccguggccaccagauuccccagaaaggccuggagacagaagagaagcagcgugcugaagccccugcugauccagcccagccccagccugcagcccagcuucaaccccggcaagacccccgccagaagcacccacagcgaggccccccccagcaagauggugcugagaaucccccaccccauccagcccgccaccgugcugcagaccgugcccggcgugcccccccugggcgugagcggcggcgagagcuucgagagccccgccgcccugcccgccgugccccccgaggccagaaccagcuucccccugagcgagagccagacccugcugagcagcgcccccgugcccaaggugaugcugcccagccuggcccccagcaaguucagaaagcccuacgugagaagaagacccagcaagagaagaggcgugaaggccagccccugcaugaagcccgcccccgugauccaccaccccgccagcgugaucuucaccgugcccgccaccaccgugaagaucgugagccugggcggcggcugcaacaugauccagcccgugaacgccgccguggcccagagcccccagaccauccccaucaccacccugcuggugaaccccaccagcuuccccugcccccugaaccagagccugguggccagcagcgugagcccccugaucgugagcggcaacagcgugaaccugcccauccccagcacccccgaggacaaggcccacgugaacguggacaucgccugcgccguggccgacggcgagaacgccuuccagggccuggagcccaagcuggagccccaggagcugagcccccugagcgccaccguguuccccaagguggagcacagccccggccccccccuggccgacgccgagugccaggagggccugagcgagaacagcgccugcagauggaccguggugaagaccgaggagggcagacaggcccuggagccccugccccagggcauccaggagagccugaacaaccccacccccggcgaccuggaggagaucgugaagauggagcccgaggaggccagagaggagaucagcggcagccccgagagagacaucugcgacgacaucaagguggagcacgccguggagcuggacaccggcgcccccagcgaggagcugagcagcgccggcgaggugaccaagcagaccgugcugcagaaggaggaggagagaagccagcccaccaagacccccagcagcagccaggagccccccgacgagggcaccagcggcaccgacgugaacaagggcagcagcaagaacgcccugagcagcauggaccccgaggugagacugagcagcccccccggcaagcccgaggacagcagcagcguggacggccagagcgugggcacccccgugggccccgagaccggcggcgagaagaacggccccgaggaggaggaggaggaggacuucgacgaccugacccaggacgaggaggacgagaugagcagcgccagcgaggagagcgugcugagcgugcccgagcugcaggagaccauggagaagcugaccuggcuggccagcgagagaagaaugagccaggagggcgagagcgaggaggagaacagccaggaggagaacagcgagcccgaggaggaggaggaggaggaggccgagggcauggagagccugcagaaggaggacgagaugaccgacgaggccgugggcgacagcgccgagaagccccccaccuucgccagccccgagaccgcccccgagguggagaccagcagaaccccccccggcgagagcaucaaggccgccggcaagggcagaaacaaccacagagccagaaacaagagaggcagcagagccagagccagcaaggacaccagcaagcugcugcugcuguacgacgaggacauccuggagagagacccccugagagagcagaaggaccuggccuucgcccaggccuaccugaccagagugagagaggcccugcagcacauccccggcaaguacgaggacuuccugcaggugaucuacgaguucgagagcagcacccagagaagaaccgccguggaccuguacaagagccugcagauccugcugcaggacuggccccagcugcugaaggacuucgccgccuuccugcugcccgagcaggcccuggccugcggccuguucgaggagcagcaggccuucgagaagagcagaaaguuccugagacagcuggagaucugcuucgccgagaaccccagccaccaccagaagaucaucaaggugcugcagggcugcgccgacugccugccccaggagaucaccgagcugaagacccagauguggcagcugcugaagggccacgaccaccugcaggacgaguucagcaucuucuucgaccaccugagacccgccgccagcagaaugggcgacuucgaggagaucaacuggaccgaggagaaggaguacgaguucgacggcuucgaggagguggcccugcccgacguggaggaggaggaggagccccccaagauccccaccgccagcaagaacaagagaaagaaggagaucggcgugcagaaccacgacaaggagaccgaguggcccgacggcgccaaggacugcgccugcagcugccacgagggcggccccgacagcaagcugaagaagagcaagagaagaagcugcagccacugcagcagcaaggugugcgacagcaagagcuacaagagcaaggagccccacgagcuggugggcagcagcccccacagagaggccagccccaugcccggcgccaaggaggccggccagggcaaggacaugauggaggaggaggcccccgaggagagagagagcaccgaggccacccagagcagaaccgugagaaccaccagaaagggcgagaugcccgugagcggccuggccgugggcagcacccugcccagccccagagaggugaccgugaccgagagacugcugcuggacggcccccccccccacagccccgagaccccccaguucccccccaccaccggcgccgugcuguacaccgugaagagaaaccaggugggccccgaggugagaagcugccccaaggccagccccagacugcagaaggagagagagggccagaaggccgugagcgagagcgaggcccugaugcuggugugggacgccagcgagaccgagaagcugcccggcaccguggagccccccgccagcuuccugagccccgugagcagcaagaccagagacgccggcagaagacacgugagcggcaagcccgacacccaggagagauggcugcccagcagcagagccagagugaagaccagagacagaaccugccccgugcacgagagccccagcggcaucgacaccagcgagaccagccccaaggcccccagaggcggccuggccaaggacagcggcacccaggccaagggccccgagggcgagcagcagcccaaggccgccgaggccaccgugugcgccaacaacagcaaggugagcagcaccggcgagaagguggugcuguggaccagagaggccgacagagugauccugaccaugugccaggagcagggcgcccagccccagaccuucaacaucaucagccagcagcugggcaacaagacccccgccgaggugagccacagauucagagagcugaugcagcuguuccacaccgccugcgaggccagcagcgaggacgaggacgacgccaccagcaccagcaacgccgaccagcugagcgaccacggcgaccugcugagcgaggaggagcuggacgaguaa

SEQ ID NO: 17643 - RNA, 1365 nt, Artificial Sequence
  GOPC__Homo_sapiens__NP_001017408
augagcgccggcggccccugccccgccgccgccggcggcggccccggcggcgccagcugcagcgugggcgcccccggcggcgugagcauguucagauggcuggaggugcuggagaaggaguucgacaaggccuucguggacguggaccugcugcugggcgagaucgaccccgaccaggccgacaucaccuacgagggcagacagaagaugaccagccugagcagcugcuucgcccagcugugccacaaggcccagagcgugagccagaucaaccacaagcuggaggcccagcugguggaccugaagagcgagcugaccgagacccaggccgagaagguggugcuggagaaggaggugcacgaccagcugcugcagcugcacagcauccagcugcagcugcacgccaagaccggccagagcgccgacagcggcaccaucaaggccaagcuggagagagagcuggaggccaacaagaaggagaagaugaaggaggcccagcuggaggccgaggugaagcugcugagaaaggagaacgaggcccugagaagacacaucgccgugcugcaggccgagguguacggcgccagacuggccgccaaguaccuggacaaggagcuggccggcagagugcagcagauccagcugcugggcagagacaugaagggccccgcccacgacaagcuguggaaccagcuggaggccgagauccaccugcacagacacaagaccgugaucagagccugcagaggcagaaacgaccugaagagacccaugcaggccccccccggccacgaccaggacagccugaagaagagccagggcgugggccccaucagaaaggugcugcugcugaaggaggaccacgagggccugggcaucagcaucaccggcggcaaggagcacggcgugcccauccugaucagcgagauccaccccggccagcccgccgacagaugcggcggccugcacgugggcgacgccauccuggccgugaacggcgugaaccugagagacaccaagcacaaggaggccgugaccauccugagccagcagagaggcgagaucgaguucgaggugguguacguggcccccgagguggacagcgacgacgagaacguggaguacgaggacgagagcggccacagauacagacuguaccuggacgagcuggagggcggcggcaaccccggcgccagcugcaaggacaccagcggcgagaucaaggugcugcagggcuucaacaagaaggccgugaccgacacccacgagaacggcgaccugggcaccgccagcgagaccccccuggacgacggcgccagcaagcuggacgaccugcacacccuguaccacaagaagagcuacuaa

SEQ ID NO: 17644 - RNA, 741 nt, Artificial Sequence
  GORAB__Homo_sapiens__NP_001139511
augagcugggccgccgugcuggccguggccgccgccagauucggccacuucuggggcugcagauggcccggccccauggcccagggcugggccggcuucagcgaggaggagcugagaagacugaagcagaccaaggaccccuucgagccccagagaagacugcccgccaagaagagcagacagcagcugcagagagagaaggcccugguggagcagagccagaagcugggccugcaggacggcagcaccagccugcugcccgagcagcugcugagcgcccccaagcagagagugaacgugcagaagccccccuucagcagccccacccugcccagccacuucacccugaccagccccgugggcgacggccagccccagggcaucgagagccagcccaaggagcugggccuggagaacagccacgacggccacaacaacguggagauccugccccccaagcccgacugcaagcuggagaagaagaagguggagcugcaggagaagagcagaugggaggugcugcagcaggagcagagacugauggaggagaagaacaagagaaagaaggcccugcuggccaaggccaucgccgagagaagcaagagaacccaggccgagaccaugaagcugaagagaauccagaaggagcugcaggcccuggacgacauggugagcgccgacaucggcauccugagaaacagaaucgaccaggccagccuggacuacagcuacgccagauaa

SEQ ID NO: 17645 - RNA, 1323 nt, Artificial Sequence
  GORASP1__Homo_sapiens__NP_114105
augggccugggcgugagcgccgagcagcccgccggcggcgccgagggcuuccaccugcacggcgugcaggagaacagccccgcccagcaggccggccuggagcccuacuucgacuucaucaucaccaucggccacagcagacugaacaaggagaacgacacccugaaggcccugcugaaggccaacguggagaagcccgugaagcuggagguguucaacaugaagaccaugagagugagagagguggagguggugcccagcaacauguggggcggccagggccugcugggcgccagcgugagauucugcagcuucagaagagccagcgagcagguguggcacgugcuggacguggagcccagcagccccgccgcccuggccggccugagacccuacaccgacuacguggugggcagcgaccagauccugcaggagagcgaggacuucuucacccugaucgagagccacgagggcaagccccugaagcugaugguguacaacagcaagagcgacagcugcagagaggugaccgugacccccaacgccgccuggggcggcgagggcagccugggcugcggcaucggcuacggcuaccugcacagaauccccacccagccccccagcuaccacaagaagccccccggcacccccccccccagcgcccugccccugggcgcccccccccccgacgcccugccccccggccccacccccgaggacagccccagccuggagaccggcagcagacagagcgacuacauggaggcccugcugcaggcccccggcagcagcauggaggacccccugcccggccccggcagccccagccacagcgcccccgaccccgacggccugccccacuucauggagaccccccugcagccccccccccccgugcagagagugauggaccccggcuuccuggacgugagcggcaucagccugcuggacaacagcaacgccagcguguggcccagccugcccagcagcaccgagcugaccaccaccgccgugagcaccagcggccccgaggacaucugcagcagcagcagcagccacgagagaggcggcgaggccaccuggagcggcagcgaguucgaggugagcuuccuggacagccccggcgcccaggcccaggccgaccaccugccccagcugacccugcccgacagccugaccagcgccgccagccccgaggacggccugagcgccgagcugcuggaggcccaggccgaggaggagcccgccagcaccgagggccuggacaccggcaccgaggccgagggccuggacagccaggcccagaucagcaccaccgaguaa

SEQ ID NO: 17646 - RNA, 1359 nt, Artificial Sequence
  GORASP2__Homo_sapiens__NP_056345
augggcagcagccagagcguggagauccccggcggcggcaccgagggcuaccacgugcugagagugcaggagaacagccccggccacagagccggccuggagcccuucuucgacuucaucgugagcaucaacggcagcagacugaacaaggacaacgacacccugaaggaccugcugaaggccaacguggagaagcccgugaagaugcugaucuacagcagcaagacccuggagcugagagagaccagcgugacccccagcaaccuguggggcggccagggccugcugggcgugagcaucagauucugcagcuucgacggcgccaacgagaacguguggcacgugcuggagguggagagcaacagccccgccgcccuggccggccugagaccccacagcgacuacaucaucggcgccgacaccgugaugaacgagagcgaggaccuguucagccugaucgagacccacgaggccaagccccugaagcuguacguguacaacaccgacaccgacaacugcagagaggugaucaucacccccaacagcgccuggggcggcgagggcagccugggcugcggcaucggcuacggcuaccugcacagaauccccaccagacccuucgaggagggcaagaagaucagccugcccggccagauggccggcacccccaucaccccccugaaggacggcuucaccgaggugcagcugagcagcgugaacccccccagccugagcccccccggcaccaccggcaucgagcagagccugaccggccugagcaucagcagcaccccccccgccgugagcagcgugcugagcaccggcgugcccaccgugccccugcugcccccccaggugaaccagagccugaccagcgugccccccaugaaccccgccaccacccugcccggccugaugccccugcccgccggccugcccaaccugcccaaccugaaccugaaccugcccgccccccacaucaugcccggcgugggccugcccgagcuggugaaccccggccugcccccccugcccagcaugccccccagaaaccugcccggcaucgccccccugccccugcccagcgaguuccugcccagcuucccccuggugcccgagagcagcagcgccgccagcagcggcgagcugcugagcagccugccccccaccagcaacgcccccagcgaccccgccaccaccaccgccaaggccgacgccgccagcagccugaccguggacgugaccccccccaccgccaaggcccccaccaccguggaggacagagugggcgacagcacccccgugagcgagaagcccgugagcgccgccguggacgccaacgccagcgagagccccuaa

SEQ ID NO: 17647 - RNA, 747 nt, Artificial Sequence
  GOSR1__Homo_sapiens__NP_001007026
auggccgccggcaccagcagcuacugggaggaccugagaaagcaggccagacagcuggagaacgagcuggaccugaagcuggugagcuucagcaagcugugcaccagcuacagccacagcagcaccagagacggcagaagagacagcagcgacaccaccccccugcugaacggcagcagccaggacagaauguucgagaccauggccaucgagaucgagcagcugcuggccagacugaccggcgugaacgacaagauggccgaguacaccaacagcgccggcgugcccagccugaacgccgcccugaugcacacccugcagagacacagagacauccugcaggacuacacccacgaguuccacaagaccaaggccaacuucauggccaucagagagagagagaaccugaugggcagcgugagaaaggacaucgagagcuacaagagcggcagcggcgugaacaacagaagaaccgagcuguuccugaaggagcacgaccaccugagaaacagcgacagacugaucgaggagaccaucagcaucgccauggccaccaaggagaacaugaccagccagagaggcaugcugaagagcauccacagcaagaugaacacccuggccaacagauuccccgccgugaacagccugauccagagaaucaaccugagaaagagaagagacagccugauccugggcggcgugaucggcaucugcaccauccugcugcugcuguacgccuuccacuaa

SEQ ID NO: 17648 - RNA, 588 nt, Artificial Sequence
  GOSR2__Homo_sapiens__NP_001012529
auggacccccuguuccagcagacccacaagcaggugcacgagauccagagcugcaugggcagacuggagaccgccgacaagcagagcgugcacaucguggagaacgagauccaggccagcaucgaccagaucuucagcagacuggagagacuggagauccugagcagcaaggagccccccaacaagagacagaacgccagacugagaguggaccagcugaaguacgacgugcagcaccugcagaccgcccugagaaacuuccagcacagaagacacgccagagagcagcaggagagacagagagaggagcugcugagcagaaccuucaccaccaacgacagcgacaccaccauccccauggacgagagccugcaguucaacagcagccugcagaaggugcacaacggcauggacgaccugauccuggacggccacaacauccuggacggccugagaacccagagacugacccugaaggugggcagccugcugggcgacagagagaaggccagcugcuucagccugauccagcaguucagcaacugcguguacauccugaucaccugcccccagaucgugaucuucuaa

SEQ ID NO: 17649 - RNA, 1242 nt, Artificial Sequence
  GOT1__Homo_sapiens__NP_002070
auggccccccccagcguguucgccgaggugccccaggcccagcccgugcugguguucaagcugaccgccgacuucagagaggaccccgaccccagaaaggugaaccugggcgugggcgccuacagaaccgacgacugccaccccugggugcugcccguggugaagaagguggagcagaagaucgccaacgacaacagccugaaccacgaguaccugcccauccugggccuggccgaguucagaagcugcgccagcagacuggcccugggcgacgacagccccgcccugaaggagaagagagugggcggcgugcagagccugggcggcaccggcgcccugagaaucggcgccgacuuccuggccagaugguacaacggcaccaacaacaagaacacccccguguacgugagcagccccaccugggagaaccacaacgccguguucagcgccgccggcuucaaggacaucagaagcuacagauacugggacgccgagaagagaggccuggaccugcagggcuuccugaacgaccuggagaacgcccccgaguucagcaucguggugcugcacgccugcgcccacaaccccaccggcaucgaccccacccccgagcaguggaagcagaucgccagcgugaugaagcacagauuccuguuccccuucuucgacagcgccuaccagggcuucgccagcggcaaccuggagagagacgccugggccaucagauacuucgugagcgagggcuucgaguucuucugcgcccagagcuucagcaagaacuucggccuguacaacgagagagugggcaaccugaccguggugggcaaggagcccgagagcauccugcaggugcugagccagauggagaagaucgugagaaucaccuggagcaacccccccgcccagggcgccagaaucguggccagcacccugagcaaccccgagcuguucgaggaguggaccggcaacgugaagaccauggccgacagaauccugaccaugagaagcgagcugagagccagacuggaggcccugaagacccccggcaccuggaaccacaucaccgaccagaucggcauguucagcuucaccggccugaaccccaagcagguggaguaccuggugaacgagaagcacaucuaccugcugcccagcggcagaaucaacgugagcggccugaccaccaagaaccuggacuacguggccaccagcauccacgaggccgugaccaagauccaguaa

SEQ ID NO: 17650 - RNA, 1164 nt, Artificial Sequence
  GOT2__Homo_sapiens__NP_001273149
auggcccugcugcacagcggcagagugcugcccggcaucgccgccgccuuccaccccggccuggccgccgccgccagcgccagagccagcagcugguggacccacguggagaugggcccccccgaccccauccugggcgugaccgaggccuucaagagagacaccaacagcaagaagaugaaccugggcgugggcgccuacagagacgacaacggcaagcccuacgugcugcccagcgugagaaaguucgugaccgugcagaccaucagcggcaccggcgcccugagaaucggcgccagcuuccugcagagauucuucaaguucagcagagacguguuccugcccaagcccaccuggggcaaccacacccccaucuucagagacgccggcaugcagcugcagggcuacagauacuacgaccccaagaccugcggcuucgacuucaccggcgccguggaggacaucagcaagauccccgagcagagcgugcugcugcugcacgccugcgcccacaaccccaccggcguggaccccagacccgagcaguggaaggagaucgccaccguggugaagaagagaaaccuguucgccuucuucgacauggccuaccagggcuucgccagcggcgacggcgacaaggacgccugggccgugagacacuucaucgagcagggcaucaacgugugccugugccagagcuacgccaagaacaugggccuguacggcgagagagugggcgccuucaccauggugugcaaggacgccgacgaggccaagagaguggagagccagcugaagauccugaucagacccauguacagcaaccccccccugaacggcgccagaaucgccgccgccauccugaacacccccgaccugagaaagcaguggcugcaggaggugaaggugauggccgacagaaucaucggcaugagaacccagcuggugagcaaccugaagaaggagggcagcacccacaacuggcagcacaucaccgaccagaucggcauguucugcuucaccggccugaagcccgagcagguggagagacugaucaaggaguucagcaucuacaugaccaaggacggcagaaucagcguggccggcgugaccagcagcaacgugggcuaccuggcccacgccauccaccaggugaccaaguaa

SEQ ID NO: 17651 - RNA, 1959 nt, Artificial Sequence
  GP1BA__Homo_sapiens__NP_000164
augccccugcugcugcugcugcugcugcugcccagcccccugcacccccaccccaucugcgaggugagcaagguggccagccaccuggaggugaacugcgacaagagaaaccugaccgcccugccccccgaccugcccaaggacaccaccauccugcaccugagcgagaaccugcuguacaccuucagccuggccacccugaugcccuacaccagacugacccagcugaaccuggacagaugcgagcugaccaagcugcagguggacggcacccugcccgugcugggcacccuggaccugagccacaaccagcugcagagccugccccugcugggccagacccugcccgcccugaccgugcuggacgugagcuucaacagacugaccagccugccccugggcgcccugagaggccugggcgagcugcaggagcuguaccugaagggcaacgagcugaagacccugccccccggccugcugacccccacccccaagcuggagaagcugagccuggccaacaacaaccugaccgagcugcccgccggccugcugaacggccuggagaaccuggacacccugcugcugcaggagaacagccuguacaccauccccaagggcuucuucggcagccaccugcugcccuucgccuuccugcacggcaaccccuggcugugcaacugcgagauccuguacuucagaagauggcugcaggacaacgccgagaacguguacguguggaagcagggcguggacgugaaggccaugaccagcaacguggccagcgugcagugcgacaacagcgacaaguuccccguguacaaguaccccggcaagggcugccccacccugggcgacgagggcgacaccgaccuguacgacuacuaccccgaggaggacaccgagggcgacaaggugagagccaccagaaccguggugaaguuccccaccaaggcccacaccacccccuggggccuguucuacagcuggagcaccgccagccuggacagccagaugcccagcagccugcaccccacccaggagagcaccaaggagcagaccaccuucccccccagauggacccccaacuucacccugcacauggagagcaucaccuucagcaagacccccaagagcaccaccgagcccacccccagccccaccaccagcgagcccgugcccgagcccgcccccaacaugaccacccuggagcccacccccagccccaccacccccgagcccaccagcgagcccgcccccagccccaccacccccgagcccaccagcgagcccgcccccagccccaccacccccgagcccaccagcgagcccgcccccagccccaccacccccgagcccacccccauccccaccaucgccaccagccccaccauccuggugagcgccaccagccugaucacccccaagagcaccuuccugaccaccaccaagcccgugagccugcuggagagcaccaagaagaccauccccgagcuggaccagccccccaagcugagaggcgugcugcagggccaccuggagagcagcagaaacgaccccuuccugcaccccgacuucugcugccugcugccccugggcuucuacgugcugggccuguucuggcugcuguucgccagcguggugcugauccugcugcugagcugggugggccacgugaagccccaggcccuggacagcggccagggcgccgcccugaccaccgccacccagaccacccaccuggagcugcagagaggcagacaggugaccgugcccagagccuggcugcuguuccugagaggcagccugcccaccuucagaagcagccuguuccugugggugagacccaacggcagagugggcccccugguggccggcagaagacccagcgcccugagccagggcagaggccaggaccugcugagcaccgugagcaucagauacagcggccacagccuguaa

SEQ ID NO: 17652 - RNA, 621 nt, Artificial Sequence
  GP1BB__Homo_sapiens__NP_000398
augggcagcggccccagaggcgcccugagccugcugcugcugcugcuggccccccccagcagacccgccgccggcugccccgcccccugcagcugcgccggcacccugguggacugcggcagaagaggccugaccugggccagccugcccaccgccuuccccguggacaccaccgagcuggugcugaccggcaacaaccugaccgcccugccccccggccugcuggacgcccugcccgcccugagaaccgcccaccugggcgccaaccccuggagaugcgacugcagacuggugccccugagagccuggcuggccggcagacccgagagagcccccuacagagaccugagaugcguggccccccccgcccugagaggcagacugcugcccuaccuggccgaggacgagcugagagccgccugcgcccccggcccccugugcuggggcgcccuggccgcccagcuggcccugcugggccugggccugcugcacgcccugcugcuggugcugcugcugugcagacugagaagacugagagccagagccagagccagagccgccgccagacugagccugaccgacccccugguggccgagagagccggcaccgacgagagcuaa

SEQ ID NO: 17653 - RNA, 1614 nt, Artificial Sequence
  GP2__Homo_sapiens__NP_001007241
augccccaccugauggagagaauggugggcagcggccugcuguggcuggcccuggugagcugcauccugacccaggccagcgccgugcagagaggcuacggcaaccccaucgaggccagcagcuacggccuggaccuggacugcggcgcccccggcacccccgaggcccacgugugcuucgaccccugccagaacuacacccugcuggacgagcccuucagaagcaccgagaacagcgccggcagccagggcugcgacaagaacaugagcggcugguacagauucgugggcgagggcggcgugagaaugagcgagaccugcgugcaggugcacagaugccagaccgacgcccccauguggcugaacggcacccaccccgcccugggcgacggcaucaccaaccacaccgccugcgcccacuggagcggcaacugcugcuucuggaagaccgaggugcuggugaaggccugccccggcggcuaccacguguacagacuggagggcacccccuggugcaaccugagauacugcaccgugcccagagaccccagcaccguggaggacaagugcgagaaggccugcagacccgaggaggagugccuggcccugaacagcaccuggggcugcuucugcagacaggaccugaacagcagcgacgugcacagccugcagccccagcuggacugcggccccagagagaucaaggugaagguggacaagugccugcugggcggccugggccugggcgaggaggugaucgccuaccugagagaccccaacugcagcagcauccugcagaccgaggagagaaacugggugagcgugaccagccccgugcaggccagcgccugcagaaacauccuggagagaaaccagacccacgccaucuacaagaacacccugagccuggugaacgacuucaucaucagagacaccauccugaacaucaacuuccagugcgccuacccccuggacaugaaggugagccugcaggccgcccugcagcccaucgugagcagccugaacgugagcguggacggcaacggcgaguucaucgugagaauggcccuguuccaggaccagaacuacaccaaccccuacgagggcgacgccguggagcugagcguggagagcgugcuguacgugggcgccauccuggagcagggcgacaccagcagauucaaccuggugcugagaaacugcuacgccacccccaccgaggacaaggccgaccuggugaaguacuucaucaucagaaacagcugcagcaaccagagagacagcaccauccacguggaggagaacggccagagcagcgagagcagauucagcgugcagauguucauguucgccggccacuacgaccugguguuccugcacugcgagauccaccugugcgacagccugaacgagcagugccagcccagcugcagcagaagccaggugagaagcgaggugcccgccaucgaccuggccagagugcuggaccugggccccaucaccagaagaggcgcccagagccccggcgugaugaacggcacccccagcaccgccggcuuccugguggccuggcccauggugcugcugaccgugcugcuggccuggcuguucuaa

SEQ ID NO: 17654 - RNA, 1683 nt, Artificial Sequence
  GP5__Homo_sapiens__NP_004479
augcugagaggcacccugcugugcgccgugcugggccugcugagagcccagcccuuccccugcccccccgccugcaagugcguguucagagacgccgcccagugcagcggcggcgacguggccagaaucagcgcccugggccugcccaccaaccugacccacauccugcuguucggcaugggcagaggcgugcugcagagccagagcuucagcggcaugaccgugcugcagagacugaugaucagcgacagccacaucagcgccguggcccccggcaccuucagcgaccugaucaagcugaagacccugagacugagcagaaacaagaucacccaccugcccggcgcccugcuggacaagauggugcugcuggagcagcuguuccuggaccacaacgcccugagaggcaucgaccagaacauguuccagaagcuggugaaccugcaggagcuggcccugaaccagaaccagcuggacuuccugcccgccagccuguucaccaaccuggagaaccugaagcugcuggaccugagcggcaacaaccugacccaccugcccaagggccugcugggcgcccaggccaagcuggagagacugcugcugcacagcaacagacuggugagccuggacagcggccugcugaacagccugggcgcccugaccgagcugcaguuccacagaaaccacaucagaagcaucgcccccggcgccuucgacagacugcccaaccugagcagccugacccugagcagaaaccaccuggccuuccugcccagcgcccuguuccugcacagccacaaccugacccugcugacccuguucgagaacccccuggccgagcugcccggcgugcuguucggcgagaugggcggccugcaggagcuguggcugaacagaacccagcugagaacccugcccgccgccgccuucagaaaccugagcagacugagauaccugggcgugacccugagccccagacugagcgcccugccccagggcgccuuccagggccugggcgagcugcaggugcuggcccugcacagcaacggccugaccgcccugcccgacggccugcugagaggccugggcaagcugagacaggugagccugagaagaaacagacugagagcccugcccagagcccuguucagaaaccugagcagccuggagagcgugcagcuggaccacaaccagcuggagacccugcccggcgacguguucggcgcccugcccagacugaccgaggugcugcugggccacaacagcuggagaugcgacugcggccugggccccuuccugggcuggcugagacagcaccugggccuggugggcggcgaggagccccccagaugcgccggccccggcgcccacgccggccugccccugugggcccugcccggcggcgacgccgagugccccggccccagaggccccccccccagacccgccgccgacagcagcagcgaggcccccgugcaccccgcccuggcccccaacagcagcgagcccugggugugggcccagcccgugaccaccggcaagggccaggaccacagccccuucuggggcuucuacuuccugcugcuggccgugcaggccaugaucaccgugaucaucguguucgccaugaucaagaucggccagcuguucagaaagcugaucagagagagagcccugggcuaa

SEQ ID NO: 17655 - RNA, 1863 nt, Artificial Sequence
  GP6__Homo_sapiens__NP_001077368
augagccccagccccaccgcccuguucugccugggccugugccugggcagagugcccgcccagagcggcccccugcccaagcccagccugcaggcccugcccagcagccuggugccccuggagaagcccgugacccugagaugccagggcccccccggcguggaccuguacagacuggagaagcugagcagcagcagauaccaggaccaggccgugcuguucauccccgccaugaagagaagccuggccggcagauacagaugcagcuaccagaacggcagccuguggagccugcccagcgaccagcuggagcugguggccaccggcguguucgccaagcccagccugagcgcccagcccggccccgccgugagcagcggcggcgacgugacccugcagugccagaccagauacggcuucgaccaguucgcccuguacaaggagggcgaccccgcccccuacaagaaccccgagagaugguacagagccagcuuccccaucaucaccgugaccgccgcccacagcggcaccuacagaugcuacagcuucagcagcagagaccccuaccuguggagcgcccccagcgacccccuggagcugguggugaccggcaccagcgugacccccagcagacugcccaccgagccccccagccccguggccgaguucagcgaggccaccgccgagcugaccgugagcuucaccaacgagguguucaccaccgagaccagcagaagcaucaccgccagccccaaggagagcgacagccccgccggcgagagcugcccccccgugcugcaccagggccagcccggccccgacaugcccagaggcugcgaccccaacaaccccggcggcgugagcggcagaggccuggcccagcccgaggaggcccccgccgcccagggccagggcugcgccgaggccgccagcgccccccccgccccccccgccgaccccgagaucaagagaggcagcggcuggagacccaccggcugcagccagcccagagugauguucaugaccgccgagccccaggccagaagcuaccccagagagggcagcuggcacggcagaagacugaaggacuggagaguguggagcguggaggccggcggccagagacugcagcuguggaagagaggccacgccgccagcagcuggugcagcaucagagagcccuucggccagugccugagcgugugccugccccugugccugagagcccccagcaucugggacggcagaaaccuguggagaccccaccccccccccugcacccuguggaugaccugguaccccggcuggaccaccuacuggccccugagcagcaccagccugaucugggcccccgacggcagccugagauuccccgcccugagaguggacagcgugcccagcagcgugcagaacccccccgugcugcccuucggcccccugugcagcugccugguguuccccagaaacagccacccccacagcaucagccacugcggccugaccaaccugcugagcagccugagaaccggccuggccggcagccugggcaugagcuucaucuuccugagcgugaagcuggccagaugcccccugcccuucacccuggagaacaagaucagccugugcaacauggugaagccccaccuguaccagcagaacaagaagacccagaagcuggccagaugcggcggcgccagccuguacagccagcagcugagaggccugagaugggagaacggccugagccugggcggcagaggcugcagcgagcugagaagccaccacugcacccuggccagagugaccaagcccgacuucgugagcaagaacaccggcaugaacaugagcaucacccugaucuaa

SEQ ID NO: 17656 - RNA, 534 nt, Artificial Sequence
  GP9__Homo_sapiens__NP_000165
augcccgccuggggcgcccuguuccugcugugggccaccgccgaggccaccaaggacugccccagccccugcaccugcagagcccuggagaccaugggccuguggguggacugcagaggccacggccugaccgcccugcccgcccugcccgccagaaccagacaccugcugcuggccaacaacagccugcagagcgugccccccggcgccuucgaccaccugccccagcugcagacccuggacgugacccagaaccccuggcacugcgacugcagccugaccuaccugagacuguggcuggaggacagaacccccgaggcccugcugcaggugagaugcgccagccccagccuggccgcccacggcccccugggcagacugaccggcuaccagcugggcagcugcggcuggcagcugcaggccagcugggugagacccggcgugcugugggacguggcccugguggccguggccgcccugggccuggcccugcuggccggccugcugugcgccaccaccgaggcccuggacuaa

SEQ ID NO: 17657 - RNA, 960 nt, Artificial Sequence
  GPA33__Homo_sapiens__NP_005805
auggugggcaagauguggcccgugcuguggacccugugcgccgugagagugaccguggacgccaucagcguggagaccccccaggacgugcugagagccagccagggcaagagcgugacccugcccugcaccuaccacaccagcaccagcagcagagagggccugauccagugggacaagcugcugcugacccacaccgagagaguggugaucuggcccuucagcaacaagaacuacauccacggcgagcuguacaagaacagagugagcaucagcaacaacgccgagcagagcgacgccagcaucaccaucgaccagcugaccauggccgacaacggcaccuacgagugcagcgugagccugaugagcgaccuggagggcaacaccaagagcagagugagacugcuggugcuggugccccccagcaagcccgagugcggcaucgagggcgagaccaucaucggcaacaacauccagcugaccugccagagcaaggagggcagccccaccccccaguacagcuggaagagauacaacauccugaaccaggagcagccccuggcccagcccgccagcggccagcccgugagccugaagaacaucagcaccgacaccagcggcuacuacaucugcaccagcagcaacgaggagggcacccaguucugcaacaucaccguggccgugagaagccccagcaugaacguggcccuguacgugggcaucgccgugggcgugguggccgcccugaucaucaucggcaucaucaucuacugcugcugcugcagaggcaaggacgacaacaccgaggacaaggaggacgccagacccaacagagaggccuacgaggagccccccgagcagcugagagagcugagcagagagagagaggaggaggacgacuacagacaggaggagcagagaagcaccggcagagagagccccgaccaccuggaccaguaa

SEQ ID NO: 17658 - RNA, 1866 nt, Artificial Sequence
  GPAA1__Homo_sapiens__NP_003792
augggccugcugagcgaccccgugagaagaagagcccuggccagacuggugcugagacugaacgccccccugugcgugcugagcuacguggccggcaucgccugguuccuggcccugguguuccccccccugacccagagaaccuacaugagcgagaacgccaugggcagcaccaugguggaggagcaguucgccggcggcgacagagccagagccuucgccagagacuucgccgcccacagaaagaagagcggcgcccugcccguggccuggcuggagagaaccaugagaagcgugggccuggagguguacacccagagcuucagcagaaagcugcccuuccccgacgagacccacgagagauacauggugagcggcaccaacguguacggcauccugagagcccccagagccgccagcaccgagagccuggugcugaccgugcccugcggcagcgacagcaccaacagccaggccgugggccugcugcuggcccuggccgcccacuucagaggccagaucuacugggccaaggacaucguguuccuggugaccgagcacgaccugcugggcaccgaggccuggcuggaggccuaccacgacgugaacgugaccggcaugcagagcagcccccugcagggcagagccggcgccauccaggccgccguggcccuggagcugagcagcgacguggugaccagccuggacguggccguggagggccugaacggccagcugcccaaccuggaccugcugaaccuguuccagaccuucugccagaagggcggccugcugugcacccugcagggcaagcugcagcccgaggacuggaccagccuggacggcccccugcagggccugcagacccugcugcugauggugcugagacaggccagcggcagaccccacggcagccacggccuguuccugagauacagaguggaggcccugacccugagaggcaucaacagcuucagacaguacaaguacgaccugguggccgugggcaaggcccuggagggcauguucagaaagcugaaccaccugcuggagagacugcaccagagcuucuuccuguaccugcugcccggccugagcagauucgugagcaucggccuguacaugcccgccgugggcuuccugcugcuggugcugggccugaaggcccuggagcuguggaugcagcugcacgaggccggcaugggccuggaggagcccggcggcgcccccggccccagcgugccccugccccccagccagggcgugggccuggccagccugguggccccccugcugaucagccaggccaugggccuggcccuguacgugcugcccgugcugggccagcacguggccacccagcacuuccccguggccgaggccgaggccguggugcugacccugcuggccaucuacgccgccggccuggcccugccccacaacacccacagaguggugagcacccaggcccccgacagaggcuggauggcccugaagcugguggcccugaucuaccuggcccugcagcugggcugcaucgcccugaccaacuucagccugggcuuccugcuggccaccaccauggugcccaccgccgcccuggccaagccccacggccccagaacccuguacgccgcccugcuggugcugaccagccccgccgccacccugcugggcagccuguuccuguggagagagcugcaggaggccccccugagccuggccgagggcuggcagcuguuccuggccgcccuggcccagggcgugcuggagcaccacaccuacggcgcccugcuguucccccugcugagccugggccuguaccccugcuggcugcuguucuggaacgugcuguucuggaaguaa

SEQ ID NO: 17659 - RNA, 1023 nt, Artificial Sequence
  GPALPP1__Homo_sapiens__NP_061029
auggccagagaccugaucggccccgcccugccccccggcuucaaggccagaggcaccgccgaggacgaggagagagaccccagccccguggccggccccgcccugccccccaacuacaagagcagcagcagcgacagcagcgacagcgacgaggacagcagcagccuguacgaggagggcaaccaggagagcgaggaggacgacagcggccccaccgccagaaagcagagaaagaaccaggacgacgacgacgacgacgacgacggcuucuucggccccgcccugccccccggcuucaagaagcaggacgacagcccccccagacccaucaucggccccgcccugccccccggcuucaucaagagcacccagaagagcgacaagggcagagacgaccccggccagcaggagaccgacagcagcgaggacgaggacaucaucggccccaugcccgccaagggccccgugaacuacaacgugaccaccgaguucgagaagagagcccagagaaugaaggagaagcugaccaagggcgacgacgacagcagcaagcccaucgugagagagagcuggaugaccgagcugccccccgagaugaaggacuucggccugggccccagaaccuucaagagaagagccgacgacaccagcggcgacagaagcaucuggaccgacacccccgccgacagagagagaaaggccaaggagacccaggaggccagaaagagcagcagcaagaaggacgaggagcacauccugagcggcagagacaagagacuggccgagcaggugagcagcuacaacgagagcaagagaagcgagagccugauggacauccaccacaagaagcugaagagcaaggccgccgaggacaagaacaagccccaggagagaauccccuucgacagagacaaggaccugaaggugaacagauucgacgaggcccagaagaaggcccugaucaagaagagcagagagcugaacaccagauucagccacggcaagggcaacauguuccuguaa

SEQ ID NO: 17660 - RNA, 2487 nt, Artificial Sequence
  GPAM__Homo_sapiens__XP_005270055
auggacgagagcgcccugacccugggcaccaucgacgugagcuaccugccccacagcagcgaguacagcgugggcagaugcaagcacaccagcgaggaguggggcgagugcggcuucagacccaccaucuucagaagcgccacccugaaguggaaggagagccugaugagcagaaagagacccuucgugggcagaugcugcuacagcugcaccccccagagcugggacaaguucuucaaccccagcauccccagccugggccugagaaacgugaucuacaucaacgagacccacaccagacacagaggcuggcuggccagaagacugagcuacgugcuguucauccaggagagagacgugcacaagggcauguucgccaccaacgugaccgagaacgugcugaacagcagcagagugcaggaggccaucgccgagguggccgccgagcugaaccccgacggcagcgcccagcagcagagcaaggccgugaacaaggugaagaagaaggccaagagaauccugcaggagaugguggccaccgugagccccgccaugaucagacugaccggcugggugcugcugaagcuguucaacagcuucuucuggaacauccagauccacaagggccagcuggagauggugaaggccgccaccgagaccaaccugccccugcuguuccugcccgugcacagaagccacaucgacuaccugcugcugaccuucauccuguucugccacaacaucaaggcccccuacaucgccagcggcaacaaccugaacauccccaucuucagcacccugauccacaagcugggcggcuucuucaucagaagaagacuggacgagacccccgacggcagaaaggacgugcuguacagagcccugcugcacggccacaucguggagcugcugagacagcagcaguuccuggagaucuuccuggagggcaccagaagcagaagcggcaagaccagcugcgccagagccggccugcugagcguggugguggacacccugagcaccaacgugauccccgacauccugaucauccccgugggcaucagcuacgacagaaucaucgagggccacuacaacggcgagcagcugggcaagcccaagaagaacgagagccuguggagcguggccagaggcgugaucagaaugcugagaaagaacuacggcugcgugagaguggacuucgcccagcccuucagccugaaggaguaccuggagagccagagccagaagcccgugagcgcccugcugagccuggagcaggcccugcugcccgccauccugcccagcagacccagcgacgccgccgacgagggcagagacaccagcaucaacgagagcagaaacgccaccgacgagagccugagaagaagacugaucgccaaccuggccgagcacauccuguucaccgccagcaagagcugcgccaucaugagcacccacaucguggccugccugcugcuguacagacacagacagggcaucgaccugagcacccugguggaggacuucuucgugaugaaggaggaggugcuggccagagacuucgaccugggcuucagcggcaacagcgaggacguggugaugcacgccauccagcugcugggcaacugcgugaccaucacccacaccagcagaaacgacgaguucuucaucacccccagcaccaccgugcccagcguguucgagcugaacuucuacagcaacggcgugcugcacguguucaucauggaggccaucaucgccugcagccuguacgccgugcugaacaagagaggccugggcggccccaccagcaccccccccaaccugaucagccaggagcagcuggugagaaaggccgccagccugugcuaccugcugagcaacgagggcaccaucagccugcccugccagaccuucuaccaggugugccacgagaccgugggcaaguucauccaguacggcauccugaccguggccgagcacgacgaccaggaggacaucagccccagccuggccgagcagcagugggacaagaagcugcccgagccccugagcuggagaagcgacgaggaggacgaggacagcgacuucggcgaggagcagagagacugcuaccugaaggugagccagagcaaggagcaccagcaguucaucaccuuccugcagagacugcugggcccccugcuggaggccuacagcagcgccgccaucuucgugcacaacuucagcggccccgugcccgagcccgaguaccugcagaagcugcacaaguaccugaucaccagaaccgagagaaacguggccguguacgccgagagcgccaccuacugccuggugaagaacgccgugaagauguucaaggacaucggcguguucaaggagaccaagcagaagagagugagcgugcuggagcugagcagcaccuuccugccccagugcaacagacagaagcugcuggaguacauccugagcuucguggugcuguaa

SEQ ID NO: 17661 - RNA, 1071 nt, Artificial Sequence
  GPANK1__Homo_sapiens__NP_149417
augagcagaccccugcugaucaccuucacccccgccaccgaccccagcgaccuguggaaggacggccagcagcagccccagcccgagaagcccgagagcacccuggacggcgccgccgccagagccuucuacgaggcccugaucggcgacgagagcagcgcccccgacagccagagaagccagaccgagcccgccagagagagaaagagaaagaagagaagaaucaugaaggcccccgccgccgaggccguggccgagggcgccagcggcagacacggccagggcagaagccuggaggccgaggacaagaugacccacagaauccugagagccgcccaggagggcgaccugcccgagcugagaagacugcuggagccccacgaggccggcggcgccggcggcaacaucaacgccagagacgccuucugguggaccccccugaugugcgccgccagagccggccagggcgccgccgugagcuaccugcugggcagaggcgccgccugggugggcgugugcgagcugagcggcagagacgccgcccagcuggccgaggaggccggcuuccccgagguggccagaauggugagagagagccacggcgagaccagaagccccgagaacagaagccccacccccagccugcaguacugcgagaacugcgacacccacuuccaggacagcaaccacagaaccagcaccgcccaccugcugagccugagccagggcccccagccccccaaccugccccugggcgugcccaucagcagccccggcuucaagcugcugcugagaggcggcugggagcccggcaugggccugggccccagaggcgagggcagagccaaccccauccccaccgugcugaagagagaccaggagggccugggcuacagaagcgccccccagcccagagugacccacuuccccgccugggacaccagagccguggccggcagagagagaccccccagaguggccacccugagcuggagagaggagagaagaagagaggagaaggacagagccugggagagagaccugagaaccuacaugaaccuggaguucuaa

SEQ ID NO: 17662 - RNA, 2388 nt, Artificial Sequence
  GPAT2__Homo_sapiens__NP_997211
auggccaccaugcuggagggcagaugccagacccagcccagaagcagccccagcggcagagaggccagccuguggagcagcggcuucggcaugaagcuggaggccgugacccccuuccugggcaaguacagacccuucgugggcagaugcugccagaccugcacccccaagagcugggagagccuguuccacagaagcaucaccgaccugggcuucugcaacgugauccuggugaaggaggagaacaccagauucagaggcuggcuggugagaagacugugcuacuuccuguggagccuggagcagcacaucccccccugccaggacgugccccagaagaucauggagagcaccggcgugcagaaccugcugagcggcagagugcccggcggcaccggcgagggccaggugcccgaccuggugaagaaggaggugcagagaauccugggccacauccaggccccccccagacccuuccuggugagacuguucagcugggcccugcugagauuccugaacugccuguuccugaacgugcagcugcacaagggccagaugaagauggugcagaaggccgcccaggccggccugccccuggugcugcugagcacccacaagacccugcuggacggcauccugcugcccuucaugcugcugagccagggccugggcgugcugagaguggccugggacagcagagccugcagccccgcccugagagcccugcugagaaagcugggcggccuguuccugccccccgaggccagccugagccuggacagcagcgagggccugcuggccagagccguggugcaggccgugaucgagcagcugcuggugagcggccagccccugcugaucuuccuggaggagccccccggcgcccugggccccagacugagcgcccugggccaggccugggugggcuucguggugcaggccgugcaggugggcaucgugcccgacgcccugcuggugcccguggccgugaccuacgaccuggugcccgacgcccccugcgacaucgaccacgccagcgccccccugggccuguggaccggcgcccuggccgugcugagaagccuguggagcagauggggcugcagccacagaaucugcagcagagugcaccuggcccagcccuucagccugcaggaguacaucgugagcgccagaagcugcuggggcggcagacagacccuggagcagcugcugcagcccaucgugcugggccagugcaccgccgugcccgacaccgagaaggagcaggaguggacccccaucaccggcccccugcuggcccugaaggaggaggaccagcugcuggugagaagacugagcugccacgugcugagcgccagcgugggcagcagcgccgugaugagcaccgccaucauggccacccugcugcuguucaagcaccagaagcugcugggcgaguucagcuggcugaccgaggagauccugcugagaggcuucgacgugggcuucagcggccagcugagaagccugcugcagcacagccugagccugcugagagcccacguggcccugcugagaaucagacagggcgaccugcugguggugccccagcccggccccggccugacccaccuggcccagcugagcgccgagcugcugcccguguuccugagcgaggccgugggcgccugcgccgugagaggccugcuggccggcagagugcccccccagggccccugggagcugcagggcauccugcugcugagccagaacgagcuguacagacagauccugcugcugaugcaccugcugccccaggaccugcugcugcugaagcccugccagagcagcuacugcuacugccaggaggugcuggacagacugauccagugcggccugcugguggccgaggagacccccggcagcagacccgccugcgacaccggcagacagagacugagcagaaagcugcuguggaagcccagcggcgacuucaccgacagcgacagcgacgacuucggcgaggccgacggcagauacuucagacugagccagcagagccacugccccgacuucuuccuguuccugugcagacugcugagcccccugcugaaggccuucgcccaggccgccgccuuccugagacagggccagcugcccgacaccgagcugggcuacaccgagcagcuguuccaguuccugcaggccaccgcccaggaggagggcaucuucgagugcgccgaccccaagcuggccaucagcgccguguggaccuucagagaccugggcgugcugcagcagacccccagccccgccggccccagacugcaccugagccccaccuucgccagccuggacaaccaggagaagcuggagcaguucaucagacaguucaucugcagcuaa

SEQ ID NO: 17663 - RNA, 2796 nt, Artificial Sequence
  GPATCH1__Homo_sapiens__NP_060495
auggccgccagagacagcgacagcgaggaggaccuggugagcuacggcaccggccuggagccccuggaggagggcgagagacccaagaagcccaucccccugcaggaccagaccgugagagacgagaagggcagauacaagagauuccacggcgccuucagcggcggcuucagcgccggcuacuucaacaccgugggcagcaaggagggcuggacccccagcaccuucgugagcagcagacagaacagagccgacaagagcgugcugggccccgaggacuucauggacgaggaggaccugagcgaguucggcaucgcccccaaggccaucgugaccaccgacgacuucgccagcaagaccaaggacagaaucagagagaaggccagacagcuggccgccgccaccgcccccauccccggcgccacccugcuggacgaccugaucacccccgccaagcugagcgugggcuucgagcugcugagaaagaugggcuggaaggagggccagggcgugggccccagagugaagagaagacccagaagacagaagcccgaccccggcgugaagaucuacggcugcgcccugccccccggcagcagcgagggcagcgagggcgaggacgacgacuaccugcccgacaacgugaccuucgcccccaaggacgugacccccguggacuucacccccaaggacaacgugcacggccuggccuacaagggccuggacccccaccaggcccuguucggcaccagcggcgagcacuucaaccuguucagcggcggcagcgagagagccggcgaccugggcgagaucggccugaacaagggcagaaagcugggcaucagcggccaggccuucggcgugggcgcccuggaggaggaggacgacgacaucuacgccaccgagacccugagcaaguacgacaccgugcugaaggacgaggagcccggcgacggccuguacggcuggaccgcccccagacaguacaagaaccagaaggagagcgagaaggaccugagauacgugggcaagauccuggacggcuucagccuggccagcaagccccugagcagcaagaagaucuaccccccccccgagcugcccagagacuacagacccgugcacuacuucagacccaugguggccgccaccagcgagaacagccaccugcugcaggugcugagcgagagcgccggcaaggccacccccgaccccggcacccacagcaagcaccagcugaacgccagcaagagagccgagcugcugggcgagacccccauccagggcagcgccaccagcgugcuggaguuccugagccagaaggacaaggagagaaucaaggagaugaagcaggccaccgaccugaaggccgcccagcugaaggccagaagccuggcccagaacgcccagagcagcagagcccagcugagccccgccgccgccgccggccacugcagcuggaacauggcccugggcggcggcaccgccacccugaaggccagcaacuucaagcccuucgccaaggaccccgagaagcagaagagauacgacgaguuccuggugcacaugaagcagggccagaaggacgcccuggagagaugccuggaccccagcaugaccgagugggagagaggcagagagagagacgaguucgccagagccgcccugcuguacgccagcagccacagcacccugagcagcagauucacccacgccaaggaggaggacgacagcgaccagguggaggugcccagagaccaggagaacgacgugggcgacaagcagagcgccgugaagaugaagauguucggcaagcugaccagagacaccuucgaguggcaccccgacaagcugcugugcaagagauucaacgugcccgaccccuaccccgacagcacccuggugggccugcccagagugaagagagacaaguacagcguguucaacuuccugacccugcccgagaccgccagccugcccaccacccaggccagcagcgagaaggugagccagcacagaggccccgacaagagcagaaagcccagcagaugggacaccagcaagcacgagaagaaggaggacagcaucagcgaguuccugagccuggccagaagcaaggccgagccccccaagcagcagagcagcccccuggugaacaaggaggaggagcacgcccccgagcugagcgccaaccagaccgugaacaaggacguggacgcccaggccgagggcgagggcagcagacccagcauggaccuguucagagccaucuucgccagcagcagcgacgagaagagcagcagcagcgaggacgagcagggcgacagcgaggacgaccaggccggcagcggcgaggccaacuuccagagcagccaggacaccgaccugggcgagaccagcagcguggcccacgcccuggugcccgccccccaggagcccccccccagcuuccccauccagaagaugcagaucgacgagagagaggaguucggccccagacugccccccguguucugccccaacgccagacagacccuggaggugccccagaaggagaagcacaagaagaacaaggacaagcacaaggccaagaaggagcacagaagaaagaaggagaagaagaagaagcacagaaagcacaagcacaagggcaagcagaagaacaagaagcccgagaagagcagcagcagcgagagcagcgacagcagcgacagccagagcgacgaggagaccgccgacgugagcccccaggagcugcugagaagacugaagagccugccccugagaagacaguaa

SEQ ID NO: 17664 - RNA, 1131 nt, Artificial Sequence
  GPATCH2__Homo_sapiens__NP_001284683
auguucggcgccgccggcagacagcccaucggcgcccccgccgccggcaacagcuggcacuucagcagaaccauggaggagcuggugcacgaccuggugagcgcccuggaggagagcagcgagcaggccagaggcggcuucgccgagaccggcgaccacagcagaagcaucagcugcccccugaagagacaggccagaaagagaagaggcagaaagagaagaagcuacaacgugcaccaccccugggagaccggccacugccugagcgagggcagcgacagcagccuggaggagcccagcaaggacuacagagagaaccacaacaacaacaagaaggaccacagcgacagcgacgaccagaugcugguggccaagagaagacccagcagcaaccugaacaacaacgugagaggcaagagaccccuguggcacgagagcgacuucgccguggacaacgugggcaacagaacccugagaagaagaagaaaggugaagagaauggccguggaccugccccaggacaucagcaacaagagaaccaugacccagccccccgagggcugcagagaccaggacauggacagcgacagagccuaccaguaccaggaguucaccaagaacaaggugaagaagagaaagcugaagaucaucagacagggccccaagauccaggacgagggcguggugcuggagagcgaggagaccaaccagaccaacaaggacaagauggagugcgaggagcagaaggugagcgacgagcugaugagcgagagcgacagcagcagccugagcagcaccgacgccggccuguucaccaacgacgagggcagacagggcgacgacgagcagagcgacugguucuacgagaaggagagcggcggcgccugcggcaucaccggcguggugcccuggugggagaaggaggaccccaccgagcuggacaagaacgugcccgaccccguguucgagagcauccugaccggcagcuucccccugaugagccaccccagcagaagaggcuuccaggccagacugagcagacugcacggcaugagcagcaagaacaucaagaagagcggcggcacccccaccagcauggccaccaacuggaccagcgagaucccccuguaa

SEQ ID NO: 17665 - RNA, 1449 nt, Artificial Sequence
  GPATCH2L__Homo_sapiens__NP_060396
auggacgagcuggugcacgaccuggccagcgcccuggagcagaccagcgagcagaacaagcugggcgagcugugggaggagauggcccugagccccagacagcagagaagacagcugagaaagagaagaggcagaaagagaagaagcgacuucacccaccuggccgagcacaccugcugcuacagcgaggccagcgagagcagccuggacgaggccaccaaggacugcagagagguggcccccgugaccaacuucagcgacagcgacgacaccaugguggccaagagacaccccgcccugaacgccaucgugaagagcaagcagcacagcuggcacgagagcgacagcuucaccgagaacgcccccugcagaccccugagaagaagaagaaaggugaagagagugaccagcgagguggccgccagccugcagcagaagcugaaggugagcgacuggagcuacgagagaggcugcagauucaagagcgccaagaagcagagacugagcagauggaaggagaacacccccuggaccagcagcggccacggccugugcgagagcgccgagaacagaaccuuccugagcaagaccggcagaaaggagagaauggagugcgagaccgacgagcagaagcagggcagcgacgagaacaugagcgagugcgagaccagcagcgugugcagcagcagcgacaccggccuguucaccaacgacgagggcagacagggcgacgacgagcagagcgacugguucuacgagggcgagugcgugcccggcuucaccgugcccaaccugcugcccaagugggcccccgaccacugcagcgagguggagagaauggacagcggccuggacaaguucagcgacagcaccuuccugcugcccagcagacccgcccagagaggcuaccacaccagacugaacagacugcccggcgccgccgccagaugccugagaaagggcagaagaagacuggugggcaaggagaccagcaucaacacccugggcaccgagagaaucagccacaucaucagcgaccccagacagaaggagaagaacaaggcccuggccagcgacuucccccacaucagcgccugcgcccacgaguucaacccccugagcccccuguacagccuggacgugcuggccgacgccagccacagaagaugcagccccgcccacugcagcgccagacaggccaacgugcacuggggcccccccugcagcagagacaucaagagaaagagaaagcccguggccaccgccagccugagcagccccagcgccgugcacauggacgccguggagcccaccacccccgccagccaggcccccaagagccccagcagcgaguggcuggugagaaccagcgccgccgagaaggccaccgacgccaccaccgccaccuucuucaagaugccccaggagaagagccccggcuacagcuaa

SEQ ID NO: 17666 - RNA, 4509 nt, Artificial Sequence
  GPATCH8__Homo_sapiens__NP_001002909
auggccgacagauucagcagauucaacgaggacagagacuuccagggcaaccacuucgaccaguacgaggagggccaccuggagaucgagcaggccagccuggacaagcccaucgagagcgacaacaucggccacagacugcugcagaagcacggcuggaagcugggccagggccugggcaagagccugcagggcagaaccgaccccauccccaucguggugaaguacgacgugaugggcaugggcagaauggagauggagcuggacuacgccgaggacgccaccgagagaagaagagugcuggagguggagaaggaggacaccgaggagcugagacagaaguacaaggacuacguggacaaggagaaggccaucgccaaggcccuggaggaccugagagccaacuucuacugcgagcugugcgacaagcaguaccagaagcaccaggaguucgacaaccacaucaacagcuacgaccacgcccacaagcagagacugaaggaccugaagcagagagaguucgccagaaacgugagcagcagaagcagaaaggacgagaagaagcaggagaaggcccugagaagacugcacgagcuggccgagcagagaaagcaggccgagugcgcccccggcagcggccccauguucaagcccaccaccguggccguggacgaggagggcggcgaggacgacaaggacgagagcgccaccaacagcggcaccggcgccaccgccagcugcggccugggcagcgaguucagcaccgacaagggcggccccuucaccgccgugcagaucaccaacaccaccggccuggcccaggcccccggccuggccagccagggcaucagcuucggcaucaagaacaaccugggcaccccccugcagaagcugggcgugagcuucagcuucgccaagaaggcccccgugaagcuggagagcaucgccagcguguucaaggaccacgccgaggagggcaccagcgaggacggcaccaagcccgacgagaagagcagcgaccagggccugcagaaggugggcgacagcgacggcagcagcaaccuggacggcaagaaggaggacgaggacccccaggacggcggcagccuggccagcacccugagcaagcugaagagaaugaagagagaggagggcgccggcgccaccgagcccgaguacuaccacuacaucccccccgcccacugcaaggugaagcccaacuuccccuuccugcuguucaugagagccagcgagcagauggacggcgacaacaccacccaccccaagaacgcccccgagagcaagaagggcagcagccccaagcccaagagcugcaucaaggccgccgccagccagggcgccgagaagaccgugagcgaggugagcgagcagcccaaggagaccagcaugaccgagcccagcgagcccggcagcaaggccgaggccaagaaggcccugggcggcgacgugagcgaccagagccuggagagccacagccagaaggugagcgagacccagaugugcgagagcaacagcagcaaggagaccagccuggccacccccgccggcaaggagagccaggagggccccaagcaccccaccggccccuucuuccccgugcugagcaaggacgagagcaccgcccugcaguggcccagcgagcugcugaucuucaccaaggccgagcccagcaucagcuacagcugcaacccccuguacuucgacuucaagcugagcagaaacaaggacgccagaaccaagggcaccgagaagcccaaggacaucggcagcagcagcaaggaccaccugcagggccuggaccccggcgagcccaacaagagcaaggaggugggcggcgagaagaucgugagaagcagcggcggcagaauggacgcccccgccagcggcagcgccugcagcggccugaacaagcaggagcccggcggcagccacggcagcgagaccgaggacaccggcagaagccugcccagcaagaaggagagaagcggcaagagccacagacacaagaagaagaagaagcacaagaagagcagcaagcacaagagaaagcacaaggccgacaccgaggagaagagcagcaaggccgagagcggcgagaagagcaagaagagaaagaagagaaagagaaagaagaacaagagcagcgcccccgccgacagcgagagaggccccaagcccgagccccccggcagcggcagccccgccccccccagaagaagaagaagagcccaggacgacagccagagaagaagccugcccgccgaggagggcagcagcggcaagaaggacgagggcggcggcggcagcagcagccaggaccacggcggcagaaagcacaagggcgagcugccccccagcagcugccagagaagagccggcaccaagagaagcagcagaagcagccacagaagccagcccagcagcggcgacgaggacagcgacgacgccagcagccacagacugcaccagaagagccccagccaguacagcgaggaggaggaggaggaggacagcggcagcgagcacagcagaagcagaagcagaagcggcagaagacacagcagccacagaagcagcagaagaagcuacagcagcagcagcgacgccagcagcgaccagagcugcuacagcagacagagaagcuacagcgacgacagcuacagcgacuacagcgacagaagcagaagacacagcaagagaagccacgacagcgacgacagcgacuacgccagcagcaagcacagaagcaagagacacaaguacagcagcagcgacgacgacuacagccugagcugcagccagagcagaagcagaagcagaagccacaccagagagagaagcagaagcagaggcagaagcagaagcagcagcugcagcagaagcagaagcaagagaagaagcagaagcaccaccgcccacagcuggcagagaagcagaagcuacagcagagacagaagcagaagcaccagaagccccagccagagaagcggcagcagaaagagaagcuggggccacgagagccccgaggagagacacagcggcagaagagacuucaucagaagcaagaucuacagaagccagagcccccacuacuucagaagcggcagaggcgagggccccggcaagaaggacgacggcagaggcgacgacagcaaggccaccggcccccccagccagaacagcaacaucggcaccggcagaggcagcgagggcgacugcagccccgaggacaagaacagcgugaccgccaagcugcugcuggagaagauccagagcagaaagguggagagaaagcccagcgugagcgaggaggugcaggccacccccaacaaggccggccccaagcugaaggaccccccccagggcuacuucggccccaagcugccccccagccugggcaacaagcccgugcugccccugaucggcaagcugcccgccaccagaaagcccaacaagaagugcgaggagagcggccuggagagaggcgaggagcaggagcagagcgagaccgaggagggcccccccggcagcagcgacgcccuguucggccaccaguuccccagcgaggagaccaccggcccccugcuggaccccccccccgaggagagcaagagcggcgaggccaccgccgaccaccccguggccccccugggcacccccgcccacagcgacugcuaccccggcgaccccaccaucagccacaacuaccugcccgaccccagcgacggcgacacccuggagagccuggacagcagcagccagcccggccccguggagagcagccugcugcccaucgcccccgaccuggagcacuuccccagcuacgccccccccagcggcgaccccagcaucgagagcaccgacggcgccgaggacgccagccuggccccccuggagagccagcccaucaccuucacccccgaggagauggagaaguacagcaagcugcagcaggccgcccagcagcacauccagcagcagcugcuggccaagcaggugaaggccuuccccgccagcgccgcccuggcccccgccacccccgcccugcagcccauccacauccagcagcccgccaccgccagcgccaccagcaucaccaccgugcagcacgccauccugcagcaccacgccgccgccgccgccgccgccaucggcauccacccccacccccacccccagccccuggcccaggugcaccacaucccccagccccaccugacccccaucagccugagccaccugacccacagcaucauccccggccaccccgccaccuuccuggccagccaccccauccacaucauccccgccagcgccauccaccccggccccuucaccuuccaccccgugccccacgccgcccuguaccccacccugcuggcccccagacccgccgccgccgccgccaccgcccugcaccugcacccccugcugcaccccaucuucagcggccaggaccugcagcacccccccagccacggcaccuaa

SEQ ID NO: 17667 - RNA, 993 nt, Artificial Sequence
  GPBAR1__Homo_sapiens__XP_011509046
augacccccaacagcaccggcgaggugcccagccccauccccaagggcgcccugggccugagccuggcccuggccagccugaucaucaccgccaaccugcugcuggcccugggcaucgccugggacagaagacugagaagcccccccgccggcugcuucuuccugagccugcugcuggccggccugcugaccggccuggcccugcccacccugcccggccuguggaaccagagcagaagaggcuacuggagcugccugcugguguaccuggcccccaacuucagcuuccugagccugcuggccaaccugcugcuggugcacggcgagagauacauggccgugcugagaccccugcagccccccggcagcaucagacuggcccugcugcugaccugggccggcccccugcuguucgccagccugcccgcccugggcuggaaccacuggacccccggcgccaacugcagcagccaggccaucuuccccgcccccuaccuguaccuggagguguacggccugcugcugcccgccgugggcgccgccgccuuccugagcgugagagugcuggccaccgcccacagacagcugcaggacaucugcagacuggagagagccgugugcagagacgagcccagcgcccuggccagagcccugaccuggagacaggccagagcccaggccggcgccaugcugcuguucggccugugcuggggccccuacguggccacccugcugcugagcgugcuggccuacgagcagagacccccccugggccccggcacccugcugagccugcugagccugggcagcgccagcgccgccgccgugcccguggccaugggccugggcgaccagagauacaccgcccccuggagagccgccgcccagagaugccugcagggccuguggggcagagccagcagagacagccccggccccagcaucgccuaccaccccagcagccagagcagcguggaccuggaccugaacuaa

SEQ ID NO: 17668 - RNA, 1677 nt, Artificial Sequence
  GPC1__Homo_sapiens__NP_002072
auggagcugagagccagaggcugguggcugcugugcgccgccgccgcccugguggccugcgccagaggcgaccccgccagcaagagcagaagcugcggcgaggugagacagaucuacggcgccaagggcuucagccugagcgacgugccccaggccgagaucagcggcgagcaccugagaaucugcccccagggcuacaccugcugcaccagcgagauggaggagaaccuggccaacagaagccacgccgagcuggagaccgcccugagagacagcagcagagugcugcaggccaugcuggccacccagcugagaagcuucgacgaccacuuccagcaccugcugaacgacagcgagagaacccugcaggccaccuuccccggcgccuucggcgagcuguacacccagaacgccagagccuucagagaccuguacagcgagcugagacuguacuacagaggcgccaaccugcaccuggaggagacccuggccgaguucugggccagacugcuggagagacuguucaagcagcugcacccccagcugcugcugcccgacgacuaccuggacugccugggcaagcaggccgaggcccugagacccuucggcgaggcccccagagagcugagacugagagccaccagagccuucguggccgccagaagcuucgugcagggccugggcguggccagcgacguggugagaaagguggcccaggugccccugggccccgagugcagcagagccgugaugaagcugguguacugcgcccacugccugggcgugcccggcgccagacccugccccgacuacugcagaaacgugcugaagggcugccuggccaaccaggccgaccuggacgccgaguggagaaaccugcuggacagcauggugcugaucaccgacaaguucuggggcaccagcggcguggagagcgugaucggcagcgugcacaccuggcuggccgaggccaucaacgcccugcaggacaacagagacacccugaccgccaaggugauccagggcugcggcaaccccaaggugaacccccagggccccggccccgaggagaagagaagaagaggcaagcuggcccccagagagagaccccccagcggcacccuggagaagcuggugagcgaggccaaggcccagcugagagacgugcaggacuucuggaucagccugcccggcacccugugcagcgagaagauggcccugagcaccgccagcgacgacagaugcuggaacggcauggccagaggcagauaccugcccgaggugaugggcgacggccuggccaaccagaucaacaaccccgagguggagguggacaucaccaagcccgacaugaccaucagacagcagaucaugcagcugaagaucaugaccaacagacugagaagcgccuacaacggcaacgacguggacuuccaggacgccagcgacgacggcagcggcagcggcagcggcgacggcugccuggacgaccugugcagcagaaaggugagcagaaagagcagcagcagcagaaccccccugacccacgcccugcccggccugagcgagcaggagggccagaagaccagcgccgccagcugcccccagccccccaccuuccugcugccccugcugcuguuccuggcccugaccguggccagacccagauggagauaa

SEQ ID NO: 17669 - RNA, 1740 nt, Artificial Sequence
  GPC2__Homo_sapiens__NP_689955
augagcgcccugagaccccugcugcugcugcugcugccccugugccccggccccggccccggccccggcagcgaggccaaggugaccagaagcugcgccgagaccagacaggugcugggcgccagaggcuacagccugaaccugaucccccccgcccugaucagcggcgagcaccugagagugugcccccaggaguacaccugcugcagcagcgagaccgagcagagacugaucagagagaccgaggccaccuucagaggccugguggaggacagcggcagcuuccuggugcacacccuggccgccagacacagaaaguucgacgaguucuuccuggagaugcugagcguggcccagcacagccugacccagcuguucagccacagcuacggcagacuguacgcccagcacgcccugaucuucaacggccuguucagcagacugagagacuucuacggcgagagcggcgagggccuggacgacacccuggccgacuucugggcccagcugcuggagagaguguucccccugcugcacccccaguacagcuucccccccgacuaccugcugugccugagcagacuggccagcagcaccgacggcagccugcagcccuucggcgacagccccagaagacugagacugcagaucaccagaacccugguggccgccagagccuucgugcagggccuggagaccggcagaaacguggugagcgaggcccugaaggugcccgugagcgagggcugcagccaggcccugaugagacugaucggcugcccccugugcagaggcgugcccagccugaugcccugccagggcuucugccugaacguggugagaggcugccugagcagcagaggccuggagcccgacuggggcaacuaccuggacggccugcugauccuggccgacaagcugcagggccccuucagcuucgagcugaccgccgagagcaucggcgugaagaucagcgagggccugauguaccugcaggagaacagcgccaaggugagcgcccagguguuccaggagugcggcccccccgaccccgugcccgccagaaacagaagagcccccccccccagagaggaggccggcagacuguggagcauggugaccgaggaggagagacccaccaccgccgccggcaccaaccugcacagacuggugugggagcugagagagagacuggccagaaugagaggcuucugggccagacugagccugaccgugugcggcgacagcagaauggccgccgacgccagccuggaggccgcccccugcuggaccggcgccggcagaggcagauaccugccccccguggugggcggcagccccgccgagcaggugaacaaccccgagcugaagguggacgccagcggccccgacgugcccaccagaagaagaagacugcagcugagagccgccaccgccagaaugaagaccgccgcccugggccacgaccuggacggccaggacgccgacgaggacgccagcggcagcggcggcggccagcaguacgccgacgacuggauggccggcgccguggccccccccgccagaccccccagaccccccuacccccccagaagagacggcagcggcggcaagggcggcggcggcagcgccagauacaaccagggcagaagcagaagcggcggcgccagcaucggcuuccacacccagaccauccugauccugagccugagcgcccuggcccugcugggccccagauaa

SEQ ID NO: 17670 - RNA, 1812 nt, Artificial Sequence
  GPC3__Homo_sapiens__NP_001158089
auggccggcaccgugagaaccgccugccuggugguggccaugcugcugagccuggacuuccccggccaggcccagccccccccccccccccccgacgccaccugccaccaggugagaagcuucuuccagagacugcagcccggccugaagugggugcccgagacccccgugcccggcagcgaccugcaggugugccugcccaagggccccaccugcugcagcagaaagauggaggagaaguaccagcugaccgccagacugaacauggagcagcugcugcagagcgccagcauggagcugaaguuccugaucauccagaacgccgccguguuccaggaggccuucgagaucguggugagacacgccaagaacuacaccaacgccauguucaagaacaacuaccccagccugaccccccaggccuucgaguucgugggcgaguucuucaccgacgugagccuguacauccugggcagcgacaucaacguggacgacauggugaacgagcuguucgacagccuguuccccgugaucuacacccagcugaugaaccccggccugcccgacagcgcccuggacaucaacgagugccugagaggcgccagaagagaccugaagguguucggcaacuuccccaagcugaucaugacccaggugagcaagagccugcaggugaccagaaucuuccugcaggcccugaaccugggcaucgaggugaucaacaccaccgaccaccugaaguucagcaaggacugcggcagaaugcugaccagaaugugguacugcagcuacugccagggccugaugauggugaagcccugcggcggcuacugcaacguggugaugcagggcugcauggccggcgugguggagaucgacaaguacuggagagaguacauccugagccuggaggagcuggugaacggcauguacagaaucuacgacauggagaacgugcugcugggccuguucagcaccauccacgacagcauccaguacgugcagaagaacgccggcaagcugaccaccaccgagaccgagaagaagaucuggcacuucaaguaccccaucuucuuccugugcaucggccuggaccugcagaucggcaagcugugcgcccacagccagcagagacaguacagaagcgccuacuaccccgaggaccuguucaucgacaagaaggugcugaagguggcccacguggagcacgaggagacccugagcagcagaagaagagagcugauccagaagcugaagagcuucaucagcuucuacagcgcccugcccggcuacaucugcagccacagccccguggccgagaacgacacccugugcuggaacggccaggagcugguggagagauacagccagaaggccgccagaaacggcaugaagaaccaguucaaccugcacgagcugaagaugaagggccccgagcccguggugagccagaucaucgacaagcugaagcacaucaaccagcugcugagaaccaugagcaugcccaagggcagagugcuggacaagaaccuggacgaggagggcuucgagagcggcgacugcggcgacgacgaggacgagugcaucggcggcagcggcgacggcaugaucaaggugaagaaccagcugagauuccuggccgagcuggccuacgaccuggacguggacgacgcccccggcaacagccagcaggccacccccaaggacaacgagaucagcaccuuccacaaccugggcaacgugcacagcccccugaagcugcugaccagcauggccaucagcguggugugcuucuucuuccuggugcacuaa

SEQ ID NO: 17671 - RNA, 1671 nt, Artificial Sequence
  GPC4__Homo_sapiens__NP_001439
auggccagauucggccugcccgcccugcugugcacccuggccgugcugagcgccgcccugcuggccgccgagcugaagagcaagagcugcagcgaggugagaagacuguacgugagcaagggcuucaacaagaacgacgccccccugcacgagaucaacggcgaccaccugaagaucugcccccagggcagcaccugcugcagccaggagauggaggagaaguacagccugcagagcaaggacgacuucaagagcguggugagcgagcagugcaaccaccugcaggccguguucgccagcagauacaagaaguucgacgaguucuucaaggagcugcuggagaacgccgagaagagccugaacgacauguucgugaagaccuacggccaccuguacaugcagaacagcgagcuguucaaggaccuguucguggagcugaagagauacuacguggugggcaacgugaaccuggaggagaugcugaacgacuucugggccagacugcuggagagaauguucagacuggugaacagccaguaccacuucaccgacgaguaccuggagugcgugagcaaguacaccgagcagcugaagcccuucggcgacgugcccagaaagcugaagcugcaggugaccagagccuucguggccgccagaaccuucgcccagggccuggccguggccggcgacguggugagcaaggugagcguggugaaccccaccgcccagugcacccacgcccugcugaagaugaucuacugcagccacugcagaggccuggugaccgugaagcccugcuacaacuacugcagcaacaucaugagaggcugccuggccaaccagggcgaccuggacuucgaguggaacaacuucaucgacgccaugcugaugguggccgagagacuggagggccccuucaacaucgagagcgugauggaccccaucgacgugaagaucagcgacgccaucaugaacaugcaggacaacagcgugcaggugagccagaagguguuccagggcugcggcccccccaagccccugcccgccggcagaaucagcagaagcaucagcgagagcgccuucagcgccagauucagaccccaccaccccgaggagagacccaccaccgccgccggcaccagccuggacagacuggugaccgacgugaaggagaagcugaagcaggccaagaaguucuggagcagccugcccagcaacgugugcaacgacgagagaauggccgccggcaacggcaacgaggacgacugcuggaacggcaagggcaagagcagauaccuguucgccgugaccggcaacggccuggccaaccagggcaacaaccccgaggugcagguggacaccagcaagcccgacauccugauccugagacagaucauggcccugagagugaugaccagcaagaugaagaacgccuacaacggcaacgacguggacuucuucgacaucagcgacgagagcagcggcgagggcagcggcagcggcugcgaguaccagcagugccccagcgaguucgacuacaacgccaccgaccacgccggcaagagcgccaacgagaaggccgacagcgccggcgugagacccggcgcccaggccuaccugcugaccguguucugcauccuguuccuggugaugcagagagaguggagauaa

SEQ ID NO: 17672 - RNA, 1719 nt, Artificial Sequence
  GPC5__Homo_sapiens__NP_004457
auggacgcccagaccuggcccgugggcuucagaugccugcugcugcuggcccuggugggcagcgccagaagcgagggcgugcagaccugcgaggaggugagaaagcuguuccaguggagacugcugggcgccgugagaggccugcccgacagccccagagccggccccgaccugcaggugugcaucagcaagaagcccaccugcugcaccagaaagauggaggagagauaccagaucgccgccagacaggacaugcagcaguuccugcagaccagcagcagcacccugaaguuccugaucagcagaaacgccgccgccuuccaggagacccuggagacccugaucaagcaggccgagaacuacaccagcauccuguucugcagcaccuacagaaacauggcccuggaggccgccgccagcgugcaggaguucuucaccgacgugggccuguaccuguucggcgccgacgugaaccccgaggaguucgugaacagauucuucgacagccuguucccccugguguacaaccaccugaucaaccccggcgugaccgacagcagccuggaguacagcgagugcaucagaauggccagaagagacgugagccccuucggcaacaucccccagagagugaugggccagaugggcagaagccugcugcccagcagaaccuuccugcaggcccugaaccugggcaucgaggugaucaacaccaccgacuaccugcacuucagcaaggagugcagcagagcccugcugaagaugcaguacugcccccacugccagggccuggcccugaccaagcccugcaugggcuacugccugaacgugaugagaggcugccuggcccacauggccgagcugaacccccacuggcacgccuacaucagaagccuggaggagcugagcgacgccaugcacggcaccuacgacaucggccacgugcugcugaacuuccaccugcuggugaacgacgccgugcugcaggcccaccugaacggccagaagcugcuggagcaggugaacagaaucugcggcagacccgugagaacccccacccagagccccagaugcagcuucgaccagagcaaggagaagcacggcaugaagaccaccaccagaaacagcgaggagacccuggccaacagaagaaaggaguucaucaacagccugagacuguacagaagcuucuacggcggccuggccgaccagcugugcgccaacgagcuggccgccgccgacggccugcccugcuggaacggcgaggacaucgugaagagcuacacccagagaguggugggcaacggcaucaaggcccagagcggcaaccccgaggugaaggugaagggcaucgaccccgugaucaaccagaucaucgacaagcugaagcacguggugcagcugcugcagggcagaagccccaagcccgacaagugggagcugcugcagcugggcagcggcggcggcaugguggagcaggugagcggcgacugcgacgacgaggacggcugcggcggcagcggcagcggcgaggugaagagaacccugaagaucaccgacuggaugcccgacgacaugaacuucagcgacgugaagcagauccaccagaccgacaccggcagcacccuggacaccaccggcgccggcugcgccguggccaccgagagcaugaccuucacccugaucagcguggugaugcugcugcccggcaucugguaa

SEQ ID NO: 17673 - RNA, 1668 nt, Artificial Sequence
  GPC6__Homo_sapiens__NP_005699
augcccagcuggaucggcgccgugauccugccccugcugggccugcugcugagccugcccgccggcgccgacgugaaggccagaagcugcggcgaggugagacaggccuacggcgccaagggcuucagccuggccgacauccccuaccaggagaucgccggcgagcaccugagaaucugcccccaggaguacaccugcugcaccaccgagauggaggacaagcugagccagcagagcaagcuggaguucgagaaccugguggaggagaccagccacuucgugagaaccaccuucgugagcagacacaagaaguucgacgaguucuucagagagcugcuggagaacgccgagaagagccugaacgacauguucgugagaaccuacggcaugcuguacaugcagaacagcgagguguuccaggaccuguucaccgagcugaagagauacuacaccggcggcaacgugaaccuggaggagaugcugaacgacuucugggccagacugcuggagagaauguuccagcugaucaacccccaguaccacuucagcgaggacuaccuggagugcgugagcaaguacaccgaccagcugaagcccuucggcgacgugcccagaaagcugaagauccaggugaccagagccuucaucgccgccagaaccuucgugcagggccugaccgugggcagagagguggccaacagagugagcaaggugagccccacccccggcugcaucagagcccugaugaagaugcuguacugccccuacugcagaggccugcccaccgugagacccugcaacaacuacugccugaacgugaugaagggcugccuggccaaccaggccgaccuggacaccgaguggaaccuguucaucgacgccaugcugcugguggccgagagacuggagggccccuucaacaucgagagcgugauggaccccaucgacgugaagaucagcgaggccaucaugaacaugcaggagaacagcaugcaggugagcgccaagguguuccagggcugcggccagcccaagcccgcccccgcccugagaagcgccagaagcgcccccgagaacuucaacaccagauucagacccuacaaccccgaggagagacccaccaccgccgccggcaccagccuggacagacuggugaccgacaucaaggagaagcugaagcugagcaagaagguguggagcgcccugcccuacaccaucugcaaggacgagagcgugaccgccggcaccagcaacgaggaggagugcuggaacggccacagcaaggccagauaccugcccgagaucaugaacgacggccugaccaaccagaucaacaaccccgagguggacguggacaucaccagacccgacaccuucaucagacagcagaucauggcccugagagugaugaccaacaagcugaagaacgccuacaacggcaacgacgugaacuuccaggacaccagcgacgagagcagcggcagcggcagcggcagcggcugcauggacgacgugugccccaccgaguucgaguucgugaccaccgaggcccccgccguggaccccgacagaagagagguggacagcagcgccgcccagagaggccacagccugcugagcuggagccugaccugcaucgugcuggcccugcagagacugugcagauaa

SEQ ID NO: 17674 - RNA, 2019 nt, Artificial Sequence
  GPCPD1__Homo_sapiens__NP_062539
augacccccagccagguggccuucgagaucagaggcacccugcugcccggcgagguguucgccaucugcggcagcugcgacgcccugggcaacuggaacccccagaacgccguggcccugcugcccgagaacgacaccggcgagagcaugcuguggaaggccaccaucgugcugagcagaggcgugagcgugcaguacagauacuucaagggcuacuuccuggagcccaagaccaucggcggccccugccaggugaucgugcacaagugggagacccaccugcagcccagaagcaucaccccccuggagagcgagaucaucaucgacgacggccaguucggcauccacaacggcguggagacccuggacagcggcuggcugaccugccagaccgagaucagacugagacugcacuacagcgagaagccccccgugagcaucaccaagaagaagcugaagaagagcagauucagagugaagcugacccuggagggccuggaggaggacgacgacgacagagugagccccaccgugcugcacaagaugagcaacagccuggagaucagccugaucagcgacaacgaguucaagugcagacacagccagcccgagugcggcuacggccugcagcccgacagauggaccgaguacagcauccagaccauggagcccgacaaccuggagcugaucuucgacuucuucgaggaggaccugagcgagcacguggugcagggcgacgcccugcccggccacgugggcaccgccugccugcugagcagcaccaucgccgagagcggcaagagcgccggcauccugacccugcccaucaugagcagaaacagcagaaagaccaucggcaaggugagaguggacuacaucaucaucaagccccugcccggcuacagcugcgacaugaagagcagcuucagcaaguacuggaagcccagaaucccccuggacgugggccacagaggcgccggcaacagcaccaccaccgcccagcuggccaaggugcaggagaacaccaucgccagccugagaaacgccgccagccacggcgccgccuucguggaguucgacgugcaccugagcaaggacuucgugcccgugguguaccacgaccugaccugcugccugaccaugaagaagaaguucgacgccgaccccguggagcuguucgagauccccgugaaggagcugaccuucgaccagcugcagcugcugaagcugacccacgugaccgcccugaagagcaaggacagaaaggagagcguggugcaggaggagaacagcuucagcgagaaccagcccuuccccagccugaagauggugcuggagagccugcccgaggacgugggcuucaacaucgagaucaaguggaucugccagcagagagacggcaugugggacggcaaccugagcaccuacuucgacaugaaccuguuccuggacaucauccugaagaccgugcuggagaacagcggcaagagaagaaucguguucagcagcuucgacgccgacaucugcaccauggugagacagaagcagaacaaguaccccauccuguuccugacccagggcaagagcgagaucuaccccgagcugauggaccugagaagcagaaccacccccaucgccaugagcuucgcccaguucgagaaccugcugggcaucaacgugcacaccgaggaccugcugagaaaccccagcuacauccaggaggccaaggccaagggccuggugaucuucugcuggggcgacgacaccaacgaccccgagaacagaagaaagcugaaggagcugggcgugaacggccugaucuacgacagaaucuacgacuggaugcccgagcagcccaacaucuuccagguggagcagcuggagagacugaagcaggagcugcccgagcugaagagcugccugugccccaccgugagcagauucgugcccagcagccugugcggcgagagcgacauccacguggacgccaacggcaucgacaacguggagaacgccuaa

SEQ ID NO: 17675 - RNA, 981 nt, Artificial Sequence
  GPD1__Homo_sapiens__NP_001244128
auggccagcaagaaggugugcaucgugggcagcggcaacuggggcagcgccaucgccaagaucgugggcggcaacgccgcccagcuggcccaguucgaccccagagugaccauguggguguucgaggaggacaucggcggcaagaagcugaccgagaucaucaacacccagcacgagaacgugaaguaccugcccggccacaagcugccccccaacguguucaucggcaagaucugcgaccagcugaagggccaccugaaggccaacgccaccggcaucagccugaucaagggcguggacgagggccccaacggccugaagcugaucagcgaggugaucggcgagagacugggcauccccaugagcgugcugaugggcgccaacaucgccagcgagguggccgacgagaaguucugcgagaccaccaucggcugcaaggaccccgcccagggccagcugcugaaggagcugaugcagacccccaacuucagaaucaccguggugcaggagguggacaccguggagaucugcggcgcccugaagaacgugguggccgugggcgccggcuucugcgacggccugggcuucggcgacaacaccaaggccgccgugaucagacugggccugauggagaugaucgccuucgccaagcuguucugcagcggccccgugagcagcgccaccuuccuggagagcugcggcguggccgaccugaucaccaccugcuacggcggcagaaacagaaagguggccgaggccuucgccagaaccggcaagagcaucgagcagcuggagaaggagcugcugaacggccagaagcugcagggccccgagaccgccagagagcuguacagcauccugcagcacaagggccugguggacaaguucccccuguucauggccguguacaaggugugcuacgagggccagcccgugggcgaguucauccacugccugcagaaccaccccgagcacauguaa

SEQ ID NO: 17676 - RNA, 1056 nt, Artificial Sequence
  GPD1L__Homo_sapiens__NP_055956
auggccgccgccccccugaaggugugcaucgugggcagcggcaacuggggcagcgccguggccaagaucaucggcaacaacgugaagaagcugcagaaguucgccagcaccgugaagauguggguguucgaggagaccgugaacggcagaaagcugaccgacaucaucaacaacgaccacgagaacgugaaguaccugcccggccacaagcugcccgagaacgugguggccaugagcaaccugagcgaggccgugcaggacgccgaccugcugguguucgugaucccccaccaguucauccacagaaucugcgacgagaucaccggcagagugcccaagaaggcccugggcaucacccugaucaagggcaucgacgagggccccgagggccugaagcugaucagcgacaucaucagagagaagaugggcaucgacaucagcgugcugaugggcgccaacaucgccaacgagguggccgccgagaaguucugcgagaccaccaucggcagcaaggugauggagaacggccugcuguucaaggagcugcugcagacccccaacuucagaaucaccgugguggacgacgccgacaccguggagcugugcggcgcccugaagaacaucguggccgugggcgccggcuucugcgacggccugagaugcggcgacaacaccaaggccgccgugaucagacugggccugauggagaugaucgccuucgccagaaucuucugcaagggccaggugagcaccgccaccuuccuggagagcugcggcguggccgaccugaucaccaccugcuacggcggcagaaacagaagaguggccgaggccuucgccagaaccggcaagaccaucgaggagcuggagaaggagaugcugaacggccagaagcugcagggcccccagaccagcgccgagguguacagaauccugaagcagaagggccugcuggacaaguucccccuguucaccgccguguaccagaucugcuacgagagcagacccgugcaggagaugcugagcugccugcagagccaccccgagcacaccuaa

SEQ ID NO: 17677 - RNA, 2184 nt, Artificial Sequence
  GPD2__Homo_sapiens__NP_001076581
auggccuuccagaaggccgugaagggcaccauccuggugggcggcggcgcccuggccaccgugcugggccugagccaguucgcccacuacagaagaaagcagaugaaccuggccuacgugaaggccgccgacugcaucagcgagcccgugaacagagagccccccagcagagaggcccagcugcugacccugcagaacaccagcgaguucgacauccuggugaucggcggcggcgccaccggcagcggcugcgcccuggacgccgugaccagaggccugaagaccgcccugguggagagagacgacuucagcagcggcaccagcagcagaagcaccaagcugauccacggcggcgugagauaccugcagaaggccaucaugaagcuggacaucgagcaguacagaauggugaaggaggcccugcacgagagagccaaccugcuggagaucgccccccaccugagcgccccccugcccaucaugcugcccguguacaagugguggcagcugcccuacuacugggugggcaucaagcuguacgaccugguggccggcagcaacugccugaagagcagcuacgugcugagcaagagcagagcccuggagcacuuccccaugcugcagaaggacaagcuggugggcgccaucguguacuacgacggccagcacaacgacgccagaaugaaccuggccaucgcccugaccgccgccagauacggcgccgccaccgccaacuacauggagguggugagccugcugaagaagaccgacccccagaccggcaaggugagagugagcggcgccagaugcaaggacgugcugaccggccaggaguucgacgugagagccaagugcgugaucaacgccaccggccccuucaccgacagcgugagaaagauggacgacaaggacgccgccgccaucugccagcccagcgccggcgugcacaucgugaugcccggcuacuacagccccgagagcaugggccugcuggaccccgccaccagcgacggcagagugaucuucuuccugcccuggcagaagaugaccaucgccggcaccaccgacacccccaccgacgugacccaccaccccauccccagcgaggaggacaucaacuucauccugaacgaggugagaaacuaccugagcugcgacguggaggugagaagaggcgacgugcuggccgccuggagcggcaucagaccccuggugaccgaccccaagagcgccgacacccagagcaucagcagaaaccacgugguggacaucagcgagagcggccugaucaccaucgccggcggcaaguggaccaccuacagaagcauggccgaggacaccaucaacgccgccgugaagacccacaaccugaaggccggccccagcagaaccgugggccuguuccugcagggcggcaaggacuggagccccacccuguacaucagacuggugcaggacuacggccuggagagcgagguggcccagcaccuggccgccaccuacggcgacaaggccuucgagguggccaagauggccagcgugaccggcaagagauggcccaucgugggcgugagacuggugagcgaguuccccuacaucgaggccgaggugaaguacggcaucaaggaguacgccugcaccgccguggacaugaucagcagaagaaccagacuggccuuccugaacgugcaggccgccgaggaggcccugcccagaaucguggagcugaugggcagagagcugaacugggacgacuacaagaagcaggagcagcuggagaccgccagaaaguuccuguacuacgagaugggcuacaagagcagaagcgagcagcugaccgacagaagcgagaucagccugcugcccagcgacaucgacagauacaagaagagauuccacaaguucgacgccgaccagaagggcuucaucaccaucguggacgugcagagagugcuggagagcaucaacgugcagauggacgagaacacccugcacgagauccugaacgagguggaccugaacaagaacggccagguggagcugaacgaguuccugcagcugaugagcgccauccagaagggcagagugagcggcagcagacuggccauccugaugaagaccgccgaggagaaccuggacagaagagugcccauccccguggacagaagcugcggcggccuguaa

SEQ ID NO: 17678 - RNA, 1128 nt, Artificial Sequence
  GPER1__Homo_sapiens__NP_001091671
auggacgugaccagccaggccagaggcgugggccuggagauguaccccggcaccgcccagcccgccgcccccaacaccaccagccccgagcugaaccugagccacccccugcugggcaccgcccuggccaacggcaccggcgagcugagcgagcaccagcaguacgugaucggccuguuccugagcugccuguacaccaucuuccuguuccccaucggcuucgugggcaacauccugauccugguggugaacaucagcuucagagagaagaugaccauccccgaccuguacuucaucaaccuggccguggccgaccugauccugguggccgacagccugaucgagguguucaaccugcacgagagauacuacgacaucgccgugcugugcaccuucaugagccuguuccugcaggugaacauguacagcagcguguucuuccugaccuggaugagcuucgacagauacaucgcccuggccagagccaugagaugcagccuguucagaaccaagcaccacgccagacugagcugcggccugaucuggauggccagcgugagcgccacccuggugcccuucaccgccgugcaccugcagcacaccgacgaggccugcuucugcuucgccgacgugagagaggugcaguggcuggaggugacccugggcuucaucgugcccuucgccaucaucggccugugcuacagccugaucgugagagugcuggugagagcccacagacacagaggccugagacccagaagacagaaggcccugagaaugauccuggccguggugcugguguucuucgugugcuggcugcccgagaacguguucaucagcgugcaccugcugcagagaacccagcccggcgccgcccccugcaagcagagcuucagacacgcccacccccugaccggccacaucgugaaccuggccgccuucagcaacagcugccugaacccccugaucuacagcuuccugggcgagaccuucagagacaagcugagacuguacaucgagcagaagaccaaccugcccgcccugaacagauucugccacgccgcccugaaggccgugauccccgacagcaccgagcagagcgacgugagauucagcagcgccguguaa

SEQ ID NO: 17679 - RNA, 390 nt, Artificial Sequence
  GPHA2__Homo_sapiens__NP_570125
augcccauggccagcccccagacccuggugcuguaccugcuggugcuggccgugaccgaggccuggggccaggaggccgugauccccggcugccaccugcaccccuucaacgugaccgugagaagcgacagacagggcaccugccagggcagccacguggcccaggccugcgugggccacugcgagagcagcgccuuccccagcagauacagcgugcugguggccagcggcuacagacacaacaucaccagcgugagccagugcugcaccaucagcggccugaagaaggugaaggugcagcugcagugcgugggcagcagaagagaggagcuggagaucuucaccgccagagccugccagugcgacaugugcagacugagcagauacuaa

SEQ ID NO: 17680 - RNA, 2211 nt, Artificial Sequence
  GPHN__Homo_sapiens__NP_001019389
auggccaccgagggcaugauccugaccaaccacgaccaccagaucagagugggcgugcugaccgugagcgacagcugcuucagaaaccuggccgaggacagaagcggcaucaaccugaaggaccuggugcaggaccccagccugcugggcggcaccaucagcgccuacaagaucgugcccgacgagaucgaggagaucaaggagacccugaucgacuggugcgacgagaaggagcugaaccugauccugaccaccggcggcaccggcuucgcccccagagacgugacccccgaggccaccaaggaggugaucgagagagaggcccccggcauggcccuggccaugcugaugggcagccugaacgugaccccccugggcaugcugagcagacccgugugcggcaucagaggcaagacccugaucaucaaccugcccggcagcaagaagggcagccaggagugcuuccaguucauccugcccgcccugccccacgccaucgaccugcugagagacgccaucgugaaggugaaggaggugcacgacgagcuggaggaccugcccagccccccccccccccugagccccccccccaccaccagcccccacaagcagaccgaggacaagggcgugcagugcgaggaggaggaggaggagaagaaggacagcggcguggccagcaccgaggacagcagcagcagccacaucaccgccgccgccaucgccgccaagauccccgacagcaucaucagcagaggcgugcaggugcugcccagagacaccgccagccugagcaccacccccagcgagagccccagagcccaggccaccagcagacugagcaccgccagcugccccacccccaaggugcagagcagaugcagcagcaaggagaacauccugagagccagccacagcgccguggacaucaccaagguggccagaagacacagaaugagccccuucccccugaccagcauggacaaggccuucaucaccgugcuggagaugacccccgugcugggcaccgagaucaucaacuacagagacggcaugggcagagugcuggcccaggacguguacgccaaggacaaccugccccccuuccccgccagcgugaaggacggcuacgccgugagagccgccgacggccccggcgacagauucaucaucggcgagagccaggccggcgagcagcccacccagaccgugaugcccggccaggugaugagagugaccaccggcgcccccauccccugcggcgccgacgccguggugcagguggaggacaccgagcugaucagagagagcgacgacggcaccgaggagcuggaggugagaauccuggugcaggccagacccggccaggacaucagacccaucggccacgacaucaagagaggcgagugcgugcuggccaagggcacccacaugggccccagcgagaucggccugcuggccaccgugggcgugaccgagguggaggugaacaaguuccccgugguggccgugaugagcaccggcaacgagcugcugaaccccgaggacgaccugcugcccggcaagaucagagacagcaacagaagcacccugcuggccaccauccaggagcacggcuaccccaccaucaaccugggcaucgugggcgacaaccccgacgaccugcugaacgcccugaacgagggcaucagcagagccgacgugaucaucaccagcggcggcgugagcaugggcgagaaggacuaccugaagcaggugcuggacaucgaccugcacgcccagauccacuucggcagaguguucaugaagcccggccugcccaccaccuucgccacccuggacaucgacggcgugagaaagaucaucuucgcccugcccggcaaccccgugagcgccguggugaccugcaaccuguucguggugcccgcccugagaaagaugcagggcauccuggaccccagacccaccaucaucaaggccagacugagcugcgacgugaagcuggaccccagacccgaguaccacagaugcauccugaccuggcaccaccaggagccccugcccugggcccagagcaccggcaaccagaugagcagcagacugaugagcaugagaagcgccaacggccugcugaugcugccccccaagaccgagcaguacguggagcugcacaagggcgaggugguggacgugauggugaucggcagacuguaa

SEQ ID NO: 17681 - RNA, 555 nt, Artificial Sequence
  GPIHBP1__Homo_sapiens__NP_835466
augaaggcccugggcgccgugcugcuggcccugcugcuguucggcagacccggcagaggccagacccagcaggaggaggaggaggaggacgaggaccacggccccgacgacuacgacgaggaggacgaggacgagguggaggaggaggagaccaacagacugcccggcggcagaagcagagugcugcugagaugcuacaccugcaagagccugcccagagacgagagaugcaaccugacccagaacugcagccacggccagaccugcaccacccugaucgcccacggcaacaccgagagcggccugcugaccacccacagcaccuggugcaccgacagcugccagcccaucaccaagaccguggagggcacccaggugaccaugaccugcugccagagcagccugugcaacgugccccccuggcagagcagcagagugcaggaccccaccggcaagggcgccggcggccccagaggcagcagcgagaccgugggcgccgcccugcugcugaaccugcuggccggccugggcgccaugggcgccagaagacccuaa

SEQ ID NO: 17682 - RNA, 1710 nt, Artificial Sequence
  GPI__Homo_sapiens__NP_001171651
augguggcccugugcagccugcagcaccugggcagcagcgaccccagagcccugcccacccugcccaccgccaccagcggccagagacccgccaagagaagaagaaagagccccgccauggccgcccugaccagagacccccaguuccagaagcugcagcagugguacagagagcacagaagcgagcugaaccugagaagacuguucgacgccaacaaggacagauucaaccacuucagccugacccugaacaccaaccacggccacauccugguggacuacagcaagaaccuggugaccgaggacgugaugagaaugcugguggaccuggccaagagcagaggcguggaggccgccagagagagaauguucaacggcgagaagaucaacuacaccgagggcagagccgugcugcacguggcccugagaaacagaagcaacacccccauccugguggacggcaaggacgugaugcccgaggugaacaaggugcuggacaagaugaagagcuucugccagggcccccugauggugaccgaggcccugaagcccuacagcagcggcggccccagagugugguacgugagcaacaucgacggcacccacaucgccaagacccuggcccagcugaaccccgagagcagccuguucaucaucgccagcaagaccuucaccacccaggagaccaucaccaacgccgagaccgccaaggagugguuccugcaggccgccaaggaccccagcgccguggccaagcacuucguggcccugagcaccaacaccaccaaggugaaggaguucggcaucgacccccagaacauguucgaguucugggacugggugggcggcagauacagccuguggagcgccaucggccugagcaucgcccugcacgugggcuucgacaacuucgagcagcugcugagcggcgcccacuggauggaccagcacuucagaaccaccccccuggagaagaacgcccccgugcugcuggcccugcugggcaucugguacaucaacugcuucggcugcgagacccacgccaugcugcccuacgaccaguaccugcacagauucgccgccuacuuccagcagggcgacauggagagcaacggcaaguacaucaccaagagcggcaccagaguggaccaccagaccggccccaucguguggggcgagcccggcaccaacggccagcacgccuucuaccagcugauccaccagggcaccaagaugauccccugcgacuuccugauccccgugcagacccagcaccccaucagaaagggccugcaccacaagauccugcuggccaacuuccuggcccagaccgaggcccugaugagaggcaagagcaccgaggaggccagaaaggagcugcaggccgccggcaagagccccgaggaccuggagagacugcugccccacaagguguucgagggcaacagacccaccaacagcaucguguucaccaagcugacccccuucaugcugggcgcccugguggccauguacgagcacaagaucuucgugcagggcaucaucugggacaucaacagcuucgaccaguggggcguggagcugggcaagcagcuggccaagaagaucgagcccgagcuggacggcagcgcccaggugaccagccacgacgccagcaccaacggccugaucaacuucaucaagcagcagagagaggccagagugcaguaa

SEQ ID NO: 17683 - RNA, 1431 nt, Artificial Sequence
  GPKOW__Homo_sapiens__NP_056513
auggccgacagcaaggagggcgugcugccccugaccgccgccagcaccgcccccaucagcuucggcuucaccagaaccagcgccagaagaagacuggccgacagcggcgacggcgccggccccagccccgaggagaaggacuuccugaagaccguggagggcagagagcugcagagcgugaagccccaggaggcccccaaggagcuggugaucccccugauccagaacggccacagaagacagccccccgccagaccccccggccccagcaccgacaccggcgcccuggccgacggcguggugagccaggccgugaaggagcugaucgccgagagcaagaagagccuggaggagagagagaacgccggcguggaccccacccuggccauccccaugauccagaagggcugcacccccagcggcgagggcgccgacagcgagcccagagccgagaccgugcccgaggaggccaacuacgaggccgugcccguggaggccuacggccuggccaugcugagaggcaugggcuggaagcccggcgagggcaucggcagaaccuucaaccagguggugaagcccagagugaacagccugagacccaagggccugggccugggcgccaaccugaccgaggcccaggcccugacccccaccggccccagcagaaugcccagacccgacgaggagcaggagaaggacaaggaggaccagccccagggccuggugcccggcggcgccgugguggugcugagcggcccccacagaggccuguacggcaagguggagggccuggaccccgacaacgugagagccauggugagacuggccgugggcagcagaguggugaccgugagcgaguacuaccugagacccgugagccagcaggaguucgacaagaacacccuggaccugagacagcagaacggcaccgccagcagcagaaagacccuguggaaccaggagcuguacauccagcaggacaacagcgagagaaagagaaagcaccugcccgacagacaggacggccccgccgccaagagcgagaaggccgcccccagaagccagcacuggcugcacagagaccugagagugagauucguggacaacauguacaagggcggccaguacuacaacaccaagaugaucaucgaggacgugcugagccccgacaccugcgugugcagaaccgacgagggcagagugcuggagggccugagagaggacaugcuggagacccuggugcccaaggccgagggcgacagagugaugguggugcugggcccccagaccggcagagugggccaccugcugagcagagacagagccagaagcagagcccuggugcagcugcccagagagaaccaggugguggagcugcacuacgacgccaucugccaguacaugggccccagcgacaccgacgacgacuaa

SEQ ID NO: 17684 - RNA, 2523 nt, Artificial Sequence
  GPLD1__Homo_sapiens__NP_001494
augagcgccuucagacuguggcccggccugcugaucaugcugggcagccugugccacagaggcagccccugcggccugagcacccacguggagaucggccacagagcccuggaguuccugcagcugcacaacggcagagugaacuacagagagcugcugcuggagcaccaggacgccuaccaggccggcaucguguuccccgacugcuucuaccccagcaucugcaagggcggcaaguuccacgacgugagcgagagcacccacuggacccccuuccugaacgccagcgugcacuacaucagagagaacuacccccugcccugggagaaggacaccgagaagcugguggccuuccuguucggcaucaccagccacauggccgccgacgugagcuggcacagccugggccuggagcagggcuuccugagaaccaugggcgccaucgacuuccacggcagcuacagcgaggcccacagcgccggcgacuucggcggcgacgugcugagccaguucgaguucaacuucaacuaccuggccagaagaugguacgugcccgugaaggaccugcugggcaucuacgagaagcuguacggcagaaaggugaucaccgagaacgugaucguggacugcagccacauccaguuccuggagauguacggcgagaugcuggccgugagcaagcuguaccccaccuacagcaccaagagccccuuccugguggagcaguuccaggaguacuuccugggcggccuggacgacauggccuucuggagcaccaacaucuaccaccugaccagcuucaugcuggagaacggcaccagcgacugcaaccugcccgagaacccccuguucaucgccugcggcggccagcagaaccacacccagggcagcaagaugcagaagaacgacuuccacagaaaccugaccaccagccugaccgagagcguggacagaaacaucaacuacaccgagagaggcguguucuucagcgugaacagcuggacccccgacagcaugagcuucaucuacaaggcccuggagagaaacaucagaaccauguucaucggcggcagccagcugagccagaagcacgugagcagcccccuggccagcuacuuccugagcuuccccuacgccagacugggcugggccaugaccagcgccgaccugaaccaggacggccacggcgaccugguggugggcgcccccggcuacagcagacccggccacauccacaucggcagaguguaccugaucuacggcaacgaccugggccugccccccguggaccuggaccuggacaaggaggcccacagaauccuggagggcuuccagcccagcggcagauucggcagcgcccuggccgugcuggacuucaacguggacggcgugcccgaccuggccgugggcgcccccagcgugggcagcgagcagcugaccuacaagggcgccguguacguguacuucggcagcaagcagggcggcaugagcagcagccccaacaucaccaucagcugccaggacaucuacugcaaccugggcuggacccugcuggccgccgacgugaacggcgacagcgagcccgaccuggugaucggcagccccuucgcccccggcggcggcaagcagaagggcaucguggccgccuucuacagcggccccagccugagcgacaaggagaagcugaacguggaggccgccaacuggaccgugagaggcgaggaggacuucagcugguucggcuacagccugcacggcgugaccguggacaacagaacccugcugcuggugggcagccccaccuggaagaacgccagcagacugggccaccugcugcacaucagagacgagaagaagagccugggcagaguguacggcuacuucccccccaacggccagagcugguucaccaucagcggcgacaaggccaugggcaagcugggcaccagccugagcagcggccacgugcugaugaacggcacccugaagcaggugcugcuggugggcgcccccaccuacgacgacgugagcaagguggccuuccugaccgugacccugcaccagggcggcgccaccagaauguacgcccugaccagcgacgcccagccccugcugcugagcaccuucagcggcgacagaagauucagcagauucggcggcgugcugcaccugagcgaccuggacgacgacggccuggacgagaucaucauggccgccccccugagaaucgccgacgugaccagcggccugaucggcggcgaggacggcagaguguacguguacaacggcaaggagaccacccugggcgacaugaccggcaagugcaagagcuggaucacccccugccccgaggagaaggcccaguacgugcugaucagccccgaggccagcagcagauucggcagcagccugaucaccgugagaagcaaggccaagaaccagguggugaucgccgccggcagaagcagccugggcgccagacugagcggcgcccugcacguguacagccugggcagcgacuaa

SEQ ID NO: 17685 - RNA, 816 nt, Artificial Sequence
  GPM6A__Homo_sapiens__NP_001248377
augaccgaccuggagggcugcuucgagugcugcaucaagugccugggcggcauccccuacgccagccugaucgccaccauccugcuguacgccggcguggcccuguucugcggcugcggccacgaggcccugagcggcaccgugaacauccugcagaccuacuucgagauggccagaaccgccggcgacacccuggacguguucaccaugaucgacaucuucaaguacgugaucuacggcaucgccgccgccuucuucguguacggcauccugcugaugguggagggcuucuucaccaccggcgccaucaaggaccuguacggcgacuucaagaucaccaccugcggcagaugcgugagcgccugguucaucaugcugaccuaccuguucaugcuggccuggcugggcgugaccgccuucaccagccugcccguguacauguacuucaaccuguggaccaucugcagaaacaccacccugguggagggcgccaaccugugccuggaccugagacaguucggcaucgugaccaucggcgaggagaagaagaucugcaccgugagcgagaacuuccugagaaugugcgagagcaccgagcugaacaugaccuuccaccuguucaucguggcccuggccggcgccggcgccgccgugaucgccauggugcacuaccugauggugcugagcgccaacugggccuacgugaaggacgccugcagaaugcagaaguacgaggacaucaagagcaaggaggagcaggagcugcacgacauccacagcaccagaagcaaggagagacugaacgccuacaccuaa

SEQ ID NO: 17686 - RNA, 741 nt, Artificial Sequence
  GPM6B__Homo_sapiens__NP_001001994
augggcugcuucgagugcugcaucaagugccugggcggcgugcccuacgccagccugguggccaccauccugugcuucagcggcguggcccuguucugcggcugcggccacguggcccuggccggcaccguggccauccuggagcagcacuucagcaccaacgccagcgaccacgcccugcugagcgaggugauccagcugaugcaguacgugaucuacggcaucgccagcuucuucuuccuguacggcaucauccugcuggccgagggcuucuacaccaccagcgccgugaaggagcugcacggcgaguucaagaccaccgccugcggcagaugcaucagcggcauguucguguuccugaccuacgugcugggcguggccuggcugggcguguucggcuucagcgccgugcccguguucauguucuacaacaucuggagcaccugcgaggugaucaagagcccccagaccaacggcaccaccggcguggagcagaucugcguggacaucagacaguacggcaucauccccuggaacgccuuccccggcaagaucugcggcagcgcccuggagaacaucugcaacaccaacgaguucuacaugagcuaccaccuguucaucguggccugcgccggcgccggcgccaccgugaucgcccugcugaucuacaugauggccaccaccuacaacuacgccgugcugaaguucaagagcagagaggacugcugcaccaaguucuaa

SEQ ID NO: 17687 - RNA, 1089 nt, Artificial Sequence
  GPN1__Homo_sapiens__NP_001138519
augaccggccacaccagaagcagccugcccagaugcaccggcaucgugcugcugaucaagcugagauucagcgagagacugaccggccaccugcacgcccagggcaccccccccuacgugaucaaccuggaccccgccgugcacgaggugcccuuccccgccaacaucgacaucagagacaccgugaaguacaaggaggugaugaagcaguacggccugggccccaacggcggcaucgugaccagccugaaccuguucgccaccagauucgaccaggugaugaaguucaucgagaaggcccagaacaugagcaaguacgugcugaucgacacccccggccagaucgagguguucaccuggagcgccagcggcaccaucaucaccgaggcccuggccagcagcuuccccaccguggugaucuacgugauggacaccagcagaagcaccaaccccgugaccuucaugagcaacaugcuguacgccugcagcauccuguacaagaccaagcugcccuucaucguggugaugaacaagaccgacaucaucgaccacagcuucgccguggaguggaugcaggacuucgaggccuuccaggacgcccugaaccaggagaccaccuacgugagcaaccugaccagaagcaugagccuggugcuggacgaguucuacagcagccugagaguggugggcgugagcgccgugcugggcaccggccuggacgagcuguucgugcaggugaccagcgccgccgaggaguacgagagagaguacagacccgaguacgagagacugaagaagagccuggccaacgccgagagccagcagcagagagagcagcuggagagacugagaaaggacaugggcagcguggcccuggacgccggcaccgccaaggacagccugagccccgugcugcaccccagcgaccugauccugaccagaggcacccuggacgaggaggacgaggaggccgacagcgacaccgacgacaucgaccacagagugaccgaggagagccacgaggagcccgccuuccagaacuucaugcaggagagcauggcccaguacuggaagagaaacaacaaguaa

SEQ ID NO: 17688 - RNA, 1719 nt, Artificial Sequence
  GPNMB__Homo_sapiens__NP_001005340
auggagugccuguacuacuuccugggcuuccugcugcuggccgccagacugccccuggacgccgccaagagauuccacgacgugcugggcaacgagagacccagcgccuacaugagagagcacaaccagcugaacggcuggagcagcgacgagaacgacuggaacgagaagcuguaccccguguggaagagaggcgacaugagauggaagaacagcuggaagggcggcagagugcaggccgugcugaccagcgacagccccgcccuggugggcagcaacaucaccuucgccgugaaccugaucuuccccagaugccagaaggaggacgccaacggcaacaucguguacgagaagaacugcagaaacgaggccggccugagcgccgaccccuacguguacaacuggaccgccuggagcgaggacagcgacggcgagaacggcaccggccagagccaccacaacguguuccccgacggcaagcccuucccccaccaccccggcuggagaagauggaacuucaucuacguguuccacacccugggccaguacuuccagaagcugggcagaugcagcgugagagugagcgugaacaccgccaacgugacccugggcccccagcugauggaggugaccguguacagaagacacggcagagccuacgugcccaucgcccaggugaaggacguguacguggugaccgaccagauccccguguucgugaccauguuccagaagaacgacagaaacagcagcgacgagaccuuccugaaggaccugcccaucauguucgacgugcugauccacgaccccagccacuuccugaacuacagcaccaucaacuacaaguggagcuucggcgacaacaccggccuguucgugagcaccaaccacaccgugaaccacaccuacgugcugaacggcaccuucagccugaaccugaccgugaaggccgccgcccccggccccugccccccccccccccccccccccagacccagcaagcccacccccagccuggccaccacccugaagagcuacgacagcaacacccccggccccgccggcgacaacccccuggagcugagcagaauccccgacgagaacugccagaucaacagauacggccacuuccaggccaccaucaccaucguggagggcauccuggaggugaacaucauccagaugaccgacgugcugaugcccgugcccuggcccgagagcagccugaucgacuucguggugaccugccagggcagcauccccaccgaggugugcaccaucaucagcgaccccaccugcgagaucacccagaacaccgugugcagccccguggacguggacgagaugugccugcugaccgugagaagaaccuucaacggcagcggcaccuacugcgugaaccugacccugggcgacgacaccagccuggcccugaccagcacccugaucagcgugcccgacagagaccccgccagcccccugagaauggccaacagcgcccugaucagcgugggcugccuggccaucuucgugaccgugaucagccugcugguguacaagaagcacaaggaguacaaccccaucgagaacagccccggcaacguggugagaagcaagggccugagcguguuccugaacagagccaaggccguguucuuccccggcaaccaggagaaggacccccugcugaagaaccaggaguucaagggcgugagcuaa

SEQ ID NO: 17689 - RNA, 1527 nt, Artificial Sequence
  GPR101__Homo_sapiens__NP_473362
augaccagcaccugcaccaacagcaccagagagagcaacagcagccacaccugcaugccccugagcaagaugcccaucagccuggcccacggcaucaucagaagcaccgugcuggugaucuuccuggccgccagcuucgugggcaacaucgugcuggcccuggugcugcagagaaagccccagcugcugcaggugaccaacagauucaucuucaaccugcuggugaccgaccugcugcagaucagccugguggcccccugggugguggccaccagcgugccccuguucuggccccugaacagccacuucugcaccgcccuggugagccugacccaccuguucgccuucgccagcgugaacaccaucgugguggugagcguggacagauaccugagcaucauccacccccugagcuaccccagcaagaugacccagagaagaggcuaccugcugcuguacggcaccuggaucguggccauccugcagagcacccccccccuguacggcuggggccaggccgccuucgacgagagaaacgcccugugcagcaugaucuggggcgccagccccagcuacaccauccugagcguggugagcuucaucgugaucccccugaucgugaugaucgccugcuacagcgugguguucugcgccgccagaagacagcacgcccugcuguacaacgugaagagacacagccuggaggugagagugaaggacugcguggagaacgaggacgaggagggcgccgagaagaaggaggaguuccaggacgagagcgaguucagaagacagcacgagggcgaggugaaggccaaggagggcagaauggaggccaaggacggcagccugaaggccaaggagggcagcaccggcaccagcgagagcagcguggaggccagaggcagcgaggaggugagagagagcagcaccguggccagcgacggcagcauggagggcaaggagggcagcaccaagguggaggagaacagcaugaaggccgacaagggcagaaccgaggugaaccagugcagcaucgaccugggcgaggacgacauggaguucggcgaggacgacaucaacuucagcgaggacgacguggaggccgugaacauccccgagagccugccccccagcagaagaaacagcaacagcaaccccccccugcccagaugcuaccagugcaaggccgccaaggugaucuucaucaucaucuucagcuacgugcugagccugggccccuacugcuuccuggccgugcuggccguguggguggacguggagacccaggugccccagugggugaucaccaucaucaucuggcuguucuuccugcagugcugcauccaccccuacguguacggcuacaugcacaagaccaucaagaaggagauccaggacaugcugaagaaguucuucugcaaggagaagccccccaaggaggacagccaccccgaccugcccggcaccgagggcggcaccgagggcaagaucgugcccagcuacgacagcgccaccuuccccuaa

SEQ ID NO: 17690 - RNA, 1008 nt, Artificial Sequence
  GPR119__Homo_sapiens__NP_848566
auggagagcagcuucagcuucggcgugauccuggccgugcuggccagccugaucaucgccaccaacacccugguggccguggccgugcugcugcugauccacaagaacgacggcgugagccugugcuucacccugaaccuggccguggccgacacccugaucggcguggccaucagcggccugcugaccgaccagcugagcagccccagcagacccacccagaagacccugugcagccugagaauggccuucgugaccagcagcgccgccgccagcgugcugaccgugaugcugaucaccuucgacagauaccuggccaucaagcagcccuucagauaccugaagaucaugagcggcuucguggccggcgccugcaucgccggccuguggcuggugagcuaccugaucggcuuccugccccugggcauccccauguuccagcagaccgccuacaagggccagugcagcuucuucgccguguuccacccccacuucgugcugacccugagcugcgugggcuucuuccccgccaugcugcuguucguguucuucuacugcgacaugcugaagaucgccagcaugcacagccagcagaucagaaagauggagcacgccggcgccauggccggcggcuacagaagccccagaacccccagcgacuucaaggcccugagaaccgugagcgugcugaucggcagcuucgcccugagcuggacccccuuccugaucaccggcaucgugcagguggccugccaggagugccaccuguaccuggugcuggagagauaccuguggcugcugggcgugggcaacagccugcugaacccccugaucuacgccuacuggcagaaggaggugagacugcagcuguaccacauggcccugggcgugaagaaggugcugaccagcuuccugcuguuccugagcgccagaaacugcggccccgagagacccagagagagcagcugccacaucgugaccaucagcagcagcgaguucgacggcuaa

SEQ ID NO: 17691 - RNA, 1005 nt, Artificial Sequence
  GPR12__Homo_sapiens__NP_005279
augaacgaggaccugaaggugaaccugagcggccugcccagagacuaccuggacgccgccgccgccgagaacaucagcgccgccgugagcagcagagugcccgccguggagcccgagcccgagcugguggugaaccccugggacaucgugcugugcaccagcggcacccugaucagcugcgagaacgccaucguggugcugaucaucuuccacaaccccagccugagagcccccauguuccugcugaucggcagccuggcccuggccgaccugcuggccggcaucggccugaucaccaacuucguguucgccuaccugcugcagagcgaggccaccaagcuggugaccaucggccugaucguggccagcuucagcgccagcgugugcagccugcuggccaucaccguggacagauaccugagccuguacuacgcccugaccuaccacagcgagagaaccgugaccuucaccuacgugaugcuggugaugcuguggggcaccagcaucugccugggccugcugcccgugaugggcuggaacugccugagagacgagagcaccugcagcguggugagaccccugaccaagaacaacgccgccauccugagcgugagcuuccuguucauguucgcccugaugcugcagcuguacauccagaucugcaagaucgugaugagacacgcccaccagaucgcccugcagcaccacuuccuggccaccagccacuacgugaccaccagaaagggcgugagcacccuggccaucauccugggcaccuucgccgccugcuggaugcccuucacccuguacagccugaucgccgacuacaccuaccccagcaucuacaccuacgccacccugcugcccgccaccuacaacagcaucaucaaccccgugaucuacgccuucagaaaccaggagauccagaaggcccugugccugaucugcugcggcugcauccccagcagccuggcccagagagccagaagccccagcgacguguaa

SEQ ID NO: 17692 - RNA, 1143 nt, Artificial Sequence
  GPR132__Homo_sapiens__NP_001265623
augugccccaugcugcugaagaacggcuacaacggcaacgccacccccgugaccaccaccgcccccugggccagccugggccugagcgccaagaccugcaacaacgugagcuucgaggagagcagaaucgugcugguggugguguacagcgccgugugcacccugggcgugcccgccaacugccugaccgccuggcuggcccugcugcaggugcugcagggcaacgugcuggccguguaccugcugugccuggcccugugcgagcugcuguacaccggcacccugccccugugggugaucuacaucagaaaccagcacagauggacccugggccugcuggccugcaaggugaccgccuacaucuucuucugcaacaucuacgugagcauccuguuccugugcugcaucagcugcgacagauucguggccgugguguacgcccuggagagcagaggcagaagaagaagaagaaccgccauccugaucagcgccugcaucuucauccuggugggcaucgugcacuaccccguguuccagaccgaggacaaggagaccugcuucgacaugcugcagauggacagcagaaucgccggcuacuacuacgccagauucaccgugggcuucgccaucccccugagcaucaucgccuucaccaaccacagaaucuucagaagcaucaagcagagcaugggccugagcgccgcccagaaggccaaggugaagcacagcgccaucgccgugguggugaucuuccuggugugcuucgcccccuaccaccuggugcugcuggugaaggccgccgccuucagcuacuacagaggcgacagaaacgccaugugcggccuggaggagagacuguacaccgccagcgugguguuccugugccugagcaccgugaacggcguggccgaccccaucaucuacgugcuggccaccgaccacagcagacaggaggugagcagaauccacaagggcuggaaggaguggagcaugaagaccgacgugaccagacugacccacagcagagacaccgaggagcugcagagccccguggcccuggccgaccacuacaccuucagcagacccgugcacccccccggcagccccugccccgccaagagacugaucgaggagagcugcuaa

SEQ ID NO: 17693 - RNA, 1485 nt, Artificial Sequence
  GPR135__Homo_sapiens__NP_072093
auggaggagccccagccccccagaccccccgccagcauggcccugcugggcagccagcacagcggcgcccccagcgccgccggcccccccggcggcaccagcagcgccgccaccgccgccgugcugagcuucagcaccguggccaccgccgcccugggcaaccugagcgacgccagcggcggcggcaccgccgccgcccccggcggcggcggccugggcggcagcggcgccgccagagaggccggcgccgccgugagaagaccccugggccccgaggccgccccccugcugagccacggcgccgccguggccgcccaggcccuggugcugcugcugaucuuccugcugagcagccugggcaacugcgccgugaugggcgugaucgugaagcacagacagcugagaaccgugaccaacgccuucauccugagccugagccugagcgaccugcugaccgcccugcugugccugcccgccgccuuccuggaccuguucaccccccccggcggcagcgcccccgccgccgccgccggccccuggagaggcuucugcgccgccagcagauucuucagcagcugcuucggcaucgugagcacccugagcguggcccugaucagccuggacagauacugcgccaucgugagaccccccagagagaagaucggcagaagaagagcccugcagcugcuggccggcgccuggcugaccgcccugggcuucagccugcccugggagcugcugggcgcccccagagagcuggccgccgcccagagcuuccacggcugccuguacagaaccagccccgaccccgcccagcugggcgccgccuucagcgugggccuggugguggccugcuaccugcugcccuuccugcugaugugcuucugccacuaccacaucugcaagaccgugagacugagcgacgugagagugagacccgugaacaccuacgccagagugcugagauucuucagcgaggugagaaccgccaccaccgugcugaucaugaucguguucgugaucugcugcuggggccccuacugcuuccuggugcugcuggccgccgccagacaggcccagaccaugcaggcccccagccugcugagcgugguggccguguggcugaccugggccaacggcgccaucaaccccgugaucuacgccaucagaaaccccaacaucagcaugcugcugggcagaaacagagaggagggcuacagaaccagaaacguggacgccuuccugcccagccagggccccggccugcaggccagaagcagaagcagacugagaaacagauacgccaacagacugggcgccugcaacagaaugagcagcagcaaccccgccagcggcguggccggcgacguggccaugugggccagaaagaaccccguggugcuguucugcagagagggcccccccgagcccgugaccgccgugaccaagcagcccaagagcgaggccggcgacaccagccuguaa

SEQ ID NO: 17694 - RNA, 1290 nt, Artificial Sequence
  GPR137C__Homo_sapiens__NP_001093122
augagagugagcgugcccggccccgccgccgccgccgcccccgccgccggcagagagcccagcacccccggcggcggcagcggcggcggcggcgccguggccgccgccagcggcgccgccgugcccggcagcgugcagcuggcccugagcgugcugcacgcccugcuguacgccgcccuguucgccuucgccuaccugcagcuguggagacugcugcuguacagagagagaagacugagcuaccagagccugugccuguuccugugccugcugugggccgcccugagaaccacccuguucagcgccgccuucagccugagcggcagccugccccugcugagaccccccgcccaccugcacuucuucccccacuggcugcuguacugcuuccccagcugccugcaguucagcacccugugccugcugaaccuguaccuggccgaggugaucugcaaggugagaugcgccaccgagcuggacagacacaagauccugcugcaccugggcuucaucauggccagccugcuguuccugguggugaaccugaccugcgccaugcuggugcacggcgacgugcccgagaaccagcugaaguggaccguguucgugagagcccugaucaacgacagccuguucauccugugcgccaucagccuggugugcuacaucugcaagaucaccaagaugagcagcgccaacguguaccuggagagcaagggcaugagccugugccagaccgugguggugggcagcguggugauccugcuguacagcagcagagccugcuacaaccuggugguggugaccaucagccaggacacccuggagagccccuucaacuacggcugggacaaccugagcgacaaggcccacguggaggacaucagcggcgaggaguacaucguguucggcauggugcuguuccugugggagcacgugcccgccuggagcguggugcuguucuucagagcccagagacugaaccagaaccuggcccccgccggcaugaucaacagccacagcuacagcagcagagccuacuucuucgacaaccccagaagauacgacagcgacgacgaccugcccagacugggcagcagcagagagggcagccugcccaacagccagagccugggcugguacggcaccaugaccggcugcggcagcagcagcuacaccgugaccccccaccugaacggccccaugaccgacaccgccccccugcuguucaccugcagcaaccuggaccugaacaaccaccacagccuguacgugaccccccagaacuaa

SEQ ID NO: 17695 - RNA, 1062 nt, Artificial Sequence
  GPR139__Homo_sapiens__NP_001002911
auggagcacacccacgcccaccuggccgccaacagcagccugagcugguggagccccggcagcgccugcggccugggcuucgugcccgugguguacuacagccugcugcugugccugggccugcccgccaacauccugaccgugaucauccugagccagcugguggccagaagacagaagagcagcuacaacuaccugcuggcccuggccgccgccgacauccuggugcuguucuucaucguguucguggacuuccugcuggaggacuucauccugaacaugcagaugccccaggugcccgacaagaucaucgaggugcuggaguucagcagcauccacaccagcaucuggaucaccgugccccugaccaucgacagauacaucgccgugugccacccccugaaguaccacaccgugagcuaccccgccagaaccagaaaggugaucgugagcguguacaucaccugcuuccugaccagcauccccuacuacugguggcccaacaucuggaccgaggacuacaucagcaccagcgugcaccacgugcugaucuggauccacugcuucaccguguaccuggugcccugcagcaucuucuucauccugaacagcaucaucguguacaagcugagaagaaagagcaacuucagacugagaggcuacagcaccggcaagaccaccgccauccuguucaccaucaccagcaucuucgccacccugugggcccccagaaucaucaugauccuguaccaccuguacggcgcccccauccagaacagauggcuggugcacaucaugagcgacaucgccaacaugcuggcccugcugaacaccgccaucaacuucuuccuguacugcuucaucagcaagagauucagaaccauggccgccgccacccugaaggccuucuucaagugccagaagcagcccgugcaguucuacaccaaccacaacuucagcaucaccagcagccccuggaucagccccgccaacagccacugcaucaagaugcugguguaccaguacgacaagaacggcaagcccaucaaggugagccccuaa

SEQ ID NO: 17696 - RNA, 1215 nt, Artificial Sequence
  GPR143__Homo_sapiens__NP_000264
auggccagccccagacugggcaccuucugcugccccaccagagacgccgccacccagcuggugcugagcuuccagcccagagccuuccacgcccugugccugggcagcggcggccugagacuggcccugggccugcugcagcugcugcccggcagaagacccgccggccccggcagccccgccaccagcccccccgccagcgugagaauccugagagccgccgccgccugcgaccugcugggcugccugggcauggugaucagaagcaccguguggcugggcuuccccaacuucguggacagcgugagcgacaugaaccacaccgagaucuggcccgccgccuucugcgugggcagcgccauguggauccagcugcuguacagcgccugcuucugguggcuguucugcuacgccguggacgccuaccuggugaucagaagaagcgccggccugagcaccauccugcuguaccacaucauggccuggggccuggccacccugcugugcguggagggcgccgccaugcuguacuaccccagcgugagcagaugcgagagaggccuggaccacgccaucccccacuacgugaccauguaccugccccugcugcuggugcugguggccaaccccauccuguuccagaagaccgugaccgccguggccagccugcugaagggcagacagggcaucuacaccgagaacgagagaagaaugggcgccgugaucaagaucagauucuucaagaucaugcuggugcugaucaucugcuggcugagcaacaucaucaacgagagccugcuguucuaccuggagaugcagaccgacaucaacggcggcagccugaagcccgugagaaccgccgccaagaccaccugguucaucaugggcauccugaaccccgcccagggcuuccugcugagccuggccuucuacggcuggaccggcugcagccugggcuuccagagccccagaaaggagauccagugggagagccugaccaccagcgccgccgagggcgcccaccccagcccccugaugccccacgagaaccccgccagcggcaaggugagccaggugggcggccagaccagcgacgaggcccugagcaugcugagcgagggcagcgacgccagcaccaucgagauccacaccgccagcgagagcugcaacaagaacgagggcgaccccgcccugcccacccacggcgaccuguaa

SEQ ID NO: 17697 - RNA, 1044 nt, Artificial Sequence
  GPR148__Homo_sapiens__NP_997247
augggcgacgagcuggcccccugccccgugggcaccaccgccuggcccgcccugauccagcugaucagcaagacccccugcaugccccaggccgccagcaacaccagccugggccugggcgaccugagagugcccagcagcaugcuguacuggcuguuccugcccagcagccugcuggccgccgccacccuggccgugagcccccugcugcuggugaccauccugagaaaccagagacugagacaggagccccacuaccugcugcccgccaacauccugcugagcgaccuggccuacauccugcugcacaugcugaucagcagcagcagccugggcggcugggagcugggcagaauggccugcggcauccugaccgacgccguguucgccgccugcaccagcaccauccugagcuucaccgccaucgugcugcacaccuaccuggccgugauccacccccugagauaccugagcuucaugagccacggcgccgccuggaaggccguggcccugaucuggcugguggccugcugcuuccccaccuuccugaucuggcugagcaaguggcaggacgcccagcuggaggagcagggcgccagcuacauccugccccccagcaugggcacccagcccggcugcggccugcuggugaucgugaccuacaccagcauccugugcgugcuguuccugugcaccgcccugaucgccaacugcuucuggagaaucuacgccgaggccaagaccagcggcaucuggggccagggcuacagcagagccagaggcacccugcugauccacagcgugcugaucacccuguacgugagcaccggcgugguguucagccuggacauggugcugaccagauaccaccacaucgacagcggcacccacaccuggcugcuggccgccaacagcgaggugcugaugaugcugcccagagccaugcugaccuaccuguaccugcugagauacagacagcugcugggcauggugagaggccaccugcccagcagaagacaccaggccaucuucaccaucagcuaa

SEQ ID NO: 17698 - RNA, 2196 nt, Artificial Sequence
  GPR149__Homo_sapiens__NP_001033794
augagccuguuccugagcaaccugagcaccaacgacagcagccuguggaaggagaaccacaacagcaccgaccugcugaacccccccggcacccugaacaucuaccuguucugccugaccugccugaugaccuucgccgcccuggugggcagcaucuacagccugaucagccugcugaagaugcagaacagaaccguggugagcaugcugguggccagcuggagcguggacgaccugaugagcgugcugagcgugaccaucuucauguuccugcaguggcccaacgaggugcccggcuacuuccaguuccugugcaccaccagcgcccugauguaccugugccagggccugagcagcaaccugaaggccacccugcuggugagcuacaacuucuacaccaugcacagaggcgugggcagccagaccgccagcagaagaagcggccaggugcugggcguggugcugaccgugugggccgccagccugcugcugagcgcccugccccugugcggcuggggcgccuucgugagaacccccuggggcugccugguggacugcagcagcagcuacgugcuguuccugagcaucguguacgcccuggccuucggccugcuggugggccugagcgugccccugacccacagacugcugugcagcgaggagccccccagacugcacagcaacuaccaggagaucagcagaggcgccagcauccccggcaccccccccaccgccggcagaguggugagccugagccccgaggacgcccccggccccagccugagaagaagcggcggcugcagccccagcagcgacaccguguucggccccggcgcccccgccgccgccggcgccgaggccugcagaagagagaacagaggcacccuguacggcaccagaagcuucaccgugagcguggcccagaagagauucgcccugauccuggcccugaccaagguggugcuguggcugcccaugaugaugcacaugguggugcagaacguggugggcuuccagagccugccccuggagaccuucagcuuccugcugacccugcuggccaccaccgugacccccguguucgugcugagcaagagauggacccaccugcccugcggcugcaucaucaacugcagacagaacgccuacgccguggccagcgacggcaagaagaucaagagaaagggcuucgaguucaaccugagcuuccagaagagcuacggcaucuacaagaucgcccacgaggacuacuacgacgacgacgagaacagcaucuucuaccacaaccugaugaacagcgagugcgagaccaccaaggacccccagagagacaacagaaacaucuucaacgccaucaagguggagaucagcaccacccccagccuggacagcagcacccagagaggcaucaacaagugcaccaacaccgacaucaccgaggccaagcaggacagcaacaacaagaaggacgccuucagcgacaagaccggcggcgacaucaacuacgaggagaccaccuucagcgagggccccgagagaagacugagccacgaggagagccagaagcccgaccugagcgacugggaguggugcagaagcaagagcgagagaacccccagacagagaagcggcuacgcccuggccaucccccugugcgccuuccagggcaccgugagccugcacgcccccaccggcaagacccugagccugagcaccuacgaggugagcgccgagggccagaagaucacccccgccagcaagaagaucgagguguacagaagcaagagcgugggccacgagcccaacagcgaggacagcagcagcaccuucguggacaccagcgugaagauccaccuggaggugcuggagaucugcgacaacgaggaggcccuggacaccgugagcaucaucagcaacaucagccagagcagcacccaggugagaagccccagccugagauacagcagaaaggagaacagauucgugagcugcgaccugggcgagaccgccagcuacagccuguuccugcccaccagcaaccccgacggcgacaucaacaucagcauccccgacaccguggaggcccacagacagaacagcaagagacagcaccaggagagagacggcuaccaggaggagauccagcugcugaacaaggccuacagaaagagagaggaggagagcaagggcagcuaa

SEQ ID NO: 17699 - RNA, 1305 nt, Artificial Sequence
  GPR150__Homo_sapiens__NP_954713
auggaggaccuguucagccccagcauccugccccccgcccccaacaucagcgugcccauccugcugggcuggggccugaaccugacccugggccagggcgcccccgccagcggcccccccagcagaagagugagacugguguuccugggcgugauccuggugguggccguggccggcaacaccaccgugcugugcagacugugcggcggcggcggccccugggccggccccaagagaagaaagauggacuuccugcuggugcagcuggcccuggccgaccuguacgccugcggcggcaccgcccugagccagcuggccugggagcugcugggcgagcccagagccgccaccggcgaccuggccugcagauuccugcagcugcugcaggccagcggcagaggcgccagcgcccaccugguggugcugaucgcccuggagagaagaagagccgugagacugccccacggcagaccccugcccgccagagcccuggccgcccugggcuggcugcuggcccugcugcuggcccugccccccgccuucguggugagaggcgacagccccagcccccugccccccccccccccccccaccagccugcagcccggcgccccccccgccgccagagccuggcccggcgagagaagaugccacggcaucuucgccccccugcccagauggcaccugcagguguacgccuucuacgaggccguggccggcuucguggcccccgugaccgugcugggcguggccugcggccaccugcugagcgugugguggagacacagaccccaggcccccgccgccgccgcccccuggagcgccagccccggcagagcccccgcccccagcgcccugcccagagccaaggugcagagccugaagaugagccugcugcuggcccugcuguucgugggcugcgagcugcccuacuucgccgccagacuggccgccgccuggagcagcggccccgccggcgacugggagggcgagggccugagcgccgcccugagagugguggccauggccaacagcgcccugaaccccuucguguaccuguucuuccaggccggcgacugcagacugagaagacagcugagaaagagacugggcagccugugcugcgccccccagggcggcgccgaggacgaggagggccccagaggccaccaggcccuguacagacagagauggccccacccccacuaccaccacgccagaagagagccccuggacgagggcggccugagaccccccccccccagacccagaccccugcccugcagcugcgagagcgccuucuaa

SEQ ID NO: 17700 - RNA, 1260 nt, Artificial Sequence
  GPR151__Homo_sapiens__NP_919227
augcuggccgccgccuucgccgacagcaacagcagcagcaugaacgugagcuucgcccaccugcacuucgccggcggcuaccugcccagcgacagccaggacuggagaaccaucauccccgcccugcugguggccgugugccuggugggcuucgugggcaaccugugcgugaucggcauccugcugcacaacgccuggaagggcaagcccagcaugauccacagccugauccugaaccugagccuggccgaccugagccugcugcuguucagcgcccccaucagagccaccgccuacagcaagagcgugugggaccugggcugguucgugugcaagagcagcgacugguucauccacaccugcauggccgccaagagccugaccaucguggugguggccaaggugugcuucauguacgccagcgaccccgccaagcaggugagcauccacaacuacaccaucuggagcgugcugguggccaucuggaccguggccagccugcugccccugcccgagugguucuucagcaccaucagacaccacgagggcguggagaugugccugguggacgugcccgccguggccgaggaguucaugagcauguucggcaagcuguacccccugcuggccuucggccugccccuguucuucgccagcuucuacuucuggagagccuacgaccagugcaagaagagaggcaccaagacccagaaccugagaaaccagaucagaagcaagcaggugaccgugaugcugcugagcaucgccaucaucagcgcccugcuguggcugcccgaguggguggccuggcuguggguguggcaccugaaggccgccggccccgcccccccccagggcuucaucgcccugagccaggugcugauguucagcaucagcagcgccaacccccugaucuuccuggugaugagcgaggaguucagagagggccugaagggcguguggaaguggaugaucaccaagaagccccccaccgugagcgagagccaggagacccccgccggcaacagcgagggccugcccgacaaggugcccagccccgagagccccgccagcauccccgagaaggagaagcccagcagccccagcagcggcaagggcaagaccgagaaggccgagauccccauccugcccgacguggagcaguucuggcacgagagagacaccgugcccagcgugcaggacaacgaccccauccccugggagcacgaggaccaggagaccggcgagggcgugaaguaa

SEQ ID NO: 17701 - RNA, 1413 nt, Artificial Sequence
  GPR152__Homo_sapiens__NP_996880
auggacaccaccauggaggccgaccugggcgccaccggccacagacccagaaccgagcuggacgacgaggacagcuacccccagggcggcugggacaccguguuccugguggcccugcugcugcugggccugcccgccaacggccugauggccuggcuggccggcagccaggccagacacggcgccggcaccagacuggcccugcugcugcugagccuggcccugagcgacuuccuguuccuggccgccgccgccuuccagauccuggagaucagacacggcggccacuggccccugggcaccgccgccugcagauucuacuacuuccuguggggcgugagcuacagcagcggccuguuccugcuggccgcccugagccuggacagaugccugcuggcccugugcccccacugguaccccggccacagacccgugagacugccccugugggugugcgccggcgugugggugcuggccacccuguucagcgugcccuggcugguguuccccgaggccgccguguggugguacgaccuggugaucugccuggacuucugggacagcgaggagcugagccugagaaugcuggaggugcugggcggcuuccugcccuuccugcugcugcuggugugccacgugcugacccaggccaccgccugcagaaccugccacagacagcagcagcccgccgccugcagaggcuucgccagaguggccagaaccauccugagcgccuacguggugcugagacugcccuaccagcuggcccagcugcuguaccuggccuuccugugggacguguacagcggcuaccugcugugggaggcccugguguacagcgacuaccugauccugcugaacagcugccugagccccuuccugugccugauggccagcgccgaccugagaacccugcugagaagcgugcugagcagcuucgccgccgcccugugcgaggagagacccggcagcuucacccccaccgagccccagacccagcuggacagcgagggccccacccugcccgagcccauggccgaggcccagagccagauggaccccguggcccagccccaggugaaccccacccugcagcccagaagcgaccccaccgcccagccccagcugaaccccaccgcccagccccagagcgaccccaccgcccagccccagcugaaccugauggcccagccccagagcgacagcguggcccagccccaggccgacaccaacgugcagacccccgcccccgccgccagcagcgugcccagccccugcgacgaggccagccccacccccagcagccaccccacccccggcgcccuggaggaccccgccaccccccccgccagcgagggcgagagccccagcagcaccccccccgaggccgcccccggcgccggccccaccuaa

SEQ ID NO: 17702 - RNA, 1830 nt, Artificial Sequence
  GPR153__Homo_sapiens__XP_011539736
augagcgacgagagaagacugcccggcagcgccgugggcuggcuggugugcggcggccugagccugcuggccaacgccuggggcauccugagcgugggcgccaagcagaagaaguggaagccccuggaguuccugcugugcacccuggccgccacccacaugcugaacguggccgugcccaucgccaccuacagcguggugcagcugagaagacagagacccgacuucgaguggaacgagggccugugcaagguguucgugagcaccuucuacacccugacccuggccaccugcuucagcgugaccagccugagcuaccacagaauguggauggugugcuggcccgugaacuacagacugagcaacgccaagaagcaggccgugcacaccgugaugggcaucuggauggugagcuucauccugagcgcccugcccgccgugggcuggcacgacaccagcgagagauucuacacccacggcugcagauucaucguggccgagaucggccugggcuucggcgugugcuuccugcugcuggugggcggcagcguggccaugggcgugaucugcaccgccaucgcccuguuccagacccuggccgugcaggugggcagacaggccgacagaagagccuucaccgugcccaccaucgugguggaggacgcccagggcaagagaagaagcagcaucgacggcagcgagcccgccaagaccagccugcagaccaccggccuggugaccaccaucguguucaucuacgacugccugaugggcuuccccgugcugguggugagcuucagcagccugagagccgacgccagcgcccccuggauggcccugugcgugcuguggugcagcguggcccaggcccugcugcugcccguguuccugugggccugcgacagauacagagccgaccugaaggccgugagagagaagugcauggcccugauggccaacgacgaggagagcgacgacgagaccagccuggagggcggcaucagccccgaccuggugcuggagagaagccuggacuacggcuacggcggcgacuucguggcccuggacagaauggccaaguacgagaucagcgcccuggagggcggccugccccagcuguacccccugagaccccugcaggaggacaagaugcaguaccugcaggugccccccaccagaagauucagccacgacgacgccgacgugugggccgccgugccccugcccgccuuccugcccagauggggcagcggcgaggaccuggccgcccuggcccaccuggugcugcccgccggccccgagagaagaagagccagccugcuggccuucgccgaggacgccccccccagcagagccagaagaagaagcgccgagagccugcugagccugagacccagcgcccuggacagcggccccagaggcgccagagacagcccccccggcagccccagaagaagacccggccccggccccagaagcgccagcgccagccugcugcccgacgccuucgcccugaccgccuucgagugcgagccccaggcccugagaagaccccccggccccuuccccgccgcccccgccgcccccgacggcgccgaccccggcgaggcccccaccccccccagcagcgcccagagaagccccggccccagacccagcgcccacagccacgccggcagccugagacccggccugagcgccagcuggggcgagcccggcggccugagagccgccggcggcggcggcagcaccagcagcuuccugagcagccccagcgagagcagcggcuacgccacccugcacagcgacagccugggcagcgccagcuaa

SEQ ID NO: 17703 - RNA, 2529 nt, Artificial Sequence
  GPR155__Homo_sapiens__NP_001253980
augaacagcaaccugcccgccgagaaccugaccaucgccgugaacaugaccaagacccugcccaccgccgugacccacggcuucaacagcaccaacgacccccccagcaugagcaucaccagacuguuccccgcccugcuggagugcuucggcaucgugcugugcggcuacaucgccggcagagccaacgugaucaccagcacccaggccaagggccugggcaacuucgugagcagauucgcccugcccgcccugcuguucaagaacaugguggugcugaacuucagcaacguggacuggagcuuccuguacagcauccugaucgccaaggccagcguguucuucaucgugugcgugcugacccugcugguggccagccccgacagcagauucagcaaggccggccuguuccccaucuucgccacccagagcaacgacuucgcccugggcuaccccaucguggaggcccuguaccagaccaccuaccccgaguaccugcaguacaucuaccugguggcccccaucagccugaugaugcugaaccccaucggcuucaucuucugcgagauccagaaguggaaggacacccagaacgccagccagaacaagaucaagaucgugggccugggccugcugagagugcugcagaaccccaucguguucaugguguucaucggcaucgccuucaacuucauccuggacagaaaggugcccguguacguggagaacuuccuggacggccugggcaacagcuucagcggcagcgcccuguucuaccugggccugaccauggugggcaagaucaagagacugaagaagagcgccuucguggugcugauccugcugaucaccgccaagcugcuggugcugccccugcugugcagagagaugguggagcugcuggacaagggcgacagcguggugaaccacaccagccugagcaacuacgccuuccuguacggcguguuccccguggcccccggcguggccaucuucgccacccaguucaacauggagguggagaucaucaccagcggcauggugaucagcaccuucgugagcgcccccaucauguacgugagcgccuggcugcugaccuuccccaccauggaccccaagccccuggccuacgccauccagaacgugagcuucgacaucagcaucgugagccugaucagccugagcaucgugugcgccggcaugaugaucuggaacuucgugaaggagaagaacuucgugggccagauccugguguucgugcugcuguacagcagccuguacagcaccuaccuguggaccggccugcuggccaucagccuguuccugcugaagaagagagagagagugcagauccccgugggcaucaucaucaucagcggcuggggcauccccgcccugcuggugggcgugcugcugaucaccggcaagcacaacggcgacagcaucgacagcgccuucuucuacggcaaggagcagaugaucaccaccgccgugacccuguucugcagcauccugaucgccggcaucagccugaugugcaugaaccagaccgcccaggccggcagcuacgagggcuucgaccagagccagagccacaaggugguggagcccggcaacaccgccuucgaggagagccccgcccccgugaacgagcccgagcuguucaccagcagcauccccgagaccagcugcugcagcugcagcaugggcaacggcgagcugcacugccccagcaucgagcccaucgccaacaccagcaccagcgagcccgugauccccagcuucgagaagaacaaccacugcgugagcagaugcaacagccagagcugcauccuggcccaggaggaggagcaguaccugcagagcggcgaccagcagcugaccagacacgugcugcugugccugcugcugaucaucggccuguucgccaaccugagcagcugccugugguggcuguucaaccaggagcccggcagacuguacguggagcugcaguucuucugcgccguguucaacuucggccagggcuucaucagcuucggcaucuucggccuggacaagcaccugaucauccugcccuucaagagaagacuggaguuccuguggaacaacaaggacaccgccgagaacagagacagccccgugagcgaggagaucaagaugaccugccagcaguucauccacuaccacagagaccugugcaucagaaacaucgugaaggagagaagaugcggcgccaagaccagcgccggcaccuucugcggcugcgaccuggugagcuggcugaucgaggugggccuggccagcgacagaggcgaggccgugaucuacggcgacagacuggugcagggcggcgugauccagcacaucaccaacgaguacgaguucagagacgaguaccuguucuacagauuccugcagaagagccccgagcagagcccccccgccaucaacgccaacacccugcagcaggagagauacaaggagaucgagcacagcagcccccccagccacagccccaagaccuaa

SEQ ID NO: 17704 - RNA, 2433 nt, Artificial Sequence
  GPR156__Homo_sapiens__NP_001161743
auggagcccgagaucaacugcagcgagcugugcgacagcuuccccggccaggagcuggacagaagaccccugcacgaccugugcaagaccaccaucaccagcagccaccacagcagcaagaccaucagcagccugagccccgugcugcugggcaucguguggaccuuccugagcugcggccugcugcugauccuguucuuccuggccuucaccauccacugcagaaagaacagaaucgugaagaugagcagccccaaccugaacaucgugacccugcugggcagcugccugaccuacagcagcgccuaccuguucggcauccaggacgugcuggugggcagcagcauggagacccugauccagaccagacugagcaugcugugcaucggcaccagccugguguucggccccauccugggcaagagcuggagacuguacaagguguucacccagagagugcccgacaagagagugaucaucaaggaccugcagcugcugggccugguggccgcccugcugauggccgacgugauccugcugaugaccugggugcugaccgaccccauccagugccugcagauccugagcgugaccggcaaggacgugagcugcaccagcaccagcacccacuucugcgccagcagauacagcgacguguggaucgcccugaucuggggcugcaagggccugcugcugcuguacggcgccuaccuggccggccugaccggccacgugagcagcccccccgugaaccagagccugaccaucauggugggcgugaaccugcuggugcuggccgccggccugcuguucguggugaccagauaccugcacagcuggcccaaccugguguucggccugaccagcggcggcaucuucgugugcaccaccaccaucaacugcuucaucuucaucccccagcugaagcaguggaaggccuucgaggaggagaaccagaccaucagaagaauggccaaguacuucagcacccccaacaagagcuuccacacccaguacggcgaggaggagaacugccaccccagaggcgagaagagcagcauggagagacugcugaccgagaagaacgccgugaucgagagccugcaggagcaggugaacaacgccaaggagaagaucgugagacugaugagcgccgagugcaccuacgaccugcccgagggcgccgccccccccgccagcagccccaacaaggacgugcaggccguggccagcgugcacacccuggccgccgcccagggccccagcggccaccugagcgacuuccagaacgaccccggcauggccgccagagacagccagugcaccagcggccccagcagcuacgcccagagccuggagggccccggcaaggacagcagcuucagccccggcaaggaggagaagaucagcgacagcaaggacuucagcgaccaccuggacagcggcugcagccagaagcccuggaccgagcagagccugggccccgagagaggcgaccaggugcccaugaaccccagccagagccugcugcccgagagaggcggcagcgacccccagagacagagacaccuggagaacagcgaggagccccccgagagaagaagcagagugagcagcgugaucagagagaagcugcaggaggugcugcaggaccugggccugggccccgaggccagccugagcaccgcccccagcugccaccagcagaccuggaagaacagcgccgccuucagcccccagaagaugccccugagcaaggagcugggcuucagccccuacauggugagaagaagaagagccgcccagagagccagaagccacuuccccggcagcgcccccagcagcgugggccacagagccaacagaaccgugcccggcgcccacagcagacugcacgugcagaacggcgacagccccagccuggccccccagaccaccgacagcagagugagaagacccagcagcagaaagcccagccugcccagcgacccccaggacagacccggcacccuggagggcagcaagcagagccagaccgagcccgagggcgccagaggcagcaaggccgccuuccugagacagcccagcggcagcggcagagcccccagccccgccgcccccugccugagcaaggccagccccgaccugcccgagcaguggcagcuguggccccccgugcccagcggcugcgccagccugagcagccagcacagcuacuucgacaccgagagcagcagcagcgacgaguucuucugcagaugccacagacccuacugcgagaucugcuuccagagcagcagcgacagcagcgacagcggcaccagcgacaccgaccccgagcccaccggcggccuggccagcugggagaagcugugggccagaagcaagcccaucgugaacuucaaggacgaccugaagcccacccugguguaa

SEQ ID NO: 17705 - RNA, 3648 nt, Artificial Sequence
  GPR158__Homo_sapiens__NP_065803
augggcgccauggccuacccccugcugcugugccugcugcuggcccagcugggccugggcgccgugggcgccagcagagacccccagggcagacccgacagccccagagagagaacccccaagggcaagccccacgcccagcagcccggcagagccagcgccagcgacagcagcgcccccuggagcagaagcaccgacggcaccauccuggcccagaagcuggccgaggaggugcccauggacguggccagcuaccuguacaccggcgacagccaccagcugaagagagccaacugcagcggcagauacgagcuggccggccugcccggcaaguggcccgcccuggccagcgcccaccccagccugcacagagcccuggacacccugacccacgccaccaacuuccugaacgugaugcugcagagcaacaagagcagagagcagaaccugcaggacgaccuggacugguaccaggcccugguguggagccugcuggagggcgagcccagcaucagcagagccgccaucaccuucagcaccgacagccugagcgcccccgccccccagguguuccugcaggccaccagagaggagagcagaauccugcugcaggaccugagcagcagcgccccccaccuggccaacgccacccuggagaccgagugguuccacggccugagaagaaaguggagaccccaccugcacagaagaggccccaaccagggccccagaggccugggccacagcuggagaagaaaggacggccugggcggcgacaagagccacuucaaguggagcccccccuaccuggagugcgagaacggcagcuacaagcccggcuggcuggugacccugagcagcgccaucuacggccugcagcccaaccuggugcccgaguucagaggcgugaugaagguggacaucaaccugcagaagguggacaucgaccagugcagcagcgacggcugguucagcggcacccacaagugccaccugaacaacagcgagugcaugcccaucaagggccugggcuucgugcugggcgccuacgagugcaucugcaaggccggcuucuaccaccccggcgugcugcccgugaacaacuucagaagaagaggccccgaccagcacaucagcggcagcaccaaggacgugagcgaggaggccuacgugugccugcccugcagagagggcugccccuucugcgccgacgacagccccugcuucgugcaggaggacaaguaccugagacuggccaucaucagcuuccaggcccugugcaugcugcuggacuucgugagcaugcuggugguguaccacuucagaaaggccaagagcaucagagccagcggccugauccugcuggagaccauccuguucggcagccugcugcuguacuuccccguggugauccuguacuucgagcccagcaccuucagaugcauccugcugagaugggccagacugcugggcuucgccaccguguacggcaccgugacccugaagcugcacagagugcugaagguguuccugagcagaaccgcccagagaauccccuacaugaccggcggcagagugaugagaaugcuggccgugauccugcuggugguguucugguuccugaucggcuggaccagcagcgugugccagaaccuggagaagcagaucagccugaucggccagggcaagaccagcgaccaccugaucuucaacaugugccugaucgacagaugggacuacaugaccgccguggccgaguuccuguuccugcuguggggcguguaccugugcuacgccgugagaaccgugcccagcgccuuccacgagcccagauacauggccguggccgugcacaacgagcugaucaucagcgccaucuuccacaccaucagauucgugcuggccagcagacugcagagcgacuggaugcugaugcuguacuucgcccacacccaccugaccgugaccgugaccaucggccugcugcugauccccaaguucagccacagcagcaacaaccccagagacgacaucgccaccgaggccuacgaggacgagcuggacaugggcagaagcggcagcuaccugaacagcagcaucaacagcgccuggagcgagcacagccuggaccccgaggacaucagagacgagcugaagaagcuguacgcccagcuggagaucuacaagagaaagaagaugaucaccaacaacccccaccugcagaagaagagaugcagcaagaagggccugggcagaagcaucaugagaagaaucaccgagauccccgagaccgugagcagacagugcagcaaggaggacaaggagggcgccgaccacggcaccgccaagggcaccgcccugaucagaaagaacccccccgagagcagcggcaacaccggcaagagcaaggaggagacccugaagaacagaguguucagccugaagaagagccacagcaccuacgaccacgugagagaccagaccgaggagagcagcagccugcccaccgagagccaggaggaggagaccaccgagaacagcacccuggagagccugagcggcaagaagcugacccagaagcugaaggaggacagcgaggccgagagcaccgagagcgugccccuggugugcaagagcgccagcgcccacaaccugagcagcgagaagaagaccggccaccccagaaccagcaugcugcagaagagccugagcgugaucgccagcgccaaggagaagacccugggccuggccggcaagacccagaccgccggcguggaggagagaaccaagagccagaagccccugcccaaggacaaggagaccaacagaaaccacagcaacagcgacaacaccgagaccaaggaccccgccccccagaacagcaaccccgccgaggagcccagaaagccccagaagagcggcaucaugaagcagcagagagugaaccccaccaccgccaacagcgaccugaaccccggcaccacccagaugaaggacaacuucgacaucggcgaggugugccccugggagguguacgaccugacccccggccccgugcccagcgagagcaaggugcagaagcacgugagcaucguggccagcgagauggagaagaaccccaccuucagccugaaggagaagagccaccacaagcccaaggccgccgaggugugccagcagagcaaccagaagagaaucgacaaggccgaggugugccugugggagagccagggccagagcauccuggaggacgagaagcugcugaucagcaagacccccgugcugcccgagagagccaaggaggagaacggcggccagcccagagccgccaacgugugcgccggccagagcgaggagcugccccccaaggccguggccagcaagaccgagaacgagaaccugaaccagaucggccaccaggagaagaagaccagcagcagcgaggagaacgugagaggcagcuacaacagcagcaacaacuuccagcagccccugaccagcagagccgaggugugccccugggaguucgagacccccgcccagcccaacgccggcagaagcguggcccugcccgccagcagcgcccugagcgccaacaagaucgccggccccagaaaggaggagaucugggacagcuucaagguguaa

SEQ ID NO: 17706 - RNA, 1083 nt, Artificial Sequence
  GPR15__Homo_sapiens__NP_005281
auggaccccgaggagaccagcguguaccuggacuacuacuacgccaccagccccaacagcgacaucagagagacccacagccacgugcccuacaccagcguguuccugcccguguucuacaccgccguguuccugaccggcgugcugggcaaccuggugcugaugggcgcccugcacuucaagcccggcagcagaagacugaucgacaucuucaucaucaaccuggccgccagcgacuucaucuuccuggugacccugccccuguggguggacaaggaggccagccugggccuguggagaaccggcagcuuccugugcaagggcagcagcuacaugaucagcgugaacaugcacugcagcgugcugcugcugaccugcaugagcguggacagauaccuggccaucguguggcccguggugagcagaaaguucagaagaaccgacugcgccuacguggugugcgccagcaucugguucaucagcugccugcugggccugcccacccugcugagcagagagcugacccugaucgacgacaagcccuacugcgccgagaagaaggccacccccaucaagcugaucuggagccugguggcccugaucuucaccuucuucgugccccugcugagcaucgugaccugcuacugcugcaucgccagaaagcugugcgcccacuaccagcagagcggcaagcacaacaagaagcugaagaagagcaucaagaucaucuucaucgugguggccgccuuccuggugagcuggcugcccuucaacaccuucaaguuccuggccaucgugagcggccugagacaggagcacuaccugcccagcgccauccugcagcugggcauggaggugagcggcccccuggccuucgccaacagcugcgugaaccccuucaucuacuacaucuucgacagcuacaucagaagagccaucgugcacugccugugccccugccugaagaacuacgacuucggcagcagcaccgagaccagcgacagccaccugaccaaggcccugagcaccuucauccacgccgaggacuucgccagaagaagaaagagaagcgugagccuguaa

SEQ ID NO: 17707 - RNA, 1017 nt, Artificial Sequence
  GPR160__Homo_sapiens__NP_055188
augaccgcccugagcagcgagaacugcagcuuccaguaccagcugagacagaccaaccagccccuggacgugaacuaccugcuguuccugaucauccugggcaagauccugcugaacauccugacccugggcaugagaagaaagaacaccugccagaacuucauggaguacuucugcaucagccuggccuucguggaccugcugcugcuggugaacaucagcaucauccuguacuucagagacuucgugcugcugagcaucagauucaccaaguaccacaucugccuguucacccagaucaucagcuucaccuacggcuuccugcacuaccccguguuccugaccgccugcaucgacuacugccugaacuucagcaagaccaccaagcugagcuucaagugccagaagcuguucuacuucuucaccgugauccugaucuggaucagcgugcuggccuacgugcugggcgaccccgccaucuaccagagccugaaggcccagaacgccuacagcagacacugccccuucuacgugagcauccagagcuacuggcugagcuucuucauggugaugauccuguucguggccuucaucaccugcugggaggaggugaccacccuggugcaggccaucagaaucaccagcuacaugaacgagaccauccuguacuuccccuucagcagccacagcagcuacaccgugagaagcaagaagaucuuccugagcaagcugaucgugugcuuccugagcaccuggcugcccuucgugcugcugcaggugaucaucgugcugcugaaggugcagauccccgccuacaucgagaugaacauccccuggcuguacuucgugaacagcuuccugaucgccaccguguacugguucaacugccacaagcugaaccugaaggacaucggccugccccuggaccccuucgugaacuggaagugcugcuucaucccccugaccauccccaaccuggagcagaucgagaagcccaucagcaucaugaucugcuaa

SEQ ID NO: 17708 - RNA, 1641 nt, Artificial Sequence
  GPR161__Homo_sapiens__NP_001254540
augaagguggugcagcacgcccugcccacccccagaagaggcgcccugaccaugagccugaacagcagccugagcugcagaaaggagcugagcaaccugaccgaggaggagggcggcgagggcggcgugaucaucacccaguucaucgccaucaucgugaucaccaucuucgugugccugggcaaccuggugaucguggugacccuguacaagaagagcuaccugcugacccugagcaacaaguucguguucagccugacccugagcaacuuccugcugagcgugcuggugcugcccuucguggugaccagcagcaucagaagagaguggaucuucggcgugguguggugcaacuucagcgcccugcuguaccugcugaucagcagcgccagcaugcugacccugggcgugaucgccaucgacagauacuacgccgugcuguaccccaugguguaccccaugaagaucaccggcaacagagccgugauggcccugguguacaucuggcugcacagccugaucggcugccugcccccccuguucggcuggagcagcguggaguucgacgaguucaaguggaugugcguggccgccuggcacagagagcccggcuacaccgccuucuggcagaucuggugcgcccuguuccccuuccuggugaugcuggugugcuacggcuucaucuucagaguggccagagugaaggccagaaaggugcacugcggcaccguggugaucguggaggaggacgcccagagaaccggcagaaagaacagcagcaccagcaccagcagcagcggcagcagaagaaacgccuuccagggcgugguguacagcgccaaccagugcaaggcccugaucaccauccugguggugcugggcgccuucauggugaccuggggccccuacaugguggugaucgccagcgaggcccuguggggcaagagcagcgugagccccagccuggagaccugggccaccuggcugagcuucgccagcgccgugugccacccccugaucuacggccuguggaacaagaccgugagaaaggagcugcugggcaugugcuucggcgacagauacuacagagagcccuucgugcagagacagagaaccagcagacuguucagcaucagcaacagaaucaccgaccugggccugagcccccaccugaccgcccugauggccggcggccagccccugggccacagcagcagcaccggcgacaccggcuucagcugcagccaggacagcggcaccgacaugaugcugcuggaggacuacaccagcgacgacaacccccccagccacugcaccugcccccccaagagaagaagcagcgugaccuucgaggacgagguggagcagaucaaggaggccgccaagaacagcauccugcacgugaaggccgaggugcacaagagccuggacagcuacgccgccagccuggccaaggccaucgaggccgaggccaagaucaaccuguucggcgaggaggcccugcccggcgugcuggugaccgccagaaccgugcccggcggcggcuucggcggcagaagaggcagcagaacccuggugagccagagacugcagcugcagagcaucgaggagggcgacgugcuggccgccgagcagagauaa

SEQ ID NO: 17709 - RNA, 915 nt, Artificial Sequence
  GPR162__Homo_sapiens__NP_055264
augcugagcaccggcguggugagcuucuucagccugaagagcgacagcgccccccccuggauggugcuggccgugcuguggugcagcauggcccagacccugcugcugcccagcuucaucuggagcugcgagagauacagagccgacgugagaaccgugugggagcagugcguggccaucaugagcgaggaggacggcgacgacgacggcggcugcgacgacuacgccgagggcagagugugcaaggugagauucgacgccaacggcgccaccggccccggcagcagagaccccgcccaggugaagcugcugcccggcagacacaugcuguuccccccccuggagagagugcacuaccugcaggugccccugagcagaagacugagccacgacgagaccaacaucuucagcacccccagagagcccggcagcuuccugcacaaguggagcagcagcgacgacaucagagugcugcccgcccagagcagagcccugggcggcccccccgaguaccugggccagagacacagacuggaggacgaggaggacgaggaggaggccgagggcggcggccuggccagccugagacaguuccuggagagcggcgugcugggcagcggcggcggcccccccagaggccccggcuucuucagagaggagaucaccaccuucaucgacgagaccccccugcccagccccaccgccagccccggccacagccccagaagacccagaccccugggccugagccccagaagacugagccugggcagccccgagagcagagccgugggccugccccugggccugagcgccggcagaagaugcagccugaccggcggcgaggagagcgccagagccuggggcggcagcuggggccccggcaaccccaucuucccccagcugacccuguaa

SEQ ID NO: 17710 - RNA, 960 nt, Artificial Sequence
  GPR171__Homo_sapiens__NP_037440
augaccaacagcagcuucuucugccccguguacaaggaccuggagcccuucaccuacuucuucuaccugguguuccuggugggcaucaucggcagcugcuucgccaccugggccuucauccagaagaacaccaaccacagaugcgugagcaucuaccugaucaaccugcugaccgccgacuuccugcugacccuggcccugcccgugaagaucgugguggaccugggcguggcccccuggaagcugaagaucuuccacugccaggugaccgccugccugaucuacaucaacauguaccugagcaucaucuuccuggccuucgugagcaucgacagaugccugcagcugacccacagcugcaagaucuacagaauccaggagcccggcuucgccaagaugaucagcaccgugguguggcugauggugcugcugaucauggugcccaacaugaugauccccaucaaggacaucaaggagaagagcaacgugggcugcauggaguucaagaaggaguucggcagaaacuggcaccugcugaccaacuucaucugcguggccaucuuccugaacuucagcgccaucauccugaucagcaacugccuggugaucagacagcuguacagaaacaaggacaacgagaacuaccccaacgugaagaaggcccugaucaacauccugcuggugaccaccggcuacaucaucugcuucgugcccuaccacaucgugagaauccccuacacccugagccagaccgaggugaucaccgacugcagcaccagaaucagccuguucaaggccaaggaggccacccugcugcuggccgugagcaaccugugcuucgaccccauccuguacuaccaccugagcaaggccuucagaagcaaggugaccgagaccuucgccagccccaaggagaccaaggcccagaaggagaagcugagaugcgagaacaacgccuaa

SEQ ID NO: 17711 - RNA, 1002 nt, Artificial Sequence
  GPR174__Homo_sapiens__NP_115942
augcccgccaacuacaccugcaccagacccgacggcgacaacaccgacuucagauacuucaucuacgccgugaccuacaccgugauccuggugcccggccugaucggcaacauccuggcccuguggguguucuacggcuacaugaaggagaccaagagagccgugaucuucaugaucaaccuggccaucgccgaccugcugcaggugcugagccugccccugagaaucuucuacuaccugaaccacgacuggcccuucggccccggccugugcauguucugcuucuaccugaaguacgugaacauguacgccagcaucuacuuccuggugugcaucagcgugagaagauucugguuccugauguaccccuucagauuccacgacugcaagcagaaguacgaccuguacaucagcaucgccggcuggcugaucaucugccuggccugcgugcuguucccccugcugagaaccagcgacgacaccagcggcaacagaaccaagugcuucguggaccugcccaccagaaacgugaaccuggcccagagcguggugaugaugaccaucggcgagcugaucggcuucgugaccccccugcugaucgugcuguacugcaccuggaagaccgugcugagccugcaggacaaguaccccauggcccaggaccugggcgagaagcagaaggcccugaagaugauccugaccugcgccggcguguuccugaucugcuucgcccccuaccacuucagcuucccccuggacuuccuggugaagagcaacgagaucaagagcugccuggccagaagagugauccugaucuuccacagcguggcccugugccuggccagccugaacagcugccuggaccccgugaucuacuacuucagcaccaacgaguucagaagaagacugagcagacaggaccugcacgacagcauccagcugcacgccaagagcuucgugagcaaccacaccgccagcaccaugacccccgagcugugcuaa

SEQ ID NO: 17712 - RNA, 1413 nt, Artificial Sequence
  GPR176__Homo_sapiens__NP_001258784
augcccgccccccugcugcugaucagcagaacccugggcaacuucauggugcuguggagcaccugcagaaccaccguguucaagagcgugaccaacagauucaucaagaaccuggccugcagcggcaucugcgccagccuggugugcgugcccuucgacaucauccugagcaccagcccccacugcugcugguggaucuacaccaugcuguucugcaagguggugaaguuccugcacaagguguucugcagcgugaccauccugagcuuccccgccaucgcccuggacagauacuacagcgugcuguacccccuggagagaaagaucagcgacgccaagagcagagagcuggugauguacaucugggcccacgccgugguggccagcgugcccguguucgccgugaccaacguggccgacaucuacgccaccagcaccugcaccgagguguggagcaacagccugggccaccugguguacgugcugguguacaacaucaccaccgugaucgugcccgugguggugguguuccuguuccugauccugaucagaagagcccugagcgccagccagaagaagaaggugaucaucgccgcccugagaaccccccagaacaccaucagcauccccuacgccagccagagagaggccgagcugcacgccacccugcugagcauggugaugguguucauccugugcagcgugcccuacgccacccuggugguguaccagaccgugcugaacgugcccgacaccagcguguuccugcugcugaccgccguguggcugcccaaggugagccugcuggccaaccccgugcuguuccugaccgugaacaagagcgugagaaagugccugaucggcacccuggugcagcugcaccacagauacagcagaagaaacguggugagcaccggcagcggcauggccgaggccagccuggagcccagcaucagaagcggcagccagcugcuggagauguuccacaucggccagcagcagaucuucaagcccaccgaggacgaggaggagagcgaggccaaguacaucggcagcgccgacuuccaggccaaggagaucuucagcaccugccuggagggcgagcagggcccccaguucgcccccagcgcccccccccugagcaccguggacagcgugagccagguggcccccgccgcccccguggagcccgagaccuuccccgacaaguacagccugcaguucggcuucggccccuucgagcugcccccccaguggcugagcgagaccagaaacagcaagaagagacugcugcccccccugggcaacacccccgaggagcugauccagaccaaggugcccaaggugggcagaguggagagaaagaugagcagaaacaacaaggugagcaucuuccccaagguggacagcuaa

SEQ ID NO: 17713 - RNA, 7104 nt, Artificial Sequence
  GPR179__Homo_sapiens__NP_001004334
augggcaccagaggcgccgugaugcccccccccauguggggccugcugggcugcugcuucgugugcgccugggcccugggcggccccagacccaucagaagccugcccccccugagcagccaggugaagcccggcagcgugcccaugcaggugccccuggagggcgccgaggccgcccuggccuaccuguacagcggcgacgcccagcagcugagccaggugaacugcagcgagagauacgaggccagaggcgccggcgccaugcccggccugccccccagccugcagggcgccgccggcacccuggcccaggccgccaacuuccugaacaugcugcugcaggccaacgacaucagagagagcagcguggaggaggacguggagugguaccaggcccuggugagaagcguggccgagggcgaccccagaguguacagagcccugcugaccuucaaccccccccccggcgccagccaccugcagcuggcccugcaggccaccagaaccggcgaggagaccauccugcaggaccugagcggcaacugggugcaggaggagaacccccccggcgaccuggacacccccgcccugaagaagagagugcugaccaacgaccugggcagccugggcagccccaaguggccccaggccgacggcuacgugggcgacacccagcaggugagacugagcccccccuuccuggagugccaggagggcagacugagacccggcuggcugaucacccugagcgccaccuucuacggccugaagcccgaccugagccccgaggugagaggccaggugcagauggacguggaccugcagagcguggacaucaaccagugcgccagcggccccggcugguacagcaacacccaccugugcgaccugaacagcacccagugcgugccccuggagagccagggcuucgugcugggcagauaccugugcagaugcagacccggcuucuacggcgccagccccagcggcggccuggaggagagcgacuuccagaccaccggccaguucggcuuccccgagggcagaagcggcagacugcugcagugccugcccugccccgagggcugcaccagcugcauggacgccacccccugccugguggaggaggccgccgugcugagagccgccgugcuggccugccaggccugcugcaugcuggccaucuuccugagcaugcuggugagcuacagaugcagaagaaacaagagaaucugggccagcggcguggugcugcuggagaccgugcuguucggcuuccugcugcuguacuuccccguguucauccuguacuucaagcccagcguguucagaugcaucgcccugagaugggugagacugcugggcuucgccaucguguacggcaccaucauccugaagcuguacagagugcugcagcuguuccugagcagaaccgcccagagaagcgcccugcugagcagcggcagacugcugagacaccugggccugcugcugcugcccgugcugggcuuccuggccguguggaccgugggcgcccuggagagaggcauccagcacgccccccuggugaucagaggccacacccccagcggcagacacuucuaccugugccaccacgacagaugggacuacaucauggugguggccgagcugcugcugcugugcuggggcagcuuccugugcuacgccaccagagccgugcugagcgccuuccacgagcccagauacaugggcaucgcccugcacaacgagcugcugcugagcgccgccuuccacaccgccagauucgugcuggugcccagccugcaccccgacuggacccugcugcuguucuucuuccacacccacagcaccgugaccaccacccuggcccugaucuucauccccaaguucuggaagcugggcgccccccccagagaggagaugguggacgaggugugcgaggacgagcuggaccugcagcacagcggcagcuaccugggcagcagcaucgccagcgccuggagcgagcacagccuggaccccggcgacaucagagacgagcugaagaagcuguacgcccagcuggaggugcacaagaccaaggagauggccgccaacaacccccaccugcccaagaagagaggcagcagcugccagggccugggcagaagcuucaugagauaccuggccgaguuccccgaggcccuggccagacagcacagcagagacagcggcagccccggccacggcagccugcccggcagcagcagaagaagacugcugagcagcagccugcaggagcccgagggcacccccgcccugcacaagagcagaagcaccuacgaccagagaagagagcaggaccccccccugcuggacagccugcugagaagaaagcuggccaagaaggccagcagaaccgagagcagagagagcguggagggcccccccgcccugggcuucagaagcgccagcgcccacaaccugaccgugggcgagagacugcccagagccagacccgccagccugcagaagagccugagcguggccagcagcagagagaaggcccugcugauggccagccaggccuaccuggaggagaccuacagacaggccaaggagagagaggagagaaagaaggccaaggccgccauggccagccuggugagaagacccagcgccagaagacuggagagacccagaggcgccccccugagcgccccccccagccccgccaagagcagcagcguggacagcagccacaccagcggcagacugcacgaggaggccagaagaagacugccccacccccccaucagacaccaggugagcacccccauccuggcccugagcggcggccugggcgagcccagaaugcugagccccaccagcacccuggcccccgcccugcugcccgcccuggcccccacccccgcccccgcccuggcccccgugcccgugagcccccagagccccaaccugcugaccuacaucugccccugggagaacgccgagcugcccgccaagcaggagaacgugccccaggagggccccagcggccccgagagaggccaccacagccccgcccccgccagagccagacuguggagagcccugagcguggccguggagaagagcagagccggcgagaacgagauggacgccgaggacgcccaccaccagagagaggccaacgacguggacgaggacagacccaagaucuuccccaagagccacagccugaaggcccccgugcagcagggcagcaugagaagccugggccuggccaucaaggcccugaccagaagcagaagcaccuacagagagaaggagagcguggaggagagccccgagggccagaacagcggcaccgccggcgagagcaugggcgcccccagcagaagccccagacugggcagacccaaggccgugagcaagcaggccgcccugauccccagcgacgacaaggagagccugcagaaccagcagaacgcccacaccagcagaaugcugcaggugugccagagagagggcagcagagagcaggaggacagaggcagaagaaugacccagggccugggcgagagaaaggccgagagagccggcaagaccggccuggccaugcugagacaggugagcagagacaagaacaucaagcagagcaaggagacccccgugggcuggcaggagcugcccaaggccggccugcagagccugggcagcgccgaccacagaguggccgaggugugccccugggaggugaccgagagcgagaccagacagcccgacagcggcaacaaggccgagaucugccccugggagaccagcgagggcgcccccgagagcagagcccugagacaggaccccggcgacagccagaagaagagaggcgaggccagaggcaagagcgagcccaucgacguggugcccaugaugagaaagaagcccgagagacuggugagagagcaggaggccgugugccccugggagagcgccgacagaggcggccugagccccggcagcgccccccaggaccccggcagaaucagagacaagagcgaggccggcgacagcguggaggccagaaagguggagaagcccggcugggaggccgccggccccgaggcccacacccccgacaucaccaaggccgagcccugccccugggaggccagcgagggcggcgaggacggcaagcccgcccaggaggccgugaaggaccugccccaggagaagcagaagaccagaaaggccaccuucuggaaggagcagaagcccggcggcgaccuggagagccugugccccugggagagcaccgacuucagaggccccagcgccgugagcauccaggcccccggcagcagcgagugcagcggcagccugggcagcggcaucgccgaggugugccugugggaggccggcgacgcccccgccauccagaaggccgagaucugccccugggagcuggacgacaacgugaugggccaggagaugcugagccugggcaccggcagagagagccugcaggagaaggagaaggccagcagaaagggcagcuucggcgagaugggcgagcagaccgugaaggccgugcagaagcugagccagcagcaggagagcgugugccccagagagagcaccgugcccggccacagcagccccugccuggacaacagcagcagcaaggccggcagccaguuccugugcaacggcggcagcagagccacccaggugugcccccaggaggaccugagacccgaggcccaggaggccacccccgccaagaccgagaucugccccugggaggugaacgagagaaccagagaggaguggaccagcgcccaggugcccagaggcggcgagagccagaaggacaaggagaagaugcccggcaagagcgagaucgaggacgugaccgccugggagaagcccgagggccagauccagaagcaggaggccgugggccccugggagagcguggaccccggcagcuucagcccccagcccagaccccaggacaccgagagaccccagacccugcugcagaugagcggcagcgugggcagcaaggccgccgacaucugcccccuggacguggaggagaaccugaccgccggcaaggccgagaucugccccugggaggugggcgccggcgccggcgaggagagagcccugggcgccgaggccaucagaaagagccccaacgacaccggcaaggugagcgccgaccugggccccagagagagagccgugaccgcccccgagaagccccagaagcccacccccgagugggagguggccugccccuggggcagcgugggccccggcgccugcagccagcaccccggcacccuggacgccgacggccccaaggccggcuuccaggagcuggaccacaugggcugcagacccggcgaggugugccccugggaggcccaggaggccgccaccagcgagaaggccaagaucugccccugggaggugagcgagggcaccaccggcaagggccuggaccagaaggccggcagcgagagcgccgagcagagagagaaggcccuggagaagggcagacugaccagccugggcgaggacgugagcaagggcauggccaagcugugccagcagcaggagaccaucugcaucugggagaacaaggaccugagagagagccccgcccaggcccccaagaucagcgaccugcccagcagcaugagcagcgagguggccgagggccacagccuggaggccaccgagaagggcgaccugagacaggaccccaagaccggcagcuuccccgagcacaucacccaggagaaggcccccgccgccgacaccgaggaguucaccaccgaggacggcgagaagaccagccacgagcugcagagcgugugccccugggagaccaccgcccccgccgacagcgugagccaccuggacagacagagacccgaccagcccaaggccagcagccagagacuggugagcaccggcggcagagccgccgacgugugccccugggacgugcccgacgccggcguguacaagagcgacagcagcgccaaggccgagaccugccccugggaggugaccgagagaauccccgugaagggcgugagcagacaggacggcaagggcgacagccaggaggagaagggcagagcccccgagaagagcgagcccaagggcgugcccgugcagaagaagcccgagauggccgacuucagacagcaggaggccgugugccccugggagagccaggacggcaagggccugagcccccagcccgcccccgacgccagcgacagaagcagaggcagcagcgaggccgccggcagcguggagaccagaguggccgaggugugccugugggaggugguggaggcccccagcgccaagaaggccgagaucugccccugggaggccggcggcggcgccgccgaggagggcgagcaggagagagagagccagggccagggcgagauguuccugcagaaggccggccccggcggcaccgaggagcacuucagcaaggccgccgccaagcccagagagcaggaggccgugugccccggcgagggcaccggcagcggcggccugcugccccagagcggcgcccuggaccccgagcugaaggugagccccaaggaggccggcagcaugggcagcagaauggccgagcugugccagugggagaucaccgaccccgagggcaacaagaucaagggcaccauggccgacaucugccccggcgaggagaccggcgugcccagcgaggagagcggccugcuggcccugaccgccaccagaagagaguucuuccccaccgcccccgagaagccccugugccugcuggugcacggcccccuggaccacuucuuccccgagagcaagauccccugccccaaggugagcagacccgccagcaccuucacccuggagggcgugagagagcugcagggccccagcggccuggagcccagaaccagccuggcccccgagcccagccugcaggaggccgagagccagagcagcagccugaccgaggacagcggccagguggccuucgaggcccaguacgaggaguucaccccccccaccguguaccccugggacugggaguaa

SEQ ID NO: 17714 - RNA, 1020 nt, Artificial Sequence
  GPR17__Homo_sapiens__NP_001154889
augaacggccuggagguggccccccccggccugaucaccaacuucagccuggccaccgccgagcagugcggccaggagaccccccuggagaacaugcuguucgccagcuucuaccugcuggacuucauccuggcccuggugggcaacacccuggcccuguggcuguucaucagagaccacaagagcggcacccccgccaacguguuccugaugcaccuggccguggccgaccugagcugcgugcuggugcugcccaccagacugguguaccacuucagcggcaaccacuggcccuucggcgagaucgccugcagacugaccggcuuccuguucuaccugaacauguacgccagcaucuacuuccugaccugcaucagcgccgacagauuccuggccaucgugcaccccgugaagagccugaagcugagaagaccccuguacgcccaccuggccugcgccuuccuguggguggugguggccguggccauggccccccugcuggugagcccccagaccgugcagaccaaccacaccguggugugccugcagcuguacagagagaaggccagccaccacgcccuggugagccuggccguggccuucaccuuccccuucaucaccaccgugaccugcuaccugcugaucaucagaagccugagacagggccugagaguggagaagagacugaagaccaaggccgugagaaugaucgccaucgugcuggccaucuuccuggugugcuucgugcccuaccacgugaacagaagcguguacgugcugcacuacagaagccacggcgccagcugcgccacccagagaauccuggcccuggccaacagaaucaccagcugccugaccagccugaacggcgcccuggaccccaucauguacuucuucguggccgagaaguucagacacgcccugugcaaccugcugugcggcaagagacugaagggccccccccccagcuucgagggcaagaccaacgagagcagccugagcgccaagagcgagcuguaa

SEQ ID NO: 17715 - RNA, 1323 nt, Artificial Sequence
  GPR180__Homo_sapiens__NP_851320
augggcggccugagacugcuggccguggcccugaccugcugcugguggccccagggcagccagggcaagacccugagaggcagcuucagcagcaccgccgcccaggacgcccagggccagagaaucggccacuucgaguuccacggcgaccacgcccugcugugcgugagaaucaacaacaucgccguggccgugggcaaggaggccaagcuguaccuguuccaggcccaggaguggcugaagcugcagcagagcagccacggcuacagcugcagcgagaagcugagcaaggcccagcugaccaugaccaugaaccagaccgagcacaaccugaccgugagccagauccccagcccccagaccuggcacguguucuacgccgacaaguacaccugccaggacgacaaggagaacagccagguggaggacauccccuucgagauggugcugcugaaccccgacgccgagggcaaccccuucgaccacuucagcgccggcgagagcggccugcacgaguucuucuuccugcuggugcugguguacuucgugaucgccugcaucuacgcccagagccuguggcaggccaucaagaagggcggccccaugcacaugauccugaaggugcugaccaccgcccugcugcugcaggccggcagcgcccuggccaacuacauccacuucagcagcuacagcaaggacggcaucggcgugcccuucaugggcagccuggccgaguucuucgacaucgccagccagauccagaugcuguaccugcugcugagccugugcaugggcuggaccaucgugagaaugaagaagagccagagcagaccccugcagugggacagcacccccgccagcaccggcaucgccguguucaucgugaugacccagagcgugcugcugcugugggagcaguucgaggacaucagccaccacagcuaccacagccaccacaaccuggccggcauccugcugaucgugcugagaaucugccuggcccugagccugggcugcggccuguaccagaucaucaccguggagagaagcacccugaagagagaguucuacaucaccuucgccaagggcugcauccugugguuccugugccaccccgugcuggccugcaucagcgugaucuucagcgacuaccagagagacaaggugaucaccaucggcgugauccugugccagagcgugagcauggugauccuguacagacuguuccugagccacagccuguacugggaggugagcagccugagcagcgugacccugccccugaccaucagcagcggccacaagagcagaccccacuucuaa

SEQ ID NO: 17716 - RNA, 1215 nt, Artificial Sequence
  GPR182__Homo_sapiens__XP_011536129
augagcgugaagcccagcuggggccccggccccagcgagggcgugaccgccgugcccaccagcgaccugggcgagauccacaacuggaccgagcugcuggaccuguucaaccacacccugagcgagugccacguggagcugagccagagcaccaagagaguggugcuguucgcccuguaccuggccauguucguggugggccugguggagaaccugcuggugaucugcgugaacuggagaggcagcggcagagccggccugaugaaccuguacauccugaacauggccaucgccgaccugggcaucgugcugagccugcccguguggaugcuggaggugacccuggacuacaccuggcuguggggcagcuucagcugcagauucacccacuacuucuacuucgugaacauguacagcagcaucuucuuccuggugugccugagcguggacagauacgugacccugaccagcgccagccccagcuggcagagauaccagcacagagugagaagagccaugugcgccggcaucugggugcugagcgccaucaucccccugcccgagguggugcacauccagcugguggagggccccgagcccaugugccuguucauggcccccuucgagaccuacagcaccugggcccuggccguggcccugagcaccaccauccugggcuuccugcugcccuucccccugaucaccguguucaacgugcugaccgccugcagacugagacagcccggccagcccaagagcagaagacacugccugcugcugugcgccuacguggccguguucgugaugugcuggcugcccuaccacgugacccugcugcugcugacccugcacggcacccacaucagccugcacugccaccuggugcaccugcuguacuucuucuacgacgugaucgacugcuucagcaugcugcacugcgugaucaaccccauccuguacaacuuccugagcccccacuucagaggcagacugcugaacgccguggugcacuaccugcccaaggaccagaccaaggccggcaccugcgccagcagcagcagcugcagcacccagcacagcaucaucaucaccaagggcgacagccagcccgccgccgccgccccccaccccgagcccagccugagcuuccaggcccaccaccugcugcccaacaccagccccaucagccccacccagccccugacccccagcuaa

SEQ ID NO: 17717 - RNA, 1086 nt, Artificial Sequence
  GPR183__Homo_sapiens__NP_004942
auggacauccagauggccaacaacuucaccccccccagcgccaccccccagggcaacgacugcgaccuguacgcccaccacagcaccgccagaaucgugaugccccugcacuacagccugguguucaucaucggccuggugggcaaccugcuggcccugguggugaucgugcagaacagaaagaagaucaacagcaccacccuguacagcaccaaccuggugaucagcgacauccuguucaccaccgcccugcccaccagaaucgccuacuacgccaugggcuucgacuggagaaucggcgacgcccugugcagaaucaccgcccugguguucuacaucaacaccuacgccggcgugaacuucaugaccugccugagcaucgacagauucaucgccguggugcacccccugagauacaacaagaucaagagaaucgagcacgccaagggcgugugcaucuucguguggauccugguguucgcccagacccugccccugcugaucaaccccaugagcaagcaggaggccgagagaaucaccugcauggaguaccccaacuucgaggagaccaagagccugcccuggauccugcugggcgccugcuucaucggcuacgugcugccccugaucaucauccugaucugcuacagccagaucugcugcaagcuguucagaaccgccaagcagaacccccugaccgagaagagcggcgugaacaagaaggcccugaacaccaucauccugaucaucgugguguucgugcugugcuucacccccuaccacguggccaucauccagcacaugaucaagaagcugagauucagcaacuuccuggagugcagccagagacacagcuuccagaucagccugcacuucaccgugugccugaugaacuucaacugcugcauggaccccuucaucuacuucuucgccugcaagggcuacaagagaaaggugaugagaaugcugaagagacaggugagcgugagcaucagcagcgccgugaagagcgcccccgaggagaacagcagagagaugaccgagacccagaugaugauccacagcaagagcagcaacggcaaguaa

SEQ ID NO: 17718 - RNA, 1305 nt, Artificial Sequence
  GPR19__Homo_sapiens__XP_011518926
augaaggaggccagcuucuucuucagccccaccagaaucaagagaaagaaggugaacaugguguucgcccacagaauggacaacagcaagccccaccugaucauccccacccugcuggugccccugcagaacagaagcugcaccgagaccgccaccccccugcccagccaguaccugauggagcugagcgaggagcacagcuggaugagcaaccagaccgaccugcacuacgugcugaagcccggcgagguggccaccgccagcaucuucuucggcauccuguggcuguucagcaucuucggcaacagccuggugugccuggugauccacagaagcagaagaacccagagcaccaccaacuacuucguggugagcauggccugcgccgaccugcugaucagcguggccagcacccccuucgugcugcugcaguucaccaccggcagauggacccugggcagcgccaccugcaagguggugagauacuuccaguaccugacccccggcgugcagaucuacgugcugcugagcaucugcaucgacagauucuacaccaucguguacccccugagcuucaaggugagcagagagaaggccaagaagaugaucgccgccagcuggguguucgacgccggcuucgugacccccgugcuguucuucuacggcagcaacugggacagccacugcaacuacuuccugcccagcagcugggagggcaccgccuacaccgugauccacuuccuggugggcuucgugauccccagcgugcugaucauccuguucuaccagaaggugaucaaguacaucuggagaaucggcaccgacggcagaaccgugagaagaaccaugaacaucgugcccagaaccaaggugaagaccaucaagauguuccugauccugaaccugcuguuccugcugagcuggcugcccuuccacguggcccagcuguggcacccccacgagcaggacuacaagaagagcagccugguguucaccgccaucaccuggaucagcuucagcagcagcgccagcaagcccacccuguacagcaucuacaacgccaacuucagaagaggcaugaaggagaccuucugcaugagcagcaugaagugcuacagaagcaacgccuacaccaucaccaccagcagcagaauggccaagaagaacuacgugggcaucagcgagauccccagcauggccaagaccaucaccaaggacagcaucuacgacagcuucgacagagaggccaaggagaagaagcuggccuggcccaucaacagcaacccccccaacaccuucguguaa

SEQ ID NO: 17719 - RNA, 1068 nt, Artificial Sequence
  GPR1__Homo_sapiens__NP_001091669
auggaggaccuggaggagacccuguucgaggaguucgagaacuacagcuacgaccuggacuacuacagccuggagagcgaccuggaggagaaggugcagcugggcguggugcacugggugagccuggugcuguacugccuggccuucgugcugggcauccccggcaacgccaucgugaucugguucaccggcuucaaguggaagaagaccgugaccacccugugguuccugaaccuggccaucgccgacuucaucuuccugcuguuccugccccuguacaucagcuacguggccaugaacuuccacuggcccuucggcaucuggcugugcaaggccaacagcuucaccgcccagcugaacauguucgccagcguguucuuccugaccgugaucagccuggaccacuacauccaccugauccaccccgugcugagccacagacacagaacccugaagaacagccugaucgugaucaucuucaucuggcugcuggccagccugaucggcggccccgcccuguacuucagagacaccguggaguucaacaaccacacccugugcuacaacaacuuccagaagcacgaccccgaccugacccugaucagacaccacgugcugaccugggugaaguucaucaucggcuaccuguucccccugcugaccaugagcaucugcuaccugugccugaucuucaaggugaagaagagaagcauccugaucagcagcagacacuucuggaccauccuggugguggugguggccuucguggugugcuggacccccuaccaccuguucagcaucugggagcugaccauccaccacaacagcuacagccaccacgugaugcaggccggcaucccccugagcaccggccuggccuuccugaacagcugccugaaccccauccuguacgugcugaucagcaagaaguuccaggccagauucagaagcagcguggccgagauccugaaguacacccugugggaggugagcugcagcggcaccgugagcgagcagcugagaaacagcgagaccaagaaccugugccugcuggagaccgcccaguaa

SEQ ID NO: 17720 - RNA, 1077 nt, Artificial Sequence
  GPR20__Homo_sapiens__NP_005284
augcccagcgugagccccgccggccccagcgccggcgccgugcccaacgccaccgccgugaccaccgugagaaccaacgccagcggccuggaggugccccuguuccaccuguucgccagacuggacgaggagcugcacggcaccuuccccggccuguggcuggcccugauggccgugcacggcgccaucuuccuggccggccuggugcugaacggccuggcccuguacguguucugcugcagaaccagagccaagacccccagcgugaucuacaccaucaaccugguggugaccgaccugcuggugggccugagccugcccaccagauucgccguguacuacggcgccagaggcugccugagaugcgccuucccccacgugcugggcuacuuccugaacaugcacugcagcauccuguuccugaccugcaucugcguggacagauaccuggccaucgugagacccgagggcagcagaagaugcagacagcccgccugcgccagagccgugugcgccuucguguggcuggccgccggcgccgugacccugagcgugcugggcgugaccggcagcagacccugcugcagaguguucgcccugaccgugcuggaguuccugcugccccugcuggugaucagcguguucaccggcagaaucaugugcgcccugagcagacccggccugcugcaccagggcagacagagaagagugagagccaugcagcugcugcugaccgugcugaucaucuuccuggugugcuucacccccuuccacgccagacagguggccguggcccuguggcccgacaugccccaccacaccagccuggugguguaccacguggccgugacccugagcagccugaacagcugcauggaccccaucguguacugcuucgugaccagcggcuuccaggccaccgugagaggccuguucggccagcacggcgagagagagcccagcagcggcgacguggugagcaugcacagaagcagcaagggcagcggcagacaccacauccugagcgccggcccccacgcccugacccaggcccuggccaacggccccgaggccuaa

SEQ ID NO: 17721 - RNA, 1302 nt, Artificial Sequence
  GPR22__Homo_sapiens__XP_011514358
augugcuucagccccauccuggagaucaacaugcagagcgagagcaacaucaccgugagagacgacaucgacgacaucaacaccaacauguaccagccccugagcuacccccugagcuuccaggugagccugaccggcuuccugaugcuggagaucgugcugggccugggcagcaaccugaccgugcuggugcuguacugcaugaagagcaaccugaucaacagcgugagcaacaucaucaccaugaaccugcacgugcuggacgugaucaucugcgugggcugcaucccccugaccaucgugauccugcugcugagccuggagagcaacaccgcccugaucugcugcuuccacgaggccugcgugagcuucgccagcgugagcaccgccaucaacguguucgccaucacccuggacagauacgacaucagcgugaagcccgccaacagaauccugaccaugggcagagccgugaugcugaugaucagcaucuggaucuucagcuucuucagcuuccugauccccuucaucgaggugaacuucuucagccugcagagcggcaacaccugggagaacaagacccugcugugcgugagcaccaacgaguacuacaccgagcugggcauguacuaccaccugcuggugcagauccccaucuucuucuucaccgugguggugaugcugaucaccuacaccaagauccugcaggcccugaacaucagaaucggcaccagauucagcaccggccagaagaagaaggccagaaagaagaagaccaucagccugaccacccagcacgaggccaccgacaugagccagagcagcggcggcagaaacgugguguucggcgugagaaccagcgugagcgugaucaucgcccugagaagagccgugaagagacacagagagagaagagagagacagaagagaguguucagaaugagccugcugaucaucagcaccuuccugcugugcuggacccccaucagcgugcugaacaccaccauccugugccugggccccagcgaccugcuggugaagcugagacugugcuuccuggugauggccuacggcaccaccaucuuccacccccugcuguacgccuucaccagacagaaguuccagaaggugcugaagagcaagaugaagaagagaguggugagcaucguggaggccgacccccugcccaacaacgccgugauccacaacagcuggaucgaccccaagagaaacaagaagaucaccuucgaggacagcgagaucagagagaagugccuggugccccagguggugaccgacuaa

SEQ ID NO: 17722 - RNA, 1014 nt, Artificial Sequence
  GPR26__Homo_sapiens__NP_703143
augaacagcugggacgccggccuggccggccugcuggugggcaccaugggcgugagccugcugagcaacgcccuggugcugcugugccugcugcacagcgccgacaucagaagacaggcccccgcccuguucacccugaaccugaccugcggcaaccugcugugcaccguggugaacaugccccugacccuggccggcgugguggcccagagacagcccgccggcgacagacugugcagacuggccgccuuccuggacaccuuccuggccgccaacagcaugcugagcauggccgcccugagcaucgacagauggguggccgugguguucccccugagcuacagagccaagaugagacugagagacgccgcccugaugguggccuacaccuggcugcacgcccugaccuuccccgccgccgcccuggcccugagcuggcugggcuuccaccagcuguacgccagcugcacccugugcagcagaagacccgacgagagacugagauucgccguguucaccggcgccuuccacgcccugagcuuccugcugagcuucguggugcugugcugcaccuaccugaaggugcugaagguggccagauuccacugcaagagaaucgacgugaucaccaugcagacccuggugcugcugguggaccugcaccccagcgugagagagagaugccuggaggagcagaagagaagaagacagagagccaccaagaagaucagcaccuucaucggcaccuuccuggugugcuucgcccccuacgugaucaccagacugguggagcuguucagcaccgugcccaucggcagccacuggggcgugcugagcaagugccuggccuacagcaaggccgccagcgaccccuucguguacagccugcugagacaccaguacagaaagagcugcaaggagauccugaacagacugcugcacagaagaagcauccacagcagcggccugaccggcgacagccacagccagaacauccugcccgugagcgaguaa

SEQ ID NO: 17723 - RNA, 1146 nt, Artificial Sequence
  GPR34__Homo_sapiens__NP_001091048
augagaagccacaccaucaccaugaccaccaccagcgugagcagcuggcccuacagcagccacagaaugagauucaucaccaaccacagcgaccagcccccccagaacuucagcgccacccccaacgugaccaccugccccauggacgagaagcugcugagcaccgugcugaccaccagcuacagcgugaucuucaucgugggccuggugggcaacaucaucgcccuguacguguuccugggcauccacagaaagagaaacagcauccagaucuaccugcugaacguggccaucgccgaccugcugcugaucuucugccugcccuucagaaucauguaccacaucaaccagaacaaguggacccugggcgugauccugugcaagguggugggcacccuguucuacaugaacauguacaucagcaucauccugcugggcuucaucagccuggacagauacaucaagaucaacagaagcauccagcagagaaaggccaucaccaccaagcagagcaucuacgugugcugcaucguguggaugcuggcccugggcggcuuccugaccaugaucauccugacccugaagaagggcggccacaacagcaccaugugcuuccacuacagagacaagcacaacgccaagggcgaggccaucuucaacuucauccugguggugauguucuggcugaucuuccugcugaucauccugagcuacaucaagaucggcaagaaccugcugagaaucagcaagagaagaagcaaguuccccaacagcggcaaguacgccaccaccgccagaaacagcuucaucgugcugaucaucuucaccaucugcuucgugcccuaccacgccuucagauucaucuacaucagcagccagcugaacgugagcagcugcuacuggaaggagaucgugcacaagaccaacgagaucaugcuggugcugagcagcuucaacagcugccuggaccccgugauguacuuccugaugagcagcaacaucagaaagaucaugugccagcugcuguucagaagauuccagggcgagcccagcagaagcgagagcaccagcgaguucaagcccggcuacagccugcacgacaccagcguggccgugaagauccagagcagcagcaagagcaccuaa

SEQ ID NO: 17724 - RNA, 1023 nt, Artificial Sequence
  GPR35__Homo_sapiens__NP_001182311
augcugagcggcagcagagccgugcccaccccccacagaggcagcgaggagcugcugaaguacaugcugcacagccccugcgugagccugaccaugaacggcaccuacaacaccugcggcagcagcgaccugaccuggccccccgccaucaagcugggcuucuacgccuaccugggcgugcugcuggugcugggccugcugcugaacagccuggcccuguggguguucugcugcagaaugcagcaguggaccgagaccagaaucuacaugaccaaccuggccguggccgaccugugccugcugugcacccugcccuucgugcugcacagccugagagacaccagcgacaccccccugugccagcugagccagggcaucuaccugaccaacagauacaugagcaucagccuggugaccgccaucgccguggacagauacguggccgugagacacccccugagagccagaggccugagaagccccagacaggccgccgccgugugcgccgugcugugggugcuggugaucggcagccugguggccagauggcugcugggcauccaggagggcggcuucugcuucagaagcaccagacacaacuucaacagcauggccuucccccugcugggcuucuaccugccccuggccguggugguguucugcagccugaagguggugaccgcccuggcccagagaccccccaccgacgugggccaggccgaggccaccagaaaggccgccagaauggugugggccaaccugcugguguucguggugugcuuccugccccugcacgugggccugaccgugagacuggccgugggcuggaacgccugcgcccugcuggagaccaucagaagagcccuguacaucaccagcaagcugagcgacgccaacugcugccuggacgccaucugcuacuacuacauggccaaggaguuccaggaggccagcgcccuggccguggcccccagcgccaaggcccacaagagccaggacagccugugcgugacccuggccuaa

SEQ ID NO: 17725 - RNA, 1842 nt, Artificial Sequence
  GPR37__Homo_sapiens__NP_005293
augagagcccccggcgcccugcuggccagaaugagcagacugcugcugcugcugcugcugaaggugagcgccagcagcgcccugggcguggcccccgccagcagaaacgagaccugccugggcgagagcugcgcccccaccgugauccagagaagaggcagagacgccuggggccccggcaacagcgccagagacgugcugagagccagagcccccagagaggagcagggcgccgccuuccuggccggccccagcugggaccugcccgccgcccccggcagagaccccgccgccggcagaggcgccgaggccagcgccgccggcccccccggcccccccaccagaccccccggccccuggagauggaagggcgccagaggccaggagcccagcgagacccugggcagaggcaaccccaccgcccugcagcuguuccugcagaucagcgaggaggaggagaagggccccagaggcgccggcaucagcggcagaagccaggagcagagcgugaagaccgugcccggcgccagcgaccuguucuacuggcccagaagagccggcaagcugcagggcagccaccacaagccccugagcaagaccgccaacggccuggccggccacgagggcuggaccaucgcccugcccggcagagcccuggcccagaacggcagccugggcgagggcauccacgagcccggcggccccagaagaggcaacagcaccaacagaagagugagacugaagaaccccuucuacccccugacccaggagagcuacggcgccuacgccgugaugugccugagcguggugaucuucggcaccggcaucaucggcaaccuggccgugaugugcaucgugugccacaacuacuacaugagaagcaucagcaacagccugcuggccaaccuggccuucugggacuuccugaucaucuucuucugccugccccuggugaucuuccacgagcugaccaagaaguggcugcuggaggacuucagcugcaagaucgugcccuacaucgagguggccagccugggcgugaccaccuucacccugugcgcccugugcaucgacagauucagagccgccaccaacgugcagauguacuacgagaugaucgagaacugcagcagcaccaccgccaagcuggccgugaucugggugggcgcccugcugcuggcccugcccgagguggugcugagacagcugagcaaggaggaccugggcuucagcggcagagcccccgccgagagaugcaucaucaagaucagccccgaccugcccgacaccaucuacgugcuggcccugaccuacgacagcgccagacuguggugguacuucggcugcuacuucugccugcccacccuguucaccaucaccugcagccuggugaccgccagaaagaucagaaaggccgagaaggccugcaccagaggcaacaagagacagauccagcuggagagccagaugaacugcaccgugguggcccugaccauccuguacggcuucugcaucauccccgagaacaucugcaacaucgugaccgccuacauggccaccggcgugagccagcagaccauggaccugcugaacaucaucagccaguuccugcuguucuucaagagcugcgugacccccgugcugcuguucugccugugcaagcccuucagcagagccuucauggagugcugcugcugcugcugcgaggagugcauccagaagagcagcaccgugaccagcgacgacaacgacaacgaguacaccaccgagcuggagcugagccccuucagcaccaucagaagagagaugagcaccuucgccagcgugggcacccacugcuaa

SEQ ID NO: 17726 - RNA, 1446 nt, Artificial Sequence
  GPR37L1__Homo_sapiens__NP_004758
augagauggcuguggccccuggccgugagccuggccgugauccuggccgugggccugagcagagugagcggcggcgccccccugcaccugggcagacacagagccgagacccaggagcagcagagcagaagcaagagaggcaccgaggacgaggaggccaagggcgugcagcaguacgugcccgaggagugggccgaguaccccagacccauccaccccgccggccugcagcccaccaagccccugguggccaccagccccaaccccggcaaggacggcggcacccccgacagcggccaggagcugagaggcaaccugaccggcgcccccggccagagacugcagauccagaacccccuguaccccgugaccgagagcagcuacagcgccuacgccaucaugcugcuggcccuggugguguucgccgugggcaucgugggcaaccugagcgugaugugcaucguguggcacagcuacuaccugaagagcgccuggaacagcauccuggccagccuggcccugugggacuuccuggugcuguucuucugccugcccaucgugaucuucaacgagaucaccaagcagagacugcugggcgacgugagcugcagagccgugcccuucauggaggugagcagccugggcgugaccaccuucagccugugcgcccugggcaucgacagauuccacguggccaccagcacccugcccaaggugagacccaucgagagaugccagagcauccuggccaagcuggccgugaucugggugggcagcaugacccuggccgugcccgagcugcugcuguggcagcuggcccaggagcccgcccccaccaugggcacccuggacagcugcaucaugaagcccagcgccagccugcccgagagccuguacagccuggugaugaccuaccagaacgccagaauguggugguacuucggcugcuacuucugccugcccauccuguucaccgugaccugccagcuggugaccuggagagugagaggcccccccggcagaaagagcgagugcagagccagcaagcacgagcagugcgagagccagcugaacagcaccguggugggccugaccgugguguacgccuucugcacccugcccgagaacgugugcaacaucgugguggccuaccugagcaccgagcugaccagacagacccuggaccugcugggccugaucaaccaguucagcaccuucuucaagggcgccaucacccccgugcugcugcugugcaucugcagaccccugggccaggccuuccuggacugcugcugcugcugcugcugcgaggagugcggcggcgccagcgaggccagcgccgccaacggcagcgacaacaagcugaagaccgaggugagcagcagcaucuacuuccacaagcccagagagagccccccccugcugccccugggcacccccugcuaa

SEQ ID NO: 17727 - RNA, 1362 nt, Artificial Sequence
  GPR39__Homo_sapiens__NP_001499
auggccagccccagccugcccggcagcgacugcagccagaucaucgaccacagccacgugcccgaguucgagguggccaccuggaucaagaucacccugauccugguguaccugaucaucuucgugaugggccugcugggcaacagcgccaccaucagagugacccaggugcugcagaagaagggcuaccugcagaaggaggugaccgaccacauggugagccuggccugcagcgacauccugguguuccugaucggcaugcccauggaguucuacagcaucaucuggaacccccugaccaccagcagcuacacccugagcugcaagcugcacaccuuccuguucgaggccugcagcuacgccacccugcugcacgugcugacccugagcuucgagagauacaucgccaucugccaccccuucagauacaaggccgugagcggccccugccaggugaagcugcugaucggcuucgugugggugaccagcgcccugguggcccugccccugcuguucgccaugggcaccgaguacccccuggugaacgugcccagccacagaggccugaccugcaacagaagcagcaccagacaccacgagcagcccgagaccagcaacaugagcaucugcaccaaccugagcagcagauggaccguguuccagagcagcaucuucggcgccuucgugguguaccugguggugcugcugagcguggccuucaugugcuggaacaugaugcaggugcugaugaagagccagaagggcagccuggccggcggcaccagacccccccagcugagaaagagcgagagcgaggagagcagaaccgccagaagacagaccaucaucuuccugagacugaucguggugacccuggccgugugcuggaugcccaaccagaucagaagaaucauggccgccgccaagcccaagcacgacuggaccagaagcuacuucagagccuacaugauccugcugcccuucagcgagaccuucuucuaccugagcagcgugaucaacccccugcuguacaccgugagcagccagcaguucagaagaguguucgugcaggugcugugcugcagacugagccugcagcacgccaaccacgagaagagacugagagugcacgcccacagcaccaccgacagcgccagauucgugcagagaccccugcuguucgccagcagaagacagagcagcgccagaagaaccgagaagaucuuccugagcaccuuccagagcgaggccgagccccagagcaagagccagagccugagccuggagagccuggagcccaacagcggcgccaagcccgccaacagcgccgccgagaacggcuuccaggagcacgagguguaa

SEQ ID NO: 17728 - RNA, 1089 nt, Artificial Sequence
  GPR4__Homo_sapiens__NP_005273
augggcaaccacaccugggagggcugccacguggacagcagaguggaccaccuguucccccccagccuguacaucuucgugaucggcgugggccugcccaccaacugccuggcccugugggccgccuacagacaggugcagcagagaaacgagcugggcguguaccugaugaaccugagcaucgccgaccugcuguacaucugcacccugccccuguggguggacuacuuccugcaccacgacaacuggauccacggccccggcagcugcaagcuguucggcuucaucuucuacaccaacaucuacaucagcaucgccuuccugugcugcaucagcguggacagauaccuggccguggcccacccccugagauucgccagacugagaagagugaagaccgccguggccgugagcagcguggugugggccaccgagcugggcgccaacagcgccccccuguuccacgacgagcuguucagagacagauacaaccacaccuucugcuucgagaaguuccccauggagggcuggguggccuggaugaaccuguacagaguguucgugggcuuccuguuccccugggcccugaugcugcugagcuacagaggcauccugagagccgugagaggcagcgugagcaccgagagacaggagaaggccaagaucaagagacuggcccugagccugaucgccaucgugcuggugugcuucgcccccuaccacgugcugcugcugagcagaagcgccaucuaccugggcagacccugggacugcggcuucgaggagagaguguucagcgccuaccacagcagccuggccuucaccagccugaacugcguggccgaccccauccuguacugccuggugaacgagggcgccagaagcgacguggccaaggcccugcacaaccugcugagauuccuggccagcgacaagccccaggagauggccaacgccagccugacccuggagaccccccugaccagcaagagaaacagcaccgccaaggccaugaccggcagcugggccgccaccccccccagccagggcgaccaggugcagcugaagaugcugccccccgcccaguaa

SEQ ID NO: 17729 - RNA, 1854 nt, Artificial Sequence
  GPR50__Homo_sapiens__NP_004215
augggccccacccuggccgugcccacccccuacggcugcaucggcugcaagcugccccagcccgaguacccccccgcccugaucaucuucauguucugcgccauggugaucaccaucgugguggaccugaucggcaacagcauggugauccuggccgugaccaagaacaagaagcugagaaacagcggcaacaucuucguggugagccugagcguggccgacaugcugguggccaucuaccccuacccccugaugcugcacgccaugagcaucggcggcugggaccugagccagcugcagugccagauggugggcuucaucaccggccugagcguggugggcagcaucuucaacaucguggccaucgccaucaacagauacugcuacaucugccacagccugcaguacgagagaaucuucagcgugagaaacaccugcaucuaccuggugaucaccuggaucaugaccgugcuggccgugcugcccaacauguacaucggcaccaucgaguacgaccccagaaccuacaccugcaucuucaacuaccugaacaaccccguguucaccgugaccaucgugugcauccacuucgugcugccccugcugaucgugggcuucugcuacgugagaaucuggaccaaggugcuggccgccagagaccccgccggccagaaccccgacaaccagcuggccgaggugagaaacuuccugaccauguucgugaucuuccugcuguucgccgugugcuggugccccaucaacgugcugaccgugcugguggccgugagccccaaggagauggccggcaagauccccaacuggcuguaccuggccgccuacuucaucgccuacuucaacagcugccugaacgccgugaucuacggccugcugaacgagaacuucagaagagaguacuggaccaucuuccacgccaugagacaccccaucaucuucuucagcggccugaucagcgacaucagagagaugcaggaggccagaacccuggccagagccagagcccacgccagagaccaggccagagagcaggacagagcccacgccugccccgccguggaggagacccccaugaacgugagaaacgugccccugcccggcgacgccgccgccggccaccccgacagagccagcggccaccccaagccccacagcagaagcagcagcgccuacagaaagagcgccagcacccaccacaagagcguguucagccacagcaaggccgccagcggccaccugaagcccgugagcggccacagcaagcccgccagcggccaccccaagagcgccaccguguaccccaagcccgccagcgugcacuucaaggccgacagcgugcacuucaagggcgacagcgugcacuucaagcccgacagcgugcacuucaagcccgccagcagcaaccccaagcccaucaccggccaccacgugagcgccggcagccacagcaagagcgccuucagcgccgccaccagccaccccaagcccaccaccggccacaucaagcccgccaccagccacgccgagcccaccaccgccgacuaccccaagcccgccaccaccagccaccccaagcccaccgccgccgacaaccccgagcugagcgccagccacugccccgagauccccgccaucgcccaccccgugagcgacgacagcgaccugcccgagagcgccagcagccccgccgccggccccaccaagcccgccgccagccagcuggagagcgacaccaucgccgaccugcccgaccccaccguggugaccaccagcaccaacgacuaccacgacgugguggugaucgacguggaggacgaccccgacgagauggccguguaa

SEQ ID NO: 17730 - RNA, 1086 nt, Artificial Sequence
  GPR52__Homo_sapiens__NP_005675
augaacgagagcagauggaccgaguggagaauccugaacaugagcagcggcaucgugaacgugagcgagagacacagcugcccccugggcuucggccacuacagcgugguggacgugugcaucuucgagaccguggugaucgugcugcugaccuuccugaucaucgccggcaaccugaccgugaucuucguguuccacugcgccccccugcugcaccacuacaccaccagcuacuucauccagaccauggccuacgccgaccuguucgugggcgugagcugccuggugcccacccugagccugcugcacuacagcaccggcgugcacgagagccugaccugccagguguucggcuacaucaucagcgugcugaagagcgugagcauggccugccuggccugcaucagcguggacagauaccuggccaucaccaagccccugagcuacaaccagcuggugacccccugcagacugagaaucugcaucauccugaucuggaucuacagcugccugaucuuccugcccagcuucuucggcuggggcaagcccggcuaccacggcgacaucuucgaguggugcgccaccagcuggcugaccagcgccuacuucaccggcuucaucgugugccugcuguacgcccccgccgccuucguggugugcuucaccuacuuccacaucuucaagaucugcagacagcacaccaaggagaucaacgacagaagagccagauuccccagccacgagguggacagcagcagagagaccggccacagccccgacagaagauacgccauggugcuguucagaaucaccagcguguucuacaugcuguggcugcccuacaucaucuacuuccugcuggagagcagcagagugcuggacaaccccacccugagcuuccugaccaccuggcuggccaucagcaacagcuucugcaacugcgugaucuacagccugagcaacagcguguucagacugggccugagaagacugagcgagaccaugugcaccagcugcaugugcgugaaggaccaggaggcccaggagcccaagcccagaaagagagccaacagcugcagcaucuaa

SEQ ID NO: 17731 - RNA, 960 nt, Artificial Sequence
  GPR55__Homo_sapiens__XP_011510479
augagccagcagaacaccagcggcgacugccuguucgacggcgugaacgagcugaugaagacccugcaguucgccgugcacauccccaccuucgugcugggccugcugcugaaccugcuggccauccacggcuucagcaccuuccugaagaacagauggcccgacuacgccgccaccagcaucuacaugaucaaccuggccguguucgaccugcugcuggugcugagccugcccuucaagauggugcugagccaggugcagagccccuuccccagccugugcacccugguggagugccuguacuucgugagcauguacggcagcguguucaccaucugcuucaucagcauggacagauuccuggccaucagauacccccugcuggugagccaccugagaagccccagaaagaucuucggcaucugcugcaccaucugggugcugguguggaccggcagcauccccaucuacagcuuccacggcaagguggagaaguacaugugcuuccacaacaugagcgacgacaccuggagcgccaagguguucuucccccuggagguguucggcuuccugcugcccaugggcaucaugggcuucugcugcagcagaagcauccacauccugcugggcagaagagaccacacccaggacugggugcagcagaaggccugcaucuacagcaucgccgccagccuggccguguucguggugagcuuccugcccgugcaccugggcuucuuccugcaguuccuggugagaaacagcuucaucguggagugcagagccaagcagagcaucagcuucuuccugcagcugagcaugugcuucagcaacgugaacugcugccuggacguguucugcuacuacuucgugaucaaggaguucagaaugaacaucagagcccacagacccagcagagugcagcuggugcugcaggacaccaccaucagcagaggcuaa

SEQ ID NO: 17732 - RNA, 1014 nt, Artificial Sequence
  GPR65__Homo_sapiens__NP_003599
augaacagcaccugcaucgaggagcagcacgaccuggaccacuaccuguuccccaucguguacaucuucgugaucaucgugagcauccccgccaacaucggcagccugugcgugagcuuccugcaggccaagaaggagagcgagcugggcaucuaccuguucagccugagccugagcgaccugcuguacgcccugacccugccccuguggaucgacuacaccuggaacaaggacaacuggaccuucagccccgcccugugcaagggcagcgccuuccugauguacaugaacuucuacagcagcaccgccuuccugaccugcaucgccguggacagauaccuggccgugguguacccccugaaguucuucuuccugagaaccagaagauucgcccugauggugagccugagcaucuggauccuggagaccaucuucaacgccgugaugcugugggaggacgagaccgugguggaguacugcgacgccgagaagagcaacuucacccugugcuacgacaaguacccccuggagaaguggcagaucaaccugaaccuguucagaaccugcaccggcuacgccaucccccuggugaccauccugaucugcaacagaaagguguaccaggccgugagacacaacaaggccaccgagaacaaggagaagaagagaaucaucaagcugcuggugagcaucaccgugaccuucgugcugugcuucacccccuuccacgugaugcugcugaucagaugcauccuggagcacgccgugaacuucgaggaccacagcaacagcggcaagagaaccuacaccauguacagaaucaccguggcccugaccagccugaacugcguggccgaccccauccuguacugcuucgugaccgagaccggcagauacgacauguggaacauccugaaguucugcaccggcagaugcaacaccagccagagacagagaaagagaauccugagcgugagcaccaaggacaccauggagcuggaggugcuggaguaa

SEQ ID NO: 17733 - RNA, 1098 nt, Artificial Sequence
  GPR68__Homo_sapiens__NP_001171147
augggcaacaucaccgccgacaacagcagcaugagcugcaccaucgaccacaccauccaccagacccuggcccccgugguguacgugaccgugcugguggugggcuuccccgccaacugccugagccuguacuucggcuaccugcagaucaaggccagaaacgagcugggcguguaccugugcaaccugaccguggccgaccuguucuacaucugcagccugcccuucuggcugcaguacgugcugcagcacgacaacuggagccacggcgaccugagcugccaggugugcggcauccugcuguacgagaacaucuacaucagcgugggcuuccugugcugcaucagcguggacagauaccuggccguggcccaccccuucagauuccaccaguucagaacccugaaggccgccgugggcgugagcguggugaucugggccaaggagcugcugaccagcaucuacuuccugaugcacgaggaggugaucgaggacgagaaccagcacagagugugcuucgagcacuaccccauccaggccuggcagagagccaucaacuacuacagauuccuggugggcuuccuguuccccaucugccugcugcuggccagcuaccagggcauccugagagccgugagaagaagccacggcacccagaagagcagaaaggaccagauccagagacuggugcugagcaccguggugaucuuccuggccugcuuccugcccuaccacgugcugcugcuggugagaagcgugugggaggccagcugcgacuucgccaagggcguguucaacgccuaccacuucagccugcugcugaccagcuucaacugcguggccgaccccgugcuguacugcuucgugagcgagaccacccacagagaccuggccagacugagaggcgccugccuggccuuccugaccugcagcagaaccggcagagccagagaggccuacccccugggcgcccccgaggccagcggcaagagcggcgcccagggcgaggagcccgagcugcugaccaagcugcaccccgccuuccagacccccaacagccccggcagcggcggcuuccccaccggcagacuggccuaa

SEQ ID NO: 17734 - RNA, 1134 nt, Artificial Sequence
  GPR6__Homo_sapiens__NP_001273028
augacccugcuggccuggugcaccagaggcgccaaccccgccgccaugaacgccagcgccgccagccugaacgacagccaggugguggugguggccgccgagggcgccgccgccgccgccaccgccgccggcggccccgacaccggcgaguggggcccccccgccgccgccgcccugggcgccggcggcggcgccaacggcagccuggagcugagcagccagcugagcgccggcccccccggccugcugcugcccgccgugaaccccugggacgugcugcugugcgugagcggcaccgugaucgccggcgagaacgcccuggugguggcccugaucgccagcacccccgcccugagaacccccauguucgugcuggugggcagccuggccaccgccgaccugcuggccggcugcggccugauccugcacuucguguuccaguaccuggugcccagcgagaccgugagccugcugaccgugggcuuccugguggccagcuucgccgccagcgugagcagccugcuggccaucaccguggacagauaccugagccuguacaacgcccugaccuacuacagcagaagaacccugcugggcgugcaccugcugcuggccgccaccuggaccgugagccugggccugggccugcugcccgugcugggcuggaacugccuggccgagagagccgccugcagcguggugagaccccuggccagaagccacguggcccugcugagcgccgccuucuucaugguguucggcaucaugcugcaccuguacgugagaaucugccaggugguguggagacacgcccaccagaucgcccugcagcagcacugccuggcccccccccaccuggccgccaccagaaagggcgugggcacccuggccguggugcugggcaccuucggcgccagcuggcugcccuucgccaucuacugcguggugggcagccacgaggaccccgccguguacaccuacgccacccugcugcccgccaccuacaacagcaugaucaaccccaucaucuacgccuucagaaaccaggagauccagagagcccuguggcugcugcugugcggcugcuuccagagcaaggugcccuucagaagcagaagccccagcgagguguaa

SEQ ID NO: 17735 - RNA, 1623 nt, Artificial Sequence
  GPR75__Homo_sapiens__NP_006785
augaacagcaccggccaccugcaggacgcccccaacgccaccagccugcacgugccccacagccaggagggcaacagcaccagccugcaggagggccugcaggaccugauccacaccgccacccuggugaccugcaccuuccugcuggccgugaucuucugccugggcagcuacggcaacuucaucguguuccugagcuucuucgaccccgccuucagaaaguucagaaccaacuucgacuucaugauccugaaccugagcuucugcgaccuguucaucugcggcgugaccgcccccauguucaccuucgugcuguucuucagcagcgccagcagcauccccgacgccuucugcuucaccuuccaccugaccagcagcggcuucaucaucaugagccugaagaccguggccgugaucgcccugcacagacugagaauggugcugggcaagcagcccaacagaaccgccagcuuccccugcaccgugcugcugacccugcugcugugggccaccagcuucacccuggccacccuggccacccugaagaccagcaagagccaccugugccugcccaugagcagccugaucgccggcaagggcaaggccauccugagccuguacgugguggacuucaccuucugcguggccguggugagcgugagcuacaucaugaucgcccagacccugagaaagaacgcccaggugagaaagugcccccccgugaucaccguggacgccagcagaccccagcccuucaugggcgugcccgugcagggcggcggcgaccccauccagugcgccaugcccgcccuguacagaaaccagaacuacaacaagcugcagcacgugcagaccagaggcuacaccaagagccccaaccagcuggugacccccgccgccagcagacugcagcuggugagcgccaucaaccugagcaccgccaaggacagcaaggccguggugaccugcgugaucaucgugcugagcgugcuggugugcugccugccccugggcaucagccuggugcagguggugcugagcagcaacggcagcuucauccuguaccaguucgagcuguucggcuucacccugaucuucuucaagagcggccugaaccccuucaucuacagcagaaacagcgccggccugagaagaaaggugcuguggugccugcaguacaucggccugggcuucuucugcugcaagcagaagaccagacugagagccaugggcaagggcaaccuggaggugaacagaaacaagagcagccaccacgagaccaacagcgccuacaugcugagccccaagccccagaagaaguucguggaccaggccugcggccccagccacagcaaggagagcauggugagccccaagaucagcgccggccaccagcacugcggccagagcagcagcacccccaucaacaccagaaucgagcccuacuacagcaucuacaacagcagccccagccaggaggagagcagccccugcaaccugcagcccgugaacagcuucggcuucgccaacagcuacaucgccaugcacuaccacaccaccaacgaccuggugcaggaguacgacagcaccagcgccaagcagauccccgugcccagcguguaa

SEQ ID NO: 17736 - RNA, 1092 nt, Artificial Sequence
  GPR78__Homo_sapiens__NP_543009
augggccccggcgaggcccugcuggccggccugcuggugauggugcuggccguggcccugcugagcaacgcccuggugcugcugugcugcgccuacagcgccgagcugagaaccagagccagcggcgugcugcuggugaaccugagccugggccaccugcugcuggccgcccuggacaugcccuucacccugcugggcgugaugagaggcagaacccccagcgcccccggcgccugccaggugaucggcuuccuggacaccuuccuggccagcaacgccgcccugagcguggccgcccugagcgccgaccaguggcuggccgugggcuucccccugagauacgccggcagacugagacccagauacgccggccugcugcugggcugcgccuggggccagagccuggccuucagcggcgccgcccugggcugcagcuggcugggcuacagcagcgccuucgccagcugcagccugagacugccccccgagcccgagagacccagauucgccgccuucaccgccacccugcacgccgugggcuucgugcugccccuggccgugcugugccugaccagccugcaggugcacagaguggccagaagacacugccagagaauggacaccgugaccaugaaggcccuggcccugcuggccgaccugcaccccagcgugagacagagaugccugauccagcagaagagaagaagacacagagccaccagaaagaucggcaucgccaucgccaccuuccugaucugcuucgcccccuacgugaugaccagacuggccgagcuggugcccuucgugaccgugaacgcccaguggggcauccugagcaagugccugaccuacagcaaggccguggccgaccccuucaccuacagccugcugagaagacccuucagacaggugcuggccggcauggugcacagacugcugaagagaacccccagacccgccagcacccacgacagcagccuggacguggccggcauggugcaccagcugcugaagagaacccccagacccgccagcacccacaacggcagcguggacaccgagaacgacagcugccugcagcagacccacuaa

SEQ ID NO: 17737 - RNA, 1272 nt, Artificial Sequence
  GPR83__Homo_sapiens__NP_057624
auggugccccaccugcugcugcugugccugcugccccuggugagagccaccgagccccacgagggcagagccgacgagcagagcgccgaggccgcccuggccgugcccaacgccagccacuucuucagcuggaacaacuacaccuucagcgacuggcagaacuucgugggcagaagaagauacggcgccgagagccagaaccccaccgugaaggcccugcugaucguggccuacagcuucaucaucguguucagccuguucggcaacgugcuggugugccacgugaucuucaagaaccagagaaugcacagcgccaccagccuguucaucgugaaccuggccguggccgacaucaugaucacccugcugaacacccccuucacccuggugagauucgugaacagcaccuggaucuucggcaagggcaugugccacgugagcagauucgcccaguacugcagccugcacgugagcgcccugacccugaccgccaucgccguggacagacaccaggugaucaugcacccccugaagcccagaaucagcaucaccaagggcgugaucuacaucgccgugaucuggaccauggccaccuucuucagccugccccacgccaucugccagaagcuguucaccuucaaguacagcgaggacaucgugagaagccugugccugcccgacuuccccgagcccgccgaccuguucuggaaguaccuggaccuggccaccuucauccugcuguacauccugccccugcugaucaucagcguggccuacgccagaguggccaagaagcuguggcugugcaacaugaucggcgacgugaccaccgagcaguacuucgcccugagaagaaagaagaagaagaccaucaagaugcugaugcuggugguggugcuguucgcccugugcugguucccccugaacugcuacgugcugcugcugagcagcaaggugaucagaaccaacaacgcccuguacuucgccuuccacugguucgccaugagcagcaccugcuacaaccccuucaucuacugcuggcugaacgagaacuucagaaucgagcugaaggcccugcugagcaugugccagagaccccccaagccccaggaggacagaccccccagccccgugcccagcuucagaguggccuggaccgagaagaacgacggccagagagccccccuggccaacaaccugcugcccaccagccagcugcagagcggcaagaccgaccugagcagcguggagcccaucgugaccaugagcuaa

SEQ ID NO: 17738 - RNA, 1077 nt, Artificial Sequence
  GPR87__Homo_sapiens__NP_076404
augggcuucaaccugacccuggccaagcugcccaacaacgagcugcacggccaggagagccacaacagcggcaacagaagcgacggccccggcaagaacaccacccugcacaacgaguucgacaccaucgugcugcccgugcuguaccugaucaucuucguggccagcauccugcugaacggccuggccguguggaucuucuuccacaucagaaacaagaccagcuucaucuucuaccugaagaacaucgugguggccgaccugaucaugacccugaccuuccccuucagaaucgugcacgacgccggcuucggccccugguacuucaaguucauccugugcagauacaccagcgugcuguucuacgccaacauguacaccagcaucguguuccugggccugaucagcaucgacagauaccugaagguggugaagcccuucggcgacagcagaauguacagcaucaccuucaccaaggugcugagcgugugcgugugggugaucauggccgugcugagccugcccaacaucauccugaccaacggccagcccaccgaggacaacauccacgacugcagcaagcugaagagcccccugggcgugaaguggcacaccgccgugaccuacgugaacagcugccuguucguggccgugcuggugauccugaucggcugcuacaucgccaucagcagauacauccacaagagcagcagacaguucaucagccagagcagcagaaagagaaagcacaaccagagcaucagaguggugguggccguguucuucaccugcuuccugcccuaccaccugugcagaauccccuucaccuucagccaccuggacagacugcuggacgagagcgcccagaagauccuguacuacugcaaggagaucacccuguuccugagcgccugcaacgugugccuggaccccaucaucuacuucuucaugugcagaagcuucagcagaagacuguucaagaagagcaacaucagaaccagaagcgagagcaucagaagccugcagagcgugagaagaagcgaggugagaaucuacuacgacuacaccgacguguaa

SEQ ID NO: 17739 - RNA, 4188 nt, Artificial Sequence
  GPRASP1__Homo_sapiens__NP_001092881
augaccggcgccgagaucgagagcggcgcccaggugaagcccgagaagaagcccggcgaggagguggugggcggcgccgagaucgagaacgacgugccccugguggugagacccaaggugagaacccaggcccagaucaugcccggcgccagacccaagaacaagagcaaggugaugcccggcgccagcaccaagguggagaccagcgccgugggcggcgccagacccaagagcaaggccaaggccauccccgugagcagauucaaggaggaggcccagaugugggcccagcccagauucggcgccgagagacugagcaagaccgagagaaacagccagaccaacaucaucgccagcccccuggugagcaccgacagcgugcugguggccaagaccaaguaccugagcgaggacagagagcuggugaacaccgacaccgagagcuuccccagaagaaaggcccacuaccaggccggcuuccagcccagcuucagaagcaaggaggagaccaacaugggcagcuggugcugccccagacccaccagcaagcaggaggccagccccaacagcgacuucaaguggguggacaagagcgugagcagccuguucuggagcggcgacgaggugaccgccaaguuccaccccggcaacagagugaaggacagcaacagaagcaugcacauggccaaccaggaggccaacaccaugagcagaagccagaccaaccaggagcuguacaucgccagcagcagcggcagcgaggacgagagcgugaagacccccugguucugggccagagacaagaccaacaccuggagcggccccagagaggaccccaacagcagaagcagauucagaagcaagaaggagguguacguggagagcagcagcggcagcgagcacgaggaccaccuggagagcugguucggcgccggcaaggaggccaaguucagaagcaagaugagagccggcaaggaggccaacaacagagccagacacagagccaagagagaggccugcaucgacuucaugcccggcagcaucgacgugaucaagaaggagagcugcuucuggcccgaggagaacgccaacaccuucagcagacccaugaucaagaaggaggccagagccagagccaugaccaaggaggaggccaagaccaaggccagagccagagccaagcaggaggccagaagcgaggaggaggcccugaucggcaccugguucugggccaccgacgagagcagcauggccgacgaggccagcaucgagagcagccugcagguggaggacgagagcaucaucggcagcugguucuggaccgaggaggaggccagcaugggcaccggcgccagcagcaagagcagacccagaaccgacggcgagagaaucggcgacagccuguucggcgccagagagaagaccagcaugaagaccggcgccgaggccaccagcgagagcauccuggccgccgacgacgagcaggugaucaucggcagcugguucugggccggcgaggaggugaaccaggaggccgaggaggagaccaucuucggcagcugguucugggugaucgacgccgccagcguggagagcggcgugggcgugagcugcgagagcagaaccagaagcgaggaggaggaggugaucggccccugguucuggagcggcgagcagguggacaucgaggccggcaucggcgaggaggccagacccggcgccgaggaggagaccaucuucggcagcugguucugggccgagaaccagaccuacauggacugcagagccgagaccagcugcgacaccaugcagggcgccgaggaggaggagcccaucaucggcagcugguucuggaccagaguggaggccugcguggagggcgacgugaacagcaagagcagccuggaggacaaggaggaggccaugauccccugcuucggcgccaaggaggaggugagcaugaagcacggcaccggcgugagaugcagauucauggccggcgccgaggagaccaacaacaagagcugcuucugggccgagaaggagcccugcauguaccccgccggcggcggcagcuggaagagcagacccgaggaggaggaggacaucgugaacagcugguucuggagcagaaaguacaccaagcccgaggccaucaucggcagcuggcugugggccaccgaggagagcaacaucgacggcaccggcgagaaggccaagcugcugaccgaggaggagaccaucaucaacagcugguucuggaaggaggacgaggccaucagcgaggccaccgacagagaggagagcagacccgaggccgaggagggcgacaucaucggcagcugguucugggccggcgaggaggacagacuggagcccgccgccgagaccagagaggaggacagacuggccgccgagaaggagggcaucgugggcagcugguucggcgccagagaggagaccaucagaagagaggccggcagcugcagcaagagcagccccaaggccgaggaggaggaggugaucaucggcagcugguucugggaggaggaggccagccccgaggccguggccggcgugggcuucgagagcaagcccggcaccgaggaggaggagaucaccgugggcagcugguucuggcccgaggaggaggccagcauccaggccggcagccaggccguggaggagauggagagcgagaccgaggaggagaccaucuucggcagcugguucugggacggcaaggaggugagcgaggaggccggccccugcugcgugagcaagcccgaggacgacgaggagaugaucguggagagcugguucuggagcagagacaaggccaucaaggagaccggcaccguggccaccugcgagagcaagcccgagaacgaggagggcgccaucgugggcagcugguucgaggccgaggacgagguggacaacagaaccgacaacggcagcaacugcggcagcagaacccuggccgacgaggacgaggccaucgugggcagcugguucugggccggcgacgaggcccacuucgagagcaaccccagccccguguucagagccaucugcagaagcaccugcagcguggagcaggagcccgaccccagcagaagaccccagagcugggaggaggugaccgugcaguucaagcccggccccuggggcagagugggcuuccccagcaucagccccuucagauuccccaaggaggccgccagccuguucugcgagauguucggcggcaagcccagaaacauggugcugagccccgagggcgaggaccaggagagccugcugcagcccgaccagcccagccccgaguuccccuuccaguacgaccccagcuacagaagcgugcaggagaucagagagcaccugagagccaaggagagcaccgagcccgagagcagcagcugcaacugcauccagugcgagcugaagaucggcagcgaggaguucgaggagcugcugcugcugauggagaagaucagagaccccuucauccacgagaucagcaagaucgccaugggcaugagaagcgccagccaguucaccagagacuucaucagagacagcggcguggugagccugaucgagacccugcugaacuaccccagcagcagagugagaaccagcuuccuggagaacaugaucagaauggccccccccuaccccaaccugaacaucauccagaccuacaucugcaaggugugcgaggagacccuggccuacagcguggacagccccgagcagcugagcggcaucagaaugaucagacaccugaccaccaccaccgacuaccacacccugguggccaacuacaugagcggcuuccugagccugcuggccaccggcaacgccaagaccagauuccacgugcugaagaugcugcugaaccugagcgagaaccuguucaugaccaaggagcugcugagcgccgaggccgugagcgaguucaucggccuguucaacagagaggagaccaacgacaacauccagaucgugcuggccaucuucgagaacaucggcaacaacaucaagaaggagaccguguucagcgacgacgacuucaacaucgagccccugaucagcgccuuccacaagguggagaaguucgccaaggagcugcagggcaagaccgacaaccagaacgaccccgagggcgaccaggagaacuaa

SEQ ID NO: 17740 - RNA, 1074 nt, Artificial Sequence
  GPRC5A__Homo_sapiens__NP_003970
auggccaccaccgugcccgacggcugcagaaacggccugaagagcaaguacuacagacugugcgacaaggccgaggccuggggcaucgugcuggagaccguggccaccgccggcguggugaccagcguggccuucaugcugacccugcccauccuggugugcaaggugcaggacagcaacagaagaaagaugcugcccacccaguuccuguuccugcugggcgugcugggcaucuucggccugaccuucgccuucaucaucggccuggacggcagcaccggccccaccagauucuuccuguucggcauccuguucagcaucugcuucagcugccugcuggcccacgccgugagccugaccaagcuggugagaggcagaaagccccugagccugcuggugauccugggccuggccgugggcuucagccuggugcaggacgugaucgccaucgaguacaucgugcugaccaugaacagaaccaacgugaacguguucagcgagcugagcgcccccagaagaaacgaggacuucgugcugcugcugaccuacgugcuguuccugauggcccugaccuuccugaugagcagcuucaccuucugcggcagcuucaccggcuggaagagacacggcgcccacaucuaccugaccaugcugcugagcaucgccaucuggguggccuggaucacccugcugaugcugcccgacuucgacagaagaugggacgacaccauccugagcagcgcccuggccgccaacggcuggguguuccugcuggccuacgugagccccgaguucuggcugcugaccaagcagagaaaccccauggacuaccccguggaggacgccuucugcaagccccagcuggugaagaagagcuacggcguggagaacagagccuacagccaggaggagaucacccagggcuucgaggagaccggcgacacccuguacgcccccuacagcacccacuuccagcugcagaaccagcccccccagaaggaguucagcauccccagagcccacgccuggcccagccccuacaaggacuacgaggugaagaaggagggcagcuaa

SEQ ID NO: 17741 - RNA, 1605 nt, Artificial Sequence
  GPRC5B__Homo_sapiens__NP_001291700
augugcgccgugggcgugguggccauccugagaagagaccccagagagggcugcaccgacuggaccugcguguucagaggcgccaaggaggccggcgugggccccagcgugagaaagagaaccaccaccagcggcagcugggccgugagaagagagaagagcgugagcagaagaaaccugcccggcggcggccuggccgugugcgugagacugggcguguacagaggcgugggcgacuucgagagacacagagccggcagcauccugagcgccagcuggaccuggugcuggugcgugagcggcaagcugcugcugaugaacccccccuggagcguggccuggggccaggagggcuucagagccggcacccccggcagcagauaccugcccagaauguucguggccagcgagagaaagaugagagcccaccaggugcugaccuuccugcugcuguucgugaucaccagcguggccagcgagaacgccagcaccagcagaggcugcggccuggaccugcugccccaguacgugagccugugcgaccuggacgccaucuggggcaucgugguggaggccguggccggcgccggcgcccugaucacccugcugcugaugcugauccugcuggugagacugcccuucaucaaggagaaggagaagaagagccccgugggccugcacuuccuguuccugcugggcacccugggccuguucggccugaccuucgccuucaucauccaggaggacgagaccaucugcagcgugagaagauuccuguggggcgugcuguucgcccugugcuucagcugccugcugagccaggccuggagagugagaagacuggugagacacggcaccggccccgccggcuggcagcuggugggccuggcccugugccugaugcuggugcaggugaucaucgccguggaguggcuggugcugaccgugcugagagacaccagacccgccugcgccuacgagcccauggacuucgugauggcccugaucuacgacauggugcugcugguggugacccugggccuggcccuguucacccugugcggcaaguucaagagauggaagcugaacggcgccuuccugcugaucaccgccuuccugagcgugcugaucuggguggccuggaugaccauguaccuguucggcaacgugaagcugcagcagggcgacgccuggaacgaccccacccuggccaucacccuggccgccagcggcuggguguucgugaucuuccacgccauccccgagauccacugcacccugcugcccgcccugcaggagaacacccccaacuacuucgacaccagccagcccagaaugagagagaccgccuucgaggaggacgugcagcugcccagagccuacauggagaacaaggccuucagcauggacgagcacaacgccgcccugagaaccgccggcuuccccaacggcagccugggcaagagacccagcggcagccugggcaagagacccagcgcccccuucagaagcaacguguaccagcccaccgagauggccguggugcugaacggcggcaccauccccaccgccccccccagccacaccggcagacaccugugguaa

SEQ ID NO: 17742 - RNA, 1362 nt, Artificial Sequence
  GPRC5C__Homo_sapiens__NP_061123
augggcacccagcccgagcccggccugggcgccagaauggccauccacaaggcccuggugaugugccugggccugccccuguuccuguuccccggcgccugggcccagggccacgugccccccggcugcagccagggccugaacccccuguacuacaaccugugcgacagaagcggcgccuggggcaucgugcuggaggccguggccggcgccggcaucgugaccaccuucgugcugaccaucauccugguggccagccugcccuucgugcaggacaccaagaagagaagccugcugggcacccagguguucuuccugcugggcacccugggccuguucugccugguguucgccugcguggugaagcccgacuucagcaccugcgccagcagaagauuccuguucggcgugcuguucgccaucugcuucagcugccuggccgcccacguguucgcccugaacuuccuggccagaaagaaccacggccccagaggcugggugaucuucaccguggcccugcugcugacccugguggaggugaucaucaacaccgaguggcugaucaucacccuggugagaggcagcggcgagggcggcccccagggcaacagcagcgccggcugggccguggccagccccugcgccaucgccaacauggacuucgugauggcccugaucuacgugaugcugcugcugcugggcgccuuccugggcgccuggcccgcccugugcggcagauacaagagauggagaaagcacggcguguucgugcugcugaccaccgccaccagcguggccaucugggugguguggaucgugauguacaccuacggcaacaagcagcacaacagccccaccugggacgaccccacccuggccaucgcccuggccgccaacgccugggccuucgugcuguucuacgugauccccgaggugagccaggugaccaagagcagccccgagcagagcuaccagggcgacauguaccccaccagaggcgugggcuacgagaccauccugaaggagcagaagggccagagcauguucguggagaacaaggccuucagcauggacgagcccguggccgccaagagacccgugagccccuacagcggcuacaacggccagcugcugaccagcguguaccagcccaccgagauggcccugaugcacaaggugcccagcgagggcgccuacgacaucauccugcccagagccaccgccaacagccaggugaugggcagcgccaacagcacccugagagccgaggacauguacagcgcccagagccaccaggccgccaccccccccaaggacggcaagaacagccagguguucagaaaccccuacgugugggacuaa

SEQ ID NO: 17743 - RNA, 1038 nt, Artificial Sequence
  GPRC5D__Homo_sapiens__NP_061124
auguacaaggacugcaucgagagcaccggcgacuacuuccugcugugcgacgccgagggccccuggggcaucauccuggagagccuggccauccugggcaucguggugaccauccugcugcugcuggccuuccuguuccugaugagaaagauccaggacugcagccaguggaacgugcugcccacccagcugcuguuccugcugagcgugcugggccuguucggccuggccuucgccuucaucaucgagcugaaccagcagaccgcccccgugagauacuuccuguucggcgugcuguucgcccugugcuucagcugccugcuggcccacgccagcaaccuggugaagcuggugagaggcugcgugagcuucagcuggaccaccauccugugcaucgccaucggcugcagccugcugcagaucaucaucgccaccgaguacgugacccugaucaugaccagaggcaugauguucgugaacaugacccccugccagcugaacguggacuucguggugcugcugguguacgugcuguuccugauggcccugaccuucuucgugagcaaggccaccuucugcggccccugcgagaacuggaagcagcacggcagacugaucuucaucaccgugcuguucagcaucaucaucugggugguguggaucagcaugcugcugagaggcaacccccaguuccagagacagccccagugggacgaccccguggugugcaucgcccuggugaccaacgccuggguguuccugcugcuguacaucgugcccgagcugugcauccuguacagaagcugcagacaggagugcccccugcagggcaacgccugccccgugaccgccuaccagcacagcuuccagguggagaaccaggagcugagcagagccagagacagcgacggcgccgaggaggacguggcccugaccagcuacggcacccccauccagccccagaccguggaccccacccaggagugcuucaucccccaggccaagcugagcccccagcaggacgccggcggcguguaa

SEQ ID NO: 17744 - RNA, 2256 nt, Artificial Sequence
  GPRC6A__Homo_sapiens__NP_001273283
auggccuuccugaucauccugaucaccugcuucgugaucauccuggccaccagccagcccugccagacccccgacgacuucguggccgccaccagccccggccacaucaucaucggcggccuguucgccauccacgagaagaugcugagcagcgaggacagccccagaagaccccagauccaggagugcgugggcuucgagaucagcguguuccugcagacccuggccaugauccacagcaucgagaugaucaacaacagcacccugcugcccggcgugaagcugggcuacgagaucuacgacaccugcaccgaggugaccguggccauggccgccacccugagauuccugagcaaguucaacugcagcagagagaccguggaguucaagugcgacuacagcagcuacaugcccagagugaaggccgugaucggcagcggcuacagcgagaucaccauggccgugagcagaaugcugaaccugcagcugaugccccaggugggcuacgagagcaccgccgagauccugagcgacaagaucagauuccccagcuuccugagaaccgugcccagcgacuuccaccagaucaaggccauggcccaccugauccagaagagcggcuggaacuggaucggcaucaucaccaccgacgacgacuacggcagacuggcccugaacaccuucaucauccaggccgaggccaacaacgugugcaucgccuucaaggaggugcugcccgccuuccugagcgacaacaccaucgaggugagaaucaacagaacccugaagaagaucauccuggaggcccagcugcugggcgugcugaagaacgugaccuucaccgacggcuggaacagcuuccacuucgacgcccacggcgaccugaacaccggcuacgacguggugcuguggaaggagaucaacggccacaugaccgugaccaagauggccgaguacgaccugcagaacgacguguucaucauccccgaccaggagaccaagaacgaguucagaaaccugaagcagauccagagcaagugcagcaaggagugcagccccggccagaugaagaagaccaccagaagccagcacaucugcugcuacgagugccagaacugccccgagaaccacuacaccaaccagaccgacaugccccacugccugcugugcaacaacaagacccacugggcccccgugagaagcaccaugugcuucgagaaggagguggaguaccugaacuggaacgacagccuggccauccugcugcugauccugagccugcugggcaucaucuucgugcugguggugggcaucaucuucaccagaaaccugaacacccccguggugaagagcagcggcggccugagagugugcuacgugauccugcugugccacuuccugaacuucgccagcaccagcuucuucaucggcgagccccaggacuucaccugcaagaccagacagaccauguucggcgugagcuucacccugugcaucagcugcauccugaccaagagccugaagauccugcuggccuucagcuucgaccccaagcugcagaaguuccugaagugccuguacagacccauccugaucaucuucaccugcaccggcauccagguggugaucugcacccuguggcugaucuucgccgcccccaccguggaggugaacgugagccugcccagagugaucauccuggagugcgaggagggcagcauccuggccuucggcaccaugcugggcuacaucgccauccuggccuucaucugcuucaucuucgccuucaagggcaaguacgagaacuacaacgaggccaaguucaucaccuucggcaugcugaucuacuucaucgccuggaucaccuucauccccaucuacgccaccaccuucggcaaguacgugcccgccguggagaucaucgugauccugaucagcaacuacggcauccuguacugcaccuucauccccaagugcuacgugaucaucugcaagcaggagaucaacaccaagagcgccuuccugaagaugaucuacagcuacagcagccacagcgugagcagcaucgcccugagccccgccagccuggacagcaugagcggcaacgugaccaugaccaaccccagcagcagcggcaagagcgccaccuggcagaagagcaaggaccugcaggcccaggccuucgcccacaucugcagagagaacgccaccagcgugagcaagacccugcccagaaagagaaugagcagcaucuaa

SEQ ID NO: 17745 - RNA, 3027 nt, Artificial Sequence
  GPRIN1__Homo_sapiens__XP_005265863
auggacaccgccgaggaccccgccuggcugcagcugcugcagaaggacagcagcccccccggccccagacccaccgccuucuucugcccccaggacggcagccugggcgccggcagcagcgccaugagagacuacugccccagccagcagaaggccagccccgccccccccagacacacccccgaccagagccccggcauggagagcagacacagaagccccagcggcgccggcgagggcgccagcugcagcgacggccccagaggcagccuggccugccccagccccaccugcuucagcccccaggagagccccagcaaggagacccuggaggcccacggcgccagcaucagcggcacccccgaggccaccaccagcggcaagcccgagcccgugagcagcgugaagaccgagcccaagagcagcgacgacagaaaccccauguuccuggagaagauggacuucaagagcagcaagcaggccgacagcaccagcaucggcaaggaggaccccggcagcagcagaaaggccgaccccauguucaccggcaaggccgagcccgagauccugggcaagggcgaccccguggcccccggcagaauggaccccaugaccgugagaaaggaggaccugggcagccugggcaagguggacccccugugcagcagcaagaccuacaccgugagccccagaaaggaggaccccggcagccugagaaagguggaccccgugagcagcgacaagguggaccccguguuccccagaaaggaggagcccagauacagcggcaaggagcaccccgugagcagcgagaagguggcccccaccagcgccgagaagguggaccuggugcugagcggcaagagagaccccggccccagcggcaaggccgaccccaugccccuggagagcauggacagcgccagcaccggcaagaccgagcccggccugcugggcaagcugauccccggcagcagcggcaagaacggccccgugagcagcggcaccggcgcccccggcagccugggcagacuggaccccaccugccugggcauggccgaccccgccagcgugggcaacguggagaccgugcccgccaccaaggaggacagcagauuccugggcaagauggaccccgccagcagcggcgagggcagacccgugagcggccacaccgacaccaccgccagcgccaagaccgaccugaccagccugaagaacguggaccccaugagcagcggcaagguggaccccgugagccugggcaagauggaccccaugugcagcggcaagcccgagcugcugagccccggccaggccgagagagugagcgugggcaaggccggcaccgugagccccggcaaggaggaccccgugagcagcagaagagaggaccccaucagcgccggcagcagaaagaccagcagcgagaaggugaaccccgagagcagcggcaagaccaaccccgugagcagcggccccggcgaccccagaagccugggcaccgccggcccccccagcgccgugaaggccgagcccgccaccggcggcaagggcgacccccugagcagcgagaaggccggccugguggccagcggcaaggccgcccccaccgccagcggcaaggccgagccccuggccgugggcaaggaggaccccgugagcaagggcaaggccgacgccggccccagcggccagggcgacagcgugagcaucggcaagguggugagcacccccggcaagaccgugcccgugcccagcggcaagguggaccccgugagccugggcaaggccgaggccauccccgagggcaaggugggcagccugccccuggagaagggcagccccgugaccaccaccaaggccgaccccagagccagcggcaaggcccagccccagagcggcggcaaggccgagaccaagcugcccggccaggagggcgccgccgcccccggcgaggccggcgccgugugccugaagaaggagaccccccaggccagcgagaagguggaccccggcagcugcagaaaggccgagccccuggccagcggcaagggcgagcccgugagccugggcaaggccgacagcgcccccagcagaaagaccgagagccccagccugggcaagguggugccccugagccuggagaagaccaagcccagcagcagcagcagacagcuggacagaaaggcccugggcagcgccagaagccccgagggcgccagaggcagcgagggcagaguggagcccaaggccgagcccgugagcagcaccgaggccagcagccugggccagaaggaccuggaggccgccggcgccgagagaagccccugccccgaggccgccgcccccccccccggccccagaaccagagacaacuucaccaaggcccccagcugggaggccagcgccccccccccccccagagaggacgccggcacccaggccggcgcccaggccugcgugagcguggccgugagccccaugagcccccaggacggcgccggcggcagcgccuucagcuuccaggccgcccccagagcccccagcccccccagcagaagagacgccggccugcaggugagccugggcgccgccgagaccagaagcguggccaccggccccaugaccccccaggccgccgccccccccgccuuccccgaggugagagugagacccggcagcgcccuggccgccgccguggccccccccgagcccgccgagcccgugagagacgugagcugggacgagaagggcaugaccugggagguguacggcgccgccauggagguggaggugcugggcauggccauccagaagcaccuggagagacagaucgaggagcacggcagacagggcgcccccgcccccccccccgccgccagagccggccccggcagaagcggcagcgugagaaccgccccccccgacggcgccgccaagagaccccccggccuguucagagcccugcugcagagcgugagaagacccagaugcugcagcagagccggccccaccgccgaguaa

SEQ ID NO: 17746 - RNA, 1449 nt, Artificial Sequence
  GPRIN2__Homo_sapiens__XP_011538700
augcugaacgagagccugauggagaaggccgacgccuggggccugagccugccccuggagcuggaggccgccaugagcagcagcagacccgagcccggccccugggccccccugagccccagacugcagccccugagccagagcagcagcagccugcugggcgagggcagagagcagagacccgagcugagaaagaccgccagcagcaccguguggcaggcccagcugggcgaggccagcaccagaccccaggcccccgaggaggagggcaacccccccgagagcaugaagcccgccagagccagcggccccaaggccagacccagcgccggcggccacugguggagcagcaccgugggcaacgugagcaccaugggcggcagcgaccugugcagacugagagcccccagcgccgccgccaugcagagaagccacagcgaccuggugagaagcacccagaugagaggccacagcggcgccagaaaggccagccugagcugcagcgcccugggcagcagccccgugcacagagcccagcugcagcccggcggcaccagcggccagggcggccaggcccccgccggccuggagagagaccuggcccccgaggacgagaccagcaacagcgccuggaugcugggcgccagccagcugagcgugcccccccuggaccugggcgacaccaccgcccacagcagcagcgcccaggccgagcccaaggccgccgagcagcuggccaccaccaccugccacgcccugccccccgccgcccugcugugcggcaugagagaggugagagccggcggcugcugccacgcccugcccgccaccggcauccuggccuuccccaagcugguggccagcgugagcgagagcggccugcaggcccagcacggcgugaagauccacugcagacugagcggcggccugcccggccacagccacugcugcgcccaccuguggggccccgccggccuggugcccgagcccggcagcagaaccaaggacguguggaccaugaccagcgccaacgaccuggcccccgccgaggccagcccccugagcgcccaggacgccggcgugcaggccgcccccguggccgccugcaaggccguggccaccagccccagccuggaggcccccgccgcccugcacguguuccccgaggugacccugggcagcagccuggaggaggugcccagccccgugagagacgugagaugggacgccgagggcaugaccugggagguguacggcgccgccguggaccuggaggugcugggcguggccauccagaagcaccuggagaugcaguucgagcagcugcagagagcccccgccagcgaggacagccugagcguggagggcagaagaggcccccugagagccgugaugcagagccugagaagacccagcugcugcggcugcagcggcgccgcccccgaguaa

SEQ ID NO: 17747 - RNA, 2331 nt, Artificial Sequence
  GPRIN3__Homo_sapiens__XP_005262993
augggcaccgugcccgacccccugagaagcgccaagaccagccugaucgccgccagcggcaaggaggacgaccugggcgagccccaggccgccagccccagacacagacccgcccugcugugcaagaacgccaacggcuucagcggcgcccccgccgagcccgaccugagccccagagccgccgccgaggcccugaugcaggugugcgagcacgagaccacccagcccgacaugagcagccccggcguguucaacgaggugcagaaggcccccgccaccuucaacagccccggcaacccccagcugcccggcagcagccagcccgccgccagcgcccccagcagcgccgccggcagagaccugauccacaccccccugaccaugcccgccaaccagcacaccugccagagcauccccggcgaccagcccaacgccaucaccagcagcaugcccgaggacagccugaugagaagccagagaaccagcaacagagagcagcccgagaagcccagcugccccgugggcggcgugcugagcagcagcaaggaccaggugagcugcgaguuccccagccccgagaccauccagggcaccgugcagacccccgugaccgccgccagaguggugagccacagcagcagccccgugggcggccccgagggcgagagacagggcgccaucugcgacagcgagaugagaagcugcaagccccugaccagagagagcggcugcagcgagaacaagcagcccagcgugaccgccagcggcccccagggcaccaccagcgugaccccccagcccaccccccugaccagcgagcccagcgccugcccccccggccccgagaaggugccccugcccgcccagagacagaugagcagauucaaggaggccagcaccaugaccaaccaggccgagagcgagaucaaggaggugcccagcagagccuggcaggacgccgaggugcaggccguggccagcguggagagcagaagcgugagcaccagccccagcauccugaccgccuuccugaaggagagcagagcccccgagcacuucgagcaggagcagcugagagugaucugccacagcagcggcagccacacccuggagcugagcgacagcacccuggccccccaggagagcagccagugccccggcaucaugccccaggugcacauccaggccgccgccgccgagagcaccgccuuccagagagagaacaagcuggccagccugcccggcggcgugcugaagaccagcagcaucaaccuggugagcagcaacgcccagcacaccugcaaggaggacggcagacuggccggcaugacccccgugagagaggagagcaccgccaagaagcuggccggcaccaacagcagcagccugaaggccaccgccaucgaccagaucagcaucagcgccugcagccaggccgagaccagcuacggccugggcaaguucgagaccagacccagcgaguucgccgagaagaccaccaacggccacaagaccgaccccgacugcaagcugagcgacagcugcggcagcaucagcaaggccgaccacagcggcagccuggaccccaccaacaagggcgacgccagagagaagaagcccgccagcccccagguggugaaggagaaggagagcaccggcaccgacaccagcgacgccaagacccugcugcugaaccccaagagccaggagagcggcggcaccgagagcgccgccaaccccacccccagccccaucagaaagaaccaggagagcacccuggaggagaacagacagaccaagaccgccaccagccugagccugcccagcgaccccaugggcgacagcagccccggcagcggcaagaagacccccagcagaagcgugaaggccagccccagaagacccagcagagugagcgaguuccugaaggagcagaagcugaacgugaccgccgccgccgcccaggugggccugacccccggcgacaagaagaagcagcugggcgccgacagcaagcugcagcugaagcagagcaagagagugagagacguggugugggacgagcagggcaugaccugggagguguacggcgccagccuggacgccgagagccugggcaucgccauccagaaccaccugcagagacagaucagagagcacgagaagcugaucaagacccagaacagccagaccagaagaagcaucagcagcgacaccagcagcaacaagaagcugagaggcagacagcacagcguguuccagagcaugcugcagaacuucagaagacccaacugcugcgugagacccgcccccagcagcgugcuggacuaa

SEQ ID NO: 17748 - RNA, 984 nt, Artificial Sequence
  GPS2__Homo_sapiens__NP_004480
augcccgcccugcuggagagacccaagcugagcaacgccauggccagagcccugcacagacacaucaugauggagagagagagaaagagacaggaggaggaggagguggacaagaugauggagcagaagaugaaggaggagcaggagagaagaaagaagaaggagauggaggagagaaugagccuggaggagaccaaggagcagauccugaagcuggaggagaagcugcuggcccugcaggaggagaagcaccagcuguuccugcagcugaagaaggugcugcacgaggaggagaagagaagaagaaaggagcagagcgaccugaccacccugaccagcgccgccuaccagcagagccugaccgugcacaccggcacccaccugcugagcaugcagggcagccccggcggccacaacagacccggcacccugauggccgccgacagagccaagcagauguucggcccccaggugcugaccaccagacacuacgugggcagcgccgccgccuucgccggcacccccgagcacggccaguuccagggcagccccggcggcgccuacggcaccgcccagccccccccccacuacggccccacccagcccgccuacagccccagccagcagcugagagcccccagcgccuuccccgccgugcaguaccugagccagccccagccccagcccuacgccgugcacggccacuuccagcccacccagaccggcuuccugcagcccggcggcgcccugagccugcagaagcagauggagcacgccaaccagcagaccggcuucagcgacagcagcagccugagacccaugcacccccaggcccugcaccccgcccccggccugcuggccagcccccagcugcccgugcagaugcagcccgccggcaagagcggcuucgccgccaccagccagcccggccccagacugcccuucauccagcacagccagaaccccagauucuaccacaaguaa

SEQ ID NO: 17749 - RNA, 2028 nt, Artificial Sequence
  GPSM1__Homo_sapiens__NP_001139110
auggccggccccgccccccccgccgccgacgagcugcccggccccgccgccagaagacuguacagcagaauggaggccagcugccuggagcuggcccuggagggcgagagacugugcaaggccggcgacuucaagaccggcguggccuucuucgaggccgccgugcaggugggcaccgaggaccugaagacccugagcgccaucuacagccagcugggcaacgccuacuucuaccugaaggagcacggcagagcccuggaguaccacaagcacgaccugcugcuggccagaaccaucggcgacagaaugggcgaggccaaggccagcggcaaccugggcaacacccugaaggugcugggcagauucgacgaggccgccgugugcugccagagacaccugagcaucgcccaggagcagggcgacaaggugggcgaggccagagcccuguacaacaucggcaacguguaccacgccaagggcaagcagcugagcuggaacgccgccaacgccacccaggaccccggccaccugccccccgacgugagagagacccugugcaaggccagcgaguucuacgagagaaaccugagccuggugaaggagcugggcgacagagccgcccagggcagagccuacggcaaccugggcaacacccacuaccugcugggcaacuucaccgaggccaccaccuuccacaaggagagacuggccaucgccaaggaguucggcgacaaggccgccgagagaagagccuacagcaaccugggcaacgcccacguguuccugggcagauucgacguggccgccgaguacuacaagaagacccugcagcugagcagacagcugagagaccaggccguggaggcccaggccugcuacagccugggcaacaccuacacccugcugcaggacuacgagagagccgccgaguaccaccugagacaccugcugaucgcccaggagcuggccgacagagugggcgagggcagagccugcuggagccugggcaacgccuacgugagcaugggcagacccgcccaggcccugaccuucgccaagaagcaccugcagaucagccaggagaucggcgacagacacggcgagcugaccgccagaaugaacguggcccagcugcagcuggugcugggcagacugaccagccccgccgccagcgagaagcccgaccuggccggcuacgaggcccagggcgccagacccaagagaacccagagacugagcgccgagaccugggaccugcugagacugccccuggagagagagcagaacggcgacagccaccacagcggcgacuggagaggccccagcagagacagccugccccugcccgugagaagcagaaaguaccaggagggccccgacgccgagagaagacccagagagggcagccacagcccccuggacagcgccgacgugagagugcacgugcccagaaccagcauccccagagcccccagcagcgacgaggagugcuucuucgaccugcugaccaaguuccagagcagcagaauggacgaccagagaugcccccuggacgacggccaggccggcgccgccgaggccaccgccgcccccacccuggaggacagaaucgcccagcccagcaugaccgccagcccccagaccgaggaguucuucgaccugaucgccagcagccagagcagaagacuggacgaccagagagccagcgugggcagccugcccggccugagaaucacccacagcaacgccggccaccugagaggccacggcgagccccaggagcccggcgacgacuucuucaacaugcugaucaaguaccagagcagcagaaucgacgaccagagaugccccccccccgacgugcugcccagaggccccaccaugcccgacgaggacuucuucagccugauccagagagugcaggccaagagaauggacgagcagagaguggaccuggccggcggccccgagcagggcgccggcggcccccccgagccccagcagcagugccagcccggcgccagcuaa

SEQ ID NO: 17750 - RNA, 1377 nt, Artificial Sequence
  GPSM2__Homo_sapiens__XP_011539605
auggaggagaaccugaucagcaugagagaggaccacagcuuccacgugagauacagaauggaggccagcugccuggagcuggcccuggagggcgagagacugugcaagagcggcgacugcagagccggcgugagcuucuucgaggccgccgugcaggugggcaccgaggaccugaagacccugagcgccaucuacagccagcugggcaacgccuacuucuaccugcacgacuacgccaaggcccuggaguaccaccaccacgaccugacccuggccagaaccaucggcgaccagcugggcgaggccaaggccagcggcaaccugggcaacacccugaaggugcugggcaacuucgacgaggccaucgugugcugccagagacaccuggacaucagcagagagcugaacgacaaggugggcgaggccagagcccuguacaaccugggcaacguguaccacgccaagggcaagagcuucggcugccccggcccccaggacgugggcgaguuccccgaggaggugagagacgcccugcaggccgccguggacuucuacgaggagaaccugagccuggugaccgcccugggcgacagagccgcccagggcagagccuucggcaaccugggcaacacccacuaccugcugggcaacuucagagacgccgugaucgcccacgagcagagacugcugaucgccaaggaguucggcgacaaggccgccgagagaagagccuacagcaaccugggcaacgccuacaucuuccugggcgaguucgagaccgccagcgaguacuacaagaagacccugcugcuggccagacagcugaaggacagagccguggaggcccagagcugcuacagccugggcaacaccuacacccugcugcaggacuacgagaaggccaucgacuaccaccugaagcaccuggccaucgcccaggagcugaacgacagaaucggcgagggcagagccugcuggagccugggcaacgccuacaccgcccugggcaaccacgaccaggccaugcacuucgccgagaagcaccuggagaucagcagagaggugggcgacaagagcggcgagcugaccgccagacugaaccugagcgaccugcagauggugcugggccugagcuacagcaccaacaacagcaucaugagcgagaacaccgagaucgacagcagccugaacggcgugagacccaagcugggcagaagacacagcauggagaacauggagcugaugaagcugacccccgagaaggugcugaagaaccagcacuucaacgugcugaucaugagaauccacagcaugcaccuggugcaggugcugaagaucgugcaguacaccaagaaggacaucuucaaggagaucuaa

SEQ ID NO: 17751 - RNA, 483 nt, Artificial Sequence
  GPSM3__Homo_sapiens__NP_071390
auggaggccgagagaccccaggaggaggaggacggcgagcagggccccccccaggacgaggagggcuggcccccccccaacagcaccaccagacccuggagaagcgccccccccagcccccccccccccggcaccagacacaccgcccugggccccagaagcgccagccugcugagccugcagaccgagcugcugcuggaccugguggccgaggcccagagcagaagacuggaggagcagagagccaccuucuacaccccccagaaccccagcagccuggcccccgccccccugagaccccuggaggacagagagcagcuguacagcaccauccugagccaccagugccagagaauggaggcccagagaagcgagcccccccugccccccggcggccaggagcugcuggagcugcugcugagagugcagggcggcggcagaauggaggagcagagaagcagaccccccacccacaccugcuaa

SEQ ID NO: 17752 - RNA, 1272 nt, Artificial Sequence
  GPT2__Homo_sapiens__NP_001135938
augggccagcagcccaucaccuuccugagacaggugauggcccugugcaccuaccccaaccugcuggacagccccagcuuccccgaggacgccaagaagagagccagaagaauccugcaggccugcggcggcaacagccugggcagcuacagcgccagccagggcgugaacugcaucagagaggacguggccgccuacaucaccagaagagacggcggcgugcccgccgaccccgacaacaucuaccugaccaccggcgccagcgacggcaucagcaccauccugaagauccuggugagcggcggcggcaagagcagaaccggcgugaugauccccaucccccaguacccccuguacagcgccgugaucagcgagcuggacgccauccaggugaacuacuaccuggacgaggagaacugcugggcccugaacgugaacgagcugagaagagccgugcaggaggccaaggaccacugcgaccccaaggugcugugcaucaucaaccccggcaaccccaccggccaggugcagagcagaaagugcaucgaggacgugauccacuucgccugggaggagaagcuguuccugcuggccgacgagguguaccaggacaacguguacagccccgacugcagauuccacagcuucaagaaggugcuguacgagaugggccccgaguacagcagcaacguggagcuggccagcuuccacagcaccagcaagggcuacaugggcgagugcggcuacagaggcggcuacauggaggugaucaaccugcaccccgagaucaagggccagcuggugaagcugcugagcgugagacugugcccccccgugagcggccaggccgccauggacaucguggugaacccccccguggccggcgaggagagcuucgagcaguucagcagagagaaggagagcgugcugggcaaccuggccaagaaggccaagcugaccgaggaccuguucaaccaggugcccggcauccacugcaacccccugcagggcgccauguacgccuuccccagaaucuucauccccgccaaggccguggaggccgcccaggcccaccagauggcccccgacauguucuacugcaugaagcugcuggaggagaccggcaucugcguggugcccggcagcggcuucggccagagagagggcaccuaccacuucagaaugaccauccugccccccguggagaagcugaagaccgugcugcagaaggugaaggacuuccacaucaacuuccuggagaaguacgccuaa

SEQ ID NO: 17753 - RNA, 1491 nt, Artificial Sequence
  GPT__Homo_sapiens__XP_011515295
auggccagcagcaccggcgacagaagccaggccgugagacacggccugagagccaaggugcugacccuggacggcaugaaccccagagugagaagaguggaguacgccgugagaggccccaucgugcagagagcccuggagcuggagcaggagcugagacagggcgugaagaagcccuucaccgaggugaucagagccaacaucggcgacgcccaggccaugggccagagacccaucaccuuccugagacaggugcuggcccugugcgugaaccccgaccugcugagcagccccaacuuccccgacgacgccaagaagagagccgagagaauccugcaggccugcggcggccacagccugggcgccuacagcgugagcagcggcauccagcugaucagagaggacguggccagauacaucgagagaagagacggcggcauccccgccgaccccaacaacguguuccugagcaccggcgccagcgacgccaucgugaccgugcugaagcugcugguggccggcgagggccacaccagaaccggcgugcugauccccaucccccaguacccccuguacagcgccacccuggccgagcugggcgccgugcagguggacuacuaccuggacgaggagagagccugggcccuggacguggccgagcugcacagagcccugggccaggccagagaccacugcagacccagagcccugugcgugaucaaccccggcaaccccaccggccaggugcagaccagagagugcaucgaggccgugaucagauucgccuucgaggagagacuguuccugcuggccgacgagguguaccaggacaacguguacgccgccggcagccaguuccacagcuucaagaaggugcugauggagaugggcccccccuacgccggccagcaggagcuggccagcuuccacagcaccagcaagggcuacaugggcgagugcggcuucagaggcggcuacguggagguggugaacauggacgccgccgugcagcagcagaugcugaagcugaugagcgugagacugugcccccccgugcccggccaggcccugcuggaccugguggugagcccccccgcccccaccgaccccagcuucgcccaguuccaggccgagaagcaggccgugcuggccgagcuggccgccaaggccaagcugaccgagcagguguucaacgaggcccccggcaucagcugcaaccccgugcagggcgccauguacagcuuccccagagugcagcugccccccagagccguggagagagcccaggagcugggccuggcccccgacauguucuucugccugagacugcuggaggagaccggcaucugcguggugcccggcagcggcuucggccagagagagggcaccuaccacuucagaaugaccauccugcccccccuggagaagcugagacugcugcuggagaagcugagcagauuccacgccaaguucacccuggaguacagcuaa

SEQ ID NO: 17754 - RNA, 666 nt, Artificial Sequence
  GPX5__Homo_sapiens__NP_001500
augaccacccagcugagaguggugcaccugcugccccugcugcuggccugcuucgugcagaccagccccaagcaggagaagaugaagauggacugccacaaggacgagaagggcaccaucuacgacuacgaggccaucgcccugaacaagaacgaguacgugagcuucaagcaguacgugggcaagcacauccuguucgugaacguggccaccuacugcggccugaccgcccaguaccccgagcugaacgcccugcaggaggagcugaagcccuacggccugguggugcugggcuuccccugcaaccaguucggcaagcaggagcccggcgacaacaaggagauccugcccggccugaaguacgugagacccggcggcggcuucgugcccagcuuccagcuguucgagaagggcgacgugaacggcgagaaggagcagaagguguucagcuuccugaagcacagcugcccccaccccagcgagauccugggcaccuucaagagcaucagcugggaccccgugaaggugcacgacaucagauggaacuucgagaaguuccuggugggccccgacggcauccccgugaugagauggagccacagagccaccgugagcagcgugaagaccgacauccuggccuaccugaagcaguucaagaccaaguaa

SEQ ID NO: 17755 - RNA, 2238 nt, Artificial Sequence
  GRAMD1B__Homo_sapiens__NP_001273492
augaagggcuucaagcugagcugcaccgccagcaacagcaacagaagcacccccgccugcagccccauccugagaaagagaagcagaagccccaccccccagaaccaggacggcgacaccaugguggagaagggcagcgaccacagcagcgacaagagccccagcacccccgagcagggcgugcagagaagcugcagcagccagagcggcagaagcggcggcaagaacagcaagagccacaagagacugagcaagaagagccagagcugguacaacgugcugagccccaccuacaagcagagaaacgaggacuucagaaagcuguucaagcagcugcccgacaccgagagacugaucguggacuacagcugcgcccugcagagagacauccugcugcagggcagacuguaccugagcgagaacuggaucugcuucuacagcaacaucuucagaugggagacccugcugaccgugagacugaaggacaucugcagcaugaccaaggagaagaccgccagacugauccccaacgccauccaggugugcaccgacagcgagaagcacuucuucaccagcuucggcgccagagacagaaccuacaugaugauguucagacuguggcagaacgcccugcuggagaagccccugugccccaaggagcuguggcacuucgugcaccagugcuacggcaacgagcugggccugaccagcgacgacgaggacuacgugccccccgacgacgacuucaacaccaugggcuacugcgaggagauccccguggaggagaacgaggugaacgacagcagcagcaagagcagcaucgagaccaagcccgacgccagcccccagcugcccaagaagagcaucaccaacagcacccugaccagcaccggcagcagcgaggcccccgugagcuucgacggccugccccuggaggaggaggcccuggagggcgacggcagccuggagaaggagcuggccaucgacaacaucaugggcgagaagaucgagaugaucgcccccgugaacagccccagccuggacuucaacgacaacgaggacauccccaccgagcugagcgacagcagcgacacccacgacgagggcgaggugcaggccuucuacgaggaccugagcggcagacaguacgugaacgagguguucaacuucagcguggacaagcuguacgaccugcuguucaccaacagccccuuccagagagacuucauggagcagagaagauucagcgacaucaucuuccaccccuggaagaaggaggagaacggcaaccagagcagagugauccuguacaccaucacccugaccaacccccuggcccccaagaccgccaccgugagagagacccagaccauguacaaggccagccaggagagcgagugcuacgugaucgacgccgaggugcugacccacgacgugcccuaccacgacuacuucuacaccaucaacagauacacccugaccagaguggccagaaacaagagcagacugagagugagcaccgagcugagauacagaaagcagcccuggggccuggugaagaccuucaucgagaagaacuucuggagcggccuggaggacuacuucagacaccuggagagcgagcuggccaagaccgagagcaccuaccuggccgagaugcacagacagagccccaaggagaaggccagcaagaccaccaccgugagaagaagaaagagaccccacgcccaccugagagugccccaccuggaggaggugaugagccccgugaccacccccaccgacgaggacgugggccacagaaucaagcacguggccggcagcacccagaccagacacauccccgaggacacccccaacggcuuccaccugcagagcgugagcaagcugcugcuggugaucagcugcgugaucugcuucagccuggugcugcuggugauccugaacaugaugcuguucuacaagcuguggaugcuggaguacaccacccagacccugaccgccuggcagggccugagacugcaggagagacugccccagagccagaccgagugggcccagcugcuggagagccagcagaaguaccacgacaccgagcugcagaaguggagagagaucaucaagagcagcgugaugcugcuggaccagaugaaggacagccugaucaaccugcagaacggcaucagaagcagagacuacaccagcgagagcgaggagaagagaaacagauaccacuaa

SEQ ID NO: 17756 - RNA, 1344 nt, Artificial Sequence
  GRAMD3__Homo_sapiens__NP_001139791
augaccagaagacagcaggugcugcaggccaagagaagcauccagcagaccuuccaggcccagcugaugcccuggaagagcauguuccacggcagagaggugaagcccgugggccccgaccuggagcugagcgaggccgagaacggcguggaggagaagaagaaggccugcagaagccccaccgcccagagccccacccccagcguggaggccgacagccccgaccagaagaagaucaucagccuguggagcaagagcagcuucgacggcgccagccuggccagcgacaagaacgacugcaagaccgagagcaagaacgaccccaagaccgagagaaagaagagcagcagcagcagccaguacaaggccaacaugcacuuccacaagcuguuccugagcgugcccaccgaggagccccugaagcagagcuucaccugcgcccugcagaaggagauccuguaccagggcaagcuguucgugagcgagaacuggaucugcuuccacagcaagguguucggcaaggacaccaagaucagcauccccgccuucagcgugacccugaucaagaagaccaagaccgcccugcuggugcccaacgcccugaucaucgccaccgugaccgacagauacaucuucgugagccugcugagcagagacagcaccuacaagcugcugaagagcgugugcggccaccuggagaacaccagcgugggcaacagccccaaccccagcagcgccgagaacagcuucagagccgacagacccagcagccugccccuggacuucaacgacgaguucagcgaccuggacggcguggugcagcagagaagacaggacauggagggcuacagcagcagcggcagccagacccccgagagcgagaacagcagagacuuccacgccaccgagagccagaccgugcugaacgugagcaagggcgaggccaagcccaccagagccgacgcccacgugaacagagugcccgagggcaaggccaagagccugcccgugcagggccugagcgagaccgugggcauccugcacaaggugaagagccagaagugccccaugcugcaccacauccugaucuucuacgccaucguggugugcgcccugaucaucagcaccuucuacaugagauacagaaucaacacccuggaggagcagcugggccugcugaccagcaucguggacacccacaacaccgagcaggccgcccccagcggccugagaagccaggugcaguucaacguggaggugcugugccaggagcugaccgccaacaucgugaagcuggagaagauccagaacaaccugcagaagcugcuggagaacggcgacuaa

SEQ ID NO: 17757 - RNA, 1737 nt, Artificial Sequence
  GRAMD4__Homo_sapiens__NP_055939
augcugagaagacuggacaagaucagauucagaggccacaagagagacgacuuccuggaccuggccgagagccccaacgccagcgacaccgagugcagcgacgagaucccccugaaggugcccagaaccagccccagagacagcgaggagcugagagaccccgccggccccggcacccugaucauggccaccggcgugcaggacuucaacagaaccgaguucgacagacugaacgagaucaagggccaccuggagaucgcccugcuggagaagcacuuccugcaggaggagcugagaaagcugagagaggagaccaacgccgagaugcugagacaggagcuggacagagagagacagagaagaauggagcuggagcagaaggugcaggaggugcugaaggccagaaccgaggagcagauggcccagcagccccccaagggccaggcccaggccagcaacggcgccgagagaagaagccagggccugagcagcagacugcagaagugguucuacgagagauucggcgaguacguggaggacuucagauuccagcccgaggagaacaccguggagaccgaggagccccugagcgccagaagacugaccgagaacaugagaagacugaagagaggcgccaagcccgugaccaacuucgugaagaaccugagcgcccugagcgacugguacagcguguacaccagcgccaucgccuucaccguguacaugaacgccguguggcacggcugggccaucccccuguuccuguuccuggccauccugagacugagccugaacuaccugaucgccagaggcuggagaauccaguggagcaucgugcccgaggugagcgagcccguggagccccccaaggaggaccugaccgugagcgagaaguuccagcuggugcuggacguggcccagaaggcccagaaccuguucggcaagauggccgacauccuggagaagaucaagaaccuguucaugugggugcagcccgagaucacccagaagcuguacguggcccugugggccgccuuccuggccagcugcuucuuccccuacagacuggugggccuggccgugggccuguacgccggcaucaaguucuuccugaucgacuucaucuucaagagaugccccagacugagagccaaguacgacacccccuacaucaucuggagaagccugcccaccgacccccagcugaaggagagaagcagcgccgccgugagcagaagacugcagaccaccagcagcagaagcuacgugcccagcgcccccgccggccugggcaaggaggaggacgccggcagauuccacagcaccaagaagggcaacuuccacgagaucuucaaccugaccgagaacgagagaccccuggccgugugcgagaacggcuggagaugcugccugaucaacagagacagaaagaugcccaccgacuacaucagaaacggcgugcuguacgugaccgagaacuaccugugcuucgagagcagcaagagcggcagcagcaagagaaacaaggugaucaagcugguggacaucaccgacauccagaaguacaaggugcugagcgugcugcccggcagcggcaugggcaucgccgugagcacccccagcacccagaagccccugguguucggcgccauggugcacagagacgaggccuucgagaccauccugagccaguacaucaagaucaccagcgccgccgccagcggcggcgacagcuaa

SEQ ID NO: 17758 - RNA, 993 nt, Artificial Sequence
  GRAP2__Homo_sapiens__NP_001278754
auggaggccguggccaaguucgacuucaccgccagcggcgaggacgagcugagcuuccacaccggcgacgugcugaagauccugagcaaccaggaggagugguucaaggccgagcugggcagccaggagggcuacgugcccaagaacuucaucgacauccaguuccccaagugguuccacgagggccugagcagacaccaggccgagaaccugcugaugggcaaggaggugggcuucuucaucaucagagccagccagagcagccccggcgacuucagcaucagcgugagacacgaggacgacgugcagcacuucaaggugaugagagacaacaagggcaacuacuuccuguggaccgagaaguuccccagccugaacaagcugguggacuacuacagaaccaacagcaucagcagacagaagcagaucuuccugagagacagaaccagagaggaccagggccacagaggcaacagccuggacagaagaagccagggcggcccccaccugagcggcgccgugggcgaggagaucagacccagcaugaacagaaagcugagcgaccacccccccacccugccccugcagcagcaccagcaccagccccagcccccccaguacgcccccgccccccagcagcugcagcagcccccccagcagagauaccugcagcaccaccacuuccaccaggagagaagaggcggcagccuggacaucaacgacggccacugcggcaccggccugggcagcgagaugaacgccgcccugaugcacagaagacacaccgaccccgugcagcugcaggccgccggcagagugagaugggccagagcccuguacgacuucgaggcccuggaggacgacgagcugggcuuccacagcggcgaggugguggaggugcuggacagcagcaaccccagcugguggaccggcagacugcacaacaagcugggccuguuccccgccaacuacguggcccccaugaccagauaa

SEQ ID NO: 17759 - RNA, 654 nt, Artificial Sequence
  GRAP__Homo_sapiens__NP_006604
auggagagcguggcccuguacagcuuccaggccaccgagagcgacgagcuggccuucaacaagggcgacacccugaagauccugaacauggaggacgaccagaacugguacaaggccgagcugagaggcguggagggcuucauccccaagaacuacaucagagugaagccccaccccugguacagcggcagaaucagcagacagcuggccgaggagauccugaugaagagaaaccaccugggcgccuuccugaucagagagagcgagagcagccccggcgaguucagcgugagcgugaacuacggcgaccaggugcagcacuucaaggugcugagagaggccagcggcaaguacuuccugugggaggagaaguucaacagccugaacgagcugguggacuucuacagaaccaccaccaucgccaagaagagacagaucuuccugagagacgaggagccccugcugaagagccccggcgccugcuucgcccaggcccaguucgacuucagcgcccaggaccccagccagcugagcuucagaagaggcgacaucaucgaggugcuggagagacccgacccccacugguggagaggcagaagcugcggcagagugggcuucuuccccagaagcuacgugcagcccgugcaccuguaa

SEQ ID NO: 17760 - RNA, 759 nt, Artificial Sequence
  GRASP__Homo_sapiens__NP_001258785
augacccugcugcccagcaagggcggcgacaccaucgccagcgugaacggccugaacguggagggcaucagacacagagagaucguggacaucaucaaggccagcggcaacgugcugagacuggagacccuguacggcaccagcaucagaaaggccgagcuggaggccagacugcaguaccugaagcagacccuguacgagaaguggggcgaguacagaagccugauggugcaggagcagagacuggugcacggccugguggugaaggaccccagcaucuacgacacccuggagagcgugagaagcugccuguacggcgccggccugcugcccggcagccugcccuucggcccccugcuggccgugcccggcagacccagaggcggcgccagaagagccagaggcgacgccgacgacgccguguaccacaccugcuucuucggcgacagcgagccccccgcccugccccccccccccccccccgccagagccuucggccccggccccgccgagacccccgccgugggccccggccccggccccagagccgcccugagcagaagcgccagcgugagaugcgccggccccggcggcggcggcggcggcggcgcccccggcgcccuguggaccgaggccagagagcaggcccugugcggccccggccugagaaagaccaaguacagaagcuucagaagaagacugcugaaguucauccccggccugaacagaagccuggaggaggaggagagccagcuguaa

SEQ ID NO: 17761 - RNA, 1647 nt, Artificial Sequence
  GRB10__Homo_sapiens__NP_001001549
auggcccuggccggcugccccgacagcuuccugcaccaccccuacuaccaggacaagguggagcagacccccagaagccagcaggaccccgccggccccggccugcccgcccagagcgacagacuggccaaccaccaggaggacgacguggaccuggaggcccuggugaacgacaugaacgccagccuggagagccuguacagcgccugcagcaugcagagcgacaccgugccccugcugcagaacggccagcacgccagaagccagcccagagccagcggcccccccagaagcauccagccccaggugagccccagacagagagugcagagaagccagcccgugcacauccuggccgugagaagacugcaggaggaggaccagcaguucagaaccagcagccugcccgccauccccaaccccuuccccgagcugugcggccccggcagcccccccgugcugacccccggcagccugccccccagccaggccgccgccaagcaggacgugaagguguucagcgaggacggcaccagcaaggugguggagauccuggccgacaugaccgccagagaccugugccagcugcugguguacaagagccacugcguggacgacaacagcuggacccugguggagcaccacccccaccugggccuggagagaugccuggaggaccacgagcugguggugcagguggagagcaccauggccagcgagagcaaguuccuguucagaaagaacuacgccaaguacgaguucuucaagaaccccaugaacuucuuccccgagcagauggugaccuggugccagcagagcaacggcagccagacccagcugcugcaggagcccagacaccugcagcugcuggccgaccuggaggacagcaacaucuucagccugaucgccggcagaaagcaguacaacgcccccaccgaccacggccugugcaucaagcccaacaaggugagaaacgagaccaaggagcugagacugcugugcgccgaggacgagcagaccagaaccugcuggaugaccgccuucagacugcugaaguacggcaugcugcuguaccagaacuacagaaucccccagcagagaaaggcccugcugagccccuucagcacccccgugagaagcgugagcgagaacagccugguggccauggacuucagcggccagaccggcagagugaucgagaaccccgccgaggcccagagcgccgcccuggaggagggccacgccuggagaaagagaagcaccagaaugaacauccugggcagccagagcccccugcaccccagcacccugagcaccgugauccacagaacccagcacugguuccacggcagaaucagcagagaggagagccacagaaucaucaagcagcagggccugguggacggccuguuccugcugagagacagccagagcaaccccaaggccuucgugcugacccugugccaccaccagaagaucaagaacuuccagauccugcccugcgaggacgacggccagaccuucuucagccuggacgacggcaacaccaaguucagcgaccugauccagcugguggacuucuaccagcugaacaagggcgugcugcccugcaagcugaagcaccacugcaucagaguggcccuguaa

SEQ ID NO: 17762 - RNA, 1362 nt, Artificial Sequence
  GRB14__Homo_sapiens__NP_001290351
augagccugagcgccagaagagugacccugcccgccaucacccccaucauccugcagaagagagugaucaagguguacagcgaggacgagaccagcagagcccuggacgugcccagcgacaucaccgccagagacgugugccagcugcugauccugaagaaccacuacaucgacgaccacagcuggacccuguucgagcaccugccccacaucggcguggagagaaccaucgaggaccacgagcuggugaucgaggugcugagcaacuggggcaucgaggaggagaacaagcuguacuucagaaagaacuacgccaaguacgaguucuucaagaaccccauguacuucuuccccgagcacauggugagcuucgccaccgagaccaacggcgagaucagccccacccagauccugcagauguuccugagcagcagcaccuaccccgagauccacggcuuccugcacgccaaggagcagggcaagaagagcuggaagaagaucuacuucuuccugagaagaagcggccuguacuucagcaccaagggcaccagcaaggagcccagacaccugcaguucuucagcgaguucggcaacagcgacaucuacgugagccuggccggcaagaagaagcacggcgcccccaccaacuacggcuucugcuucaagcccaacaaggccggcggccccagagaccugaagaugcugugcgccgaggaggagcagagcagaaccugcugggugaccgccaucagacugcugaaguacggcaugcagcuguaccagaacuacaugcaccccuaccagggcagaagcggcugcagcagccagagcaucagccccaugagaagcaucagcgagaacagccugguggccauggacuucagcggccagaagagcagagugaucgagaaccccaccgaggcccugagcguggccguggaggagggccuggccuggagaaagaagggcugccugagacugggcacccacggcagccccaccgccagcagccagagcagcgccaccaacauggccauccacagaagccagcccugguuccaccacaagaucagcagagacgaggcccagagacugaucauccagcagggccugguggacggcguguuccuggugagagacagccagagcaaccccaagaccuucgugcugagcaugagccacggccagaagaucaagcacuuccagaucauccccguggaggacgacggcgagauguuccacacccuggacgacggccacaccagauucaccgaccugauccagcugguggaguucuaccagcugaacaagggcgugcugcccugcaagcugaagcacuacugcgccagaaucgcccuguaa

SEQ ID NO: 17763 - RNA, 654 nt, Artificial Sequence
  GRB2__Homo_sapiens__NP_002077
auggaggccaucgccaaguacgacuucaaggccaccgccgacgacgagcugagcuucaagagaggcgacauccugaaggugcugaacgaggagugcgaccagaacugguacaaggccgagcugaacggcaaggacggcuucauccccaagaacuacaucgagaugaagccccaccccugguucuucggcaagauccccagagccaaggccgaggagaugcugagcaagcagagacacgacggcgccuuccugaucagagagagcgagagcgcccccggcgacuucagccugagcgugaaguucggcaacgacgugcagcacuucaaggugcugagagacggcgccggcaaguacuuccuguggguggugaaguucaacagccugaacgagcugguggacuaccacagaagcaccagcgugagcagaaaccagcagaucuuccugagagacaucgagcaggugccccagcagcccaccuacgugcaggcccuguucgacuucgacccccaggaggacggcgagcugggcuucagaagaggcgacuucauccacgugauggacaacagcgaccccaacugguggaagggcgccugccacggccagaccggcauguuccccagaaacuacgugacccccgugaacagaaacguguaa

SEQ ID NO: 17764 - RNA, 1668 nt, Artificial Sequence
  GRB7__Homo_sapiens__NP_001229371
augggcaaguggagacccggccagggccacaccaccggcagcgugaagccccugagcagaagcgacgccauggagcuggaccugagccccccccaccugagcagcagccccgaggaccugugccccgcccccggcaccccccccggcacccccagaccccccgacaccccccugcccgaggaggugaagagaagccagccccugcugauccccaccaccggcagaaagcugagagaggaggagagaagagccaccagccugcccagcauccccaaccccuuccccgagcugugcagcccccccagccagagccccauccugggcggccccagcagcgccagaggccugcugcccagagacgccagcagaccccacguggugaagguguacagcgaggacggcgccugcagaagcguggagguggccgccggcgccaccgccagacacgugugcgagaugcuggugcagagagcccacgcccugagcgacgagaccuggggccugguggagugccacccccaccuggcccuggagagaggccuggaggaccacgagagcgugguggaggugcaggccgccuggcccgugggcggcgacagcagauucguguucagaaagaacuucgccaaguacgagcuguucaagagcagcccccacagccuguuccccgagaagauggugagcagcugccuggacgcccacaccggcaucagccacgaggaccugauccagaacuuccugaacgccggcagcuuccccgagauccagggcuuccugcagcugagaggcagcggcagaaagcuguggaagagauucuucugcuuccugagaagaagcggccuguacuacagcaccaagggcaccagcaaggaccccagacaccugcaguacguggccgacgugaacgagagcaacguguacguggugacccagggcagaaagcuguacggcaugcccaccgacuucggcuucugcgugaagcccaacaagcugagaaacggccacaagggccugagaaucuucugcagcgaggacgagcagagcagaaccugcuggcuggccgccuucagacuguucaaguacggcgugcagcuguacaagaacuaccagcaggcccagagcagacaccugcaccccagcugccugggcagccccccccugagaagcgccagcgacaacacccugguggccauggacuucagcggccacgccggcagagugaucgagaaccccagagaggcccugagcguggcccuggaggaggcccaggccuggagaaagaagaccaaccacagacugagccugcccaugcccgccagcggcaccagccugagcgccgccauccacagaacccagcugugguuccacggcagaaucagcagagaggagagccagagacugaucggccagcagggccugguggacggccuguuccuggugagagagagccagagaaacccccagggcuucgugcugagccugugccaccugcagaaggugaagcacuaccugauccugcccagcgaggaggagggcagacuguacuucagcauggacgacggccagaccagauucaccgaccugcugcagcugguggaguuccaccagcugaacagaggcauccugcccugccugcugagacacugcugcaccagaguggcccuguaa

SEQ ID NO: 17765 - RNA, 1230 nt, Artificial Sequence
  GREB1__Homo_sapiens__NP_683701
augggcaacagcuacgccggccagcugaagaccaccagauucgaggaggugcugcacaacagcaucgaggccagccugagaagcaacaaccuggugcccagacccaucuucagccagcuguaccuggaggccgagcagcagcuggccgcccuggagggcggcagcagaguggacaacgaggaggaggaggaggagggcgagggcggccuggagaccaacggcccccccaaccccuuccagcugcacccccugcccgagggcugcugcaccaccgacggcuucugccaggccggcaaggaccugagacuggugagcaucagcaacgagcccauggacgugcccgccggcuuccugcuggugggcgugaagagccccagccugcccgaccaccugcuggugugcgccguggacaagagauuccugcccgacgacaacggccacaacgcccugcugggcuucagcggcaacugcgugggcugcggcaagaagggcuucugcuacuucaccgaguucagcaaccacaucaaccugaagcugaccacccagcccaagaagcagaagcaccugaaguacuaccuggugagaaacgcccagggcacccugaccaagggcccccugaucugcuggaagggcagcgaguucagaagcagacagauccccgccagcaccugcagcagcagccuguuccccgcccuggagagcaccgccgccuuccccagcgagcccgugcccggcaccaaccccagcauccugaugggcgcccagcaggccggccccgccagcgaccaccccagccugaacgccgccaugggccccgccguguucaacggcaaggacagccccaagugccagcagcuggccaagaacaaccugcuggcccugcccagacccagcgcccugggcauccugagcaacagcggcccccccaagaagagacacaagggcuggagccccgagagccccagcgcccccgacggcggcugcccccagggcggcggcaacagagccaaguacgagagcgccggcaugagcugcgugccccaggugggccuggugggccccgccagcgugaccuuccccgugguggccagcggcgagcccgugagcgugcccgacaaccugcugaagaucugcaaggccaagcccgugaucuucaagguguucgugaacggcgccacccagaugguggcccugggccccgccgagcccgccagccccagaagccuguaa

SEQ ID NO: 17766 - RNA, 432 nt, Artificial Sequence
  GREM1__Homo_sapiens__NP_001178252
augagcagaaccgccuacaccgugggcgcccugcugcugcugcugggcacccugcugcccgccgccgagggcaagaagaagggcagccagggcgccauccccccccccgacaaggcccugcacgugaccgagagaaaguaccugaagagagacuggugcaagacccagccccugaagcagaccauccacgaggagggcugcaacagcagaaccaucaucaacagauucugcuacggccagugcaacagcuucuacauccccagacacaucagaaaggaggagggcagcuuccagagcugcagcuucugcaagcccaagaaguucaccaccaugauggugacccugaacugccccgagcugcagccccccaccaagaagaagagagugaccagagugaagcagugcagaugcaucagcaucgaccuggacuaa

SEQ ID NO: 17767 - RNA, 561 nt, Artificial Sequence
  GREM2__Homo_sapiens__XP_005273283
augagagcccugagagccgagagcaccagcggcagcagacagacccccugcagaauguucuggaagcugagccugagccuguuccugguggccgugcuggugaagguggccgaggccagaaagaacagacccgccggcgccauccccagccccuacaaggacggcagcagcaacaacagcgagagauggcagcaccagaucaaggaggugcuggccagcagccaggaggcccugguggugaccgagagaaaguaccugaagagcgacuggugcaagacccagccccugagacagaccgugagcgaggagggcugcagaagcagaaccauccugaacagauucugcuacggccagugcaacagcuucuacauccccagacacgugaagaaggaggaggagagcuuccagagcugcgccuucugcaagccccagagagugaccagcgugcugguggagcuggagugccccggccuggacccccccuucagacugaagaagauccagaaggugaagcagugcagaugcaugagcgugaaccugagcgacagcgacaagcaguaa

SEQ ID NO: 17768 - RNA, 1857 nt, Artificial Sequence
  GRHL1__Homo_sapiens__NP_937825
augacccaggaguacgacaacaagagacccgugcuggugcugcagaacgaggcccuguacccccagagaagaagcuacaccagcgaggacgaggccuggaagagcuuccuggagaacccccugaccgccgccaccaaggccaugaugagcaucaacggcgacgaggacagcgccgccgcccugggccugcuguacgacuacuacaaggugcccagagagagaagaagcagcaccgccaagcccgagguggagcaccccgagcccgaccacagcaagagaaacagcauccccaucgugaccgagcagccccugaucagcgccggcgagaacagagugcaggugcugaagaacgugcccuucaacaucgugcugccccacggcaaccagcugggcaucgacaagagaggccaccugaccgcccccgacaccaccgugaccgugagcaucgccaccaugcccacccacagcaucaagaccgagacccagccccacggcuucgccgugggcaucccccccgccguguaccaccccgagcccaccgagagaguggugguguucgacagaaaccugaacaccgaccaguucagcagcggcgcccaggcccccaacgcccagagaagaacccccgacagcaccuucagcgagaccuucaaggagggcgugcaggagguguucuuccccagcgaccugagccugagaaugcccggcaugaacagcgaggacuacguguucgacagcgugagcggcaacaacuucgaguacacccuggaggccagcaagagccugagacagaagcccggcgacagcaccaugaccuaccugaacaagggccaguucuaccccaucacccugaaggaggugagcagcagcgagggcauccaccaccccaucagcaaggugagaagcgugaucauggugguguucgccgaggacaagagcagagaggaccagcugagacacuggaaguacuggcacagcagacagcacaccgccaagcagagaugcaucgacaucgccgacuacaaggagagcuucaacaccaucagcaacaucgaggagaucgccuacaacgccaucagcuucaccugggacaucaacgacgaggccaagguguucaucagcgugaacugccugagcaccgacuucagcagccagaagggcgugaagggccugccccugaacauccagguggacaccuacagcuacaacaacagaagcaacaagcccgugcacagagccuacugccagaucaagguguucugcgacaagggcgccgagagaaagaucagagacgaggagagaaagcagagcaagagaaaggugagcgacgugaaggugccccugcugcccagccacaagagaauggacaucaccguguucaagcccuucaucgaccuggacacccagcccgugcuguucauccccgacgugcacuucgccaaccugcagagaggcacccacgugcugcccaucgccagcgaggagcuggagggcgagggcagcgugcugaagagaggccccuacggcaccgaggacgacuucgccgugccccccagcaccaagcuggccagaaucgaggagcccaagagagugcugcuguacgugagaaaggagagcgaggagguguucgacgcccugaugcugaagacccccagccugaagggccugauggaggccaucagcgacaaguacgacgugccccacgacaagaucggcaagaucuucaagaagugcaagaagggcauccuggugaacauggacgacaacaucgugaagcacuacagcaacgaggacaccuuccagcugcagaucgaggaggccggcggcagcuacaagcugacccugaccgagaucuaa

SEQ ID NO: 17769 - RNA, 1878 nt, Artificial Sequence
  GRHL2__Homo_sapiens__NP_079191
augagccaggagagcgacaacaacaagagacugguggcccuggugcccaugcccagcgacccccccuucaacaccagaagagccuacaccagcgaggacgaggccuggaagagcuaccuggagaacccccugaccgccgccaccaaggccaugaugagcaucaacggcgacgaggacagcgccgccgcccugggccugcuguacgacuacuacaaggugcccagagacaagagacugcugagcgugagcaaggccagcgacagccaggaggaccaggagaagagaaacugccugggcaccagcgaggcccagagcaaccugagcggcggcgagaacagagugcaggugcugaagaccgugcccgugaaccugagccugaaccaggaccaccuggagaacagcaagagagagcaguacagcaucagcuuccccgagagcagcgccaucauccccgugagcggcaucaccguggugaaggccgaggacuucacccccguguucauggccccccccgugcacuaccccagaggcgacggcgaggagcagagaguggugaucuucgagcagacccaguacgacgugcccagccuggccacccacagcgccuaccugaaggacgaccagagaagcacccccgacagcaccuacagcgagagcuucaaggacgccgccaccgagaaguucagaagcgccagcgugggcgccgaggaguacauguacgaccagaccagcagcggcaccuuccaguacacccuggaggccaccaagagccugagacagaagcagggcgagggccccaugaccuaccugaacaagggccaguucuacgccaucacccugagcgagaccggcgacaacaagugcuucagacaccccaucagcaaggugagaagcguggugauggugguguucagcgaggacaagaacagagacgagcagcugaaguacuggaaguacuggcacagcagacagcacaccgccaagcagagagugcuggacaucgccgacuacaaggagagcuucaacaccaucggcaacaucgaggagaucgccuacaacgccgugagcuucaccugggacgugaacgaggaggccaagaucuucaucaccgugaacugccugagcaccgacuucagcagccagaagggcgugaagggccugccccugaugauccagaucgacaccuacagcuacaacaacagaagcaacaagcccauccacagagccuacugccagaucaagguguucugcgacaagggcgccgagagaaagaucagagacgaggagagaaagcagaacagaaagaagggcaagggccaggccagccagacccagugcaacagcagcagcgacggcaagcuggccgccaucccccugcagaagaagagcgacaucaccuacuucaagaccaugcccgaccugcacagccagcccgugcuguucauccccgacgugcacuucgccaaccugcagagaaccggccagguguacuacaacaccgacgacgagagagagggcggcagcgugcuggugaagagaauguucagacccauggaggaggaguucggccccgugcccagcaagcagaugaaggaggagggcaccaagagagugcugcuguacgugagaaaggagaccgacgacguguucgacgcccugaugcugaagagccccaccgugaagggccugauggaggccaucagcgagaaguacggccugcccguggagaagaucgccaagcuguacaagaagagcaagaagggcauccuggugaacauggacgacaacaucaucgagcacuacagcaacgaggacaccuucauccugaacauggagagcaugguggagggcuucaaggugacccugauggagaucuaa

SEQ ID NO: 17770 - RNA, 987 nt, Artificial Sequence
  GRHPR__Homo_sapiens__NP_036335
augagacccgugagacugaugaagguguucgugaccagaagaauccccgccgagggcagaguggcccuggccagagccgccgacugcgagguggagcagugggacagcgacgagcccauccccgccaaggagcuggagagaggcguggccggcgcccacggccugcugugccugcugagcgaccacguggacaagagaauccuggacgccgccggcgccaaccugaaggugaucagcaccaugagcgugggcaucgaccaccuggcccuggacgagaucaagaagagaggcaucagagugggcuacacccccgacgugcugaccgacaccaccgccgagcuggccgugagccugcugcugaccaccugcagaagacugcccgaggccaucgaggaggugaagaacggcggcuggaccagcuggaagccccuguggcugugcggcuacggccugacccagagcaccgugggcaucaucggccugggcagaaucggccaggccaucgccagaagacugaagcccuucggcgugcagagauuccuguacaccggcagacagcccagacccgaggaggccgccgaguuccaggccgaguucgugagcacccccgagcuggccgcccagagcgacuucaucgugguggccugcagccugacccccgccaccgagggccugugcaacaaggacuucuuccagaagaugaaggagaccgccguguucaucaacaucagcagaggcgacguggugaaccaggacgaccuguaccaggcccuggccagcggcaagaucgccgccgccggccuggacgugaccagccccgagccccugcccaccaaccacccccugcugacccugaagaacugcgugauccugccccacaucggcagcgccacccacagaaccagaaacaccaugagccugcuggccgccaacaaccugcuggccggccugagaggcgagcccaugcccagcgagcugaagcuguaa

SEQ ID NO: 17771 - RNA, 2721 nt, Artificial Sequence
  GRIA1__Homo_sapiens__NP_000818
augcagcacaucuucgccuucuucugcaccggcuuccugggcgccguggugggcgccaacuuccccaacaacauccagaucggcggccuguuccccaaccagcagagccaggagcacgccgccuucagauucgcccugagccagcugaccgagccccccaagcugcugccccagaucgacaucgugaacaucagcgacagcuucgagaugaccuacagauucugcagccaguucagcaagggcguguacgccaucuucggcuucuacgagagaagaaccgugaacaugcugaccagcuucugcggcgcccugcacgugugcuucaucacccccagcuuccccguggacaccagcaaccaguucgugcugcagcugagacccgagcugcaggacgcccugaucagcaucaucgaccacuacaaguggcagaaguucguguacaucuacgacgccgacagaggccugagcgugcugcagaaggugcuggacaccgccgccgagaagaacuggcaggugaccgccgugaacauccugaccaccaccgaggagggcuacagaaugcuguuccaggaccuggagaagaagaaggagagacugguggugguggacugcgagagcgagagacugaacgccauccugggccagaucaucaagcuggagaagaacggcaucggcuaccacuacauccuggccaaccugggcuucauggacaucgaccugaacaaguucaaggagagcggcgccaacgugaccggcuuccagcuggugaacuacaccgacaccauccccgccaagaucaugcagcaguggaagaacagcgacgccagagaccacaccagaguggacuggaagagacccaaguacaccagcgcccugaccuacgacggcgugaaggugauggccgaggccuuccagagccugagaagacagagaaucgacaucagcagaagaggcaacgccggcgacugccuggccaaccccgccgugcccuggggccagggcaucgacauccagagagcccugcagcaggugagauucgagggccugaccggcaacgugcaguucaacgagaagggcagaagaaccaacuacacccugcacgugaucgagaugaagcacgacggcaucagaaagaucggcuacuggaacgaggacgacaaguucgugcccgccgccaccgacgcccaggccggcggcgacaacagcagcgugcagaacagaaccuacaucgugaccaccauccuggaggaccccuacgugaugcugaagaagaacgccaaccaguucgagggcaacgacagauacgagggcuacugcguggagcuggccgccgagaucgccaagcacgugggcuacagcuacagacuggagaucgugagcgacggcaaguacggcgccagagaccccgacaccaaggccuggaacggcauggugggcgagcugguguacggcagagccgacguggccguggccccccugaccaucacccuggugagagaggaggugaucgacuucagcaagcccuucaugagccugggcaucagcaucaugaucaagaagccccagaagagcaagcccggcguguucagcuuccuggacccccuggccuacgagaucuggaugugcaucguguucgccuacaucggcgugagcguggugcuguuccuggugagcagauucagccccuacgaguggcacagcgaggaguucgaggagggcagagaccagaccaccagcgaccagagcaacgaguucggcaucuucaacagccugugguucagccugggcgccuucaugcagcagggcugcgacaucagccccagaagccugagcggcagaaucgugggcggcguguggugguucuucacccugaucaucaucagcagcuacaccgccaaccuggccgccuuccugaccguggagagaauggugagccccaucgagagcgccgaggaccuggccaagcagaccgagaucgccuacggcacccuggaggccggcagcaccaaggaguucuucagaagaagcaagaucgccguguucgagaagauguggaccuacaugaagagcgccgagcccagcguguucgugagaaccaccgaggagggcaugaucagagugagaaagagcaagggcaaguacgccuaccugcuggagagcaccaugaacgaguacaucgagcagagaaagcccugcgacaccaugaaggugggcggcaaccuggacagcaagggcuacggcaucgccacccccaagggcagcgcccugagaaaccccgugaaccuggccgugcugaagcugaacgagcagggccugcuggacaagcugaagaacaaguggugguacgacaagggcgagugcggcagcggcggcggcgacagcaaggacaagaccagcgcccugagccugagcaacguggccggcguguucuacauccugaucggcggccugggccuggccaugcugguggcccugaucgaguucugcuacaagagcagaagcgagagcaagagaaugaagggcuucugccugaucccccagcagagcaucaacgaggccaucagaaccagcacccugcccagaaacagcggcgccggcgccagcagcggcggcagcggcgagaacggcagaguggugagccacgacuuccccaagagcaugcagagcauccccugcaugagccacagcagcggcaugccccugggcgccaccggccuguaa

SEQ ID NO: 17772 - RNA, 2652 nt, Artificial Sequence
  GRIA2__Homo_sapiens__NP_000817
augcagaagaucaugcacaucagcgugcugcugagccccgugcuguggggccugaucuucggcgugagcagcaacagcauccagaucggcggccuguuccccagaggcgccgaccaggaguacagcgccuucagagugggcauggugcaguucagcaccagcgaguucagacugaccccccacaucgacaaccuggagguggccaacagcuucgccgugaccaacgccuucugcagccaguucagcagaggcguguacgccaucuucggcuucuacgacaagaagagcgugaacaccaucaccagcuucugcggcacccugcacgugagcuucaucacccccagcuuccccaccgacggcacccaccccuucgugauccagaugagacccgaccugaagggcgcccugcugagccugaucgaguacuaccagugggacaaguucgccuaccuguacgacagcgacagaggccugagcacccugcaggccgugcuggacagcgccgccgagaagaaguggcaggugaccgccaucaacgugggcaacaucaacaacgacaagaaggacgagauguacagaagccuguuccaggaccuggagcugaagaaggagagaagagugauccuggacugcgagagagacaaggugaacgacaucguggaccaggugaucaccaucggcaagcacgugaagggcuaccacuacaucaucgccaaccugggcuucaccgacggcgaccugcugaagauccaguucggcggcgccaacgugagcggcuuccagaucguggacuacgacgacagccuggugagcaaguucaucgagagauggagcacccuggaggagaaggaguaccccggcgcccacaccaccaccaucaaguacaccagcgcccugaccuacgacgccgugcaggugaugaccgaggccuucagaaaccugagaaagcagagaaucgagaucagcagaagaggcaacgccggcgacugccuggccaaccccgccgugcccuggggccagggcguggagaucgagagagcccugaagcaggugcagguggagggccugagcggcaacaucaaguucgaccagaacggcaagagaaucaacuacaccaucaacaucauggagcugaagaccaacggccccagaaagaucggcuacuggagcgagguggacaagaugguggugacccugaccgagcugcccagcggcaacgacaccagcggccuggagaacaagaccgugguggugaccaccauccuggagagccccuacgugaugaugaagaagaaccacgagaugcuggagggcaacgagagauacgagggcuacugcguggaccuggccgccgagaucgccaagcacugcggcuucaaguacaagcugaccaucgugggcgacggcaaguacggcgccagagacgccgacaccaagaucuggaacggcauggugggcgagcugguguacggcaaggccgacaucgccaucgccccccugaccaucacccuggugagagaggaggugaucgacuucagcaagcccuucaugagccugggcaucagcaucaugaucaagaagccccagaagagcaagcccggcguguucagcuuccuggacccccuggccuacgagaucuggaugugcaucguguucgccuacaucggcgugagcguggugcuguuccuggugagcagauucagccccuacgaguggcacaccgaggaguucgaggacggcagagagacccagagcagcgagagcaccaacgaguucggcaucuucaacagccugugguucagccugggcgccuucaugagacagggcugcgacaucagccccagaagccugagcggcagaaucgugggcggcguguggugguucuucacccugaucaucaucagcagcuacaccgccaaccuggccgccuuccugaccguggagagaauggugagccccaucgagagcgccgaggaccugagcaagcagaccgagaucgccuacggcacccuggacagcggcagcaccaaggaguucuucagaagaagcaagaucgccguguucgacaagauguggaccuacaugagaagcgccgagcccagcguguucgugagaaccaccgccgagggcguggccagagugagaaagagcaagggcaaguacgccuaccugcuggagagcaccaugaacgaguacaucgagcagagaaagcccugcgacaccaugaaggugggcggcaaccuggacagcaagggcuacggcaucgccacccccaagggcagcagccugagaacccccgugaaccuggccgugcugaagcugagcgagcagggcgugcuggacaagcugaagaacaaguggugguacgacaagggcgagugcggcgccaaggacagcggcagcaaggagaagaccagcgcccugagccugagcaacguggccggcguguucuacauccuggugggcggccugggccuggccaugcugguggcccugaucgaguucugcuacaagagcagagccgaggccaagagaaugaagguggccaagaacgcccagaacaucaaccccagcagcagccagaacagccagaacuucgccaccuacaaggagggcuacaacguguacggcaucgagagcgugaagaucuaa

SEQ ID NO: 17773 - RNA, 2685 nt, Artificial Sequence
  GRIA3__Homo_sapiens__NP_000819
auggccagacagaagaagaugggccagagcgugcugagagccguguucuuccuggugcugggccugcugggccacagccacggcggcuuccccaacaccaucagcaucggcggccuguucaugagaaacaccgugcaggagcacagcgccuucagauucgccgugcagcuguacaacaccaaccagaacaccaccgagaagcccuuccaccugaacuaccacguggaccaccuggacagcagcaacagcuucagcgugaccaacgccuucugcagccaguucagcagaggcguguacgccaucuucggcuucuacgaccagaugagcaugaacacccugaccagcuucugcggcgcccugcacaccagcuucgugacccccagcuuccccaccgacgccgacgugcaguucgugauccagaugagacccgcccugaagggcgccauccugagccugcugggccacuacaagugggagaaguucguguaccuguacgacaccgagagaggcuucagcauccugcaggccaucauggaggccgccgugcagaacaacuggcaggugaccgccagaagcgugggcaacaucaaggacgugcaggaguucagaagaaucaucgaggagauggacagaagacaggagaagagauaccugaucgacugcgagguggagagaaucaacaccauccuggagcagguggugauccugggcaagcacagcagaggcuaccacuacaugcuggccaaccugggcuucaccgacauccugcuggagagagugaugcacggcggcgccaacaucaccggcuuccagaucgugaacaacgagaaccccauggugcagcaguucauccagagaugggugagacuggacgagagagaguuccccgaggccaagaacgccccccugaaguacaccagcgcccugacccacgacgccauccuggugaucgccgaggccuucagauaccugagaagacagagaguggacgugagcagaagaggcagcgccggcgacugccuggccaaccccgccgugcccuggagccagggcaucgacaucgagagagcccugaagauggugcaggugcagggcaugaccggcaacauccaguucgacaccuacggcagaagaaccaacuacaccaucgacguguacgagaugaaggugagcggcagcagaaaggccggcuacuggaacgaguacgagagauucgugcccuucagcgaccagcagaucagcaacgacagcgccagcagcgagaacagaaccaucguggugaccaccauccuggagagccccuacgugauguacaagaagaaccacgagcagcuggagggcaacgagagauacgagggcuacugcguggaccuggccuacgagaucgccaagcacgugagaaucaaguacaagcugagcaucgugggcgacggcaaguacggcgccagagaccccgagaccaagaucuggaacggcauggugggcgagcugguguacggcagagccgacaucgccguggccccccugaccaucacccuggugagagaggaggugaucgacuucagcaagcccuucaugagccugggcaucagcaucaugaucaagaagccccagaagagcaagcccggcguguucagcuuccuggacccccuggccuacgagaucuggaugugcaucguguucgccuacaucggcgugagcguggugcuguuccuggugagcagauucagccccuacgaguggcaccuggaggacaacaacgaggagcccagagacccccagagcccccccgacccccccaacgaguucggcaucuucaacagccugugguucagccugggcgccuucaugcagcagggcugcgacaucagccccagaagccugagcggcagaaucgugggcggcguguggugguucuucacccugaucaucaucagcagcuacaccgccaaccuggccgccuuccugaccguggagagaauggugagccccaucgagagcgccgaggaccuggccaagcagaccgagaucgccuacggcacccuggacagcggcagcaccaaggaguucuucagaagaagcaagaucgccguguacgagaagauguggagcuacaugaagagcgccgagcccagcguguucaccaagaccaccgccgacggcguggccagagugagaaagagcaagggcaaguucgccuuccugcuggagagcaccaugaacgaguacaucgagcagagaaagcccugcgacaccaugaaggugggcggcaaccuggacagcaagggcuacggcguggccacccccaagggcagcgcccugggcaacgccgugaaccuggccgugcugaagcugaacgagcagggccugcuggacaagcugaagaacaaguggugguacgacaagggcgagugcggcagcggcggcggcgacagcaaggacaagaccagcgcccugagccugagcaacguggccggcguguucuacauccuggugggcggccugggccuggccaugaugguggcccugaucgaguucugcuacaagagcagagccgagagcaagagaaugaagcugaccaagaacacccagaacuucaagcccgcccccgccaccaacacccagaacuacgccaccuacagagagggcuacaacguguacggcaccgagagcgugaagaucuaa

SEQ ID NO: 17774 - RNA, 2655 nt, Artificial Sequence
  GRIA4__Homo_sapiens__NP_001070711
augagaaucaucagcagacagaucgugcugcuguucagcggcuucuggggccuggccaugggcgccuuccccagcagcgugcagaucggcggccuguucaucagaaacaccgaccaggaguacaccgccuucagacuggccaucuuccugcacaacaccagccccaacgccagcgaggcccccuucaaccuggugccccacguggacaacaucgagaccgccaacagcuucgccgugaccaacgccuucugcagccaguacagcagaggcguguucgccaucuucggccuguacgacaagagaagcgugcacacccugaccagcuucugcagcgcccugcacaucagccugaucacccccagcuuccccaccgagggcgagagccaguucgugcugcagcugagacccagccugagaggcgcccugcugagccugcuggaccacuacgaguggaacugcuucguguuccuguacgacaccgacagaggcuacagcauccugcaggccaucauggagaaggccggccagaacggcuggcacgugagcgccaucugcguggagaacuucaacgacgugagcuacagacagcugcuggaggagcuggacagaagacaggagaagaaguucgugaucgacugcgagaucgagagacugcagaacauccuggagcagaucgugagcgugggcaagcacgugaagggcuaccacuacaucaucgccaaccugggcuucaaggacaucagccuggagagauucauccacggcggcgccaacgugaccggcuuccagcugguggacuucaacacccccauggugaucaagcugauggacagauggaagaagcuggaccagagagaguaccccggcagcgagaccccccccaaguacaccagcgcccugaccuacgacggcgugcuggugauggccgagaccuucagaagccugagaagacagaagaucgacaucagcagaagaggcaacgccggcgacugccuggccaaccccgccgcccccuggggccagggcaucgacauggagagaacccugaagcaggugagaauccagggccugaccggcaacgugcaguucgaccacuacggcagaagagugaacuacaccauggacguguucgagcugaagagcaccggccccagaaaggugggcuacuggaacgacauggacaagcuggugcugauccaggacgugcccacccugggcaacgacaccgccgccaucgagaacagaaccgugguggugaccaccaucauggagagccccuacgugauguacaagaagaaccacgagauguucgagggcaacgacaaguacgagggcuacugcguggaccuggccagcgagaucgccaagcacaucggcaucaaguacaagaucgccaucgugcccgacggcaaguacggcgccagagacgccgacaccaagaucuggaacggcauggugggcgagcugguguacggcaaggccgagaucgccaucgccccccugaccaucacccuggugagagaggaggugaucgacuucagcaagcccuucaugagccugggcaucagcaucaugaucaagaagccccagaagagcaagcccggcguguucagcuuccuggacccccuggccuacgagaucuggaugugcaucguguucgccuacaucggcgugagcguggugcuguuccuggugagcagauucagccccuacgaguggcacaccgaggagcccgaggacggcaaggagggccccagcgaccagccccccaacgaguucggcaucuucaacagccugugguucagccugggcgccuucaugcagcagggcugcgacaucagccccagaagccugagcggcagaaucgugggcggcguguggugguucuucacccugaucaucaucagcagcuacaccgccaaccuggccgccuuccugaccguggagagaauggugagccccaucgagagcgccgaggaccuggccaagcagaccgagaucgccuacggcacccuggacagcggcagcaccaaggaguucuucagaagaagcaagaucgccguguacgagaagauguggaccuacaugagaagcgccgagcccagcguguucaccagaaccaccgccgagggcguggccagagugagaaagagcaagggcaaguucgccuuccugcuggagagcaccaugaacgaguacaucgagcagagaaagcccugcgacaccaugaaggugggcggcaaccuggacagcaagggcuacggcguggccacccccaagggcagcagccugggcaacgccgugaaccuggccgugcugaagcugaacgagcagggccugcuggacaagcugaagaacaaguggugguacgacaagggcgagugcggcagcggcggcggcgacagcaaggacaagaccagcgcccugagccugagcaacguggccggcguguucuacauccuggugggcggccugggccuggccaugcugguggcccugaucgaguucugcuacaagagcagagccgaggccaagagaaugaagguggccaagagcgcccagaccuucaaccccaccagcagccagaacacccagaaccuggccaccuacagagagggcuacaacguguacggcaccgagagcaucaagaucuaa

SEQ ID NO: 17775 - RNA, 3030 nt, Artificial Sequence
  GRID1__Homo_sapiens__NP_060021
auggaggcccugacccuguggcugcugcccuggaucugccagugcgugagcgugagagccgacagcaucauccacaucggcgccaucuucgaggagaacgccgccaaggacgacagaguguuccagcuggccgugagcgaccugagccugaacgacgacauccugcagagcgagaagaucaccuacagcaucaaggugaucgaggccaacaaccccuuccaggccgugcaggaggccugcgaccugaugacccagggcauccuggcccuggugaccagcaccggcugcgccagcgccaacgcccugcagagccugaccgacgccaugcacaucccccaccuguucgugcagagaaaccccggcggcagccccagaaccgccugccaccugaaccccagccccgacggcgaggccuacacccuggccagcagaccccccgugagacugaacgacgugaugcugagacuggugaccgagcugagauggcagaaguucgugauguucuacgacagcgaguacgacaucagaggccugcagagcuuccuggaccaggccagcagacugggccuggacgugagccugcagaagguggacaagaacaucagccacguguucaccagccuguucaccaccaugaagaccgaggagcugaacagauacagagacacccugagaagagccauccugcugcugagcccccagggcgcccacagcuucaucaacgaggccguggagaccaaccuggccagcaaggacagccacuggguguucgugaacgaggagaucagcgaccccgagauccuggaccuggugcacagcgcccugggcagaaugaccguggugagacagaucuuccccagcgccaaggacaaccagaagugcaccagaaacaaccacagaaucagcagccugcugugcgacccccaggagggcuaccugcagaugcugcagaucagcaaccuguaccuguacgacagcgugcugaugcuggccaacgccuuccacagaaagcuggaggacagaaaguggcacagcauggccagccugaacugcaucagaaagagcaccaagcccuggaacggcggcagaagcaugcuggacaccaucaagaagggccacaucaccggccugaccggcgugauggaguucagagaggacagcagcaaccccuacgugcaguucgagauccugggcaccaccuacagcgagaccuucggcaaggacaugagaaagcuggccaccugggacagcgagaagggccugaacggcagccugcaggagagacccaugggcagcagacugcagggccugacccugaagguggugaccgugcuggaggagcccuucgugaugguggccgagaacauccugggccagcccaagagauacaagggcuucagcaucgacgugcuggacgcccuggccaaggcccugggcuucaaguacgagaucuaccaggcccccgacggcagauacggccaccagcugcacaacaccagcuggaacggcaugaucggcgagcugaucagcaagagagccgaccuggccaucagcgccaucaccaucacccccgagagagagagcgugguggacuucagcaagagauacauggacuacagcgugggcauccugaucaagaagcccgaggagaagaucagcaucuucagccuguucgcccccuucgacuucgccgugugggccugcaucgccgccgccauccccguggugggcgugcugaucuucgugcugaacagaauccaggccgugagagcccagagcgccgcccagcccagacccagcgccagcgccacccugcacagcgccaucuggaucguguacggcgccuucgugcagcagggcggcgagagcagcgugaacagcauggccaugagaaucgugaugggcagcugguggcuguucacccugaucgugugcagcagcuacaccgccaaccuggccgccuuccugaccgugagcagaauggacaaccccaucagaaccuuccaggaccugagcaagcagguggagaugagcuacggcaccgugagagacagcgccguguacgaguacuucagagccaagggcaccaacccccuggagcaggacagcaccuucgccgagcuguggagaaccaucagcaagaacggcggcgccgacaacugcgugagcagccccagcgagggcaucagaaaggccaagaagggcaacuacgccuuccugugggacguggccgugguggaguacgccgcccugaccgacgacgacugcagcgugaccgugaucggcaacagcaucagcagcaagggcuacggcaucgcccugcagcacggcagccccuacagagaccuguucagccagagaauccuggagcugcaggacaccggcgaccuggacgugcugaagcagaagugguggccccacaugggcagaugcgaccugaccagccacgccagcgcccaggccgacggcaagagccugaagcugcacagcuucgccggcguguucugcauccuggccaucggccugcugcuggccugccugguggccgcccuggagcugugguggaacagcaacagaugccaccaggagacccccaaggaggacaaggaggugaaccuggagcaggugcacagaagaaugaacagccugauggacgaggacaucgcccacaagcagaucagccccgccagcaucgagcugagcgcccuggagaugggcggccuggcccccacccagacccuggagcccaccagagaguaccagaacacccagcugagcgugagcaccuuccugcccgagcagagcagccacggcaccagcagaacccugagcagcggccccagcagcaaccugccccugccccugagcagcagcgccaccaugcccagcaugcagugcaagcacagaagccccaacggcggccuguucagacagagccccgugaagacccccauccccaugagcuuccagcccgugcccggcggcgugcugcccgaggcccuggacaccagccacggcaccagcaucuaa

SEQ ID NO: 17776 - RNA, 2739 nt, Artificial Sequence
  GRID2__Homo_sapiens__NP_001273767
auggagguguuccccuuccugcuggugcugagcgugugguggagcagaaccugggacagcgccaacgccgacagcaucauccacaucggcgccaucuucgacgagagcgccaagaaggacgacgagguguucagaaccgccgugggcgaccugaaccagaacgaggagauccugcagaccgagaagaucaccuucagcgugaccuucguggacggcaacaaccccuuccaggccgugcaggaggacaucagaggcauccaggaguuccuggacaaggugagccagcagggcauggacguggcccugcagaagguggagaacaacaucaacaagaugaucaccacccuguucgacaccaugagaaucgaggagcugaacagauacagagacacccugagaagagccauccuggugaugaaccccgccaccgccaagagcuucaucaccgaggugguggagaccaaccugguggccuucgacugccacuggaucaucaucaacgaggagaucaacgacguggacgugcaggagcuggugagaagaagcaucggcagacugaccaucaucagacagaccuuccccgugccccagaacaucagccagagaugcuucagaggcaaccacagaaucagcagcacccugugcgaccccaaggaccccuucgcccagaacauggagaucagcaaccuguacaucuacgacaccgugcugcugcuggccaacgccuuccacaagaagcuggaggacagaaaguggcacagcauggccagccugagcugcaucagaaagaacagcaagcccuggcagggcggcagaagcaugcuggagaccaucaagaagggcggcgugagcggccugaccggcgagcuggaguucggcgagaacggcggcaaccccaacgugcacuucgagauccugggcaccaacuacggcgaggagcugggcagaggcgugagaaagcugggcugcuggaaccccgugaccggccugaacggcagccugaccgacaagaagcuggagaacaacaugagaggcguggugcugagaguggugaccgugcuggaggagcccuucgugauggugagcgagaacgugcugggcaagcccaagaaguaccagggcuucagcaucgacgugcuggacgcccugagcaacuaccugggcuucaacuacgagaucuacguggcccccgaccacaaguacggcagcccccaggaggacggcaccuggaacggccuggugggcgagcugguguucaagagagccgacaucggcaucagcgcccugaccaucacccccgacagagagaacgugguggacuucaccaccagauacauggacuacagcgugggcgugcugcugagaagagccgagaagaccguggacauguucgccugccuggcccccuucgaccugagccugugggccugcaucgccggcaccgugcugcuggugggccugcugguguaccugcugaacuggcugaacccccccagacugcagaugggcagcaugaccagcaccacccuguacaacagcaugugguucguguacggcagcuucgugcagcagggcggcgaggugcccuacaccacccuggccaccagaaugaugaugggcgccugguggcuguucgcccugaucgugaucagcagcuacaccgccaaccuggccgccuuccugaccaucaccagaaucgagagcagcauccagagccugcaggaccugagcaagcagaccgagauccccuacggcaccgugcuggacagcgccguguacgagcacgugagaaugaagggccugaaccccuucgagagagacagcauguacagccagauguggagaaugaucaacagaagcaacggcagcgagaacaacgugcuggagagccaggccggcauccagaaggugaaguacggcaacuacgccuucgugugggacgccgccgugcuggaguacguggccaucaacgaccccgacugcagcuucuacaccaucggcaacaccguggccgacagaggcuacggcaucgcccugcagcacggcagccccuacagagacguguucagccagagaauccuggagcugcagcagaacggcgacauggacauccugaagcacaagugguggcccaagaacggccagugcgaccuguacagcagcguggacaccaagcagaagggcggcgcccuggacaucaagagcuucgccggcguguucugcauccuggccgccggcaucgugcugagcugcuucaucgccaugcuggagaccugguggaacaagagaaagggcagcagagugcccagcaaggaggacgacaaggagaucgaccuggagcaccugcacagaagagugaacagccugugcaccgacgacgacagcccccacaagcaguucagcaccagcagcaucgaccugaccccccuggacaucgacacccugcccaccagacaggcccuggagcagaucagcgacuucagaaacacccacaucaccaccaccaccuucauccccgagcagauccagacccugagcagaacccugagcgccaaggccgccagcggcuucaccuucggcaacgugcccgagcacagaaccggccccuucagacacagagcccccaacggcggcuucuucagaagccccaucaagaccaugagcagcauccccuaccagcccacccccacccugggccugaaccugggcaacgaccccgacagaggcaccagcaucuaa

SEQ ID NO: 17777 - RNA, 2757 nt, Artificial Sequence
  GRIK1__Homo_sapiens__NP_000821
auggagcacggcacccugcuggcccagcccggccuguggaccagagacaccagcugggcccugcuguacuuccugugcuacauccugccccagaccgccccccaggugcugagaaucggcggcaucuucgagaccguggagaacgagcccgugaacguggaggagcuggccuucaaguucgccgugaccagcaucaacagaaacagaacccugaugcccaacaccacccugaccuacgacauccagagaaucaaccuguucgacagcuucgaggccagcagaagagccugcgaccagcuggcccugggcguggccgcccuguucggccccagccacagcagcagcgugagcgccgugcagagcaucugcaacgcccuggaggugccccacauccagaccagauggaagcaccccagcguggacaacaaggaccuguucuacaucaaccuguaccccgacuacgccgccaucagcagagccauccuggaccuggugcuguacuacaacuggaagaccgugaccgugguguacgaggacagcaccggccugaucagacugcaggagcugaucaaggcccccagcagauacaacaucaagaucaagaucagacagcugcccagcggcaacaaggacgccaagccccugcugaaggagaugaagaagggcaaggaguucuacgugaucuucgacugcagccacgagaccgccgccgagauccugaagcagauccuguucaugggcaugaugaccgaguacuaccacuacuucuucaccacccuggaccuguucgcccuggaccuggagcuguacagauacagcggcgugaacaugaccggcuucagacugcugaacaucgacaacccccacgugagcagcaucaucgagaaguggagcauggagagacugcaggccccccccagacccgagaccggccugcuggacggcaugaugaccaccgaggccgcccugauguacgacgccguguacaugguggccaucgccagccacagagccagccagcugaccgugagcagccugcagugccacagacacaagcccuggagacugggccccagauucaugaaccugaucaaggaggccagaugggacggccugaccggccacaucaccuucaacaagaccaacggccugagaaaggacuucgaccuggacaucaucagccugaaggaggagggcaccgagaaggccgccggcgaggugagcaagcaccuguacaagguguggaagaagaucggcaucuggaacagcaacagcggccugaacaugaccgacagcaacaaggacaagagcagcaacaucaccgacagccuggccaacagaacccugaucgugaccaccauccuggaggagcccuacgugauguacagaaagagcgacaagccccuguacggcaacgacagauucgagggcuacugccuggaccugcugaaggagcugagcaacauccugggcuucaucuacgacgugaagcuggugcccgacggcaaguacggcgcccagaacgacaagggcgaguggaacggcauggugaaggagcugaucgaccacagagccgaccuggccguggccccccugaccaucaccuacgugagagagaaggugaucgacuucagcaagcccuucaugacccugggcaucagcauccuguacagaaagcccaacggcaccaaccccggcguguucagcuuccugaacccccugagccccgacaucuggauguacgugcugcuggccugccugggcgugagcugcgugcuguucgugaucgccagauucacccccuacgagugguacaacccccaccccugcaaccccgacagcgacgugguggagaacaacuucacccugcugaacagcuucugguucggcgugggcgcccugaugcagcagggcagcgagcugaugcccaaggcccugagcaccagaaucgugggcggcaucuggugguucuucacccugaucaucaucagcagcuacaccgccaaccuggccgccuuccugaccguggagagaauggagagccccaucgacagcgccgacgaccuggccaagcagaccaagaucgaguacggcgccgugagagacggcagcaccaugaccuucuucaagaagagcaagaucagcaccuacgagaagaugugggccuucaugagcagcagacagcagaccgcccuggugagaaacagcgacgagggcauccagagagugcugaccaccgacuacgcccugcugauggagagcaccagcaucgaguacgugacccagagaaacugcaaccugacccagaucggcggccugaucgacagcaagggcuacggcgugggcacccccaucggcagccccuacagagacaagaucaccaucgccauccugcagcugcaggaggagggcaagcugcacaugaugaaggagaagugguggagaggcaacggcugccccgaggaggacaacaaggaggccagcgcccugggcguggagaacaucggcggcaucuucaucgugcuggccgccggccuggugcugagcguguucguggccaucggcgaguucaucuacaagagcagaaagaacaacgacaucgagcaggccuucugcuucuucuacggccugcagugcaagcagacccaccccaccaacagcaccagcggcaccacccugagcaccgaccuggagugcggcaagcugaucagagaggagagaggcaucagaaagcagagcagcgugcacaccguguaa

SEQ ID NO: 17778 - RNA, 2727 nt, Artificial Sequence
  GRIK2__Homo_sapiens__XP_005267002
augaagaucaucuuccccauccugagcaaccccguguucagaagaaccgugaagcugcugcugugccugcuguggaucggcuacagccagggcaccacccacgugcugagauucggcggcaucuucgaguacguggagagcggccccaugggcgccgaggagcuggccuucagauucgccgugaacaccaucaacagaaacagaacccugcugcccaacaccacccugaccuacgacacccagaagaucaaccuguacgacagcuucgaggccagcaagaaggccugcgaccagcugagccugggcguggccgccaucuucggccccagccacagcagcagcgccaacgccgugcagagcaucugcaacgcccugggcgugccccacauccagaccagauggaagcaccaggugagcgacaacaaggacagcuucuacgugagccuguaccccgacuucagcagccugagcagagccauccuggaccuggugcaguucuucaaguggaagaccgugaccgugguguacgacgacagcaccggccugaucagacugcaggagcugaucaaggcccccagcagauacaaccugagacugaagaucagacagcugcccgccgacaccaaggacgccaagccccugcugaaggagaugaagagaggcaaggaguuccacgugaucuucgacugcagccacgagauggccgccggcauccugaagcaggcccuggccaugggcaugaugaccgaguacuaccacuacaucuucaccacccuggaccuguucgcccuggacguggagcccuacagauacagcggcgugaacaugaccggcuucagaauccugaacaccgagaacacccaggugagcagcaucaucgagaaguggagcauggagagacugcaggccccccccaagcccgacagcggccugcuggacggcuucaugaccaccgacgccgcccugauguacgacgccgugcacguggugagcguggccgugcagcaguucccccagaugaccgugagcagccugcagugcaacagacacaagcccuggagauucggcaccagauucaugagccugaucaaggaggcccacugggagggccugaccggcagaaucaccuucaacaagaccaacggccugagaaccgacuucgaccuggacgugaucagccugaaggaggagggccuggagaagaucggcaccugggaccccgccagcggccugaacaugaccgagagccagaagggcaagcccgccaacaucaccgacagccugagcaacagaagccugaucgugaccaccauccuggaggagcccuacgugcuguucaagaagagcgacaagccccuguacggcaacgacagauucgagggcuacugcaucgaccugcugagagagcugagcaccauccugggcuucaccuacgagaucagacugguggaggacggcaaguacggcgcccaggacgacgccaacggccaguggaacggcauggugagagagcugaucgaccacaaggccgaccuggccguggccccccuggccaucaccuacgugagagagaaggugaucgacuucagcaagcccuucaugacccugggcaucagcauccuguacagaaagcccaacggcaccaaccccggcguguucagcuuccugaacccccugagccccgacaucuggauguacauccugcuggccuaccugggcgugagcugcgugcuguucgugaucgccagauucagccccuacgagugguacaacccccaccccugcaaccccgacagcgacgugguggagaacaacuucacccugcugaacagcuucugguucggcgugggcgcccugaugcagcagggcagcgagcugaugcccaaggcccugagcaccagaaucgugggcggcaucuggugguucuucacccugaucaucaucagcagcuacaccgccaaccuggccgccuuccugaccguggagagaauggagagccccaucgacagcgccgacgaccuggccaagcagaccaagaucgaguacggcgccguggaggacggcgccaccaugaccuucuucaagaagagcaagaucagcaccuacgacaagaugugggccuucaugagcagcagaagacagagcgugcuggugaagagcaacgaggagggcauccagagagugcugaccagcgacuacgccuuccugauggagagcaccaccaucgaguucgugacccagagaaacugcaaccugacccagaucggcggccugaucgacagcaagggcuacggcgugggcacccccaugggcagccccuacagagacaagaucaccaucgccauccugcagcugcaggaggagggcaagcugcacaugaugaaggagaagugguggagaggcaacggcugccccgaggaggagagcaaggaggccagcgcccugggcgugcagaacaucggcggcaucuucaucgugcuggccgccggccuggugcugagcguguucguggccgugggcgaguuccuguacaagagcaagaagaacgcccagcuggagaagagaagcuucugcagcgccaugguggaggagcugagaaugagccugaagugccagagaagacugaagcacaagccccaggcccccgugaucgugaagaccgaggaggugaucaacaugcacaccuucaacgacagaagacugcccggcaaggagaccauggccuaa

SEQ ID NO: 17779 - RNA, 2871 nt, Artificial Sequence
  GRIK4__Homo_sapiens__NP_001269399
augcccagagugagcgccccccuggugcugcugcccgccuggcuggugaugguggccugcagcccccacagccugagaaucgccgccauccuggacgaccccauggagugcagcagaggcgagagacugagcaucacccuggccaagaacagaaucaacagagcccccgagagacugggcaaggccaagguggagguggacaucuucgagcugcugagagacagcgaguacgagaccgccgagaccaugugccagauccugcccaagggcgugguggccgugcugggccccagcagcagccccgccagcagcagcaucaucagcaacaucugcggcgagaaggaggugccccacuucaagguggcccccgaggaguucgugaaguuccaguuccagagauucaccacccugaaccugcaccccagcaacaccgacaucagcguggccguggccggcauccugaacuucuucaacugcaccaccgccugccugaucugcgccaaggccgagugccugcugaaccuggagaagcugcugagacaguuccugaucagcaaggacacccugagcgugagaaugcuggacgacaccagagaccccaccccccugcugaaggagaucagagacgacaagaccgccaccaucaucauccacgccaacgccagcaugagccacaccauccugcugaaggccgccgagcugggcauggugagcgccuacuacaccuacaucuucaccaaccuggaguucagccugcagagaauggacagccugguggacgacagagugaacauccugggcuucagcaucuucaaccagagccacgccuucuuccaggaguucgcccagagccugaaccagagcuggcaggagaacugcgaccacgugcccuucaccggccccgcccugagcagcgcccugcuguucgacgccguguacgccguggugaccgccgugcaggagcugaacagaagccaggagaucggcgugaagccccugagcugcggcagcgcccagaucuggcagcacggcaccagccugaugaacuaccugagaaugguggagcuggagggccugaccggccacaucgaguucaacagcaagggccagagaagcaacuacgcccugaagauccugcaguucaccagaaacggcuucagacagaucggccaguggcacguggccgagggccugagcauggacagccaccuguacgccagcaacaucagcgacacccuguucaacaccacccugguggugaccaccauccuggagaaccccuaccugaugcugaagggcaaccaccaggagauggagggcaacgacagauacgagggcuucugcguggacaugcugaaggagcuggccgagauccugagauucaacuacaagaucagacuggugggcgacggcguguacggcgugcccgaggccaacggcaccuggaccggcauggugggcgagcugaucgccagaaaggccgaccuggccguggccggccugaccaucaccgccgagagagagaaggugaucgacuucagcaagcccuucaugacccugggcaucagcauccuguacagagugcacaugggcagaaagcccggcuacuucagcuuccuggaccccuucagccccggcguguggcuguucaugcugcuggccuaccuggccgugagcugcgugcuguuccugguggccagacugacccccuacgagugguacagcccccaccccugcgcccagggcagaugcaaccugcuggugaaccaguacagccugggcaacagccugugguuccccgugggcggcuucaugcagcagggcagcaccaucgcccccagagcccugagcaccagaugcgugagcggcguguggugggccuucacccugaucaucaucagcagcuacaccgccaaccuggccgccuuccugaccgugcagagaauggacgugcccaucgagagcguggacgaccuggccgaccagaccgccaucgaguacggcaccauccacggcggcagcagcaugaccuucuuccagaacagcagauaccagaccuaccagagaauguggaacuacauguacagcaagcagcccagcguguucgugaagagcaccgaggagggcaucgccagagugcugaacagcaacuacgccuuccugcuggagagcaccaugaacgaguacuacagacagagaaacugcaaccugacccagaucggcggccugcuggacaccaagggcuacggcaucggcaugcccgugggcagcguguucagagacgaguucgaccuggccauccugcagcugcaggagaacaacagacuggagauccugaagagaaaguggugggagggcggcaagugccccaaggaggaggaccacagagccaagggccugggcauggagaacaucggcggcaucuucguggugcugaucugcggccugaucguggccaucuucauggccaugcuggaguuccuguggacccugagacacagcgaggccaccgaggugagcgugugccaggagauggugaccgagcugagaagcaucauccugugccaggacagcauccaccccagaagaagaagagccgccgugcccccccccagaccccccauccccgaggagagaagacccagaggcaccgccacccugagcaacggcaagcugugcggcgccggcgagcccgaccagcuggcccagagacuggcccaggaggccgcccugguggccagaggcugcacccacaucagagugugccccgagugcagaagauuccagggccugagagccagacccagccccgccagaagcgaggagagccuggagugggagaagaccaccaacagcagcgagcccgaguaa

SEQ ID NO: 17780 - RNA, 2946 nt, Artificial Sequence
  GRIK5__Homo_sapiens__NP_001287959
augcccgccgagcugcugcugcugcugaucguggccuucgccagccccagcugccaggugcugagcagccugagaauggccgccauccuggacgaccagaccgugugcggcagaggcgagagacuggcccuggcccuggccagagagcagaucaacggcaucaucgaggugcccgccaaggccagaguggagguggacaucuucgagcugcagagagacagccaguacgagaccaccgacaccaugugccagauccugcccaagggcguggugagcgugcugggccccagcagcagccccgccagcgccagcaccgugagccacaucugcggcgagaaggagaucccccacaucaaggugggccccgaggagacccccagacugcaguaccugagauucgccagcgugagccuguaccccagcaacgaggacgugagccuggccgugagcagaauccugaagagcuucaacuaccccagcgccagccugaucugcgccaaggccgagugccugcugagacuggaggagcuggugagaggcuuccugaucagcaaggagacccugagcgugagaaugcuggacgacagcagagaccccaccccccugcugaaggagaucagagacgacaaggugagcaccaucaucaucgacgccaacgccagcaucagccaccugauccugagaaaggccagcgagcugggcaugaccagcgccuucuacaaguacauccugaccaccauggacuuccccauccugcaccuggacggcaucguggaggacagcagcaacauccugggcuucagcauguucaacaccagccaccccuucuaccccgaguucgugagaagccugaacaugagcuggagagagaacugcgaggccagcaccuaccugggccccgcccugagcgccgcccugauguucgacgccgugcacgugguggugagcgccgugagagagcugaacagaagccaggagaucggcgugaagccccuggccugcaccagcgccaacaucuggccccacggcaccagccugaugaacuaccugagaaugguggaguacgacggccugaccggcagaguggaguucaacagcaagggccagagaaccaacuacacccugagaauccuggagaagagcagacagggccacagagagaucggcgugugguacagcaacagaacccuggccaugaacgccaccacccuggacaucaaccugagccagacccuggccaacaagacccugguggugaccaccauccuggagaaccccuacgugaugagaagacccaacuuccaggcccugagcggcaacgagagauucgagggcuucugcguggacaugcugagagagcuggccgagcugcugagauucagauacagacugagacugguggaggacggccuguacggcgcccccgagcccaacggcagcuggaccggcauggugggcgagcugaucaacagaaaggccgaccuggccguggccgccuucaccaucaccgccgagagagagaaggugaucgacuucagcaagcccuucaugacccugggcaucagcauccuguacagagugcacaugggcagaaagcccggcuacuucagcuuccuggaccccuucagccccgccguguggcuguucaugcugcuggccuaccuggccgugagcugcgugcuguuccuggccgccagacugagccccuacgagugguacaacccccaccccugccugagagccagaccccacauccuggagaaccaguacacccugggcaacagccugugguuccccgugggcggcuucaugcagcagggcagcgagaucaugcccagagcccugagcaccagaugcgugagcggcguguggugggccuucacccugaucaucaucagcagcuacaccgccaaccuggccgccuuccugaccgugcagagaauggaggugcccguggagagcgccgacgaccuggccgaccagaccaacaucgaguacggcaccauccacgccggcagcaccaugaccuucuuccagaacagcagauaccagaccuaccagagaauguggaacuacaugcagagcaagcagcccagcguguucgugaagagcaccgaggagggcaucgccagagugcugaacagcagauacgccuuccugcuggagagcaccaugaacgaguaccacagaagacugaacugcaaccugacccagaucggcggccugcuggacaccaagggcuacggcaucggcaugccccugggcagccccuucagagacgagaucacccuggccauccugcagcugcaggagaacaacagacuggagauccugaagagaaaguggugggagggcggcagaugccccaaggaggaggaccacagagccaagggccugggcauggagaacaucggcggcaucuucaucgugcugaucugcggccugaucaucgccguguucguggccgugauggaguucaucuggagcaccagaagaagcgccgagagcgaggagacccccgcccugcaccccgccgccugccagugcagcgcccugggccccagaaccccccugaaggagcccagcaugcugcuggugaaggugcccagcaccagagugcagguggccuucagcagaaccagccugagacaggugugccccuuccugcugcagcaccagcugagcagccuguacuggauccaggccaccaacgugcagaucugcugccacuucagcagccugaagcccagccccgaccugaccuucccccccagccacagaccccugagcagccugcuguucaccgcccuggccgccgugggcggccugcccgacgccagcagcuucuucuucccccccaucagcagcugccccccccugcagagcggcaucggccccugccacagcaccgaggccacccuggugaccagcaacuuccacguguaa

SEQ ID NO: 17781 - RNA, 2658 nt, Artificial Sequence
  GRIN1__Homo_sapiens__NP_000823
augagcaccaugagacugcugacccuggcccugcuguucagcugcagcguggccagagccgccugcgaccccaagaucgugaacaucggcgccgugcugagcaccagaaagcacgagcagauguucagagaggccgugaaccaggccaacaagagacacggcagcuggaagauccagcugaacgccaccagcgugacccacaagcccaacgccauccagauggcccugagcgugugcgaggaccugaucagcagccagguguacgccauccuggugagccacccccccacccccaacgaccacuucacccccacccccgugagcuacaccgccggcuucuacagaauccccgugcugggccugaccaccagaaugagcaucuacagcgacaagagcauccaccugagcuuccugagaaccgugccccccuacagccaccagagcagcgugugguucgagaugaugagaguguacagcuggaaccacaucauccugcuggugagcgacgaccacgagggcagagccgcccagaagagacuggagacccugcuggaggagagagagagcaaggccgagaaggugcugcaguucgaccccggcaccaagaacgugaccgcccugcugauggaggccaaggagcuggaggccagagugaucauccugagcgccagcgaggacgacgccgccaccguguacagagccgccgccaugcugaacaugaccggcagcggcuacguguggcuggugggcgagagagagaucagcggcaacgcccugagauacgcccccgacggcauccugggccugcagcugaucaacggcaagaacgagagcgcccacaucagcgacgccgugggcgugguggcccaggccgugcacgagcugcuggagaaggagaacaucaccgacccccccagaggcugcgugggcaacaccaacaucuggaagaccggcccccuguucaagagagugcugaugagcagcaaguacgccgacggcgugaccggcagaguggaguucaacgaggacggcgacagaaaguucgccaacuacagcaucaugaaccugcagaacagaaagcuggugcaggugggcaucuacaacggcacccacgugauccccaacgacagaaagaucaucuggcccggcggcgagaccgagaagcccagaggcuaccagaugagcaccagacugaagaucgugaccauccaccaggagcccuucguguacgugaagcccacccugagcgacggcaccugcaaggaggaguucaccgugaacggcgaccccgugaagaaggugaucugcaccggccccaacgacaccagccccggcagccccagacacaccgugccccagugcugcuacggcuucugcaucgaccugcugaucaagcuggccagaaccaugaacuucaccuacgaggugcaccugguggccgacggcaaguucggcacccaggagagagugaacaacagcaacaagaaggaguggaacggcaugaugggcgagcugcugagcggccaggccgacaugaucguggccccccugaccaucaacaacgagagagcccaguacaucgaguucagcaagcccuucaaguaccagggccugaccauccuggugaagaaggagauccccagaagcacccuggacagcuucaugcagcccuuccagagcacccuguggcugcuggugggccugagcgugcacgugguggccgugaugcuguaccugcuggacagauucagccccuucggcagauucaaggugaacagcgaggaggaggaggaggacgcccugacccugagcagcgccaugugguucagcuggggcgugcugcugaacagcggcaucggcgagggcgcccccagaagcuucagcgccagaauccugggcauggugugggccggcuucgccaugaucaucguggccagcuacaccgccaaccuggccgccuuccuggugcuggacagacccgaggagagaaucaccggcaucaacgaccccagacugagaaaccccagcgacaaguucaucuacgccaccgugaagcagagcagcguggacaucuacuucagaagacagguggagcugagcaccauguacagacacauggagaagcacaacuacgagagcgccgccgaggccauccaggccgugagagacaacaagcugcacgccuucaucugggacagcgccgugcuggaguucgaggccagccagaagugcgaccuggugaccaccggcgagcuguucuucagaagcggcuucggcaucggcaugagaaaggacagccccuggaagcagaacgugagccugagcauccugaagagccacgagaacggcuucauggaggaccuggacaagaccugggugagauaccaggagugcgacagcagaagcaacgcccccgccacccugaccuucgagaacauggccggcguguucaugcugguggccggcggcaucguggccggcaucuuccugaucuucaucgagaucgccuacaagagacacaaggacgccagaagaaagcagaugcagcuggccuucgccgccgugaacguguggagaaagaaccugcagcaguaccaccccaccgacaucaccggcccccugaaccugagcgaccccagcgugagcaccgugguguaa

SEQ ID NO: 17782 - RNA, 4395 nt, Artificial Sequence
  GRIN2A__Homo_sapiens__NP_000824
augggcagagugggcuacuggacccugcuggugcugcccgcccugcugguguggagaggccccgcccccagcgccgccgccgagaagggcccccccgcccugaacaucgccgugaugcugggccacagccacgacgugaccgagagagagcugagaacccuguggggccccgagcaggccgccggccugccccuggacgugaacgugguggcccugcugaugaacagaaccgaccccaagagccugaucacccacgugugcgaccugaugagcggcgccagaauccacggccugguguucggcgacgacaccgaccaggaggccguggcccagaugcuggacuucaucagcagccacaccuucgugcccauccugggcauccacggcggcgccagcaugaucauggccgacaaggaccccaccagcaccuucuuccaguucggcgccagcauccagcagcaggccaccgugaugcugaagaucaugcaggacuacgacuggcacguguucagccuggugaccaccaucuuccccggcuacagagaguucaucagcuucgugaagaccaccguggacaacagcuucgugggcugggacaugcagaacgugaucacccuggacaccagcuucgaggacgccaagacccaggugcagcugaagaagauccacagcagcgugauccugcuguacugcagcaaggacgaggccgugcugauccugagcgaggccagaagccugggccugaccggcuacgacuucuucuggaucgugcccagccuggugagcggcaacaccgagcugauccccaaggaguuccccagcggccugaucagcgugagcuacgacgacugggacuacagccuggaggccagagugagagacggcaucggcauccugaccaccgccgccagcagcaugcuggagaaguucagcuacauccccgaggccaaggccagcugcuacggccagauggagagacccgaggugcccaugcacacccugcaccccuucauggugaacgugaccugggacggcaaggaccugagcuucaccgaggagggcuaccaggugcaccccagacugguggugaucgugcugaacaaggacagagagugggagaaggugggcaagugggagaaccacacccugagccugagacacgccguguggcccagauacaagagcuucagcgacugcgagcccgacgacaaccaccugagcaucgugacccuggaggaggcccccuucgugaucguggaggacaucgacccccugaccgagaccugcgugagaaacaccgugcccugcagaaaguucgugaagaucaacaacagcaccaacgagggcaugaacgugaagaagugcugcaagggcuucugcaucgacauccugaagaagcugagcagaaccgugaaguucaccuacgaccuguaccuggugaccaacggcaagcacggcaagaaggugaacaacguguggaacggcaugaucggcgaggugguguaccagagagccgugauggccgugggcagccugaccaucaacgaggagagaagcgaggugguggacuucagcgugcccuucguggagaccggcaucagcgugauggugagcagaagcaacggcaccgugagccccagcgccuuccuggagcccuucagcgccagcgugugggugaugauguucgugaugcugcugaucgugagcgccaucgccguguucguguucgaguacuucagccccgugggcuacaacagaaaccuggccaagggcaaggccccccacggccccagcuucaccaucggcaaggccaucuggcugcuguggggccugguguucaacaacagcgugcccgugcagaaccccaagggcaccaccagcaagaucauggugagcgugugggccuucuucgccgugaucuuccuggccagcuacaccgccaaccuggccgccuucaugauccaggaggaguucguggaccaggugaccggccugagcgacaagaaguuccagagaccccacgacuacagcccccccuucagauucggcaccgugcccaacggcagcaccgagagaaacaucagaaacaacuaccccuacaugcaccaguacaugaccaaguucaaccagaagggcguggaggacgcccuggugagccugaagaccggcaagcuggacgccuucaucuacgacgccgccgugcugaacuacaaggccggcagagacgagggcugcaagcuggugaccaucggcagcggcuacaucuucgccaccaccggcuacggcaucgcccugcagaagggcagccccuggaagagacagaucgaccuggcccugcugcaguucgugggcgacggcgagauggaggagcuggagacccuguggcugaccggcaucugccacaacgagaagaacgaggugaugagcagccagcuggacaucgacaacauggccggcguguucuacaugcuggccgccgccauggcccugagccugaucaccuucaucugggagcaccuguucuacuggaagcugagauucugcuucaccggcgugugcagcgacagacccggccugcuguucagcaucagcagaggcaucuacagcugcauccacggcgugcacaucgaggagaagaagaagagccccgacuucaaccugaccggcagccagagcaacaugcugaagcugcugagaagcgccaagaacaucagcagcaugagcaacaugaacagcagcagaauggacagccccaagagagccgccgacuucauccagagaggcagccugaucauggacauggugagcgacaagggcaaccugauguacagcgacaacagaagcuuccagggcaaggagagcaucuucggcgacaacaugaacgagcugcagaccuucguggccaacagacagaaggacaaccugaacaacuacguguuccagggccagcacccccugacccugaacgagagcaaccccaacaccguggagguggccgugagcaccgagagcaaggccaacagcagacccagacagcuguggaagaagagcguggacagcaucagacaggacagccugagccagaaccccgugagccagagagacgaggccaccgccgagaacagaacccacagccugaagagccccagauaccugcccgaggagauggcccacagcgacaucagcgagaccagcaacagagccaccugccacagagagcccgacaacagcaagaaccacaagaccaaggacaacuucaagagaagcguggccagcaaguaccccaaggacugcagcgagguggagagaaccuaccugaagaccaagagcagcagccccagagacaagaucuacaccaucgacggcgagaaggagcccggcuuccaccuggaccccccccaguucguggagaacgugacccugcccgagaacguggacuuccccgaccccuaccaggaccccagcgagaacuucagaaagggcgacagcacccugcccaugaacagaaacccccugcacaacgaggagggccugagcaacaacgaccaguacaagcuguacagcaagcacuucacccugaaggacaagggcagcccccacagcgagaccagcgagagauacagacagaacagcacccacugcagaagcugccugagcaacaugcccaccuacagcggccacuucaccaugagaagccccuucaagugcgacgccugccugagaaugggcaaccuguacgacaucgacgaggaccagaugcugcaggagaccggcaaccccgccaccggcgagcagguguaccagcaggacugggcccagaacaacgcccugcagcugcagaagaacaagcugagaaucagcagacagcacagcuacgacaacaucguggacaagcccagagagcuggaccugagcagacccagcagaagcaucagccugaaggacagagagagacugcuggagggcaacuucuacggcagccuguucagcgugcccagcagcaagcugagcggcaagaagagcagccuguucccccagggccuggaggacagcaagagaagcaagagccugcugcccgaccacaccagcgacaaccccuuccugcacagccacagagacgaccagagacuggugaucggcagaugccccagcgaccccuacaagcacagccugcccagccaggccgugaacgacagcuaccugagaagcagccugagaagcaccgccagcuacugcagcagagacagcagaggccacaacgacguguacaucagcgagcacgugaugcccuacgccgccaacaagaacaacauguacagcacccccagagugcugaacagcugcagcaacagaagaguguacaagaagaugcccagcaucgagagcgacguguaa

SEQ ID NO: 17783 - RNA, 4455 nt, Artificial Sequence
  GRIN2B__Homo_sapiens__XP_011518932
augaagcccagagccgagugcugcagccccaaguucuggcuggugcuggccgugcuggccgugagcggcagcagagccagaagccagaagagcccccccagcaucggcaucgccgugauccuggugggcaccagcgacgagguggccaucaaggacgcccacgagaaggacgacuuccaccaccugagcguggugcccagaguggagcugguggccaugaacgagaccgaccccaagagcaucaucaccagaaucugcgaccugaugagcgacagaaagauccagggcgugguguucgccgacgacaccgaccaggaggccaucgcccagauccuggacuucaucagcgcccagacccugacccccauccugggcauccacggcggcagcagcaugaucauggccgacaaggacgagagcagcauguucuuccaguucggccccagcaucgagcagcaggccagcgugaugcugaacaucauggaggaguacgacugguacaucuucagcaucgugaccaccuacuuccccggcuaccaggacuucgugaacaagaucagaagcaccaucgagaacagcuucgugggcugggagcuggaggaggugcugcugcuggacaugagccuggacgacggcgacagcaagauccagaaccagcugaagaagcugcagagccccaucauccugcuguacugcaccaaggaggaggccaccuacaucuucgagguggccaacagcgugggccugaccggcuacggcuacaccuggaucgugcccagccugguggccggcgacaccgacaccgugcccgccgaguuccccaccggccugaucagcgugagcuacgacgagugggacuacggccugcccgccagagugagagacggcaucgccaucaucaccaccgccgccagcgacaugcugagcgagcacagcuucauccccgagcccaagagcagcugcuacaacacccacgagaagagaaucuaccagagcaacaugcugaacagauaccugaucaacgugaccuucgagggcagaaaccugagcuucagcgaggacggcuaccagaugcaccccaagcuggugaucauccugcugaacaaggagagaaagugggagagagugggcaaguggaaggacaagagccugcagaugaaguacuacguguggcccagaaugugccccgagaccgaggagcaggaggacgaccaccugagcaucgugacccuggaggaggcccccuucgugaucguggagagcguggacccccugagcggcaccugcaugagaaacaccgugcccugccagaagagaaucgugaccgagaacaagaccgacgaggagcccggcuacaucaagaagugcugcaagggcuucugcaucgacauccugaagaagaucagcaagagcgugaaguucaccuacgaccuguaccuggugaccaacggcaagcacggcaagaagaucaacggcaccuggaacggcaugaucggcgagguggugaugaagagagccuacauggccgugggcagccugaccaucaacgaggagagaagcgaggugguggacuucagcgugcccuucaucgagaccggcaucagcgugauggugagcagaagcaacggcaccgugagccccagcgccuuccuggagcccuucagcgccgacgugugggugaugauguucgugaugcugcugaucgugagcgccguggccguguucguguucgaguacuucagccccgugggcuacaacagaugccuggccgacggcagagagcccggcggccccagcuucaccaucggcaaggccaucuggcugcuguggggccugguguucaacaacagcgugcccgugcagaaccccaagggcaccaccagcaagaucauggugagcgugugggccuucuucgccgugaucuuccuggccagcuacaccgccaaccuggccgccuucaugauccaggaggaguacguggaccaggugagcggccugagcgacaagaaguuccagagacccaacgacuucagcccccccuucagauucggcaccgugcccaacggcagcaccgagagaaacaucagaaacaacuacgccgagaugcacgccuacaugggcaaguucaaccagagaggcguggacgacgcccugcugagccugaagaccggcaagcuggacgccuucaucuacgacgccgccgugcugaacuacauggccggcagagacgagggcugcaagcuggugaccaucggcagcggcaagguguucgccagcaccggcuacggcaucgccauccagaaggacagcggcuggaagagacagguggaccuggccauccugcagcuguucggcgacggcgagauggaggagcuggaggcccuguggcugaccggcaucugccacaacgagaagaacgaggugaugagcagccagcuggacaucgacaacauggccggcguguucuacaugcugggcgccgccauggcccugagccugaucaccuucaucugcgagcaccuguucuacuggcaguucagacacugcuucaugggcgugugcagcggcaagcccggcaugguguucagcaucagcagaggcaucuacagcugcauccacggcguggccaucgaggagagacagagcgugaugaacagccccaccgccaccaugaacaacacccacagcaacauccugagacugcugagaaccgccaagaacauggccaaccugagcggcgugaacggcagcccccagagcgcccuggacuucaucagaagagagagcagcguguacgacaucagcgagcacagaagaagcuucacccacagcgacugcaagagcuacaacaacccccccugcgaggagaaccuguucagcgacuacaucagcgagguggagagaaccuucggcaaccugcagcugaaggacagcaacguguaccaggaccacuaccaccaccaccacagaccccacagcaucggcagcgccagcagcaucgacggccuguacgacugcgacaacccccccuucaccacccagagcagaagcaucagcaagaagccccuggacaucggccugcccagcagcaagcacagccagcugagcgaccuguacggcaaguucagcuucaagagcgacagauacagcggccacgacgaccugaucagaagcgacgugagcgacaucagcacccacaccgugaccuacggcaacaucgagggcaacgccgccaagagaagaaagcagcaguacaaggacagccugaagaagagacccgccagcgccaagagcagaagagaguucgacgagaucgagcuggccuacagaagaagaccccccagaagccccgaccacaagagauacuucagagacaaggagggccugagagacuucuaccuggaccaguucagaaccaaggagaacagcccccacugggagcacguggaccugaccgacaucuacaaggagagaagcgacgacuucaagagagacagcgugagcggcggcggccccugcaccaacagaagccacaucaagcacggcaccggcgacaagcacggcguggugagcggcgugcccgcccccugggagaagaaccugaccaacguggagugggaggacagaagcggcggcaacuucugcagaagcugccccagcaagcugcacaacuacagcaccaccgugaccggccagaacagcggcagacaggccugcaucagaugcgaggccugcaagaaggccggcaaccuguacgacaucagcgaggacaacagccugcaggagcuggaccagcccgccgcccccguggccgugaccagcaacgccagcaccaccaaguacccccagagccccaccaacagcaaggcccagaagaagaacagaaacaagcugagaagacagcacagcuacgacaccuucguggaccugcagaaggaggaggccgcccuggcccccagaagcgugagccugaaggacaagggcagauucauggacggcagccccuacgcccacauguucgagaugagcgccggcgagagcaccuucgccaacaacaagagcagcgugcccaccgccggccaccaccaccacaacaaccccggcggcggcuacaugcugagcaagagccuguaccccgacagagugacccagaaccccuucauccccaccuucggcgacgaccagugccugcugcacggcagcaagagcuacuucuucagacagcccaccguggccggcgccagcaaggccagacccgacuucagagcccuggugaccaacaagcccguggugagcgcccugcacggcgccgugcccgccagauuccagaaggacaucugcaucggcaaccagagcaaccccugcgugcccaacaacaagaaccccagagccuucaacggcagcagcaacggccacguguacgagaagcugagcagcaucgagagcgacguguaa

SEQ ID NO: 17784 - RNA, 3702 nt, Artificial Sequence
  GRIN2C__Homo_sapiens__NP_000826
augggcggcgcccugggccccgcccugcugcugaccagccuguucggcgccugggccggccugggccccggccagggcgagcagggcaugaccguggccgugguguucagcagcagcggccccccccaggcccaguucagagccagacugaccccccagagcuuccuggaccugccccuggagauccagccccugaccgugggcgugaacaccaccaaccccagcagccugcugacccagaucugcggccugcugggcgccgcccacgugcacggcaucguguucgaggacaacguggacaccgaggccguggcccagauccuggacuucaucagcagccagacccacgugcccauccugagcaucagcggcggcagcgccguggugcugacccccaaggagcccggcagcgccuuccugcagcugggcgugagccuggagcagcagcugcaggugcuguucaaggugcuggaggaguacgacuggagcgccuucgccgugaucaccagccugcaccccggccacgcccuguuccuggagggcgugagagccguggccgacgccagccacgugagcuggagacugcuggacguggugacccuggagcugggccccggcggccccagagccagaacccagagacugcugagacagcuggacgcccccguguucguggccuacugcagcagagaggaggccgaggugcuguucgccgaggccgcccaggccggccuggugggccccggccacguguggcuggugcccaaccuggcccugggcagcaccgacgccccccccgccaccuuccccgugggccugaucagcguggugaccgagagcuggagacugagccugagacagaaggugagagacggcguggccauccuggcccugggcgcccacagcuacuggagacagcacggcacccugcccgcccccgccggcgacugcagagugcaccccggccccgugagccccgccagagaggccuucuacagacaccugcugaacgugaccugggagggcagagacuucagcuucagccccggcggcuaccuggugcagcccaccaugguggugaucgcccugaacagacacagacugugggagauggugggcagaugggagcacggcgugcuguacaugaaguaccccguguggcccagauacagcgccagccugcagcccgugguggacagcagacaccugaccguggccacccuggaggagagacccuucgugaucguggagagccccgaccccggcaccggcggcugcgugcccaacaccgugcccugcagaagacagagcaaccacaccuucagcagcggcgacguggcccccuacaccaagcugugcugcaagggcuucugcaucgacauccugaagaagcuggccagaguggugaaguucagcuacgaccuguaccuggugaccaacggcaagcacggcaagagagugagaggcguguggaacggcaugaucggcgagguguacuacaagagagccgacauggccaucggcagccugaccaucaacgaggagagaagcgagaucguggacuucagcgugcccuucguggagaccggcaucagcgugaugguggccagaagcaacggcaccgugagccccagcgccuuccuggagcccuacagccccgccgugugggugaugauguucgugaugugccugaccgugguggccaucaccguguucauguucgaguacuucagccccgugagcuacaaccagaaccugaccagaggcaagaagagcggcggccccgccuucaccaucggcaagagcguguggcugcugugggcccugguguucaacaacagcgugcccaucgagaaccccagaggcaccaccagcaagaucauggugcuggugugggccuucuucgccgugaucuuccuggccagcuacaccgccaaccuggccgccuucaugauccaggagcaguacaucgacaccgugagcggccugagcgacaagaaguuccagagaccccaggaccaguacccccccuucagauucggcaccgugcccaacggcagcaccgagagaaacaucagaagcaacuacagagacaugcacacccacauggugaaguucaaccagagaagcguggaggacgcccugaccagccugaagaugggcaagcuggacgccuucaucuacgacgccgccgugcugaacuacauggccggcaaggacgagggcugcaagcuggugaccaucggcagcggcaagguguucgccaccaccggcuacggcaucgccaugcagaaggacagccacuggaagagagccaucgaccuggcccugcugcaguuccugggcgacggcgagacccagaagcuggagaccguguggcugagcggcaucugccagaacgagaagaacgaggugaugagcagcaagcuggacaucgacaacauggccggcguguucuacaugcugcugguggccaugggccuggcccugcugguguucgccugggagcaccugguguacuggaagcugagacacagcgugcccaacagcagccagcuggacuuccugcuggccuucagcagaggcaucuacagcugcuucagcggcgugcagagccuggccagcccccccagacaggccagccccgaccugaccgccagcagcgcccaggccagcgugcugaagaugcugcaggccgccagagacauggugaccaccgccggcgugagcagcagccuggacagagccaccagaaccaucgagaacuggggcggcggcagaagagcccccccccccagccccugccccacccccagaagcggccccagccccugccugcccacccccgaccccccccccgagcccagccccaccggcuggggcccccccgacggcggcagagccgcccuggugagaagagccccccagccccccggcagaccccccacccccggccccccccugagcgacgugagcagagugagcagaagacccgccugggaggccagauggcccgugagaaccggccacugcggcagacaccugagcgccagcgagagaccccugagccccgccagaugccacuacagcagcuuccccagagccgacagaagcggcagacccuuccugccccuguuccccgagcuggaggaccugccccugcugggccccgagcagcuggccagaagagaggcccugcugcacgccgccugggccagaggcagcagacccagacacgccagccugcccagcagcguggccgaggccuucgccagacccagcagccugcccgccggcugcaccggccccgccugcgccagacccgacggccacagcgccugcagaagacuggcccaggcccagagcaugugccugcccaucuacagagaggccugccaggagggcgagcaggccggcgcccccgccuggcagcacagacagcacgugugccugcacgcccacgcccaccugcccuucugcuggggcgccgugugcccccaccugccccccugcgccagccacggcagcuggcugagcggcgccuggggcccccugggccacagaggcagaacccugggccugggcaccggcuacagagacagcggcggccuggacgagaucagcagaguggccagaggcacccagggcuuccccggccccugcaccuggagaagaaucagcagccuggagagcgagguguaa

SEQ ID NO: 17785 - RNA, 4011 nt, Artificial Sequence
  GRIN2D__Homo_sapiens__NP_000827
augagaggcgccggcggccccagaggccccagaggccccgccaagaugcugcugcugcuggcccuggccugcgccagccccuuccccgaggaggcccccggccccggcggcgccggcggccccggcggcggccugggcggcgccagaccccugaacguggcccugguguucagcggccccgccuacgccgccgaggccgccagacugggccccgccguggccgccgccgugagaagccccggccuggacgugagacccguggcccuggugcugaacggcagcgaccccagaagccuggugcugcagcugugcgaccugcugagcggccugagagugcacggcgugguguucgaggacgacagcagagcccccgccguggcccccauccuggacuuccugagcgcccagaccagccugcccaucguggccgugcacggcggcgccgcccuggugcugacccccaaggagaagggcagcaccuuccugcagcugggcagcagcaccgagcagcagcugcaggugaucuucgaggugcuggaggaguacgacuggaccagcuucguggccgugaccaccagagcccccggccacagagccuuccugagcuacaucgaggugcugaccgacggcagccuggugggcugggagcacagaggcgcccugacccuggaccccggcgccggcgaggccgugcugagcgcccagcugagaagcgugagcgcccagaucagacugcuguucugcgccagagaggaggccgagcccguguucagagccgccgaggaggccggccugaccggcagcggcuacgugugguucauggugggcccccagcuggccggcggcggcggcagcggcgcccccggcgagcccccccugcugcccggcggcgccccccugcccgccggccuguucgccgugagaagcgccggcuggagagacgaccuggccagaagaguggccgccggcguggccgugguggccagaggcgcccaggcccugcugagagacuacggcuuccugcccgagcugggccacgacugcagagcccagaacagaacccacagaggcgagagccugcacagauacuucaugaacaucaccugggacaacagagacuacagcuucaacgaggacggcuuccuggugaaccccagccugguggugaucagccugaccagagacagaaccugggagguggugggcagcugggagcagcagacccugagacugaaguacccccuguggagcagauacggcagauuccugcagcccguggacgacacccagcaccugaccguggccacccuggaggagagacccuucgugaucguggagcccgccgaccccaucagcggcaccugcaucagagacagcgugcccugcagaagccagcugaacagaacccacagccccccccccgacgcccccagacccgagaagagaugcugcaagggcuucugcaucgacauccugaagagacuggcccacaccaucggcuucagcuacgaccuguaccuggugaccaacggcaagcacggcaagaagaucgacggcguguggaacggcaugaucggcgagguguucuaccagagagccgacauggccaucggcagccugaccaucaacgaggagagaagcgagaucguggacuucagcgugcccuucguggagaccggcaucagcgugaugguggccagaagcaacggcaccgugagccccagcgccuuccuggagcccuacagccccgccgugugggugaugauguucgugaugugccugaccgugguggccgugaccguguucaucuucgaguaccugagccccgugggcuacaacagaagccuggccaccggcaagagacccggcggcagcaccuucaccaucggcaagagcaucuggcugcugugggcccugguguucaacaacagcgugcccguggagaaccccagaggcaccaccagcaagaucauggugcuggugugggccuucuucgccgugaucuuccuggccagcuacaccgccaaccuggccgccuucaugauccaggaggaguacguggacaccgugagcggccugagcgacagaaaguuccagagaccccaggagcaguaccccccccugaaguucggcaccgugcccaacggcagcaccgagaagaacaucagaagcaacuaccccgacaugcacagcuacauggugagauacaaccagcccagaguggaggaggcccugacccagcugaaggccggcaagcuggacgccuucaucuacgacgccgccgugcugaacuacauggccagaaaggacgagggcugcaagcuggugaccaucggcagcggcaagguguucgccaccaccggcuacggcaucgcccugcacaagggcagcagauggaagagacccaucgaccuggcccugcugcaguuccugggcgacgacgagaucgagaugcuggagagacuguggcugagcggcaucugccacaacgacaagaucgaggugaugagcagcaagcuggacaucgacaacauggccggcguguucuacaugcugcugguggccaugggccugagccugcugguguucgccugggagcaccugguguacuggagacugagacacugccugggccccacccacagaauggacuuccugcuggccuucagcagaggcauguacagcugcugcagcgccgaggccgcccccccccccgccaagccccccccccccccccagccccugcccagccccgccuaccccgcccccagacccgcccccggccccgcccccuucgugcccagagagagagccagcguggacagauggagaagaaccaagggcgccggcccccccggcggcgccggccuggccgacggcuuccacagauacuacggccccaucgagccccagggccugggccugggccugggcgaggccagagccgcccccagaggcgccgccggcagaccccugagcccccccgccgcccagcccccccagaagcccccccccagcuacuucgccaucgugagagacaaggagcccgccgagccccccgccggcgccuuccccggcuuccccagcccccccgccccccccgccgccgccgccaccgccgugggccccccccugugcagacuggccuucgaggacgagagcccccccgcccccgccagauggcccagaagcgaccccgagagccagccccugcugggccccggcgccggcggcgccggcggcaccggcggcgccggcggcggcgcccccgccgcccccccccccugcagagccgcccccccccccugccccuaccuggaccuggagcccagccccagcgacagcgaggacagcgagagccugggcggcgccagccugggcggccuggagcccuggugguucgccgacuuccccuaccccuacgccgagagacugggccccccccccggcagauacuggagcguggacaagcugggcggcuggagagccggcagcugggacuaccugccccccagaagcggccccgccgccuggcacugcagacacugcgccagccuggagcugcugcccccccccagacaccugagcugcagccacgacggccuggacggcggcuggugggcccccccccccccccccugggccgccggcccccugcccagaagaagagccagaugcggcugccccagaagccacccccacagacccagagccagccacagaacccccgccgccgccgccccccaccaccacagacacagaagagccgccggcggcugggaccugcccccccccgcccccaccagcagaagccuggaggaccugagcagcugccccagagccgcccccgccagaagacugaccggccccagcagacacgccagaagaugcccccacgccgcccacuggggccccccccugcccaccgccagccacagaagacacagaggcggcgaccugggcaccagaagaggcagcgcccacuucagcagccuggagagcgagguguaa

SEQ ID NO: 17786 - RNA, 3348 nt, Artificial Sequence
  GRIN3A__Homo_sapiens__NP_597702
augagaagacugagccugugguggcugcugagcagagugugccugcugcugcccccccccugcgcccuggugcuggccggcgugcccagcagcagcagccacccccagcccugccagauccugaagagaaucggccacgccgugagagugggcgccgugcaccugcagcccuggaccaccgcccccagagccgccagcagagcccccgacgacagcagagccggcgcccagagagacgagcccgagcccggcaccagaagaagccccgcccccagccccggcgccagauggcugggcagcacccugcacggcagaggcccccccggcagcagaaagcccggcgagggcgccagagccgaggcccuguggcccagagacgcccugcuguucgccguggacaaccugaacagaguggagggccugcugcccuacaaccugagccuggagguggugauggccaucgaggccggccugggcgaccugccccugcugcccuucagcagccccagcagccccuggagcagcgaccccuucagcuuccugcagagcgugugccacaccgugguggugcagggcgugagcgcccugcuggccuucccccagagccagggcgagaugauggagcuggaccuggugagccuggugcugcacauccccgugaucagcaucgugagacacgaguuccccagagagagccagaacccccugcaccugcagcugagccuggagaacagccugagcagcgacgccgacgugaccgugagcauccugaccaugaacaacugguacaacuucagccugcugcugugccaggaggacuggaacaucaccgacuuccugcugcugacccagaacaacagcaaguuccaccugggcagcaucaucaacaucaccgccaaccugcccagcacccaggaccugcugagcuuccugcagauccagcuggagagcaucaagaacagcacccccaccguggugauguucggcugcgacauggagagcaucagaagaaucuucgagaucaccacccaguucggcgugaugccccccgagcugagaugggugcugggcgacagccagaacguggaggagcugagaaccgagggccugccccugggccugaucgcccacggcaagaccacccagagcguguucgagcacuacgugcaggacgccauggagcugguggccagagccguggccaccgccaccaugauccagcccgagcuggcccugauccccagcaccaugaacugcauggagguggagaccaccaaccugaccagcggccaguaccugagcagauuccuggccaacaccaccuucagaggccugagcggcagcaucagagugaagggcagcaccaucgugagcagcgagaacaacuucuucaucuggaaccugcagcacgaccccaugggcaagcccauguggaccagacugggcagcuggcagggcggcaagaucgugauggacuacggcaucuggcccgagcaggcccagagacacaagacccacuuccagcaccccagcaagcugcaccugagaguggugacccugaucgagcaccccuucguguucaccagagagguggacgacgagggccugugccccgccggccagcugugccuggaccccaugaccaacgacagcagcacccuggacagccuguucagcagccugcacagcagcaacgacaccgugcccaucaaguucaagaagugcugcuacggcuacugcaucgaccugcuggagaagaucgccgaggacaugaacuucgacuucgaccuguacaucgugggcgacggcaaguacggcgccuggaagaacggccacuggaccggccuggugggcgaccugcugagaggcaccgcccacauggccgugaccagcuucagcaucaacaccgccagaagccaggugaucgacuucaccagccccuucuucagcaccagccugggcauccuggugagaaccagagacaccgccgcccccaucggcgccuucauguggccccugcacuggaccauguggcugggcaucuucguggcccugcacaucaccgccguguuccugacccuguacgaguggaagagccccuucggccugacccccaagggcagaaacagaagcaagguguucagcuucagcagcgcccugaacaucugcuacgcccugcuguucggcagaaccguggccaucaagccccccaagugcuggaccggcagauuccugaugaaccugugggccaucuucugcauguucugccugagcaccuacaccgccaaccuggccgccgugauggugggcgagaagaucuacgaggagcugagcggcauccacgaccccaagcugcaccaccccagccagggcuucagauucggcaccgugagagagagcagcgccgaggacuacgugagacagagcuuccccgagaugcacgaguacaugagaagauacaacgugcccgccacccccgacggcguggaguaccugaagaacgaccccgagaagcuggacgccuucaucauggacaaggcccugcuggacuacgaggugagcaucgacgccgacugcaagcugcugaccgugggcaagcccuucgccaucgagggcuacggcaucggccugccccccaacagcccccugaccgccaacaucagcgagcugaucagccaguacaagagccacggcuucauggacaugcugcacgacaagugguacagaguggugcccugcggcaagagaagcuucgccgugaccgagacccugcagaugggcaucaagcacuucagcggccuguucgugcugcugugcaucggcuucggccugagcauccugaccaccaucggcgagcacaucguguacagacugcugcugcccagaaucaagaacaagagcaagcugcaguacuggcugcacaccagccagagacugcacagagccaucaacaccagcuucaucgaggagaagcagcagcacuucaagaccaagagaguggagaagagaagcaacgugggccccagacagcugaccguguggaacaccagcaaccugagccacgacaacagaagaaaguacaucuucagcgacgaggagggccagaaccagcugggcaucagaauccaccaggacaucccccugccccccagaagaagagagcugcccgcccugagaaccaccaacggcaaggccgacagccugaacgugagcagaaacagcgugaugcaggagcugagcgagcuggagaagcagauccaggugaucagacaggagcugcagcuggccgugagcagaaagaccgagcuggaggaguaccagagaaccagcagaaccugcgagagcuaa

SEQ ID NO: 17787 - RNA, 3132 nt, Artificial Sequence
  GRIN3B__Homo_sapiens__NP_619635
auggaguucgugagagcccuguggcugggccuggcccuggcccugggccccggcagcgccggcggccacccccagcccugcggcgugcuggccagacugggcggcagcgugagacugggcgcccugcugcccagagccccccuggccagagccagagccagagccgcccuggccagagccgcccuggcccccagacugccccacaaccugagccuggagcuggugguggccgccccccccgccagagaccccgccagccugaccagaggccugugccaggcccuggugccccccggcguggccgcccugcuggccuuccccgaggccagacccgagcugcugcagcugcacuuccuggccgccgccaccgagacccccgugcugagccugcugagaagagaggccagagccccccugggcgcccccaaccccuuccaccugcagcugcacugggccagcccccuggagacccugcuggacgugcugguggccgugcugcaggcccacgccugggaggacgugggccuggcccugugcagaacccaggaccccggcggccugguggcccuguggaccagcagagccggcagacccccccagcuggugcuggaccugagcagaagagacaccggcgacgccggccugagagccagacuggcccccauggccgcccccgugggcggcgaggcccccgugcccgccgccgugcugcugggcugcgacaucgccagagccagaagagugcuggaggccgugccccccggcccccacuggcugcugggcaccccccugccccccaaggcccugcccaccgccggccugccccccggccugcuggcccugggcgagguggccagacccccccuggaggccgccauccacgacaucgugcagcugguggccagagcccugggcagcgccgcccaggugcagcccaagagagcccugcugcccgcccccgugaacugcggcgaccugcagcccgccggccccgagagccccggcagauuccuggccagauuccuggccaacaccagcuuccagggcagaaccggccccgugugggugaccggcagcagccaggugcacaugagcagacacuucaagguguggagccugagaagagaccccagaggcgcccccgccugggccaccgugggcagcuggagagacggccagcuggaccuggagcccggcggcgccagcgccagacccccccccccccagggcgcccagguguggcccaagcugagaguggugacccugcuggagcaccccuucguguucgccagagaccccgacgaggacggccagugccccgccggccagcugugccuggaccccggcaccaacgacagcgccacccuggacgcccuguucgccgcccuggccaacggcagcgcccccagagcccugagaaagugcugcuacggcuacugcaucgaccugcuggagagacuggccgaggacacccccuucgacuucgagcuguaccuggugggcgacggcaaguacggcgcccugagagacggcagauggaccggccuggugggcgaccugcuggccggcagagcccacauggccgugaccagcuucagcaucaacagcgccagaagccaggugguggacuucaccagccccuucuucagcaccagccugggcaucauggugagagccagagacaccgccagccccaucggcgccuucauguggccccugcacuggagcaccuggcugggcguguucgccgcccugcaccugaccgcccuguuccugaccguguacgaguggagaagccccuacggccugacccccagaggcagaaacagaagcaccguguucagcuacagcagcgcccugaaccugugcuacgccauccuguucagaagaaccgugagcagcaagacccccaagugccccaccggcagacugcugaugaaccugugggccaucuucugccugcuggugcugagcagcuacaccgccaaccuggccgccgugauggugggcgacaagaccuucgaggagcugagcggcauccacgaccccaagcugcaccaccccgcccagggcuucagauucggcaccgugugggagagcagcgccgaggccuacaucaagaagagcuuccccgacaugcacgcccacaugagaagacacagcgcccccaccacccccagaggcguggccaugcugaccagcgacccccccaagcugaacgccuucaucauggacaagagccugcuggacuacgaggugagcaucgacgccgacugcaagcugcugaccgugggcaagcccuucgccaucgagggcuacggcaucggccugccccagaacagcccccugaccagcaaccugagcgaguucaucagcagauacaagagcagcggcuucaucgaccugcugcacgacaagugguacaagauggugcccugcggcaagagaguguucgccgugaccgagacccugcagaugagcaucuaccacuucgccggccuguucgugcugcugugccugggccugggcagcgcccugcugagcagccugggcgagcacgccuucuucagacuggcccugcccagaaucagaaagggcagcagacugcaguacuggcugcacaccagccagaagauccacagagcccugaacaccgagccccccgagggcagcaaggaggagaccgccgaggccgagcccagcggccccgagguggagcagcagcagcagcagcaggaccagcccaccgcccccgagggcuggaagagagccagaagagccguggacaaggagagaagagugagauuccugcuggagcccgccguggugguggcccccgaggccgacgccgaggccgaggccgcccccagagagggccccguguggcugugcagcuacggcagaccccccgccgccagacccaccggcgccccccagcccggcgagcugcaggagcuggagagaagaaucgagguggccagagagagacugagacaggcccuggugagaagaggccagcugcuggcccagcugggcgacagcgccagacacagacccagaagacugcugcaggccagagccgcccccgccgaggcccccccccacagcggcagacccggcagccaggaguaa

SEQ ID NO: 17788 - RNA, 1116 nt, Artificial Sequence
  GRINA__Homo_sapiens__NP_001009184
augagccacgagaagagcuuccuggugagcggcgacaacuaccccccccccaaccccggcuaccccggcggcccccagccccccaugccccccuacgcccagccccccuaccccggcgcccccuacccccagccccccuuccagcccagccccuacggccagcccggcuacccccacggccccagccccuacccccagggcggcuacccccagggccccuacccccagggcggcuacccccagggccccuacccccaggagggcuacccccagggccccuacccccagggcggcuacccccagggccccuacccccagagccccuucccccccaaccccuacggccagccccagguguuccccggccaggaccccgacagcccccagcacggcaacuaccaggaggagggcccccccagcuacuacgacaaccaggacuuccccgccaccaacugggacgacaagagcaucagacaggccuucaucagaaagguguuccuggugcugacccugcagcugagcgugacccugagcaccgugagcguguucaccuucguggccgaggugaagggcuucgugagagagaacguguggaccuacuacgugagcuacgccguguucuucaucagccugaucgugcugagcugcugcggcgacuucagaagaaagcaccccuggaaccugguggcccugagcgugcugaccgccagccugagcuacauggugggcaugaucgccagcuucuacaacaccgaggccgugaucauggccgugggcaucaccaccgccgugugcuucaccguggugaucuucagcaugcagaccagauacgacuucaccagcugcaugggcgugcugcuggugagcaugguggugcuguucaucuucgccauccugugcaucuucaucagaaacagaauccuggagaucguguacgccagccugggcgcccugcuguucaccugcuuccuggccguggacacccagcugcugcugggcaacaagcagcugagccugagccccgaggaguacguguucgccgcccugaaccuguacaccgacaucaucaacaucuuccuguacauccugaccaucaucggcagagccaaggaguaa

SEQ ID NO: 17789 - RNA, 3231 nt, Artificial Sequence
  GRIP1__Homo_sapiens__NP_066973
augaucgccgugagcuucaagugcagaugccagauccugagaagacugaccaaggacgagagccccuacaccaagagcgccagccagaccaagccccccgacggcgcccuggccgugagaagacagagcauccccgaggaguucaagggcagcaccgugguggagcugaugaagaaggagggcaccacccugggccugaccgugagcggcggcaucgacaaggacggcaagcccagagugagcaaccugagacagggcggcaucgccgccagaagcgaccagcuggacgugggcgacuacaucaaggccgugaacggcaucaaccuggccaaguucagacacgacgagaucaucagccugcugaagaacgugggcgagagaguggugcuggagguggaguacgagcugccccccgugagcgugcagggcagcagcgugaucuucagaaccguggaggugacccugcacaaggagggcaacaccuucggcuucgugaucagaggcggcgcccacgacgacagaaacaagagcagacccguggugaucaccugcgugagacccggcggccccgccgacagagagggcaccaucaagcccggcgacagacugcugagcguggacggcaucagacugcugggcaccacccacgccgaggccaugagcauccugaagcagugcggccaggaggccgcccugcugaucgaguacgacgugagcgugauggacagcguggccaccgccagcggcccccugcugguggagguggccaagacccccggcgccagccugggcguggcccugaccaccagcaugugcugcaacaagcaggugaucgugaucgacaagaucaagagcgccagcaucgccgacagaugcggcgcccugcacgugggcgaccacauccugagcaucgacggcaccagcauggaguacugcacccuggccgaggccacccaguuccuggccaacaccaccgaccaggugaagcuggagauccugccccaccaccagaccagacuggcccugaagggccccgaccacgccgcccuggugagcagcagcuucagccccaccagcaugagcgccuacagccugagcagccugaacaugggcacccugcccagaagccuguacagcaccagccccagaggcaccaugaugagaagaagacugaagaagaaggacuucaagagcagccugagccuggccagcagcaccgugggccuggccggccagguggugcacaccgagaccaccgagguggugcugaccgccgaccccgugaccggcuucggcauccagcugcagggcagcguguucgccaccgagacccugagcagccccccccugaucagcuacaucgaggccgacagccccgccgagagaugcggcgugcugcagaucggcgacagagugauggccaucaacggcauccccaccgaggacagcaccuucgaggaggccagccagcugcugagagacagcagcaucaccagcaaggugacccuggagaucgaguucgacguggccgagagcgugauccccagcagcggcaccuuccacgugaagcugcccaagaagcacaacguggagcugggcaucaccaucagcagccccagcagcagaaagcccggcgacccccuggugaucagcgacaucaagaagggcagcguggcccacagaaccggcacccuggagcugggcgacaagcugcuggccaucgacaacaucagacuggacaacugcagcauggaggacgccgugcagauccugcagcagugcgaggaccuggugaagcugaagaucagaaaggacgaggacaacagcgacgagcaggagagcagcggcgccaucaucuacaccguggagcugaagagauacggcggcccccugggcaucaccaucagcggcaccgaggagcccuucgaccccaucaucaucagcagccugaccaagggcggccuggccgagagaaccggcgccauccacaucggcgacagaauccuggccaucaacagcagcagccugaagggcaagccccugagcgaggccauccaccugcugcagauggccggcgagaccgugacccugaagaucaagaagcagaccgacgcccagagcgccagcagccccaagaaguuccccaucagcagccaccugagcgaccugggcgacguggaggaggacagcagccccgcccagaagcccggcaagcugagcgacauguaccccagcaccgugcccagcguggacagcgccguggacagcugggacggcagcgccaucgacaccagcuacggcacccagggcaccagcuuccaggccagcggcuacaacuucaacaccuacgacuggagaagccccaagcagagaggcagccugagccccgugaccaagcccagaagccagaccuaccccgacgugggccugagcuacgaggacugggacagaagcaccgccagcggcuucgccggcgccgccgacagcgccgagaccgagcaggaggagaacuucuggagccaggcccuggaggaccuggagaccugcggccagagcggcauccugagagagcuggaggagaaggccgacagaagagugagccugagaaacaugacccugcuggccaccaucaugagcggcagcaccaugagccugaaccacgaggcccccacccccagaagccagcugggcagacaggccagcuuccaggagagaagcagcagcagaccccacuacagccagaccaccagaagcaacacccugcccagcgacgugggcagaaagagcgugacccugagaaagaugaagcaggagaucaaggagaucaugagccccacccccguggagcugcacaaggugacccuguacaaggacagcgacauggaggacuucggcuucagcguggccgacggccugcuggagaagggcguguacgugaagaacaucagacccgccggccccggcgaccugggcggccugaagcccuacgacagacugcugcaggugaaccacgugagaaccagagacuucgacugcugccugguggugccccugaucgccgagagcggcaacaagcuggaccuggugaucagcagaaacccccuggccagccagaagagcaucgaccagcagagccugcccggcgacuggagcgagcagaacagcgccuucuuccagcagcccagccacggcggcaaccuggagaccagagagcccaccaacacccuguaa

SEQ ID NO: 17790 - RNA, 1692 nt, Artificial Sequence
  GRK1__Homo_sapiens__NP_002920
auggacuucggcagccuggagaccgugguggccaacagcgccuucaucgccgccagaggcagcuucgacggcagcagcagccagcccagcagagacaagaaguaccuggccaagcugaagcugcccccccugagcaagugcgagagccugagagacagccugagccuggaguucgagagcgugugccuggagcagcccaucggcaagaagcuguuccagcaguuccugcagagcgccgagaagcaccugcccgcccuggagcuguggaaggacaucgaggacuacgacaccgccgacaacgaccugcagccccagaaggcccagaccauccuggcccaguaccuggacccccaggccaagcuguucugcagcuuccuggacgagggcaucguggccaaguucaaggagggccccguggagauccaggacggccuguuccagccccugcugcaggccacccuggcccaccugggccaggcccccuuccaggaguaccugggcagccuguacuuccugagauuccugcaguggaaguggcuggaggcccagcccaugggcgaggacugguuccuggacuucagagugcugggcaagggcggcuucggcgaggugagcgccugccagaugaaggccaccggcaagcuguacgccugcaagaagcugaacaagaagagacugaagaagagaaagggcuaccagggcgccaugguggagaagaagauccugaugaaggugcacagcagauucaucgugagccuggccuacgccuucgagaccaaggccgaccugugccuggugaugaccaucaugaacggcggcgacaucagauaccacaucuacaacgugaacgaggagaaccccggcuuccccgagcccagagcccuguucuacaccgcccagaucaucugcggccuggagcaccugcaccagagaagaaucguguacagagaccugaagcccgagaacgugcugcuggacaacgacggcaacgugagaaucagcgaccugggccuggccguggagcugcuggacggccagagcaagaccaagggcuacgccggcacccccggcuucauggcccccgagcugcugcagggcgaggaguacgacuucagcguggacuacuucgcccugggcgugacccuguacgagaugaucgccgccagaggccccuucagagccagaggcgagaagguggagaacaaggagcugaagcacagaaucaucagcgagcccgugaaguaccccgacaaguucagccaggccagcaaggacuucugcgaggcccugcuggagaaggaccccgagaagagacugggcuucagagacgagaccugcgacaagcugagagcccacccccuguucaaggaccugaacuggagacagcuggaggccggcaugcugaugccccccuucauccccgacagcaagaccguguacgccaaggacauccaggacgugggcgccuucagcaccgugaagggcguggccuucgacaagaccgacaccgaguucuuccaggaguucgccaccggcaacugccccauccccuggcaggaggagaugaucgagaccggcaucuucggcgagcugaacguguggagaagcgacggccagaugcccgacgacaugaagggcaucagcggcggcagcagcagcagcagcaagagcggcaugugccuggugagcuaa

SEQ ID NO: 17791 - RNA, 1641 nt, Artificial Sequence
  GRK4__Homo_sapiens__NP_001004056
auggagcuggagaacaucguggccaacagccugcugcugaaggccagacaggagaaggacuacagcagccugugcgacaagcagcccaucggcagaagacuguucagacaguucugcgacaccaagcccacccugaagagacacaucgaguuccuggacgccguggccgaguacgagguggccgacgacgaggacagaagcgacugcggccugagcauccuggacagauucuucaacgacaagcuggccgccccccugcccgagaucccccccgacguggugaccgagugcagacugggccugaaggaggagaaccccagcaagaaggccuucgaggagugcaccagaguggcccacaacuaccugagaggcgagcccuucgaggaguaccaggagagcagcuacuucagccaguuccugcaguggaaguggcuggagagacagcccgugaccaagaacaccuucagacacuacagagugcugggcaagggcggcuucggcgaggugugcgccugccaggugagagccaccggcaagauguacgccugcaagaagcugcagaagaagagaaucaagaagagaaagggcgaggccauggcccugaacgagaagagaauccuggagaaggugcagagcagauucguggugagccuggccuacgccuacgagaccaaggacgcccugugccuggugcugaccaucaugaacggcggcgaccugaaguuccacaucuacaaccugggcaaccccggcuucgacgagcagagagccguguucuacgccgccgagcugugcugcggccuggaggaccugcagagagagagaaucguguacagagaccugaagcccgagaacauccugcuggacgacagaggccacaucagaaucagcgaccugggccuggccaccgagauccccgagggccagagagugagaggcagagugggcaccgugggcuacauggcccccgagguggugaacaacgagaaguacaccuucagccccgacugguggggccugggcugccugaucuacgagaugauccagggccacagccccuucaagaaguacaaggagaaggugaagugggaggagguggaccagagaaucaagaacgacaccgaggaguacagcgagaaguucagcgaggacgccaagagcaucugcagaaugcugcugaccaagaaccccagcaagagacugggcugcagaggcgagggcgccgccggcgugaagcagcaccccguguucaaggacaucaacuucagaagacuggaggccaacaugcuggagccccccuucugccccgacccccacgccguguacugcaaggacgugcuggacaucgagcaguucagcguggugaagggcaucuaccuggacaccgccgacgaggacuucuacgccagauucgccaccggcugcgugagcauccccuggcagaacgagaugaucgagagcggcugcuucaaggacaucaacaagagcgagagcgaggaggcccugccccuggaccuggacaagaacauccacacccccgugagcagacccaacagaggcuucuucuacagacuguucagaagaggcggcugccugaccauggugcccagcgagaaggagguggagcccaagcagugcuaa

SEQ ID NO: 17792 - RNA, 1773 nt, Artificial Sequence
  GRK5__Homo_sapiens__NP_005299
auggagcuggagaacaucguggccaacaccgugcugcugaaggccagagagggcggcggcggcaagagaaagggcaagagcaagaaguggaaggagauccugaaguucccccacaucagccagugcgaggaccugagaagaaccaucgacagagacuacugcagccugugcgacaagcagcccaucggcagacugcuguucagacaguucugcgagaccagacccggccuggagugcuacauccaguuccuggacagcguggccgaguacgaggugacccccgacgagaagcugggcgagaagggcaaggagaucaugaccaaguaccugacccccaagagccccguguucaucgcccaggugggccaggaccuggugagccagaccgaggagaagcugcugcagaagcccugcaaggagcuguucagcgccugcgcccagagcgugcacgaguaccugagaggcgagcccuuccacgaguaccuggacagcauguucuucgacagauuccugcaguggaaguggcuggagagacagcccgugaccaagaacaccuucagacaguacagagugcugggcaagggcggcuucggcgaggugugcgccugccaggugagagccaccggcaagauguacgccugcaagagacuggagaagaagagaaucaagaagagaaagggcgagagcauggcccugaacgagaagcagauccuggagaaggugaacagccaguucguggugaaccuggccuacgccuacgagaccaaggacgcccugugccuggugcugaccaucaugaacggcggcgaccugaaguuccacaucuacaacaugggcaaccccggcuucgaggaggagagagcccuguucuacgccgccgagauccugugcggccuggaggaccugcacagagagaacaccguguacagagaccugaagcccgagaacauccugcuggacgacuacggccacaucagaaucagcgaccugggccuggccgugaagauccccgagggcgaccugaucagaggcagagugggcaccgugggcuacauggcccccgaggugcugaacaaccagagauacggccugagccccgacuacuggggccugggcugccugaucuacgagaugaucgagggccagagccccuucagaggcagaaaggagaaggugaagagagaggagguggacagaagagugcuggagaccgaggagguguacagccacaaguucagcgaggaggccaagagcaucugcaagaugcugcugaccaaggacgccaagcagagacugggcugccaggaggagggcgccgccgaggugaagagacaccccuucuucagaaacaugaacuucaagagacuggaggccggcaugcuggacccccccuucgugcccgaccccagagccguguacugcaaggacgugcuggacaucgagcaguucagcaccgugaagggcgugaaccuggaccacaccgacgacgacuucuacagcaaguucagcaccggcagcgugagcauccccuggcagaacgagaugaucgagaccgagugcuucaaggagcugaacguguucggccccaacggcacccugccccccgaccugaacagaaaccacccccccgagccccccaagaagggccugcugcagagacuguucaagagacagcaccagaacaacagcaagagcagccccagcagcaagaccagcuucaaccaccacaucaacagcaaccacgugagcagcaacagcaccggcagcagcuaa

SEQ ID NO: 17793 - RNA, 1683 nt, Artificial Sequence
  GRK6__Homo_sapiens__NP_001004105
auggagcuggagaacaucguggccaacaccgugcugcugaaggccagagagggcggcggcggcaacagaaagggcaagagcaagaaguggagacagaugcugcaguucccccacaucagccagugcgaggagcugagacugagccuggagagagacuaccacagccugugcgagagacagcccaucggcagacugcuguucagagaguucugcgccaccagacccgagcugagcagaugcguggccuuccuggacggcguggccgaguacgaggugacccccgacgacaagagaaaggccugcggcagacagcugacccagaacuuccugagccacaccggccccgaccugauccccgaggugcccagacagcuggugaccaacugcacccagagacuggagcagggccccugcaaggaccuguuccaggagcugaccagacugacccacgaguaccugagcguggcccccuucgccgacuaccuggacagcaucuacuucaacagauuccugcaguggaaguggcuggagagacagcccgugaccaagaacaccuucagacaguacagagugcugggcaagggcggcuucggcgaggugugcgccugccaggugagagccaccggcaagauguacgccugcaagaagcuggagaagaagagaaucaagaagagaaagggcgaggccauggcccugaacgagaagcagauccuggagaaggugaacagcagauucguggugagccuggccuacgccuacgagaccaaggacgcccugugccuggugcugacccugaugaacggcggcgaccugaaguuccacaucuaccacaugggccaggccggcuuccccgaggccagagccguguucuacgccgccgagaucugcugcggccuggaggaccugcacagagagagaaucguguacagagaccugaagcccgagaacauccugcuggacgaccacggccacaucagaaucagcgaccugggccuggccgugcacgugcccgagggccagaccaucaagggcagagugggcaccgugggcuacauggcccccgagguggugaagaacgagagauacaccuucagccccgacuggugggcccugggcugccugcuguacgagaugaucgccggccagagccccuuccagcagagaaagaagaagaucaagagagaggagguggagagacuggugaaggaggugcccgaggaguacagcgagagauucagcccccaggccagaagccugugcagccagcugcugugcaaggaccccgccgagagacugggcugcagaggcggcagcgccagagaggugaaggagcacccccuguucaagaagcugaacuucaagagacugggcgccggcaugcuggagccccccuucaagcccgacccccaggccaucuacugcaaggacgugcuggacaucgagcaguucagcaccgugaagggcguggagcuggagcccaccgaccaggacuucuaccagaaguucgccaccggcagcgugcccauccccuggcagaacgagaugguggagaccgagugcuuccaggagcugaacguguucggccuggacggcagcgugccccccgaccuggacuggaagggccagccccccgccccccccaagaagggccugcugcagagacuguucagcagacagagauaa

SEQ ID NO: 17794 - RNA, 1662 nt, Artificial Sequence
  GRK7__Homo_sapiens__NP_631948
augguggacaugggcgcccuggacaaccugaucgccaacaccgccuaccugcaggccagaaagcccagcgacugcgacagcaaggagcugcagagaagaagaagaagccuggcccugcccggccugcagggcugcgccgagcugagacagaagcugagccugaacuuccacagccugugcgagcagcagcccaucggcagaagacuguucagagacuuccuggccaccgugcccaccuucagaaaggccgccaccuuccuggaggacgugcagaacugggagcuggccgaggagggccccaccaaggacagcgcccugcagggccugguggccaccugcgccagcgcccccgcccccggcaacccccagcccuuccugagccaggccguggccaccaagugccaggccgccaccaccgaggaggagagaguggccgccgugacccuggccaaggccgaggccauggccuuccugcaggagcagcccuucaaggacuucgugaccagcgccuucuacgacaaguuccugcaguggaagcuguucgagaugcagcccgugagcgacaaguacuucaccgaguucagagugcugggcaagggcggcuucggcgaggugugcgccgugcaggugaagaacaccggcaagauguacgccugcaagaagcuggacaagaagagacugaagaagaagggcggcgagaagauggcccugcuggagaaggagauccuggagaaggugagcagccccuucaucgugagccuggccuacgccuucgagagcaagacccaccugugccuggugaugagccugaugaacggcggcgaccugaaguuccacaucuacaacgugggcaccagaggccuggacaugagcagagugaucuucuacagcgcccagaucgccugcggcaugcugcaccugcacgagcugggcaucguguacagagacaugaagcccgagaacgugcugcuggacgaccugggcaacugcagacugagcgaccugggccuggccguggagaugaagggcggcaagcccaucacccagagagccggcaccaacggcuacauggcccccgagauccugauggagaaggugagcuacagcuaccccguggacugguucgccaugggcugcagcaucuacgagaugguggccggcagaacccccuucaaggacuacaaggagaaggugagcaaggaggaccugaagcagagaacccugcaggacgaggugaaguuccagcacgacaacuucaccgaggaggccaaggacaucugcagacuguuccuggccaagaagcccgagcagagacugggcagcagagagaagagcgacgaccccagaaagcaccacuucuucaagaccaucaacuuccccagacuggaggccggccugaucgagccccccuucgugcccgaccccagcgugguguacgccaaggacaucgccgagaucgacgacuucagcgaggugagaggcguggaguucgacgacaaggacaagcaguucuucaagaacuucgccaccggcgccgugcccaucgccuggcaggaggagaucaucgagaccggccuguucgaggagcugaacgaccccaacagacccaccggcugcgaggagggcaacagcagcaagagcggcgugugccugcugcuguaa

SEQ ID NO: 17795 - RNA, 2721 nt, Artificial Sequence
  GRM1__Homo_sapiens__NP_001264995
auggugggccugcugcuguucuucuuccccgccaucuuccuggaggugagccugcugcccagaagccccggcagaaaggugcugcuggccggcgccagcagccagagaagcguggccagaauggacggcgacgugaucaucggcgcccuguucagcgugcaccaccagccccccgccgagaaggugcccgagagaaagugcggcgagaucagagagcaguacggcauccagagaguggaggccauguuccacacccuggacaagaucaacgccgaccccgugcugcugcccaacaucacccugggcagcgagaucagagacagcugcuggcacagcagcguggcccuggagcagagcaucgaguucaucagagacagccugaucagcaucagagacgagaaggacggcaucaacagaugccugcccgacggccagagccugccccccggcagaaccaagaagcccaucgccggcgugaucggccccggcagcagcagcguggccauccaggugcagaaccugcugcagcuguucgacaucccccagaucgccuacagcgccaccagcaucgaccugagcgacaagacccuguacaaguacuuccugagaguggugcccagcgacacccugcaggccagagccaugcuggacaucgugaagagauacaacuggaccuacgugagcgccgugcacaccgagggcaacuacggcgagagcggcauggacgccuucaaggagcuggccgcccaggagggccugugcaucgcccacagcgacaagaucuacagcaacgccggcgagaagagcuucgacagacugcugagaaagcugagagagagacugcccaaggccagagugguggugugcuucugcgagggcaugaccgugagaggccugcugagcgccaugagaagacugggcguggugggcgaguucagccugaucggcagcgacggcugggccgacagagacgaggugaucgagggcuacgagguggaggccaacggcggcaucaccaucaagcugcagagccccgaggugagaagcuucgacgacuacuuccugaagcugagacuggacaccaacaccagaaaccccugguuccccgaguucuggcagcacagauuccagugcagacugcccggccaccugcuggagaaccccaacuucaagagaaucugcaccggcaacgagagccuggaggagaacuacgugcaggacagcaagaugggcuucgugaucaacgccaucuacgccauggcccacggccugcagaacaugcaccacgcccugugccccggccacgugggccugugcgacgccaugaagcccaucgacggcagcaagcugcuggacuuccugaucaagagcagcuucaucggcgugagcggcgaggaggugugguucgacgagaagggcgacgcccccggcagauacgacaucaugaaccugcaguacaccgaggccaacagauacgacuacgugcacgugggcaccuggcacgagggcgugcugaacaucgacgacuacaagauccagaugaacaagagcggcguggugagaagcgugugcagcgagcccugccugaagggccagaucaaggugaucagaaagggcgaggugagcugcugcuggaucugcaccgccugcaaggagaacgaguacgugcaggacgaguucaccugcaaggccugcgaccugggcugguggcccaacgccgaccugaccggcugcgagcccauccccgugagauaccuggaguggagcaacaucgagagcaucaucgccaucgccuucagcugccugggcauccuggugacccuguucgugacccugaucuucgugcuguacagagacacccccguggugaagagcagcagcagagagcugugcuacaucauccuggccggcaucuuccugggcuacgugugccccuucacccugaucgccaagcccaccaccaccagcugcuaccugcagagacugcuggugggccugagcagcgccaugugcuacagcgcccuggugaccaagaccaacagaaucgccagaauccuggccggcagcaagaagaagaucugcaccagaaagcccagauucaugagcgccugggcccaggugaucaucgccagcauccugaucagcgugcagcugacccugguggugacccugaucaucauggagccccccaugcccauccugagcuaccccagcaucaaggagguguaccugaucugcaacaccagcaaccugggcgugguggccccccugggcuacaacggccugcugaucaugagcugcaccuacuacgccuucaagaccagaaacgugcccgccaacuucaacgaggccaaguacaucgccuucaccauguacaccaccugcaucaucuggcuggccuucgugcccaucuacuucggcagcaacuacaagaucaucaccaccugcuucgccgugagccugagcgugaccguggcccugggcugcauguucacccccaagauguacaucaucaucgccaagcccgagagaaacgugagaagcgccuucaccaccagcgacguggugagaaugcacgugggcgacggcaagcugcccugcagaagcaacaccuuccugaacaucuucagaagaaagaaggccggcgccggcaacgccaagaagagacagcccgaguucagccccaccagccagugccccagcgcccacgugcagcuguaa

SEQ ID NO: 17796 - RNA, 2619 nt, Artificial Sequence
  GRM2__Homo_sapiens__NP_000830
augggcagccugcuggcccugcuggcccugcugcugcuguggggcgccguggccgagggccccgccaagaaggugcugacccuggagggcgaccuggugcugggcggccuguuccccgugcaccagaagggcggccccgccgaggacugcggccccgugaacgagcacagaggcauccagagacuggaggccaugcuguucgcccuggacagaaucaacagagacccccaccugcugcccggcgugagacugggcgcccacauccuggacagcugcagcaaggacacccacgcccuggagcaggcccuggacuucgugagagccagccugagcagaggcgccgacggcagcagacacaucugccccgacggcagcuacgccacccacggcgacgcccccaccgccaucaccggcgugaucggcggcagcuacagcgacgugagcauccagguggccaaccugcugagacuguuccagaucccccagaucagcuacgccagcaccagcgccaagcugagcgacaagagcagauacgacuacuucgccagaaccgugccccccgacuucuuccaggccaaggccauggccgagauccugagauucuucaacuggaccuacgugagcaccguggccagcgagggcgacuacggcgagaccggcaucgaggccuucgagcuggaggccagagccagaaacaucugcguggccaccagcgagaaggugggcagagccaugagcagagccgccuucgagggcguggugagagcccugcugcagaagcccagcgccagaguggccgugcuguucaccagaagcgaggacgccagagagcugcuggccgccagccagagacugaacgccagcuucaccuggguggccagcgacggcuggggcgcccuggagagcgugguggccggcagcgagggcgccgccgagggcgccaucaccaucgagcuggccagcuaccccaucagcgacuucgccagcuacuuccagagccuggaccccuggaacaacagcagaaaccccugguucagagaguucugggagcagagauucagaugcagcuucagacagagagacugcgccgcccacagccugagagccgugcccuucgagcaggagagcaagaucauguucguggugaacgccguguacgccauggcccacgcccugcacaacaugcacagagcccugugccccaacaccaccagacugugcgacgccaugagacccgugaacggcagaagacuguacaaggacuucgugcugaacgugaaguucgacgcccccuucagacccgccgacacccacaacgaggugagauucgacagauucggcgacggcaucggcagauacaacaucuucaccuaccugagagccggcagcggcagauacagauaccagaaggugggcuacugggccgagggccugacccuggacaccagccugauccccugggccagccccagcgccggcccccugcccgccagcagaugcagcgagcccugccugcagaacgaggugaagagcgugcagcccggcgaggugugcugcuggcugugcauccccugccagcccuacgaguacagacuggacgaguucaccugcgccgacugcggccugggcuacuggcccaacgccagccugaccggcugcuucgagcugccccaggaguacaucagauggggcgacgccugggccgugggccccgugaccaucgccugccugggcgcccuggccacccuguucgugcugggcguguucgugagacacaacgccacccccguggugaaggccagcggcagagagcugugcuacauccugcugggcggcguguuccugugcuacugcaugaccuucaucuucaucgccaagcccagcaccgccgugugcacccugagaagacugggccugggcaccgccuucagcgugugcuacagcgcccugcugaccaagaccaacagaaucgccagaaucuucggcggcgccagagagggcgcccagagacccagauucaucagccccgccagccagguggccaucugccuggcccugaucagcggccagcugcugaucgugguggccuggcuggugguggaggcccccggcaccggcaaggagaccgcccccgagagaagagagguggugacccugagaugcaaccacagagacgccagcaugcugggcagccuggccuacaacgugcugcugaucgcccugugcacccuguacgccuucaagaccagaaagugccccgagaacuucaacgaggccaaguucaucggcuucaccauguacaccaccugcaucaucuggcuggccuuccugcccaucuucuacgugaccagcagcgacuacagagugcagaccaccaccaugugcgugagcgugagccugagcggcagcguggugcugggcugccuguucgcccccaagcugcacaucauccuguuccagccccagaagaacguggugagccacagagcccccaccagcagauucggcagcgccgccgccagagccagcagcagccugggccagggcagcggcagccaguucgugcccaccgugugcaacggcagagaggugguggacagcaccaccagcagccuguaa

SEQ ID NO: 17797 - RNA, 2640 nt, Artificial Sequence
  GRM3__Homo_sapiens__NP_000831
augaagaugcugaccagacugcaggugcugacccuggcccuguucagcaagggcuuccugcugagccugggcgaccacaacuuccugagaagagagaucaagaucgagggcgaccuggugcugggcggccuguuccccaucaacgagaagggcaccggcaccgaggagugcggcagaaucaacgaggacagaggcauccagagacuggaggccaugcuguucgccaucgacgagaucaacaaggacgacuaccugcugcccggcgugaagcugggcgugcacauccuggacaccugcagcagagacaccuacgcccuggagcagagccuggaguucgugagagccagccugaccaagguggacgaggccgaguacaugugccccgacggcagcuacgccauccaggagaacaucccccugcugaucgccggcgugaucggcggcagcuacagcagcgugagcauccagguggccaaccugcugagacuguuccagaucccccagaucagcuacgccagcaccagcgccaagcugagcgacaagagcagauacgacuacuucgccagaaccgugccccccgacuucuaccaggccaaggccauggccgagauccugagauucuucaacuggaccuacgugagcaccguggccagcgagggcgacuacggcgagaccggcaucgaggccuucgagcaggaggccagacugagaaacaucugcaucgccaccgccgagaaggugggcagaagcaacaucagaaagagcuacgacagcgugaucagagagcugcugcagaagcccaacgccagagugguggugcuguucaugagaagcgacgacagcagagagcugaucgccgccgccagcagagccaacgccagcuucaccuggguggccagcgacggcuggggcgcccaggagagcaucaucaagggcagcgagcacguggccuacggcgccaucacccuggagcuggccagccagcccgugagacaguucgacagauacuuccagagccugaaccccuacaacaaccacagaaaccccugguucagagacuucugggagcagaaguuccagugcagccugcagaacaagagaaaccacagaagagugugcgacaagcaccuggccaucgacagcagcaacuacgagcaggagagcaagaucauguucguggugaacgccguguacgccauggcccacgcccugcacaagaugcagagaacccugugccccaacaccaccaagcugugcgacgccaugaagauccuggacggcaagaagcuguacaaggacuaccugcugaagaucaacuucaccgcccccuucaaccccaacaaggacgccgacagcaucgugaaguucgacaccuucggcgacggcaugggcagauacaacguguucaacuuccagaacgugggcggcaaguacagcuaccugaaggugggccacugggccgagacccugagccuggacgugaacagcauccacuggagcagaaacagcgugcccaccagccagugcagcgaccccugcgcccccaacgagaugaagaacaugcagcccggcgacgugugcugcuggaucugcauccccugcgagcccuacgaguaccuggccgacgaguucaccugcauggacugcggcagcggccaguggcccaccgccgaccugaccggcugcuacgaccugcccgaggacuacaucagaugggaggacgccugggccaucggccccgugaccaucgccugccugggcuucaugugcaccugcaugguggugaccguguucaucaagcacaacaacaccccccuggugaaggccagcggcagagagcugugcuacauccugcuguucggcgugggccugagcuacugcaugaccuucuucuucaucgccaagcccagccccgugaucugcgcccugagaagacugggccugggcagcagcuucgccaucugcuacagcgcccugcugaccaagaccaacugcaucgccagaaucuucgacggcgugaagaacggcgcccagagacccaaguucaucagccccagcagccagguguucaucugccugggccugauccuggugcagaucgugauggugagcguguggcugauccuggaggcccccggcaccagaagauacacccuggccgagaagagagagaccgugauccugaagugcaacgugaaggacagcagcaugcugaucagccugaccuacgacgugauccuggugauccugugcaccguguacgccuucaagaccagaaagugccccgagaacuucaacgaggccaaguucaucggcuucaccauguacaccaccugcaucaucuggcuggccuuccugcccaucuucuacgugaccagcagcgacuacagagugcagaccaccaccaugugcaucagcgugagccugagcggcuucguggugcugggcugccuguucgcccccaaggugcacaucauccuguuccagccccagaagaacguggugacccacagacugcaccugaacagauucagcgugagcggcaccggcaccaccuacagccagagcagcgccagcaccuacgugcccaccgugugcaacggcagagaggugcuggacagcaccaccagcagccuguaa

SEQ ID NO: 17798 - RNA, 2739 nt, Artificial Sequence
  GRM4__Homo_sapiens__NP_000832
augcccggcaagagaggccugggcugguggugggccagacugccccugugccugcugcugagccuguacggccccuggaugcccagcagccugggcaagcccaagggccacccccacaugaacagcaucagaaucgacggcgacaucacccugggcggccuguuccccgugcacggcagaggcagcgagggcaagcccugcggcgagcugaagaaggagaagggcauccacagacuggaggccaugcuguucgcccuggacagaaucaacaacgaccccgaccugcugcccaacaucacccugggcgccagaauccuggacaccugcagcagagacacccacgcccuggagcagagccugaccuucgugcaggcccugaucgagaaggacggcaccgaggugagaugcggcagcggcggcccccccaucaucaccaagcccgagagaguggugggcgugaucggcgccagcggcagcagcgugagcaucaugguggccaacauccugagacuguucaagaucccccagaucagcuacgccagcaccgcccccgaccugagcgacaacagcagauacgacuucuucagcagaguggugcccagcgacaccuaccaggcccaggccaugguggacaucgugagagcccugaaguggaacuacgugagcaccguggccagcgagggcagcuacggcgagagcggcguggaggccuucauccagaagagcagagaggacggcggcgugugcaucgcccagagcgugaagauccccagagagcccaaggccggcgaguucgacaagaucaucagaagacugcuggagaccagcaacgccagagccgugaucaucuucgccaacgaggacgacaucagaagagugcuggaggccgccagaagagccaaccagaccggccacuucuucuggaugggcagcgacagcuggggcagcaagaucgcccccgugcugcaccuggaggagguggccgagggcgccgugaccauccugcccaagagaaugagcgugagaggcuucgacagauacuucagcagcagaacccuggacaacaacagaagaaacaucugguucgccgaguucugggaggacaacuuccacugcaagcugagcagacacgcccugaagaagggcagccacgugaagaagugcaccaacagagagagaaucggccaggacagcgccuacgagcaggagggcaaggugcaguucgugaucgacgccguguacgccaugggccacgcccugcacgccaugcacagagaccugugccccggcagagugggccugugccccagaauggaccccguggacggcacccagcugcugaaguacaucagaaacgugaacuucagcggcaucgccggcaaccccgugaccuucaacgagaacggcgacgcccccggcagauacgacaucuaccaguaccagcugagaaacgacagcgccgaguacaaggugaucggcagcuggaccgaccaccugcaccugagaaucgagagaaugcacuggcccggcagcggccagcagcugcccagaagcaucugcagccugcccugccagcccggcgagagaaagaagaccgugaagggcaugcccugcugcuggcacugcgagcccugcaccggcuaccaguaccagguggacagauacaccugcaagaccugccccuacgacaugagacccaccgagaacagaaccggcugcagacccauccccaucaucaagcuggaguggggcagccccugggccgugcugccccuguuccuggccguggugggcaucgccgccacccuguucguggugaucaccuucgugagauacaacgacacccccaucgugaaggccagcggcagagagcugagcuacgugcugcuggccggcaucuuccugugcuacgccaccaccuuccugaugaucgccgagcccgaccugggcaccugcagccugagaagaaucuuccugggccugggcaugagcaucagcuacgccgcccugcugaccaagaccaacagaaucuacagaaucuucgagcagggcaagagaagcgugagcgcccccagauucaucagccccgccagccagcuggccaucaccuucagccugaucagccugcagcugcugggcaucugcgugugguucgugguggaccccagccacagcgugguggacuuccaggaccagagaacccuggaccccagauucgccagaggcgugcugaagugcgacaucagcgaccugagccugaucugccugcugggcuacagcaugcugcugauggugaccugcaccguguacgccaucaagaccagaggcgugcccgagaccuucaacgaggccaagcccaucggcuucaccauguacaccaccugcaucguguggcuggccuucauccccaucuucuucggcaccagccagagcgccgacaagcuguacauccagaccaccacccugaccgugagcgugagccugagcgccagcgugagccugggcaugcuguacaugcccaagguguacaucauccuguuccaccccgagcagaacgugcccaagagaaagagaagccugaaggccguggugaccgccgccaccaugagcaacaaguucacccagaagggcaacuucagacccaacggcgaggccaagagcgagcugugcgagaaccuggaggcccccgcccuggccaccaagcagaccuacgugaccuacaccaaccacgccaucuaa

SEQ ID NO: 17799 - RNA, 3543 nt, Artificial Sequence
  GRM5__Homo_sapiens__NP_000833
auggugcugcugcugauccugagcgugcugcugcugaaggaggacgugagaggcagcgcccagagcagcgagagaagagugguggcccacaugcccggcgacaucaucaucggcgcccuguucagcgugcaccaccagcccaccguggacaaggugcacgagagaaagugcggcgccgugagagagcaguacggcauccagagaguggaggccaugcugcacacccuggagagaaucaacagcgaccccacccugcugcccaacaucacccugggcugcgagaucagagacagcugcuggcacagcgccguggcccuggagcagagcaucgaguucaucagagacagccugaucagcagcgaggaggaggagggccuggugagaugcguggacggcagcagcagcagcuucagaagcaagaagcccaucgugggcgugaucggccccggcagcagcagcguggccauccaggugcagaaccugcugcagcuguucaacaucccccagaucgccuacagcgccaccagcauggaccugagcgacaagacccuguucaaguacuucaugagaguggugcccagcgacgcccagcaggccagagccaugguggacaucgugaagagauacaacuggaccuacgugagcgccgugcacaccgagggcaacuacggcgagagcggcauggaggccuucaaggacaugagcgccaaggagggcaucugcaucgcccacagcuacaagaucuacagcaacgccggcgagcagagcuucgacaagcugcugaagaagcugaccagccaccugcccaaggccagagugguggccugcuucugcgagggcaugaccgugagaggccugcugauggccaugagaagacugggccuggccggcgaguuccugcugcugggcagcgacggcugggccgacagauacgacgugaccgacggcuaccagagagaggccgugggcggcaucaccaucaagcugcagagccccgacgugaagugguucgacgacuacuaccugaagcugagacccgagaccaaccacagaaaccccugguuccaggaguucuggcagcacagauuccagugcagacuggagggcuucccccaggagaacagcaaguacaacaagaccugcaacagcagccugacccugaagacccaccacgugcaggacagcaagaugggcuucgugaucaacgccaucuacagcauggccuacggccugcacaacaugcagaugagccugugccccggcuacgccggccugugcgacgccaugaagcccaucgacggcagaaagcugcuggagagccugaugaagaccaacuucaccggcgugagcggcgacaccauccuguucgacgagaacggcgacagccccggcagauacgagaucaugaacuucaaggagaugggcaaggacuacuucgacuacaucaacgugggcagcugggacaacggcgagcugaagauggacgacgacgagguguggagcaagaagagcaacaucaucagaagcgugugcagcgagcccugcgagaagggccagaucaaggugaucagaaagggcgaggugagcugcugcuggaccugcacccccugcaaggagaacgaguacguguucgacgaguacaccugcaaggccugccagcugggcagcuggcccaccgacgaccugaccggcugcgaccugauccccgugcaguaccugagauggggcgaccccgagcccaucgccgccgugguguucgccugccugggccugcuggccacccuguucgugaccgugguguucaucaucuacagagacacccccguggugaagagcagcagcagagagcugugcuacaucauccuggccggcaucugccugggcuaccugugcaccuucugccugaucgccaagcccaagcagaucuacugcuaccugcagagaaucggcaucggccugagccccgccaugagcuacagcgcccuggugaccaagaccaacagaaucgccagaauccuggccggcagcaagaagaagaucugcaccaagaagcccagauucaugagcgccugcgcccagcuggugaucgccuucauccugaucugcauccagcugggcaucaucguggcccuguucaucauggagccccccgacaucaugcacgacuaccccagcaucagagagguguaccugaucugcaacaccaccaaccugggcguggugaccccccugggcuacaacggccugcugauccugagcugcaccuucuacgccuucaagaccagaaacgugcccgccaacuucaacgaggccaaguacaucgccuucaccauguacaccaccugcaucaucuggcuggccuucgugcccaucuacuucggcagcaacuacaagaucaucaccaugugcuucagcgugagccugagcgccaccguggcccugggcugcauguucgugcccaagguguacaucauccuggccaagcccgagagaaacgugagaagcgccuucaccaccagcaccguggugagaaugcacgugggcgacggcaagagcagcagcgccgccagcagaagcagcagccuggugaaccuguggaagagaagaggcagcagcggcgagacccugagcagcaacggcaagagcgugaccugggcccagaacgagaagagcagcagaggccagcaccuguggcagagacugagcauccacaucaacaagaaggagaaccccaaccagaccgccgugaucaagcccuuccccaagagcaccgagagcagaggccugggcgccggcgccggcgccggcggcagcgccggcggcgugggcgccaccggcggcgccggcugcgccggcgccggccccggcggccccgagagccccgacgccggccccaaggcccuguacgacguggccgaggccgaggagcacuuccccgcccccgccagacccagaagccccagccccaucagcacccugagccacagagccggcagcgccagcagaaccgacgacgacgugcccagccugcacagcgagcccguggccagaagcagcagcagccagggcagccugauggagcagaucagcagcguggugaccagauucaccgccaacaucagcgagcugaacagcaugaugcugagcaccgccgcccccagccccggcgugggcgccccccugugcagcagcuaccugauccccaaggagauccagcugcccaccaccaugaccaccuucgccgagauccagccccugcccgccaucgaggugaccggcggcgcccagcccgccgccggcgcccaggccgccggcgacgccgccagagagagccccgccgccggccccgaggccgccgccgccaagcccgaccuggaggagcugguggcccugaccccccccagccccuucagagacagcguggacagcggcagcaccacccccaacagccccgugagcgagagcgcccugugcauccccagcagccccaaguacgacacccugaucaucagagacuacacccagagcagcagcagccuguaa

SEQ ID NO: 17800 - RNA, 2634 nt, Artificial Sequence
  GRM6__Homo_sapiens__NP_000834
auggccagacccagaagagccagagagccccugcugguggcccugcugccccuggccuggcuggcccaggccggccuggccagagccgccggcagcgugagacuggccggcggccugacccugggcggccuguuccccgugcacgccagaggcgccgccggcagagccugcggccagcugaagaaggagcagggcgugcacagacuggaggccaugcuguacgcccuggacagagugaacgccgaccccgagcugcugcccggcgugagacugggcgccagacugcuggacaccugcagcagagacaccuacgcccuggagcaggcccugagcuucgugcaggcccugaucagaggcagaggcgacggcgacgaggugggcgugagaugccccggcggcgugcccccccugagacccgccccccccgagagagugguggccguggugggcgccagcgccagcagcgugagcaucaugguggccaacgugcugagacuguucgccaucccccagaucagcuacgccagcaccgcccccgagcugagcgacagcaccagauacgacuucuucagcagaguggugccccccgacagcuaccaggcccaggccaugguggacaucgugagagcccugggcuggaacuacgugagcacccuggccagcgagggcaacuacggcgagagcggcguggaggccuucgugcagaucagcagagaggccggcggcgugugcaucgcccagagcaucaagauccccagagagcccaagcccggcgaguucagcaaggugaucagaagacugauggagacccccaacgccagaggcaucaucaucuucgccaacgaggacgacaucagaagagugcuggaggccgccagacaggccaaccugaccggccacuuccugugggugggcagcgacagcuggggcgccaagaccagccccauccugagccuggaggacguggccgugggcgccaucaccauccugcccaagagagccagcaucgacggcuucgaccaguacuucaugaccagaagccuggagaacaacagaagaaacaucugguucgccgaguucugggaggagaacuucaacugcaagcugaccagcagcggcacccagagcgacgacagcaccagaaagugcaccggcgaggagagaaucggcagagacagcaccuacgagcaggagggcaaggugcaguucgugaucgacgccguguacgccaucgcccacgcccugcacagcaugcaccaggcccugugccccggccacaccggccugugccccgccauggagcccaccgacggcagaaugcugcugcaguacaucagagccgugagauucaacggcagcgccggcacccccgugauguucaacgagaacggcgacgcccccggcagauacgacaucuuccaguaccaggccaccaacggcagcgccagcagcggcggcuaccaggccgugggccagugggccgagacccugagacuggacguggaggcccugcaguggagcggcgacccccacgaggugcccagcagccugugcagccugcccugcggccccggcgagagaaagaagauggugaagggcgugcccugcugcuggcacugcgaggccugcgacggcuacagauuccagguggacgaguucaccugcgaggccugccccggcgacaugagacccacccccaaccacaccggcugcagacccacccccguggugagacugagcuggagcagccccugggccgcccccccccugcugcuggccgugcugggcaucguggccaccaccaccgugguggccaccuucgugagauacaacaacacccccaucgugagagccagcggcagagagcugagcuacgugcugcugaccggcaucuuccugaucuacgccaucaccuuccugaugguggccgagcccggcgccgccgugugcgccgccagaagacuguuccugggccugggcaccacccugagcuacagcgcccugcugaccaagaccaacagaaucuacagaaucuucgagcagggcaagagaagcgugacccccccccccuucaucagccccaccagccagcuggugaucaccuucagccugaccagccugcagguggugggcaugaucgccuggcugggcgccagacccccccacagcgugaucgacuacgaggagcagagaaccguggaccccgagcaggccagaggcgugcugaagugcgacaugagcgaccugagccugaucggcugccugggcuacagccugcugcugauggugaccugcaccguguacgccaucaaggccagaggcgugcccgagaccuucaacgaggccaagcccaucggcuucaccauguacaccaccugcaucaucuggcuggccuucgugcccaucuucuucggcaccgcccagagcgccgagaagaucuacauccagaccaccacccugaccgugagccugagccugagcgccagcgugagccugggcaugcuguacgugcccaagaccuacgugauccuguuccaccccgagcagaacgugcagaagagaaagagaagccugaaggccaccagcaccguggccgccccccccaagggcgaggacgccgaggcccacaaguaa

SEQ ID NO: 17801 - RNA, 2748 nt, Artificial Sequence
  GRM7__Homo_sapiens__NP_000835
auggugcagcugagaaagcugcugagagugcugacccugaugaaguuccccugcugcgugcuggaggugcugcugugcgcccuggccgccgccgccagaggccaggagauguacgccccccacagcaucagaaucgagggcgacgugacccugggcggccuguuccccgugcacgccaagggccccagcggcgugcccugcggcgacaucaagagagagaacggcauccacagacuggaggccaugcuguacgcccuggaccagaucaacagcgaccccaaccugcugcccaacgugacccugggcgccagaauccuggacaccugcagcagagacaccuacgcccuggagcagagccugaccuucgugcaggcccugauccagaaggacaccagcgacgugagaugcaccaacggcgagccccccguguucgugaagcccgagaagguggugggcgugaucggcgccagcggcagcagcgugagcaucaugguggccaacauccugagacuguuccagaucccccagaucagcuacgccagcaccgcccccgagcugagcgacgacagaagauacgacuucuucagcagaguggugccccccgacagcuuccaggcccaggccaugguggacaucgugaaggcccugggcuggaacuacgugagcacccuggccagcgagggcagcuacggcgagaagggcguggagagcuucacccagaucagcaaggaggccggcggccugugcaucgcccagagcgugagaaucccccaggagagaaaggacagaaccaucgacuucgacagaaucaucaagcagcugcuggacacccccaacagcagagccguggugaucuucgccaacgacgaggacaucaagcagauccuggccgccgccaagagagccgaccaggugggccacuuccugugggugggcagcgacagcuggggcagcaagaucaacccccugcaccagcacgaggacaucgccgagggcgccaucaccauccagcccaagagagccaccguggagggcuucgacgccuacuucaccagcagaacccuggagaacaacagaagaaacgugugguucgccgaguacugggaggagaacuucaacugcaagcugaccaucagcggcagcaagaaggaggacaccgacagaaagugcaccggccaggagagaaucggcaaggacagcaacuacgagcaggagggcaaggugcaguucgugaucgacgccguguacgccauggcccacgcccugcaccacaugaacaaggaccugugcgccgacuacagaggcgugugccccgagauggagcaggccggcggcaagaagcugcugaaguacaucagaaacgugaacuucaacggcagcgccggcacccccgugauguucaacaagaacggcgacgcccccggcagauacgacaucuuccaguaccagaccaccaacaccagcaaccccggcuacagacugaucggccaguggaccgacgagcugcagcugaacaucgaggacaugcaguggggcaagggcgugagagagauccccgccagcgugugcacccugcccugcaagcccggccagagaaagaagacccagaagggcacccccugcugcuggaccugcgagcccugcgacggcuaccaguaccaguucgacgagaugaccugccagcacugccccuacgaccagagacccaacgagaacagaaccggcugccaggacauccccaucaucaagcuggaguggcacagccccugggccgugauccccguguuccuggccaugcugggcaucaucgccaccaucuucgugauggccaccuucaucagauacaacgacacccccaucgugagagccagcggcagagagcugagcuacgugcugcugaccggcaucuuccugugcuacaucaucaccuuccugaugaucgccaagcccgacguggccgugugcagcuucagaagaguguuccugggccugggcaugugcaucagcuacgccgcccugcugaccaagaccaacagaaucuacagaaucuucgagcagggcaagaagagcgugaccgcccccagacugaucagccccaccagccagcuggccaucaccagcagccugaucagcgugcagcugcugggcguguucaucugguucggcguggacccccccaacaucaucaucgacuacgacgagcacaagaccaugaaccccgagcaggccagaggcgugcugaagugcgacaucaccgaccugcagaucaucugcagccugggcuacagcauccugcugauggugaccugcaccguguacgccaucaagaccagaggcgugcccgagaacuucaacgaggccaagcccaucggcuucaccauguacaccaccugcaucguguggcuggccuucauccccaucuucuucggcaccgcccagagcgccgagaagcuguacauccagaccaccacccugaccaucagcaugaaccugagcgccagcguggcccugggcaugcuguacaugcccaagguguacaucaucaucuuccaccccgagcugaacgugcagaagagaaagagaagcuucaaggccguggugaccgccgccaccaugagcagcagacugagccacaagcccagcgacagacccaacggcgaggccaagaccgagcugugcgagaacguggaccccaacagccccgccgccaagaagaaguacgugagcuacaacaaccuggugaucuaa

SEQ ID NO: 17802 - RNA, 2727 nt, Artificial Sequence
  GRM8__Homo_sapiens__XP_006716001
auggugugcgagggcaagagaagcgccagcugccccugcuucuuccugcugaccgccaaguucuacuggauccugaccaugaugcagagaacccacagccaggaguacgcccacagcaucagaguggacggcgacaucauccugggcggccuguuccccgugcacgccaagggcgagagaggcgugcccugcggcgagcugaagaaggagaagggcauccacagacuggaggccaugcuguacgccaucgaccagaucaacaaggaccccgaccugcugagcaacaucacccugggcgugagaauccuggacaccugcagcagagacaccuacgcccuggagcagagccugaccuucgugcaggcccugaucgagaaggacgccagcgacgugaagugcgccaacggcgacccccccaucuucaccaagcccgacaagaucagcggcgugaucggcgccgccgccagcagcgugagcaucaugguggccaacauccugagacuguucaagaucccccagaucagcuacgccagcaccgcccccgagcugagcgacaacaccagauacgacuucuucagcagaguggugccccccgacagcuaccaggcccaggccaugguggacaucgugaccgcccugggcuggaacuacgugagcacccuggccagcgagggcaacuacggcgagagcggcguggaggccuucacccagaucagcagagagaucggcggcgugugcaucgcccagagccagaagauccccagagagcccagacccggcgaguucgagaagaucaucaagagacugcuggagacccccaacgccagagccgugaucauguucgccaacgaggacgacaucagaagaauccuggaggccgccaagaagcugaaccagagcggccacuuccuguggaucggcagcgacagcuggggcagcaagaucgcccccguguaccagcaggaggagaucgccgagggcgccgugaccauccugcccaagagagccagcaucgacggcuucgacagauacuucagaagcagaacccuggccaacaacagaagaaacgugugguucgccgaguucugggaggagaacuucggcugcaagcugggcagccacggcaagagaaacagccacaucaagaagugcaccggccuggagagaaucgccagagacagcagcuacgagcaggagggcaaggugcaguucgugaucgacgccguguacagcauggccuacgcccugcacaacaugcacaaggaccugugccccggcuacaucggccugugccccagaaugagcaccaucgacggcaaggagcugcugggcuacaucagagccgugaacuucaacggcagcgccggcacccccgugaccuucaacgagaacggcgacgcccccggcagauacgacaucuuccaguaccagaucaccaacaagagcaccgaguacaaggugaucggccacuggaccaaccagcugcaccugaagguggaggacaugcagugggcccacagagagcacacccaccccgccagcgugugcagccugcccugcaagcccggcgagagaaagaagaccgugaagggcgugcccugcugcuggcacugcgagagaugcgagggcuacaacuaccagguggacgagcugagcugcgagcugugcccccuggaccagagacccaacaugaacagaaccggcugccagcugauccccaucaucaagcuggaguggcacagccccugggccguggugcccguguucguggccauccugggcaucaucgccaccaccuucgugaucgugaccuucgugagauacaacgacacccccaucgugagagccagcggcagagagcugagcuacgugcugcugaccggcaucuuccugugcuacagcaucaccuuccugaugaucgccgcccccgacaccaucaucugcagcuucagaagaguguuccugggccugggcaugugcuucagcuacgccgcccugcugaccaagaccaacagaauccacagaaucuucgagcagggcaagaagagcgugaccgcccccaaguucaucagccccgccagccagcuggugaucaccuucagccugaucagcgugcagcugcugggcguguucgugugguucgugguggaccccccccacaucaucaucgacuacggcgagcagagaacccuggaccccgagaaggccagaggcgugcugaagugcgacaucagcgaccugagccugaucugcagccugggcuacagcauccugcugauggugaccugcaccguguacgccaucaagaccagaggcgugcccgagaccuucaacgaggccaagcccaucggcuucaccauguacaccaccugcaucaucuggcuggccuucauccccaucuucuucggcaccgcccagagcgccgagaagauguacauccagaccaccacccugaccgugagcaugagccugagcgccagcgugagccugggcaugcuguacaugcccaagguguacaucaucaucuuccaccccgagcagaacgugcagaagagaaagagaagcuucaaggccguggugaccgccgccaccaugcagagcaagcugauccagaagggcaacgacagacccaacggcgaggugaagagcgagcugugcgagagccuggagaccaacaccagcagcaccaagaccaccuacaucagcuacagcaaccacagcaucuaa

SEQ ID NO: 17803 - RNA, 1782 nt, Artificial Sequence
  GRN__Homo_sapiens__XP_005257310
auguggacccuggugagcuggguggcccugaccgccggccugguggccggcaccagaugccccgacggccaguucugccccguggccugcugccuggaccccggcggcgccagcuacagcugcugcagaccccugcuggacaaguggcccaccacccugagcagacaccugggcggccccugccagguggacgcccacugcagcgccggccacagcugcaucuucaccgugagcggcaccagcagcugcugccccuuccccgaggccguggccugcggcgacggccaccacugcugccccagaggcuuccacugcagcgccgacggcagaagcugcuuccagagaagcggcaacaacagcgugggcgccauccagugccccgacagccaguucgagugccccgacuucagcaccugcugcgugaugguggacggcagcuggggcugcugccccaugccccaggccagcugcugcgaggacagagugcacugcugcccccacggcgccuucugcgaccuggugcacaccagaugcaucacccccaccggcacccacccccuggccaagaagcugcccgcccagagaaccaacagagccguggcccugagcagcagcgugaugugccccgacgccagaagcagaugccccgacggcagcaccugcugcgagcugcccagcggcaaguacggcugcugccccaugcccaacgccaccugcugcagcgaccaccugcacugcugcccccaggacaccgugugcgaccugauccagagcaagugccugagcaaggagaacgccaccaccgaccugcugaccaagcugcccgcccacaccgugggcgacgugaagugcgacauggaggugagcugccccgacggcuacaccugcugcagacugcagagcggcgccuggggcugcugccccuucacccaggccgugugcugcgaggaccacauccacugcugccccgccggcuucaccugcgacacccagaagggcaccugcgagcagggcccccaccaggugcccuggauggagaaggcccccgcccaccugagccugcccgacccccaggcccugaagagagacgugcccugcgacaacgugagcagcugccccagcagcgacaccugcugccagcugaccagcggcgaguggggcugcugccccauccccgaggccgugugcugcagcgaccaccagcacugcugcccccagggcuacaccugcguggccgagggccagugccagagaggcagcgagaucguggccggccuggagaagaugcccgccagaagagccagccugagccaccccagagacaucggcugcgaccagcacaccagcugccccgugggccagaccugcugccccagccugggcggcagcugggccugcugccagcugccccacgccgugugcugcgaggacagacagcacugcugccccgccggcuacaccugcaacgugaaggccagaagcugcgagaaggagguggugagcgcccagcccgccaccuuccuggccagaagcccccacgugggcgugaaggacguggagugcggcgagggccacuucugccacgacaaccagaccugcugcagagacaacagacagggcugggccugcugccccuacagacagggcgugugcugcgccgacagaagacacugcugccccgccggcuucagaugcgccgccagaggcaccaagugccugagaagagaggcccccagaugggacgccccccugagagaccccgcccugagacagcugcuguaa

SEQ ID NO: 17804 - RNA, 654 nt, Artificial Sequence
  GRPEL1__Homo_sapiens__NP_079472
auggccgcccagugcgugagacuggccagaagaagccugcccgcccuggcccugagccugagacccagccccagacugcugugcaccgccaccaagcagaagaacagcggccagaaccuggaggaggacaugggccagagcgagcagaaggccgacccccccgccaccgagaagacccugcuggaggagaaggugaagcuggaggagcagcugaaggagaccguggagaaguacaagagagcccuggccgacaccgagaaccugagacagagaagccagaagcugguggaggaggccaagcuguacggcauccaggccuucugcaaggaccugcuggagguggccgacgugcuggagaaggccacccagugcgugcccaaggaggagaucaaggacgacaacccccaccugaagaaccuguacgagggccuggugaugaccgaggugcagauccagaagguguucaccaagcacggccugcugaagcugaaccccgugggcgccaaguucgaccccuacgagcacgaggcccuguuccacacccccguggagggcaaggagcccggcaccguggcccuggugagcaaggugggcuacaagcugcacggcagaacccugagacccgcccuggugggcguggugaaggaggccuaa

SEQ ID NO: 17805 - RNA, 426 nt, Artificial Sequence
  GRP__Homo_sapiens__NP_001012530
augagaggcagagagcugccccuggugcugcuggcccuggugcugugccuggcccccagaggcagagccgugccccugcccgccggcggcggcaccgugcugaccaagauguaccccagaggcaaccacugggccgugggccaccugaugggcaagaagagcaccggcgagagcagcagcgugagcgagagaggcagccugaagcagcagcugagagaguacaucagaugggaggaggccgccagaaaccugcugggccugaucgaggccaaggagaacagaaaccaccagcccccccagcccaaggcccugggcaaccagcagcccagcugggacagcgaggacagcagcaacuucaaggacgugggcagcaagggcaagggcagccagagagagggcagaaacccccagcugaaccagcaguaa

SEQ ID NO: 17806 - RNA, 1155 nt, Artificial Sequence
  GRPR__Homo_sapiens__NP_005305
auggcccugaacgacugcuuccugcugaaccuggagguggaccacuucaugcacugcaacaucagcagccacagcgccgaccugcccgugaacgacgacuggagccaccccggcauccuguacgugauccccgccguguacggcgugaucauccugaucggccugaucggcaacaucacccugaucaagaucuucugcaccgugaagagcaugagaaacgugcccaaccuguucaucagcagccuggcccugggcgaccugcugcugcugaucaccugcgcccccguggacgccagcagauaccuggccgacagauggcuguucggcagaaucggcugcaagcugauccccuucauccagcugaccagcgugggcgugagcguguucacccugaccgcccugagcgccgacagauacaaggccaucgugagacccauggacauccaggccagccacgcccugaugaagaucugccugaaggccgccuucaucuggaucaucagcaugcugcuggccauccccgaggccguguucagcgaccugcaccccuuccacgaggagagcaccaaccagaccuucaucagcugcgcccccuacccccacagcaacgagcugcaccccaagauccacagcauggccagcuuccugguguucuacgugaucccccugagcaucaucagcguguacuacuacuucaucgccaagaaccugauccagagcgccuacaaccugcccguggagggcaacauccacgugaagaagcagaucgagagcagaaagagacuggccaagaccgugcugguguucgugggccuguucgccuucugcuggcugcccaaccacgugaucuaccuguacagaagcuaccacuacagcgagguggacaccagcaugcugcacuucgugaccagcaucugcgccagacugcuggccuucaccaacagcugcgugaaccccuucgcccuguaccugcugagcaagagcuucagaaagcaguucaacacccagcugcugugcugccagcccggccugaucaucagaagccacagcaccggcagaagcaccaccugcaugaccagccugaagagcaccaaccccagcguggccaccuucagccugaucaacggcaacaucugccacgagagauacguguaa

SEQ ID NO: 17807 - RNA, 957 nt, Artificial Sequence
  GRSF1__Homo_sapiens__NP_001091947
auggaggacgugcugaacuucuucagcgacugcagaaucagaaacggcgagaacggcauccacuuccugcugaacagagacggcaagagaagaggcgacgcccugaucgagauggagagcgagcaggacgugcagaaggcccuggagaagcacagaauguacaugggccagagauacguggagguguacgagaucaacaacgaggacguggacgcccugaugaagagccugcaggugaagagcagccccguggugaacgacggcguggugagacugagaggccugcccuacagcugcaacgagaaggacaucguggacuucuucgccggccugaacaucguggacaucaccuucgugauggacuacagaggcagaagaaagaccggcgaggccuacgugcaguucgaggagcccgagauggccaaccaggcccugcugaagcacagagaggagaucggcaacagauacaucgagaucuuccccagcagaagaaacgaggugagaacccacgugggcagcuacaagggcaagaagaucgccagcuuccccaccgccaaguacaucaccgagcccgagaugguguucgaggagcacgaggugaacgaggacauccagcccaugaccgccuucgagagcgagaaggagaucgagcugcccaaggaggugcccgagaagcugcccgaggccgccgacuucggcaccaccagcagccugcacuucgugcacaugagaggccugcccuuccaggccaacgcccaggacaucaucaacuucuucgccccccugaagcccgugagaaucaccauggaguacagcagcagcggcaaggccaccggcgaggccgacgugcacuucgagacccacgaggacgccguggccgccaugcugaaggacagaagccacgugcaccacagauacaucgagcuguuccugaacagcugccccaagggcaaguaa

SEQ ID NO: 17808 - RNA, 873 nt, Artificial Sequence
  GRXCR1__Homo_sapiens__NP_001073945
augcugaagagagagaugaagcccgagagcgacagacccagaaaggugagauucagaaucgccagcagccacagcggcagagugcugaaggagguguacgaggacggccagcccagcggcagccuggacagcgagugcgccagcaucugcggcaucgacggccugggcgacagcgacggccagcagaacggccacaucgagagcgagggcgacgagaacgagaacgaccaggacagccugcuggugcuggccagagccgccagcgagaagggcuucggcaccagaagagugaacauccugagcaagaacggcaccgugagaggcgugaaguacaaggugagcgccggccaggcccuguucaacaaccugaccaaggugcugcagcagcccagcaccgaccuggaguucgacagaguggugaucuacaccaccugccugagaguggugagaaccaccuucgagagaugcgagcuggugagaaagaucuuccagaaccacagagugaaguucgaggagaagaacaucgcccugaacggcgaguacggcaaggagcuggacgagagaugcagaagagugagcgaggcccccagccugcccgugguguucaucgacggccacuaccugggcggcgccgagaagauccugagcaugaacgagagcggcgagcugcaggacauccugaccaagaucgagagagugcagcacccccacgagugccccagcugcggcggcuucggcuuccugcccugcagcgugugccacggcagcaagaugagcauguucagaaacugcuucaccgacagcuucaaggcccugaagugcaccgccugcaacgagaacggccugcagagaugcaagaacugcgccggcuaa

SEQ ID NO: 17809 - RNA, 747 nt, Artificial Sequence
  GRXCR2__Homo_sapiens__XP_011535976
auggaggaccccgagaagaagcugaaccagaagagcgacggcaagcccagaaaggugagauucaagaucagcagcagcuacagcggcagagugcugaagcagguguucgaggacggccaggagcuggagagccccaaggaggaguacccccacagcuuccugcaggagagccuggagaccauggacggcguguacggcagcggcgaggugcccagaccccagaugugcagccccaagcugaccgcccagagaaucagcguguucagagagggcaacgccuacacccuggccggcggccagcccagauucaacgacuacaaggccaacgaccacaagccccugcccaucaucgacuucggcaagaucaucaucuacaccaacaaccugaagaucaucagaacccccauggacaagagagacuucgugagaaagauccugcagaaggaggaggaggccgaggaggagagccugaugaacaaggaggagagcuacggcggcagagaccagcacgacagaccccugguggaggccgagagcacccugccccagaacagauacacccaggagggcgacauccccgaggacagcugcuuccacugcagaggcagcggcagcgccaccugcagccugugccacggcagcaaguucagcaugcuggccaacagauucaaggagagcuacagagcccugagaugccccgccugcaacgagaacggccugcagcccugccagaucugcaaccaguaa

SEQ ID NO: 17810 - RNA, 618 nt, Artificial Sequence
  GSC2__Homo_sapiens__NP_005306
auggccgccgccgccggcggcgccgccagcagaagaggcgccggcagacccugccccuucagcaucgagcacauccugagcagccugcccgagagaagccugcccgccagagccgccugccccccccagcccgccggcagacagagccccgccaagcccgaggagcccggcgcccccgaggccgcccccugcgccugcugcugcugcugcggccccagagccgcccccugcggcccccccgaggccgccgccggccugggcgccagacuggccuggccccugagacugggccccgccgugccccugagccugggcgcccccgccggcggcagcggcgcccugcccggcgccgugggccccggcagccagagaagaaccagaagacacagaaccaucuucagcgaggagcagcugcaggcccuggaggcccuguucgugcagaaccaguaccccgacgugagcaccagagagagacuggccggcagaaucagacugagagaggagagaguggaggugugguucaagaacagaagagccaaguggagacaccagaagagagccagcgccagcgccagacugcugcccggcgugaagaagagccccaagggcagcugcuaa

SEQ ID NO: 17811 - RNA, 774 nt, Artificial Sequence
  GSC__Homo_sapiens__NP_776248
augcccgccagcauguucagcaucgacaacauccuggccgccagacccagaugcaaggacagcgugcugcccguggcccacagcgccgccgcccccgugguguuccccgcccugcacggcgacagccuguacggcgccagcggcggcgccagcagcgacuacggcgccuucuaccccagacccguggcccccggcggcgccggccugcccgccgccgugagcggcagcagacugggcuacaacaacuacuucuacggccagcugcacgugcaggccgcccccgugggccccgccugcugcggcgccgugcccccccugggcgcccagcagugcagcugcgugcccaccccccccggcuacgagggccccggcagcgugcuggugagccccgugccccaccagaugcugcccuacaugaacgugggcacccugagcagaaccgagcugcagcugcugaaccagcugcacugcagaagaaagagaagacacagaaccaucuucaccgacgagcagcuggaggcccuggagaaccuguuccaggagaccaaguaccccgacgugggcaccagagagcagcuggccagaaaggugcaccugagagaggagaagguggaggugugguucaagaacagaagagccaaguggagaagacagaagagaagcagcagcgaggagagcgagaacgccgagaaguggaacaagaccagcagcagcaaggccagccccgagaagagagaggaggagggcaagagcgaccuggacagcgacagcuaa

SEQ ID NO: 17812 - RNA, 1338 nt, Artificial Sequence
  GSDMA__Homo_sapiens__XP_006721895
augaccauguucgagaacgugaccagagcccuggccagacagcugaaccccagaggcgaccugaccccccuggacagccugaucgacuucaagagauuccaccccuucugccuggugcugagaaagagaaagagcacccuguucuggggcgccagauacgugagaaccgacuacacccugcuggacgugcuggagcccggcagcagccccagcgaccccaccgacaccggcaacuucggcuucaagaacaugcuggacaccagaguggagggcgacguggacgugcccaagaccgugaaggugaagggcaccgccggccugagccagaacagcacccuggaggugcagacccugagcguggcccccaaggcccuggagaccgugcaggagagaaagcuggccgccgaccaccccuuccugaaggagaugcaggaccagggcgagaaccuguacguggugauggaggugguggagaccgugcaggaggugacccuggagagagccggcaaggccgaggccugcuucagccugcccuucuucgccccccugggccugcagggcagcaucaaccacaaggaggccgugaccauccccaagggcugcgugcuggccuucagagugagacagcugauggugaagggcaaggacgagugggacaucccccacaucugcaacgacaacaugcagaccuucccccccggcgagaagagcggcgaggagaaggugauccugauccaggccagcgacgugggcgacgugcacgagggcuucagaacccugaaggaggaggugcagagagagacccagcagguggagaagcugagcagagugggccagagcagccugcugagcagccugagcaagcugcugggcaagaagaaggagcugcaggaccuggagcuggcccuggagggcgcccuggacaagggccacgaggugacccuggaggcccugcccaaggacgugcugcugagcaaggaggccgugggcgccauccuguacuucgugggcgcccugaccgagcugagcgaggcccagcagaagcugcuggugaagagcauggagaagaagauccugcccgugcagcugaagcugguggagagcaccauggagcagaacuuccugcuggacaaggagggcguguucccccugcagcccgagcugcugagcagccugggcgacgaggagcugacccugaccgaggcccuggugggccugagcggccuggaggugcagagaagcggcccccaguacaugugggaccccgacacccugcccagacugugcgcccuguacgccggccugagccugcugcagcagcugaccaaggccagcuaa

SEQ ID NO: 17813 - RNA, 1251 nt, Artificial Sequence
  GSDMB__Homo_sapiens__XP_011523318
auguucagcguguucgaggagaucaccagaaucguggugaaggagauggacgccggcggcgacaugaucgccgugagaagccugguggacgccgacagauucagaugcuuccaccuggugggcgagaagagaaccuucuucggcugcagacacuacaccaccggccugacccugauggacauccuggacaccgacggcgacaaguggcuggacgagcuggacagcggccugcagggccagaaggccgaguuccagauccuggacaacguggacagcaccggcgagcugaucgugagacugcccaaggagaucaccaucagcggcagcuuccagggcuuccaccaccagaagaucaagaucagcgagaacagaaucagccagcaguaccuggccacccuggagaacagaaagcugaagagagagcugcccuucagcuucagaagcaucaacaccagagagaaccuguaccuggugaccgagacccuggagaccgugaaggaggagacccugaagagcgacagacaguacaaguucuggagccagaucagccagggccaccugagcuacaagcacaagggccagagagaggugaccaucccccccaacagagugcugagcuacagagugaagcagcugguguuccccaacaaggagaccaugaacauccacuucagaggcaagaccaagagcuuccccgaggagaaggacggcgccagcagcugccugggcaagagccugggcagcgaggacagcagaaacaugaaggagaagcuggaggacauggagagcgugcugaaggaccugaccgaggagaagagaaaggacgugcugaacagccuggccaagugccugggcaaggaggacaucagacaggaccuggagcagagagugagcgaggugcugaucagcggcgagcugcacauggaggaccccgacaagccccugcugagcagccuguucaacgccgccggcgugcugguggaggccagagccaaggccauccuggacuuccuggacgcccugcuggagcugagcgaggagcagcaguucguggccgaggcccuggagaagggcacccugccccugcugaaggaccaggugaagagcgugauggagcagaacugggacgagcuggccagcagcccccccgacauggacuacgaccccgaggccagaauccugugcgcccuguacgugguggugagcauccugcuggagcuggccgagggccccaccagcgugagcagcuaa

SEQ ID NO: 17814 - RNA, 1527 nt, Artificial Sequence
  GSDMC__Homo_sapiens__NP_113603
augcccagcaugcuggagagaaucagcaagaaccuggugaaggagaucggcagcaaggaccugacccccgugaaguaccugcugagcgccaccaagcugagacaguucgugauccugagaaagaagaaggacagcagaagcagcuucugggagcagagcgacuacgugcccguggaguucagccugaacgacauccuggagcccagcagcagcgugcuggagaccguggugaccggccccuuccacuucagcgacaucaugauccagaagcacaaggccgacaugggcgugaacgugggcaucgaggugagcgugagcggcgaggccagcguggaccacggcugcagccuggaguuccagaucgugaccauccccagccccaaccuggaggacuuccagaagagaaagcugcuggaccccgagcccagcuuccugaaggagugcagaagaagaggcgacaaccuguacguggugaccgaggccguggagcugaucaacaacaccgugcuguacgacagcagcagcgugaacauccugggcaagaucgcccuguggaucaccuacggcaagggccagggccagggcgagagccugagagugaagaagaaggcccugacccugcagaagggcauggugauggccuacaagagaaagcagcuggugaucaaggagaaggccauccugaucagcgacgacgacgagcagagaaccuuccaggacgaguacgagaucagcgagauggugggcuacugcgccgccagaagcgagggccugcugcccagcuuccacaccaucagccccacccuguucaacgccagcagcaacgacaugaagcugaagcccgagcuguuccugacccagcaguuccugagcggccaccugcccaaguacgagcaggugcacauccugcccgugggcagaaucgaggagcccuucuggcagaacuucaagcaccugcaggaggagguguuccagaagaucaagacccuggcccagcugagcaaggacgugcaggacgugauguucuacagcauccuggccaugcugagagacagaggcgcccugcaggaccugaugaacaugcuggagcuggacagcagcggccaccuggacggccccggcggcgccauccugaagaagcugcagcaggacagcaaccacgccugguucaaccccaaggaccccauccuguaccugcuggaggccaucauggugcugagcgacuuccagcacgaccugcuggccugcagcauggagaagagaauccugcugcagcagcaggagcuggugagaagcauccuggagcccaacuucagauaccccuggagcauccccuucacccugaagcccgagcugcuggccccccugcagagcgagggccuggccaucaccuacggccugcuggaggagugcggccugagaauggagcuggacaaccccagaagcaccugggacguggaggccaagaugccccugagcgcccuguacggcacccugagccugcugcagcagcuggccgaggccuaa

SEQ ID NO: 17815 - RNA, 1455 nt, Artificial Sequence
  GSDMD__Homo_sapiens__NP_079012
augggcagcgccuucgagagaguggugagaagaguggugcaggagcuggaccacggcggcgaguucauccccgugaccagccugcagagcagcaccggcuuccagcccuacugccugguggugagaaagcccagcagcagcugguucuggaagcccagauacaagugcgugaaccugagcaucaaggacauccuggagcccgacgccgccgagcccgacgugcagagaggcagaagcuuccacuucuacgacgccauggacggccagauccagggcagcguggagcuggccgcccccggccaggccaagaucgccggcggcgccgccgugagcgacagcagcagcaccagcaugaacguguacagccugagcguggaccccaacaccuggcagacccugcugcacgagagacaccugagacagcccgagcacaaggugcugcagcagcugagaagcagaggcgacaacguguacguggugaccgaggugcugcagacccagaaggagguggaggugaccagaacccacaagagagagggcagcggcagauucagccugcccggcgccaccugccugcagggcgagggccagggccaccugagccagaagaagaccgugaccauccccagcggcagcacccuggccuucagaguggcccagcuggugaucgacagcgaccuggacgugcugcuguuccccgacaagaagcagagaaccuuccagccccccgccaccggccacaagagaagcaccagcgagggcgccuggccccagcugcccagcggccugagcaugaugagaugccugcacaacuuccugaccgacggcgugcccgccgagggcgccuucaccgaggacuuccagggccugagagccgagguggagaccaucagcaaggagcuggagcugcuggacagagagcugugccagcugcugcuggagggccuggagggcgugcugagagaccagcuggcccugagagcccuggaggaggcccuggagcagggccagagccugggccccguggagccccuggacggccccgccggcgccgugcuggagugccuggugcugagcagcggcaugcuggugcccgagcuggccauccccgugguguaccugcugggcgcccugaccaugcugagcgagacccagcacaagcugcuggccgaggcccuggagagccagacccugcugggcccccuggagcuggugggcagccugcuggagcagagcgcccccuggcaggagagaagcaccaugagccugccccccggccugcugggcaacagcuggggcgagggcgcccccgccugggugcugcuggacgagugcggccuggagcugggcgaggacaccccccacgugugcugggagccccaggcccagggcagaaugugcgcccuguacgccagccuggcccugcugagcggccugagccaggagccccacuaa

SEQ ID NO: 17816 - RNA, 3342 nt, Artificial Sequence
  GSE1__Homo_sapiens__NP_001127945
augggccccaucaucgugccccccggcggccacagcgugcccagcaccccccccguggugaccaucgcccccaccaagaccgugaacggcguguggagaagcgagagcagacaggacgccggcagcagaagcagcagcggcggcagagagagacugaucguggagcccccccugccccaggagaaggccggcggccccgccauccccagccaccugcugagcacccccuaccccuucggccugagccccagcagcguggugcaggacagcagauuccccccccugaaccugcagagacccgugcaccacguggugccccccagcaccgugaccgaggacuaccugagaagcuucagacccuaccacaccaccgacgaccugagaaugagcagccugcccccccugggccuggaccccgccaccgccgccgccuacuaccaccccagcuaccuggccccccaccccuucccccaccccgccuucagaauggacgacagcuacugccugagcgcccugagaagccccuucuaccccauccccacccccggcagccugcccccccugcaccccagcgccaugcaccugcaccugagcggcgugagauacccccccgagcugagccacagcagccuggccgcccugcacagcgagagaaugagcggccugagcgccgagagacugcagauggacgaggagcugagaagagagagagagagagagagagagagagagagagagagagaggccgacagagagagagagaaggagagagagagagagagagagaaggagagagagcaggagaaggagagagagagagagaaggagagagagagagagcuggagagacagagagagcagagagccagagagaaggagcugcuggccgccaaggcccuggagcccagcuuccugcccguggccgagcugcacggccugagaggccacgccaccgaggagagaggcaagcccagcgagcagcugacccccaccagagccgagaagcugaaggacgccggccugcaggcccccaagcccgugcagcacccccugcaccccgugcccaccccccaccacaccgugcccagccugaucagcaaccacggcaucuucagccugcccagcagcagcgccgccaccgcccugcugauccagagaaccaacgaggaggagaaguggcuggccagacagagaagacugagacaggagaaggaggacagacagagccaggugagcgaguucagacagcaggugcuggagcagcaccuggacaugggcagaccccccgugcccgccgaggccgagcacagacccgagagcaccaccagacccggccccaacagacacgagcccggcggcagagaccccccccagcacuucggcggcccccccccccugaucagccccaagccccagcugcacgccgcccccaccgcccuguggaaccccgugagccugauggacaacacccuggagaccagaagagccgagagccacagccugcacagccaccccgccgccuucgagcccagcagacaggccgccgugccccuggugaagguggagagaguguucugccccgagaaggccgaggagggccccagaaagagagagcccgccccccuggacaaguaccagccccccccccccccccccagagagggcggcagccuggagcaccagcccuuccugcccggccccggccccuuccuggccgagcuggagaagagcacccagaccauccugggccagcagagagccagccugccccaggccgccaccuucggcgagcugagcggcccccugaagcccggcagccccuacagaccccccgugcccagagcccccgaccccgccuacaucuacgacgaguuccugcagcagagaagaagacuggugagcaagcuggaccuggaggagagaagaagaagagaggcccaggagaagggcuacuacuacgaccuggacgacagcuacgacgagagcgacgaggaggaggugagagcccaccugagaugcguggccgagcagcccccccugaagcuggacaccagcagcgagaagcuggaguuccugcagcuguucggccugaccacccagcagcagaaggaggagcugguggcccagaagagaagaaagagaagaagaaugcugagagagagaagccccagcccccccaccauccagagcaagagacagacccccagccccagacuggcccugagcaccagauacagccccgacgagaugaacaacagccccaacuucgaggagaagaagaaguuccugaccaucuucaaccugacccacaucagcgccgagaagagaaaggacaaggagagacugguggagaugcugagagccaugaagcagaaggcccugagcgccgccguggccgacagccugaccaacagccccagagacagccccgccgugagccugagcgagcccgccacccagcaggccagccuggacguggagaagcccgugggcguggccgccagccugagcgacauccccaaggccgccgagcccggcaagcuggagcaggugagaccccaggagcugagcagagugcaggagcuggcccccgccagcggcgagaaggccagacugagcgaggcccccggcggcaagaagagccugagcaugcugcacuacaucagaggcgccgcccccaaggacauccccgugccccugagccacagcaccaacggcaagagcaagcccugggagcccuucguggccgaggaguucgcccaccaguuccacgagagcgugcugcagagcacccagaaggcccugcagaagcacaagggcagcguggccgugcugagcgccgagcagaaccacaagguggacaccagcgugcacuacaacauccccgagcugcagagcagcagcagagccccccccccccagcacaacggccagcaggagccccccaccgccagaaagggcccccccacccaggagcuggacagagacagcgaggaggaggaggaggaggacgacgaggacggcgaggacgaggaggaggugcccaagagaaaguggcagggcaucgaggccguguucgaggccuaccaggagcacaucgaggagcagaaccuggagagacaggugcugcagacccagugcagaagacuggaggccagacacuacagccugagccugaccgccgagcagcugagccacagcguggccgagcugagaagccagaagcagaagauggugagcgagagagagagacugcaggccgagcuggaccaccugagaaagugccuggcccugcccgccaugcacuggcccagaggcuaccugaagggcuaccccagauaa

SEQ ID NO: 17817 - RNA, 996 nt, Artificial Sequence
  GSG1L__Homo_sapiens__NP_001103233
augaagaccagcagaagaggcagagcccugcuggccguggcccugaaccugcuggcccugcuguucgccaccaccgccuuccugaccacccacuggugccagggcacccagagagugcccaagcccggcugcggccagggcggcagagccaacugccccaacagcggcgccaacgccaccgccaacggcaccgccgcccccgccgccgccgccgccgccgccaccgccagcggcaacggcccccccggcggcgcccuguacagcugggagaccggcgacgacagauuccuguucagaaacuuccacaccggcaucugguacagcugcgaggaggagcugagcggccugggcgagaagugcagaagcuucaucgaccuggcccccgccagcgagaagggcgugcuguggcugagcguggugagcgaggugcuguacauccugcugcugguggugggcuucagccugaugugccuggagcuguuccacagcagcaacgugaucgacggccugaagcugaacgccuucgccgccguguucaccgugcugagcggccugcugggcaugguggcccacaugauguacacccagguguuccaggugaccgugagccugggccccgaggacuggagaccccacagcugggacuacggcuggagcuucugccuggccuggggcagcuucaccugcugcauggccgccagcgugaccacccugaacagcuacaccaagaccgugaucgaguucagacacaagagaaagguguucgagcagggcuacagagaggagcccaccuucaucgaccccgaggccaucaaguacuucagagagagaauggagaagagagacggcagcgaggaggacuuccaccuggacugcagacacgagagauaccccgccagacaccagccccacauggccgacagcuggcccagaagcagcgcccaggaggcccccgagcugaacagacagugcugggugcugggccacuggguguaa

SEQ ID NO: 17818 - RNA, 1452 nt, Artificial Sequence
  GSK3A__Homo_sapiens__NP_063937
augagcggcggcggccccagcggcggcggccccggcggcagcggcagagccagaaccagcagcuucgccgagcccggcggcggcggcggcggcggcggcggcggccccggcggcagcgccagcggccccggcggcaccggcggcggcaaggccagcgugggcgccaugggcggcggcgugggcgccagcagcagcggcggcggccccggcggcagcggcggcggcggcagcggcggccccggcgccggcaccagcuuccccccccccggcgugaagcugggcagagacagcggcaaggugaccaccgugguggccacccugggccagggccccgagagaagccaggagguggccuacaccgacaucaaggugaucggcaacggcagcuucggcgugguguaccaggccagacuggccgagaccagagagcugguggccaucaagaaggugcugcaggacaagagauucaagaacagagagcugcagaucaugagaaagcuggaccacugcaacaucgugagacugagauacuucuucuacagcagcggcgagaagaaggacgagcuguaccugaaccuggugcuggaguacgugcccgagaccguguacagaguggccagacacuucaccaaggccaagcugaccauccccauccuguacgugaagguguacauguaccagcuguucagaagccuggccuacauccacagccagggcgugugccacagagacaucaagccccagaaccugcugguggaccccgacaccgccgugcugaagcugugcgacuucggcagcgccaagcagcuggugagaggcgagcccaacgugagcuacaucugcagcagauacuacagagcccccgagcugaucuucggcgccaccgacuacaccagcagcaucgacguguggagcgccggcugcgugcuggccgagcugcugcugggccagcccaucuuccccggcgacagcggcguggaccagcugguggagaucaucaaggugcugggcacccccaccagagagcagaucagagagaugaaccccaacuacaccgaguucaaguucccccagaucaaggcccaccccuggaccaagguguucaagagcagaaccccccccgaggccaucgcccugugcagcagccugcuggaguacacccccagcagcagacugagcccccuggaggccugcgcccacagcuucuucgacgagcugagaugccugggcacccagcugcccaacaacagaccccugcccccccuguucaacuucagcgccggcgagcugagcauccagcccagccugaacgccauccugauccccccccaccugagaagccccgccggcaccaccacccugacccccagcagccaggcccugaccgagacccccaccagcagcgacuggcagagcaccgacgccacccccacccugaccaacagcagcuaa

SEQ ID NO: 17819 - RNA, 1263 nt, Artificial Sequence
  GSK3B__Homo_sapiens__NP_001139628
augagcggcagacccagaaccaccagcuucgccgagagcugcaagcccgugcagcagcccagcgccuucggcagcaugaaggugagcagagacaaggacggcagcaaggugaccaccgugguggccacccccggccagggccccgacagaccccaggaggugagcuacaccgacaccaaggugaucggcaacggcagcuucggcgugguguaccaggccaagcugugcgacagcggcgagcugguggccaucaagaaggugcugcaggacaagagauucaagaacagagagcugcagaucaugagaaagcuggaccacugcaacaucgugagacugagauacuucuucuacagcagcggcgagaagaaggacgagguguaccugaaccuggugcuggacuacgugcccgagaccguguacagaguggccagacacuacagcagagccaagcagacccugcccgugaucuacgugaagcuguacauguaccagcuguucagaagccuggccuacauccacagcuucggcaucugccacagagacaucaagccccagaaccugcugcuggaccccgacaccgccgugcugaagcugugcgacuucggcagcgccaagcagcuggugagaggcgagcccaacgugagcuacaucugcagcagauacuacagagcccccgagcugaucuucggcgccaccgacuacaccagcagcaucgacguguggagcgccggcugcgugcuggccgagcugcugcugggccagcccaucuuccccggcgacagcggcguggaccagcugguggagaucaucaaggugcugggcacccccaccagagagcagaucagagagaugaaccccaacuacaccgaguucaaguucccccagaucaaggcccaccccuggaccaagguguucagacccagaaccccccccgaggccaucgcccugugcagcagacugcuggaguacacccccaccgccagacugaccccccuggaggccugcgcccacagcuucuucgacgagcugagagaccccaacgugaagcugcccaacggcagagacacccccgcccuguucaacuucaccacccaggagcugagcagcaaccccccccuggccaccauccugauccccccccacgccagaauccaggccgccgccagcacccccaccaacgccaccgccgccagcgacgccaacaccggcgacagaggccagaccaacaacgccgccagcgccagcgccagcaacagcaccuaa

SEQ ID NO: 17820 - RNA, 2349 nt, Artificial Sequence
  GSN__Homo_sapiens__NP_000168
auggccccccacagacccgcccccgcccugcugugcgcccugagccuggcccugugcgcccugagccugcccgugagagccgccaccgccagcagaggcgccagccaggccggcgccccccagggcagagugcccgaggccagacccaacagcauggugguggagcaccccgaguuccugaaggccggcaaggagcccggccugcagaucuggagaguggagaaguucgaccuggugcccgugcccaccaaccuguacggcgacuucuucaccggcgacgccuacgugauccugaagaccgugcagcugagaaacggcaaccugcaguacgaccugcacuacuggcugggcaacgagugcagccaggacgagagcggcgccgccgccaucuucaccgugcagcuggacgacuaccugaacggcagagccgugcagcacagagaggugcagggcuucgagagcgccaccuuccugggcuacuucaagagcggccugaaguacaagaagggcggcguggccagcggcuucaagcacguggugcccaacgaggugguggugcagagacuguuccaggugaagggcagaagaguggugagagccaccgaggugcccgugagcugggagagcuucaacaacggcgacugcuucauccuggaccugggcaacaacauccaccaguggugcggcagcaacagcaacagauacgagagacugaaggccacccaggugagcaagggcaucagagacaacgagagaagcggcagagccagagugcacgugagcgaggagggcaccgagcccgaggccaugcugcaggugcugggccccaagcccgcccugcccgccggcaccgaggacaccgccaaggaggacgccgccaacagaaagcuggccaagcuguacaaggugagcaacggcgccggcaccaugagcgugagccugguggccgacgagaaccccuucgcccagggcgcccugaagagcgaggacugcuucauccuggaccacggcaaggacggcaagaucuucguguggaagggcaagcaggccaacaccgaggagagaaaggccgcccugaagaccgccagcgacuucaucaccaagauggacuaccccaagcagacccaggugagcgugcugcccgagggcggcgagaccccccuguucaagcaguucuucaagaacuggagagaccccgaccagaccgacggccugggccugagcuaccugagcagccacaucgccaacguggagagagugcccuucgacgccgccacccugcacaccagcaccgccauggccgcccagcacggcauggacgacgacggcaccggccagaagcagaucuggagaaucgagggcagcaacaaggugcccguggaccccgccaccuacggccaguucuacggcggcgacagcuacaucauccuguacaacuacagacacggcggcagacagggccagaucaucuacaacuggcagggcgcccagagcacccaggacgagguggccgccagcgccauccugaccgcccagcuggacgaggagcugggcggcacccccgugcagagcagaguggugcagggcaaggagcccgcccaccugaugagccuguucggcggcaagcccaugaucaucuacaagggcggcaccagcagagagggcggccagaccgcccccgccagcaccagacuguuccaggugagagccaacagcgccggcgccaccagagccguggaggugcugcccaaggccggcgcccugaacagcaacgacgccuucgugcugaagacccccagcgccgccuaccugugggugggcaccggcgccagcgaggccgagaagaccggcgcccaggagcugcugagagugcugagagcccagcccgugcagguggccgagggcagcgagcccgacggcuucugggaggcccugggcggcaaggccgccuacagaaccagccccagacugaaggacaagaagauggacgcccacccccccagacuguucgccugcagcaacaagaucggcagauucgugaucgaggaggugcccggcgagcugaugcaggaggaccuggccaccgacgacgugaugcugcuggacaccugggaccagguguucgugugggugggcaaggacagccaggaggaggagaagaccgaggcccugaccagcgccaagagauacaucgagaccgaccccgccaacagagacagaagaacccccaucaccguggugaagcagggcuucgagccccccagcuucgugggcugguuccugggcugggacgacgacuacuggagcguggacccccuggacagagccauggccgagcuggccgccuaa

SEQ ID NO: 17821 - RNA, 1911 nt, Artificial Sequence
  GSPT1__Homo_sapiens__NP_001123478
auggaccccggcagcggcggcggcggcggcggcggcggcggcggcggcagcagcagcggcagcagcagcagcgacagcgcccccgacugcugggaccaggccgacauggaggcccccggccccggccccugcggcggcggcggcagccuggccgccgccgccgaggcccagagagagaaccugagcgccgccuucagcagacagcugaacgugaacgccaagcccuucgugcccaacgugcacgccgccgaguucgugcccagcuuccugagaggccccgccgccccccccccccccgccggcggcgccgccaacaaccacggcgccggcagcggcgccggcggcagagccgcccccguggagagcagccaggaggagcagagccugugcgagggcagcaacagcgccgugagcauggagcugagcgagcccaucgagaacggcgagaccgagaugagccccgaggagagcugggagcacaaggaggagaucagcgaggccgagcccggcggcggcagccugggcgacggcagaccccccgaggagagcgcccacgagaugauggaggaggaggaggagauccccaagcccaagagcgugguggccccccccggcgcccccaagaaggagcacgugaacgugguguucaucggccacguggacgccggcaagagcaccaucggcggccagaucauguaccugaccggcaugguggacaagagaacccuggagaaguacgagagagaggccaaggagaagaacagagagaccugguaccugagcugggcccuggacaccaaccaggaggagagagacaagggcaagaccguggaggugggcagagccuacuucgagaccgagaagaagcacuucaccauccuggacgcccccggccacaagagcuucgugcccaacaugaucggcggcgccagccaggccgaccuggccgugcuggugaucagcgccagaaagggcgaguucgagaccggcuucgagaagggcggccagaccagagagcacgccaugcuggccaagaccgccggcgugaagcaccugaucgugcugaucaacaagauggacgaccccaccgugaacuggagcaacgagagauacgaggagugcaaggagaagcuggugcccuuccugaagaaggugggcuucaaccccaagaaggacauccacuucaugcccugcagcggccugaccggcgccaaccugaaggagcagagcgacuucugccccugguacaucggccugcccuucauccccuaccuggacaaccugcccaacuucaacagaagcguggacggccccaucagacugcccaucguggacaaguacaaggacaugggcaccguggugcugggcaagcuggagagcggcagcaucugcaagggccagcagcuggugaugaugcccaacaagcacaacguggaggugcugggcauccugagcgacgacguggagaccgacaccguggcccccggcgagaaccugaagaucagacugaagggcaucgaggaggaggagauccugcccggcuucauccugugcgaccccaacaaccugugccacagcggcagaaccuucgacgcccagaucgugaucaucgagcacaagagcaucaucugccccggcuacaacgccgugcugcacauccacaccugcaucgaggagguggagaucaccgcccugaucugccugguggacaagaagagcggcgagaagagcaagaccagacccagauucgugaagcaggaccaggugugcaucgccagacugagaaccgccggcaccaucugccuggagaccuucaaggacuucccccagaugggcagauucacccugagagacgagggcaagaccaucgccaucggcaaggugcugaagcuggugcccgagaaggacuaa

SEQ ID NO: 17822 - RNA, 1887 nt, Artificial Sequence
  GSPT2__Homo_sapiens__NP_060564
auggacagcggcagcagcagcagcgacagcgcccccgacugcugggaccagguggacauggagagccccggcagcgcccccagcggcgacggcgugagcagcgccguggccgaggcccagagagagccccugagcagcgccuucagcagaaagcugaacgugaacgccaagcccuucgugcccaacgugcacgccgccgaguucgugcccagcuuccugagaggccccacccagccccccacccugcccgccggcagcggcagcaacgacgagaccugcaccggcgccggcuacccccagggcaagagaaugggcagaggcgcccccguggagcccagcagagaggagccccuggugagccuggagggcagcaacagcgccgugaccauggagcugagcgagcccgugguggagaacggcgagguggagauggcccuggaggagagcugggagcacagcaaggaggugagcgaggccgagcccggcggcggcagcagcggcgacagcggcccccccgaggagagcggccaggagaugauggaggagaaggaggagaucagaaagagcaagagcgugaucgugcccagcggcgcccccaagaaggagcacgugaacgugguguucaucggccacguggacgccggcaagagcaccaucggcggccagaucauguuccugaccggcaugguggacaagagaacccuggagaaguacgagagagaggccaaggagaagaacagagagaccugguaccugagcugggcccuggacaccaaccaggaggagagagacaagggcaagaccguggaggugggcagagccuacuucgagaccgagagaaagcacuucaccauccuggacgcccccggccacaagagcuucgugcccaacaugaucggcggcgccagccaggccgaccuggccgugcuggugaucagcgccagaaagggcgaguucgagaccggcuucgagaagggcggccagaccagagagcacgccaugcuggccaagaccgccggcgugaagcaccugaucgugcugaucaacaagauggacgaccccaccgugaacuggagcaucgagagauacgaggagugcaaggagaagcuggugcccuuccugaagaaggugggcuucagccccaagaaggacauccacuucaugcccugcagcggccugaccggcgccaacaucaaggagcagagcgacuucugccccugguacaccggccugcccuucauccccuaccuggacaaccugcccaacuucaacagaagcaucgacggccccaucagacugcccaucguggacaaguacaaggacaugggcaccguggugcugggcaagcuggagagcggcagcaucuucaagggccagcagcuggugaugaugcccaacaagcacaacguggaggugcugggcauccugagcgacgacaccgagaccgacuucguggcccccggcgagaaccugaagaucagacugaagggcaucgaggaggaggagauccugcccggcuucauccugugcgaccccagcaaccugugccacagcggcagaaccuucgacgugcagaucgugaucaucgagcacaagagcaucaucugccccggcuacaacgccgugcugcacauccacaccugcaucgaggagguggagaucaccgcccugaucagccugguggacaagaagagcggcgagaagagcaagaccagacccagauucgugaagcaggaccaggugugcaucgccagacugagaaccgccggcaccaucugccuggagaccuucaaggacuucccccagaugggcagauucacccugagagacgagggcaagaccaucgccaucggcaaggugcugaagcuggugcccgagaaggacuaa

SEQ ID NO: 17823 - RNA, 1569 nt, Artificial Sequence
  GSR__Homo_sapiens__NP_000628
auggcccugcugcccagagcccugagcgccggcgccggccccagcuggagaagagccgccagagccuucagaggcuuccugcugcugcugcccgagcccgccgcccugaccagagcccugagcagagccauggccugcagacaggagccccagccccagggccccccccccgccgccggcgccguggccagcuacgacuaccuggugaucggcggcggcagcggcggccuggccagcgccagaagagccgccgagcugggcgccagagccgccgugguggagagccacaagcugggcggcaccugcgugaacgugggcugcgugcccaagaaggugauguggaacaccgccgugcacagcgaguucaugcacgaccacgccgacuacggcuuccccagcugcgagggcaaguucaacuggagagugaucaaggagaagagagacgccuacgugagcagacugaacgccaucuaccagaacaaccugaccaagagccacaucgagaucaucagaggccacgccgccuucaccagcgaccccaagcccaccaucgaggugagcggcaagaaguacaccgccccccacauccugaucgccaccggcggcaugcccagcaccccccacgagagccagauccccggcgccagccugggcaucaccagcgacggcuucuuccagcuggaggagcugcccggcagaagcgugaucgugggcgccggcuacaucgccguggagauggccggcauccugagcgcccugggcagcaagaccagccugaugaucagacacgacaaggugcugagaagcuucgacagcaugaucagcaccaacugcaccgaggagcuggagaacgccggcguggaggugcugaaguucagccaggugaaggaggugaagaagacccugagcggccuggaggugagcauggugaccgccgugcccggcagacugcccgugaugaccaugauccccgacguggacugccugcugugggccaucggcagagugcccaacaccaaggaccugagccugaacaagcugggcauccagaccgacgacaagggccacaucaucguggacgaguuccagaacaccaacgugaagggcaucuacgccgugggcgacgugugcggcaaggcccugcugacccccguggccaucgccgccggcagaaagcuggcccacagacuguucgaguacaaggaggacagcaagcuggacuacaacaacauccccaccgugguguucagccacccccccaucggcaccgugggccugaccgaggacgaggccauccacaaguacggcaucgagaacgugaagaccuacagcaccagcuucacccccauguaccacgccgugaccaagagaaagaccaagugcgugaugaagauggugugcgccaacaaggaggagaagguggugggcauccacaugcagggccugggcugcgacgagaugcugcagggcuucgccguggccgugaagaugggcgccaccaaggccgacuucgacaacaccguggccauccaccccaccagcagcgaggagcuggugacccugagauaa

SEQ ID NO: 17824 - RNA, 1425 nt, Artificial Sequence
  GSS__Homo_sapiens__XP_011527098
auggccaccaacuggggcagccugcugcaggacaagcagcagcuggaggagcuggccagacaggccguggacagagcccuggccgagggcgugcugcugagaaccagccaggagcccaccagcagcgagguggugagcuacgcccccuucacccuguuccccagccuggugcccagcgcccugcuggagcaggccuacgccgugcagauggacuucaaccugcugguggacgccgugagccagaacgccgccuuccuggagcagacccugagcagcaccaucaagcaggacgacuucaccgccagacuguucgacauccacaagcaggugcugaaggagggcaucgcccagaccguguuccugggccugaacagaagcgacuacauguuccagagaagcgccgacggcagccccgcccugaagcagaucgagaucaacaccaucagcgccagcuucggcggccuggccagcagaacccccgccgugcacagacacgugcugagcgugcugagcaagaccaaggaggccggcaagauccugagcaacaaccccagcaagggccuggcccugggcaucgccaaggccugggagcuguacggcagccccaacgcccuggugcugcugaucgcccaggagaaggagagaaacaucuucgaccagagagccaucgagaacgagcugcuggccagaaacauccacgugaucagaagaaccuucgaggacaucagcgagaagggcagccuggaccaggacagaagacuguucguggacggccaggagaucgccgugguguacuucagagacggcuacaugcccagacaguacagccugcagaacugggaggccagacugcugcuggagagaagccacgccgccaagugccccgacaucgccacccagcuggccggcaccaagaaggugcagcaggagcugagcagacccggcaugcuggagaugcugcugcccggccagcccgaggccguggccagacugagagccaccuucgccggccuguacagccuggacgugggcgaggagggcgaccaggccaucgccgaggcccuggccgcccccagcagauucgugcugaagccccagagagagggcggcggcaacaaccuguacggcgaggagauggugcaggcccugaagcagcugaaggacagcgaggagagagccagcuacauccugauggagaagaucgagcccgagcccuucgagaacugccugcugagacccggcagccccgccagaguggugcagugcaucagcgagcugggcaucuucggcguguacgugagacaggagaagacccuggugaugaacaagcacgugggccaccugcugagaaccaaggccaucgagcacgccgacggcggcguggccgccggcguggccgugcuggacaaccccuaccccguguaa

SEQ ID NO: 17825 - RNA, 669 nt, Artificial Sequence
  GSTA1__Homo_sapiens__NP_665683
auggccgagaagcccaagcugcacuacuucaacgccagaggcagaauggagagcaccagauggcugcuggccgccgccggcguggaguucgaggagaaguucaucaagagcgccgaggaccuggacaagcugagaaacgacggcuaccugauguuccagcaggugcccaugguggagaucgacggcaugaagcuggugcagaccagagccauccugaacuacaucgccagcaaguacaaccuguacggcaaggacaucaaggagagagcccugaucgacauguacaucgagggcaucgccgaccugggcgagaugauccugcugcugcccgugugcccccccgaggagaaggacgccaagcuggcccugaucaaggagaagaucaagaacagauacuuccccgccuucgagaaggugcugaagagccacggccaggacuaccuggugggcaacaagcugagcagagccgacauccaccugguggagcugcuguacuacguggaggagcuggacagcagccugaucagcagcuucccccugcugaaggcccugaagaccagaaucagcaaccugcccaccgugaagaaguuccugcagcccggcagccccagaaagccccccauggacgagaagagccuggaggaggccagaaagaucuucagauucuaa

SEQ ID NO: 17826 - RNA, 669 nt, Artificial Sequence
  GSTA2__Homo_sapiens__XP_011512834
auggccgagaagcccaagcugcacuacagcaacaucagaggcagaauggagagcaucagauggcugcuggccgccgccggcguggaguucgaggagaaguucaucaagagcgccgaggaccuggacaagcugagaaacgacggcuaccugauguuccagcaggugcccaugguggagaucgacggcaugaagcuggugcagaccagagccauccugaacuacaucgccagcaaguacaaccuguacggcaaggacaucaaggagaaggcccugaucgacauguacaucgagggcaucgccgaccugggcgagaugauccugcugcugcccuucagccagcccgaggagcaggacgccaagcuggcccugauccaggagaagaccaagaacagauacuuccccgccuucgagaaggugcugaagagccacggccaggacuaccuggugggcaacaagcugagcagagccgacauccaccugguggagcugcuguacuacguggaggagcuggacagcagccugaucagcagcuucccccugcugaaggcccugaagaccagaaucagcaaccugcccaccgugaagaaguuccugcagcccggcagccccagaaagccccccauggacgagaagagccuggaggagagcagaaagaucuucagauucuaa

SEQ ID NO: 17827 - RNA, 669 nt, Artificial Sequence
  GSTA4__Homo_sapiens__XP_005249092
auggccgccagacccaagcugcacuaccccaacggcagaggcagaauggagagcgugagaugggugcuggccgccgccggcguggaguucgacgaggaguuccuggagaccaaggagcagcuguacaagcugcaggacggcaaccaccugcuguuccagcaggugcccaugguggagaucgacggcaugaagcuggugcagaccagaagcauccugcacuacaucgccgacaagcacaaccuguucggcaagaaccugaaggagagaacccugaucgacauguacguggagggcacccuggaccugcuggagcugcugaucaugcaccccuuccugaagcccgacgaccagcagaaggagguggugaacauggcccagaaggccaucaucagauacuuccccguguucgagaagauccugagaggccacggccagagcuuccuggugggcaaccagcugagccuggccgacgugauccugcugcagaccauccuggcccuggaggagaagauccccaacauccugagcgccuuccccuuccugcaggaguacaccgugaagcugagcaacauccccaccaucaagagauuccuggagcccggcagcaagaagaagcccccccccgacgagaucuacgugagaaccguguacaacaucuucagacccuaa

SEQ ID NO: 17828 - RNA, 669 nt, Artificial Sequence
  GSTA5__Homo_sapiens__NP_714543
auggccgagaagcccaagcugcacuacagcaacgccagaggcagcauggagagcaucagauggcugcuggccgccgccggcguggagcuggaggagaaguuccuggagagcgccgaggaccuggacaagcugagaaacgacggcagccugcuguuccagcaggugcccaugguggagaucgacggcaugaagcuggugcagaccagagccauccugaacuacaucgccagcaaguacaaccuguacggcaaggacaugaaggagagagcccugaucgacauguacaccgagggcaucguggaccugaccgagaugauccugcugcugcugaucugccagcccgaggagagagacgccaagaccgcccuggugaaggagaagaucaagaacagauacuuccccgccuucgagaaggugcugaagagccacagacaggacuaccuggugggcaacaagcugagcugggccgacauccaccugguggagcuguucuacuacguggaggagcuggacagcagccugaucagcagcuucccccugcugaaggcccugaagaccagaaucagcaaccugcccaccgugaagaaguuccugcagcccggcagccagagaaagccccccauggacgagaagagccuggaggaggccagaaagaucuucagauucuaa

SEQ ID NO: 17829 - RNA, 1902 nt, Artificial Sequence
  GSTCD__Homo_sapiens__NP_001026890
augaaggccaucaagaagagccugaccgaggaggaguaccuguaccuggacuucagccaccagaccgagggcugcaucuucccccugcacaccagcgugacccuguuccugcugagcuacugcgacugcaagaucuucaagaucugccugguggugaccaaggaggugagcagagacagcagccugcugagagacgaccugauccaggacguggagauccagaucaucagcagacaggagcugccccccaucgugcagaacugcugccugcccgccgugguggagagaagcgacaacuucugcagagccggccuggccguggugcugagacacaucauccagaagagcuacgaggccgacccccugaagaaggagcugcuggagcugcugggcuucaagaagaccugccugaaggccugcgccgaggugagccaguggaccagacugugcgagcugaccaucccccuggccaucgagaacuuccugagagagagcagcgaccagccccccaccauccccguggagauccugcagcuggagaagaagcugagcgagcccgugagagugcacaacgacgacaagcugagaagacagaagcugaagcagcagaaggccgacggcgugggccccccccugaccaagggcaaggccaagagcaaggugcacacccaggagaccagcgagggccuggacagcagcagcaagagccuggagcugaagguggccuucagcaagcugaccgugcaggaggagcccgccaccaccaacagagagcccagccacaucagaaaggccaaggccagcgaccugcccccccuggagcacguguucgccgagggccuguacuucacccuggccgacaucgugcugcugcccugcauccaccacuuccuggugaucaucagcagaaaguucagcgagaagcugguggaguucccccugcuggccagcugguaccagagaauccaggaggugcccggcgugaagaccgccgccagcaagugcggcauccaguuccugcaccugcccaagcugcugaccaccagcaccgagcagcaccccaaccugugcgaggugcccggcguggaggagcagagcgacccccuguucaucggcggccccagacccaccauggccaagcugauggagaagggcaucgaggugauguucagcccccaccccugccccaccuggacccuggacuggaacgugcugcccgccgccgugagccccaaggagggcaagaugagcagcgacagagcccugagaaagcagcagcagcugaacaaccugguguacguggugaccaaccaggccaagcccggcgacagaaucguggacuucugcagcggcggcggccacgugggcaucgugcuggcccacaugcugcccagcugccaggugacccugaucgagaacaaggagcugagccugaucagagccaagaagagaagcgacgagcugggccugagcaacaucugguucauccaggccaacauggaguacuucaccggcauguucaacaucggcguggcccugcacgccugcggcguggccaccgacauggugaucgagcacugcaucaagaccagagccagcuucgugaccugccccugcugcuacggcuucauccagaacaccagcaaguucaacuuccccaagagcgagcaguucaagaagacccugagcuacaaggagcacaugauccugugcagauucgccgaccagaccgccgugcagcugcccccccagagaagacugaucggcaagcagugcaugugccugguggaccuggacagagccagagccgccgaggagugcggcuacagcgugcaggugaucagcauggagcccgagagcugcagccccaagaacaacaugaucgugggcgugcccaucuaa

SEQ ID NO: 17830 - RNA, 849 nt, Artificial Sequence
  GSTK1__Homo_sapiens__NP_001137151
augggcccccugcccagaaccguggagcuguucuacgacgugcugagccccuacagcuggcugggcuucgagauccugugcagauaccagaacaucuggaacaucaaccugcagcugagacccagccugaucaccggcaucaugaaggacagcggcaacaagccccccggccugcugcccagaaagggccuguacauggccaacgaccugaagcugcugagacaccaccugcagauccccauccacuuccccaaggacuuccugagcgugaugcuggagaagggcagccugagcgccaugagauuccugaccgccgugaaccuggagcaccccgagaugcuggagaaggccagcagagagcuguggaugagaguguggagcagagugagcgugggccugugggagagcagcggcagaacccuggacgacuuccugaccuuccccagacacguguucagagugaugauccugcccccccccggcggcagcaccgugcugcccgugaccccccugagcccccacagacugcccgccguguucagcagcagccagaacgaggacaucaccgagccccagagcauccuggccgccgccgagaaggccggcaugagcgccgagcaggcccagggccugcuggagaagaucgccacccccaaggugaagaaccagcugaaggagaccaccgaggccgccugcagauacggcgccuucggccugcccaucaccguggcccacguggacggccagacccacaugcuguucggcagcgacagaauggagcugcuggcccaccugcugggcgagaaguggaugggccccaucccccccgccgugaacgccagacuguaa

SEQ ID NO: 17831 - RNA, 897 nt, Artificial Sequence
  GSTM3__Homo_sapiens__XP_011539598
augaacgagguguggcugccccccgccggcaagggcggcgccagcaccagcggcccccugcugagcugcagcacccccgccagagugccccccagaggcagacaggcccugaaccccaacgccggcaucagcagagccugcgccagacccugcggcgccgccgaggccagagacggcgagagaggcggcggcggcgugagagcccccgccagaggccccagaccccugaugagcggcaucaagccccugccccugaccgugagccuggugcuggagggcagcgaggccagacaccacguggugagagugguguacggcagcagagugcugggcuacagcugggcccccgacuacgacagaagccaguggcuggacgugaaguucaagcuggaccuggacuuccccaaccugcccuaccugcuggacggcaagaacaagaucacccagagcaacgccauccugagauacaucgccagaaagcacaacaugugcggcgagaccgaggaggagaagaucagaguggacaucaucgagaaccaggugauggacuucagaacccagcugaucagacugugcuacagcagcgaccacgagaagcugaagccccaguaccuggaggagcugcccggccagcugaagcaguucagcauguuccugggcaaguucagcugguucgccggcgagaagcugaccuucguggacuuccugaccuacgacauccuggaccagaacagaaucuucgaccccaagugccuggacgaguuccccaaccugaaggccuucaugugcagauucgaggcccuggagaagaucgccgccuaccugcagagcgaccaguucugcaagaugcccaucaacaacaagauggcccaguggggcaacaagcccgugugcuaa

SEQ ID NO: 17832 - RNA, 627 nt, Artificial Sequence
  GSTO1__Homo_sapiens__NP_001177931
augagcggcgagagcgccagaagccugggcaagggcagcgccccccccggccccgugcccgagggcagcaucagaaucuacagcaugagauucugccccuucgccgagagaaccagacuggugcugaaggccaagggcaucagacacgaggugaucaacaucaaccugaagaacaagcccgagugguucuucaagaagaaccccuucggccuggugcccgugcuggagaacagccagggccagcugaucuacgagagcgccaucaccugcgaguaccuggacgaggccuaccccggcaagaagcugcugcccgacgaccccuacgagaaggccugccagaagaugauccuggagcuguucagcaaggugcugaccaacaagaagaccaccuucuucggcggcaacagcaucagcaugaucgacuaccugaucuggcccugguucgagagacuggaggccaugaagcugaacgagugcguggaccacacccccaagcugaagcuguggauggccgccaugaaggaggaccccaccgugagcgcccugcugaccagcgagaaggacuggcagggcuuccuggagcuguaccugcagaacagccccgaggccugcgacuacggccuguaa

SEQ ID NO: 17833 - RNA, 630 nt, Artificial Sequence
  GSTO2__Homo_sapiens__NP_001177942
augagcggcgacgccaccagaacccugggcaagggcagccagccccccggccccgugcccgagggccugaucagaaucuacagcaugagauucugccccuacagccacagaaccagacuggugcugaaggccaaggacaucagacacgagguggugaacaucaaccugagaaacaagcccgagugguacuacaccaagcaccccuucggccacauccccgugcuggagaccagccagugccagcugaucuacgagagcgugaucgccugcgaguaccuggacgacgccuaccccggcagaaagcuguuccccuacgaccccuacgagagagccagacagaagaugcugcuggagcuguucugcaagauccuggaguaccagaacaccaccuucuucggcggcaccugcaucagcaugaucgacuaccugcuguggcccugguucgagagacuggacguguacggcauccuggacugcgugagccacacccccgcccugagacuguggaucagcgccaugaagugggaccccaccgugugcgcccugcugauggacaagagcaucuuccagggcuuccugaaccuguacuuccagaacaaccccaacgccuucgacuucggccugugcuaa

SEQ ID NO: 17834 - RNA, 633 nt, Artificial Sequence
  GSTP1__Homo_sapiens__NP_000843
augccccccuacaccgugguguacuuccccgugagaggcagaugcgccgcccugagaaugcugcuggccgaccagggccagagcuggaaggaggagguggugaccguggagaccuggcaggagggcagccugaaggccagcugccuguacggccagcugcccaaguuccaggacggcgaccugacccuguaccagagcaacaccauccugagacaccugggcagaacccugggccuguacggcaaggaccagcaggaggccgcccugguggacauggugaacgacggcguggaggaccugagaugcaaguacaucagccugaucuacaccaacuacgaggccggcaaggacgacuacgugaaggcccugcccggccagcugaagcccuucgagacccugcugagccagaaccagggcggcaagaccuucaucgugggcgaccagaucagcuucgccgacuacaaccugcuggaccugcugcugauccacgaggugcuggcccccggcugccuggacgccuucccccugcugagcgccuacgugggcagacugagcgccagacccaagcugaaggccuuccuggccagccccgaguacgugaaccugcccaucaacggcaacggcaagcaguaa

SEQ ID NO: 17835 - RNA, 723 nt, Artificial Sequence
  GSTT1__Homo_sapiens__NP_000844
augggccuggagcuguaccuggaccugcugagccagcccugcagagccguguacaucuucgccaagaagaacgacauccccuucgagcugagaaucguggaccugaucaagggccagcaccugagcgacgccuucgcccaggugaacccccugaagaaggugcccgcccugaaggacggcgacuucacccugaccgagagcguggccauccugcuguaccugaccagaaaguacaaggugcccgacuacugguacccccaggaccugcaggccagagccagaguggacgaguaccuggccuggcagcacaccacccugagaagaagcugccugagagcccuguggcacaaggugauguuccccguguuccugggcgagcccgugagcccccagacccuggccgccacccuggccgagcuggacgugacccugcagcugcuggaggacaaguuccugcagaacaaggccuuccugaccggcccccacaucagccuggccgaccugguggccaucaccgagcugaugcaccccgugggcgccggcugccagguguucgagggcagacccaagcuggccaccuggagacagagaguggaggccgccgugggcgaggaccuguuccaggaggcccacgaggugauccugaaggccaaggacuucccccccgccgaccccaccaucaagcagaagcugaugcccugggugcuggccaugaucagauaa

SEQ ID NO: 17836 - RNA, 735 nt, Artificial Sequence
  GSTT2B__Homo_sapiens__NP_001074312
augggccuggagcuguuccuggaccuggugagccagcccagcagagccguguacaucuucgccaagaagaacggcaucccccuggagcugagaaccguggaccuggugaagggccagcacaagagcaaggaguuccugcagaucaacagccugggcaagcugcccacccugaaggacggcgacuucauccugaccgagagcagcgccauccugaucuaccugagcugcaaguaccagacccccgaccacugguaccccagcgaccugcaggccagagccagagugcacgaguaccugggcuggcacgccgacugcaucagaggcaccuucggcaucccccugugggugcaggugcugggcccccugaucggcgugcaggugcccgaggagaagguggagagaaacagaaccgccauggaccaggcccugcaguggcuggaggacaaguuccugggcgacagacccuuccuggccggccagcaggugacccuggccgaccugauggcccuggaggagcugaugcagcccguggcccugggcuacgagcuguucgagggcagacccagacuggccgccuggagaggcagaguggaggccuuccugggcgccgagcugugccaggaggcccacagcaucauccugagcauccuggagcaggccgccaagaagacccugcccacccccagccccgaggccuaccaggccaugcugcugagaaucgccagaauccccuaa

SEQ ID NO: 17837 - RNA, 735 nt, Artificial Sequence
  GSTT2__Homo_sapiens__NP_000845
augggccuggagcuguuccuggaccuggugagccagcccagcagagccguguacaucuucgccaagaagaacggcaucccccuggagcugagaaccguggaccuggugaagggccagcacaagagcaaggaguuccugcagaucaacagccugggcaagcugcccacccugaaggacggcgacuucauccugaccgagagcagcgccauccugaucuaccugagcugcaaguaccagacccccgaccacugguaccccagcgaccugcaggccagagccagagugcacgaguaccugggcuggcacgccgacugcaucagaggcaccuucggcaucccccugugggugcaggugcugggcccccugaucggcgugcaggugcccaaggagaagguggagagaaacagaaccgccauggaccaggcccugcaguggcuggaggacaaguuccugggcgacagacccuuccuggccggccagcaggugacccuggccgaccugauggcccuggaggagcugaugcagcccguggcccugggcuacgagcuguucgagggcagacccagacuggccgccuggagaggcagaguggaggccuuccugggcgccgagcugugccaggaggcccacagcaucauccugagcauccuggagcaggccgccaagaagacccugcccacccccagccccgaggccuaccaggccaugcugcugagaaucgccagaauccccuaa

SEQ ID NO: 17838 - RNA, 651 nt, Artificial Sequence
  GSTZ1__Homo_sapiens__NP_665877
augcaggccggcaagcccauccuguacagcuacuucagaagcagcugcagcuggagagugagaaucgcccuggcccugaagggcaucgacuacgagaccgugcccaucaaccugaucaaggacggcggccagcaguucagcaaggacuuccaggcccugaaccccaugaagcaggugcccacccugaagaucgacggcaucaccauccaccagagccuggccaucaucgaguaccuggaggagaugagacccacccccagacugcugccccaggaccccaagaagagagccagcgugagaaugaucagcgaccugaucgccggcggcauccagccccugcagaaccugagcgugcugaagcaggugggcgaggagaugcagcugaccugggcccagaacgccaucaccugcggcuucaacgcccuggagcagauccugcagagcaccgccggcaucuacugcgugggcgacgaggugaccauggccgaccugugccuggugccccagguggccaacgccgagagauucaagguggaccugacccccuaccccaccaucagcagcaucaacaagagacugcuggugcuggaggccuuccaggugagccaccccugcagacagcccgacacccccaccgagcugagagccuaa

SEQ ID NO: 17839 - RNA, 795 nt, Artificial Sequence
  GSX1__Homo_sapiens__NP_663632
augcccagaagcuuccugguggacagccuggugcugagagaggccggcgagaagaaggcccccgagggcagcccccccccccuguuccccuacgccgugccccccccccacgcccugcacggccugagccccggcgccugccacgccagaaaggccggccugcugugcgugugcccccugugcgugaccgccagccagcugcacggcccccccggcccccccgcccugccccugcugaaggccagcuucccccccuucggcagccaguacugccacgccccccugggcagacagcacagcgccgugagccccggcguggcccacggccccgccgccgccgccgccgccgccgcccuguaccagaccagcuacccccugcccgaccccagacaguuccacugcaucagcguggacagcagcagcaaccagcugcccagcagcaagagaaugagaaccgccuucaccagcacccagcugcuggagcuggagagagaguucgccagcaacauguaccugagcagacugagaagaaucgagaucgccaccuaccugaaccugagcgagaagcaggugaagaucugguuccagaacagaagagugaagcacaagaaggagggcaagggcagcaaccacagaggcggcggcggcggcggcgccggcggcggcggcagcgccccccagggcugcaagugcgccagccugagcagcgccaagugcagcgaggacgacgacgagcugcccaugagccccagcagcagcggcaaggacgacagagaccugaccgugacccccuaa

SEQ ID NO: 17840 - RNA, 915 nt, Artificial Sequence
  GSX2__Homo_sapiens__NP_573574
augagcagaagcuucuacguggacagccugaucaucaaggacaccagcagacccgcccccagccugcccgagccccaccccggccccgacuucuucaucccccugggcaugccccccccccuggugaugagcgugagcggccccggcugccccagcagaaagagcggcgccuucugcgugugcccccugugcgugaccagccaccugcacagcagcagaggcagcgugggcgccggcagcggcggcgccggcgccggcgugaccggcgccggcggcagcggcguggccggcgccgccggcgcccugccccugcugaagagccaguucagcagcgcccccggcgacgcccaguucugccccagagugaaccacgcccaccaccaccaccaccccccccagcaccaccaccaccaccaccagccccagcagcccggcagcgccgccgccgccgccgccgccgccgccgccgccgccgccgccgccgcccugggccacccccagcaccacgcccccgugugcaccgccaccaccuacaacguggccgaccccagaagauuccacugccugaccaugggcggcagcgacgccagccaggugcccaacggcaagagaaugagaaccgccuucaccagcacccagcugcuggagcuggagagagaguucagcagcaacauguaccugagcagacugagaagaaucgagaucgccaccuaccugaaccugagcgagaagcaggugaagaucugguuccagaacagaagagugaagcacaagaaggagggcaagggcacccagagaaacagccacgccggcugcaagugcgugggcagccaggugcacuacgccagaagcgaggacgaggacagccugagccccgccagcgccaacgacgacaaggagaucagcccccuguaa

SEQ ID NO: 17841 - RNA, 1377 nt, Artificial Sequence
  GTDC1__Homo_sapiens__NP_001006637
augagcauccugaucaucgaggccuucuacggcggcagccacaagcagcugguggaccugcugcaggaggagcugggcgacugcgugguguacacccugcccgccaagaaguggcacuggagagccagaaccagcgcccuguacuucagccagaccauccccaucagcgagcacuacagaacccuguucgccagcagcgugcugaaccugaccgagcuggccgcccugagacccgaccugggcaagcugaagaagauccuguacuuccacgagaaccagcugaucuaccccgugaagaagugccaggagagagacuuccaguacggcuacaaccagauccugagcugccugguggccgacguggugguguucaacagcguguucaacauggagagcuuccugaccagcaugggcaaguucaugaagcugauccccgaccacagacccaaggaccuggagagcaucaucagacccaagugccaggugaucuacuuccccaucagauuccccgacgugagcagauucaugcccaagcacaagaccacccaccugaagaagaugcugggccugaagggcaacggcggcgccgugcugagcauggcccugcccuuccagcccgagcagagagacagcgaggaccugcugaagaacuucaacagcgagugcgacacccacugcggccuggacaccgccagacaggaguaccugggcaacagccugagacaggagagcgaccugaagaagagcaccagcagcgacaacagcagcagccaccacggcgagaacaagcagaaccugaccguggaccccugcgacauccugggcggcguggacaaccagcagagacugcugcacaucguguggccccacagaugggagcacgacaaggaccccgagagcuucuucaaggugcugaugcaccugaaggaccugggccugaacuuccacgugagcgugcugggcgagaccuucaccgacgugcccgacaucuucagcgaggccaagaaggcccugggcagcagcgugcugcacuggggcuaccugcccagcaaggacgacuacuuccaggugcugugcauggccgacguggugaucagcaccgccaagcacgaguucuucggcguggccaugcuggaggccguguacugcggcugcuacccccugugccccaaggaccugguguaccccgagaucuuccccgccgaguaccuguacagcacccccgagcagcugagcaagagacugcagaacuucugcaagagacccgacaucaucagaaagcaccuguacaagggcgagaucgcccccuucagcugggccgcccugcacggcaaguucagaagccugcugaccaccgagcccagagaggaccuguaa

SEQ ID NO: 17842 - RNA, 1131 nt, Artificial Sequence
  GTF2A1__Homo_sapiens__NP_056943
auggccaacagcgccaacaccaacaccgugcccaagcuguacagaagcgugaucgaggacgugaucaacgacgugagagacaucuuccuggacgacggcguggacgagcaggugcugauggagcugaagacccugugggagaacaagcugaugcagagcagagccguggacggcuuccacagcgaggagcagcagcugcugcugcaggugcagcagcagcaccagccccagcagcagcagcaccaccaccaccaccaccaccagcaggcccagccccagcagaccgugccccagcaggcccagacccagcaggugcugauccccgccagccagcaggccaccgccccccaggugaucgugcccgacagcaagcugauccagcacaugaacgccagcaacaugagcgccgccgccaccgccgccacccuggcccugcccgccggcgugacccccgugcagcagauccugaccaacagcggccagcugcugcagguggugagagccgccaacggcgcccaguacaucuuccagccccagcagagcguggugcugcagcagcaggugaucccccagaugcagcccggcggcgugcaggcccccgugauccagcaggugcuggccccccugcccggcggcaucagcccccagaccggcgugaucauccagccccagcagauccuguucaccggcaacaagacccaggugauccccaccaccguggccgcccccacccccgcccaggcccagaucaccgccaccggccagcagcagccccaggcccagcccgcccagacccaggccccccuggugcugcagguggacggcaccggcgacaccagcagcgaggaggacgaggacgaggaggaggacuacgacgacgacgaggaggaggacaaggagaaggacggcgccgaggacggccagguggaggaggagccccugaacagcgaggacgacgugagcgacgaggagggccaggagcuguucgacaccgagaacgugguggugugccaguacgacaagauccacagaagcaagaacaaguggaaguuccaccugaaggacggcaucaugaaccugaacggcagagacuacaucuucagcaaggccaucggcgacgccgagugguaa

SEQ ID NO: 17843 - RNA, 1335 nt, Artificial Sequence
  GTF2A1L__Homo_sapiens__NP_001180416
auggccugccugaaccccgugcugugggagaccaaggugcugcagagcaaggccaccgaggacuucuucagaaacagcauccagagcccccuguucacccugcagcugccccacagccugcaccagacccugcagagcagcaccgccagccuggugauccccgccggcagaacccugcccagcuucaccaccgccgagcugggcaccagcaacagcagcgccaacuucaccuuccccggcuaccccauccacgugcccgccggcgugacccugcagaccgugagcggccaccuguacaaggugaacgugcccaucauggugaccgagaccagcggcagagccggcauccugcagcaccccauccagcagguguuccagcagcugggccagcccagcgugauccagaccagcgugccccagcugaaccccuggagccugcaggccaccaccgagaagagccagagaaucgagaccgugcugcagcagcccgccauccugcccagcggccccguggacagaaagcaccuggagaacgccaccagcgacauccuggugagccccggcaacgagcacaagaucgugcccgaggcccugcugugccaccaggagagcagccacuacaucagccugcccggcgugguguucagcccccaggugagccagaccaacagcaacguggagagcgugcugagcggcagcgccagcauggcccagaaccugcacgacgagagccugagcaccagcccccacggcgcccugcaccagcacgugaccgacauccagcugcacauccugaagaacagaauguacggcugcgacagcgugaagcagcccagaaacaucgaggagcccagcaacauccccgugagcgagaaggacagcaacagccagguggaccugagcaucagagugaccgacgacgacaucggcgagaucauccagguggacggcagcggcgacaccagcagcaacgaggagaucggcagcaccagagacgccgacgagaacgaguuccugggcaacaucgacggcggcgaccugaaggugcccgaggaggaggccgacagcaucagcaacgaggacagcgccaccaacagcagcgacaacgaggacccccaggugaacaucguggaggaggacccccugaacagcggcgacgacgugagcgagcaggacgugcccgaccuguucgacaccgacaacgugaucgugugccaguacgacaagauccacagaagcaagaacaaguggaaguucuaccugaaggacggcgugaugugcuucggcggcagagacuacguguucgccaaggccaucggcgacgccgagugguaa

SEQ ID NO: 17844 - RNA, 330 nt, Artificial Sequence
  GTF2A2__Homo_sapiens__NP_004483
auggccuaccagcuguacagaaacaccacccugggcaacagccugcaggagagccuggacgagcugauccagagccagcagaucaccccccagcuggcccugcaggugcugcugcaguucgacaaggccaucaacgccgcccuggcccagagagugagaaacagagugaacuucagaggcagccugaacaccuacagauucugcgacaacguguggaccuucgugcugaacgacguggaguucagagaggugaccgagcugaucaagguggacaaggugaagaucguggccugcgacggcaagaacaccggcagcaacaccaccgaguaa

SEQ ID NO: 17845 - RNA, 1320 nt, Artificial Sequence
  GTF2E1__Homo_sapiens__NP_005504
auggccgaccccgacgugcugaccgaggugcccgccgcccugaagagacuggccaaguacgugaucagaggcuucuacggcaucgagcacgcccuggcccuggacauccugaucagaaacagcugcgugaaggaggaggacaugcuggagcugcugaaguucgacagaaagcagcugagaagcgugcugaacaaccugaagggcgacaaguucaucaagugcagaaugagaguggagaccgccgccgacggcaagaccaccagacacaacuacuacuucaucaacuacagaacccuggugaacguggugaaguacaagcuggaccacaugagaagaagaaucgagaccgacgagagagacagcaccaacagagccagcuucaagugccccgugugcagcagcaccuucaccgaccuggaggccaaccagcuguucgaccccaugaccggcaccuucagaugcaccuucugccacaccgagguggaggaggacgagagcgccaugcccaagaaggacgccagaacccugcuggccagauucaacgagcagaucgagcccaucuacgcccugcugagagagaccgaggacgugaaccuggccuacgagauccuggagcccgagcccaccgagauccccgcccugaagcagagcaaggaccacgccgccaccaccgccggcgccgccagccuggccggcggccaccacagagaggccugggccaccaagggccccagcuacgaggaccuguacacccagaacguggugaucaacauggacgaccaggaggaccugcacagagccagccuggagggcaagagcgccaaggagagacccaucuggcugagagagagcaccgugcagggcgccuacggcagcgaggacaugaaggagggcggcaucgacauggacgccuuccaggagagagaggagggccacgccggccccgacgacaacgaggaggugaugagagcccugcugauccacgagaagaagaccagcagcgccauggccggcagcgugggcgccgccgcccccgugaccgccgccaacggcagcgacagcgagagcgagaccagcgagagcgacgacgacagcccccccagacccgccgccguggccgugcacaagagagaggaggacgaggaggaggacgacgaguucgaggagguggccgacgaccccaucgugaugguggccggcagacccuucagcuacagcgaggugagccagagacccgagcugguggcccagaugacccccgaggagaaggaggccuacaucgccaugggccagagaauguucgaggaccuguucgaguaa

SEQ ID NO: 17846 - RNA, 876 nt, Artificial Sequence
  GTF2E2__Homo_sapiens__NP_002086
auggaccccagccugcugagagagagagagcuguucaagaagagagcccugagcacccccgugguggagaagagaagcgccagcagcgagagcagcagcagcagcagcaagaagaagaagaccaagguggagcacggcggcagcagcggcagcaagcagaacagcgaccacagcaacggcagcuucaaccugaaggcccugagcggcagcagcggcuacaaguucggcgugcuggccaagaucgugaacuacaugaagaccagacaccagagaggcgacacccacccccugacccuggacgagauccuggacgagacccagcaccuggacaucggccugaagcagaagcaguggcugaugaccgaggcccuggugaacaaccccaagaucgaggugaucgacggcaaguacgccuucaagcccaaguacaacgugagagacaagaaggcccugcugagacugcuggaccagcacgaccagagaggccugggcggcauccugcuggaggacaucgaggaggcccugcccaacagccagaaggccgugaaggcccugggcgaccagauccuguucgugaacagacccgacaagaagaagauccuguucuucaacgacaagagcugccaguucagcguggacgaggaguuccagaagcuguggagaagcgugaccguggacagcauggacgaggagaagaucgaggaguaccugaagagacagggcaucagcagcaugcaggagagcggccccaagaagguggcccccauccagagaagaaagaagcccgccagccagaagaagagaagauucaagacccacaacgagcaccuggccggcgugcugaaggacuacagcgacaucaccagcagcaaguaa

SEQ ID NO: 17847 - RNA, 1554 nt, Artificial Sequence
  GTF2F1__Homo_sapiens__NP_002087
auggccgcccugggccccagcagccagaacgugaccgaguacguggugagagugcccaagaacaccaccaagaaguacaacaucauggccuucaacgccgccgacaaggugaacuucgccaccuggaaccaggccagacuggagagagaccugagcaacaagaagaucuaccaggaggaggagaugcccgagagcggcgccggcagcgaguucaacagaaagcugagagaggaggccagaagaaagaaguacggcaucgugcugaaggaguucagacccgaggaccagcccuggcugcugagagugaacggcaagagcggcagaaaguucaagggcaucaagaagggcggcgugaccgagaacaccagcuacuacaucuucacccagugccccgacggcgccuucgaggccuuccccgugcacaacugguacaacuucaccccccuggccagacacagaacccugaccgccgaggaggccgaggaggagugggagagaagaaacaaggugcugaaccacuucagcaucaugcagcagagaagacugaaggaccaggaccaggacgaggacgaggaggagaaggagaagagaggcagaagaaaggccagcgagcugagaauccacgaccuggaggacgaccuggagaugagcagcgacgccagcgacgccagcggcgaggagggcggcagagugcccaaggccaagaagaaggccccccuggccaagggcggcagaaagaagaagaagaagaagggcagcgacgacgaggccuucgaggacagcgacgacggcgacuucgagggccaggagguggacuacaugagcgacggcagcagcagcagccaggaggagcccgagagcaaggccaaggccccccagcaggaggagggccccaagggcguggacgagcagagcgacagcagcgaggagagcgaggaggagaagccccccgaggaggacaaggaggaggaggaggagaagaaggcccccaccccccaggagaagaagagaagaaaggacagcagcgaggagagcgacagcagcgaggagagcgacaucgacagcgaggccagcagcgcccuguucauggccaagaagaagaccccccccaagagagagagaaagcccagcggcggcagcagcagaggcaacagcagacccggcacccccagcgccgagggcggcagcaccagcagcacccugagagccgccgccagcaagcuggagcagggcaagagagugagcgagaugcccgccgccaagagacugagacuggacaccggcccccagagccugagcggcaagagcaccccccagccccccagcggcaagaccacccccaacagcggcgacgugcaggugaccgaggacgccgugagaagauaccugaccagaaagcccaugaccaccaaggaccugcugaagaaguuccagaccaagaagaccggccugagcagcgagcagaccgugaacgugcuggcccagauccugaagagacugaaccccgagagaaagaugaucaacgacaagaugcacuucagccugaaggaguaa

SEQ ID NO: 17848 - RNA, 750 nt, Artificial Sequence
  GTF2F2__Homo_sapiens__NP_004119
auggccgagagaggcgagcuggaccugaccggcgccaagcagaacaccggcguguggcuggugaaggugcccaaguaccugagccagcagugggccaaggccagcggcagaggcgaggugggcaagcugagaaucgccaagacccagggcagaaccgaggugagcuucacccugaacgaggaccuggccaacauccacgacaucggcggcaagcccgccagcgugagcgcccccagagagcaccccuucgugcugcagagcgugggcggccagacccugaccguguucaccgagagcagcagcgacaagcugagccuggagggcaucguggugcagagagccgagugcagacccgccgccagcgagaacuacaugagacugaagagacugcagaucgaggagagcagcaagcccgugagacugagccagcagcuggacaagguggugaccaccaacuacaagcccguggccaaccaccaguacaacaucgaguacgagagaaagaagaaggaggacggcaagagagccagagccgacaagcagcacgugcuggacaugcuguucagcgccuucgagaagcaccaguacuacaaccugaaggaccugguggacaucaccaagcagcccgugguguaccugaaggagauccugaaggagaucggcgugcagaacgugaagggcauccacaagaacaccugggagcugaagcccgaguacagacacuaccagggcgaggagaagagcgacuaa

SEQ ID NO: 17849 - RNA, 1647 nt, Artificial Sequence
  GTF2H1__Homo_sapiens__NP_001135779
auggccaccagcagcgaggaggugcugcugaucgugaagaaggugagacagaagaagcaggacggcgcccuguaccugauggccgagagaaucgccugggcccccgagggcaaggacagauucaccaucagccacauguacgccgacaucaagugccagaagaucagccccgagggcaaggccaagauccagcugcagcuggugcugcacgccggcgacaccaccaacuuccacuucagcaacgagagcaccgccgugaaggagagagacgccgugaaggaccugcugcagcagcugcugcccaaguucaagagaaaggccaacaaggagcuggaggagaagaacagaaugcugcaggaggaccccgugcuguuccagcuguacaaggaccugguggugagccaggugaucagcgccgaggaguucugggccaacagacugaacgugaacgccaccgacagcagcagcaccagcaaccacaagcaggacgugggcaucagcgccgccuuccuggccgacgugagaccccagaccgacggcugcaacggccugagauacaaccugaccagcgacaucaucgagagcaucuucagaaccuaccccgccgugaagaugaaguacgccgagaacgugccccacaacaugaccgagaaggaguucuggaccagauucuuccagagccacuacuuccacagagacagacugaacaccggcagcaaggaccuguucgccgagugcgccaagaucgacgagaagggccugaagaccauggugagccugggcgugaagaacccccugcuggaccugaccgcccuggaggacaagccccuggacgagggcuacggcaucagcagcgugcccagcgccagcaacagcaagagcaucaaggagaacagcaacgccgccaucaucaagagauucaaccaccacagcgccauggugcuggccgccggccugagaaagcaggaggcccagaacgagcagaccagcgagcccagcaacauggacggcaacagcggcgacgccgacugcuuccagcccgccgugaagagagccaagcugcaggagagcaucgaguacgaggaccugggcaagaacaacagcgugaagaccaucgcccugaaccugaagaagagcgacagauacuaccacggccccacccccauccagagccugcaguacgccaccagccaggacaucaucaacagcuuccagagcaucagacaggagauggaggccuacacccccaagcugacccaggugcugagcagcagcgccgccagcagcaccaucaccgcccugagccccggcggcgcccugaugcagggcggcacccagcaggccaucaaccagauggugcccaacgacauccagagcgagcugaagcaccuguacguggccgugggcgagcugcugagacacuucuggagcugcuuccccgugaacacccccuuccuggaggagaagguggugaagaugaagagcaaccuggagagauuccaggugaccaagcugugccccuuccaggagaagaucagaagacaguaccugagcaccaaccuggugagccacaucgaggagaugcugcagaccgccuacaacaagcugcacaccuggcagagcagaagacugaugaagaagaccuaa

SEQ ID NO: 17850 - RNA, 1188 nt, Artificial Sequence
  GTF2H2C_2__Homo_sapiens__NP_001035955
auggacgaggagcccgagagaaccaagagaugggagggcggcuacgagagaaccugggagauccugaaggaggacgagagcggcagccugaaggccaccaucgaggacauccuguucaaggccaagagaaagagaguguucgagcaccacggccaggugagacugggcaugaugagacaccuguacguggugguggacggcagcagaaccauggaggaccaggaccugaagcccaacagacugaccugcacccugaagcugcuggaguacuucguggaggaguacuucgaccagaaccccaucagccagaucggcaucaucgugaccaagagcaagagagccgagaagcugaccgagcugagcggcaaccccagaaagcacaucaccagccugaaggaggccguggacaugaccugccacggcgagcccagccuguacaacagccugagcauggccaugcagacccugaagcacaugcccggccacaccagcagagaggugcugaucaucuucagcagccugaccaccugcgaccccagcaacaucuacgaccugaucaagacccugaaggccgccaagaucagagugagcgugaucggccugagcgccgaggugagagugugcaccgugcuggccagagagaccggcggcaccuaccacgugauccuggacgagagccacuacaaggagcugcugacccaccaccugagccccccccccgccagcagcagcagcgagugcagccugaucagaaugggcuucccccagcacaccaucgccagccugagcgaccaggacgccaagcccagcuucagcauggcccaccuggacggcaacaccgagcccggccugacccugggcggcuacuucugcccccagugcagagccaaguacugcgagcugcccguggagugcaagaucugcggccugacccuggugagcgccccccaccuggccagaagcuaccaccaccuguucccccuggacgccuuccaggagaucccccuggaggaguacaacggcgagagauucugcuacggcugccagggcgagcugaaggaccagcacguguacgugugcgccgugugccagaacguguucugcguggacugcgacguguucgugcacgacagccugcacugcugccccggcugcauccacaagauccccgcccccagcggcguguaa

SEQ ID NO: 17851 - RNA, 1017 nt, Artificial Sequence
  GTF2H2C__Homo_sapiens__XP_005248650
augagacaccuguacguggugguggacggcagcagaaccauggaggaccaggaccugaagcccaacagacugaccugcacccugaagcugcuggaguacuucguggaggaguacuucgaccagaaccccaucagccagaucggcaucaucgugaccaagagcaagagagccgagaagcugaccgagcugagcggcaaccccagaaagcacaucaccagccugaaggaggccguggacaugaccugccacggcgagcccagccuguacaacagccugagcauggccaugcagacccugaagcacaugcccggccacaccagcagagaggugcugaucaucuucagcagccugaccaccugcgaccccagcaacaucuacgaccugaucaagacccugaaggccgccaagaucagagugagcgugaucggccugagcgccgaggugagagugugcaccgugcuggccagagagaccggcggcaccuaccacgugauccuggacgagagccacuacaaggagcugcugacccaccaccugagccccccccccgccagcagcagcagcgagugcagccugaucagaaugggcuucccccagcacaccaucgccagccugagcgaccaggacgccaagcccagcuucagcauggcccaccuggacggcaacaccgagcccggccugacccugggcggcuacuucugcccccagugcagagccaaguacugcgagcugcccguggagugcaagaucugcggccugacccuggugagcgccccccaccuggccagaagcuaccaccaccuguucccccuggacgccuuccaggagaucccccuggaggaguacaacggcgagagauucugcuacggcugccagggcgagcugaaggaccagcacguguacgugugcgccgugugccagaacguguucugcguggacugcgacguguucgugcacgacagccugcacugcugccccggcugcauccacaagauccccgcccccagcggcguguaa

SEQ ID NO: 17852 - RNA, 1188 nt, Artificial Sequence
  GTF2H2__Homo_sapiens__NP_001506
auggacgaggagcccgagagaaccaagagaugggagggcggcuacgagagaaccugggagauccugaaggaggacgagagcggcagccugaaggccaccaucgaggacauccuguucaaggccaagagaaagagaguguucgagcaccacggccaggugagacugggcaugaugagacaccuguacguggugguggacggcagcagaaccauggaggaccaggaccugaagcccaacagacugaccugcacccugaagcugcuggaguacuucguggaggaguacuucgaccagaaccccaucagccagaucggcaucaucgugaccaagagcaagagagccgagaagcugaccgagcugagcggcaaccccagaaagcacaucaccagccugaagaaggccguggacaugaccugccacggcgagcccagccuguacaacagccugagcaucgccaugcagacccugaagcacaugcccggccacaccagcagagaggugcugaucaucuucagcagccugaccaccugcgaccccagcaacaucuacgaccugaucaagacccugaaggccgccaagaucagagugagcgugaucggccugagcgccgaggugagagugugcaccgugcuggccagagagaccggcggcaccuaccacgugauccuggacgagagccacuacaaggagcugcugacccaccacgugagccccccccccgccagcagcagcagcgagugcagccugaucagaaugggcuucccccagcacaccaucgccagccugagcgaccaggacgccaagcccagcuucagcauggcccaccuggacggcaacaccgagcccggccugacccugggcggcuacuucugcccccagugcagagccaaguacugcgagcugcccguggagugcaagaucugcggccugacccuggugagcgccccccaccuggccagaagcuaccaccaccuguucccccuggacgccuuccaggagaucccccuggaggaguacaacggcgagagauucugcuacggcugccagggcgagcugaaggaccagcacguguacgugugcgccgugugccagaacguguucugcguggacugcgacguguucgugcacgacagccugcacugcugccccggcugcauccacaagauccccgcccccagcggcguguaa

SEQ ID NO: 17853 - RNA, 804 nt, Artificial Sequence
  GTF2H3__Homo_sapiens__NP_001258796
auggugcugggcaacagccaccuguucaugaacagaagcaacaagcuggccgugaucgccagccacauccaggagagcagauuccuguaccccggcaagaacggcagacugggcgacuucuucggcgaccccggcaacccccccgaguucaaccccagcggcagcaaggacggcaaguacgagcugcugaccagcgccaacgaggugaucguggaggagaucaaggaccugaugaccaagagcgacaucaagggccagcacaccgagacccugcuggccggcagccuggccaaggcccugugcuacauccacagaaugaacaaggaggugaaggacaaccaggagaugaagagcagaauccuggugaucaaggccgccgaggacagcgcccugcaguacaugaacuucaugaacgugaucuucgccgcccagaagcagaacauccugaucgacgccugcgugcuggacagcgacagcggccugcugcagcaggccugcgacaucaccggcggccuguaccugaaggugccccagaugcccagccugcugcaguaccugcuguggguguuccugcccgaccaggaccagagaagccagcugauccugcccccccccgugcacguggacuacagagccgccugcuucugccacagaaaccugaucgagaucggcuacgugugcagcgugugccugagcaucuucugcaacuucagccccaucugcaccaccugcgagaccgccuucaagaucagccugccccccgugcugaaggccaagaagaagaagcugaaggugagcgccuaa

SEQ ID NO: 17854 - RNA, 1389 nt, Artificial Sequence
  GTF2H4__Homo_sapiens__NP_001508
auggagagcacccccagcagaggccugaacagagugcaccugcagugcagaaaccugcaggaguuccugggcggccugagccccggcgugcuggacagacuguacggccaccccgccaccugccuggccguguucagagagcugcccagccuggccaagaacugggugaugagaaugcuguuccuggagcagccccugccccaggccgccguggcccugugggugaagaaggaguucagcaaggcccaggaggagagcaccggccugcugagcggccugagaaucuggcacacccagcugcugcccggcggccugcagggccugauccugaaccccaucuucagacagaaccugagaaucgcccugcugggcggcggcaaggccuggagcgacgacaccagccagcugggccccgacaagcacgccagagacgugcccagccuggacaaguacgccgaggagagaugggagguggugcugcacuucauggugggcagccccagcgccgccgugagccaggaccuggcccagcugcugagccaggccggccugaugaagagcaccgagcccggcgagccccccugcaucaccagcgccggcuuccaguuccugcugcuggacacccccgcccagcugugguacuucaugcugcaguaccugcagaccgcccagagcagaggcauggaccugguggagauccugagcuuccuguuccagcugagcuucagcacccugggcaaggacuacagcguggagggcaugagcgacagccugcugaacuuccugcagcaccugagagaguucggccugguguuccagagaaagagaaagagcagaagauacuaccccaccagacuggccaucaaccugagcagcggcgugagcggcgccggcggcaccgugcaccagcccggcuucaucgugguggagaccaacuacagacuguacgccuacaccgagagcgagcugcagaucgcccugaucgcccuguucagcgagaugcuguacagauuccccaacauggugguggcccaggugaccagagagagcgugcagcaggccaucgccagcggcaucaccgcccagcagaucauccacuuccugagaaccagagcccaccccgugaugcugaagcagacccccgugcugccccccaccaucaccgaccagaucagacugugggagcuggagagagacagacugagauucaccgagggcgugcuguacaaccaguuccugagccagguggacuucgagcugcugcuggcccacgccagagagcugggcgugcugguguucgagaacagcgccaagagacugaugguggugacccccgccggccacagcgacgugaagagauucuggaagagacagaagcacagcagcuaa

SEQ ID NO: 17855 - RNA, 216 nt, Artificial Sequence
  GTF2H5__Homo_sapiens__NP_997001
auggugaacgugcugaagggcgugcugaucgagugcgaccccgccaugaagcaguuccugcuguaccuggacgagagcaacgcccugggcaagaaguucaucauccaggacaucgacgacacccacguguucgugaucgccgagcuggugaacgugcugcaggagagagugggcgagcugauggaccagaacgccuucagccugacccagaaguaa

SEQ ID NO: 17856 - RNA, 825 nt, Artificial Sequence
  GTF2I__Homo_sapiens__NP_001267729
auggcccagguggccaugagcacccugcccguggaggacgaggagagcagcgagagcagaaugguggugaccuuccugaugagcgcccuggagagcaugugcaaggagcuggccaagagcaaggccgagguggccugcaucgccguguacgagaccgacguguucguggugggcaccgagagaggcagagccuucgugaacaccagaaaggacuuccagaaggacuucgugaaguacugcguggaggaggaggagaaggccgccgagaugcacaagaugaagagcaccacccaggccaacagaaugagcguggacgccguggagaucgagacccugagaaagaccguggaggacuacuucugcuucugcuacggcaaggcccugggcaagagcaccguggugcccgugcccuacgagaagaugcugagagaccagagcgccgugguggugcagggccugcccgagggcguggccuucaagcaccccgagaacuacgaccuggccacccugaaguggauccuggagaacaaggccggcaucagcuucaucaucaagagacccuuccuggagcccaagaagcacgugggcggcagagugauggugaccgacgccgacagaagcauccugagccccggcggcagcugcggccccaucaaggugaagaccgagcccaccgaggacagcggcaucagccuggagauggccgccgugaccgugaaggaggagagcgaggaccccgacuacuaccaguacaacauccagggcagccaccacagcagcgagggcaacgagggcaccgagauggaggugcccgccgagggcuaa

SEQ ID NO: 17857 - RNA, 2931 nt, Artificial Sequence
  GTF2IRD1__Homo_sapiens__NP_001186136
auggcccugcugggcaagagaugcgacgugcccaccaacggcugcggccccgacagauggaacagcgccuucaccagaaaggacgagaucaucaccagccuggugagcgcccuggacagcaugugcagcgcccugagcaagcugaacgccgagguggccugcguggccgugcacgacgagagcgccuucguggugggcaccgagaagggcagaauguuccugaacgccagaaaggagcugcagagcgacuuccugagauucugccugagcgccgcccagcacagagccgccaccagccagcuggagggcagaguggugagaagagugcugaccguggccagcagagcccugugccccaccggcggcccccccuggaaggaccccgaggccgagcaccccaagaaggugcagagaggcgagggcggcggcagaagccugcccagaagcagccuggagcacggcagcgacguguaccugcugagaaagaugguggaggagguguucgacgugcuguacagcgaggcccugggcagagccagcguggugccccugcccuacgagagacugcugagagagcccggccugcuggccgugcagggccugcccgagggccuggccuucagaagacccgccgaguacgaccccaaggcccugauggccauccuggagcacagccacagaaucagauucaagcugaagagaccccuggaggacggcggcagagacagcaaggcccugguggagcugaacggcgugagccugauccccaagggcagcagagacugcggccugcacggccaggcccccaaggugcccccccaggaccugccccccaccgccaccagcagcagcauggccagcuuccuguacagcaccgcccugcccaaccacgccaucagagagcugaagcaggaggcccccagcugcccccuggcccccagcgaccugggccugagcagacccaugcccgagcccaaggccaccggcgcccaggacuucagcgacugcugcggccagaagcccaccggccccggcggcccccugauccagaacgugcacgccagcaagagaauccuguucagcaucgugcacgacaagagcgagaagugggacgccuucaucaaggagaccgaggacaucaacacccugagagagugcgugcagauccuguucaacagcagauacgccgaggcccugggccuggaccacauggugcccgugcccuacagaaagaucgccugcgaccccgaggccguggagaucgugggcauccccgacaagauccccuucaagagacccugcaccuacggcgugcccaagcugaagagaauccuggaggagagacacagcauccacuucaucaucaagagaauguucgacgagagaaucuucaccggcaacaaguucaccaaggacaccaccaagcuggagcccgccagcccccccgaggacaccagcgccgaggugagcagagccaccgugcuggaccuggccggcaacgccagaagcgacaagggcagcaugagcgaggacugcggccccggcaccagcggcgagcugggcggccugagacccaucaagaucgagcccgaggaccuggacaucauccaggugaccgugcccgaccccagccccaccagcgaggagaugaccgacagcaugcccggccaccugcccagcgaggacagcggcuacggcauggagaugcugaccgacaagggccugagcgaggacgccagacccgaggagagacccguggaggacagccacggcgacgugaucagaccccugagaaagcagguggagcugcuguucaacaccagauacgccaaggccaucggcaucagcgagcccgugaaggugcccuacagcaaguuccugaugcaccccgaggagcuguucguggugggccugcccgagggcaucagccugagaagacccaacugcuucggcaucgccaagcugagaaagauccuggaggccagcaacagcauccaguucgugaucaagagacccgagcugcugaccgagggcgugaaggagcccaucauggacagccaggagagagacagcggcgacccccugguggacgagagccugaagagacagggcuuccaggagaacuacgacgccagacugagcagaaucgacaucgccaacacccugagagagcaggugcaggaccuguucaacaagaaguacggcgaggcccugggcaucaaguaccccgugcaggugcccuacaagagaaucaagagcaaccccggcagcgugaucaucgagggccugccccccggcauccccuucagaaagcccugcaccuucggcagccagaaccuggagagaauccuggccguggccgacaagaucaaguucaccgugaccagacccuuccagggccugauccccaagcccgacgaggacgacgccaacagacugggcgagaaggugauccugagagagcaggugaaggagcuguucaacgagaaguacggcgaggcccugggccugaacagacccgugcuggugcccuacaagcugaucagagacagccccgacgccguggaggugaccggccugcccgacgacauccccuucagaaaccccaacaccuacgacauccacagacuggagaagauccugaaggccagagagcacgugagaauggugaucaucaaccagcugcagcccuucgccgagaucugcaacgacgccaaggugcccgccaaggacagcagcauccccaagagaaagagaaagagagugagcgagggcaacagcgugagcagcagcagcagcagcagcagcagcagcagcagcaaccccgacagcguggccagcgccaaccagaucagccuggugcaguggcccauguacaugguggacuacgccggccugaacgugcagcugcccggcccccugaacuacuaa

SEQ ID NO: 17858 - RNA, 2850 nt, Artificial Sequence
  GTF2IRD2__Homo_sapiens__NP_775808
auggcccagguggccgugagcacccugcccguggaggaggagagcagcagcgagaccagaaugguggugaccuuccuggugagcgcccuggagagcaugugcaaggagcuggccaagagcaaggccgagguggccugcaucgccguguacgagaccgacguguucguggugggcaccgagagaggcugcgccuucgugaacgccagaaccgacuuccagaaggacuucgccaaguacugcguggccgagggccugugcgaggugaagccccccugccccgugaacggcaugcaggugcacagcggcgagaccgagauccugagaaaggccguggaggacuacuucugcuucugcuacggcaaggcccugggcaccaccgugauggugcccgugcccuacgagaagaugcugagagaccagagcgccgugguggugcagggccugcccgagggcguggccuuccagcaccccgagaacuacgaccuggccacccugaaguggauccuggagaacaaggccggcaucagcuucaucaucaacagacccuuccugggccccgagagccagcugggcggccccggcauggugaccgacgccgagagaagcaucgugagccccagcgagagcugcggccccaucaacgugaagaccgagcccauggaggacagcggcaucagccugaaggccgaggccgugagcgugaagaaggagagcgaggaccccaacuacuaccaguacaacaugcagggcagccaccccagcagcaccagcaacgaggugaucgagauggagcugcccauggaggacagcaccccccuggugcccagcgaggagcccaacgaggaccccgaggccgaggugaagaucgagggcaacaccaacagcagcagcgugaccaacagcgccgccggcguggaggaccugaacaucgugcaggugaccgugcccgacaacgagaaggagagacugagcagcaucgagaagaucaagcagcugagagagcaggugaacgaccuguucagcagaaaguucggcgaggccaucggcguggacuuccccgugaaggugcccuacagaaagaucaccuucaaccccggcugcguggugaucgacggcaugccccccggcgugguguucaaggcccccggcuaccuggagaucagcagcaugagaagaauccuggaggccgccgaguucaucaaguucaccgugaucagaccccugcccggccuggagcugagcaacgugggcaagagaaagaucgaccaggagggcagaguguuccaggagaagugggagagagccuacuucuucguggaggugcagaacauccccaccugccugaucugcaagcagagcaugagcgugagcaaggaguacaaccugagaagacacuaccagaccaaccacagcaagcacuacgaccaguacauggagagaaugagagacgagaagcugcacgagcugaagaagggccugagaaaguaccugcugggcagcagcgacaccgagugccccgagcagaagcagguguucgccaaccccagccccacccagaagagccccgugcagcccguggaggaccuggccggcaaccugugggagaagcugagagagaagaucagaagcuucguggccuacagcaucgccaucgacgagaucaccgacaucaacaacaccacccagcuggccaucuucaucagaggcguggacgagaacuucgacgugagcgaggagcugcuggacaccgugcccaugaccggcaccaagagcggcaacgagaucuucagcagaguggagaagagccugaagaaguucugcaucgacuggagcaagcuggugagcguggccagcaccggcacccccgccaugguggacgccaacaacggccuggugaccaagcugaagagcagaguggccaccuucugcaagggcgccgagcugaagagcaucugcugcaucauccaccccgagagccugugcgcccagaagcugaagauggaccacgugauggacgugguggugaagagcgugaacuggaucugcagcagaggccugaaccacagcgaguucaccacccugcuguacgagcuggacagccaguacggcagccugcuguacuacaccgagaucaaguggcugagcagaggccuggugcugaagagauucuucgagagccuggaggagaucgacagcuucaugagcagcagaggcaagccccugccccagcugagcagcaucgacuggaucagagaccuggccuuccugguggacaugaccaugcaccugaacgcccugaacaucagccugcagggccacagccagaucgugacccagauguacgaccugaucagagccuuccuggccaagcugugccugugggagacccaccugaccagaaacaaccuggcccacuuccccacccugaagcuggccagcagaaacgagagcgacggccugaacuacauccccaagaucgccgagcugaagaccgaguuccagaagagacugagcgacuucaagcuguacgagagcgagcugacccuguucagcagccccuucagcaccaagaucgacagcgugcacgaggagcugcagauggaggugaucgaccugcagugcaacaccgugcugaagaccaaguacgacaaggugggcauccccgaguucuacaaguaccuguggggcagcuaccccaaguacaagcaccacugcgccaagauccugagcauguucggcagcaccuacaucugcgagcagcuguucagcaucaugaagcugagcaagaccaaguacugcagccagcugaaggacagccagugggacagcgugcugcacaucgccaccuaa

SEQ ID NO: 17859 - RNA, 1098 nt, Artificial Sequence
  GTF3A__Homo_sapiens__NP_002088
auggacccccccgccgugguggccgagagcgugagcagccugaccaucgccgacgccuucaucgccgccggcgagagcagcgcccccaccccccccagacccgcccugcccagaagauucaucugcagcuuccccgacugcagcgccaacuacagcaaggccuggaagcuggacgcccaccugugcaagcacaccggcgagagacccuucgugugcgacuacgagggcugcggcaaggccuucaucagagacuaccaccugagcagacacauccugacccacaccggcgagaagcccuucgugugcgccgccaacggcugcgaccagaaguucaacaccaagagcaaccugaagaagcacuucgagagaaagcacgagaaccagcagaagcaguacaucugcagcuucgaggacugcaagaagaccuucaagaagcaccagcagcugaagauccaccagugccagcacaccaacgagccccuguucaagugcacccaggagggcugcggcaagcacuucgccagccccagcaagcugaagagacacgccaaggcccacgagggcuacgugugccagaagggcugcagcuucguggccaagaccuggaccgagcugcugaagcacgugagagagacccacaaggaggagauccugugcgaggugugcagaaagaccuucaagagaaaggacuaccugaagcagcacaugaagacccacgcccccgagagagacgugugcagaugccccagagagggcugcggcagaaccuacaccaccguguucaaccugcagagccacauccugagcuuccacgaggagagcagacccuucgugugcgagcacgccggcugcggcaagaccuucgccaugaagcagagccugaccagacacgccguggugcacgaccccgacaagaagaagaugaagcugaaggugaagaagagcagagagaagagaagccuggccagccaccugagcggcuacaucccccccaagagaaagcagggccagggccugagccugugccagaacggcgagagccccaacugcguggaggacaagaugcugagcaccguggccgugcugacccugggcuaa

SEQ ID NO: 17860 - RNA, 6330 nt, Artificial Sequence
  GTF3C1__Homo_sapiens__NP_001511
auggacgcccuggagagccugcuggacgagguggcccuggagggccuggacggccugugccugcccgcccuguggagcagacuggagaccagagugccccccuucccccugccccuggagcccugcacccaggaguuccuguggagagcccuggccacccaccccggcaucagcuucuacgaggagcccagagagagacccgaccugcagcugcaggacagauacgaggagaucgaccuggagaccggcauccuggagagcagaagagaccccguggcccuggaggacguguaccccauccacaugauccuggagaacaaggacggcauccagggcagcugcagauacuucaaggagagaaagaacaucaccaacgacaucagaaccaagagccugcagcccagaugcaccaugguggaggccuucgacagauggggcaagaagcugaucaucguggccagccaggccaugagauacagagcccugaucggccaggagggcgaccccgaccugaagcugcccgacuucagcuacugcauccuggagagacugggcagaagcagauggcagggcgagcugcagagagaccugcacaccaccgccuucaagguggacgccggcaagcugcacuaccacagaaagauccugaacaagaacggccugaucaccaugcagagccacgugaucagacugcccaccggcgcccagcagcacagcauccugcugcugcugaacagauuccacguggacagaagaagcaaguacgacauccugauggagaagcugagcgugaugcugagcaccagaaccaaccacaucgagacccugggcaagcugagagaggagcugggccugugcgagagaaccuucaagagacuguaccaguacaugcugaacgccggccuggccaagguggugagccugagacugcaggagauccaccccgagugcggccccugcaagaccaagaagggcaccgacgugauggugagaugccugaagcugcugaaggaguucaagagaaacgaccacgacgacgacgaggacgaggaggugaucagcaagaccgugccccccguggacaucguguucgagagagacaugcugacccagaccuacgaccugaucgagagaagaggcaccaagggcaucagccaggccgagaucagaguggccaugaacgugggcaagcuggaggccagaaugcugugcagacugcugcagagauucaagguggugaagggcuucauggaggacgagggcagacagagaaccaccaaguacaucagcugcguguucgccgaggagagcgaccugagcagacaguaccagagagagaaggccagaagcgagcugcugaccaccgugagccuggccagcaugcaggaggagagccugcugcccgagggcgaggacaccuuccugagcgagagcgacagcgaggaggagagaagcagcagcaagagaagaggcagaggcagccagaaggacaccagagccagcgccaaccugagacccaagacccagccccaccacagcacccccaccaagggcggcuggaagguggugaaccugcacccccugaagaagcagccccccagcuuccccggcgccgccgaggagagagccugccagagccuggccagcagagacagccugcuggacaccagcagcgugagcgagcccaacgugagcuucgugagccacugcgccgacagcaacagcggcgacaucgccgugaucgaggaggugagaauggagaaccccaaggagagcagcagcagccugaagaccggcagacacagcagcggccaggacaagccccacgagaccuacagacugcugaagagaagaaaccugaucaucgaggccgugaccaaccugagacugaucgagagccuguucaccauccagaagaugaucauggaccaggagaagcaggagggcgugagcaccaagugcugcaagaagagcaucgugagacuggugagaaaccugagcgaggagggccugcugagacuguacagaaccaccgugauccaggacggcaucaagaagaagguggaccugguggugcaccccagcauggaccagaacgacccccuggugagaagcgccaucgagcaggugagauucagaaucagcaacagcagcaccgccaacagagugaagaccagccagccccccgugccccagggcgaggccgaggaggacagccagggcaaggagggccccagcggcagcggcgacagccagcugagcgccagcagcagaagcgagagcggcagaaugaagaagagcgacaacaagaugggcaucaccccccugagaaacuaccaccccaucguggugcccggccugggcagaagccugggcuuccugcccaagaugcccagacugagaguggugcacauguuccugugguaccugaucuacggccaccccgccagcaacaccguggagaagcccagcuucaucagcgagagaagaaccaucaagcaggagagcggcagagccggcgugagacccagcagcagcggcagcgccugggaggccugcagcgaggcccccagcaagggcagccaggacggcgugaccugggaggccgagguggagcuggccaccgagaccguguacguggacgacgccagcuggaugagauacaucccccccauccccgugcacagagacuucggcuucggcugggcccuggugagcgacauccugcugugccugccccugagcaucuucauccagaucgugcaggugagcuacaagguggacaaccuggaggaguuccugaacgacccccugaagaagcacacccugaucagauuccugcccagacccaucagacagcagcugcuguacaagagaagauacaucuucagcgugguggagaaccugcagagacugugcuacaugggccugcugcaguucggccccaccgagaaguuccaggacaaggaccagguguucaucuuccugaagaagaacgccgugaucguggacaccaccaucugcgacccccacuacaaccuggccagaagcagcagacccuucgagagaagacuguacgugcugaacagcaugcaggacguggagaacuacugguucgaccugcagugcgugugccugaacaccccccugggcguggugagaugccccagagugagaaagaacagcagcaccgaccagggcagcgacgaggagggcagccugcagaaggagcaggagagcgccauggacaagcacaaccuggagagaaagugcgccaugcuggaguacaccaccggcagcagagaggugguggacgagggccugauccccggcgacggccugggcgccgccggccuggacagcagcuucuacggccaccugaagagaaacuggaucuggaccagcuacaucaucaaccaggccaagaaggagaacaccgccgccgagaacggccugaccgugagacugcagaccuuccugagcaagagacccaugccccugagcgccagaggcaacagcagacugaacaucuggggcgaggccagagugggcagcgagcugugcgccggcugggaggagcaguucgagguggacagagagcccagccuggacagaaacagaagagugagaggcggcaagagccagaagagaaagagacugaagaaggaccccggcaagaagaucaagagaaagaagaagggcgaguuccccggcgagaagagcaagagacugagauaccacgacgaggccgaccagagcgcccugcagagaaugaccagacugagagugaccuggagcaugcaggaggacggccugcuggugcugugcagaaucgccagcaacgugcugaacaccaaggugaagggccccuucgugaccuggcagguggugagagacauccugcacgccaccuucgaggagagccuggacaagaccagccacagcgugggcagaagagccagauacaucgugaagaacccccaggccuaccugaacuacaaggugugccuggccgagguguaccaggacaaggcccuggugggcgacuucaugaacagaagaggcgacuacgacgaccccaaggugugcgccaacgaguucaaggaguucguggagaagcugaaggagaaguucagcagcgcccugagaaacagcaaccuggagauccccgacacccugcaggagcuguucgccagauacagagugcuggccaucggcgacgagaaggaccagaccagaaaggaggacgagcugaacagcguggacgacauccacuuccuggugcugcagaaccugauccagagcacccuggcccugagcgacagccagaugaagagcuaccagagcuuccagaccuucagacuguacagagaguacaaggaccacgugcuggugaaggccuucauggagugccagaagagaagccuggugaacagaagaagagugaaccacacccugggccccaagaagaacagagcccugcccuucgugcccaugagcuaccagcugagccagaccuacuacagaaucuucaccuggagauuccccagcaccaucugcaccgagagcuuccaguuccuggacagaaugagagccgccggcaagcuggaccagcccgacagauucagcuucaaggaccaggacaacaacgagcccaccaacgacaugguggccuucagccuggacggccccggcggcaacugcguggccgugcugacccuguucagccugggccugaucagcguggacgugagaauccccgagcagaucaucgugguggacagcagcaugguggagaacgaggugaucaagagccugggcaaggacggcagccuggaggacgacgaggacgaggaggacgaccuggacgagggcgugggcggcaagagaagaagcauggaggugaagcccgcccaggccagccacaccaacuaccugcugaugagaggcuacuacagccccggcaucgugagcaccagaaaccugaaccccaacgacagcaucguggugaacagcugccagaugaaguuccagcugagaugcacccccgugcccgccagacugagacccgccgccgccccccuggaggagcugaccaugggcaccagcugccugcccgacaccuucaccaagcugaucaacccccaggagaacaccugcagccuggaggaguucgugcugcagcuggagcugagcggcuacagccccgaggaccugaccgccgcccuggagauccuggaggccaucaucgccaccggcugcuucggcaucgacaaggaggagcugagaagaagauucagcgcccuggagaaggccggcggcggcagaaccagaaccuucgccgacugcauccaggcccugcuggagcagcaccaggugcuggaggugggcggcaacaccgccagacugguggccaugggcagcgccuggcccuggcugcugcacagcgugagacugaaggacagagaggacgccgacauccagagagaggacccccaggccagaccccuggagggcagcagcagcgaggacagcccccccgagggccaggccccccccagccacagccccagaggcaccaagagaagagccagcugggccagcgagaacggcgagaccgacgccgagggcacccagaugacccccgccaagagacccgcccugcaggacagcaaccuggcccccagccugggccccggcgccgaggacggcgccgaggcccaggcccccagccccccccccgcccuggaggacaccgccgccgccggcgccgcccaggaggaccaggagggcgugggcgaguucagcagccccggccaggagcagcugagcggccaggcccagccccccgagggcagcgaggaccccagaggcuucaccgagagcuucggcgccgccaacaucagccaggccgccagagagagagacugcgagagcgugugcuucaucggcagacccuggagagugguggacggccaccugaaccugcccgugugcaagggcaugauggaggccaugcuguaccacaucaugaccagacccggcauccccgagagcagccugcugagacacuaccagggcgugcugcagcccguggccgugcuggagcugcugcagggccuggagagccugggcugcaucagaaagagauggcugagaaagcccagacccgugagccuguucagcacccccgugguggaggagguggaggugcccagcagccuggacgagagccccauggccuucuacgagcccacccuggacugcacccugagacugggcagaguguucccccacgaggugaacuggaacaaguggauccaccuguaa

SEQ ID NO: 17861 - RNA, 2010 nt, Artificial Sequence
  GTPBP1__Homo_sapiens__NP_004277
auggccaccgagagaagcagaagcgccauggacagccccgugcccgccagcauguucgcccccgagcccagcagccccggcgccgccagagccgccgccgccgccgccagacugcacggcggcuucgacagcgacugcagcgaggacggcgaggcccugaacggcgagcccgagcuggaccugaccagcaagcuggugcuggugagccccaccagcgagcaguacgacagccugcugagacagaugugggagagaauggacgagggcugcggcgagaccaucuacgugaucggccagggcagcgacggcaccgaguacggccugagcgaggccgacauggaggccagcuacgccaccgugaagagcauggccgagcagaucgaggccgacgugauccugcugagagagagacaggaggccggcggcagagugagagacuaccuggugagaaagagagugggcgacaacgacuuccuggaggugagaguggccguggugggcaacguggacgccggcaagagcacccugcugggcgugcugacccacggcgagcuggacaacggcagaggcuucgccagacagaagcuguucagacacaagcacgagaucgagagcggcagaaccagcagcgugggcaacgacauccugggcuucgacagcgagggcaacguggugaacaagcccgacagccacggcggcagccuggaguggaccaagaucugcgagaagagcaccaaggugaucaccuucaucgaccuggccggccacgagaaguaccugaagaccaccguguucggcaugaccggccaccugcccgacuucugcaugcugauggugggcagcaacgccggcaucgugggcaugaccaaggagcaccugggccuggcccuggcccugaacgugcccguguucgugguggugaccaagaucgacaugugccccgccaacauccugcaggagacccugaagcugcugcagagacugcugaagagccccggcugcagaaagauccccgugcuggugcagagcaaggacgacgugaucgugaccgccagcaacuucagcagcgagagaaugugccccaucuuccagaucagcaacgugaccggcgagaaccuggaccugcugaagauguuccugaaccugcugagccccagaaccagcuacagagaggaggagcccgccgaguuccagaucgacgacaccuacagcgugcccggcgugggcaccguggugagcggcaccacccugagaggccugaucaagcugaacgacacccugcugcugggccccgacccccugggcaacuuccugagcaucgccgugaagagcauccacagaaagagaaugcccgugaaggaggugagaggcggccagaccgccagcuucgcccugaagaagaucaagagaagcagcaucagaaagggcauggugauggugagccccagacugaacccccaggccagcugggaguucgaggccgagauccuggugcugcaccaccccaccaccaucagccccagauaccaggccauggugcacugcggcagcaucagacagaccgccaccauccugagcauggacaaggacugccugagaaccggcgacaaggccaccgugcacuucagauucaucaagacccccgaguaccugcacaucgaccagagacugguguucagagagggcagaaccaaggccgugggcaccaucaccaagcugcugcagaccaccaacaacagccccaugaacagcaagccccagcagaucaagaugcagagcaccaagaagggcccccugaccaagagagacgagggcggccccagcggcggccccgccgugggcgcccccccccccggcgacgaggccagcagcgugggcgccggccagcccgccgccagcagcaaccugcagccccagcccaagcccagcagcggcggcagaagaagaggcggccagagacacaaggugaagagccagggcgccugcgugacccccgccagcggcugcuaa

SEQ ID NO: 17862 - RNA, 1416 nt, Artificial Sequence
  GTPBP3__Homo_sapiens__NP_001122327
auguggagaggccuguggacccuggccgcccaggccgccagaggccccagaagacugugcaccagaagaagcagcggcgcccccgcccccggcagcggcgccaccaucuucgcccugagcagcggccagggcagaugcggcaucgccgugaucagaaccagcggccccgccagcggccacgcccugagaauccugaccgcccccagagaccugccccuggccagacacgccagccugagacugcugagcgaccccagaagcggcgagccccuggacagagcccuggugcugugguuccccggcccccagagcuucaccggcgaggacugcguggaguuccacgugcacggcggccccgccguggugagcggcgugcugcaggcccugggcagcgugcccggccugagacccgccgaggccggcgaguucaccagaagagccuucgccaacggcaagcugaaccugaccgagguggagggccuggccgaccugauccacgccgagaccgaggcccagagaagacaggcccugagacagcuggacggcgagcugggccaccugugcagaggcugggccgagacccugaccaaggcccuggcccacguggaggccuacaucgacuucggcgaggacgacaaccuggaggagggcgugcuggagcaggccgacaucgaggugagagcccugcagguggcccugggcgcccaccugagagacgccagaagaggccagagacugagaagcggcgugcacgugguggugaccggcccccccaacgccggcaagagcagccuggugaaccugcugagcagaaagcccgugagcaucgugagccccgagcccggcaccaccagagacgugcuggagacccccguggaccuggccggcuuccccgugcugcugagcgacaccgccggccugagagagggcgugggccccguggagcaggagggcgugagaagagccagagagagcugcaacuuccuggccaccgugguggccagcgugggcgcccagagccccagcgacagcagccagagacugcugcuggugcugaacaagagcgaccugcugagccccgagggccccggccccggccccgaccugcccccccaccugcugcugagcugccugaccggcgagggccuggacggccugcuggaggcccugagaaaggagcuggccgccgugugcggcgaccccagcaccgaccccccccugcugaccagagccagacaccagcaccaccugcagggcugccuggacgcccugggccacuacaagcagagcaaggaccuggcccuggccgccgaggcccugagaguggccagaggccaccugaccagacugaccggcggcggcggcaccgaggagauccuggacaucaucuuccaggacuucugcgugggcaaguaa

SEQ ID NO: 17863 - RNA, 1905 nt, Artificial Sequence
  GTPBP4__Homo_sapiens__NP_036473
auggcccacuacaacuucaagaagaucaccguggugcccagcgccaaggacuucaucgaccugacccugagcaagacccagagaaagacccccaccgugauccacaagcacuaccagauccacagaaucagacacuucuacaugagaaaggugaaguucacccagcagaacuaccacgacagacugagccagauccugaccgacuuccccaagcuggacgacauccaccccuucuacgccgaccugaugaacauccuguacgacaaggaccacuacaagcuggcccugggccagaucaacaucgccaagaaccugguggacaacguggccaaggacuacgugagacugaugaaguacggcgacagccuguacagaugcaagcagcugaagagagccgcccugggcagaaugugcaccgugaucaagagacagaagcagagccuggaguaccuggagcaggugagacagcaccugagcagacugcccaccaucgaccccaacaccagaacccugcugcugugcggcuaccccaacgugggcaagagcagcuucaucaacaaggugaccagagccgacguggacgugcagcccuacgccuucaccaccaagagccuguucgugggccacauggacuacaaguaccugagauggcaggugguggacacccccggcauccuggaccacccccuggaggacagaaacaccaucgagaugcaggccaucaccgcccuggcccaccugagagccgccgugcuguacgugauggaccugagcgagcagugcggccacggccugagagagcagcuggagcuguuccagaacaucagaccccuguucaucaacaagccccugaucgugguggccaacaagugcgacgugaagagaaucgccgagcugagcgaggacgaccagaagaucuucaccgaccugcagagcgagggcuuccccgugaucgagaccagcacccugaccgaggagggcgugaucaaggugaagaccgaggccugcgacagacugcuggcccacagaguggagaccaagaugaagggcaacaaggugaacgaggugcugaacagacugcaccuggccauccccaccagaagagacgacaaggagagaccccccuucauccccgagggcgugguggccagaagaaagagaauggagaccgaggagagcagaaagaagagagagagagaccuggagcuggagaugggcgacgacuacauccuggaccugcagaaguacugggaccugaugaaccugagcgagaagcacgacaagauccccgagaucugggagggccacaacaucgccgacuacaucgaccccgccaucaugaagaagcuggaggagcuggagaaggaggaggagcugagaaccgccgccggcgaguacgacagcgugagcgagagcgaggacgaggagaugcuggagaucagacagcuggccaagcagaucagagagaagaagaagcugaagauccuggagagcaaggagaagaacacccagggccccagaaugcccagaaccgccaagaaggugcagagaaccgugcuggagaaggagaugagaagccugggcguggacauggacgacaaggacgacgcccacuacgccgugcaggccagaagaagcagaagcaucaccagaaagagaaagagagaggacagcgccccccccagcagcguggccagaagcggcagcugcagcagaacccccagagacgugagcggccugagagacgugaagauggugaagaaggccaagaccaugaugaagaacgcccagaagaagaugaacagacugggcaagaagggcgaggccgacagacacguguucgacaugaagcccaagcaccugcugagcggcaagagaaaggccggcaagaaggacagaagauaa

SEQ ID NO: 17864 - RNA, 504 nt, Artificial Sequence
  GTSF1__Homo_sapiens__NP_653195
auggaggagaccuacaccgacagccuggaccccgagaagcugcugcagugccccuacgacaagaaccaccagaucagagccugcagauuccccuaccaccugaucaagugcagaaagaaccaccccgacguggccagcaagcuggccaccugccccuucaacgccagacaccaggugcccagagccgagaucagccaccacaucagcagcugcgacgacagaagcugcaucgagcaggacguggugaaccagaccagaagccugagacaggagacccuggccgagagcaccuggcagugcccccccugcgacgaggacugggacaaggaccugugggagcagaccagcacccccuucguguggggcaccacccacuacagcgacaacaacagccccgccagcaacaucgugaccgagcacaagaacaaccuggccagcggcaugagagugcccaagagccugcccuacgugcugcccuggaagaacaacggcaacgcccaguaa

SEQ ID NO: 17865 - RNA, 606 nt, Artificial Sequence
  GUCA1A__Homo_sapiens__NP_000400
augggcaacgugauggagggcaagagcguggaggagcugagcagcaccgagugccaccagugguacaagaaguucaugaccgagugccccagcggccagcugacccuguacgaguucagacaguucuucggccugaagaaccugagccccagcgccagccaguacguggagcagauguucgagaccuucgacuucaacaaggacggcuacaucgacuucauggaguacguggccgcccugagccuggugcugaagggcaagguggagcagaagcugagaugguacuucaagcuguacgacguggacggcaacggcugcaucgacagagacgagcugcugaccaucauccaggccaucagagccaucaaccccugcagcgacaccaccaugaccgccgaggaguucaccgacaccguguucagcaagaucgacgugaacggcgacggcgagcugagccuggaggaguucaucgagggcgugcagaaggaccagaugcugcuggacacccugaccagaagccuggaccugaccagaaucgugagaagacugcagaacggcgagcaggacgaggagggcgccgacgaggccgccgaggccgccggcuaa

SEQ ID NO: 17866 - RNA, 603 nt, Artificial Sequence
  GUCA1B__Homo_sapiens__NP_002089
augggccaggaguucagcugggaggaggccgaggccgccggcgagaucgacguggccgagcugcaggagugguacaagaaguucgugauggagugccccagcggcacccuguucaugcacgaguucaagagauucuucaaggugaccgacgacgaggaggccagccaguacguggagggcauguucagagccuucgacaagaacggcgacaacaccaucgacuuccuggaguacguggccgcccugaaccuggugcugagaggcacccuggagcacaagcugaaguggaccuucaagaucuacgacaaggacggcaacggcugcaucgacagacuggagcugcugaacaucguggagggcaucuaccagcugaagaaggccugcagaagagagcugcagaccgagcagggccagcugcugacccccgaggaggugguggacagaaucuuccugcugguggacgagaacggcgacggccagcugagccugaacgaguucguggagggcgccagaagagacaagugggugaugaagaugcugcagauggacaugaaccccagcagcuggcuggcccagcagagaagaaagagcgccauguucuaa

SEQ ID NO: 17867 - RNA, 720 nt, Artificial Sequence
  GUCD1__Homo_sapiens__NP_001271183
augagaaccgaggccgaggccgccggccccccccuggagcccggcgacuucgugcagcugcccgugcccgugauccagcagcuguaccacugggacugcggccuggccugcagcagaauggugcugagauaccugggccagcuggacgacagcgaguucgagagagcccugcagaagcugcagcugaccagaagcaucuggaccaucgaccuggccuaccugaugcaccacuucggcgugagacacagauucugcacccagacccugggcguggacaagggcuacaagaaccagagcuucuacagaaagcacuucgacaccgaggagaccagagugaaccagcuguucgcccaggccaaggccugcaaggugcugguggagaagugcaccgugagcgugaaggacauccaggcccaccuggcccagggccacguggccaucgugcuggugaacagcggcgugcugcacugcgaccugugcagcagccccgugaaguacugcugcuucacccccagcggccaccacugcuucugcagaacccccgacuaccagggccacuucaucgugcugagaggcuacaacagagccaccggcugcaucuucuacaacaaccccgccuacgccgacagaaugugcagcaccagcaucagcaacuucgaggaggccagaaccagcuacggcaccgacgaggacauccuguucguguaccuggacagcuaa

SEQ ID NO: 17868 - RNA, 2199 nt, Artificial Sequence
  GUCY1A2__Homo_sapiens__NP_000846
augagcagaagaaagaucagcagcgagagcuucagcagccugggcagcgacuaccuggagaccagccccgaggaggagggcgagugcccccugagcagacugugcuggaacggcagcagaagcccccccggcccccuggagcccagccccgccgccgccgccgccgccgccgcccccgcccccacccccgccgccagcgccgccgccgccgccgccaccgccggcgccagaagagugcagagaagaagaagagugaaccuggacagccugggcgagagcaucagcagacugaccgcccccagcccccagaccauccagcagacccugaagagaacccugcaguacuacgagcaccaggugaucggcuacagagacgccgagaagaacuuccacaacaucagcaacagaugcagcuacgccgaccacagcaacaaggaggagaucgaggacgugagcggcauccugcagugcaccgccaacauccugggccugaaguucgaggagauccagaagagauucggcgaggaguucuucaacaucugcuuccacgagaacgagagagugcugagagccgugggcggcacccugcaggacuucuucaacggcuucgacgcccugcuggagcacaucagaaccagcuucggcaagcaggccacccuggagagccccagcuuccugugcaaggagcugcccgagggcacccugaugcugcacuacuuccacccccaccacaucgugggcuucgccaugcugggcaugaucaaggccgccggcaagaagaucuacagacuggacguggagguggagcagguggccaacgagaagcugugcagcgacgugagcaaccccggcaacugcagcugccugaccuuccugaucaaggagugcgagaacaccaacaucaugaagaaccugccccagggcaccagccaggugcccgccgaccugagaaucagcaucaacaccuucugcagagccuuccccuuccaccugauguucgaccccagcaugagcgugcugcagcugggcgagggccugagaaagcagcugagaugcgacacccacaaggugcugaaguucgaggacugcuucgagaucgugagccccaaggugaacgccaccuucgagagagugcugcugagacugagcacccccuucgugaucagaaccaagcccgaggccagcggcagcgagaacaaggacaaggugauggaggugaagggccagaugauccacgugcccgagagcaacagcauccuguuccugggcagccccugcguggacaagcuggacgagcugaugggcagaggccugcaccugagcgacauccccauccacgacgccaccagagacgugauccuggugggcgagcaggccaaggcccaggacggccugaagaagagaauggacaagcugaaggccacccuggagagaacccaccaggcccuggaggaggagaagaagaagaccguggaccugcuguacagcaucuuccccggcgacguggcccagcagcuguggcagggccagcaggugcaggccagaaaguucgacgacgugaccaugcuguucagcgacaucgugggcuucaccgccaucugcgcccagugcacccccaugcaggugaucagcaugcugaacgagcuguacaccagauucgaccaccagugcggcuuccuggacaucuacaagguggagaccaucggcgacgccuacugcguggccgccggccugcacagaaagagccugugccacgccaagcccaucgcccugauggcccugaagaugauggagcugagcgaggaggugcugacccccgacggcagacccauccagaugagaaucggcauccacagcggcagcgugcuggccggcguggugggcgugagaaugcccagauacugccuguucggcaacaacgugacccuggccagcaaguucgagagcggcagccaccccagaagaaucaacgugagccccaccaccuaccagcugcugaagagagaggagagcuucaccuucauccccagaagcagagaggagcugcccgacaacuuccccaaggagauccccggcaucugcuacuuccuggaggugagaaccggccccaagccccccaagcccagccugagcagcagcagaaucaagaaggugagcuacaacaucggcaccauguuccugagagagaccagccuguaa

SEQ ID NO: 17869 - RNA, 1368 nt, Artificial Sequence
  GUCY1A3__Homo_sapiens__NP_001124157
augccccccugcuuccacaacgacugcagcgaguucgugaaccagcccuaccugcuguacagcgugcacaugaagagcaccaagcccagccugagccccagcaagccccagagcagccuggugauccccaccagccuguucugcaagaccuuccccuuccacuucauguucgacaaggacaugaccauccugcaguucggcaacggcaucagaagacugaugaacagaagagacuuccagggcaagcccaacuucgaggaguacuucgagauccugacccccaagaucaaccagaccuucagcggcaucaugaccaugcugaacaugcaguucguggugagagugagaagaugggacaacagcgugaagaagagcagcagagugauggaccugaagggccagaugaucuacaucguggagagcagcgccauccuguuccugggcagccccugcguggacagacuggaggacuucaccggcagaggccuguaccugagcgacauccccauccacaacgcccugagagacguggugcugaucggcgagcaggccagagcccaggacggccugaagaagagacugggcaagcugaaggccacccuggagcaggcccaccaggcccuggaggaggagaagaagaagaccguggaccugcugugcagcaucuuccccugcgagguggcccagcagcuguggcagggccagguggugcaggccaagaaguucagcaacgugaccaugcuguucagcgacaucgugggcuucaccgccaucugcagccagugcagcccccugcaggugaucaccaugcugaacgcccuguacaccagauucgaccagcagugcggcgagcuggacguguacaagguggagaccaucggcgacgccuacugcguggccggcggccugcacaaggagagcgacacccacgccgugcagaucgcccugauggcccugaagaugauggagcugagcgacgaggugaugagcccccacggcgagcccaucaagaugagaaucggccugcacagcggcagcguguucgccggcguggugggcgugaagaugcccagauacugccuguucggcaacaacgugacccuggccaacaaguucgagagcugcagcgugcccagaaagaucaacgugagccccaccaccuacagacugcugaaggacugccccggcuucguguucacccccagaagcagagaggagcugccccccaacuuccccagcgagauccccggcaucugccacuuccuggacgccuaccagcagggcaccaacagcaagcccugcuuccagaagaaggacguggaggacggcaacgccaacuuccugggcaaggccagcggcaucgacuaa

SEQ ID NO: 17870 - RNA, 1860 nt, Artificial Sequence
  GUCY1B3__Homo_sapiens__NP_000848
auguacggcuucgugaaccacgcccuggagcugcuggugaucagaaacuacggccccgaggugugggaggacaucaagaaggaggcccagcuggacgaggagggccaguuccuggugagaaucaucuacgacgacagcaagaccuacgaccugguggccgccgccagcaaggugcugaaccugaacgccggcgagauccugcagauguucggcaagauguucuucguguucugccaggagagcggcuacgacaccauccugagagugcugggcagcaacgugagagaguuccugcagaaccuggacgcccugcacgaccaccuggccaccaucuaccccggcaugagagcccccagcuucagaugcaccgacgccgagaagggcaagggccugauccugcacuacuacagcgagagagagggccugcaggacaucgugaucggcaucaucaagaccguggcccagcagauccacggcaccgagaucgacaugaaggugauccagcagagaaacgaggagugcgaccacacccaguuccugaucgaggagaaggagagcaaggaggaggacuucuacgaggaccuggacagauucgaggagaacggcacccaggagagcagaaucagccccuacaccuucugcaaggccuuccccuuccacaucaucuucgacagagaccugguggugacccagugcggcaacgccaucuacagagugcugccccagcugcagcccggcaacugcagccugcugagcguguucagccuggugagaccccacaucgacaucagcuuccacggcauccugagccacaucaacaccguguucgugcugagaagcaaggagggccugcuggacguggagaagcuggagugcgaggacgagcugaccggcaccgagaucagcugccugagacugaagggccagaugaucuaccugcccgaggccgacagcauccuguuccugugcagccccagcgugaugaaccuggacgaccugaccagaagaggccuguaccugagcgacaucccccugcacgacgccaccagagaccuggugcugcugggcgagcaguucagagaggaguacaagcugacccaggagcuggagauccugaccgacagacugcagcugacccugagagcccuggaggacgagaagaagaagaccgacacccugcuguacagcgugcugccccccagcguggccaacgagcugagacacaagagacccgugcccgccaagagauacgacaacgugaccauccuguucagcggcaucgugggcuucaacgccuucugcagcaagcacgccagcggcgagggcgccaugaagaucgugaaccugcugaacgaccuguacaccagauucgacacccugaccgacagcagaaagaaccccuucguguacaagguggagaccgugggcgacaaguacaugaccgugagcggccugcccgagcccugcauccaccacgccagaagcaucugccaccuggcccuggacaugauggagaucgccggccaggugcagguggacggcgagagcgugcagaucaccaucggcauccacaccggcgagguggugaccggcgugaucggccagagaaugcccagauacugccuguucggcaacaccgugaaccugaccagcagaaccgagaccaccggcgagaagggcaagaucaacgugagcgaguacaccuacagaugccugaugagccccgagaacagcgacccccaguuccaccuggagcacagaggccccgugagcaugaagggcaagaaggagcccaugcaggugugguuccugagcagaaagaacaccggcaccgaggagaccaagcaggacgacgacuaa

SEQ ID NO: 17871 - RNA, 3222 nt, Artificial Sequence
  GUCY2C__Homo_sapiens__NP_004954
augaagacccugcugcuggaccuggcccuguggagccugcuguuccagcccggcuggcugagcuucagcagccaggugagccagaacugccacaacggcagcuacgagaucagcgugcugaugaugggcaacagcgccuucgccgagccccugaagaaccuggaggacgccgugaacgagggccuggagaucgugagaggcagacugcagaacgccggccugaacgugaccgugaacgccaccuucauguacagcgacggccugauccacaacagcggcgacugcagaagcagcaccugcgagggccuggaccugcugagaaagaucagcaacgcccagagaaugggcugcgugcugaucggccccagcugcaccuacagcaccuuccagauguaccuggacaccgagcugagcuaccccaugaucagcgccggcagcuucggccugagcugcgacuacaaggagacccugaccagacugaugagccccgccagaaagcugauguacuuccuggugaacuucuggaagaccaacgaccugcccuucaagaccuacagcuggagcaccagcuacguguacaagaacggcaccgagaccgaggacugcuucugguaccugaacgcccuggaggccagcgugagcuacuucagccacgagcugggcuucaagguggugcugagacaggacaaggaguuccaggacauccugauggaccacaacagaaagagcaacgugaucaucaugugcggcggccccgaguuccuguacaagcugaagggcgacagagccguggccgaggacaucgugaucauccugguggaccuguucaacgaccaguacuucgaggacaacgugaccgcccccgacuacaugaagaacgugcuggugcugacccugagccccggcaacagccugcugaacagcagcuucagcagaaaccugagccccaccaagagagacuucgcccuggccuaccugaacggcauccugcuguucggccacaugcugaagaucuuccuggagaacggcgagaacaucaccacccccaaguucgcccacgccuucagaaaccugaccuucgagggcuacgacggccccgugacccuggacgacuggggcgacguggacagcaccauggugcugcuguacaccagcguggacaccaagaaguacaaggugcugcugaccuacgacacccacgugaacaagaccuaccccguggacaugagccccaccuucaccuggaagaacagcaagcugcccaacgacaucaccggcagaggcccccagauccugaugaucgccguguucacccugaccggcgccguggugcugcugcugcugguggcccugcugaugcugagaaaguacagaaaggacuacgagcugagacagaagaaguggagccacaucccccccgagaacaucuucccccuggagaccaacgagaccaaccacgugagccugaagaucgacgacgacaagagaagagacaccauccagagacugagacagugcaaguacgacaagaagagagugauccugaaggaccugaagcacaacgacggcaacuucaccgagaagcagaagaucgagcugaacaagcugcugcagaucgacuacuacaaccugaccaaguucuacggcaccgugaagcuggacaccaugaucuucggcgugaucgaguacugcgagagaggcagccugagagaggugcugaacgacaccaucagcuaccccgacggcaccuucauggacugggaguucaagaucagcgugcuguacgacaucgccaagggcaugagcuaccugcacagcagcaagaccgaggugcacggcagacugaagagcaccaacugcgugguggacagcagaaugguggugaagaucaccgacuucggcugcaacagcauccugccccccaagaaggaccuguggaccgcccccgagcaccugagacaggccaacaucagccagaagggcgacguguacagcuacggcaucaucgcccaggagaucauccugagaaaggagaccuucuacacccugagcugcagagacagaaacgagaagaucuucagaguggagaacagcaacggcaugaagcccuucagacccgaccuguuccuggagaccgccgaggagaaggagcuggagguguaccugcuggugaagaacugcugggaggaggaccccgagaagagacccgacuucaagaagaucgagaccacccuggccaagaucuucggccuguuccacgaccagaagaacgagagcuacauggacacccugaucagaagacugcagcuguacagcagaaaccuggagcaccugguggaggagagaacccagcuguacaaggccgagagagacagagccgacagacugaacuucaugcugcugcccagacugguggugaagagccugaaggagaagggcuucguggagcccgagcuguacgaggaggugaccaucuacuucagcgacaucgugggcuucaccaccaucugcaaguacagcacccccauggaggugguggacaugcugaacgacaucuacaagagcuucgaccacaucguggaccaccacgacguguacaagguggagaccaucggcgacgccuacaugguggccagcggccugcccaagagaaacggcaacagacacgccaucgacaucgccaagauggcccuggagauccugagcuucaugggcaccuucgagcuggagcaccugcccggccugcccaucuggaucagaaucggcgugcacagcggccccugcgccgccggcguggugggcaucaagaugcccagauacugccuguucggcgacaccgugaacaccgccagcagaauggagagcaccggccugccccugagaauccacgugagcggcagcaccaucgccauccugaagagaaccgagugccaguuccuguacgaggugagaggcgagaccuaccugaagggcagaggcaacgagaccaccuacuggcugaccggcaugaaggaccagaaguucaaccugcccaccccccccaccguggagaaccagcagagacugcaggccgaguucagcgacaugaucgccaacagccugcagaagagacaggccgccggcaucagaagccagaagcccagaagaguggccagcuacaagaagggcacccuggaguaccugcagcugaacaccaccgacaaggagagcaccuacuucuaa

SEQ ID NO: 17872 - RNA, 3312 nt, Artificial Sequence
  GUCY2D__Homo_sapiens__NP_000171
augaccgccugcgccagaagagccggcggccugcccgaccccggccugugcggccccgccuggugggcccccagccugcccagacugcccagagcccugcccagacugccccugcugcugcugcugcugcugcugcagccccccgcccugagcgccguguucaccgugggcgugcugggccccugggccugcgaccccaucuucagcagagccagacccgaccuggccgccagacuggccgccgccagacugaacagagaccccggccuggccggcggccccagauucgagguggcccugcugcccgagcccugcagaacccccggcagccugggcgccgugagcagcgcccuggccagagugagcggccuggugggccccgugaaccccgccgccugcagacccgccgagcugcuggccgaggaggccggcaucgcccuggugcccuggggcugccccuggacccaggccgagggcaccaccgcccccgccgugacccccgccgccgacgcccuguacgcccugcugagagccuucggcugggccagaguggcccuggugaccgccccccaggaccuguggguggaggccggcagaagccugagcaccgcccugagagccagaggccugcccguggccagcgugaccagcauggagccccuggaccugagcggcgccagagaggcccugagaaaggugagagacggccccagagugaccgccgugaucauggugaugcacagcgugcugcugggcggcgaggagcagagauaccugcuggaggccgccgaggagcugggccugaccgacggcagccugguguuccugcccuucgacaccauccacuacgcccugagccccggccccgaggcccuggccgcccuggccaacagcagccagcugagaagagcccacgacgccgugcugacccugaccagacacugccccagcgagggcagcgugcuggacagccugagaagagcccaggagagaagagagcugcccagcgaccugaaccugcagcaggugagcccccuguucggcaccaucuacgacgccguguuccugcuggccagaggcguggccgaggccagagccgccgccggcggcagaugggugagcggcgccgccguggccagacacaucagagacgcccaggugcccggcuucugcggcgaccugggcggcgacgaggagccccccuucgugcugcuggacaccgacgccgccggcgacagacuguucgccaccuacaugcuggaccccgccagaggcagcuuccugagcgccggcaccagaaugcacuuccccagaggcggcagcgcccccggccccgaccccagcugcugguucgaccccaacaacaucugcggcggcggccuggagcccggccugguguuccugggcuuccugcugguggugggcaugggccuggccggcgccuuccuggcccacuacgugagacacagacugcugcacaugcagauggugagcggccccaacaagaucauccugaccguggacgacaucaccuuccugcacccccacggcggcaccagcagaaagguggcccagggcagcagaagcagccugggcgccagaagcaugagcgacaucagaagcggccccagccagcaccuggacagccccaacaucggcguguacgagggcgacagaguguggcugaagaaguuccccggcgaccagcacaucgccaucagacccgccaccaagaccgccuucagcaagcugcaggagcugagacacgagaacguggcccuguaccugggccuguuccuggccagaggcgccgagggccccgccgcccugugggagggcaaccuggccguggugagcgagcacugcaccagaggcagccugcaggaccugcuggcccagagagagaucaagcuggacuggauguucaagagcagccugcugcuggaccugaucaagggcaucagauaccugcaccacagaggcguggcccacggcagacugaagagcagaaacugcaucguggacggcagauucgugcugaagaucaccgaccacggccacggcagacugcuggaggcccagaaggugcugcccgagccccccagagccgaggaccagcuguggaccgcccccgagcugcugagagaccccgcccuggagagaagaggcacccuggccggcgacguguucagccuggccaucaucaugcaggagguggugugcagaagcgcccccuacgccaugcuggagcugacccccgaggagguggugcagagagugagaagcccccccccccugugcagaccccuggugagcauggaccaggcccccguggagugcauccugcugaugaagcagugcugggccgagcagcccgagcugagacccagcauggaccacaccuucgaccuguucaagaacaucaacaagggcagaaagaccaacaucaucgacagcaugcugagaaugcuggagcaguacagcagcaaccuggaggaccugaucagagagagaaccgaggagcuggagcuggagaagcagaagaccgacagacugcugacccagaugcugccccccagcguggccgaggcccugaagaccggcacccccguggagcccgaguacuucgagcaggugacccuguacuucagcgacaucgugggcuucaccaccaucagcgccaugagcgagcccaucgaggugguggaccugcugaacgaccuguacacccuguucgacgccaucaucggcagccacgacguguacaagguggagaccaucggcgacgccuacaugguggccagcggccugccccagagaaacggccagagacacgccgccgagaucgccaacaugagccuggacauccugagcgccgugggcaccuucagaaugagacacaugcccgaggugcccgugagaaucagaaucggccugcacagcggccccugcguggccggcguggugggccugaccaugcccagauacugccuguucggcgacaccgugaacaccgccagcagaauggagagcaccggccugcccuacagaauccacgugaaccugagcaccgugggcauccugagagcccuggacagcggcuaccagguggagcugagaggcagaaccgagcugaagggcaagggcgccgaggacaccuucuggcuggugggcagaagaggcuucaacaagcccauccccaagccccccgaccugcagcccggcagcagcaaccacggcaucagccugcaggagaucccccccgagagaagaagaaagcuggagaaggccagacccggccaguucagcuaa

SEQ ID NO: 17873 - RNA, 3327 nt, Artificial Sequence
  GUCY2F__Homo_sapiens__NP_001513
auguuccugggccugggcagauucagcagacuggugcugugguucgccgccuucagaaagcugcugggccaccacggccuggccagcgccaaguuccuguggugccugugccugcugagcgugaugagccugccccagcagguguggacccugcccuacaagaucggcguggugggccccugggccugcgacagccuguucagcaaggcccugcccgagguggccgccagacuggccaucgagagaaucaacagagaccccagcuucgaccugagcuacagcuucgaguacgugauccugaacgaggacugccagaccagcagagcccugagcagcuucaucagccaccaccagauggccagcggcuucaucggccccaccaaccccggcuacugcgaggccgccagccugcugggcaacagcugggacaagggcaucuucagcugggccugcgugaacuacgagcuggacaacaagaucagcuaccccaccuucagcagaacccugcccagccccaucagagugcuggugaccgugaugaaguacuuccagugggcccacgccggcgugaucagcagcgacgaggacaucugggugcacaccgccaacagaguggccagcgcccugagaagccacggccugcccgugggcguggugcugaccaccggccaggacagccagagcaugagaaaggcccugcagagaauccaccaggccgacagaaucagaaucaucaucaugugcaugcacagcgcccugaucggcggcgagacccagaugcaccugcuggagugcgcccacgaccugaagaugaccgacggcaccuacguguucgugcccuacgacgcccugcuguacagccugcccuacaagcacacccccuacagagugcugagaaacaaccccaagcugagagaggccuacgacgccgugcugaccaucaccguggagagccaggagaagaccuucuaccaggccuucaccgaggccgccgccagaggcgagauccccgagaagcuggaguucgaccaggugagcccccuguucggcaccaucuacaacagcaucuacuucaucgcccaggccaugaacaacgccaugaaggagaacggccaggccggcgccgccagccuggugcagcacagcagaaacaugcaguuccacggcuucaaccagcugaugagaaccgacagcaacggcaacggcaucagcgaguacgugauccuggacaccaaccugaaggagugggagcugcacagcaccuacaccguggacauggagauggagcugcugagauucggcggcacccccauccacuuccccggcggcagaccccccagagccgacgccaagugcugguucgccgagggcaagaucugccacggcggcaucgaccccgccuucgccaugauggugugccugacccugcugaucgcccugcugagcaucaacggcuucgccuacuucaucagaagaagaaucaacaagauccagcugaucaagggccccaacagaauccugcugacccuggaggacgugaccuucaucaacccccacuucggcagcaagagaggcagcagagccagcgugagcuuccagaucaccagcgaggugcagagcggcagaagccccagacugagcuucagcagcggcagccugacccccgccaccuacgagaacagcaacaucgccaucuacgagggcgacuggguguggcugaagaaguucagccugggcgacuucggcgaccugaagagcaucaagagcagagccagcgacguguucgagaugaugaaggaccugagacacgagaacaucaacccccugcugggcuucuucuacgacagcggcauguucgccaucgugaccgaguucugcagcagaggcagccuggaggacauccugaccaaccaggacgugaagcuggacuggauguucaagagcagccugcugcuggaccugaucaagggcaugaaguaccugcaccacagagaguucgugcacggcagacugaagagcagaaacugcgugguggacggcagauucgugcugaaggugaccgacuacggcuucaacgacauccuggagaugcugagacugagcgaggaggagagcagcauggaggagcugcuguggaccgcccccgagcugcugagagcccccagaggcagcagacugggcagcuucgccggcgacguguacagcuucgccaucaucaugcaggaggugauggugagaggcacccccuucugcaugauggaccugcccgcccaggagaucaucaacagacugaagaagcccccccccguguacagacccguggugccccccgagcacgccccccccgagugccugcagcugaugaagcagugcugggccgaggccgccgagcagagacccaccuucgacgagaucuucaaccaguucaagaccuucaacaagggcaagaagaccaacaucaucgacagcaugcugagaaugcuggagcaguacagcagcaaccuggaggaccugaucagagagagaaccgaggagcuggagaucgagaagcagaagaccgagaagcugcugacccagaugcugccccccagcguggccgagagccugaagaagggcugcaccguggagcccgagggcuucgaccuggugacccuguacuucagcgacaucgugggcuucaccaccaucagcgccaugagcgagcccaucgaggugguggaccugcugaacgaccuguacacccuguucgacgccaucaucggcagccacgacguguacaagguggagaccaucggcgacgccuacaugguggccagcggccugcccaagagaaacggcagcagacacgccgccgagaucgccaacaugagccuggacauccugagcagcgugggcaccuucaagaugagacacaugcccgaggugcccgugagaaucagaaucggccugcacagcggccccgugguggccggcguggugggccugaccaugcccagauacugccuguucggcgacaccgugaacaccgccagcagaauggagagcaccggccugcccuacagaauccacgugagccugagcaccgugaccauccugcagaaccugagcgagggcuacgagguggagcugagaggcagaaccgagcugaagggcaagggcaccgaggagaccuucuggcugaucggcaagaagggcuucaugaagccccugcccgugcccccccccguggacaaggacggccaggugggccacggccugcagcccguggagaucgccgccuuccagagaagaaaggccgagagacagcuggugagaaacaagcccuaa

SEQ ID NO: 17874 - RNA, 657 nt, Artificial Sequence
  GUK1__Homo_sapiens__NP_001152862
augcugagaagaccccuggccggccuggccgccgccgcccugggcagagccccccccgacggcaugagcggccccagacccguggugcugagcggccccagcggcgccggcaagagcacccugcugaagagacugcugcaggagcacagcggcaucuucggcuucagcgugagccacaccaccagaaaccccagacccggcgaggagaacggcaaggacuacuacuucgugaccagagaggugaugcagagagacaucgccgccggcgacuucaucgagcacgccgaguucagcggcaaccuguacggcaccagcaagguggccgugcaggccgugcaggccaugaacagaaucugcgugcuggacguggaccugcagggcgugagaaacaucaaggccaccgaccugagacccaucuacaucagcgugcagccccccagccugcacgugcuggagcagagacugagacagagaaacaccgagaccgaggagagccuggugaagagacuggccgccgcccaggccgacauggagagcagcaaggagcccggccuguucgacguggugaucaucaacgacagccuggaccaggccuacgccgagcugaaggaggcccugagcgaggagaucaagaaggcccagagaaccggcgccuaa

SEQ ID NO: 17875 - RNA, 876 nt, Artificial Sequence
  GULP1__Homo_sapiens__NP_001239597
augaacagagccuucagcagaaagaaggacaagaccuggaugcacacccccgaggcccugagcaagcacuucauccccuacaacgccaaguuccugggcagcaccgagguggagcagcccaagggcaccgagguggugagagacgccgugagaaagcugaaguucgccagacacaucaagaagagcgagggccagaagauccccaagguggagcugcagaucagcaucuacggcgugaagauccuggagcccaagaccaaggaggugcagcacaacugccagcugcacagaaucagcuucugcgccgacgacaagaccgacaagagaaucuucaccuucaucugcaaggacagcgagagcaacaagcaccugugcuacguguucgacagcgagaagugcgccgaggagaucacccugaccaucggccaggccuucgaccuggccuacagaaaguuccuggagagcggcggcaaggacguggagaccagaaagcagaucgccggccugcagaagagaauccaggaccuggagaccgagaacauggagcugaagaacaaggugcaggaccuggagaaccagcugagaaucacccaggugagcgccccccccgccggcagcaugacccccaagagccccagcaccgacaucuucgacaugauccccuucagccccaucagccaccagagcagcaugcccaccagaaacggcacccagcccccccccgugcccagcagaagcaccgagaucaagagagaccuguucggcgccgagcccuucgaccccuucaacugcggcgccgccgacuucccccccgacauccagagcaagcuggacgagaugcagagacagagauggagaggcagcaagugggacuaa

SEQ ID NO: 17876 - RNA, 1956 nt, Artificial Sequence
  GUSB__Homo_sapiens__NP_000172
auggccagaggcagcgccguggccugggccgcccugggcccccugcuguggggcugcgcccugggccugcagggcggcaugcuguacccccaggagagccccagcagagagugcaaggagcuggacggccuguggagcuucagagccgacuucagcgacaacagaagaagaggcuucgaggagcagugguacagaagaccccugugggagagcggccccaccguggacaugcccgugcccagcagcuucaacgacaucagccaggacuggagacugagacacuucgugggcugggugugguacgagagagaggugauccugcccgagagauggacccaggaccugagaaccagaguggugcugagaaucggcagcgcccacagcuacgccaucgugugggugaacggcguggacacccuggagcacgagggcggcuaccugcccuucgaggccgacaucagcaaccuggugcaggugggcccccugcccagcagacugagaaucaccaucgccaucaacaacacccugacccccaccacccugccccccggcaccauccaguaccugaccgacaccagcaaguaccccaagggcuacuucgugcagaacaccuacuucgacuucuucaacuacgccggccugcagagaagcgugcugcuguacaccacccccaccaccuacaucgacgacaucaccgugaccaccagcguggagcaggacagcggccuggugaacuaccagaucagcgugaagggcagcaaccuguucaagcuggaggugagacugcuggacgccgagaacaaggugguggccaacggcaccggcacccagggccagcugaaggugcccggcgugagccugugguggcccuaccugaugcacgagagacccgccuaccuguacagccuggaggugcagcugaccgcccagaccagccugggccccgugagcgacuucuacacccugcccgugggcaucagaaccguggccgugaccaagagccaguuccugaucaacggcaagcccuucuacuuccacggcgugaacaagcacgaggacgccgacaucagaggcaagggcuucgacuggccccugcuggugaaggacuucaaccugcugagauggcugggcgccaacgccuucagaaccagccacuaccccuacgccgaggaggugaugcagaugugcgacagauacggcaucguggugaucgacgagugccccggcgugggccuggcccugccccaguucuucaacaacgugagccugcaccaccacaugcaggugauggaggagguggugagaagagacaagaaccaccccgccguggugauguggagcguggccaacgagcccgccagccaccuggagagcgccggcuacuaccugaagauggugaucgcccacaccaagagccuggaccccagcagacccgugaccuucgugagcaacagcaacuacgccgccgacaagggcgcccccuacguggacgugaucugccugaacagcuacuacagcugguaccacgacuacggccaccuggagcugauccagcugcagcuggccacccaguucgagaacugguacaagaaguaccagaagcccaucauccagagcgaguacggcgccgagaccaucgccggcuuccaccaggaccccccccugauguucaccgaggaguaccagaagagccugcuggagcaguaccaccugggccuggaccagaagagaagaaaguacguggugggcgagcugaucuggaacuucgccgacuucaugaccgagcagagccccaccagagugcugggcaacaagaagggcaucuucaccagacagagacagcccaagagcgccgccuuccugcugagagagagauacuggaagaucgccaacgagaccagauacccccacagcguggccaagagccagugccuggagaacagccuguucaccuaa

SEQ ID NO: 17877 - RNA, 1002 nt, Artificial Sequence
  GYG1__Homo_sapiens__NP_001171649
augaccgaccaggccuucgugacccugaccaccaacgacgccuacgccaagggcgcccuggugcugggcagcagccugaagcagcacagaaccaccagaagacugguggugcuggccaccccccaggugagcgacagcaugagaaaggugcuggagaccguguucgacgaggugaucaugguggacgugcuggacagcggcgacagcgcccaccugacccugaugaagagacccgagcugggcgugacccugaccaagcugcacugcuggagccugacccaguacagcaagugcguguucauggacgccgacacccuggugcuggccaacaucgacgaccuguucgacagagaggagcugagcgccgcccccgaccccggcuggcccgacugcuucaacagcggcguguucguguaccagcccagcguggagaccuacaaccagcugcugcaccuggccagcgagcagggcagcuucgacggcggcgaccagggcauccugaacaccuucuucagcagcugggccaccaccgacaucagaaagcaccugcccuucaucuacaaccugagcagcaucagcaucuacagcuaccugcccgccuucaagguguucggcgccagcgccaagguggugcacuuccugggcagagugaagcccuggaacuacaccuacgaccccaagaccaagagcgugaagagcgaggcccacgaccccaacaugacccaccccgaguuccugauccugugguggaacaucuucaccaccaacgugcugccccugcugcagcaguucggccuggugaaggacaccugcagcuacgugaacguggaggacgugagcggcgccaucagccaccugagccugggcgagauccccgccauggcccagcccuucgugagcagcgaggagagaaaggagagaugggagcagggccaggccgacuacaugggcgccgacagcuucgacaacaucaagagaaagcuggacaccuaccugcaguaa

SEQ ID NO: 17878 - RNA, 1413 nt, Artificial Sequence
  GYG2__Homo_sapiens__NP_001073324
augagcgugaccgaccaggccuucgugacccuggccaccaacgacaucuacugccagggcgcccuggugcugggccagagccugagaagacacagacugaccagaaagcugguggugcugaucaccccccaggugagcagccugcugagagugauccugagcaagguguucgacgaggugaucgaggugaaccugaucgacagcgccgacuacauccaccuggccuuccugaagagacccgagcugggccugacccugaccaagcugcacugcuggacccugacccacuacagcaagugcguguuccuggacgccgacacccuggugcugagcaacguggacgagcuguucgacagaggcgaguucagcgccgcccccgaccccggcuggcccgacugcuucaacagcggcguguucguguuccagcccagccugcacacccacaagcugcugcugcagcacgccauggagcacggcagcuucgacggcgccgaccagggccugcugaacagcuucuucagaaacuggagcaccaccgacauccacaagcaccugcccuucaucuacaaccugagcagcaacaccauguacaccuacagccccgccuucaagcaguucggcagcagcgccaagguggugcacuuccugggcagcaugaagcccuggaacuacaaguacaacccccagagcggcagcgugcuggagcagggcagcgccagcagcagccagcaccaggccgccuuccugcaccugugguggaccguguaccagaacaacgugcugccccuguacaagagcgugcaggccggcgaggccagagccagccccggccacacccugugccacagcgacgugggcggccccugcgccgacagcgccagcggcgugggcgagcccugcgagaacagcacccccagcgccggcgugcccugcgccaacagcccccugggcagcaaccagcccgcccagggccugcccgagcccacccagaucguggacgagacccugagccugcccgagggcagaagaagcgaggacaugaucgccugccccgagaccgagacccccgccgugaucaccugcgacccccugagccagcccagcccccagcccgccgacuucaccgagaccgagaccauccugcagcccgccaacaagguggagagcgugagcagcgaggagaccuucgagcccagccaggagcugcccgccgaggcccugagagaccccagccugcaggacgcccuggagguggaccuggccgugagcgugagccagaucagcaucgaggagaaggugaaggagcugagccccgaggaggagagaagaaagugggaggagggcagaaucgacuacaugggcaaggacgccuucgccagaauccaggagaagcuggacagauuccugcaguaa

SEQ ID NO: 17879 - RNA, 2166 nt, Artificial Sequence
  GYLTL1B__Homo_sapiens__NP_001287650
augcugcccagaggcagacccagagcccugggcgccgccgcccugcugcugcugcugcugcugcugggcuuccugcuguucggcggcgaccugggcugcgagagaagagagcccggcggcagagccggcgcccccggcugcuuccccggcccccugaugcccagagugccccccgacggcagacugagaagagccgccgcccuggacggcgaccccggcgccggccccggcgaccacaacagaagcgacugcggcccccagcccccccccccccccaagugcgagcugcugcacguggccaucgugugcgccggccacaacagcagcagagacgugaucacccuggugaagagcaugcuguucuacagaaagaacccccugcaccugcaccuggugaccgacgccguggccagaaacauccuggagacccuguuccacaccuggauggugcccgccgugagagugagcuucuaccacgccgaccagcugaagccccaggugagcuggauccccaacaagcacuacagcggccuguacggccugaugaagcuggugcugcccagcgcccugcccgccgagcuggccagagugaucgugcuggacaccgacgugaccuucgccagcgacaucagcgagcugugggcccuguucgcccacuucagcgacacccaggccaucggccugguggagaaccagagcgacugguaccugggcaaccuguggaagaaccacagacccuggcccgcccugggcagaggcuucaacaccggcgugauccugcugagacuggacagacugagacaggccggcugggagcagauguggagacugaccgccagaagagagcugcugagccugcccgccaccagccuggccgaccaggacaucuucaacgccgugaucaaggagcaccccggccuggugcagagacugcccugcguguggaacgugcagcugagcgaccacacccuggccgagagaugcuacagcgaggccagcgaccugaaggugauccacuggaacagccccaagaagcugagagugaagaacaagcacguggaguucuucagaaacuucuaccugaccuuccuggaguacgacggcaaccugcugagaagagagcuguucgugugccccagccagcccccccccggcgccgagcagcugcagcaggcccuggcccagcuggacgaggaggaccccugcuucgaguucagacagcagcagcugaccgugcacagagugcacgugaccuuccugccccacgagccccccccccccagaccccacgacgugacccugguggcccagcugagcauggacagacugcagaugcuggaggcccugugcagacacuggcccggccccaugagccuggcccuguaccugaccgacgccgaggcccagcaguuccugcacuucguggaggccagccccgugcuggccgccagacaggacguggccuaccacgugguguacagagagggcccccuguaccccgugaaccagcugagaaacguggcccuggcccaggcccugacccccuacguguuccugagcgacaucgacuuccugcccgccuacagccuguacgacuaccugagagccagcaucgagcagcugggccugggcagcagaagaaaggccgcccugguggugcccgccuucgagacccugagauacagauucagcuucccccacagcaagguggagcugcuggcccugcuggacgccggcacccuguacaccuucagauaccacgaguggcccagaggccacgcccccaccgacuacgccagauggagagaggcccaggcccccuacagagugcagugggccgccaacuacgagcccuacgugguggugcccagagacugccccagauacgaccccagauucgugggcuucggcuggaacaagguggcccacaucguggagcuggacgcccaggaguacgagcugcuggugcugcccgaggccuucaccauccaccugccccacgcccccagccuggacaucagcagauucagaagcagccccaccuacagagacugccugcaggcccugaaggacgaguuccaccaggaccugagcagacaccacggcgccgccgcccugaaguaccugcccgcccugcagcagccccagagccccgccagaggcuaa

SEQ ID NO: 17880 - RNA, 453 nt, Artificial Sequence
  GYPA__Homo_sapiens__NP_002090
auguacggcaagaucaucuucgugcugcugcugagcgagaucgugagcaucagcgcccugagcaccaccgagguggccaugcacaccagcaccagcagcagcgugaccaagagcuacaucagcagccagaccaacgacacccacaagagagacaccuacgccgccacccccagagcccacgaggugagcgagaucagcgugagaaccguguacccccccgaggaggagaccggcgagagagugcagcuggcccaccacuucagcgagcccgagaucacccugaucaucuucggcgugauggccggcgugaucggcaccauccugcugaucagcuacggcaucagaagacugaucaagaagagccccagcgacgugaagccccugcccagccccgacaccgacgugccccugagcagcguggagaucgagaaccccgagaccagcgaccaguaa

SEQ ID NO: 17881 - RNA, 276 nt, Artificial Sequence
  GYPB__Homo_sapiens__NP_002091
auguacggcaagaucaucuucgugcugcugcugagcgagaucgugagcaucagcgcccugagcaccaccgagguggccaugcacaccagcaccagcagcagcgugaccaagagcuacaucagcagccagaccaacggcgagaccggccagcuggugcacagauucaccgugcccgcccccguggugaucauccugaucauccugugcgugauggccggcaucaucggcaccauccugcugaucagcuacaccaucagaagacugaucaaggccuaa

SEQ ID NO: 17882 - RNA, 324 nt, Artificial Sequence
  GYPC__Homo_sapiens__NP_001243513
auggccagcgccagcaccaccaugcacaccaccaccaucgccgagcccgaccccggcaugagcggcuggcccgacggcagaauggagaccagcacccccaccaucauggacaucguggugaucgccggcgugaucgccgccguggccaucgugcuggugagccugcuguucgugaugcugagauacauguacagacacaagggcaccuaccacaccaacgaggccaagggcaccgaguucgccgagagcgccgacgccgcccugcagggcgaccccgcccugcaggacgccggcgacagcagcagaaaggaguacuucaucuaa

SEQ ID NO: 17883 - RNA, 237 nt, Artificial Sequence
  GYPE__Homo_sapiens__NP_002093
auguacggcaagaucaucuucgugcugcugcugagcggcaucgugagcaucagcgccagcagcaccaccggcguggccaugcacaccagcaccagcagcagcgugaccaagagcuacaucagcagccagaccaacggcaucacccugaucaacuggugggccauggccagagugaucuucgaggugaugcuggugguggugggcaugaucauccugaucagcuacugcaucagauaa

SEQ ID NO: 17884 - RNA, 2022 nt, Artificial Sequence
  GYS1__Homo_sapiens__NP_001155059
augccccugaacagaacccugagcaugagcagccugcccggccuggaggacugggaggacgaguucgaccuggagaacgccgugcuguucgagguggccugggagguggccaacaaggugggcggcaucuacaccgugcugcagaccaaggccaaggugaccggcgacgaguggggcgacaacuacuuccuggugggccccuacaccgagcagggcgugagaacccagguggagcugcuggaggcccccacccccgcccugaagagaacccuggacagcaugaacagcaagggcugcaaguuccuggcccagagcgaggagaagccccacgugguggcccacuuccacgaguggcuggccggcgugggccugugccugugcagagccagaagacugcccguggccaccaucuucaccacccacgccacccugcugggcagauaccugugcgccggcgccguggacuucuacaacaaccuggagaacuucaacguggacaaggaggccggcgagagacagaucuaccacagauacugcauggagagagccgccgcccacugcgcccacguguucaccaccgugagccagaucaccgccaucgaggcccagcaccugcugaagagaaagcccgacaucgugacccccaacggccugaacgugaagaaguucagcgccaugcacgaguuccagaaccugcacgcccagagcaaggccagaauccaggaguucgugagaggccacuucuacggccaccuggacuucaaccuggacaagacccuguacuucuucaucgccggcagauacgaguucagcaacaagggcgccgacguguuccuggaggcccuggccagacugaacuaccugcugagagugaacggcagcgagcagaccgugguggccuucuucaucaugcccgccagaaccaacaacuucaacguggagacccugaagggccaggccgugagaaagcagcugugggacaccgccaacaccgugaaggagaaguucggcagaaagcuguacgagagccugcuggugggcagccugcccgacaugaacaagaugcuggacaaggaggacuucaccaugaugaagagagccaucuucgccacccagagacagagcuucccccccgugugcacccacaacaugcuggacgacagcagcgaccccauccugaccaccaucagaagaaucggccuguucaacagcagcgccgacagagugaaggugaucuuccaccccgaguuccugagcagcaccagcccccugcugcccguggacuacgaggaguucgugagaggcugccaccugggcguguuccccagcuacuacgagcccuggggcuacacccccgccgagugcaccgugaugggcauccccagcaucagcaccaaccugagcggcuucggcugcuucauggaggagcacaucgccgaccccagcgccuacggcaucuacauccuggacagaagauucagaagccuggacgacagcugcagccagcugaccagcuuccuguacagcuucugccagcagagcagaagacagagaaucauccagagaaacagaaccgagagacugagcgaccugcuggacuggaaguaccugggcagauacuacaugagcgccagacacauggcccugagcaaggccuuccccgagcacuucaccuacgagcccaacgaggccgacgccgcccagggcuacagauaccccagacccgccagcgugccccccagccccagccugagcagacacagcagcccccaccagagcgaggacgaggaggaccccagaaacggcccccuggaggaggacggcgagagauacgacgaggacgaggaggccgccaaggacagaagaaacaucagagcccccgaguggcccagaagagccagcugcaccagcagcaccagcggcagcaagagaaacagcguggacaccgccaccagcagcagccugagcacccccagcgagccccugagccccaccagcagccugggcgaggagagaaacuaa

SEQ ID NO: 17885 - RNA, 2112 nt, Artificial Sequence
  GYS2__Homo_sapiens__NP_068776
augcugagaggcagaagccugagcgugaccagccugggcggccugccccagugggagguggaggagcugcccguggaggagcugcugcuguucgagguggccugggaggugaccaacaaggugggcggcaucuacaccgugauccagaccaaggccaagaccaccgccgacgaguggggcgagaacuacuuccugaucggccccuacuucgagcacaacaugaagacccagguggagcagugcgagcccgugaacgacgccgugagaagagccguggacgccaugaacaagcacggcugccaggugcacuucggcagauggcugaucgagggcagccccuacguggugcuguucgacaucggcuacagcgccuggaaccuggacagauggaagggcgaccugugggaggccugcagcgugggcauccccuaccacgacagagaggccaacgacaugcugaucuucggcagccugaccgccugguuccugaaggaggugaccgaccacgccgacggcaaguacgugguggcccaguuccacgaguggcaggccggcaucggccugauccugagcagagccagaaagcugcccaucgccaccaucuucaccacccacgccacccugcugggcagauaccugugcgccgccaacaucgacuucuacaaccaccuggacaaguucaacaucgacaaggaggccggcgagagacagaucuaccacagauacugcauggagagagccagcgugcacugcgcccacguguucaccaccgugagcgagaucaccgccaucgaggccgagcacaugcugaagagaaagcccgacguggugacccccaacggccugaacgugaagaaguucagcgccgugcacgaguuccagaaccugcacgccauguacaaggccagaauccaggacuucgugagaggccacuucuacggccaccuggacuucgaccuggagaagacccuguuccuguucaucgccggcagauacgaguucagcaacaagggcgccgacaucuuccuggagagccugagcagacugaacuuccugcugagaaugcacaagagcgacaucaccgugaugguguucuucaucaugcccgccaagaccaacaacuucaacguggagacccugaagggccaggccgugagaaagcagcugugggacguggcccacagcgugaaggagaaguucggcaagaagcuguacgacgcccugcugagaggcgagauccccgaccugaacgacauccuggacagagacgaccugaccaucaugaagagagccaucuucagcacccagagacagagccugccccccgugaccacccacaacaugaucgacgacagcaccgaccccauccugagcaccaucagaagaaucggccuguucaacaacagaaccgacagagugaaggugauccugcaccccgaguuccugagcagcaccagcccccugcugcccauggacuacgaggaguucgugagaggcugccaccugggcguguuccccagcuacuacgagcccuggggcuacacccccgccgagugcaccgugaugggcauccccagcgugaccaccaaccugagcggcuucggcugcuucaugcaggagcacguggccgaccccaccgccuacggcaucuacaucguggacagaagauucagaagccccgacgacagcugcaaccagcugaccaaguuccuguacggcuucugcaagcagagcagaagacagagaaucauccagagaaacagaaccgagagacugagcgaccugcuggacuggagauaccugggcagauacuaccagcacgccagacaccugacccugagcagagccuuccccgacaaguuccacguggagcugaccagcccccccaccaccgagggcuucaaguaccccagacccagcagcgugccccccagccccagcggcagccaggccagcagcccccagagcagcgacguggaggacgagguggaggacgagagauacgacgaggaggaggaggccgagagagacagacugaacaucaagagccccuucagccugagccacgugccccacggcaagaagaagcugcacggcgaguacaagaacuaa

SEQ ID NO: 17886 - RNA, 1368 nt, Artificial Sequence
  GZF1__Homo_sapiens__XP_005260860
auggagagcggcgccgugcugcuggagagcaagagcagccccuucaaccugcugcacgagaugcacgagcugagacugcugggccaccugugcgacgugaccgugagcguggaguaccagggcgugagaaaggacuucauggcccacaaggccgugcuggccgccaccagcaaguucuucaaggagguguuccugaacgagaagagcguggacggcaccagaaccaacguguaccugaacgaggugcagguggccgacuucgccagcuuccuggaguucguguacaccgccaaggugcagguggaggaggacagagugcagagaaugcuggagguggccgagaagcugaagugccuggaccugagcgagaccugcuuccagcugaagaagcagaugcuggagagcgugcugcuggagcugcagaacuucagcgagagccaggagguggaggugagcagcggcagccaggugagcgccgcccccgcccccagagccagcguggccaccgacggcccccaccccagcggccugaccgacagccuggacuaccccggcgagagagccagcaacggcaugagcagcgaccugccccccaagaagagcaaggacaagcuggacaagaagaaggagguggugaagccccccuaccccaagaucagaagagccagcggcagacuggccggcagaaagguguucguggagauccccaagaagaaguacaccagaagacugagagagcagcagaagaccgccgagggcgacgugggcgacuacagaugcccccaggaccagagccccgacagagugggcaccgagauggagcaggugagcaagaacgagggcugccaggccggcgccgagcuggaggagcugagcaagaaggccggccccgaggaggaggaggaggaggaggaggaggacgaggagggcgagaagaagaagagcaacuucaagugcagcaucugcgagaaggccuuccuguacgagaagagcuuccugaagcacagcaagcacagacacggcguggccaccgaggugguguacagaugcgacaccugcggccagaccuucgccaacagaugcaaccugaagagccaccagagacacgugcacagcagcgagagacacuuccccugcgagcugugcggcaagaaguucaagagaaagaaggacgugaagagacacgugcugcaggugcacgagggcggcggcgagagacacagaugcggccagugcggcaagggccugagcagcaagaccgcccugagacugcacgagagaacccacaccggcgacagacccuacggcugcaccgagugcggcgccagauucagccagcccagcgcccugaagacccacaugagauaa

SEQ ID NO: 17887 - RNA, 789 nt, Artificial Sequence
  GZMA__Homo_sapiens__NP_006135
augagaaacagcuacagauuccuggccagcagccugagcgugguggugagccugcugcugauccccgaggacgugugcgagaagaucaucggcggcaacgaggugaccccccacagcagacccuacauggugcugcugagccuggacagaaagaccaucugcgccggcgcccugaucgccaaggacugggugcugaccgccgcccacugcaaccugaacaagagaagccaggugauccugggcgcccacagcaucaccagagaggagcccaccaagcagaucaugcuggugaagaaggaguuccccuaccccugcuacgaccccgccaccagagagggcgaccugaagcugcugcagcugaccgagaaggccaagaucaacaaguacgugaccauccugcaccugcccaagaagggcgacgacgugaagcccggcaccaugugccagguggccggcuggggcagaacccacaacagcgccagcuggagcgacacccugagagaggugaacaucaccaucaucgacagaaaggugugcaacgacagaaaccacuacaacuucaaccccgugaucggcaugaacauggugugcgccggcagccugagaggcggcagagacagcugcaacggcgacagcggcagcccccugcugugcgagggcguguucagaggcgugaccagcuucggccuggagaacaagugcggcgaccccagaggccccggcguguacauccugcugagcaagaagcaccugaacuggaucaucaugaccaucaagggcgccguguaa

SEQ ID NO: 17888 - RNA, 744 nt, Artificial Sequence
  GZMB__Homo_sapiens__NP_004122
augcagcccauccugcugcugcuggccuuccugcugcugcccagagccgacgccggcgagaucaucggcggccacgaggccaagccccacagcagacccuacauggccuaccugaugaucugggaccagaagagccugaagagaugcggcggcuuccugaucagagacgacuucgugcugaccgccgcccacugcuggggcagcagcaucaacgugacccugggcgcccacaacaucaaggagcaggagcccacccagcaguucauccccgugaagagacccaucccccaccccgccuacaaccccaagaacuucagcaacgacaucaugcugcugcagcuggagagaaaggccaagagaaccagagccgugcagccccugagacugcccagcaacaaggcccaggugaagcccggccagaccugcagcguggccggcuggggccagaccgccccccugggcaagcacagccacacccugcaggaggugaagaugaccgugcaggaggacagaaagugcgagagcgaccugagacacuacuacgacagcaccaucgagcugugcgugggcgaccccgagaucaagaagaccagcuucaagggcgacagcggcggcccccuggugugcaacaagguggcccagggcaucgugagcuacggcagaaacaacggcaugccccccagagccugcaccaaggugagcagcuucgugcacuggaucaagaagaccaugaagagauacuaa

SEQ ID NO: 17889 - RNA, 483 nt, Artificial Sequence
  GZMH__Homo_sapiens__NP_001257710
augcagcccuuccugcugcugcuggccuuccugcugacccccggcgccggcaccgaggagaucaucggcggccacgaggccaagccccacagcagacccuacauggccuucgugcaguuccugcaggagaagagcagaaagagaugcggcggcauccuggugagaaaggacuucgugcugaccgccgcccacugccagggcagcagcaucaacgugacccugggcgcccacaacaucaaggagcaggagagaacccagcaguucauccccgugaagagacccaucccccaccccgccuacaaccccaagaacuucagcaacgacaucaugcugcugcagggcgacagcggcggcccccuggugugcaaggacguggcccagggcauccugagcuacggcaacaagaagggcaccccccccggcguguacaucaaggugagccacuuccugcccuggaucaagagaaccaugaagagacuguaa

SEQ ID NO: 17890 - RNA, 795 nt, Artificial Sequence
  GZMK__Homo_sapiens__NP_002095
augaccaaguucagcagcuucagccuguucuuccugaucgugggcgccuacaugacccacgugugcuucaacauggagaucaucggcggcaaggaggugagcccccacagcagacccuucauggccagcauccaguacggcggccaccacgugugcggcggcgugcugaucgacccccagugggugcugaccgccgcccacugccaguacagauucaccaagggccagagccccaccguggugcugggcgcccacagccugagcaagaacgaggccagcaagcagacccuggagaucaagaaguucauccccuucagcagagugaccagcgacccccagagcaacgacaucaugcuggugaagcugcagaccgccgccaagcugaacaagcacgugaagaugcugcacaucagaagcaagaccagccugagaagcggcaccaagugcaaggugaccggcuggggcgccaccgaccccgacagccugagacccagcgacacccugagagaggugaccgugaccgugcugagcagaaagcugugcaacagccagagcuacuacaacggcgaccccuucaucaccaaggacauggugugcgccggcgacgccaagggccagaaggacagcugcaagggcgacagcggcggcccccugaucugcaagggcguguuccacgccaucgugagcggcggccacgagugcggcguggccaccaagcccggcaucuacacccugcugaccaagaaguaccagaccuggaucaagagcaaccuggugcccccccacaccaacuaa

SEQ ID NO: 17891 - RNA, 774 nt, Artificial Sequence
  GZMM__Homo_sapiens__NP_005308
auggaggccugcgugagcagccugcuggugcuggcccugggcgcccugagcgugggcagcagcuucggcacccagaucaucggcggcagagaggugaucccccacagcagacccuacauggccagccugcagagaaacggcagccaccugugcggcggcgugcuggugcaccccaagugggugcugaccgccgcccacugccuggcccagagaauggcccagcugagacuggugcugggccugcacacccuggacagccccggccugaccuuccacaucaaggccgccauccagcaccccagauacaagcccgugcccgcccuggagaacgaccuggcccugcugcagcuggacggcaaggugaagcccagcagaaccaucagaccccuggcccugcccagcaagagacaggugguggccgccggcaccagaugcagcauggccggcuggggccugacccaccagggcggcagacugagcagagugcugagagagcuggaccugcaggugcuggacaccagaaugugcaacaacagcagauucuggaacggcagccugagccccagcauggugugccuggccgccgacagcaaggaccaggcccccugcaagggcgacagcggcggcccccuggugugcggcaagggcagagugcuggccggcgugcugagcuucagcagcagagugugcaccgacaucuucaagccccccguggccaccgccguggcccccuacgugagcuggaucagaaaggugaccggcagaagcgccuaa

SEQ ID NO: 17892 - RNA, 585 nt, Artificial Sequence
  H1F0__Homo_sapiens__NP_005309
augaccgagaacagcaccagcgcccccgccgccaagcccaagagagccaaggccagcaagaagagcaccgaccaccccaaguacagcgacaugaucguggccgccauccaggccgagaagaacagagccggcagcagcagacagagcauccagaaguacaucaagagccacuacaaggugggcgagaacgccgacagccagaucaagcugagcaucaagagacuggugaccaccggcgugcugaagcagaccaagggcgugggcgccagcggcagcuucagacuggccaagagcgacgagcccaagaagagcguggccuucaagaagaccaagaaggagaucaagaagguggccacccccaagaaggccagcaagcccaagaaggccgccagcaaggcccccaccaagaagcccaaggccacccccgugaagaaggccaagaagaagcuggccgccacccccaagaaggccaagaagcccaagaccgugaaggccaagcccgugaaggccagcaagcccaagaaggccaagcccgugaagcccaaggccaagagcagcgccaagagagccggcaagaagaaguaa

SEQ ID NO: 17893 - RNA, 642 nt, Artificial Sequence
  H1FX__Homo_sapiens__NP_006017
augagcguggagcuggaggaggcccugcccgugaccaccgccgagggcauggccaagaaggugaccaaggccggcggcagcgccgcccugagccccagcaagaagagaaagaacagcaagaagaagaaccagcccggcaaguacagccagcuggugguggagaccaucagaagacugggcgagagaaacggcagcagccuggccaagaucuacaccgaggccaagaaggugcccugguucgaccagcagaacggcagaaccuaccugaaguacagcaucaaggcccuggugcagaacgacacccugcugcaggugaagggcaccggcgccaacggcagcuucaagcugaacagaaagaagcuggagggcggcggcgagagaagaggcgcccccgccgccgccaccgcccccgcccccaccgcccacaaggccaagaaggccgcccccggcgccgccggcagcagaagagccgacaagaagcccgccagaggccagaagcccgagcagagaagccacaagaagggcgccggcgccaagaaggacaagggcggcaaggccaagaagaccgccgccgccggcggcaagaaggugaagaaggccgccaagcccagcgugcccaaggugcccaagggcagaaaguaa

SEQ ID NO: 17894 - RNA, 390 nt, Artificial Sequence
  H2AFJ__Homo_sapiens__NP_808760
augagcggcagaggcaagcagggcggcaaggugagagccaaggccaagagcagaagcagcagagccggccugcaguuccccgugggcagagugcacagacugcugagaaagggcaacuacgccgagagagugggcgccggcgcccccguguaccuggccgccgugcuggaguaccugaccgccgagauccuggagcuggccggcaacgccgccagagacaacaagaagaccagaaucauccccagacaccugcagcuggccaucagaaacgacgaggagcugaacaagcugcugggcaaggugaccaucgcccagggcggcgugcugcccaacauccaggccgugcugcugcccaagaagaccgagagccagaagaccaagagcaaguaa

SEQ ID NO: 17895 - RNA, 432 nt, Artificial Sequence
  H2AFX__Homo_sapiens__NP_002096
augagcggcagaggcaagaccggcggcaaggccagagccaaggccaagagcagaagcagcagagccggccugcaguuccccgugggcagagugcacagacugcugagaaagggccacuacgccgagagagugggcgccggcgcccccguguaccuggccgccgugcuggaguaccugaccgccgagauccuggagcuggccggcaacgccgccagagacaacaagaagaccagaaucauccccagacaccugcagcuggccaucagaaacgacgaggagcugaacaagcugcugggcggcgugaccaucgcccagggcggcgugcugcccaacauccaggccgugcugcugcccaagaagaccagcgccaccgugggccccaaggcccccagcggcggcaagaaggccacccaggccagccaggaguacuaa

SEQ ID NO: 17896 - RNA, 1119 nt, Artificial Sequence
  H2AFY2__Homo_sapiens__NP_061119
augagcggcagaagcggcaagaagaagaugagcaagcugagcagaagcgccagagccggcgugaucuuccccgugggcagacugaugagauaccugaagaagggcaccuucaaguacagaaucagcgugggcgcccccguguacauggccgccgugaucgaguaccuggccgccgagauccuggagcuggccggcaacgccgccagagacaacaagaaggccagaaucgcccccagacacauccugcuggccguggccaacgacgaggagcugaaccagcugcugaagggcgugaccaucgccagcggcggcgugcugcccagaauccaccccgagcugcuggccaagaagagaggcaccaagggcaagagcgagaccauccugagccccccccccgagaagagaggcagaaaggccaccagcggcaagaagggcggcaagaagagcaaggccgccaagcccagaaccagcaagaagagcaagcccaaggacagcgacaaggagggcaccagcaacagcaccagcgaggacggccccggcgacggcuucaccauccugagcagcaagagccuggugcugggccagaagcugagccugacccagagcgacaucagccacaucggcagcaugagaguggagggcaucgugcaccccaccaccgccgagaucgaccugaaggaggacaucggcaaggcccuggagaaggccggcggcaaggaguuccuggagaccgugaaggagcugagaaagagccagggcccccuggagguggccgaggccgccgugagccagagcagcggccuggccgccaaguucgugauccacugccacaucccccaguggggcagcgacaagugcgaggagcagcuggaggagaccaucaagaacugccugagcgccgccgaggacaagaagcugaagagcguggccuucccccccuuccccagcggcagaaacugcuuccccaagcagaccgccgcccaggugacccugaaggccaucagcgcccacuucgacgacagcagcgccagcagccugaagaacguguacuuccugcuguucgacagcgagagcaucggcaucuacgugcaggagauggccaagcuggacgccaaguaa

SEQ ID NO: 17897 - RNA, 1116 nt, Artificial Sequence
  H2AFY__Homo_sapiens__NP_004884
augagcagcagaggcggcaagaagaagagcaccaagaccagcagaagcgccaaggccggcgugaucuuccccgugggcagaaugcugagauacaucaagaagggccaccccaaguacagaaucggcgugggcgcccccguguacauggccgccgugcuggaguaccugaccgccgagauccuggagcuggccggcaacgccgccagagacaacaagaagggcagagugacccccagacacauccugcuggccguggccaacgacgaggagcugaaccagcugcugaagggcgugaccaucgccagcggcggcgugcugcccaacauccaccccgagcugcuggccaagaagagaggcagcaagggcaagcuggaggccaucaucacccccccccccgccaagaaggccaagagccccagccagaagaagcccgugagcaagaaggccggcggcaagaagggcgccagaaagagcaagaagcagggcgaggugagcaaggccgccagcgccgacagcaccaccgagggcacccccgccgacggcuucaccgugcugagcaccaagagccuguuccugggccagaagcugaaccugauccacagcgagaucagcaaccuggccggcuucgagguggaggccaucaucaaccccaccaacgccgacaucgaccugaaggacgaccugggcaacacccuggagaagaagggcggcaaggaguucguggaggccgugcuggagcugagaaagaagaacggcccccuggagguggccggcgccgccgugagcgccggccacggccugcccgccaaguucgugauccacugcaacagccccguguggggcgccgacaagugcgaggagcugcuggagaagaccgugaagaacugccuggcccuggccgacgacaagaagcugaagagcaucgccuuccccagcaucggcagcggcagaaacggcuuccccaagcagaccgccgcccagcugauccugaaggccaucagcagcuacuucgugagcaccaugagcagcagcaucaagaccguguacuucgugcuguucgacagcgagagcaucggcaucuacgugcaggagauggccaagcuggacgccaacuaa

SEQ ID NO: 17898 - RNA, 387 nt, Artificial Sequence
  H2AFZ__Homo_sapiens__NP_002097
auggccggcggcaaggccggcaaggacagcggcaaggccaagaccaaggccgugagcagaagccagagagccggccugcaguuccccgugggcagaauccacagacaccugaagagcagaaccaccagccacggcagagugggcgccaccgccgccguguacagcgccgccauccuggaguaccugaccgccgaggugcuggagcuggccggcaacgccagcaaggaccugaaggugaagagaaucacccccagacaccugcagcuggccaucagaggcgacgaggagcuggacagccugaucaaggccaccaucgccggcggcggcgugaucccccacauccacaagagccugaucggcaagaagggccagcagaagaccguguaa

SEQ ID NO: 17899 - RNA, 528 nt, Artificial Sequence
  H2BFWT__Homo_sapiens__NP_001002916
augcugagaaccgaggugcccagacugcccagaagcaccaccgccaucguguggagcugccaccugauggccaccgccagcgccauggccggccccagcagcgagaccaccagcgaggagcagcugaucacccaggagcccaaggaggccaacagcaccaccagccagaagcagagcaagcagagaaagagaggcagacacggccccagaagaugccacagcaacugcagaggcgacagcuucgccaccuacuucagaagagugcugaagcaggugcaccagggccugagccugagcagagaggccgugagcgugauggacagccuggugcacgacauccuggacagaaucgccaccgaggccggccaccuggccagaagcaccaagagacagaccaucaccgccugggagaccagaauggccgugagacugcugcugcccggccagaugggcaagcuggccgagagcgagggcaccaaggccgugcugagaaccagccuguacgccauccagcagcagagaaaguaa

SEQ ID NO: 17900 - RNA, 411 nt, Artificial Sequence
  H3F3B__Homo_sapiens__NP_005315
auggccagaaccaagcagaccgccagaaagagcaccggcggcaaggcccccagaaagcagcuggccaccaaggccgccagaaagagcgcccccagcaccggcggcgugaagaagccccacagauacagacccggcaccguggcccugagagagaucagaagauaccagaagagcaccgagcugcugaucagaaagcugcccuuccagagacuggugagagagaucgcccaggacuucaagaccgaccugagauuccagagcgccgccaucggcgcccugcaggaggccagcgaggccuaccuggugggccuguucgaggacaccaaccugugcgccauccacgccaagagagugaccaucaugcccaaggacauccagcuggccagaagaaucagaggcgagagagccuaa

SEQ ID NO: 17901 - RNA, 861 nt, Artificial Sequence
  HAAO__Homo_sapiens__NP_036337
auggagagaagacugggcgugagagccugggugaaggagaacagaggcagcuuccagccccccgugugcaacaagcugaugcaccaggagcagcugaaggugauguucaucggcggccccaacaccagaaaggacuaccacaucgaggagggcgaggagguguucuaccagcuggagggcgacauggugcugagagugcuggagcagggcaagcacagagacguggugaucagacagggcgagaucuuccugcugcccgccagagugccccacagcccccagagauucgccaacaccgugggccuggugguggagagaagaagacuggagaccgagcuggacggccugagauacuacgugggcgacaccauggacgugcuguucgagaagugguucuacugcaaggaccugggcacccagcuggcccccaucauccaggaguucuucagcagcgagcaguacagaaccggcaagcccauccccgaccagcugcugaaggagccccccuucccccugagcaccagaagcaucauggagcccaugagccuggacgccuggcuggacagccaccacagagagcugcaggccggcaccccccugagccuguucggcgacaccuacgagacccaggugaucgccuacggccagggcagcagcgagggccugagacagaacguggacguguggcuguggcagcuggagggcagcagcguggugaccaugggcggcagaagacugagccuggcccccgacgacagccugcuggugcuggccggcaccagcuacgccugggagagaacccagggcagcguggcccugagcgugacccaggaccccgccugcaagaagccccugggcuaa

SEQ ID NO: 17902 - RNA, 1605 nt, Artificial Sequence
  HABP2__Homo_sapiens__NP_001171131
augagccugcuggagagccuggaccccgacuggacccccgaccaguacgacuacagcuacgaggacuacaaccaggaggagaacaccagcagcacccugacccacgccgagaaccccgacugguacuacaccgaggaccaggccgaccccugccagcccaaccccugcgagcacggcggcgacugccuggugcacggcagcaccuucaccugcagcugccuggcccccuucagcggcaacaagugccagaaggugcagaacaccugcaaggacaaccccugcggcagaggccagugccugaucacccagagcccccccuacuacagaugcgugugcaagcaccccuacaccggccccagcugcagccagguggugcccgugugcagacccaaccccugccagaacggcgccaccugcagcagacacaagagaagaagcaaguucaccugcgccugccccgaccaguucaagggcaaguucugcgagaucggcagcgacgacugcuacgugggcgacggcuacagcuacagaggcaagaugaacagaaccgugaaccagcacgccugccuguacuggaacagccaccugcugcugcaggagaacuacaacauguucauggaggacgccgagacccacggcaucggcgagcacaacuucugcagaaaccccgacgccgacgagaagcccuggugcuucaucaaggugaccaacgacaaggugaagugggaguacugcgacgugagcgccugcagcgcccaggacguggccuaccccgaggagagccccaccgagcccagcaccaagcugcccggcuucgacagcugcggcaagaccgagaucgccgagagaaagaucaagagaaucuacggcggcuucaagagcaccgccggcaagcaccccuggcaggccagccugcagagcagccugccccugaccaucagcaugccccagggccacuucugcggcggcgcccugauccaccccugcugggugcugaccgccgcccacugcaccgacaucaagaccagacaccugaagguggugcugggcgaccaggaccugaagaaggaggaguuccacgagcagagcuucagaguggagaagaucuucaaguacagccacuacaacgagagagacgagaucccccacaacgacaucgcccugcugaagcugaagcccguggacggccacugcgcccuggagagcaaguacgugaagaccgugugccugcccgacggcagcuuccccagcggcagcgagugccacaucagcggcuggggcgugaccgagaccggcaagggcagcagacagcugcuggacgccaaggugaagcugaucgccaacacccugugcaacagcagacagcuguacgaccacaugaucgacgacagcaugaucugcgccggcaaccugcagaagcccggccaggacaccugccagggcgacagcggcggcccccugaccugcgagaaggacggcaccuacuacguguacggcaucgugagcuggggccuggagugcggcaagagacccggcguguacacccaggugaccaaguuccugaacuggaucaaggccaccaucaagagcgagagcggcuucuaa

SEQ ID NO: 17903 - RNA, 1242 nt, Artificial Sequence
  HABP4__Homo_sapiens__NP_055097
augaagggcgcccugggcagccccguggccgccgccggcgccgccaugcaggagagcuucggcugcgugguggccaacagauuccaccagcugcuggacgacgagagcgaccccuucgacauccugagagaggccgagagaagaagacagcagcagcugcagagaaagagaagagacgaggccgccgccgccgccggcgccggccccagaggcggcagaagccccgccggcgccagcggccacagagccggcgccggcggcagaagagagagccagaaggagagaaagagccugcccgcccccguggcccagagacccgacagccccggcggcggccugcaggcccccggccagaagagaacccccagaagaggcgagcagcagggcuggaacgacagcagaggccccgagggcaugcuggagagagccgagagaagaagcuacagagaguacagacccuacgagaccgagagacaggccgacuucaccgccgagaaguuccccgacgagaagcccggcgacagauucgacagagacagaccccugagaggcagaggcggccccagaggcggcaugagaggcagaggcagaggcggccccggcaacagaguguucgacgccuucgaccagagaggcaagagagaguucgagagauacggcggcaacgacaagaucgccgugagaaccgaggacaacaugggcggcugcggcgugagaaccuggggcagcggcaaggacaccagcgacguggagcccaccgcccccauggaggagcccaccgugguggaggagagccagggcacccccgaggaggagagccccgccaaggugcccgagcuggagguggaggaggagacccaggugcaggagaugacccuggacgaguggaagaaccugcaggagcagaccagacccaagcccgaguucaacaucagaaagcccgagagcaccgugcccagcaaggccguggugauccacaagagcaaguacagagacgacauggugaaggacgacuacgaggacgacagccacguguucagaaagcccgccaacgacaucaccagccagcuggagaucaacuucggcaaccugcccagacccggcagaggcgccagaggcggcaccagaggcggcagaggcagaaucagaagagccgagaacuacggccccagagccgagguggugaugcaggacguggcccccaaccccgacgaccccgaggacuuccccgcccugagcuaa

SEQ ID NO: 17904 - RNA, 867 nt, Artificial Sequence
  HACD1__Homo_sapiens__NP_055056
augggcagacugaccgaggccgccgccgccggcagcggcagcagagccgccggcugggccggcagcccccccacccugcugccccugagccccaccagccccagaugcgccgccaccauggccagcagcgacgaggacggcaccaacggcggcgccagcgaggccggcgaggacagagaggcccccggcgagagaagaagacugggcgugcuggccaccgccuggcugaccuucuacgacaucgccaugaccgccggcuggcuggugcuggccaucgccauggugagauucuacauggagaagggcacccacagaggccuguacaagagcauccagaagacccugaaguucuuccagaccuucgcccugcuggagaucgugcacugccugaucggcaucgugcccaccagcgugaucgugaccggcgugcaggugagcagcagaaucuucaugguguggcugaucacccacagcaucaagcccauccagaacgaggagagcguggugcuguuccugguggccuggaccgugaccgagaucaccagauacagcuucuacaccuucagccugcuggaccaccugcccuacuucaucaagugggccagauacaacuucuucaucauccuguaccccgugggcguggccggcgagcugcugaccaucuacgccgcccugccccacgugaagaagaccggcauguucagcaucagacugcccaacaaguacaacgugagcuucgacuacuacuacuuccugcugaucaccauggccagcuacaucccccuguucccccagcuguacuuccacaugcugagacagagaagaaaggugcugcacggcgaggugaucguggagaaggacgacuaa

SEQ ID NO: 17905 - RNA, 765 nt, Artificial Sequence
  HACD2__Homo_sapiens__NP_940684
auggccgccguggccgccaccgccgccgccaagggcaacggcggcggcggcggcagagccggcgccggcgacgccagcggcaccagaaagaagaagggccccggcccccuggccaccgccuaccuggugaucuacaacguggugaugaccgccggcuggcuggugaucgccgugggccuggugagagccuaccuggccaagggcagcuaccacagccuguacuacagcaucgagaagccccugaaguucuuccagaccggcgcccugcuggagauccugcacugcgccaucggcaucgugcccagcagcguggugcugaccagcuuccaggugaugagcagaguguuccugaucugggccgugacccacagcgugaaggaggugcagagcgaggacagcgugcugcuguucgugaucgccuggaccaucaccgagaucaucagauacagcuucuacaccuucagccugcugaaccaccugcccuaccugaucaagugggccagauacacccuguucaucgugcuguaccccaugggcgugagcggcgagcugcugaccaucuacgccgcccugcccuucgugagacaggccggccuguacagcaucagccugcccaacaaguacaacuucagcuucgacuacuacgccuuccugauccugaucaugaucagcuacauccccaucuucccccagcuguacuuccacaugauccaccagagaagaaagauccugagccacaccgaggagcacaagaaguucgaguaa

SEQ ID NO: 17906 - RNA, 699 nt, Artificial Sequence
  HACD4__Homo_sapiens__NP_001010915
augggcccccuggcccugcccgccuggcugcagcccagauacagaaagaacgccuaccuguucaucuacuaccugauccaguucugcggccacagcuggaucuucaccaacaugaccgugagauucuucagcuucggcaaggacagcaugguggacaccuucuacgccaucggccuggugaugagacugugccagagcgugagccugcuggagcugcugcacaucuacgugggcaucgagagcaaccaccugcugcccagauuccugcagcugaccgagagaaucaucauccuguucguggugaucaccagccaggaggaggugcaggagaaguacguggugugcgugcuguucguguucuggaaccugcuggacauggugagauacaccuacagcaugcugagcgugaucggcaucagcuacgccgugcugaccuggcugagccagacccuguggaugcccaucuacccccugugcgugcuggccgaggccuucgccaucuaccagagccugcccuacuucgagagcuucggcaccuacagcaccaagcugcccuucgaccugagcaucuacuuccccuacgugcugaagaucuaccugaugaugcuguucaucggcauguacuucaccuacagccaccuguacagcgagagaagagacauccugggcaucuuccccaucaagaagaagaagauguaa

SEQ ID NO: 17907 - RNA, 2730 nt, Artificial Sequence
  HACE1__Homo_sapiens__NP_065822
auggagagagccauggagcagcugaacagacugaccagaagccugagaagagccagaaccguggagcugcccgaggacaacgagaccgccguguacacccugaugcccauggugauggccgaccagcacagaagcgugagcgagcugcugagcaacagcaaguucgacgugaacuacgccuucggcagagugaagagaagccugcugcacaucgccgccaacugcggcagcguggagugccuggugcugcugcugaagaagggcgccaaccccaacuaccaggacaucagcggcugcaccccccugcaccuggccgccagaaacggccagaagaagugcaugagcaagcugcuggaguacagcgccgacgugaacaucugcaacaacgagggccugaccgccauccacuggcuggccgugaacggcagaaccgagcugcugcacgaccuggugcagcacgugagcgacguggacguggaggacgccaugggccagaccgcccugcacguggccugccagaacggccacaagaccaccgugcagugccugcuggacagcggcgccgacaucaacagacccaacgugagcggcgccaccccccuguacuucgccugcagccacggccagagagacaccgcccagauccugcugcugagaggcgccaaguaccugcccgacaagaacggcgugaccccccuggaccugugcgugcagggcggcuacggcgagaccugcgaggugcugauccaguaccaccccagacuguuccagaccaucauccagaugacccagaacgaggaccugagagagaacaugcugagacaggugcuggagcaccugagccagcagagcgagagccaguaccugaagauccugaccagccuggccgagguggccaccaccaacggccacaagcugcugagccugagcagcaacuacgacgcccagaugaagagccugcugagaaucgugagaauguucugccacguguucagaaucggccccagcagccccagcaacggcaucgacaugggcuacaacggcaacaagacccccagaagccagguguucaagccccuggagcugcuguggcacagccuggacgaguggcuggugcugaucgccaccgagcugaugaagaacaagagagacagcaccgagaucaccagcauccugcugaagcagaagggccaggaccaggacgccgccagcaucccccccuucgagccccccggccccggcagcuacgagaaccugagcaccggcaccagagagagcaagcccgacgcccuggccggcagacaggaggccagcgccgacugccaggacgugaucagcaugaccgccaacagacugagcgccgugauccaggccuucuacaugugcugcagcugccagaugccccccggcaugaccagccccagauucaucgaguucgugugcaagcacgacgaggugcugaagugcuucgugaacagaaaccccaagaucaucuucgaccacuuccacuuccugcuggagugccccgagcugaugagcagauucaugcacaucaucaaggcccagcccuucaaggacagaugcgagugguucuacgagcaccugcacagcggccagcccgacagcgacauggugcacagacccgugaacgagaacgacauccugcuggugcacagagacagcaucuucagaagcagcugcgagguggugagcaaggccaacugcgccaagcugaagcagggcaucgccgugagauuccacggcgaggagggcaugggccagggcguggugagagagugguucgacauccugagcaacgagaucgugaaccccgacuacgcccuguucacccagagcgccgacggcaccaccuuccagcccaacagcaacagcuacgugaaccccgaccaccugaacuacuucagauucgccggccagauccugggccuggcccugaaccacagacagcuggugaacaucuacuucaccagaagcuucuacaagcacauccugggcauccccgugaacuaccaggacguggccagcaucgaccccgaguacgccaagaaccugcaguggauccuggacaacgacaucagcgaccugggccuggagcugaccuucagcguggagaccgacguguucggcgccauggaggaggugccccugaagcccggcggcggcagcauccuggugacccagaacaacaaggccgaguacgugcagcuggugaccgagcugagaaugaccagagccauccagccccagaucaacgccuuccugcagggcuuccacauguucaucccccccagccugauccagcuguucgacgaguacgagcuggagcugcugcugagcggcaugcccgagaucgacgugagcgacuggaucaagaacaccgaguacaccagcggcuacgagagagaggaccccgugauccagugguucugggaggugguggaggacaucacccaggaggagagagugcugcugcugcaguucgugaccggcagcagcagagugccccacggcggcuucgccaacaucaugggcggcagcggccugcagaacuucaccaucgccgccgugcccuacacccccaaccugcugcccaccagcagcaccugcaucaacaugcugaagcugcccgaguaccccagcaaggagauccugaaggacagacugcugguggcccugcacugcggcagcuacggcuacaccauggccuaa

SEQ ID NO: 17908 - RNA, 1737 nt, Artificial Sequence
  HACL1__Homo_sapiens__NP_036392
augcccgacagcaacuucgccgagagaagcgaggagcaggugagcggcgccaaggugaucgcccaggcccugaagacccaggacguggaguacaucuucggcaucgugggcauccccgugaccgagaucgccaucgccgcccagcagcugggcaucaaguacaucggcaugagaaacgagcaggccgccugcuacgccgccagcgccaucggcuaccugaccagcagacccggcgugugccugguggugagcggccccggccugauccacgcccugggcggcauggccaacgccaacaugaacugcuggccccugcuggugaucggcggcagcagcgagagaaaccaggagaccaugggcgccuuccaggaguucccccagguggaggccugcagacuguacaccaaguucagcgccagacccagcagcaucgaggccauccccuucgugaucgagaaggccgugagaagcagcaucuacggcagacccggcgccugcuacguggacauccccgccgacuucgugaaccugcaggugaacgugaacagcaucaaguacauggagagaugcaugagcccccccaucagcauggccgagaccagcgccgugugcaccgccgccagcgugaucagaaacgccaagcagccccugcugaucaucggcaagggcgccgccuacgcccacgccgaggagagcaucaagaagcugguggagcaguacaagcugcccuuccugcccacccccaugggcaagggcguggugcccgacaaccaccccuacugcgugggcgccgccagaagcagagcccugcaguucgccgacgugaucgugcuguucggcgccagacugaacuggauccugcacuucggccugccccccagauaccagcccgacgugaaguucauccagguggacaucugcgccgaggagcugggcaacaacgugaagcccgccgugacccugcugggcaacauccacgccgugaccaagcagcugcuggaggagcuggacaagacccccuggcaguacccccccgagagcaagugguggaagacccugagagagaagaugaagagcaacgaggccgccagcaaggagcuggccagcaagaagagccugcccaugaacuacuacaccguguucuaccacgugcaggagcagcugcccagagacugcuucguggugagcgagggcgccaacaccauggacaucggcagaaccgugcugcagaacuaccugcccagacacagacuggacgccggcaccuucggcaccaugggcgugggccugggcuucgccaucgccgccgccgugguggccaaggacagaagccccggccaguggaucaucugcguggagggcgacagcgccuucggcuucagcggcauggagguggagaccaucugcagauacaaccugcccaucauccugcugguggugaacaacaacggcaucuaccagggcuucgacaccgacaccuggaaggagaugcugaaguuccaggacgccaccgccguggugccccccaugugccugcugcccaacagccacuacgagcaggugaugaccgccuucggcggcaagggcuacuucgugcagacccccgaggagcugcagaagagccugagacagagccuggccgacaccaccaagcccagccugaucaacaucaugaucgagccccaggccaccagaaaggcccaggacuuccacuggcugaccagaagcaacauguaa

SEQ ID NO: 17909 - RNA, 2292 nt, Artificial Sequence
  HADHA__Homo_sapiens__NP_000173
augguggccugcagagccaucggcauccugagcagauucagcgccuucagaauccugagaagcagaggcuacaucugcagaaacuucaccggcagcagcgcccugcugaccagaacccacaucaacuacggcgugaagggcgacguggccguggugagaaucaacagccccaacagcaaggugaacacccugagcaaggagcugcacagcgaguucagcgaggugaugaacgagaucugggccagcgaccagaucagaagcgccgugcugaucagcagcaagcccggcugcuucaucgccggcgccgacaucaacaugcuggccgccugcaagacccugcaggaggugacccagcugagccaggaggcccagagaaucguggagaagcuggagaagagcaccaagcccaucguggccgccaucaacggcagcugccugggcggcggccuggagguggccaucagcugccaguacagaaucgccaccaaggacagaaagaccgugcugggcacccccgaggugcugcugggcgcccugcccggcgccggcggcacccagagacugcccaagauggugggcgugcccgccgcccuggacaugaugcugaccggcagaagcaucagagccgacagagccaagaagaugggccugguggaccagcugguggagccccugggccccggccugaagccccccgaggagagaaccaucgaguaccuggaggagguggccaucaccuucgccaagggccuggccgacaagaagaucagccccaagagagacaagggccugguggagaagcugaccgccuacgccaugaccauccccuucgugagacagcagguguacaagaagguggaggagaaggugagaaagcagaccaagggccuguaccccgccccccugaagaucaucgacguggugaagaccggcaucgagcagggcagcgacgccggcuaccugugcgagagccagaaguucggcgagcuggugaugaccaaggagagcaaggcccugaugggccuguaccacggccaggugcugugcaagaagaacaaguucggcgccccccagaaggacgugaagcaccuggccauccugggcgccggccugaugggcgccggcaucgcccaggugagcguggacaagggccugaagaccauccugaaggacgccacccugaccgcccuggacagaggccagcagcagguguucaagggccugaacgacaaggugaagaagaaggcccugaccagcuucgagagagacagcaucuucagcaaccugaccggccagcuggacuaccagggcuucgagaaggccgacauggugaucgaggccguguucgaggaccugagccugaagcacagagugcugaaggagguggaggccgugauccccgaccacugcaucuucgccagcaacaccagcgcccugcccaucagcgagaucgccgccgugagcaagagacccgagaaggugaucggcaugcacuacuucagccccguggacaagaugcagcugcuggagaucaucaccaccgagaagaccagcaaggacaccagcgccagcgccguggccgugggccugaagcagggcaaggugaucaucguggugaaggacggccccggcuucuacaccaccagaugccuggcccccaugaugagcgaggugaucagaauccugcaggagggcguggaccccaagaagcuggacagccugaccaccagcuucggcuuccccgugggcgccgccacccugguggacgaggugggcguggacguggccaagcacguggccgaggaccugggcaagguguucggcgagagauucggcggcggcaaccccgagcugcugacccagauggugagcaagggcuuccugggcagaaagagcggcaagggcuucuacaucuaccaggagggcgugaagagaaaggaccugaacagcgacauggacagcauccuggccagccugaagcugccccccaagagcgaggugagcagcgacgaggacauccaguucagacuggugaccagauucgugaacgaggccgugaugugccugcaggagggcauccuggccacccccgccgagggcgacaucggcgccguguucggccugggcuucccccccugccugggcggccccuucagauucguggaccuguacggcgcccagaagaucguggacagacugaagaaguacgaggccgccuacggcaagcaguucacccccugccagcugcuggccgaccacgccaacagccccaacaagaaguucuaccaguaa

SEQ ID NO: 17910 - RNA, 1380 nt, Artificial Sequence
  HADHB__Homo_sapiens__NP_001268441
augaccauccugaccuaccccuucaagaaccugcccaccgccagcaagugggcccugagauucagcaucagaccccugagcugcagcagccagcugagagccgcccccgccgugcagaccaagaccaagaagacccuggccaagcccaacaucagaaacgugguggugguggacggcgugagaacccccuuccugcugagcggcaccagcggccugcugcacagaaccagcgugcccaaggaggugguggacuacaucaucuucggcaccgugauccaggaggugaagaccagcaacguggccagagaggccgcccugggcgccggcuucagcgacaagacccccgcccacaccgugaccauggccugcaucagcgccaaccaggccaugaccaccggcgugggccugaucgccagcggccagugcgacgugaucguggccggcggcguggagcugaugagcgacgugcccaucagacacagcagaaagaugagaaagcugaugcuggaccugaacaaggccaagagcaugggccagagacugagccugaucagcaaguucagauucaacuuccuggcccccgagcugcccgccgugagcgaguucagcaccagcgagaccaugggccacagcgccgacagacuggccgccgccuucgccgugagcagacuggagcaggacgaguacgcccugagaagccacagccuggccaagaaggcccaggacgagggccugcugagcgacguggugcccuucaaggugcccggcaaggacaccgugaccaaggacaacggcaucagacccagcagccuggagcagauggccaagcugaagcccgccuucaucaagcccuacggcaccgugaccgccgccaacagcagcuuccugaccgacggcgccagcgccaugcugaucauggccgaggagaaggcccuggccaugggcuacaagcccaaggccuaccugagagacuucauguacgugagccaggaccccaaggaccagcugcugcugggccccaccuacgccacccccaaggugcuggagaaggccggccugaccaugaacgacaucgacgccuucgaguuccacgaggccuucagcggccagauccuggccaacuucaaggccauggacagcgacugguucgccgagaacuacaugggcagaaagaccaaggugggccugcccccccuggagaaguucaacaacuggggcggcagccugagccugggccaccccuucggcgccaccggcugcagacuggugauggccgccgccaacagacugagaaaggagggcggccaguacggccugguggccgccugcgccgccggcggccagggccacgccaugaucguggaggccuaccccaaguaa

SEQ ID NO: 17911 - RNA, 996 nt, Artificial Sequence
  HADH__Homo_sapiens__NP_001171634
auggccuucgugaccagacaguucaugagaagcgugagcagcagcagcaccgccagcgccagcgccaagaagaucaucgugaagcacgugaccgugaucggcggcggccugaugggcgccggcaucgcccagguggccgccgccaccggccacaccguggugcugguggaccagaccgaggacauccuggccaagagcaagaagggcaucgaggagagccugagaaagguggccaagaagaaguucgccgagaaccccaaggccggcgacgaguucguggagaagacccugagcaccaucgccaccagcaccgacgccgccagcguggugcacagcaccgaccuggugguggaggccaucguggagaaccugaaggugaagaacgagcuguucaagagacuggacaaguucgccgccgagcacaccaucuucgccagcaacaccagcagccugcagaucaccagcaucgccaacgccaccaccagacaggacagauucgccggccugcacuucuucaaccccgugcccgugaugaagcugguggaggugaucaagacccccaugaccagccagaagaccuucgagagccugguggacuucagcaaggcccugggcaagcaccccgugagcugcaaggacacccccggcuucaucgugaacagacugcuggugcccuaccugauggaggccaucagacuguacgagagagacuuccagaccugcggcgacagcaacagcggccugggcuucagccugaagggcgacgccagcaaggaggacaucgacaccgccaugaagcugggcgccggcuaccccaugggccccuucgagcugcuggacuacgugggccuggacaccaccaaguucaucguggacggcuggcacgagauggacgccgagaacccccugcaccagcccagccccagccugaacaagcugguggccgagaacaaguucggcaagaagaccggcgagggcuucuacaaguacaaguaa

SEQ ID NO: 17912 - RNA, 783 nt, Artificial Sequence
  HAGH__Homo_sapiens__NP_001035517
augaagguggaggugcugcccgcccugaccgacaacuacauguaccuggugaucgacgacgagaccaaggaggccgccaucguggaccccgugcagccccagaaggugguggacgccgccagaaagcacggcgugaagcugaccaccgugcugaccacccaccaccacugggaccacgccggcggcaacgagaagcuggugaagcuggagagcggccugaagguguacggcggcgacgacagaaucggcgcccugacccacaagaucacccaccugagcacccugcaggugggcagccugaacgugaagugccuggccacccccugccacaccagcggccacaucugcuacuucgugagcaagcccggcggcagcgagccccccgccguguucaccggcgacacccuguucguggccggcugcggcaaguucuacgagggcaccgccgacgagaugugcaaggcccugcuggaggugcugggcagacugccccccgacaccagaguguacugcggccacgaguacaccaucaacaaccugaaguucgccagacacguggagcccggcaacgccgccaucagagagaagcuggccugggccaaggagaaguacagcaucggcgagcccaccgugcccagcacccuggccgaggaguucaccuacaaccccuucaugagagugagagagaagaccgugcagcagcacgccggcgagaccgaccccgugaccaccaugagagccgugagaagagagaaggaccaguucaagaugcccagagacuaa

SEQ ID NO: 17913 - RNA, 1350 nt, Artificial Sequence
  HAL__Homo_sapiens__NP_001245262
augcugcuggcccugagaaucaacgugcuggccaagggcuacagcggcaucagccuggagacccugaagcaggugaucgagauguucaacgccagcugccugcccuacgugcccgagaagggcaccgugggcgccagcggcgaccuggccccccugagccaccuggcccugggccuggugggcgagggcaagauguggagccccaagagcggcugggccgacgccaaguacgugcuggaggcccacggccugaagcccgugauccugaagcccaaggagggccuggcccugaucaacggcacccagaugaucaccagccugggcugcgaggccguggagagagccagcgccaucgccagacaggccgacaucguggccgcccugacccuggaggugcugaagggcaccaccaaggccuucgacaccgacauccacgcccugagaccccacagaggccagaucgagguggccuucagauucagaagccugcuggacagcgaccaccaccccagcgagaucgccgagagccacagauucugcgacagagugcaggacgccuacacccugagaugcugcccccaggugcacggcguggugaacgacaccaucgccuucgugaagaacaucaucaccaccgagcugaacagcgccaccgacaaccccaugguguucgccaacagaggcgagaccgugagcggcggcaacuuccacggcgaguaccccgccaaggcccuggacuaccuggccaucggcauccacgagcuggccgccaucagcgagagaagaaucgagagacugugcaaccccagccugagcgagcugcccgccuuccugguggccgagggcggccugaacagcggcuucaugaucgcccacugcaccgccgccgcccuggugagcgagaacaaggcccugugccaccccagcagcguggacagccugagcaccagcgccgccaccgaggaccacgugagcaugggcggcugggccgccagaaaggcccugagagugaucgagcacguggagcaggugcuggccaucgagcugcuggccgccugccagggcaucgaguuccugagaccccugaagaccaccaccccccuggagaagguguacgaccuggugagaagcguggugagacccuggaucaaggacagauucauggcccccgacaucgaggccgcccacagacugcugcuggagcagaaggugugggagguggccgcccccuacaucgagaaguacagaauggagcacauccccgagagcagaccccugagccccaccgccuucagccugcaguuccugcacaagaagagcaccaagauccccgagagcgaggaccuguaa

SEQ ID NO: 17914 - RNA, 255 nt, Artificial Sequence
  HAMP__Homo_sapiens__NP_066998
auggcccugagcagccagaucugggccgccugccugcugcugcugcugcugcuggccagccugaccagcggcagcguguucccccagcagaccggccagcuggccgagcugcagccccaggacagagccggcgccagagccagcuggaugcccauguuccagagaagaagaagaagagacacccacuuccccaucugcaucuucugcugcggcugcugccacagaagcaagugcggcaugugcugcaagaccuaa

SEQ ID NO: 17915 - RNA, 648 nt, Artificial Sequence
  HAND1__Homo_sapiens__NP_004812
augaaccuggugggcagcuacgcccaccaccaccaccaccaccacccccaccccgcccaccccaugcugcacgagcccuuccuguucggccccgccagcagaugccaccaggagagacccuacuuccagagcuggcugcugagccccgccgacgccgcccccgacuuccccgccggcggccccccccccgccgccgccgccgccgccaccgccuacggccccgacgccagacccggccagagccccggcagacuggaggcccugggcggcagacugggcagaagaaagggcagcggccccaagaaggagagaagaagaaccgagagcaucaacagcgccuucgccgagcugagagagugcauccccaacgugcccgccgacaccaagcugagcaagaucaagacccugagacuggccaccagcuacaucgccuaccugauggacgugcuggccaaggacgcccagagcggcgaccccgaggccuucaaggccgagcugaagaaggccgacggcggcagagagagcaagagaaagagagagcugcagcagcacgagggcuucccccccgcccugggccccguggagaagagaaucaagggcagaaccggcuggccccagcaggugugggcccuggagcugaaccaguaa

SEQ ID NO: 17916 - RNA, 654 nt, Artificial Sequence
  HAND2__Homo_sapiens__NP_068808
augagccuggugggcggcuucccccaccaccccguggugcaccacgagggcuaccccuucgccgccgccgccgccgccgccgccgccgccgccgccagcagaugcagccacgaggagaaccccuacuuccacggcuggcugaucggccaccccgagaugagcccccccgacuacagcauggcccugagcuacagccccgaguacgccagcggcgccgccggccuggaccacagccacuacggcggcgugccccccggcgccggcccccccggccugggcggccccagacccgugaagagaagaggcaccgccaacagaaaggagagaagaagaacccagagcaucaacagcgccuucgccgagcugagagagugcauccccaacgugcccgccgacaccaagcugagcaagaucaagacccugagacuggccaccagcuacaucgccuaccugauggaccugcuggccaaggacgaccagaacggcgaggccgaggccuucaaggccgagaucaagaagaccgacgugaaggaggagaagagaaagaaggagcugaacgagauccugaagagcaccgugagcagcaacgacaagaagaccaagggcagaaccggcuggccccagcacgugugggcccuggagcugaagcaguaa

SEQ ID NO: 17917 - RNA, 1113 nt, Artificial Sequence
  HAO1__Homo_sapiens__NP_060015
augcugcccagacugaucugcaucaacgacuacgagcagcacgccaagagcgugcugcccaagagcaucuacgacuacuacagaagcggcgccaacgacgaggagacccuggccgacaacaucgccgccuucagcagauggaagcuguaccccagaaugcugagaaacguggccgagaccgaccugagcaccagcgugcugggccagagagugagcaugcccaucugcgugggcgccaccgccaugcagagaauggcccacguggacggcgagcuggccaccgugagagccugccagagccugggcaccggcaugaugcugagcagcugggccaccagcagcaucgaggagguggccgaggccggccccgaggcccugagauggcugcagcuguacaucuacaaggacagagaggugaccaagaagcuggugagacaggccgagaagaugggcuacaaggccaucuucgugaccguggacacccccuaccugggcaacagacuggacgacgugagaaacagauucaagcugcccccccagcugagaaugaagaacuucgagaccagcacccugagcuucagccccgaggagaacuucggcgacgacagcggccuggccgccuacguggccaaggccaucgaccccagcaucagcugggaggacaucaaguggcugagaagacugaccagccugcccaucguggccaagggcauccugagaggcgacgacgccagagaggccgugaagcacggccugaacggcauccuggugagcaaccacggcgccagacagcuggacggcgugcccgccaccaucgacgugcugcccgagaucguggaggccguggagggcaagguggagguguuccuggacggcggcgugagaaagggcaccgacgugcugaaggcccuggcccugggcgccaaggccguguucgugggcagacccaucguguggggccuggccuuccagggcgagaagggcgugcaggacgugcuggagauccugaaggaggaguucagacuggccauggcccugagcggcugccagaacgugaaggugaucgacaagacccuggugagaaagaacccccuggccgugagcaagaucuaa

SEQ ID NO: 17918 - RNA, 1149 nt, Artificial Sequence
  HAO2__Homo_sapiens__XP_011539860
augagccuggugugccugaccgacuuccaggcccacgccagagagcagcugagcaagagcaccagagacuucaucgagggcggcgccgacgacagcaucaccagagacgacaacaucgccgccuucaagagaaucagacugagacccagauaccugagagacgugagcgagguggacaccagaaccaccauccagggcgaggagaucagcgcccccaucugcaucgcccccaccggcuuccacugccugguguggcccgacggcgagaugagcaccgccagagcccccgagggccugagaugguuccagcuguacgugcaccccgaccugcagcugaacaagcagcugauccagagaguggagagccugggcuucaaggcccuggugaucacccuggacacccccgugugcggcaacagaagacacgacaucagaaaccagcugagaagaaaccugacccugaccgaccugcagagccccaagaagggcaacgccauccccuacuuccagaugacccccaucagcaccagccugugcuggaacgaccugagcugguuccagagcaucaccagacugcccaucauccugaagggcauccugaccaaggaggacgccgagcuggccgugaagcacaacgugcagggcaucaucgugagcaaccacggcggcagacagcuggacgaggugcuggccagcaucgacgcccugaccgaggugguggccgccgugaagggcaagaucgagguguaccuggacggcggcgugagaaccggcaacgacgugcugaaggcccuggcccugggcgccaagugcaucuuccugggcagacccauccuguggggccuggccugcaaggccgccggcagaagccugagaagcaucgagaccuggagcagcuuccccggcugcaagaagaagggccccaucaccagacugcugagacugcccaccggcggcagccagacccacagcaccgugugcgacgccgugcugcccggcccccacagcgugagaagacugauggcccacaucagccacaucagcaacaccaccacccccgugcugcaggcccugcagacccccguguuccccaagugcagcaugcccuucuucgugagccugaccaucaucugcugcagccuggccuaa

SEQ ID NO: 17919 - RNA, 1809 nt, Artificial Sequence
  HAP1__Homo_sapiens__NP_001073339
augagacccaagagacugggcagaugcugcgccggcagcagacugggccccggcgaccccgccgcccugaccugcgcccccagccccagcgccagccccgcccccgagcccagcgcccagccccaggccagaggcaccggccagagagugggcagcagagccaccagcggcagccaguuccugagcgaggccagaaccggcgccagacccgccagcgaggccggcgccaaggccggcgccagaagacccagcgccuucagcgccauccagggcgacgugagaagcaugcccgacaacagcgacgcccccuggaccagauucguguuccagggccccuucggcagcagagccaccggcagaggcaccggcaaggccgccggcaucuggaagacccccgccgccuacgugggcagaagacccggcgugagcggccccgagagagccgccuucaucagagagcuggaggaggcccugugccccaaccugcccccccccgugaagaagaucacccaggaggacgugaaggugaugcuguaccugcuggaggaggugugcaccgccuuccugauccagcugcugccccccgugugggagagcgugaccuacggcauggugcugcagagagagagagaccugaacaccgccgccagaaucggccagagccuggugaagcagaacagcgugcugauggaggagaacagcaagcuggaggcccugcugggcagcgccaaggaggagauccuguaccugagacaccaggugaaccugagagacgagcugcugcagcuguacagcgacagcgacgaggaggacgaggacgaggaggaggaggaggaggagaaggaggccgaggaggagcaggaggaggaggaggccgaggaggaccugcagugcgcccaccccugcgacgcccccaagcugaucagccaggaggcccugcugcaccagcaccacugcccccagcuggaggcccugcaggagaagcugagacugcuggaggaggagaaccaccagcugagagaggaggccagccagcuggacacccuggaggacgaggagcagaugcugauccuggagugcguggagcaguucagcgaggccagccagcagauggccgagcugagcgaggugcuggugcugagacuggagaacuacgagagacagcagcaggagguggccagacugcaggcccaggugcugaagcugcagcagagaugcagaauggagacccugcccggcuuccaggagacccuggccgaggagcugagaaccagccugagaagaaugaucagcgaccccguguacuucauggagagaaacuacgagaugcccagaggcgacaccagcagccugagauacgacuucagauacagcgaggacagagagcaggugagaggcuucgaggccgaggagggccugaugcuggccgccgacaucaugagaggcgaggacuucacccccgccgaggaguucgugccccaggaggagcugggcgccgccaagaaggugcccgccgaggagggcgugauggaggaggccgagcuggugagcgaggagaccgagggcugggaggagguggagcuggagcuggacgaggccaccagaaugaacguggugaccagcgcccuggaggccagcggccugggccccagccaccuggacaugaacuacgugcugcagcagcuggccaacuggcaggacgcccacuacagaagacagcugagauggaagaugcugcagaagggcgagugcccccacggcgcccugcccgccgccagcagaaccagcugcagaagcagcugcagauaa

SEQ ID NO: 17920 - RNA, 1065 nt, Artificial Sequence
  HAPLN1__Homo_sapiens__NP_001875
augaagagccugcugcugcuggugcugaucagcaucugcugggccgaccaccugagcgacaacuacacccuggaccacgacagagccauccacauccaggccgagaacggcccccaccugcugguggaggccgagcaggccaagguguucagccacagaggcggcaacgugacccugcccugcaaguucuacagagaccccaccgccuucggcagcggcauccacaagaucagaaucaaguggaccaagcugaccagcgacuaccugaaggagguggacguguucgugagcaugggcuaccacaagaagaccuacggcggcuaccagggcagaguguuccugaagggcggcagcgacagcgacgccagccuggugaucaccgaccugacccuggaggacuacggcagauacaagugcgaggugaucgagggccuggaggacgacaccguggugguggcccuggaccugcagggcgugguguuccccuacuuccccagacugggcagauacaaccugaacuuccacgaggcccagcaggccugccuggaccaggacgccgugaucgccagcuucgaccagcuguacgacgccuggagaggcggccuggacuggugcaacgccggcuggcugagcgacggcagcgugcaguaccccaucaccaagcccagagagcccugcggcggccagaacaccgugcccggcgugagaaacuacggcuucugggacaaggacaagagcagauacgacguguucugcuucaccagcaacuucaacggcagauucuacuaccugauccaccccaccaagcugaccuacgacgaggccgugcaggccugccugaacgacggcgcccagaucgccaaggugggccagaucuucgccgccuggaagauccugggcuacgacagaugcgacgccggcuggcuggccgacggcagcgugagauaccccaucagcagacccagaagaagaugcagccccaccgaggccgccgugagauucgugggcuuccccgacaagaagcacaagcuguacggcguguacugcuucagagccuacaacuaa

SEQ ID NO: 17921 - RNA, 1209 nt, Artificial Sequence
  HAPLN4__Homo_sapiens__NP_075378
auggugugcgccagagccgcccugggccccggcgcccugugggccgccgccuggggcgugcugcugcugaccgcccccgccggcgcccagagaggcagaaagaagguggugcacgugcuggagggcgagagcggcagcgugguggugcagaccgcccccggccagguggugagccacagaggcggcaccaucgugcugcccugcagauaccacuacgaggccgccgcccacggccacgacggcgugagacugaaguggaccaaggugguggacccccuggccuucaccgacguguucguggcccugggcccccagcacagagccuucggcagcuacagaggcagagccgagcugcagggcgacggccccggcgacgccagccuggugcugagaaacgugacccugcaggacuacggcagauacgagugcgaggugaccaacgagcuggaggacgacgccggcauggugaagcuggaccuggagggcgugguguuccccuaccaccccagaggcggcagauacaagcugaccuucgccgaggcccagagagccugcgccgagcaggacggcauccuggccagcgccgagcagcugcacgccgccuggagagacggccuggacuggugcaacgccggcuggcugagagacggcagcgugcaguaccccgugaacagacccagagagcccugcggcggccugggcggcaccggcagcgccggcggcggcggcgacgccaacggcggccugagaaacuacggcuacagacacaacgccgaggagagauacgacgccuucugcuucaccagcaaccugcccggcagaguguucuuccugaagccccugagacccgugcccuucagcggcgccgccagagccugcgccgccagaggcgccgccguggccaaggugggccagcuguucgccgccuggaagcugcagcugcuggacagaugcaccgccggcuggcuggccgacggcagcgccagauaccccaucgugaaccccagagccagaugcggcggcagaagacccggcgugagaagccugggcuuccccgacgccaccagaagacuguucggcguguacugcuacagagcccccggcgcccccgaccccgcccccggcggcuggggcuggggcugggccggcggcggcggcugggccggcggcgccagagaccccgccgccuggaccccccugcacguguaa

SEQ ID NO: 17922 - RNA, 1446 nt, Artificial Sequence
  HARS2__Homo_sapiens__NP_001265660
augccccugcugggccugcugcccagaagagccugggccagccugcugagccagcugcugagaccccccugcgccagcugcaccggcgccgugagaugccagagccagggcaccagagaccugagcccccagcacaugguggugagagagaagauccuggaccuggugaucagcugcuucaagagacacggcgccaagggcauggacacccccgccuucgagcugaaggagacccugaccgagaaguacggcgaggacagcggccugauguacgaccugaaggaccagggcggcgagcugcugagccugagauacgaccugaccgugcccuucgccagauaccuggccaugaacaaggugaagaagaugaagagauaccacgugggcaagguguggagaagagagagccccaccaucgugcagggcagauacagagaguucugccagugcgacuucgacaucgccggccaguucgaccccaugauccccgacgccgagugccugaagaucaugugcgagauccugagcggccugcagcugggcgacuuccugaucaaggugaacgacagaagaaucguggacggcauguucgccgugugcggcgugcccgagagcaaguucagagccaucugcagcagcaucgacaagcuggacaagauggccuggaaggacgugagacacgagaugguggugaagaagggccuggcccccgagguggccgacagaaucggcgacuacgugcagugccacggcggcgugagccugguggagcagauguuccaggaccccagacugagccagaacaagcaggcccuggagggccugggcgaccugaagcugcuguucgaguaccugacccuguucggcaucgccgacaagaucagcuucgaccugagccuggccagaggccuggacuacuacaccggcgugaucuacgaggccgugcugcugcagacccccacccaggccggcgaggagccccugaacgugggcagcguggccgccggcggcagauacgacggccuggugggcauguucgaccccaagggccacaaggugcccugcgugggccugagcaucggcguggagagaaucuucuacaucguggagcagagaaugaagaccaagggcgagaaggugagaaccaccgagacccagguguucguggccaccccccagaagaacuuccugcaggagagacugaagcugaucgccgagcugugggacagcggcaucaaggccgagaugcuguacaagaacaaccccaagcugcugacccagcugcacuacugcgagagcaccggcaucccccugguggugaucaucggcgagcaggagcugaaggagggcgugaucaagaucagaagcguggccagcagagaggagguggccaucaagagagagaacuucguggccgagauccagaagagacugagcgagagcuaa

SEQ ID NO: 17923 - RNA, 1410 nt, Artificial Sequence
  HARS__Homo_sapiens__NP_001244969
auggccgagagagccgcccuggaggagcuggugaagcugcagggcgagagagugagaggccugaagcagcagaaggccagcgccgagcugaucgaggaggagguggccaagcugcugaagcugaaggcccagcugggccccgacgagagcaagcagaaguucgugcugaagacccccaaggagacccugaugggcaaguacggcgaggacagcaagcugaucuacgaccugaaggaccagggcggcgagcugcugagccugagauacgaccugaccgugcccuucgccagauaccuggccaugaacaagcugaccaacaucaagagauaccacaucgccaagguguacagaagagacaaccccgccaugaccagaggcagauacagagaguucuaccagugcgacuucgacaucgccggcaacuucgaccccaugauccccgacgccgagugccugaagaucaugugcgagauccugagcagccugcagaucggcgacuuccuggugaaggugaacgacagaagaauccuggacggcauguucgccaucugcggcgugagcgacagcaaguucagaaccaucugcagcagcguggacaagcuggacaaggugagcugggaggaggugaagaacgagauggugggcgagaagggccuggcccccgagguggccgacagaaucggcgacuacgugcagcagcacggcggcgugagccugguggagcagcugcugcaggaccccaagcugagccagaacaagcaggcccuggagggccugggcgaccugaagcugcuguucgaguaccugacccuguucggcaucgacgacaagaucagcuucgaccugagccuggccagaggccuggacuacuacaccggcgugaucuacgaggccgugcugcugcagacccccgcccaggccggcgaggagccccugggcgugggcagcguggccgccggcggcagauacgacggccuggugggcauguucgaccccaagggcagaaaggugcccugcgugggccugagcaucggcguggagagaaucuucagcaucguggagcagagacuggaggcccuggaggagaagaucagaaccaccgagacccaggugcugguggccagcgcccagaagaagcugcuggaggagagacugaagcuggugagcgagcugugggacgccggcaucaaggccgagcugcuguacaagaagaaccccaagcugcugaaccagcugcaguacugcgaggaggccggcaucccccugguggccaucaucggcgagcaggagcugaaggacggcgugaucaagcugagaagcgugaccagcagagaggagguggacgugagaagagaggaccugguggaggagaucaagagaagaaccggccagccccugugcaucugcuaa

SEQ ID NO: 17924 - RNA, 1734 nt, Artificial Sequence
  HAS1__Homo_sapiens__NP_001284365
augagacaggacgcccccaagcccacccccgccgccugcagaugcagcggccuggccagaagagugcugaccaucgccuucgcccugcugauccugggccugaugaccugggccuacgccgccggcgugccccuggccagcgacagauacggccugcuggccuucggccuguacggcgccuuccugagcgcccaccugguggcccagagccuguucgccuaccuggagcacagaagaguggccgccgccgccagaggcccccuggacgccgccaccgccagaagcguggcccugaccaucagcgccuaccaggaggaccccgccuaccugagacagugccuggccagcgccagagcccugcuguaccccagagccagacugagagugcugauggugguggacggcaacagagccgaggaccuguacaugguggacauguucagagagguguucgccgacgaggaccccgccaccuacgugugggacggcaacuaccaccagcccugggagcccgccgccgccggcgccgugggcgccggcgccuacagagagguggaggccgaggaccccggcagacuggccguggaggcccuggugagaaccagaagaugcgugugcguggcccagagauggggcggcaagagagaggugauguacaccgccuucaaggcccugggcgacagcguggacuacgugcaggugugcgacagcgacaccagacuggaccccauggcccugcuggagcuggugagagugcuggacgaggaccccagagugggcgccgugggcggcgacgugagaauccugaacccccuggacagcugggugagcuuccugagcagccugagauacuggguggccuucaacguggagagagccugccagagcuacuuccacugcgugagcugcaucagcggcccccugggccuguacagaaacaaccugcugcagcaguuccuggaggccugguacaaccagaaguuccugggcacccacugcaccuucggcgacgacagacaccugaccaacagaaugcugagcaugggcuacgccaccaaguacaccagcagaagcagaugcuacagcgagacccccagcagcuuccugagauggcugagccagcagaccagauggagcaagagcuacuucagagaguggcuguacaacgcccugugguggcacagacaccacgccuggaugaccuacgaggccguggugagcggccuguuccccuucuucguggccgccaccgugcugagacuguucuacgccggcagacccugggcccugcugugggugcugcugugcgugcagggcguggcccuggccaaggccgccuucgccgccuggcugagaggcugccugagaauggugcugcugagccuguacgccccccuguacaugugcggccugcugcccgccaaguuccuggcccuggugaccaugaaccagagcggcuggggcaccagcggcagaagaaagcuggccgccaacuacgugccccugcugccccuggcccugugggcccugcugcugcugggcggccuggugagaagcguggcccacgaggccagagccgacuggagcggccccagcagagccgccgaggccuaccaccuggccgccggcgccggcgccuacgugggcuacuggguggccaugcugacccuguacugggugggcgugagaagacugugcagaagaagaaccggcggcuacagagugcagguguaa

SEQ ID NO: 17925 - RNA, 1659 nt, Artificial Sequence
  HAS2__Homo_sapiens__XP_011515304
augcacugcgagagauuccugugcauccugagaaucaucggcaccacccuguucggcgugagccugcugcugggcaucaccgccgccuacaucgugggcuaccaguucauccagaccgacaacuacuacuucagcuucggccuguacggcgccuuccuggccagccaccugaucauccagagccuguucgccuuccuggagcacagaaagaugaagaagagccuggagacccccaucaagcugaacaagaccguggcccugugcaucgccgccuaccaggaggaccccgacuaccugagaaagugccugcagagcgugaagagacugaccuaccccggcaucaagguggugauggugaucgacggcaacagcgaggacgaccuguacaugauggacaucuucagcgaggugaugggcagagacaagagcgccaccuacaucuggaagaacaacuuccacgagaagggccccggcgagaccgacgagagccacaaggagagcagccagcacgugacccagcuggugcugagcaacaagagcaucugcaucaugcagaaguggggcggcaagagagaggugauguacaccgccuucagagcccugggcagaagcguggacuacgugcaggugugcgacagcgacaccaugcuggaccccgccagcagcguggagauggugaaggugcuggaggaggaccccauggugggcggcgugggcggcgacgugcagauccugaacaaguacgacagcuggaucagcuuccugagcagcgugagauacuggauggccuucaacaucgagagagccugccagagcuacuucggcugcgugcagugcaucagcggcccccugggcauguacagaaacagccugcugcacgaguucguggaggacugguacaaccaggaguucaugggcaaccagugcagcuucggcgacgacagacaccugaccaacagagugcugagccugggcuacgccaccaaguacaccgccagaagcaagugccugaccgagacccccaucgaguaccugagauggcugaaccagcagaccagauggagcaagagcuacuucagagaguggcuguacaacgccaugugguuccacaagcaccaccuguggaugaccuacgaggccaucaucaccggcuucuuccccuucuuccugaucgccaccgugauccagcuguucuacagaggcaagaucuggaacauccugcuguuccugcugaccgugcagcuggugggccugaucaagagcagcuucgccagcugccugagaggcaacaucgugaugguguucaugagccuguacagcgugcuguacaugagcagccugcugcccgccaagauguucgccaucgccaccaucaacaaggccggcuggggcaccagcggcagaaagaccaucguggugaacuucaucggccugauccccgugagcgugugguucaccauccugcugggcggcgugaucuucaccaucuacaaggagagcaagagacccuucagcgagagcaagcagaccgugcugaucgugggcacccugcuguacgccugcuacugggugaugcugcugacccuguacguggugcugaucaacaagugcggcagaagaaagaagggccagcaguacgacauggugcuggacguguaa

SEQ ID NO: 17926 - RNA, 1662 nt, Artificial Sequence
  HAS3__Homo_sapiens__NP_005320
augcccgugcagcugaccaccgcccugagaguggugggcaccagccuguucgcccuggccgugcugggcggcauccuggccgccuacgugaccggcuaccaguucauccacaccgagaagcacuaccugagcuucggccuguacggcgccauccugggccugcaccugcugauccagagccuguucgccuuccuggagcacagaagaaugagaagagccggccaggcccugaagcugcccagccccagaagaggcagcguggcccugugcaucgccgccuaccaggaggaccccgacuaccugagaaagugccugagaagcgcccagagaaucagcuuccccgaccugaagguggugauggugguggacggcaacagacaggaggacgccuacaugcuggacaucuuccacgaggugcugggcggcaccgagcaggccggcuucuucguguggagaagcaacuuccacgaggccggcgagggcgagaccgaggccagccugcaggagggcauggacagagugagagacguggugagagccagcaccuucagcugcaucaugcagaaguggggcggcaagagagaggugauguacaccgccuucaaggcccugggcgacagcguggacuacauccaggugugcgacagcgacaccgugcuggaccccgccugcaccaucgagaugcugagagugcuggaggaggacccccaggugggcggcgugggcggcgacgugcagauccugaacaaguacgacagcuggaucagcuuccugagcagcgugagauacuggauggccuucaacguggagagagccugccagagcuacuucggcugcgugcagugcaucagcggcccccugggcauguacagaaacagccugcugcagcaguuccuggaggacugguaccaccagaaguuccugggcagcaagugcagcuucggcgacgacagacaccugaccaacagagugcugagccugggcuacagaaccaaguacaccgccagaagcaagugccugaccgagacccccaccaaguaccugagauggcugaaccagcagaccagauggagcaagagcuacuucagagaguggcuguacaacagccugugguuccacaagcaccaccuguggaugaccuacgagagcguggugaccggcuucuuccccuucuuccugaucgccaccgugauccagcuguucuacagaggcagaaucuggaacauccugcuguuccugcugaccgugcagcuggugggcaucaucaaggccaccuacgccugcuuccugagaggcaacgccgagaugaucuucaugagccuguacagccugcuguacaugagcagccugcugcccgccaagaucuucgccaucgccaccaucaacaagagcggcuggggcaccagcggcagaaagaccaucguggugaacuucaucggccugauccccgugagcaucuggguggccgugcugcugggcggccuggccuacaccgccuacugccaggaccuguucagcgagaccgagcuggccuuccuggugagcggcgccauccuguacggcugcuacuggguggcccugcugaugcuguaccuggccaucaucgccagaagaugcggcaagaagcccgagcaguacagccuggccuucgccgagguguaa

SEQ ID NO: 17927 - RNA, 1260 nt, Artificial Sequence
  HAT1__Homo_sapiens__NP_003633
auggccggcuucggcgccauggagaaguuccugguggaguacaagagcgccguggagaagaagcuggccgaguacaagugcaacaccaacaccgccaucgagcugaagcuggugagauuccccgaggaccuggagaacgacaucagaaccuucuuccccgaguacacccaccagcuguucggcgacgacgagaccgccuucggcuacaagggccugaagauccugcuguacuacaucgccggcagccugagcaccauguucagaguggaguacgccagcaagguggacgagaacuucgacugcguggaggccgacgacguggagggcaagaucagacagaucaucccccccggcuucugcaccaacaccaacgacuuccugagccugcuggagaaggagguggacuucaagcccuucggcacccugcugcacaccuacagcgugcugagccccaccggcggcgagaacuucaccuuccagaucuacaaggccgacaugaccugcagaggcuucagagaguaccacgagagacugcagaccuuccugaugugguucaucgagaccgccagcuucaucgacguggacgacgagagauggcacuacuuccugguguucgagaaguacaacaaggacggcgccacccuguucgccaccgugggcuacaugaccguguacaacuacuacguguaccccgacaagaccagacccagagugagccagaugcugauccugacccccuuccagggccagggccacggcgcccagcugcuggagaccgugcacagauacuacaccgaguuccccaccgugcuggacaucaccgccgaggaccccagcaagagcuacgugaagcugagagacuucgugcuggugaagcugugccaggaccugcccugcuucagcagagagaagcugaugcagggcuucaacgaggacauggccaucgaggcccagcagaaguucaagaucaacaagcagcacgccagaagaguguacgagauccugagacugcuggugaccgacaugagcgacgccgagcaguacagaagcuacagacuggacaucaagagaagacugaucagccccuacaagaagaagcagagagaccuggccaagaugagaaagugccugagacccgaggagcugaccaaccagaugaaccagaucgagaucagcaugcagcacgagcagcuggaggagagcuuccaggagcugguggaggacuacagaagagugaucgagagacuggcccaggaguaa

SEQ ID NO: 17928 - RNA, 1095 nt, Artificial Sequence
  HAVCR1__Homo_sapiens__NP_001166864
augcacccccagguggugauccugagccugauccugcaccuggccgacagcguggccggcagcgugaaggugggcggcgaggccggccccagcgugacccugcccugccacuacagcggcgccgugaccagcaugugcuggaacagaggcagcugcagccuguucaccugccagaacggcaucguguggaccaacggcacccacgugaccuacagaaaggacaccagauacaagcugcugggcgaccugagcagaagagacgugagccugaccaucgagaacaccgccgugagcgacagcggcguguacugcugcagaguggagcacagaggcugguucaacgacaugaagaucaccgugagccuggagaucgugccccccaaggugaccaccacccccaucgugaccaccgugcccaccgugaccaccgugagaaccagcaccaccgugcccaccaccaccaccgugcccaugaccaccgugcccaccaccaccgugcccaccaccaugagcauccccaccaccaccaccgugcugaccaccaugaccgugagcaccaccaccagcgugcccaccaccaccagcauccccaccaccaccagcgugcccgugaccaccaccgugagcaccuucgugccccccaugccccugcccagacagaaccacgagcccguggccaccagccccagcagcccccagcccgccgagacccaccccaccacccugcagggcgccaucagaagagagcccaccagcagcccccuguacagcuacaccaccgacggcaacgacaccgugaccgagagcagcgacggccuguggaacaacaaccagacccagcuguuccuggagcacagccugcugaccgccaacaccaccaagggcaucuacgccggcgugugcaucagcgugcuggugcugcuggcccugcugggcgugaucaucgccaagaaguacuucuucaagaaggaggugcagcagcugagcgugagcuucagcagccugcagaucaaggcccugcagaacgccguggagaaggaggugcaggccgaggacaacaucuacaucgagaacagccuguacgccaccgacuaa

SEQ ID NO: 17929 - RNA, 906 nt, Artificial Sequence
  HAVCR2__Homo_sapiens__NP_116171
auguucagccaccugcccuucgacugcgugcugcugcugcugcugcugcugcugaccagaagcagcgagguggaguacagagccgaggugggccagaacgccuaccugcccugcuucuacacccccgccgcccccggcaaccuggugcccgugugcuggggcaagggcgccugccccguguucgagugcggcaacguggugcugagaaccgacgagagagacgugaacuacuggaccagcagauacuggcugaacggcgacuucagaaagggcgacgugagccugaccaucgagaacgugacccuggccgacagcggcaucuacugcugcagaauccagauccccggcaucaugaacgacgagaaguucaaccugaagcuggugaucaagcccgccaaggugacccccgcccccaccagacagagagacuucaccgccgccuuccccagaaugcugaccaccagaggccacggccccgccgagacccagacccugggcagccugcccgacaucaaccugacccagaucagcacccuggccaacgagcugagagacagcagacuggccaacgaccugagagacagcggcgccaccaucagaaucggcaucuacaucggcgccggcaucugcgccggccuggcccuggcccugaucuucggcgcccugaucuucaagugguacagccacagcaaggagaagauccagaaccugagccugaucagccuggccaaccugccccccagcggccuggccaacgccguggccgagggcaucagaagcgaggagaacaucuacaccaucgaggagaacguguacgagguggaggagcccaacgaguacuacugcuacgugagcagcagacagcagcccagccagccccugggcugcagauucgccaugcccuaa

SEQ ID NO: 17930 - RNA, 696 nt, Artificial Sequence
  HAX1__Homo_sapiens__NP_001018238
augagccuguucgaccuguucagaggcuucuucggcuuccccggccccagaagcuucagccccggcggcggcaucagauuccacgacaacuucggcuucgacgaccuggugagagacuucaacagcaucuucagcgacaugggcgccuggacccugcccagccacccccccgagcugcccggccccgagagcgagacccccggcgagagacugagagagggccagacccugagagacagcaugcugaaguaccccgacagccaccagcccagaaucuucggcggcgugcuggagagcgacgccagaagcgagagcccccagcccgcccccgacuggggcagccagagacccuuccacagauucgacgacguguggcccauggacccccaccccagaaccagagaggacaacgaccuggacagccaggugagccaggagggccugggccccgugcugcagccccagcccaagagcuacuucaagagcaucagcgugaccaagaucaccaagcccgacggcaucguggaggagagaagaaccgugguggacagcgagggcagaaccgagaccaccgugaccagacacgaggccgacagcagccccagaggcgaccccgagagccccagaccccccgcccuggacgacgccuucagcauccuggaccuguuccugggcagaugguucagaagcagauaa

SEQ ID NO: 17931 - RNA, 429 nt, Artificial Sequence
  HBA2__Homo_sapiens__NP_000508
auggugcugagccccgccgacaagaccaacgugaaggccgccuggggcaaggugggcgcccacgccggcgaguacggcgccgaggcccuggagagaauguuccugagcuuccccaccaccaagaccuacuucccccacuucgaccugagccacggcagcgcccaggugaagggccacggcaagaagguggccgacgcccugaccaacgccguggcccacguggacgacaugcccaacgcccugagcgcccugagcgaccugcacgcccacaagcugagaguggaccccgugaacuucaagcugcugagccacugccugcuggugacccuggccgcccaccugcccgccgaguucacccccgccgugcacgccagccuggacaaguuccuggccagcgugagcaccgugcugaccagcaaguacagauaa

SEQ ID NO: 17932 - RNA, 444 nt, Artificial Sequence
  HBB__Homo_sapiens__NP_000509
auggugcaccugacccccgaggagaagagcgccgugaccgcccuguggggcaaggugaacguggacgaggugggcggcgaggcccugggcagacugcuggugguguaccccuggacccagagauucuucgagagcuucggcgaccugagcacccccgacgccgugaugggcaaccccaaggugaaggcccacggcaagaaggugcugggcgccuucagcgacggccuggcccaccuggacaaccugaagggcaccuucgccacccugagcgagcugcacugcgacaagcugcacguggaccccgagaacuucagacugcugggcaacgugcuggugugcgugcuggcccaccacuucggcaaggaguucaccccccccgugcaggccgccuaccagaaggugguggccggcguggccaacgcccuggcccacaaguaccacuaa

SEQ ID NO: 17933 - RNA, 444 nt, Artificial Sequence
  HBD__Homo_sapiens__NP_000510
auggugcaccugacccccgaggagaagaccgccgugaacgcccuguggggcaaggugaacguggacgccgugggcggcgaggcccugggcagacugcuggugguguaccccuggacccagagauucuucgagagcuucggcgaccugagcagccccgacgccgugaugggcaaccccaaggugaaggcccacggcaagaaggugcugggcgccuucagcgacggccuggcccaccuggacaaccugaagggcaccuucagccagcugagcgagcugcacugcgacaagcugcacguggaccccgagaacuucagacugcugggcaacgugcuggugugcgugcuggccagaaacuucggcaaggaguucaccccccagaugcaggccgccuaccagaaggugguggccggcguggccaacgcccuggcccacaaguaccacuaa

SEQ ID NO: 17934 - RNA, 444 nt, Artificial Sequence
  HBE1__Homo_sapiens__NP_005321
auggugcacuucaccgccgaggagaaggccgccgugaccagccuguggagcaagaugaacguggaggaggccggcggcgaggcccugggcagacugcuggugguguaccccuggacccagagauucuucgacagcuucggcaaccugagcagccccagcgccauccugggcaaccccaaggugaaggcccacggcaagaaggugcugaccagcuucggcgacgccaucaagaacauggacaaccugaagcccgccuucgccaagcugagcgagcugcacugcgacaagcugcacguggaccccgagaacuucaagcugcugggcaacgugauggugaucauccuggccacccacuucggcaaggaguucacccccgaggugcaggccgccuggcagaagcuggugagcgccguggccaucgcccuggcccacaaguaccacuaa

SEQ ID NO: 17935 - RNA, 627 nt, Artificial Sequence
  HBEGF__Homo_sapiens__NP_001936
augaagcugcugcccagcguggugcugaagcuguuccuggccgccgugcugagcgcccuggugaccggcgagagccuggagagacugagaagaggccuggccgccggcaccagcaaccccgacccccccaccgugagcaccgaccagcugcugccccugggcggcggcagagacagaaaggugagagaccugcaggaggccgaccuggaccugcugagagugacccugagcagcaagccccaggcccuggccacccccaacaaggaggagcacggcaagagaaagaagaagggcaagggccugggcaagaagagagaccccugccugagaaaguacaaggacuucugcauccacggcgagugcaaguacgugaaggagcugagagcccccagcugcaucugccaccccggcuaccacggcgagagaugccacggccugagccugcccguggagaacagacuguacaccuacgaccacaccaccauccuggccgugguggccguggugcugagcagcgugugccugcuggugaucgugggccugcugauguucagauaccacagaagaggcggcuacgacguggagaacgaggagaaggugaagcugggcaugaccaacagccacuaa

SEQ ID NO: 17936 - RNA, 444 nt, Artificial Sequence
  HBG1__Homo_sapiens__NP_000550
augggccacuucaccgaggaggacaaggccaccaucaccagccuguggggcaaggugaacguggaggacgccggcggcgagacccugggcagacugcuggugguguaccccuggacccagagauucuucgacagcuucggcaaccugagcagcgccagcgccaucaugggcaaccccaaggugaaggcccacggcaagaaggugcugaccagccugggcgacgccaccaagcaccuggacgaccugaagggcaccuucgcccagcugagcgagcugcacugcgacaagcugcacguggaccccgagaacuucaagcugcugggcaacgugcuggugaccgugcuggccauccacuucggcaaggaguucacccccgaggugcaggccagcuggcagaagauggugaccgccguggccagcgcccugagcagcagauaccacuaa

SEQ ID NO: 17937 - RNA, 444 nt, Artificial Sequence
  HBG2__Homo_sapiens__NP_000175
augggccacuucaccgaggaggacaaggccaccaucaccagccuguggggcaaggugaacguggaggacgccggcggcgagacccugggcagacugcuggugguguaccccuggacccagagauucuucgacagcuucggcaaccugagcagcgccagcgccaucaugggcaaccccaaggugaaggcccacggcaagaaggugcugaccagccugggcgacgccaucaagcaccuggacgaccugaagggcaccuucgcccagcugagcgagcugcacugcgacaagcugcacguggaccccgagaacuucaagcugcugggcaacgugcuggugaccgugcuggccauccacuucggcaaggaguucacccccgaggugcaggccagcuggcagaagauggugaccggcguggccagcgcccugagcagcagauaccacuaa

SEQ ID NO: 17938 - RNA, 426 nt, Artificial Sequence
  HBM__Homo_sapiens__NP_001003938
augcugagcgcccaggagagagcccagaucgcccaggugugggaccugaucgccggccacgaggcccaguucggcgccgagcugcugcugagacuguucaccguguaccccagcaccaagguguacuucccccaccugagcgccugccaggacgccacccagcugcugagccacggccagagaaugcuggccgccgugggcgccgccgugcagcacguggacaaccugagagccgcccugagcccccuggccgaccugcacgcccuggugcugagaguggaccccgccaacuucccccugcugauccagugcuuccacguggugcuggccagccaccugcaggacgaguucaccgugcagaugcaggccgccugggacaaguuccugaccggcguggccguggugcugaccgagaaguacagauaa

SEQ ID NO: 17939 - RNA, 1575 nt, Artificial Sequence
  HBP1__Homo_sapiens__NP_001231191
auggccaccggccugagcgagcaccacaacauggugugggaggugaagaccaaccagaugcccaacgccgugcagaagcugcugcuggugauggacaagagagccagcggcaugaacgacagccuggagcugcugcagugcaacgagaaccugcccagcagccccggcuacaacagcugcgacgagcacauggagcuggacgaccugcccgagcugcaggccgugcagagcgaccccacccagagcggcauguaccagcugagcagcgacgugagccaccaggaguaccccagaagcagcuggaaccagaacaccagcgacauccccgagaccaccuacagagagaacgagguggacuggcugaccgagcuggccaacaucgccaccagcccccagagcccccugaugcagugcagcuucuacaacagaagcagccccgugcacaucaucgccaccagcaagagccugcacagcuacgccagacccccccccgugagcagcagcagcaagagcgagcccgccuucccccaccaccacuggaaggaggagacccccgugagacacgagagagccaacagcgagagcgagagcggcaucuucugcaugagcagccugagcgacgacgacgaccugggcuggugcaacagcuggcccagcaccguguggcacugcuuccugaagggcaccagacugugcuuccacaagggcagcaacaaggaguggcaggacguggaggacuucgccagagccgagggcugcgacaacgaggaggaccugcagaugggcauccacaagggcuacggcagcgacggccugaagcugcugagccacgaggagagcgugagcuucggcgagagcgugcugaagcugaccuucgaccccggcaccguggaggacggccugcugaccguggagugcaagcuggaccaccccuucuacgugaagaacaagggcuggagcagcuucuaccccagccugaccguggugcagcacggcauccccugcugcgaggugcacaucggcgacgugugccugccccccggccaccccgacgccaucaacuucgacgacagcggcguguucgacaccuucaagagcuacgacuucacccccauggacagcagcgccguguacgugcugagcagcauggccagacagagaagagccagccugagcugcggcggccccggcggccaggacuucgccagaagcggcuucagcaagaacugcggcagccccggcagcagccagcugagcagcaacagccuguacgccaaggccgugaagaaccacagcagcggcaccgugagcgccaccagccccaacaagugcaagagacccaugaacgccuucaugcuguucgccaagaaguacagaguggaguacacccagauguaccccggcaaggacaacagagccaucagcgugauccugggcgacagauggaagaagaugaagaacgaggagagaagaauguacacccuggaggccaaggcccuggccgaggagcagaagagacugaaccccgacugcuggaagagaaagagaaccaacagcggcagccagcagcacuaa

SEQ ID NO: 17940 - RNA, 429 nt, Artificial Sequence
  HBQ1__Homo_sapiens__NP_005322
auggcccugagcgccgaggacagagcccuggugagagcccuguggaagaagcugggcagcaacgugggcguguacaccaccgaggcccuggagagaaccuuccuggccuuccccgccaccaagaccuacuucagccaccuggaccugagccccggcagcagccaggugagagcccacggccagaagguggccgacgcccugagccuggccguggagagacuggacgaccugccccacgcccugagcgcccugagccaccugcacgccugccagcugagaguggaccccgccagcuuccagcugcugggccacugccugcuggugacccuggccagacacuaccccggcgacuucagccccgcccugcaggccagccuggacaaguuccugagccacgugaucagcgcccuggugagcgaguacagauaa

SEQ ID NO: 17941 - RNA, 1929 nt, Artificial Sequence
  HBS1L__Homo_sapiens__NP_001138630
auggccagacacagaaacgugagaggcuacaacuacgacgaggacuucgaggacgacgaccuguacggccagagcguggaggacgacuacugcaucagccccagcaccgccagacuguacagcugccuggaccacaugagagaggugcugggcgacgccgugcccgacgagauccugaucgaggccgugcugaagaacaaguucgacgugcagaaggcccugagcggcgugcuggagcaggacagagugcagagccugaaggacaagaacgaggccaccgugagcaccggcaagaucgccaagggcaagcccguggacagccagaccagcagaagcgagagcgagaucgugcccaagguggccaagaugaccgugagcggcaagaagcagaccaugggcuucgaggugcccggcgugagcagcgaggagaacggccacagcuuccacaccccccagaagggcccccccaucgaggacgccaucgccagcagcgacgugcuggagaccgccagcaagagcgccaaccccccccacaccauccaggccagcgaggagcagagcagcacccccgcccccgugaagaagagcggcaagcugagacagcagaucgacgugaaggccgagcuggagaagagacagggcggcaagcagcugcugaaccugguggugaucggccacguggacgccggcaagagcacccugaugggccacaugcuguaccugcugggcaacaucaacaagagaaccaugcacaaguacgagcaggagagcaagaaggccggcaaggccagcuucgccuacgccugggugcuggacgagaccggcgaggagagagagagaggcgugaccauggacgugggcaugaccaaguucgagaccaccaccaaggugaucacccugauggacgcccccggccacaaggacuucauccccaacaugaucaccggcgccgcccaggccgacguggccgugcuggugguggacgccagcagaggcgaguucgaggccggcuucgagaccggcggccagaccagagagcacggccugcuggugagaagccugggcgugacccagcuggccguggccgugaacaagauggaccaggugaacuggcagcaggagagauuccaggagaucaccggcaagcugggccacuuccugaagcaggccggcuucaaggagagcgacgugggcuucauccccaccagcggccugagcggcgagaaccugaucaccagaagccagagcagcgagcugaccaagugguacaagggccugugccugcuggagcagaucgacagcuucaagcccccccagagaagcaucgacaagcccuucagacugugcgugagcgacguguucaaggaccagggcagcggcuucugcaucaccggcaagaucgaggccggcuacauccagaccggcgacagacugcuggccaugccccccaacgagaccugcaccgugaagggcaucacccugcacgacgagcccguggacugggccgccgccggcgaccacgugagccugacccuggugggcauggacaucaucaagaucaacgugggcugcaucuucugcggccccaaggugcccaucaaggccugcaccagauucagagccagaauccugaucuucaacaucgagauccccaucaccaagggcuuccccgugcugcugcacuaccagaccgugagcgagcccgccgugaucaagagacugaucagcgugcugaacaagagcaccggcgaggugaccaagaagaagcccaaguuccugaccaagggccagaacgcccugguggagcugcagacccagagacccaucgcccuggagcuguacaaggacuucaaggagcugggcagauucaugcugagauacggcggcagcaccaucgccgccggcguggugaccgagaucaaggaguaa

SEQ ID NO: 17942 - RNA, 429 nt, Artificial Sequence
  HBZ__Homo_sapiens__NP_005323
augagccugaccaagaccgagagaaccaucaucgugagcaugugggccaagaucagcacccaggccgacaccaucggcaccgagacccuggagagacuguuccugagccacccccagaccaagaccuacuucccccacuucgaccugcaccccggcagcgcccagcugagagcccacggcagcaaggugguggccgccgugggcgacgccgugaagagcaucgacgacaucggcggcgcccugagcaagcugagcgagcugcacgccuacauccugagaguggaccccgugaacuucaagcugcugagccacugccugcuggugacccuggccgccagauuccccgccgacuucaccgccgaggcccacgccgccugggacaaguuccugagcguggugagcagcgugcugaccgagaaguacagauaa

SEQ ID NO: 17943 - RNA, 1041 nt, Artificial Sequence
  HCAR1__Homo_sapiens__NP_115943
auguacaacggcagcugcugcagaaucgagggcgacaccaucagccaggugaugcccccccugcugaucguggccuucgugcugggcgcccugggcaacggcguggcccugugcggcuucugcuuccacaugaagaccuggaagcccagcaccguguaccuguucaaccuggccguggccgacuuccugcugaugaucugccugcccuucagaaccgacuacuaccugagaagaagacacugggccuucggcgacauccccugcagagugggccuguucacccuggccaugaacagagccggcagcaucguguuccugaccgugguggccgccgacagauacuucaagguggugcacccccaccacgccgugaacaccaucagcaccagaguggccgccggcaucgugugcacccugugggcccuggugauccugggcaccguguaccugcugcuggagaaccaccugugcgugcaggagaccgccgugagcugcgagagcuucaucauggagagcgccaacggcuggcacgacaucauguuccagcuggaguucuucaugccccugggcaucauccuguucugcagcuucaagaucguguggagccugagaagaagacagcagcuggccagacaggccagaaugaagaaggccaccagauucaucauggugguggccaucguguucaucaccugcuaccugcccagcgugagcgccagacuguacuuccuguggaccgugcccagcagcgccugcgaccccagcgugcacggcgcccugcacaucacccugagcuucaccuacaugaacagcaugcuggacccccugguguacuacuucagcagccccagcuuccccaaguucuacaacaagcugaagaucugcagccugaagcccaagcagcccggccacagcaagacccagagacccgaggagaugcccaucagcaaccugggcagaagaagcugcaucagcguggccaacagcuuccagagccagagcgacggccagugggacccccacaucguggaguggcacuaa

SEQ ID NO: 17944 - RNA, 1092 nt, Artificial Sequence
  HCAR2__Homo_sapiens__NP_808219
augaacagacaccaccugcaggaccacuuccuggagaucgacaagaagaacugcugcguguucagagacgacuucaucgugaaggugcugccccccgugcugggccuggaguucaucuucggccugcugggcaacggccuggcccuguggaucuucugcuuccaccugaagagcuggaagagcagcagaaucuuccuguucaaccuggccguggccgacuuccugcugaucaucugccugcccuuccugauggacaacuacgugagaagaugggacuggaaguucggcgacauccccugcagacugaugcuguucaugcuggccaugaacagacagggcagcaucaucuuccugaccgugguggccguggacagauacuucagaguggugcacccccaccacgcccugaacaagaucagcaacagaaccgccgccaucaucagcugccugcuguggggcaucaccaucggccugaccgugcaccugcugaagaagaagaugcccauccagaacggcggcgccaaccugugcagcagcuucagcaucugccacaccuuccaguggcacgaggccauguuccugcuggaguucuuccugccccugggcaucauccuguucugcagcgccagaaucaucuggagccugagacagagacagauggacagacacgccaagaucaagagagccaucaccuucaucauggugguggccaucguguucgugaucugcuuccugcccagcgugguggugagaaucagaaucuucuggcugcugcacaccagcggcacccagaacugcgagguguacagaagcguggaccuggccuucuucaucacccugagcuucaccuacaugaacagcaugcuggaccccgugguguacuacuucagcagccccagcuuccccaacuucuucagcacccugaucaacagaugccugcagagaaagaugaccggcgagcccgacaacaacagaagcaccagcguggagcugaccggcgaccccaacaagaccagaggcgcccccgaggcccugauggccaacagcggcgagcccuggagccccagcuaccugggccccaccagccccuaa

SEQ ID NO: 17945 - RNA, 1164 nt, Artificial Sequence
  HCAR3__Homo_sapiens__NP_006009
augaacagacaccaccugcaggaccacuuccuggagaucgacaagaagaacugcugcguguucagagacgacuucaucgccaaggugcugccccccgugcugggccuggaguucaucuucggccugcugggcaacggccuggcccuguggaucuucugcuuccaccugaagagcuggaagagcagcagaaucuuccuguucaaccuggccguggccgacuuccugcugaucaucugccugcccuucgugauggacuacuacgugagaagaagcgacuggaaguucggcgacauccccugcagacuggugcuguucauguucgccaugaacagacagggcagcaucaucuuccugaccgugguggccguggacagauacuucagaguggugcacccccaccacgcccugaacaagaucagcaacuggaccgccgccaucaucagcugccugcuguggggcaucaccgugggccugaccgugcaccugcugaagaagaagcugcugauccagaacggcaccgccaacgugugcaucagcuucagcaucugccacaccuucagauggcacgaggccauguuccugcuggaguucuuccugccccugggcaucauccuguucugcagcgccagaaucaucuggagccugagacagagacagauggacagacacgccaagaucaagagagccaucaccuucaucauggugguggccaucguguucgugaucugcuuccugcccagcgugguggugagaauccacaucuucuggcugcugcacaccagcggcacccagaacugcgagguguacagaagcguggaccuggccuucuucaucacccugagcuucaccuacaugaacagcaugcuggaccccgugguguacuacuucagcagccccagcuuccccaacuucuucagcacccugaucaacagaugccugcagagaaagaucaccggcgagcccgacaacaacagaagcaccagcguggagcugaccggcgaccccaacaagaccagaggcgcccccgaggcccugaucgccaacagcggcgagcccuggagccccagcuaccugggccccaccagcaacaaccacagcaagaagggccacugccaccaggagcccgccagccuggagaagcagcugggcugcugcaucgaguaa

SEQ ID NO: 17946 - RNA, 807 nt, Artificial Sequence
  HCCS__Homo_sapiens__NP_001116080
augggccugagccccagcgcccccgccguggccgugcaggccagcaacgccagcgccagcccccccagcggcugccccaugcacgagggcaagaugaagggcugccccgugaacaccgagcccagcggccccaccugcgagaagaagaccuacagcgugcccgcccaccaggagagagccuacgaguacguggagugccccaucagaggcaccgccgccgagaacaaggagaaccuggaccccagcaaccugaugcccccccccaaccagacccccgcccccgaccagcccuucgcccugagcaccgugagagaggagagcagcauccccagagccgacagcgagaagaaguggguguaccccagcgagcagauguucuggaacgccaugcugaagaagggcuggaaguggaaggacgaggacaucagccagaaggacauguacaacaucaucagaauccacaaccagaacaacgagcaggccuggaaggagauccugaagugggaggcccugcacgccgccgagugccccugcggccccagccugaucagauucggcggcaaggccaaggaguacagccccagagccagaaucagaagcuggaugggcuacgagcugcccuucgacagacacgacuggaucaucaacagaugcggcaccgaggugagauacgugaucgacuacuacgacggcggcgaggugaacaaggacuaccaguucaccauccuggacgugagacccgcccuggacagccugagcgccgugugggacagaaugaagguggccugguggagauggaccagcuaa

SEQ ID NO: 17947 - RNA, 6108 nt, Artificial Sequence
  HCFC1__Homo_sapiens__NP_005325
auggccagcgccgugagccccgccaaccugcccgccgugcugcugcagcccagauggaagagaguggugggcuggagcggccccgugcccagacccagacacggccacagagccguggccaucaaggagcugaucgugguguucggcggcggcaacgagggcaucguggacgagcugcacguguacaacaccgccaccaaccagugguucauccccgccgugagaggcgacaucccccccggcugcgccgccuacggcuucgugugcgacggcaccagacugcugguguucggcggcaugguggaguacggcaaguacagcaacgaccuguacgagcugcaggccagcagaugggaguggaagagacugaaggccaagacccccaagaacggccccccccccugccccagacugggccacagcuucagccuggugggcaacaagugcuaccuguucggcggccuggccaacgacagcgaggaccccaagaacaacauccccagauaccugaacgaccuguacauccuggagcugagacccggcagcggcgugguggccugggacauccccaucaccuacggcgugcugcccccccccagagagagccacaccgccgugguguacaccgagaaggacaacaagaagagcaagcuggugaucuacggcggcaugagcggcugcagacugggcgaccuguggacccuggacaucgacacccugaccuggaacaagcccagccugagcggcguggccccccugcccagaagccugcacagcgccaccaccaucggcaacaagauguacguguucggcggcugggugccccuggugauggacgacgugaagguggccacccacgagaaggaguggaagugcaccaacacccuggccugccugaaccuggacaccauggccugggagaccauccugauggacacccuggaggacaacauccccagagccagagccggccacugcgccguggccaucaacaccagacuguacaucuggagcggcagagacggcuacagaaaggccuggaacaaccaggugugcugcaaggaccugugguaccuggagaccgagaagccccccccccccgccagagugcagcuggugagagccaacaccaacagccuggaggugagcuggggcgccguggccaccgccgacagcuaccugcugcagcugcagaaguacgacauccccgccaccgccgccaccgccaccagccccacccccaaccccgugcccagcgugcccgccaacccccccaagagccccgcccccgccgccgccgcccccgccgugcagccccugacccaggugggcaucacccugcugccccaggccgcccccgccccccccaccaccaccaccauccaggugcugcccaccgugcccggcagcagcaucagcgugcccaccgccgccagaacccagggcgugcccgccgugcugaaggugaccggcccccaggccaccaccggcaccccccuggugaccaugagacccgccagccaggccggcaaggcccccgugaccgugaccagccugcccgccggcgugagaaugguggugcccacccagagcgcccagggcaccgugaucggcagcagcccccagaugagcggcauggccgcccuggccgccgccgccgccgccacccagaagaucccccccagcagcgcccccaccgugcugagcgugcccgccggcaccaccaucgugaagaccauggccgugacccccggcaccaccacccugcccgccaccgugaagguggccagcagccccgugauggugagcaaccccgccaccagaaugcugaagaccgccgccgcccaggugggcaccagcgugagcagcgccaccaacaccagcaccagacccaucaucaccgugcacaagagcggcaccgugaccguggcccagcaggcccagguggugaccaccguggugggcggcgugaccaagaccaucacccuggugaagagccccaucagcgugcccggcggcagcgcccugaucagcaaccugggcaaggugaugagcguggugcagaccaagcccgugcagaccagcgccgugaccggccaggccagcaccggccccgugacccagaucauccagaccaagggcccccugcccgccggcaccauccugaagcuggugaccagcgccgacggcaagcccaccaccaucaucaccaccacccaggccagcggcgccggcaccaagcccaccauccugggcaucagcagcgugagccccagcaccaccaagcccggcaccaccaccaucaucaagaccauccccaugagcgccaucaucacccaggccggcgccaccggcgugaccagcagccccggcaucaagagccccaucaccaucaucaccaccaaggugaugaccagcggcaccggcgcccccgccaagaucaucaccgccgugcccaagaucgccaccggccacggccagcagggcgugacccagguggugcugaagggcgcccccggccagcccggcaccauccugagaaccgugcccaugggcggcgugagacuggugacccccgugaccgugagcgccgugaagcccgccgugaccacccugguggugaagggcaccaccggcgugaccacccugggcaccgugaccggcaccgugagcaccagccuggccggcgccggcggccacagcaccagcgccagccuggccacccccaucaccacccugggcaccaucgccacccugagcagccaggugaucaaccccaccgccaucaccgugagcgccgcccagaccacccugaccgccgccggcggccugaccacccccaccaucaccaugcagcccgugagccagcccacccaggugacccugaucaccgcccccagcggcguggaggcccagcccgugcacgaccugcccgugagcauccuggccagccccaccaccgagcagcccaccgccaccgugaccaucgccgacagcggccagggcgacgugcagcccggcaccgugacccuggugugcagcaacccccccugcgagacccacgagaccggcaccaccaacaccgccaccaccaccgugguggccaaccugggcggccacccccagcccacccaggugcaguucgugugcgacagacaggaggccgccgccagccuggugaccagcaccgugggccagcagaacggcagcguggugagagugugcagcaacccccccugcgagacccacgagaccggcaccaccaacaccgccaccaccgccaccagcaacauggccggccagcacggcugcagcaacccccccugcgagacccacgagaccggcaccaccaacaccgccaccaccgccaugagcagcgugggcgccaaccaccagagagacgccagaagagccugcgccgccggcacccccgccgugaucagaaucagcguggccaccggcgcccuggaggccgcccagggcagcaagagccagugccagaccagacagaccagcgccaccagcaccaccaugaccgugauggccaccggcgcccccugcagcgccggcccccugcugggccccagcauggccagagagcccggcggcagaagccccgccuucgugcagcuggccccccugagcagcaaggugagacugagcagccccagcaucaaggaccugcccgccggcagacacagccacgccgugagcaccgccgccaugaccagaagcagcgugggcgccggcgagcccagaauggcccccgugugcgagagccugcagggcggcagccccagcaccaccgugaccgugaccgcccuggaggcccugcugugccccagcgccaccgugacccaggugugcagcaacccccccugcgagacccacgagaccggcaccaccaacaccgccaccaccagcaacgccggcagcgcccagagagugugcagcaacccccccugcgagacccacgagaccggcaccacccacaccgccaccaccgccaccagcaacggcggcaccggccagcccgagggcggccagcagccccccgccggcagacccugcgagacccaccagaccaccagcaccggcaccaccaugagcgugagcgugggcgcccugcugcccgacgccaccagcagccacagaaccguggagagcggccuggagguggccgccgcccccagcgugaccccccaggccggcaccgcccugcuggcccccuuccccacccagagagugugcagcaacccccccugcgagacccacgagaccggcaccacccacaccgccaccaccgugaccagcaacaugagcagcaaccaggaccccccccccgccgccagcgaccagggcgagguggagagcacccagggcgacagcgugaacaucaccagcagcagcgccaucaccaccaccgugagcagcacccugaccagagccgugaccaccgugacccagagcacccccgugcccggccccagcgugcccccccccgaggagcugcaggugagccccggccccagacagcagcugccccccagacagcugcugcagagcgccagcaccgcccugaugggcgagagcgccgaggugcugagcgccagccagacccccgagcugcccgccgccguggaccugagcagcaccggcgagcccagcagcggccaggagagcgccggcagcgccgugguggccaccgugguggugcagccccccccccccacccagagcgagguggaccagcugagccugccccaggagcugauggccgaggcccaggccggcaccaccacccugauggugaccggccugacccccgaggagcuggccgugaccgccgccgccgaggccgccgcccaggccgccgccaccgaggaggcccaggcccuggccauccaggccgugcugcaggccgcccagcaggccgugaugggcaccggcgagcccauggacaccagcgaggccgccgccaccgugacccaggccgagcugggccaccugagcgccgagggccaggagggccaggccaccaccauccccaucgugcugacccagcaggagcuggccgcccuggugcagcagcagcagcugcaggaggcccaggcccagcagcagcaccaccaccugcccaccgaggcccuggcccccgccgacagccugaacgaccccgccaucgagagcaacugccugaacgagcuggccggcaccgugcccagcaccguggcccugcugcccagcaccgccaccgagagccuggcccccagcaacaccuucguggccccccagcccguggugguggccagccccgccaagcugcaggccgccgccacccugaccgagguggccaacggcaucgagagccugggcgugaagcccgaccugccccccccccccagcaaggcccccaugaagaaggagaaccagugguucgacgugggcgugaucaagggcaccaacgugauggugacccacuacuuccugccccccgacgacgccgugcccagcgacgacgaccugggcaccgugcccgacuacaaccagcugaagaagcaggagcugcagcccggcaccgccuacaaguucagaguggccggcaucaacgccugcggcagaggccccuucagcgagaucagcgccuucaagaccugccugcccggcuuccccggcgcccccugcgccaucaagaucagcaagagccccgacggcgcccaccugaccugggagccccccagcgugaccagcggcaagaucaucgaguacagcguguaccuggccauccagagcagccaggccggcggcgagcugaagagcagcacccccgcccagcuggccuucaugagaguguacugcggccccagccccagcugccuggugcagagcagcagccugagcaacgcccacaucgacuacaccaccaagcccgccaucaucuucagaaucgccgccagaaacgagaagggcuacggccccgccacccaggugagauggcugcaggagaccagcaaggacagcagcggcaccaagcccgccaacaagagacccaugagcagccccgagaugaagagcgcccccaagaagagcaaggccgacggccaguaa

SEQ ID NO: 17948 - RNA, 2379 nt, Artificial Sequence
  HCFC2__Homo_sapiens__NP_037452
auggccgcccccagccugcugaacuggagaagagugagcagcuucaccggccccgugcccagagccagacacggccacagagccguggccaucagagagcugaugaucaucuucggcggcggcaacgagggcaucgccgacgagcugcacguguacaacaccgccaccaaccagugguuccugcccgccgugagaggcgacaucccccccggcugcgccgcccacggcuucgugugcgacggcaccagaauccugguguucggcggcaugguggaguacggcagauacagcaacgagcuguacgagcugcaggccagcagauggcuguggaagaaggugaagccccaccccccccccagcggccugccccccugccccagacugggccacagcuucagccuguacggcaacaagugcuaccuguucggcggccuggccaacgagagcgaggacagcaacaacaacgugcccagauaccugaacgacuucuacgagcuggagcugcagcacggcagcggcguggugggcuggagcauccccgugaccaagggcguggugcccagccccagagagagccacaccgccgugaucuacugcaagaaggacagcggcagccccaagauguacguguucggcggcaugugcggcgccagacuggacgaccuguggcagcuggaccuggagaccaugagcuggagcaagcccgagaccaagggcaccgugccccugcccagaagccugcacaccgccagcgugaucggcaacaagauguacaucuucggcggcugggugccccacaagggcgagaacaccgagaccagcccccacgacugcgaguggagaugcaccagcagcuucagcuaccugaaccuggacaccaccgaguggaccacccuggugagcgacagccaggaggacaagaagaacagcagacccagacccagagccggccacugcgccguggccaucggcaccagacuguacuucuggagcggcagagacggcuacaagaaggcccugaacagccaggugugcugcaaggaccugugguaccuggacaccgagaagccccccgcccccagccaggugcagcugaucaaggccaccaccaacagcuuccacgugaagugggacgaggugagcaccguggagggcuaccugcugcagcugagcaccgaccugcccuaccaggccgccagcagcgacagcagcgccgcccccaacaugcagggcgugagaauggacccccacagacagggcagcaacaacaucgugcccaacagcaucaacgacaccaucaacagcaccaagaccgagcagcccgccaccaaggagaccagcaugaagaacaagcccgacuucaaggcccugaccgacagcaacgccauccuguaccccagccuggccagcaacgccagcaaccacaacagccacgugguggacaugcugagaaagaacgagggcccccacaccagcgccaacgugggcgugcugagcagcugccuggacgugagaaccgugauccccgagaccagcgugagcagcaccgugagcagcacccagaccauggugacccagcagaccaucaagaccgagagcagcagcaccaacggcgccguggugaaggacgagaccagccugaccaccuucagcaccaagagcgagguggacgagaccuacgcccugcccgccaccaagaucagcagaguggagacccacgccaccgccacccccuucagcaaggagacccccagcaaccccguggccaccgugaaggccggcgagagacaguggugcgacgugggcaucuucaagaacaacaccgcccuggugagccaguucuaccugcugcccaagggcaagcagagcaucagcaaggugggcaacgccgacgugcccgacuacagccugcugaagaagcaggaccuggugcccggcaccggcuacagauucagaguggccgccaucaacggcugcggcaucggccccuucagcaagaucagcgaguucaagaccugcauccccggcuuccccggcgcccccagcgccgugagaaucagcaagaacguggagggcauccaccugagcugggagccccccaccagccccagcggcaacauccuggaguacagcgccuaccuggccaucagaaccgcccagauccaggacaaccccagccagcugguguucaugagaaucuacugcggccugaagaccagcugcaucgugaccgccggccagcuggccaacgcccacaucgacuacaccagcagacccgccaucguguucagaaucagcgccaagaacgagaagggcuacggccccgccacccaggugagauggcugcagggcaacaacaagaaggccccccugaacuaa

SEQ ID NO: 17949 - RNA, 1578 nt, Artificial Sequence
  HCK__Homo_sapiens__NP_001165601
augggcggcagaagcagcugcgaggaccccggcugccccagagacgaggagagagcccccagaaugggcugcaugaagagcaaguuccugcaggugggcggcaacaccuucagcaagaccgagaccagcgccagcccccacugccccguguacgugcccgaccccaccagcaccaucaagcccggccccaacagccacaacagcaacacccccggcaucagagagggcagcgaggacaucaucgugguggcccuguacgacuacgaggccauccaccacgaggaccugagcuuccagaagggcgaccagaugguggugcuggaggagagcggcgagugguggaaggccagaagccuggccaccagaaaggagggcuacauccccagcaacuacguggccagaguggacagccuggagaccgaggagugguucuucaagggcaucagcagaaaggacgccgagagacagcugcuggcccccggcaacaugcugggcagcuucaugaucagagacagcgagaccaccaagggcagcuacagccugagcgugagagacuacgaccccagacagggcgacaccgugaagcacuacaagaucagaacccuggacaacggcggcuucuacaucagccccagaagcaccuucagcacccugcaggagcugguggaccacuacaagaagggcaacgacggccugugccagaagcugagcgugcccugcaugagcagcaagccccagaagcccugggagaaggacgccugggagauccccagagagagccugaagcuggagaagaagcugggcgccggccaguucggcgagguguggauggccaccuacaacaagcacaccaagguggccgugaagaccaugaagcccggcagcaugagcguggaggccuuccuggccgaggccaacgugaugaagacccugcagcacgacaagcuggugaagcugcacgccguggugaccaaggagcccaucuacaucaucaccgaguucauggccaagggcagccugcuggacuuccugaagagcgacgagggcagcaagcagccccugcccaagcugaucgacuucagcgcccagaucgccgagggcauggccuucaucgagcagagaaacuacauccacagagaccugagagccgccaacauccuggugagcgccagccuggugugcaagaucgccgacuucggccuggccagagugaucgaggacaacgaguacaccgccagagagggcgccaaguuccccaucaaguggaccgcccccgaggccaucaacuucggcagcuucaccaucaagagcgacguguggagcuucggcauccugcugauggagaucgugaccuacggcagaauccccuaccccggcaugagcaaccccgaggugaucagagcccuggagagaggcuacagaaugcccagacccgagaacugccccgaggagcuguacaacaucaugaugagaugcuggaagaacagacccgaggagagacccaccuucgaguacauccagagcgugcuggacgacuucuacaccgccaccgagagccaguaccagcagcagcccuaa

SEQ ID NO: 17950 - RNA, 1461 nt, Artificial Sequence
  HCLS1__Homo_sapiens__NP_005326
auguggaagagcguggugggccacgacgugagcgugagcguggagacccagggcgacgacugggacaccgaccccgacuucgugaacgacaucagcgagaaggagcagagauggggcgccaagaccaucgagggcagcggcagaaccgagcacaucaacauccaccagcugagaaacaaggugagcgaggagcacgacgugcugagaaagaaggagauggagagcggccccaaggccagccacggcuacggcggcagauucggcguggagagagacagaauggacaagagcgccgugggccacgaguacguggccgagguggagaagcacagcagccagaccgacgccgccaagggcuucggcggcaaguacggcguggagagagacagagccgacaagagcgccgugggcuucgacuacaagggcgagguggagaagcacaccagccagaaggacuacagcagaggcuucggcggcagauacggcguggagaaggacaagugggacaaggccgcccugggcuacgacuacaagggcgagaccgagaagcacgagagccagagagacuacgccaagggcuucggcggccaguacggcauccagaaggacagaguggacaagagcgccgugggcuucaacgagauggaggcccccaccaccgccuacaagaagaccacccccaucgaggccgccagcagcggcaccagaggccugaaggccaaguucgagagcauggccgaggagaagagaaagagagaggaggaggagaaggcccagcagguggccagaagacagcaggagagaaaggccgugaccaagagaagccccgaggccccccagcccgugaucgccauggaggagcccgccgugcccgccccccugcccaagaagaucagcagcgaggccuggccccccgugggcaccccccccagcagcgagagcgagcccgugagaaccagcagagagcaccccgugccccugcugcccaucagacagacccugcccgaggacaacgaggagccccccgcccugccccccagaacccuggagggccugcagguggaggaggagcccguguacgaggccgagcccgagcccgagcccgagcccgagcccgagcccgagaacgacuacgaggacguggaggagauggacagacacgagcaggaggacgagcccgagggcgacuacgaggaggugcuggagcccgaggacagcagcuucagcagcgcccuggccggcagcagcggcugccccgccggcgccggcgccggcgccguggcccugggcaucagcgccguggcccuguacgacuaccagggcgagggcagcgacgagcugagcuucgaccccgacgacgugaucaccgacaucgagaugguggacgagggcugguggagaggcagaugccacggccacuucggccuguuccccgccaacuacgugaagcugcuggaguaa

SEQ ID NO: 17951 - RNA, 2673 nt, Artificial Sequence
  HCN1__Homo_sapiens__NP_066550
auggagggcggcggcaagcccaacagcagcagcaacagcagagacgacggcaacagcguguuccccgccaaggccagcgccaccggcgccggccccgccgccgccgagaagagacugggcaccccccccggcggcggcggcgccggcgccaaggagcacggcaacagcgugugcuucaagguggacggcggcggcggcggcggcggcggcggcggcggcggcgaggagcccgccggcggcuucgaggacgccgagggccccagaagacaguacggcuucaugcagagacaguucaccagcaugcugcagcccggcgugaacaaguucagccugagaauguucggcagccagaaggccguggagaaggagcaggagagagugaagaccgccggcuucuggaucauccaccccuacagcgacuucagauucuacugggaccugaucaugcugaucaugauggugggcaaccuggugaucauccccgugggcaucaccuucuucaccgagcagaccaccacccccuggaucaucuucaacguggccagcgacaccguguuccugcuggaccugaucaugaacuucagaaccggcaccgugaacgaggacagcagcgagaucauccuggaccccaaggugaucaagaugaacuaccugaagagcugguucgugguggacuucaucagcagcauccccguggacuacaucuuccugaucguggagaagggcauggacagcgagguguacaagaccgccagagcccugagaaucgugagauucaccaagauccugagccugcugagacugcugagacugagcagacugaucagauacauccaccagugggaggagaucuuccacaugaccuacgaccuggccagcgccguggugagaaucuucaaccugaucggcaugaugcugcugcugugccacugggacggcugccugcaguuccuggugccccugcugcaggacuucccccccgacugcugggugagccugaacgagauggugaacgacagcuggggcaagcaguacagcuacgcccuguucaaggccaugagccacaugcugugcaucggcuacggcgcccaggcccccgugagcaugagcgaccuguggaucaccaugcugagcaugaucgugggcgccaccugcuacgccauguucgugggccacgccaccgcccugauccagagccuggacagcagcagaagacaguaccaggagaaguacaagcagguggagcaguacaugagcuuccacaagcugcccgccgacaugagacagaagauccacgacuacuacgagcacagauaccagggcaagaucuucgacgaggagaacauccugaacgagcugaacgacccccugagagaggagaucgugaacuucaacugcagaaagcugguggccaccaugccccuguucgccaacgccgaccccaacuucgugaccgccaugcugagcaagcugagauucgagguguuccagcccggcgacuacaucaucagagagggcgccgugggcaagaagauguacuucauccagcacggcguggccggcgugaucaccaagagcagcaaggagaugaagcugaccgacggcagcuacuucggcgagaucugccugcugaccaagggcagaagaaccgccagcgugagagccgacaccuacugcagacuguacagccugagcguggacaacuucaacgaggugcuggaggaguaccccaugaugagaagagccuucgagaccguggccaucgacagacuggacagaaucggcaagaagaacagcauccugcugcagaaguuccagaaggaccugaacaccggcguguucaacaaccaggagaacgagauccugaagcagaucgugaagcacgacagagagauggugcaggccaucgcccccaucaacuacccccagaugaccacccugaacagcaccagcagcaccaccacccccaccagcagaaugagaacccagagcccccccguguacaccgccaccagccugagccacagcaaccugcacagccccagccccagcacccagaccccccagcccagcgccauccugagccccugcagcuacaccaccgccgugugcagcccccccgugcagagcccccuggccgccagaaccuuccacuacgccagccccaccgccagccagcugagccugaugcagcagcagccccagcagcaggugcagcagagccagcccccccagacccagccccagcagcccagcccccagccccagacccccggcagcagcacccccaagaacgaggugcacaagagcacccaggcccugcacaacaccaaccugaccagagaggugagaccccugagcgccagccagcccagccugccccacgaggugagcacccugaucagcagaccccaccccaccgugggcgagagccuggccagcaucccccagcccgugaccgccgugcccggcaccggccugcaggccggcggcagaagcaccgugccccagagagugacccuguucagacagaugagcagcggcgccaucccccccaacagaggcgugccccccgccccccccccccccgccgccgcccugcccagagagagcagcagcgugcugaacaccgaccccgacgccgagaagcccagauucgccagcaaccuguaa

SEQ ID NO: 17952 - RNA, 2670 nt, Artificial Sequence
  HCN2__Homo_sapiens__NP_001185
auggacgccagaggcggcggcggcagacccggcgagagccccggcgccacccccgcccccggccccccccccccccccccccccgcccccccccagcagcagcccccccccccccccccccccgcccccccccccggccccggccccgcccccccccagcacccccccagagccgaggcccugccccccgaggccgccgacgagggcggccccagaggcagacugagaagcagagacagcagcugcggcagacccggcacccccggcgccgccagcaccgccaagggcagccccaacggcgagugcggcagaggcgagccccagugcagccccgccggccccgagggccccgccagaggccccaaggugagcuucagcugcagaggcgccgccagcggccccgcccccggccccggccccgccgaggaggccggcagcgaggaggccggccccgccggcgagcccagaggcagccaggccagcuucaugcagagacaguucggcgcccugcugcagcccggcgugaacaaguucagccugagaauguucggcagccagaaggccguggagagagagcaggagagagugaagagcgccggcgccuggaucauccaccccuacagcgacuucagauucuacugggacuucaccaugcugcuguucauggugggcaaccugaucaucauccccgugggcaucaccuucuucaaggacgagaccaccgcccccuggaucguguucaacguggugagcgacaccuucuuccugauggaccuggugcugaacuucagaaccggcaucgugaucgaggacaacaccgagaucauccuggaccccgagaagaucaagaagaaguaccugagaaccugguucgugguggacuucgugagcagcauccccguggacuacaucuuccugaucguggagaagggcaucgacagcgagguguacaagaccgccagagcccugagaaucgugagauucaccaagauccugagccugcugagacugcugagacugagcagacugaucagauacauccaccagugggaggagaucuuccacaugaccuacgaccuggccagcgccgugaugagaaucugcaaccugaucagcaugaugcugcugcugugccacugggacggcugccugcaguuccuggugcccaugcugcaggacuuccccagaaacugcugggugagcaucaacggcauggugaaccacagcuggagcgagcuguacagcuucgcccuguucaaggccaugagccacaugcugugcaucggcuacggcagacaggcccccgagagcaugaccgacaucuggcugaccaugcugagcaugaucgugggcgccaccugcuacgccauguucaucggccacgccaccgcccugauccagagccuggacagcagcagaagacaguaccaggagaaguacaagcagguggagcaguacaugagcuuccacaagcugcccgccgacuucagacagaagauccacgacuacuacgagcacagauaccagggcaagauguucgacgaggacagcauccugggcgagcugaacggcccccugagagaggagaucgugaacuucaacugcagaaagcugguggccagcaugccccuguucgccaacgccgaccccaacuucgugaccgccaugcugaccaagcugaaguucgagguguuccagcccggcgacuacaucaucagagagggcaccaucggcaagaagauguacuucauccagcacggcguggugagcgugcugaccaagggcaacaaggagaugaagcugagcgacggcagcuacuucggcgagaucugccugcugaccagaggcagaagaaccgccagcgugagagccgacaccuacugcagacuguacagccugagcguggacaacuucaacgaggugcuggaggaguaccccaugaugagaagagccuucgagaccguggccaucgacagacuggacagaaucggcaagaagaacagcauccugcugcacaaggugcagcacgaccugaacagcggcguguucaacaaccaggagaacgccaucauccaggagaucgugaaguacgacagagagauggugcagcaggccgagcugggccagagagugggccuguucccccccccccccccccccccccaggugaccagcgccaucgccacccugcagcaggccgccgccaugagcuucugcccccagguggccagaccccuggugggcccccuggcccugggcagccccagacuggugagaagacccccccccggccccgcccccgccgccgccagccccggcccccccccccccgccagcccccccggcgcccccgccagccccagagcccccagaaccagccccuacggcggccugcccgccgccccccuggccggccccgcccugcccgccagaagacugagcagagccagcagaccccugagcgccagccagcccagccugccccacggcgcccccggccccgccgccagcaccagacccgccagcagcagcacccccagacugggccccacccccgccgccagagccgccgcccccagccccgacagaagagacagcgccagccccggcgccgccggcggccuggacccccaggacagcgccagaagcagacugagcagcaaccuguaa

SEQ ID NO: 17953 - RNA, 2325 nt, Artificial Sequence
  HCN3__Homo_sapiens__NP_065948
auggaggccgagcagagacccgccgccggcgccagcgagggcgccacccccggccuggaggccgugccccccguggcccccccccccgccaccgccgccagcggccccauccccaagagcggccccgagcccaagagaagacaccugggcacccugcugcagcccaccgugaacaaguucagccugagaguguucggcagccacaaggccguggagaucgagcaggagagagugaagagcgccggcgccuggaucauccaccccuacagcgacuucagauucuacugggaccugaucaugcugcugcugauggugggcaaccugaucgugcugcccgugggcaucaccuucuucaaggaggagaacagcccccccuggaucguguucaacgugcugagcgacaccuucuuccugcuggaccuggugcugaacuucagaaccggcaucgugguggaggagggcgccgagauccugcuggcccccagagccaucagaaccagauaccugagaaccugguuccugguggaccugaucagcagcauccccguggacuacaucuuccuggugguggagcuggagcccagacuggacgccgagguguacaagaccgccagagcccugagaaucgugagauucaccaagauccugagccugcugagacugcugagacugagcagacugaucagauacauccaccagugggaggagaucuuccacaugaccuacgaccuggccagcgccguggugagaaucuucaaccugaucggcaugaugcugcugcugugccacugggacggcugccugcaguuccuggugcccaugcugcaggacuucccccccgacugcugggugagcaucaaccacauggugaaccacagcuggggcagacaguacagccacgcccuguucaaggccaugagccacaugcugugcaucggcuacggccagcaggcccccgugggcaugcccgacguguggcugaccaugcugagcaugaucgugggcgccaccugcuacgccauguucaucggccacgccaccgcccugauccagagccuggacagcagcagaagacaguaccaggagaaguacaagcagguggagcaguacaugagcuuccacaagcugcccgccgacaccagacagagaauccacgaguacuacgagcacagauaccagggcaagauguucgacgaggagagcauccugggcgagcugagcgagccccugagagaggagaucaucaacuucaccugcagaggccugguggcccacaugccccuguucgcccacgccgaccccagcuucgugaccgccgugcugaccaagcugagauucgagguguuccagcccggcgaccugguggugagagagggcagcgugggcagaaagauguacuucauccagcacggccugcugagcgugcuggccagaggcgccagagacaccagacugaccgacggcagcuacuucggcgagaucugccugcugaccagaggcagaagaaccgccagcgugagagccgacaccuacugcagacuguacagccugagcguggaccacuucaacgccgugcuggaggaguuccccaugaugagaagagccuucgagaccguggccauggacagacugcugagaaucggcaagaagaacagcauccugcagagaaagagaagcgagcccagccccggcagcagcggcggcaucauggagcagcaccuggugcagcacgacagagacauggccagaggcgugagaggcagagcccccagcaccggcgcccagcugagcggcaagcccgugcugugggagccccuggugcacgccccccugcaggccgccgccgugaccagcaacguggccaucgcccugacccaccagagaggcccccugccccugagccccgacagccccgccacccugcuggccagaagcgccuggagaagcgccggcagccccgccagcccccuggugcccgugagagccggccccugggccagcaccagcagacugcccgccccccccgccagaacccugcacgccagccugagcagagccggcagaagccaggugagccugcugggccccccccccggcggcggcggcagaagacugggccccagaggcagaccccugagcgccagccagcccagccugccccagagagccaccggcgacggcagccccggcagaaagggcagcggcagcgagagacugccccccagcggccugcuggccaagccccccagaaccgcccagccccccagaccccccgugcccgagcccgccacccccagaggccugcagcugagcgccaacauguaa

SEQ ID NO: 17954 - RNA, 3612 nt, Artificial Sequence
  HCN4__Homo_sapiens__NP_005468
auggacaagcugccccccagcaugagaaagagacuguacagccugccccagcaggugggcgccaaggccuggaucauggacgaggaggaggacgccgaggaggagggcgccggcggcagacaggaccccagcagaagaagcaucagacugagaccccugcccagccccagccccagcgccgccgccggcggcaccgagagcagaagcagcgcccugggcgccgccgacagcgagggccccgccagaggcgccggcaagagcagcaccaacggcgacugcagaagauucagaggcagccuggccagccugggcagcagaggcggcggcagcggcggcaccggcagcggcagcagccacggccaccugcacgacagcgccgaggagagaagacugaucgccgagggcgacgccagccccggcgaggacagaaccccccccggccuggccgccgagcccgagagacccggcgccagcgcccagcccgccgccagccccccccccccccagcagcccccccagcccgccagcgccagcugcgagcagcccagcguggacaccgccaucaagguggagggcggcgccgccgccggcgaccagauccugcccgaggccgaggugagacugggccaggccggcuucaugcagagacaguucggcgccaugcugcagcccggcgugaacaaguucagccugagaauguucggcagccagaaggccguggagagagagcaggagagagugaagagcgccggcuucuggaucauccaccccuacagcgacuucagauucuacugggaccugaccaugcugcugcugauggugggcaaccugaucaucauccccgugggcaucaccuucuucaaggacgagaacaccacccccuggaucguguucaacguggugagcgacaccuucuuccugaucgaccuggugcugaacuucagaaccggcaucgugguggaggacaacaccgagaucauccuggacccccagagaaucaagaugaaguaccugaagagcugguucaugguggacuucaucagcagcauccccguggacuacaucuuccugaucguggagaccagaaucgacagcgagguguacaagaccgccagagcccugagaaucgugagauucaccaagauccugagccugcugagacugcugagacugagcagacugaucagauacauccaccagugggaggagaucuuccacaugaccuacgaccuggccagcgccguggugagaaucgugaaccugaucggcaugaugcugcugcugugccacugggacggcugccugcaguuccuggugcccaugcugcaggacuuccccgacgacugcugggugagcaucaacaacauggugaacaacagcuggggcaagcaguacagcuacgcccuguucaaggccaugagccacaugcugugcaucggcuacggcagacaggcccccgugggcaugagcgacguguggcugaccaugcugagcaugaucgugggcgccaccugcuacgccauguucaucggccacgccaccgcccugauccagagccuggacagcagcagaagacaguaccaggagaaguacaagcagguggagcaguacaugagcuuccacaagcugccccccgacaccagacagagaauccacgacuacuacgagcacagauaccagggcaagauguucgacgaggagagcauccugggcgagcugagcgagccccugagagaggagaucaucaacuucaacugcagaaagcugguggccagcaugccccuguucgccaacgccgaccccaacuucgugaccagcaugcugaccaagcugagauucgagguguuccagcccggcgacuacaucaucagagagggcaccaucggcaagaagauguacuucauccagcacggcguggugagcgugcugaccaagggcaacaaggagaccaagcuggccgacggcagcuacuucggcgagaucugccugcugaccagaggcagaagaaccgccagcgugagagccgacaccuacugcagacuguacagccugagcguggacaacuucaacgaggugcuggaggaguaccccaugaugagaagagccuucgagaccguggcccuggacagacuggacagaaucggcaagaagaacagcauccugcugcacaaggugcagcacgaccugaacagcggcguguucaacuaccaggagaacgagaucauccagcagaucgugcagcacgacagagagauggcccacugcgcccacagagugcaggccgccgccagcgccacccccacccccacccccgugaucuggaccccccugauccaggccccccugcaggccgccgccgccaccaccagcguggccaucgcccugacccaccaccccagacugcccgccgccaucuucagacccccccccggcagcggccugggcaaccugggcgccggccagacccccagacaccugaagagacugcagagccugauccccagcgcccugggcagcgccagccccgccagcagccccagccagguggacacccccagcagcagcagcuuccacauccagcagcuggccggcuucagcgcccccgccggccugagcccccugcugcccagcagcagcagcagccccccccccggcgccugcggcagccccagcgcccccacccccagcgccggcguggccgccaccaccaucgccggcuucggccacuuccacaaggcccugggcggcagccugagcagcagcgacagcccccugcugaccccccugcagcccggcgccagaagcccccaggccgcccagcccagccccgccccccccggcgccagaggcggccugggccugcccgagcacuuccugccccccccccccagcagcagaagccccagcagcagccccggccagcugggccagccccccggcgagcugagccugggccuggccaccggcccccugagcacccccgagaccccccccagacagcccgagccccccagccugguggccggcgccagcggcggcgccagccccgugggcuucacccccagaggcggccugagcccccccggccacagccccggcccccccagaaccuuccccagcgccccccccagagccagcggcagccacggcagccugcugcugccccccgccagcagccccccccccccccaggugccccagagaagaggcacccccccccugacccccggcagacugacccaggaccugaagcugaucagcgccagccagcccgcccugccccaggacggcgcccagacccugagaagagccagcccccacagcagcggcgagagcauggccgccuucccccuguuccccagagccggcggcggcagcggcggcagcggcagcagcggcggccugggcccccccggcagacccuacggcgccauccccggccagcacgugacccugcccagaaagaccagcagcggcagccugccccccccccugagccuguucggcgccagagccaccagcagcggcggccccccccugaccgccggcccccagagagagcccggcgccagacccgagcccgugagaagcaagcugcccagcaaccuguaa

SEQ ID NO: 17955 - RNA, 396 nt, Artificial Sequence
  HCRT__Homo_sapiens__NP_001515
augaaccugcccagcaccaaggugagcugggccgccgugacccugcugcugcugcugcugcugcugccccccgcccugcugagcagcggcgccgccgcccagccccugcccgacugcugcagacagaagaccugcagcugcagacuguacgagcugcugcacggcgccggcaaccacgccgccggcauccugacccugggcaagagaagaagcggcccccccggccugcagggcagacugcagagacugcugcaggccagcggcaaccacgccgccggcauccugaccaugggcagaagagccggcgccgagcccgcccccagacccugccugggcagaagaugcagcgcccccgccgccgccagcguggcccccggcggccagagcggcaucuaa

SEQ ID NO: 17956 - RNA, 1335 nt, Artificial Sequence
  HCRTR2__Homo_sapiens__NP_001517
augagcggcaccaagcuggaggacagcccccccugcagaaacuggagcagcgccagcgagcugaacgagacccaggagcccuuccugaaccccaccgacuacgacgacgaggaguuccugagauaccuguggagagaguaccugcaccccaaggaguacgagugggugcugaucgccggcuacaucaucguguucgugguggcccugaucggcaacgugcuggugugcguggccguguggaagaaccaccacaugagaaccgugaccaacuacuucaucgugaaccugagccuggccgacgugcuggugaccaucaccugccugcccgccacccuggugguggacaucaccgagaccugguucuucggccagagccugugcaaggugauccccuaccugcagaccgugagcgugagcgugagcgugcugacccugagcugcaucgcccuggacagaugguacgccaucugccacccccugauguucaagagcaccgccaagagagccagaaacagcaucgugaucaucuggaucgugagcugcaucaucaugaucccccaggccaucgugauggagugcagcaccguguuccccggccuggccaacaagaccacccuguucaccgugugcgacgagagauggggcggcgagaucuaccccaagauguaccacaucugcuucuuccuggugaccuacauggccccccugugccugauggugcuggccuaccugcagaucuucagaaagcuguggugcagacagauccccggcaccagcagcguggugcagagaaaguggaagccccugcagcccgugagccagcccagaggccccggccagcccaccaagagcagaaugagcgccguggccgccgagaucaagcagaucagagccagaagaaagaccgccagaaugcugaugaucgugcugcugguguucgccaucugcuaccugcccaucagcauccugaacgugcugaagagaguguucggcauguucgcccacaccgaggacagagagaccguguacgccugguucaccuucagccacuggcugguguacgccaacagcgccgccaaccccaucaucuacaacuuccugagcggcaaguucagagaggaguucaaggccgccuucagcugcugcugccugggcgugcaccacagacaggaggacagacugaccagaggcagaaccagcaccgagagcagaaagagccugaccacccagaucagcaacuucgacaacaucagcaagcugagcgagcagguggugcugaccagcaucagcacccugcccgccgccaacggcgccggcccccugcagaacugguaa

SEQ ID NO: 17957 - RNA, 279 nt, Artificial Sequence
  HCST__Homo_sapiens__NP_001007470
augauccaccugggccacauccuguuccugcugcugcugcccguggccgccgcccagaccacccccggcgagagaagcagccugcccgccuucuaccccggcaccagcggcagcugcagcggcugcggcagccugagccugccccugcuggccggccugguggccgccgacgccguggccagccugcugaucgugggcgccguguuccugugcgccagacccagaagaagccccgcccaggacggcaagguguacaucaacaugcccggcagaggcuaa

SEQ ID NO: 17958 - RNA, 1950 nt, Artificial Sequence
  HDAC10__Homo_sapiens__NP_001152758
augggcaccgcccugguguaccacgaggacaugaccgccaccagacugcugugggacgaccccgagugcgagaucgagagacccgagagacugaccgccgcccuggacagacugagacagagaggccuggagcagagaugccugagacugagcgccagagaggccagcgaggaggagcugggccuggugcacagccccgaguacgugagccuggugagagagacccaggugcugggcaaggaggagcugcaggcccugagcggccaguucgacgccaucuacuuccaccccagcaccuuccacugcgccagacuggccgccggcgccggccugcagcugguggacgccgugcugaccggcgccgugcagaacggccuggcccuggugagaccccccggccaccacggccagagagccgccgccaacggcuucugcguguucaacaacguggccaucgccgccgcccacgccaagcagaagcacggccugcacagaauccuggugguggacugggacgugcaccacggccagggcauccaguaccuguucgaggacgaccccagcgugcuguacuucagcuggcacagauacgagcacggcagauucuggcccuuccugagagagagcgacgccgacgccgugggcagaggccagggccugggcuucaccgugaaccugcccuggaaccaggugggcaugggcaacgccgacuacguggccgccuuccugcaccugcugcugccccuggccuucgagggccagaugcaggccacccccgagugcuucgcccaccugacccagcugcugcaggugcuggccggcggcagagugugcgccgugcuggagggcggcuaccaccuggagagccuggccgagagcgugugcaugaccgugcagacccugcugggcgaccccgcccccccccugagcggccccauggcccccugccagagcgcccuggagagcauccagagcgccagagccgcccaggccccccacuggaagagccugcagcagcaggacgugaccgccgugcccaugagccccagcagccacagccccgagggcagaccccccccccugcugcccggcggccccgugugcaaggccgccgccagcgcccccagcagccugcuggaccagcccugccugugccccgcccccagcgugagaaccgccguggcccugaccacccccgacaucacccuggugcugccccccgacgugauccagcaggaggccagcgcccugagagaggagaccgaggccugggccagaccccacgagagccuggccagagaggaggcccugaccgcccugggcaagcugcuguaccugcuggacggcaugcuggacggccaggugaacagcggcaucgccgccacccccgccagcgccgccgccgccacccuggacguggccgugagaagaggccugagccacggcgcccagagacugcugugcguggcccugggccagcuggacagaccccccgaccuggcccacgacggcagaagccuguggcugaacaucagaggcaaggaggccgccgcccugagcauguuccacgugagcaccccccugcccgugaugaccggcggcuuccugagcugcauccugggccuggugcugccccuggccuacggcuuccagcccgaccuggugcugguggcccugggccccggccacggccugcagggcccccacgccgcccugcuggccgccaugcugagaggccuggccggcggcagagugcuggcccugcuggaggagaacagcaccccccagcuggccggcauccuggccagagugcugaacggcgaggccccccccagccugggccccagcagcguggccagccccgaggacgugcaggcccugauguaccugagaggccagcuggagccccaguggaagaugcugcagugccacccccaccugguggccuaa

SEQ ID NO: 17959 - RNA, 891 nt, Artificial Sequence
  HDAC11__Homo_sapiens__NP_001129513
augggccuggagaagcugcaccccuucgacgccggcaaguggggcaaggugaucaacuuccugaaggaggagaagcugcugagcgacagcaugcugguggaggccagagaggccagcgaggaggaccugcugguggugcacaccagaagauaccugaacgagcugaagagaaaggugcugagaccccugagaacccagaccggcggcaccaucauggccggcaagcuggccguggagagaggcugggccaucaacgugggcggcggcuuccaccacugcagcagcgacagaggcggcggcuucugcgccuacgccgacaucacccuggccaucaaguuccuguucgagagaguggagggcaucagcagagccaccaucaucgaccuggacgcccaccagggcaacggccacgagagagacuucauggacgacaagagaguguacaucauggacguguacaacagacacaucuaccccggcgacagauucgccaagcaggccaucagaagaaagguggagcuggaguggggcaccgaggacgacgaguaccuggacaagguggagagaaacaucaagaagagccugcaggagcaccugcccgacguggugguguacaacgccggcaccgacauccuggagggcgacagacugggcggccugagcaucagccccgccggcaucgugaagagagacgagcugguguucagaauggugagaggcagaagagugcccauccugauggugaccagcggcggcuaccagaagagaaccgccagaaucaucgccgacagcauccugaaccuguucggccugggccugaucggccccgagagccccagcgugagcgcccagaacagcgacaccccccugcugccccccgccgugcccuaa

SEQ ID NO: 17960 - RNA, 870 nt, Artificial Sequence
  HDAC1__Homo_sapiens__XP_011539611
augaccgugagcuuccacaaguacggcgaguacuuccccggcaccggcgaccugagagacaucggcgccggcaagggcaaguacuacgccgugaacuacccccugagagacggcaucgacgacgagagcuacgaggccaucuucaagcccgugaugagcaaggugauggagauguuccagcccagcgccguggugcugcagugcggcagcgacagccugagcggcgacagacugggcugcuucaaccugaccaucaagggccacgccaagugcguggaguucgugaagagcuucaaccugcccaugcugaugcugggcggcggcggcuacaccaucagaaacguggccagaugcuggaccuacgagaccgccguggcccuggacaccgagauccccaacgagcugcccuacaacgacuacuucgaguacuucggccccgacuucaagcugcacaucagccccagcaacaugaccaaccagaacaccaacgaguaccuggagaagaucaagcagagacuguucgagaaccugagaaugcugccccacgcccccggcgugcagaugcaggccauccccgaggacgccauccccgaggagagcggcgacgaggacgaggacgaccccgacaagagaaucagcaucugcagcagcgacaagagaaucgccugcgaggaggaguucagcgacagcgaggaggagggcgagggcggcagaaagaacagcagcaacuucaagaaggccaagagagugaagaccgaggacgagaaggagaaggaccccgaggagaagaaggaggugaccgaggaggagaagaccaaggaggagaagcccgaggccaagggcgugaaggaggaggugaagcuggccuaa

SEQ ID NO: 17961 - RNA, 1467 nt, Artificial Sequence
  HDAC2__Homo_sapiens__NP_001518
auggccuacagccagggcggcggcaagaagaaggugugcuacuacuacgacggcgacaucggcaacuacuacuacggccagggccaccccaugaagccccacagaaucagaaugacccacaaccugcugcugaacuacggccuguacagaaagauggagaucuacagaccccacaaggccaccgccgaggagaugaccaaguaccacagcgacgaguacaucaaguuccugagaagcaucagacccgacaacaugagcgaguacagcaagcagaugcagagauucaacgugggcgaggacugccccguguucgacggccuguucgaguucugccagcugagcaccggcggcagcguggccggcgccgugaagcugaacagacagcagaccgacauggccgugaacugggccggcggccugcaccacgccaagaagagcgaggccagcggcuucugcuacgugaacgacaucgugcuggccauccuggagcugcugaaguaccaccagagagugcuguacaucgacaucgacauccaccacggcgacggcguggaggaggccuucuacaccaccgacagagugaugaccgugagcuuccacaaguacggcgaguacuuccccggcaccggcgaccugagagacaucggcgccggcaagggcaaguacuacgccgugaacuuccccaugagagacggcaucgacgacgagagcuacggccagaucuucaagcccaucaucagcaaggugauggagauguaccagcccagcgccguggugcugcagugcggcgccgacagccugagcggcgacagacugggcugcuucaaccugaccgugaagggccacgccaagugcguggagguggugaagaccuucaaccugccccugcugaugcugggcggcggcggcuacaccaucagaaacguggccagaugcuggaccuacgagaccgccguggcccuggacugcgagauccccaacgagcugcccuacaacgacuacuucgaguacuucggccccgacuucaagcugcacaucagccccagcaacaugaccaaccagaacacccccgaguacauggagaagaucaagcagagacuguucgagaaccugagaaugcugccccacgcccccggcgugcagaugcaggccauccccgaggacgccgugcacgaggacagcggcgacgaggacggcgaggaccccgacaagagaaucagcaucagagccagcgacaagagaaucgccugcgacgaggaguucagcgacagcgaggacgagggcgagggcggcagaagaaacguggccgaccacaagaagggcgccaagaaggccagaaucgaggaggacaagaaggagaccgaggacaagaagaccgacgugaaggaggaggacaagagcaaggacaacagcggcgagaagaccgacaccaagggcaccaagagcgagcagcugagcaaccccuaa

SEQ ID NO: 17962 - RNA, 1287 nt, Artificial Sequence
  HDAC3__Homo_sapiens__NP_003874
auggccaagaccguggccuacuucuacgaccccgacgugggcaacuuccacuacggcgccggccaccccaugaagccccacagacuggcccugacccacagccuggugcugcacuacggccuguacaagaagaugaucguguucaagcccuaccaggccagccagcacgacaugugcagauuccacagcgaggacuacaucgacuuccugcagagagugagccccaccaacaugcagggcuucaccaagagccugaacgccuucaacgugggcgacgacugccccguguuccccggccuguucgaguucugcagcagauacaccggcgccagccugcagggcgccacccagcugaacaacaagaucugcgacaucgccaucaacugggccggcggccugcaccacgccaagaaguucgaggccagcggcuucugcuacgugaacgacaucgugaucggcauccuggagcugcugaaguaccaccccagagugcuguacaucgacaucgacauccaccacggcgacggcgugcaggaggccuucuaccugaccgacagagugaugaccgugagcuuccacaaguacggcaacuacuucuuccccggcaccggcgacauguacgaggugggcgccgagagcggcagauacuacugccugaacgugccccugagagacggcaucgacgaccagagcuacaagcaccuguuccagcccgugaucaaccaggugguggacuucuaccagcccaccugcaucgugcugcagugcggcgccgacagccugggcugcgacagacugggcugcuucaaccugagcaucagaggccacggcgagugcguggaguacgugaagagcuucaacaucccccugcuggugcugggcggcggcggcuacaccgugagaaacguggccagaugcuggaccuacgagaccagccugcugguggaggaggccaucagcgaggagcugcccuacagcgaguacuucgaguacuucgcccccgacuucacccugcaccccgacgugagcaccagaaucgagaaccagaacagcagacaguaccuggaccagaucagacagaccaucuucgagaaccugaagaugcugaaccacgcccccagcgugcagauccacgacgugcccgccgaccugcugaccuacgacagaaccgacgaggccgacgccgaggagagaggccccgaggagaacuacagcagacccgaggcccccaacgaguucuacgacggcgaccacgacaacgacaaggagagcgacguggagaucuaa

SEQ ID NO: 17963 - RNA, 3255 nt, Artificial Sequence
  HDAC4__Homo_sapiens__NP_006028
augagcagccagagccaccccgacggccugagcggcagagaccagcccguggagcugcugaaccccgccagagugaaccacaugcccagcaccguggacguggccaccgcccugccccugcagguggcccccagcgccgugcccauggaccugagacuggaccaccaguucagccugcccguggccgagcccgcccugagagagcagcagcugcagcaggagcugcuggcccugaagcagaagcagcagauccagagacagauccugaucgccgaguuccagagacagcacgagcagcugagcagacagcacgaggcccagcugcacgagcacaucaagcagcagcaggagaugcuggccaugaagcaccagcaggagcugcuggagcaccagagaaagcuggagagacacagacaggagcaggagcuggagaagcagcacagagagcagaagcugcagcagcugaagaacaaggagaagggcaaggagagcgccguggccagcaccgaggugaagaugaagcugcaggaguucgugcugaacaagaagaaggcccuggcccacagaaaccugaaccacugcaucagcagcgaccccagauacugguacggcaagacccagcacagcagccuggaccagagcagccccccccagagcggcgugagcaccagcuacaaccaccccgugcugggcauguacgacgccaaggacgacuucccccugagaaagaccgccagcgagcccaaccugaagcugagaagcagacugaagcagaagguggccgagagaagaagcagcccccugcugagaagaaaggacggccccguggugaccgcccugaagaagagaccccuggacgugaccgacagcgccugcagcagcgcccccggcagcggccccagcagccccaacaacagcagcggcagcgugagcgccgagaacggcaucgcccccgccgugcccagcauccccgccgagaccagccuggcccacagacugguggccagagagggcagcgccgccccccugccccuguacaccagccccagccugcccaacaucacccugggccugcccgccaccggccccagcgccggcaccgccggccagcaggacgccgagagacugacccugcccgcccugcagcagagacugagccuguuccccggcacccaccugacccccuaccugagcaccagcccccuggagagagacggcggcgccgcccacagcccccugcugcagcacauggugcugcuggagcagccccccgcccaggccccccuggugaccggccugggcgcccugccccugcacgcccagagccuggugggcgccgacagagugagccccagcauccacaagcugagacagcacagaccccugggcagaacccagagcgccccccugccccagaacgcccaggcccugcagcaccuggugauccagcagcagcaccagcaguuccuggagaagcacaagcagcaguuccagcagcagcagcugcagaugaacaagaucauccccaagcccagcgagcccgccagacagcccgagagccaccccgaggagaccgaggaggagcugagagagcaccaggcccugcuggacgagcccuaccuggacagacugcccggccagaaggaggcccacgcccaggccggcgugcaggugaagcaggagcccaucgagagcgacgaggaggaggccgagccccccagagagguggagcccggccagagacagcccagcgagcaggagcugcuguucagacagcaggcccugcugcuggagcagcagagaauccaccagcugagaaacuaccaggccagcauggaggccgccggcauccccgugagcuucggcggccacagaccccugagcagagcccagagcagccccgccagcgccaccuuccccgugagcgugcaggagccccccaccaagcccagauucaccaccggccugguguacgacacccugaugcugaagcaccagugcaccugcggcagcagcagcagccaccccgagcacgccggcagaauccagagcaucuggagcagacugcaggagaccggccugagaggcaagugcgagugcaucagaggcagaaaggccacccuggaggagcugcagaccgugcacagcgaggcccacacccugcuguacggcaccaacccccugaacagacagaagcuggacagcaagaagcugcugggcagccuggccagcguguucgugagacugcccugcggcggcgugggcguggacagcgacaccaucuggaacgaggugcacagcgccggcgccgccagacuggccgugggcugcgugguggagcugguguucaagguggccaccggcgagcugaagaacggcuucgccguggugagaccccccggccaccacgccgaggagagcacccccaugggcuucugcuacuucaacagcguggccguggccgccaagcugcugcagcagagacugagcgugagcaagauccugaucguggacugggacgugcaccacggcaacggcacccagcaggccuucuacagcgaccccagcgugcuguacaugagccugcacagauacgacgacggcaacuucuuccccggcagcggcgcccccgacgaggugggcaccggccccggcgugggcuucaacgugaacauggccuucaccggcggccuggacccccccaugggcgacgccgaguaccuggccgccuucagaaccguggugaugcccaucgccagcgaguucgcccccgacguggugcuggugagcagcggcuucgacgccguggagggccaccccaccccccugggcggcuacaaccugagcgccagaugcuucggcuaccugaccaagcagcugaugggccuggccggcggcagaaucgugcuggcccuggagggcggccacgaccugaccgccaucugcgacgccagcgaggccugcgugagcgcccugcugggcaacgagcuggacccccugcccgagaaggugcugcagcagagacccaacgccaacgccgugagaagcauggagaaggugauggagauccacagcaaguacuggagaugccugcagagaaccaccagcaccgccggcagaagccugaucgaggcccagaccugcgagaacgaggaggccgagaccgugaccgccauggccagccugagcgugggcgugaagcccgccgagaagagacccgacgaggagcccauggaggaggagcccccccuguaa

SEQ ID NO: 17964 - RNA, 3372 nt, Artificial Sequence
  HDAC5__Homo_sapiens__XP_005256961
augaacagccccaacgagagcgccgacggcaugagcggcagagagcccagccuggagauccugcccagaaccagccugcacagcauccccgugaccguggaggugaagcccgugcugcccagagccaugcccagcagcaugggcggcggcggcggcggcagccccagccccguggagcugagaggcgcccuggugggcagcguggaccccacccugagagagcagcagcugcagcaggagcugcuggcccugaagcagcagcagcagcugcagaagcagcugcuguucgccgaguuccagaagcagcacgaccaccugaccagacagcacgaggugcagcugcagaagcaccugaagcagcagcaggagaugcuggccgccaagcagcagcaggagaugcuggccgccaagagacagcaggagcuggagcagcagagacagagagagcagcagagacaggaggagcuggagaagcagagacuggagcagcagcugcugauccugagaaacaaggagaagagcaaggagagcgccaucgccagcaccgaggugaagcugagacugcaggaguuccugcugagcaagagcaaggagcccacccccggcggccugaaccacagccugccccagcaccccaagugcuggggcgcccaccacgccagccuggaccagagcagccccccccagagcggcccccccggcaccccccccagcuacaagcugccccugcccggccccuacgacagcagagacgacuucccccugagaaagaccgccagcgagcccaaccugaaggugagaagcagacugaagcagaagguggccgagagaagaagcagcccccugcugagaagaaaggacggcaccgugaucagcaccuucaagaagagagccguggagaucaccggcgccggccccggcgccagcagcgugugcaacagcgcccccggcagcggccccagcagccccaacagcagccacagcaccaucgccgagaacggcuucaccggcagcgugcccaacauccccaccgagaugcugccccagcacagagcccugccccuggacagcagccccaaccaguucagccuguacaccagccccagccugcccaacaucagccugggccugcaggccaccgugaccgugaccaacagccaccugaccgccagccccaagcugagcacccagcaggaggccgagagacaggcccugcagagccugagacagggcggcacccugaccggcaaguucaugagcaccagcagcauccccggcugccugcugggcguggcccuggagggcgacggcagcccccacggccacgccagccugcugcagcacgugcugcugcuggagcaggccagacagcagagcacccugaucgccgugccccugcacggccagagcccccuggugaccggcgagagaguggccaccagcaugagaaccgugggcaagcugcccagacacagaccccugagcagaacccagagcagcccccugccccagagcccccaggcccugcagcagcuggugaugcagcagcagcaccagcaguuccuggagaagcagaagcagcagcagcugcagcugggcaagauccugaccaagaccggcgagcugcccagacagcccaccacccaccccgaggagaccgaggaggagcugaccgagcagcaggaggugcugcugggcgagggcgcccugaccaugcccagagagggcagcaccgagagcgagagcacccaggaggaccuggaggaggaggacgaggaggacgacggcgaggaggaggaggacugcauccaggugaaggacgaggagggcgagagcggcgccgaggagggccccgaccuggaggagcccggcgccggcuacaagaagcuguucagcgacgcccagccccugcagccccugcagguguaccaggccccccugagccuggccaccgugccccaccaggcccugggcagaacccagagcagccccgccgcccccggcggcaugaagagcccccccgaccagcccgugaagcaccuguucaccaccggcgugguguacgacaccuucaugcugaagcaccagugcaugugcggcaacacccacgugcaccccgagcacgccggcagaauccagagcaucuggagcagacugcaggagaccggccugcugagcaagugcgagagaaucagaggcagaaaggccacccuggacgagauccagaccgugcacagcgaguaccacacccugcuguacggcaccagcccccugaacagacagaagcuggacagcaagaagcugcugggccccaucagccagaagauguacgccgugcugcccugcggcggcaucggcguggacagcgacaccguguggaacgagaugcacagcagcagcgccgugagaauggccgugggcugccugcuggagcuggccuucaagguggccgccggcgagcugaagaacggcuucgccaucaucagaccccccggccaccacgccgaggagagcaccgccaugggcuucugcuucuucaacagcguggccaucaccgccaagcugcugcagcagaagcugaacgugggcaaggugcugaucguggacugggacauccaccacggcaacggcacccagcaggccuucuacaacgaccccagcgugcuguacaucagccugcacagauacgacaacggcaacuucuuccccggcagcggcgcccccgaggaggugggcggcggccccggcgugggcuacaacgugaacguggccuggaccggcggcguggacccccccaucggcgacguggaguaccugaccgccuucagaaccguggugaugcccaucgcccacgaguucagccccgacguggugcuggugagcgccggcuucgacgccguggagggccaccugagcccccugggcggcuacagcgugaccgccagaugcuucggccaccugaccagacagcugaugacccuggccggcggcagaguggugcuggcccuggagggcggccacgaccugaccgccaucugcgacgccagcgaggccugcgugagcgcccugcugagcguggagcugcagccccuggacgaggccgugcugcagcagaagcccaacaucaacgccguggccacccuggagaaggugaucgagauccagagcaagcacuggagcugcgugcagaaguucgccgccggccugggcagaagccugagagaggcccaggccggcgagaccgaggaggccgagaccgugagcgccauggcccugcugagcgugggcgccgagcaggcccaggccgccgccgccagagagcacagccccagacccgccgaggagcccauggagcaggagcccgcccuguaa

SEQ ID NO: 17965 - RNA, 3648 nt, Artificial Sequence
  HDAC6__Homo_sapiens__NP_006035
augaccagcaccggccaggacagcaccaccaccagacagagaagaagcagacagaacccccagagccccccccaggacagcagcgugaccagcaagagaaacaucaagaagggcgccgugcccagaagcauccccaaccuggccgaggugaagaagaagggcaagaugaagaagcugggccaggccauggaggaggaccugaucgugggccugcagggcauggaccugaaccuggaggccgaggcccuggccggcaccggccuggugcuggacgagcagcugaacgaguuccacugccugugggacgacagcuuccccgagggccccgagagacugcacgccaucaaggagcagcugauccaggagggccugcuggacagaugcgugagcuuccaggccagauucgccgagaaggaggagcugaugcuggugcacagccuggaguacaucgaccugauggagaccacccaguacaugaacgagggcgagcugagagugcuggccgacaccuacgacagcguguaccugcaccccaacagcuacagcugcgccugccuggccagcggcagcgugcugagacugguggacgccgugcugggcgccgagaucagaaacggcauggccaucaucagaccccccggccaccacgcccagcacagccugauggacggcuacugcauguucaaccacguggccguggccgccagauacgcccagcagaagcacagaaucagaagagugcugaucguggacugggacgugcaccacggccagggcacccaguucaccuucgaccaggaccccagcgugcuguacuucagcauccacagauacgagcagggcagauucuggccccaccugaaggccagcaacuggagcaccaccggcuucggccagggccagggcuacaccaucaacgugcccuggaaccaggugggcaugagagacgccgacuacaucgccgccuuccugcacgugcugcugcccguggcccuggaguuccagccccagcuggugcugguggccgccggcuucgacgcccugcagggcgaccccaagggcgagauggccgccacccccgccggcuucgcccagcugacccaccugcugaugggccuggccggcggcaagcugauccugagccuggagggcggcuacaaccugagagcccuggccgagggcgugagcgccagccugcacacccugcugggcgaccccugccccaugcuggagagccccggcgcccccugcagaagcgcccaggccagcgugagcugcgcccuggaggcccuggagcccuucugggaggugcuggugagaagcaccgagaccguggagagagacaacauggaggaggacaacguggaggagagcgaggaggagggccccugggagccccccgugcugcccauccugaccuggcccgugcugcagagcagaaccggccugguguacgaccagaacaugaugaaccacugcaaccugugggacagccaccaccccgaggugccccagagaauccugagaaucaugugcagacuggaggagcugggccuggccggcagaugccugacccugacccccagacccgccaccgaggccgagcugcugaccugccacagcgccgaguacgugggccaccugagagccaccgagaagaugaagaccagagagcugcacagagagagcagcaacuucgacagcaucuacaucugccccagcaccuucgccugcgcccagcuggccaccggcgccgccugcagacugguggaggccgugcugagcggcgaggugcugaacggcgccgccguggugagaccccccggccaccacgccgagcaggacgccgccugcggcuucugcuucuucaacagcguggccguggccgccagacacgcccagaccaucagcggccacgcccugagaauccugaucguggacugggacgugcaccacggcaacggcacccagcacauguucgaggacgaccccagcgugcuguacgugagccugcacagauacgaccacggcaccuucuuccccaugggcgacgagggcgccagcagccagaucggcagagccgccggcaccggcuucaccgugaacguggccuggaacggccccagaaugggcgacgccgacuaccuggccgccuggcacagacuggugcugcccaucgccuacgaguucaaccccgagcuggugcuggugagcgccggcuucgacgccgccagaggcgacccccugggcggcugccaggugagccccgagggcuacgcccaccugacccaccugcugaugggccuggccagcggcagaaucauccugauccuggagggcggcuacaaccugaccagcaucagcgagagcauggccgccugcaccagaagccugcugggcgacccccccccccugcugacccugcccagacccccccugagcggcgcccuggccagcaucaccgagaccauccaggugcacagaagauacuggagaagccugagagugaugaagguggaggacagagagggccccagcagcagcaagcuggugaccaagaaggccccccagcccgccaagcccagacuggccgagagaaugaccaccagagagaagaaggugcuggaggccggcaugggcaaggugaccagcgccagcuucggcgaggagagcacccccggccagaccaacagcgagaccgccgugguggcccugacccaggaccagcccagcgaggccgccaccggcggcgccacccuggcccagaccaucagcgaggccgccaucggcggcgccaugcugggccagaccaccagcgaggaggccgugggcggcgccacccccgaccagaccaccagcgaggagaccgugggcggcgccauccuggaccagaccaccagcgaggacgccgugggcggcgccacccugggccagaccaccagcgaggaggccgugggcggcgccacccuggcccagaccaccagcgaggccgccauggagggcgccacccuggaccagaccaccagcgaggaggcccccggcggcaccgagcugauccagaccccccuggccagcagcaccgaccaccagaccccccccaccagccccgugcagggcaccaccccccagaucagccccagcacccugaucggcagccugagaacccuggagcugggcagcgagagccagggcgccagcgagagccaggcccccggcgaggagaaccugcugggcgaggccgccggcggccaggacauggccgacagcaugcugaugcagggcagcagaggccugaccgaccaggccaucuucuacgccgugaccccccugcccuggugcccccaccugguggccgugugccccauccccgccgccggccuggacgugacccagcccugcggcgacugcggcaccauccaggagaacugggugugccugagcugcuaccagguguacugcggcagauacaucaacggccacaugcugcagcaccacggcaacagcggccacccccuggugcugagcuacaucgaccugagcgccuggugcuacuacugccaggccuacgugcaccaccaggcccugcuggacgugaagaacaucgcccaccagaacaaguucggcgaggacaugccccacccccacuaa

SEQ ID NO: 17966 - RNA, 2865 nt, Artificial Sequence
  HDAC7__Homo_sapiens__NP_001091886
augcacagccccggcgccgacggcacccaggugagccccggcgcccacuacugcagccccaccggcgccggcugccccagacccugcgccgacacccccggcccccagccccagcccauggaccugagagugggccagagaccccccguggagcccccccccgagcccacccugcuggcccugcagagaccccagagacugcaccaccaccuguuccuggccggccugcagcagcagagaagcguggagcccaugagacugagcauggacacccccaugcccgagcugcaggugggcccccaggagcaggagcugagacagcugcugcacaaggacaagagcaagagaagcgccguggccagcagcguggugaagcagaagcuggccgaggugauccugaagaagcagcaggccgcccuggagagaaccgugcaccccaacagccccggcauccccuacagaacccuggagccccuggagaccgagggcgccaccagaagcaugcugagcagcuuccugccccccgugcccagccugcccagcgacccccccgagcacuucccccugagaaagaccgugagcgagcccaaccugaagcugagauacaagcccaagaagagccuggagagaagaaagaacccccugcugagaaaggagagcgccccccccagccugagaagaagacccgccgagacccugggcgacagcagccccagcagcagcagcacccccgccagcggcugcagcagccccaacgacagcgagcacggccccaaccccauccugggcagcgaggccgacagcgacagaagaacccaccccacccugggccccagaggccccauccugggcagcccccacaccccccuguuccugccccacggccuggagcccgaggccggcggcacccugcccagcagacugcagcccauccugcugcuggaccccagcggcagccacgccccccugcugaccgugcccggccugggcccccugcccuuccacuucgcccagagccugaugaccaccgagagacugagcggcagcggccugcacuggccccugagcagaaccagaagcgagccccugccccccagcgccaccgccccccccccccccggccccaugcagcccagacuggagcagcugaagacccacgugcaggugaucaagagaagcgccaagcccagcgagaagcccagacugagacagauccccagcgccgaggaccuggagaccgacggcggcggccccggccaggugguggacgacggccuggagcacagagagcugggccacggccagcccgaggccagaggccccgccccccugcagcagcacccccaggugcugcugugggagcagcagagacuggccggcagacugcccagaggcagcaccggcgacaccgugcugcugccccuggcccagggcggccacagaccccugagcagagcccagagcagccccgccgcccccgccagccugagcgcccccgagcccgccagccaggccagagugcugagcagcagcgagacccccgccagaacccugcccuucaccaccggccugaucuacgacagcgugaugcugaagcaccagugcagcugcggcgacaacagcagacaccccgagcacgccggcagaauccagagcaucuggagcagacugcaggagagaggccugagaagccagugcgagugccugagaggcagaaaggccagccuggaggagcugcagagcgugcacagcgagagacacgugcugcuguacggcaccaacccccugagcagacugaagcuggacaacggcaagcuggccggccugcuggcccagagaauguucgugaugcugcccugcggcggcgugggcguggacaccgacaccaucuggaacgagcugcacagcagcaacgccgccagaugggccgccggcagcgugaccgaccuggccuucaagguggccagcagagagcugaagaacggcuucgccguggugagaccccccggccaccacgccgaccacagcaccgccaugggcuucugcuucuucaacagcguggccaucgccugcagacagcugcagcagcagagcaaggccagcaagauccugaucguggacugggacgugcaccacggcaacggcacccagcagaccuucuaccaggaccccagcgugcuguacaucagccugcacagacacgacgacggcaacuucuuccccggcagcggcgccguggacgaggugggcgccggcagcggcgagggcuucaacgugaacguggccugggccggcggccuggacccccccaugggcgaccccgaguaccuggccgccuucagaaucguggugaugcccaucgccagagaguucagccccgaccuggugcuggugagcgccggcuucgacgccgccgagggccaccccgccccccugggcggcuaccacgugagcgccaagugcuucggcuacaugacccagcagcugaugaaccuggccggcggcgccguggugcuggcccuggagggcggccacgaccugaccgccaucugcgacgccagcgaggccugcguggccgcccugcugggcaacagaguggacccccugagcgaggagggcuggaagcagaagcccaaccugaacgccaucagaagccuggaggccgugaucagagugcacagcaaguacuggggcugcaugcagagacuggccagcugccccgacagcugggugcccagagugcccggcgccgacaaggaggagguggaggccgugaccgcccuggccagccugagcgugggcauccuggccgaggacagacccagcgagcagcugguggaggaggaggagcccaugaaccuguaa

SEQ ID NO: 17967 - RNA, 861 nt, Artificial Sequence
  HDAC8__Homo_sapiens__NP_001159890
auggaggagcccgaggagcccgccgacagcggccagagccuggugcccguguacaucuacagccccgaguacgugagcaugugcgacagccuggccaagauccccaagagagccagcauggugcacagccugaucgaggccuacgcccugcacaagcagaugagagacgaggccagcggcuucugcuaccugaacgacgccgugcugggcauccugagacugagaagaaaguucgagagaauccuguacguggaccuggaccugcaccacggcgacggcguggaggacgccuucagcuucaccagcaaggugaugaccgugagccugcacaaguucagccccggcuucuuccccggcaccggcgacgugagcgacgugggccugggcaagggcagauacuacagcgugaacgugcccauccaggacggcauccaggacgagaaguacuaccagaucugcgagagcgugcugaaggagguguaccaggccuucaaccccaaggccguggugcugcagcugggcgccgacaccaucgccggcgaccccaugugcagcuucaacaugacccccgugggcaucggcaagugccugaaguacauccugcaguggcagcuggccacccugauccugggcggcggcggcuacaaccuggccaacaccgccagaugcuggaccuaccugaccggcgugauccugggcaagacccugagcagcgagauccccgaccacgaguucuucaccgccuacggccccgacuacgugcuggagaucacccccagcugcagacccgacagaaacgagccccacagaauccagcagauccugaacuacaucaagggcaaccugaagcacgugguguaa

SEQ ID NO: 17968 - RNA, 1767 nt, Artificial Sequence
  HDAC9__Homo_sapiens__NP_001191073
augaugagcagccccgcccagcccgaccugauguggaaccuggugcccugggugcuguucugcggcugcugcagaaucuuccccgacggcguggccggcagagagcagcugcuggcccagcagagaaugcacagcaugaucagcagcguggacgugaagagcgaggugcccgugggccuggagcccaucagcccccuggaccugagaaccgaccugagaaugaugaugcccgugguggaccccguggugagagagaagcagcugcagcaggagcugcugcugauccagcagcagcagcagauccagaagcagcugcugaucgccgaguuccagaagcagcacgagaaccugaccagacagcaccaggcccagcugcaggagcacaucaaggagcugcuggccaucaagcagcagcaggagcugcuggagaaggagcagaagcuggagcagcagagacaggagcaggagguggagagacacagaagagagcagcagcugcccccccugagaggcaaggacagaggcagagagagagccguggccagcaccgaggugaagcagaagcugcaggaguuccugcugagcaagagcgccaccaaggacacccccaccaacggcaagaaccacagcgugagcagacaccccaagcugugguacaccgccgcccaccacaccagccuggaccagagcagccccccccugagcggcaccagccccagcuacaaguacacccugcccggcgcccaggacgccaaggacgacuucccccugagaaagaccgagagcagcgugagcagcagcagccccggcagcggccccagcagccccaacaacggccccaccggcagcgugaccgagaacgagaccagcgugcugccccccaccccccacgccgagcagauggugagccagcagagaauccugauccacgaggacagcaugaaccugcugagccuguacaccagccccagccugcccaacaucacccugggccugcccgccgugcccagccagcugaacgccagcaacagccugaaggagaagcagaagugcgagacccagacccugagacagggcgugccccugcccggccaguacggcggcagcauccccgccagcagcagccacccccacgugacccuggagggcaagccccccaacagcagccaccaggcccugcugcagcaccugcugcugaaggagcagaugagacagcagaagcugcugguggccggcggcgugccccugcacccccagagcccccuggccaccaaggagagaaucagccccggcaucagaggcacccacaagcugcccagacacagaccccugaacagaacccagagcgccccccugccccagagcacccuggcccagcuggugauccagcagcagcaccagcaguuccuggagaagcagaagcaguaccagcagcagauccacaugaacaagcugcugagcaagagcaucgagcagcugaagcagcccggcagccaccuggaggaggccgaggaggagcugcagggcgaccaggccaugcaggaggacagagcccccagcagcggcaacagcaccagaagcgacagcagcgccugcguggacgacacccugggccaggugggcgccgugaaggugaaggaggagcccguggacagcgacgaggacgcccagauccaggagauggagagcggcgagcaggccgccuucaugcagcaggugaucggcaaggaccuggcccccggcuucgugaucaaggugaucaucuaa

SEQ ID NO: 17969 - RNA, 1989 nt, Artificial Sequence
  HDC__Homo_sapiens__NP_002103
augauggagcccgaggaguacagagagagaggcagagagaugguggacuacaucugccaguaccugagcaccgugagagagagaagagugacccccgacgugcagcccggcuaccugagagcccagcugcccgagagcgcccccgaggaccccgacagcugggacagcaucuucggcgacaucgagagaaucaucaugcccggcguggugcacuggcagagcccccacaugcacgccuacuaccccgcccugaccagcuggcccagccugcugggcgacaugcuggccgacgccaucaacugccugggcuucaccugggccagcagccccgccugcaccgagcuggagaugaacgugauggacuggcuggccaagaugcugggccugcccgagcacuuccugcaccaccaccccagcagccagggcggcggcgugcugcagagcaccgugagcgagagcacccugaucgcccugcuggccgccagaaagaacaagauccuggagaugaagaccagcgagcccgacgccgacgagagcugccugaacgccagacugguggccuacgccagcgaccaggcccacagcagcguggagaaggccggccugaucagccuggugaagaugaaguuccugcccguggacgacaacuucagccugagaggcgaggcccugcagaaggccaucgaggaggacaagcagagaggccuggugcccguguucgugugcgccacccugggcaccaccggcgugugcgccuucgacugccugagcgagcugggccccaucugcgccagagagggccuguggcugcacaucgacgccgccuacgccggcaccgccuuccugugccccgaguucagaggcuuccugaagggcaucgaguacgccgacagcuucaccuucaaccccagcaaguggaugauggugcacuucgacugcaccggcuucugggugaaggacaaguacaagcugcagcagaccuucagcgugaaccccaucuaccugagacacgccaacagcggcguggccaccgacuucaugcacuggcagaucccccugagcagaagauucagaagcgugaagcugugguucgugaucagaagcuucggcgugaagaaccugcaggcccacgugagacacggcaccgagauggccaaguacuucgagagccuggugagaaacgaccccagcuucgagauccccgccaagagacaccugggccuggugguguucagacugaagggccccaacugccugaccgagaacgugcugaaggagaucgccaaggccggcagacuguuccugauccccgccaccauccaggacaagcugaucaucagauucaccgugaccagccaguucaccaccagagacgacauccugagagacuggaaccugaucagagacgccgccacccugauccugagccagcacugcaccagccagcccagccccagagugggcaaccugaucagccagaucagaggcgccagagccugggccugcggcaccagccugcagagcgugagcggcgccggcgacgaccccgugcaggccagaaagaucaucaagcagccccagagagugggcgccggccccaugaagagagagaacggccugcaccuggagacccugcuggaccccguggacgacugcuucagcgaggaggcccccgacgccaccaagcacaagcugagcagcuuccuguucagcuaccugagcgugcagaccaagaagaagaccgugagaagccugagcugcaacagcgugcccgugagcgcccagaagccccugcccaccgaggccagcgugaagaacggcggcagcagcagagugagaaucuucagcagauuccccgaggacaugaugaugcugaagaagagcgccuucaagaagcugaucaaguucuacagcgugcccagcuuccccgagugcagcagccagugcggccugcagcugcccugcugcccccugcaggccaugguguaa

SEQ ID NO: 17970 - RNA, 615 nt, Artificial Sequence
  HDDC2__Homo_sapiens__NP_057147
auggccagcgugagcagcgccaccuucagcggccacggcgccagaagccugcugcaguuccugagacuggugggccagcugaagagagugcccagaaccggcuggguguacagaaacgugcagagacccgagagcgugagcgaccacauguacagaauggccgugauggccauggugaucaaggacgacagacugaacaaggacagaugcgugagacuggcccuggugcacgacauggccgagugcaucgugggcgacaucgcccccgccgacaacauccccaaggaggagaagcacagaagagaggaggaggccaugaagcagaucacccagcugcugcccgaggaccugagaaaggagcuguacgagcugugggaggaguacgagacccagagcagcgccgaggccaaguucgugaagcagcuggaccagugcgagaugauccugcaggccagcgaguacgaggaccuggagcacaagcccggcagacugcaggacuucuacgacagcaccgccggcaaguucaaccaccccgagaucgugcagcuggugagcgagcuggaggccgagagaagcaccaacaucgccgccgccgccagcgagccccacagcuaa

SEQ ID NO: 17971 - RNA, 771 nt, Artificial Sequence
  HDGF__Homo_sapiens__NP_001119522
augcaccccgagggcggccaguucgugccccagcugcugggccaccugcuggccaccaagcugaagagauuccugcugagcaagggcggcagaagagcccagauccccgacgugagcagagccaccccccacaccaucgacgagaugcccgaggccgccgugaagagcaccgccaacaaguaccagguguucuucuucggcacccacgagaccgccuuccugggccccaaggaccuguuccccuacgaggagagcaaggagaaguucggcaagcccaacaagagaaagggcuucagcgagggccugugggagaucgagaacaaccccaccgugaaggccagcggcuaccagagcagccagaagaagagcugcguggaggagcccgagcccgagcccgaggccgccgagggcgacggcgacaagaagggcaacgccgagggcagcagcgacgaggagggcaagcuggugaucgacgagcccgccaaggagaagaacgagaagggcgcccugaagagaagagccggcgaccugcuggaggacagccccaagagacccaaggaggccgagaaccccgagggcgaggagaaggaggccgccacccuggagguggagagaccccugcccauggagguggagaagaacagcacccccagcgagcccggcagcggcagaggccccccccaggaggaggaggaggaggaggacgaggaggaggaggccaccaaggaggacgccgaggcccccggcaucagagaccacgagagccuguaa

SEQ ID NO: 17972 - RNA, 756 nt, Artificial Sequence
  HDGFL1__Homo_sapiens__NP_612641
augagcgccuacggcaugcccauguacaagagcggcgaccugguguucgccaagcugaagggcuacgcccacuggcccgccagaaucgagcacaugacccagcccaacagauaccagguguucuucuucggcacccacgagaccgccuuccugagccccaagagacuguuccccuacaaggagugcaaggagaaguucggcaagcccaacaagagaagaggcuucagcgccggccugugggagaucgagaacaaccccaccgugcaggccagcgacugcccccuggccagcgagaagggcagcggcgacggccccuggcccgagcccgaggccgccgagggcgacgaggacaagcccacccacgccggcggcggcggcgacgagcugggcaagcccgacgacgacaagcccaccgaggaggagaagggcccccugaagagaagcgccggcgacccccccgaggacgcccccaagagacccaaggaggccgcccccgaccaggaggaggaggccgaggccgagagagccgccgaggccgagagagccgccgccgccgccgccgccaccgccguggacgaggagagccccuuccugguggccguggagaacggcagcgcccccagcgagcccggccuggugugcgagcccccccagcccgaggaggaggagcugagagaggaggagguggccgacgaggaggccagccaggaguggcacgccgaggcccccggcggcggcgacagagacagccuguaa

SEQ ID NO: 17973 - RNA, 612 nt, Artificial Sequence
  HDGFRP3__Homo_sapiens__NP_057157
auggccagacccagacccagagaguacaaggccggcgaccugguguucgccaagaugaagggcuacccccacuggcccgccagaaucgacgagcugcccgagggcgccgugaagccccccgccaacaaguaccccaucuucuucuucggcacccacgagaccgccuuccugggccccaaggaccuguuccccuacaaggaguacaaggacaaguucggcaagagcaacaagagaaagggcuucaacgagggccugugggagaucgagaacaaccccggcgugaaguucaccggcuaccaggccauccagcagcagagcagcagcgagaccgagggcgagggcggcaacaccgccgacgccagcagcgaggaggagggcgacagaguggaggaggacggcaagggcaagagaaagaacgagaaggccggcagcaagagaaagaagagcuacaccagcaagaagagcagcaagcagagcagaaagagccccggcgacgaggacgacaaggacugcaaggaggaggagaacaagagcagcagcgagggcggcgacgccggcaacgacaccagaaacaccaccagcgaccugcagaagaccagcgagggcaccuaa

SEQ ID NO: 17974 - RNA, 756 nt, Artificial Sequence
  HDHD1__Homo_sapiens__NP_001129037
auggccgcccccccccagcccgugacccaccugaucuucgacauggacggccugcugcugggcuacaccggcagcaucguggccgccgccagcggcgagagcagcagaggccugcagagcagauggaccgacaccgagagacuguacagcgugguguuccaggagaucugcaacagauacgacaagaaguacagcugggacgugaagagccuggugaugggcaagaaggcccuggaggccgcccagaucaucaucgacgugcugcagcugcccaugagcaaggaggagcugguggaggagagccagaccaagcugaaggagguguuccccaccgccgcccugaugcccggcgccgagaagcugaucauccaccugagaaagcacggcauccccuucgcccuggccaccagcagcggcagcgccagcuucgacaugaagaccagcagacacaaggaguucuucagccuguucagccacaucgugcugggcgacgaccccgaggugcagcacggcaagcccgaccccgacaucuuccuggccugcgccaagagauucagccccccccccgccauggagaagugccugguguucgaggacgcccccaacggcguggaggccgcccuggccgccggcaugcagguggugauggugcccgacggcaaccugagcagagaccugaccaccaaggccacccuggugcugaacagccugcaggacuuccagcccgagcuguucggccugcccagcuacgaguaa

SEQ ID NO: 17975 - RNA, 3708 nt, Artificial Sequence
  HDLBP__Homo_sapiens__NP_001230829
augcaccuggccgagagagacagauggcuguucguggccaccgugaugaugcacuucgugagcaucaagagcggcuuccccggccugugcgugggcgugagaagcaccaugagcagcguggccgugcugacccaggagagcuucgccgagcacagaagcggccuggugccccagcagaucaagguggccacccugaacagcgaggaggagagcgacccccccaccuacaaggacgccuuccccccccugcccgagaaggccgccugccuggagagcgcccaggagcccgccggcgccuggggcaacaagaucagacccaucaaggccagcgugaucacccagguguuccacgugccccuggaggagagaaaguacaaggacaugaaccaguucggcgagggcgagcaggccaagaucugccuggagaucaugcagagaaccggcgcccaccuggagcugagccuggccaaggaccagggccugagcaucauggugagcggcaagcuggacgccgugaugaaggccagaaaggacaucguggccagacugcagacccaggccagcgccaccguggccauccccaaggagcaccacagauucgugaucggcaagaacggcgagaagcugcaggaccuggagcugaagaccgccaccaagauccagauccccagacccgacgaccccagcaaccagaucaagaucaccggcaccaaggagggcaucgagaaggccagacacgaggugcugcugaucagcgccgagcaggacaagagagccguggagagacuggagguggagaaggccuuccaccccuucaucgccggccccuacaacagacuggugggcgagaucaugcaggagaccggcaccagaaucaacauccccccccccagcgugaacagaaccgagaucguguucaccggcgagaaggagcagcuggcccaggccguggccagaaucaagaagaucuacgaggagaaggccaacagcuucaccgugagcagcguggccgcccccagcuggcugcacagauucaucaucggcaagaagggccagaaccuggccaagaucacccagcagaugcccaaggugcacaucgaguucaccgagggcgaggacaagaucacccuggagggccccaccgaggacgugaacguggcccaggagcagaucgagggcauggugaaggaccugaucaacagaauggacuacguggagaucaacaucgaccacaaguuccacagacaccugaucggcaagagcggcgccaacaucaacagaaucaaggaccaguacaaggugagcgugagaaucccccccgacagcgagaagagcaaccugaucagaaucgagggcgacccccagggcgugcagcaggccaagagagagcugcuggagcuggccagcagaauggagaacgagagaaccaaggaccugaucaucgagcagagauuccacagaaccaucaucggccagaagggcgagagaaucagagagaucagagacaaguuccccgaggugaucaucaacuuccccgaccccgcccagaagagcgacaucgugcagcugagaggccccaagaacgagguggagaagugcaccaaguacaugcagaagaugguggccgaccugguggagaacagcuacagcaucagcgugcccaucuucaagcaguuccacaagaacaucaucggcaagggcggcgccaacaucaagaagaucagagaggagagcaacaccaagaucgaccugcccgccgagaacagcaacagcgagaccaucaucaucaccggcaagagagccaacugcgaggccgccagaagcagaauccugagcauccagaaggaccuggccaacaucgccgagguggaggugagcauccccgccaagcugcacaacagccugaucggcaccaagggcagacugaucagaagcaucauggaggagugcggcggcgugcacauccacuuccccguggagggcagcggcagcgacaccguggugaucagaggccccagcagcgacguggagaaggccaagaagcagcugcugcaccuggccgaggagaagcagaccaagagcuucaccguggacaucagagccaagcccgaguaccacaaguuccugaucggcaagggcggcggcaagaucagaaaggugagagacagcaccggcgccagagugaucuuccccgccgccgaggacaaggaccaggaccugaucaccaucaucggcaaggaggacgccgugagagaggcccagaaggagcuggaggcccugauccagaaccuggacaacgugguggaggacagcaugcugguggaccccaagcaccacagacacuucgugaucagaagaggccaggugcugagagagaucgccgaggaguacggcggcgugauggugagcuuccccagaagcggcacccagagcgacaaggugacccugaagggcgccaaggacugcguggaggccgccaagaagagaauccaggagaucaucgaggaccuggaggcccaggugacccuggagugcgccaucccccagaaguuccacagaagcgugaugggccccaagggcagcagaauccagcagaucaccagagacuucagcgugcagaucaaguuccccgacagagaggagaacgccgugcacagcaccgagcccguggugcaggagaacggcgacgaggccggcgagggcagagaggccaaggacugcgaccccggcagccccagaagaugcgacaucaucaucaucagcggcagaaaggagaagugcgaggccgccaaggaggcccuggaggcccuggugcccgugaccaucgagguggaggugcccuucgaccugcacagauacgugaucggccagaagggcagcggcaucagaaagaugauggacgaguucgaggugaacauccacgugcccgcccccgagcugcagagcgacaucaucgccaucaccggccuggccgccaaccuggacagagccaaggccggccugcuggagagagugaaggagcugcaggccgagcaggaggacagagcccugagaagcuucaagcugagcgugaccguggaccccaaguaccaccccaagaucaucggcagaaagggcgccgugaucacccagaucagacuggagcacgacgugaacauccaguuccccgacaaggacgacggcaaccagccccaggaccagaucaccaucaccggcuacgagaagaacaccgaggccgccagagacgccauccugagaaucgugggcgagcuggagcagauggugagcgaggacgugccccuggaccacagagugcacgccagaaucaucggcgccagaggcaaggccaucagaaagaucauggacgaguucaagguggacaucagauucccccagagcggcgcccccgaccccaacugcgugaccgugaccggccugcccgagaacguggaggaggccaucgaccacauccugaaccuggaggaggaguaccuggccgacgugguggacagcgaggcccugcagguguacaugaagccccccgcccacgaggaggccaaggcccccagcagaggcuucguggugagagacgcccccuggaccgccagcagcagcgagaaggcccccgacaugagcagcagcgaggaguuccccagcuucggcgcccagguggcccccaagacccugcccuggggccccaagagauaa

SEQ ID NO: 17976 - RNA, 6435 nt, Artificial Sequence
  HEATR1__Homo_sapiens__NP_060542
augaccagccuggcccagcagcugcagagacuggcccugccccagagcgacgccagccugcugagcagagacgagguggccagccugcuguucgaccccaaggaggccgccaccaucgacagagacaccgccuucgccaucggcugcaccggccuggaggagcugcugggcaucgaccccagcuucgagcaguucgaggccccccuguucagccagcuggccaagacccuggagagaagcgugcagaccaaggccgugaacaagcagcuggacgagaacaucagccuguuccugauccaccugagccccuacuuccugcugaagcccgcccagaagugccuggaguggcugauccacagauuccacauccaccuguacaaccaggacagccugaucgccugcgugcugcccuaccacgagaccagaaucuucgugagagugauccagcugcugaagaucaacaacagcaagcacagaugguucuggcugcugcccgugaagcagagcggcgugccccuggccaagggcacccugaucacccacugcuacaaggaccugggcuucauggacuucaucugcagccuggugaccaagagcgugaagguguucgccgaguaccccggcagcagcgcccagcugagagugcugcuggccuucuacgccagcaccaucgugagcgcccugguggccgccgaggacgugagcgacaacaucaucgccaagcuguuccccuacauccagaagggccugaagagcagccugcccgacuacagagccgccaccuacaugaucaucugccagaucagcgugaaggugaccauggagaacaccuucgugaacagccuggccagccagaucaucaagacccugaccaagauccccagccugaucaaggacggccugagcugccugaucgugcugcugcagagacagaagcccgagagccugggcaagaagcccuucccccaccugugcaacgugcccgaccugaucaccauccugcacggcaucagcgagaccuacgacgugagcccccugcugcacuacaugcugccccaccugguggugagcaucauccaccacgugaccggcgaggagaccgagggcauggacggccagaucuacaagagacaccuggaggccauccugaccaagaucagccugaagaacaaccuggaccaccugcuggccagccugcuguucgaggaguacaucagcuacagcagccaggaggagauggacagcaacaaggugagccugcugaacgagcaguuccugccccugaucagacugcuggagagcaaguaccccagaacccuggacguggugcuggaggagcaccugaaggagaucgccgaccugaagaagcaggagcuguuccaccaguucgugagccugagcaccagcggcggcaaguaccaguuccuggccgacagcgacaccagccugaugcugagccugaaccacccccuggcccccgugagaauccuggccaugaaccaccugaagaagaucaugaagaccagcaaggagggcguggacgagagcuucaucaaggaggccgugcuggccagacugggcgacgacaacaucgacguggugcugagcgccaucagcgccuucgagaucuucaaggagcacuucagcagcgaggugaccaucagcaaccugcugaaccuguuccagagagccgagcugagcaagaacggcgagugguacgaggugcugaagaucgccgccgacauccugaucaaggaggagauccugagcgagaacgaccagcugagcaaccaggugguggugugccugcugcccuucauggugaucaacaacgacgacaccgagagcgccgagaugaagaucgccaucuaccugagcaagagcggcaucugcagccugcacccccugcugagaggcugggaggaggcccuggagaacgugaucaagagcaccaagcccggcaagcugaucggcguggccaaccagaagaugaucgagcugcuggccgacaacaucaaccugggcgaccccagcagcaugcugaagaugguggaggaccugaucagcgugggcgaggaggagagcuucaaccugaagcagaaggugaccuuccacgugauccugagcgugcuggugagcugcugcagcagccugaaggagacccacuuccccuucgccaucagaguguucagccugcugcagaagaagaucaagaagcuggagagcgugaucaccgccguggagauccccagcgaguggcacaucgagcugaugcuggacagaggcauccccguggagcugugggcccacuacguggaggagcugaacagcacccagagaguggccguggaggacagcguguuccugguguucagccugaagaaguucaucuacgcccugaaggcccccaagagcuuccccaagggcgacaucugguggaaccccgagcagcugaaggaggacagcagagacuaccugcaccugcugaucggccuguucgagaugaugcugaacggcgccgacgccgugcacuucagagugcugaugaagcuguucaucaaggugcaccuggaggacguguuccagcuguucaaguucugcagcgugcuguggaccuacggcagcagccugagcaacccccugaacugcagcgugaagaccgugcugcagacccaggcccuguacgugggcugcgccaugcugagcagccagaagacccagugcaagcaccagcuggccagcaucagcagccccguggugaccagccugcugaucaaccugggcagccccgugaaggaggugagaagagccgccauccagugccugcaggcccugagcggcguggccagccccuucuaccugaucaucgaccaccugaucagcaaggccgaggagaucaccagcgacgccgccuacgugauccaggaccuggccacccuguucgaggagcugcagagagagaagaagcugaagagccaccagaagcugagcgagacccugaagaaccugcugagcugcguguacagcugccccagcuacaucgccaaggaccugaugaaggugcugcagggcgugaacggcgagauggugcugagccagcugcugcccauggccgagcagcugcuggagaagauccagaaggagcccaccgccgugcugaaggacgaggccauggugcugcaccugacccugggcaaguacaacgaguucagcgugagccugcugaacgaggaccccaagagccuggacaucuucaucaaggccgugcacaccaccaaggagcuguacgccggcaugcccaccauccagaucaccgcccuggagaagaucaccaagcccuucuucgccgccaucagcgacgagaaggugcagcagaagcugcugagaaugcuguucgaccugcuggugaacugcaagaacagccacugcgcccagaccgugagcagcguguucaagggcaucagcgugaacgccgagcaggugagaaucgagcuggagccccccgacaaggccaagccccugggcaccgugcagcagaagagaagacagaagaugcagcagaagaagagccaggaccuggagagcgugcaggaggugggcggcagcuacuggcagagagugacccugauccuggagcugcugcagcacaagaagaagcugagaagcccccagauccuggugcccacccuguucaaccugcugagcagaugccuggagccccugccccaggagcagggcaacauggaguacaccaagcagcugauccugagcugccugcugaacaucugccagaagcugagccccgacggcggcaagauccccaaggacauccuggacgaggagaaguucaacguggagcugaucgugcagugcaucagacugagcgagaugccccagacccaccaccacgcccugcugcugcugggcaccguggccggcaucuuccccgacaaggugcugcacaacaucaugagcaucuucaccuucaugggcgccaacgugaugagacuggacgacaccuacagcuuccaggugaucaacaagaccgugaagauggugauccccgcccugauccagagcgacagcggcgacagcaucgaggugagcagaaacguggaggagaucguggugaagaucaucagcguguucguggacgcccugccccacgugcccgagcacagaagacugcccauccuggugcagcugguggacacccugggcgccgagaaguuccuguggauccugcugauccugcuguucgagcaguacgugaccaagaccgugcuggccgccgccuacggcgagaaggacgccauccuggaggccgacaccgaguucugguucagcgugugcugcgaguucagcgugcagcaccagauccagagccugaugaacauccugcaguaccugcugaagcugcccgaggagaaggaggagaccauccccaaggccgugagcuucaacaagagcgagagccaggaggagaugcugcagguguucaacguggagacccacaccagcaagcagcugagacacuucaaguuccugagcgugagcuucaugagccagcugcugagcagcaacaacuuccugaagaaggugguggagagcggcggccccgagauccugaagggccuggaggagagacugcuggagaccgugcugggcuacaucagcgccguggcccagagcauggagagaaacgccgacaagcugaccgugaaguucuggagagcccugcugagcaaggccuacgaccugcuggacaaggugaacgcccugcugcccaccgagaccuucauccccgugaucagaggccuggugggcaacccccugcccagcgugagaagaaaggcccuggaccugcugaacaacaagcugcagcagaacaucagcuggaagaagaccaucgugaccagauuccugaagcuggugcccgaccugcuggccaucgugcagagaaagaagaaggagggcgaggaggagcaggccaucaacagacagaccgcccuguacacccugaagcugcugugcaagaacuucggcgccgagaaccccgaccccuucgugcccgugcugaacaccgccgugaagcugaucgcccccgagagaaaggaggagaagaacgugcugggcagcgcccugcugugcaucgccgaggugaccagcacccuggaggcccuggccaucccccagcugcccagccugaugcccagccugcugaccaccaugaagaacaccagcgagcuggugagcagcgagguguaccugcugagcgcccuggccgcccugcagaaggugguggagacccugccccacuucaucagccccuaccuggagggcauccugagccaggugauccaccuggagaagaucaccagcgagaugggcagcgccagccaggccaacaucagacugaccagccugaagaagacccuggccaccacccuggcccccagagugcugcugcccgccaucaagaagaccuacaagcagaucgagaagaacuggaagaaccacaugggccccuucaugagcauccugcaggagcacaucggcgugaugaagaaggaggagcugaccagccaccagagccagcugaccgccuucuuccuggaggcccuggacuucagagcccagcacagcgagaacgaccuggaggaggugggcaagaccgagaacugcaucaucgacugccugguggccaugguggugaagcugagcgaggugaccuucagaccccuguucuucaagcuguucgacugggccaagaccgaggacgcccccaaggacagacugcugaccuucuacaaccuggccgacugcaucgccgagaagcugaagggccuguucacccuguucgccggccaccuggugaagcccuucgccgacacccugaaccaggugaacaucagcaagaccgacgaggccuucuucgacagcgagaacgaccccgagaagugcugccugcugcugcaguucauccugaacugccuguacaagaucuuccuguucgacacccagcacuucaucagcaaggagagagccgaggcccugaugaugccccugguggaccagcuggagaacagacugggcggcgaggagaaguuccaggagagagugaccaagcaccugauccccugcaucgcccaguucagcguggccauggccgacgacagccuguggaagccccugaacuaccagauccugcugaagaccagagacagcagccccaaggugagauucgccgcccugaucaccgugcuggcccuggccgagaagcugaaggagaacuacaucgugcugcugcccgagagcauccccuuccuggccgagcugauggaggacgagugcgaggagguggagcaccagugccagaagaccauccagcagcuggagaccgugcugggcgagccccugcagagcuacuucuaa

SEQ ID NO: 17977 - RNA, 2043 nt, Artificial Sequence
  HEATR3__Homo_sapiens__NP_891552
augggcaagagcagaaccaagagauucaagagaccccaguucagccccaccggcgacugccaggccgaggccgccgccgccgccaacggcaccggcggcgaggaggacgacggccccgccgccgagcugcuggagaagcugcagcaccccagcgccgaggugagagagugcgccugcgccggccuggccagacuggugcagcagagacccgcccugcccggccuggccagaagagacgccgugagaagacugggcccccugcugcuggaccccagccuggccgugagagagaccgccgccggcgcccugagaaaccugagcgccugcggcggcuucgaggugugcgacgacauggugaccaaggacaucaugaccccccugguggcccugcugaaggagugcagcgccggccuggacagcaacgagaugagccugcaggagaagaaggaccagaacagaaacagcaucgagaacaucgccaacgagaccgugaacgugcuguggaacaucugcgagugcagcagcagagccgugagcaucuucaacaaggagggcugccuggagaucgugcugaaguaccugagcagauuccccaccaacguggaccuggccaucagcguggccuacugccugcagaccgugaccgaggacaaccccgagcugcugaagagcuucagcgccaccgcccugaacaugcuggagagcgcccugcugagccccgugagcagcauggagagccugcugcugaagacccugguggccggcaccaucuggaaccugaaggacaucauccccugcaagagccaggccgagaucaucaacgcccugcugaagauccugagcgaggugcugggcauggacgccggcgagauggugauccagaugaaggaggccgagacccagagacugaagaccgccgccgaggccgaggagauccuggagaacaccaacggcgacgaccugaucgaggacgacgagauggagggcaucagccacaagagaagagugagaagaaagaccuucgugagcgaccugcugccccccaccgacaaggagcugagagagaccaucgcccugcugaccgcccagcagaccgcccuggagaucaucgugaacaugugcugcaacgaggaccccagcgacgacgagugggaggagcugagcagcagcgacgagagcgacgccuucauggagaacagcuucagcgagugcggcggccagcuguucagcccccugugccugagccacgaggugcacaccgcccugaccaacuaccugauccccaagaagaucuucgagaagaccgccuuccccaacagcaucgccguggaccugugcagcagaaaccccaccuggaagccccugaucagaaagaugaacaccauccagugcagagcccuguucugccugcagagccuggugagccugcuggacguggagcaccugggcggcgccgccgcccugcagacccuggcccagcaccugagccagcugcuguucagccagcccgacuucgccaagcacguggacuuccuggaggccaucagcagcgcccugagagcccugcugcagaccauggccagcaagaacaucagccagugcaugacccccgaccagcugaugacccugugcaaggccggcauccacagcagcaacgugggcgugagagugaacguggugagcauccugggcaucaccggcagcgugcuggccaaggaggacggcacccuggagacccugaagaacaucggcugcuuccugcuggaggugaccaccaaggaccccagccuggugguggccggcgaggcccuggacgcccuguucgacguguucgccgacggcaaggaggccgagagagccagcauccagaucaagcugcugagcgcccugaaggaguuccagcccguguucaagaugaagaucagaaaggagggcagaggcaacuacagcaccgaccagcugugcgugcuggacaacgugaagaugaaccugagaagauucaucgccuaccaggagaccguggagaagagacugaccagcuaa

SEQ ID NO: 17978 - RNA, 6216 nt, Artificial Sequence
  HEATR5B__Homo_sapiens__NP_061897
auggagcuggcccacagccugcugcugaacgaggaggcccuggcccagaucaccgaggccaagagacccguguucaucuucgaguggcugagauuccuggacaaggugcugguggccgccaacaagaccgacgugaaggagaagcagaagaagcugguggagcagcugaccggccugaucagcagcagccccggcccccccaccagaaagcugcuggccaagaaccuggccgcccuguacagcaucggcgacaccuucaccguguuccagacccuggacaagugcaacgacaucaucagaaacaaggacgacaccgccgccuaccugcccaccaagcuggccgccguggccugcgugggcgccuucuacgagaagaugggcagaaugcugggcagcgccuuccccgagaccgugaacaaccugcugaagagccugaagagcgccgagagccagggcagaagcgagauccugaugagccugcagaaggugcugagcggccugggcggcgccgccgccagcagccacagagacaucuacaagaacgccagaagccugcugaccgacagaagcauggccgugagaugcgccguggccaagugccugcuggagcugcagaacgaggccguguucauguggaccgccgagcuggagaacaucgccacccugugcuucaaggcccuggagaacagcaacuacggcgugagaguggccgugagcaagcugcugggcaccgugauggccaccgcccugaugcccaagcaggccaccgugaugagacagaacgugaagagagccaccuucgacgaggugcuggagcugauggccaccggcuuccugagaggcggcagcggcuuccugaagagcggcggcgagaugcugaaggugggcggcagcgugaacagagaggugagagugggcgugacccaggccuacgugguguucgugaccacccugggcggccaguggcuggagagaagcuucgccaccuuccugagccacgugcuggaccuggugagccaccccagagccacccagacccacguggaggccguguacagcagaagaugcgugagcuucauccugagagccaccgugggcagccugcugggcgagaaggcccagaucgccgccgccaaggagaucugccaggccaucggcaagcagaugaaggccguggaggccguggugaacgacaccagcggcgagaacaagagcggcgccgccgacaucgccgccagccagcacgugauggugugcgcccugcaggagcugggcagccuggugcagagccugaacgccaccgccagcccccugauccaggaggccagcaucggccugcuggagaucgugaccagcgugcugcugcaccccagcauggccgccagacuggccgccgccuggugccugagaugcguggccguggcccugcccuuccagcugacccccuuccuggacagaugcgccgagagacugaacaaccugaagaccagccccgaggccgugagcggcuacagcuucgccauggccgcccugcugggcggcgugcaccagugcccccugggcaucccccacgccaagggcaagaugguggugagcaucgccgaggaccugcugagaaccgccgcccagaacagcagacugagccugcagagaacccaggccggcuggcugcugcugggcgcccugaugacccugggccccagcguggugagauaccaccugcccaagaugcugcugcuguggagaaacguguuccccagaagccugaaggagcuggaggccgagaaggccagaggcgacagcuucaccuggcaggugacccuggagggcagagccggcgcccugugcgccaugagaagcuucguggcccacugccccgagcugcugaccgaggacgugaucagaaagcugaugacccccaucgagugcgccaugaccaugaugagccacauccccagcgugaugaaggcccacggcgcccaccugaaggccagcgccgccauggugagacugagacuguacgacauccuggcccugcugccccccaagaccuacgagggcagcuucaacgcccugcugagagagcugguggccgaguucacccugaccgacaacagcgccaacaccaccaccagccugcugagaagccugugccacuacgacgacagcgugcugcugggcagcuggcugcaggagaccgaccacaagagcaucgaggaccagcugcagcccaacagcgccagcggcagcggcgcccuggagcacgaccccagcagcaucuaccugagaauccccgccggcgaggccgugcccggcccccugccccugggcgugagcgugaucgacgccagcguggcccuguucggcgugguguucccccacgugagcuacaagcacagacugcagaugcuggaccacuucgccgagugcgugaagcaggccaagggcgugagacagcaggccgugcagcugaacaucuucaccgccgugcugagcgcccugaagggccuggccgagaacaagagcacccugggccccgaggaggugagaaagagcgcccugacccuggugaugggcccccuggacaaccccaaccccauccugagaugcgccgccggcgaggcccugggcagaauggcccagguggugggcgaggccaccuucaucgccagaauggcccaguacagcuucgacaagcugaagagcgccagagacguggugagcagaaccggccacagccuggcccugggcugccugcacagauacgugggcggcaucggcagcggccagcaccugaagaccagcgugagcauccugcuggcccuggcccaggacggcaccagccccgaggugcagaccuggagccugcacagccuggcccugaucguggacagcagcggccccauguacagaggcuacguggagcccacccugagccuggugcugacccugcugcugaccgugccccccagccacaccgaggugcaccagugccugggcagaugccugggcgccaucaucaccaccgugggccccgagcugcagggcaacggcgccaccaccagcaccaucagaagcagcugccuggugggcugcgccaucacccaggaccacagcgacagccuggugcaggccgccgccaucagcugccugcagcagcugcacauguucgcccccagacacgugaaccugagcagccuggugcccagccugugcgugcaccugugcagcagccaccugcugcugagaagagccgccguggccugccugagacagcuggcccagagagaggccgccgaggugugcgaguacgccaugagccuggccaagaacaccggcgacaaggagagcagcagcgccaacgugagccccuucgcccccggcgugagcagcagaaccgacauccacugcagacaccagggcgugaacaucaccgagaccggccuggagggccugcuguucggcaugcuggacagagagaccgacagaaagcugugcagcgacauccacgacacccugggccacaugcugagcagccuggccguggagaagcugagccacuggcugaugcugugcaaggacgugcuggccgccagcagcgacaugagcaccgccacccugcugagcagcggcaaggacgaggaggccgagaagaaggacgagauggacgacgacaccauguucaccacccugggcgaggaggacaagagcaagcccuucguggcccccagaugggccaccagaguguucgccgccgacugccugugcagaaucaucaaccugugcgagaacgccgaccaggcccacuucgaccuggcccuggccagaagcgccaagcugagaaaccccaccaacgaccugcuggugcugcaccugagcgaccugaucagaauggccuucauggccgccaccgaccacagcaaccagcugagaauggccggccugcaggcccuggaggacaucaucaagaaguucgccagcgugcccgagcccgaguuccccggccacgugauccuggagcaguaccaggccaacgugggcgccgcccugagacccgccuucagccaggacacccccagcgacaucaucgccaaggccugccaggugugcagcaccuggaucggcagcggcguggugagcgaccugaacgaccugagaagagugcacaaccugcuggugagcagccuggacaaggugcaggccggcaagggcagcagcagccagcuguacagagagagcgccaccaccauggagaagcuggccgugcugaaggccugggccgagguguacgugguggccaugaacaucaagaaggaggccgagagcaagcccaagagagccaucaagaacaccgacgacgacgacgacgacugcggcaccaucgacgagcugccccccgacagccugaucacccuggugcagcccgagcugcccacccugagcagacuguggcuggccgcccugaaggacuacgcccugcugacccugcccgccgaguucagcagccagcugccccccgacggcggcgccuucuacacccccgagaccaucgacaccgccagacugcacuacagaaacagcugggcccccauccugcacgccguggcccuguggcugaacagcaccggcuucaccugcagcgagagcaccgaggccgccgccaucagcggccugcagaagagaagcaccagcgugaaccugaaccaggccagcggcgccgugggcagcgccaagagccugcccgagaucaacaaggacagaaugcaccugauccugggcgugagcauccaguuccugugcagccccagacccgaggagcccaucgagcacgugaccgccugccugcaggcccugcacacccugcuggacagccccuacgccagagugcacaucgccgaggaccagcugaucggcguggagcugcugagcgugcugcacagacugcugcugaccuggaaccccagcagcgugcagcugcuggugaccggcguggugcagcagaucgugagagccgcccaggacuaccugcaggagaagagaaacacccugaacgaggacgacauggagaaggaggccugcaccgugcugggcgagggcggcgacagcggcggccugauccccggcaagagccugguguucgccaccauggagcugcugauguucauccuggugagacacaugccccaccugagcaccaaggugagcgacagccccagccacaucgccaccaagaccagacugagcgaggagagcgccagacugguggccgccaccgugaccauccugagcgaccugcccagccugugcagccccgccggcugcaugaccauccugcccaccauccuguuccugaucgccagaauccugaaggacaccgccaucaagagcgccgacaaccaggugcccccccccgugagcgccgcccugcagggcaucaagagcaucgugacccugagcauggccaagaccgaggccggcgugcagaagcaguggaccgcccugaucagaagcacccuggccugcauccuggaguacagccagcccgaggacagcgugcccacccccgacgaggugagcaugcugaccgccaucgcccuguuccuguggagcgccagcaacgagaucaucggcgugcagagccugcagaacggcugcaugaacagauucaagaacgcccugaacagcugcgaccccugggugcaggccaagugcuaccagcugcugcugagcguguuccagcacagcaacagagcccugagcacccccuacauccacagccuggcccccaucgugguggagaagcugaaggccguggagagaaacagacccgccagcaacaucgagcugcuggccgugcaggagggcaucaaggugcuggagacccugguggcccugggcgaggagcagaacagagugcagcugcuggcccugcuggugcccacccugaucagcuaccugcuggacgagaacagcuucgccagcgccagcagcgccagcaaggaccugcacgaguucgcccugcagaaccugaugcacaucggcccccuguacccccacgccuucaagaccgugaugggcgccgcccccgagcugaaggugagacuggagaccgccgugagagccagccaggccagcaaggccaaggccgccgccagacagcccgcccccgccauccacagcgcccccaccaucaagcugaagaccagcuucuucuaa

SEQ ID NO: 17979 - RNA, 3546 nt, Artificial Sequence
  HEATR6__Homo_sapiens__NP_071353
auggccgccgugcagguggugggcagcuggcccagcgugcagcccagagaggcccccagagaggccauccccgagagaggcaacggcuucagacugcugagcgccagacugugcgcccugagacccgacgacagcagcagcgccagaaccgagauccaccugcuguucgaccagcugaucagcgagaacuacagcgagggcagcggcguggcccccgaggacgugagcgcccugcuggugcaggccugcagacuggugccccugaaccagaaccaccuggugagcaaggugagccagcugauccaccaccugcugaacagacugcaggugaucguggacgagcagcaccuggacuuccugcuggccuacaccaucagcgccauccaccagugcagcagcuggacccacagagagauccugcaggcccuggccgcccugguguacugcaacggcagcaagugccagaaguaccugcccgagcugcugggcaacaccggccugcugaugaagcugagcgaccuggcccagagcgaccccgaggugagaagagccgccgugcacugcauggccaaccugugccugagcgugcccggccagcccuaccuggaggagcccuaccagaacgugugcuuccaggccuuccugaccauccugcagagccccaagagcagcgacauggacgacaucaccuucugcaugcugcugcagaacgcccugaagggcauccagagccugcugaacggcggcagaaugaagcugacccagaccgacgagcugggcgcccugcuggccgugcugaagaaguucauguuccacggccugcccggccugaacaucgagaugcccaccgugcuguaccccaccccccugccccaguacgacggcagaacccccaucaagccccagcagagcgagagcagcgccagcagacccacccugaacaagaagaagaagagcaaggugaagcccaagaagauccagcagggcgaggaggaggagaaggagagcagcggcgagaucgaggccgcccccgugaccggcaccggcagagugaaccugcacgagggcaacaccuggugccccagcagccugggcgugcagagccugccccuggacggcagcggcgccgccgagaaggacggcgugagcagcagcuucagcagcagcagcuggaagagagugagcagcagcgagagcgacuucagcgacgccgagggcggcaugcagagcaagaugagaagcuaccaggccaaggugagacagggcgcccuggugugcuuccugagcaccaucaagagcaucgagaagaaggugcuguacggcuacuggagcgccuucauccccgacacccccgagcugggcagcccccagagcgugagccugaugacccugacccugaaggaccccagccccaagaccagagccugcgcccugcaggugcugagcgccauccuggagggcagcaagcaguuccugagcguggccgaggacaccagcgaccacagaagagccuucacccccuucagcgugaugaucgccugcagcaucagagagcugcacagaugccugcugcuggcccugguggccgagagcagcagccagaccgugacccagaucaucaagugccuggccaaccuggugagcaacgcccccuacgacagacugaagcugagccugcugaccaagguguggaaccagaucaagcccuacaucagacacaaggacgugaacgugagagugagcagccugacccugcugggcgccaucgugagcacccacgccccccugcccgaggugcagcugcugcugcagcagcccugcagcagcggccugggcaacagcaacagcgccaccccccaccugagcccccccgacugguggaagaaggcccccgccggccccagccuggaggagaccagcgugagcagccccaagggcagcagcgagcccugcuggcugaucagacugugcaucagcaucguggugcugcccaaggaggacagcugcagcggcagcgacgccggcagcgccgccggcagcaccuacgagcccagccccaugagacuggaggcccugcaggugcugacccugcuggccagaggcuacuucagcaugacccaggccuaccugauggagcugggcgaggugaucugcaagugcaugggcgaggccgaccccagcauccagcugcacggcgccaagcugcuggaggagcugggcaccggccugauccagcaguacaagcccgacagcaccgccgcccccgaccagagagcccccguguuccugguggugauguucuggaccaugaugcugaacggcccccugcccagagcccugcagaacagcgagcaccccacccugcaggccagcgccugcgacgcccugagcagcauccugcccgaggccuucagcaaccugcccaacgacagacagaugcugugcaucaccgugcugcugggccugaacgacagcaagaacagacuggugaaggccgccaccagcagagcccugggcguguacgugcuguuccccugccugagacaggacgugaucuucguggccgacgccgccaacgccauccugaugagccuggaggacaagagccugaacgugagagccaaggccgccuggagccugggcaaccugaccgacacccugaucgugaacauggagacccccgaccccagcuuccaggaggaguucagcggccugcugcugcugaagaugcugagaagcgccaucgaggccagcaaggacaaggacaaggugaagagcaacgccgugagagcccugggcaaccugcugcacuuccugcagcccagccacaucgagaagcccaccuucgccgagaucaucgaggagagcauccaggcccugaucagcaccgugcugaccgaggccgccaugaaggugagauggaacgccugcuacgccaugggcaacguguucaagaaccccgcccugccccugggcaccgcccccuggaccagccaggccuacaacgcccugaccagcguggugaccagcugcaagaacuucaaggugagaaucagaagcgccgccgcccugagcgugcccggcaagagagagcaguacggcagcguggaccaguacgccagaaucuggaacgcccuggugaccgcccugcagaagagcgaggacaccaucgacuuccuggaguucaaguacugcgugagccugagaacccagaucugccaggcccugauccaccugcugagccuggccagcgccagcgaccugcccugcaugaaggagacccuggagcugagcggcaacauggugcagagcuacauccugcaguuccugaagagcggcgccgagggcgacgacaccggcgccccccacagcccccaggagagagaccagauggugagaauggcccugaagcacaugggcagcauccaggcccccaccggcgacaccgccagaagagccaucaugggcuuccuggaggagauccuggccgugugcuucgacagcagcggcagccagggcgcccugcccggccugaccaaccaguaa

SEQ ID NO: 17980 - RNA, 570 nt, Artificial Sequence
  HEBP1__Homo_sapiens__NP_057071
augcugggcaugaucaagaacagccuguucggcagcguggagaccuggcccuggcaggugcugagcaagggcgacaaggaggagguggccuacgaggagagagccugcgagggcggcaaguucgccaccguggaggugaccgacaagcccguggacgaggcccugagagaggccaugcccaagguggccaaguacgccggcggcaccaacgacaagggcaucggcaugggcaugaccgugcccaucagcuucgccguguuccccaacgaggacggcagccugcagaagaagcugaaggugugguucagaauccccaaccaguuccagagcgacccccccgcccccagcgacaagagcgugaagaucgaggagagagagggcaucaccguguacagcaugcaguucggcggcuacgccaaggaggccgacuacguggcccaggccaccagacugagagccgcccuggagggcaccgccaccuacagaggcgacaucuacuucugcaccggcuacgacccccccaugaagcccuacggcagaagaaacgagaucuggcugcugaagaccuaa

SEQ ID NO: 17981 - RNA, 618 nt, Artificial Sequence
  HEBP2__Homo_sapiens__NP_055135
auggccgagccccugcagcccgaccccggcgccgccgaggacgccgccgcccaggccguggagacccccggcuggaaggcccccgaggacgccggcccccagcccggcagcuacgagaucagacacuacggccccgccaagugggugagcaccagcguggagagcauggacugggacagcgccauccagaccggcuucaccaagcugaacagcuacauccagggcaagaacgagaaggagaugaagaucaagaugaccgcccccgugaccagcuacguggagcccggcagcggccccuucagcgagagcaccaucaccaucagccuguacauccccagcgagcagcaguucgacccccccagaccccuggagagcgacguguucaucgaggacagagccgagaugaccguguucgugagaagcuucgacggcuucagcagcgcccagaagaaccaggagcagcugcugacccuggccagcauccugagagaggacggcaagguguucgacgagaagguguacuacaccgccggcuacaacagccccgugaagcugcugaacagaaacaacgagguguggcugauccagaagaacgagcccaccaaggagaacgaguaa

SEQ ID NO: 17982 - RNA, 1632 nt, Artificial Sequence
  HECA__Homo_sapiens__NP_057301
augcccaaccccaagaacagcaagggcggcagaaagaacaagagagccaacagcagcggcgacgagcaggagaacggcgccggcgcccuggccgccgccggcgccgccggcgccgccgccggcggcgcccuggccgccgccgccggcugcggcgccgccgccgccggcgcccccggcgccggcggcgccgccggcgccggcggcgccggcaccggcgccgccaacgccgccgccgccgccggcgccgccgccgccggcgacgccaagaacgaggcccccugcgccaccccccugaucugcagcuucggcagacccguggaccuggagaaggacgacuaccagaagguggugugcaacaacgagcacugccccugcagcaccuggaugcaccugcagugcuucuacgagugggagagcagcauccuggugcaguucaacugcaucggcagagccagaagcuggaacgagaagcagugcagacagaacauguggaccaagaagggcuacgaccuggccuucagauucugcagcugcagaugcggccagggccaccugaagaaggacaccgacugguaccaggugaagagaaugcaggacgagaagaagaagaagagcggcagcgagaagaacaccggcagaccccccggcgaggccgccgaggaggccaagaagugcagaccccccaacaagccccagaagggccccagccacgaccugcccagaagacacagcauggacagacagaacagccaggagaaggccgugggcgccgccgccuacggcgccagaagccccggcggcagccccggccagagcccccccaccggcuacagcauccugagccccgcccacuucagcggccccagaagcagcagauaccugggcgaguuccugaagaacgccauccaccuggagccccacaagaaggccauggccggcggccacguguucagaaacgcccacuucgacuacagccccgccggccuggccgugcacagaggcggccacuucgacacccccgugcaguuccugagaagacuggaccugagcgagcugcugacccacauccccagacacaagcugaacaccuuccacgugagaauggaggacgacgcccaggugggccagggcgaggaccugagaaaguucauccuggccgcccugagcgccagccacagaaacguggugaacugcgcccugugccacagagcccugcccguguucgagcaguucccccugguggacggcacccuguuccugagccccagcagacacgacgagaucgaguacgacgugcccugccaccugcagggcagacugaugcaccuguacgccgugugcguggacugccuggagggcgugcacaagaucaucugcaucaagugcaagagcagaugggacggcagcuggcaccagcugggcaccauguacaccuacgacauccuggccgccagccccugcugccaggccagacugaacugcaagcacugcggcaagcccgugaucgacgugagaaucggcaugcaguacuucagcgaguacagcaacgugcagcagugcccccacugcggcaaccuggacuaccacuucgugaagcccuucagcagcuucaaggugcuggaggccuacuaa

SEQ ID NO: 17983 - RNA, 2343 nt, Artificial Sequence
  HECTD2__Homo_sapiens__NP_001271203
augagcgaggccgugagagugcccagccccgccaccccccuggugguggccgccgccgcccccgaggagagaaagggcaaggagagcgagagagagaagcugccccccaucgugagcgccggcgccggcgccaccgccggccuggacagaggcgccaagggccagaucagcaccuucagcagcuucaucagcgccgugagccccaagaaggaggccgccgagaacagaagcagccccgcccaccugguguuccccaacaucaagaacgugagagagcccccccccaucugccuggacgugagacagaagcagagaaccagcauggacgccagcagcagcgagaugaaggcccccgugcugcccgagcccauccugcccauccagcccaagaccgugaaggacuuccaggaggacguggagaaggugaagagcagcggcgacuggaaggccgugcacgacuucuaccugaccaccuucgacagcuuccccgagcugaacgccgccuucaagaaggacgccaccgccagcuucaacaccaucgaggacagcggcaucaacgccaaguucgugaacgccguguacgacacccugcugaacaccccccaggacgugcagaagaccgugcugaagggcaucaucaacagccugcugagagaguggaagggccccagaaccaaggacgaccugagagccuacuucauccugcugcagaacccccaguucaacaacaccagcaccuacgugaucuacgcccaccugcugagacagaucgccacccugguggaggccgaccaccacuuccuggugcacugguucaagaagcaguacagcagacugagccagaagagauucaagcagcugguggagagacugcugcaguucaucagccugagacuguuccccgccaagcccgaggaguucccccccaucaccaagugcagcugguggauccccagcgccgccaaggugcuggcccugcugaacaccgccaacaaccuggugcaccccccccugauccccuacaccgacuucuacaacagcacccuggaccacaucgaccugauggaggaguaccacaccuggcagaacuucggcaacagccacagauucagcuucugccaguaccccuucgugaucagcguggccgccaagaagaucaucauccagagagacagcgagcagcagaugaucaacaucgccagacagagccugguggacaaggugagcagaagacagagacccgacaugaacauccuguuccugaacaugaaggugagaagaacccaccuggugagcgacagccuggacgagcugaccagaaagagagccgaccugaagaagaagcugaaggugaccuucgugggcgaggccggccuggacaugggcggccugaccaaggagugguuccugcugcugaucagacagaucuuccaccccgacuacggcauguucaccuaccacaaggacagccacugccacugguucagcagcuucaagugcgacaacuacagcgaguucagacuggugggcauccugaugggccuggccguguacaacagcaucacccuggacaucagauucccccccugcugcuacaagaagcugcugagcccccccaucauccccagcgaccagaacauccccgugggcaucugcaacgugaccguggacgaccugugccagaucaugcccgagcuggcccacggccugagcgagcugcugagccacgagggcaacguggaggaggacuucuacagcaccuuccagguguuccaggaggaguucggcaucaucaagagcuacaaccugaagcccggcggcgacaagaucagcgugaccaaccagaacagaaaggaguacgugcagcuguacaccgacuuccugcugaacaagagcaucuacaagcaguucgccgccuucuacuacggcuuccacagcgugugcgccagcaacgcccugaugcugcugagacccgaggagguggagauccuggugugcggcagccccgaccuggacaugcacgcccugcagagaagcacccaguacgacggcuacgccaagaccgaccugaccaucaaguacuucugggacguggugcugggcuucccccuggaccugcagaagaagcugcugcacuucaccaccggcagcgacagagugcccgugggcggcauggccgaccugaacuucaagaucagcaagaacgagaccagcaccaacugccugcccguggcccacaccugcuucaaccagcugugccugccccccuacaagagcaagaaggaccugaagcagaagcugaucaucggcaucagcaacagcgagggcuucggccuggaguaa

SEQ ID NO: 17984 - RNA, 12855 nt, Artificial Sequence
  HECTD4__Homo_sapiens__NP_001103132
augggccugcugcugguguucccccugauccagagccagagcagaaccgaccccagccugugcaacaucaccgccgaggugcugcugaacugccugagagacugccagccccugagccugaccaaggagcccgccgacugccugaacggcaucgagacccugcugugcagcuggcuggaggagaccagcgacaccggcagacacaucccccacaagcagaaggagaacgccgccgccgcccugguggcccuggccugcgccagaggcagccugaagaccuucgugcacaccgugcaccugcugcagaagcagaccgaccugggcagccugcccguggccgacgugcuguacagacugcugcugcuggagggcggccccggcagccccagcugccugcugggcggcaagcacaucgugagcuggggcuacgaggacaugcugcccgcccccgacagcaacaccggcagcagcagcgagaacaaggacgccgaccugggcagaugccugaccgccgacggccuguaccuguacaccaccaacagcgugggcagaggcgugagcaagcugggcagcggccugcacggcacccugagaggcuucguguacugcagaaacgaggagcuggagcccggcuggguggccuucggcagcggcagccugcugcacagacccgugagcuucgacaacaagccccacagccuguuccaggugaucgaccagaacacccugcaggugugccagguggugcccaugcccgccaaccaccugcccaucggcagcaccaugagcaccgugcaccugagcagcgacggcaccuacuucuacuggaucuggagccccgccagccugaacgagaagacccccaagggccacagcguguucauggacaucuucgagcuggugguggagaacggcguguucguggccaacccccugcaggagagaaccauccugaugagaaaggagggcgagagcgccaagagcaucaacgagaugcugcugagcagacugagcagauacagagccagccccagcgccacccuggccgcccugaccggcagcaccaucagcaacacccugaaggaggaccaggccgccaacaccagcugcggccugccccugaagaugcugagaaagacccccaucuacaccugcggcaccuaccuggugaugcuggugcccccccccggcggcagcggcagcagcgccaccagaagccuguucggcggcaccagcggccugagcagccugaagauccuggccagcagccugguguacaacaucagcgacggccaguucaccagcagagccgaccugaucgacgccgccggcagcagccugggcagaggcgcccuggugcccggccugggcgccugcuacgacaccgugaacaacaugcuguggaccugcagcaacgacuacaucgaccaguggugcaaccccggcaaccaggccuuccacuacgugugccagagacugggcgugagccacaucaucaccgagcccaaggaggaggccaucaccaccaacgaggugaucaaccagcugcugcaccacgugggcgccaugugcauccaccagcugaaccugcuggccaccaaccccaaccugcccaucaccagcgugcugggcaagcagcaccccaucgaggcccaccaccugagcagcaucugcgacaucauggagaaggccauggugaacggcgacaccugcaucaucagaugcauccuggugguguuccaggugguguucaaguucuucuucagcccccagaccgagagaaacagagacaucaucagaagaagcggccugcugcuguggcagcugcugauggcccccaaggaccagaucugccccgagauccagaaggaggugugccuggccaucagcagcggccugaacauccuguaccccggcgagaccgagaucaacaaccugcugaagcuggugcugaccgagggcgagagaaacagcggccugagccagcugagagacgugauccugaccaaccuggccgagcagcugcagaacaacagauucggcagcgacgaggacgaccacuacagacugaacgacgagcugcugcacuacauccugaagaucguggugagagagagcugcauccugaucaccaagugccagaccgugagcaaggacgacuuccagaagcugcugagcaccgugcccgccgccagcagcugccugagauaccugauggccgugcagaaccaccugcugagcaacaccauccugaucaagcccgacgagaacgacgacagcgacagcagccugcagggcgagacccugaaggugcaggagcugaaggugagcauccuggcccuggccacccagauccugaccggcugcgacgaggugcuggagaugcugcagcaggugaccaccgcccugaucaacagcgacaucgccgacagagagcagagacugaagggccuggagcaggugaccaaggccaccaugcugggccaccugcugcccgugcugcugaccagccugaugcaccccaaccugcagacccugaucauggccgacgcccugaugccccagcuggugcagcuggugcuguacaccagccagaccgcccugcugcugaagacccagugccccguguucgccgaggugggcugcagccccugcggcgcccccgaccagaagugcagacuguuccccgacgagagaaugcuggaggagaaggaggagcccggcuuccugaccggccugaagauccccgcccccugggccgccggcaagaccguggagaccgugcaccccgugagagacaacuacaaguucaaggagaccgugcacauccccggcgccagaugccuguaccugagauucgacagcagaugcagcagccaguacgacuacgacaagcuggugaucuacgccggccccaacaccaacagcagaaagguggccgaguacggcggcaacacccugggcuacggcagcagaagcgugcugggcaccggcuggcccaaggaccuggugaagugcaucagcccccccagccugaacuucaagguggagggcgacaccgugaccuucagcuucgagaugagaagcggcagagagcacaacacccccgacaaggccauguggggcuucgccugcaccgugagagcccaggagagcagcgaggacgugagcggcggccugcccuuccugguggaccuggcccugggccugagcgugcuggccugcagcaugcugagaauccuguacaacggccccgagaucaccaaggaggaggaggccugccaggagcugcugagaagcaagcugcugcagagaugccaguggcagguggaggccaacggcgugaucagccccgcccugacccccagccccagcccccugccccugaccaucgaggaggacagagaguucaccuaccccagcgacgugcuggugccccccgugggcaacuacuucgaccugcccagaaucagacugccccccggcaucaugaucaagcugagagagaucagcggcagagccagaccccaguucagacccagcaucaaggaggugauccagcccgacgugauggaggagaugguggugagcugcgugaucaagcaccugaaccugguggacgcccugcagagccugaucaacuuccaguaccaggaggagcacgccgaggaguacgaccugcugugcaagaucaugggcgagaccuucaagaagcugaacgccauggagagacagcugcagagcguggccgagcuggagcagaaguggcagagcgagguggacgacgccaugcagggcaagcuggagaacaacaugcccuucuucuacgacuaccacuucaacgagaacaagaugaaggagcuggagcugcugugcagcaugaaggaggugagcuucgacggcaacgaccuggagaacauggugcugagccugagagagaaguuccugcaggaggugaacagccugauccagaagcccagccacccccuggccaagaccaagacccuggugaagagccugaugaacagagccgagcugcugcugcacgugaccaucgccgcccagagcggccugaccagaagcaucagcggcacccccgccgagacccccgccugcaagagcgccagcgagaccaaggugaucagccacgccgugagacagcccguguuccugagaagcaugagcgcccccagcgaccuggagaugaucggcaacgaggaccuggaguucaccagagccaaccagagaagaagacacgugaccagccacagaagcagcagcuucacccugcugcagagccuggccaucgaggacagcagagacaagcccaccuacagcgugcugcugggccagcuguucgccuucaucggcaccaaccccgaccaggccgugagcagcagcagcuuccugcuggccgcccagaccagauggagaagaggcaacaccagaaagcaggcccuggugcacaugagagagcugcugaccgccgccgugagagugggcggcgugacccaccuggugggccccgugaccauggugcugcagggcggccccagaaucgaggagcugaccugcggcggcaugguggagcaggugcaggaggccuucggcgagaccaugaccagcguggugagccugugcgccagauaccccaucgccugcgccaacagcaucggccugcugugcaccauccccuacaccagaagcgaggagaagugccuggugagaagcggccuggugcagcugauggacagacugugcagccugagcaaccagaccgagagcagcagcagcgagaagcagaccaagaagcagaagguggccaccauggccugggccgccuuccaggugcuggccaacagaugcguggagugggagaaggaggagggcggcagcaccgaggccgugcacagcggccuggccagacaggugagcagccugcugaccaaccaccuggccagagccaccgagugcugcggcaaccaggccgccggcaacgacgcccugcaggacgugcugagccugcugaacgaccugagcagaagccacaucggcaaggccauccugagccagcccgccugcgugagcaagcugcugagccugcugcuggaccagagacccagccccaagcuggugcugaucauccugcagcugugcagagccgcccugccccugaugagcguggaggacugcggcaacguggagcugccccccuggagcuacagcgugcccagccugaacagcgagcaggaggaccccagcgaccccgccagcaagaucgccagccugcugcuggccaagcuggccgacuacguggugcccggcugccagaccgugcugagccccaccgccagcgagcccgacaccacccugaccaagaccagccccaagaacagccugaagggcgacaaggaccccggcgaggagagcgaggccguggacggcaagcugagcaucuucauccacaagagagaggaccagagcagccacgaggugcugcagccccugcugagcagcagcgagggcagacccuucagacugggcaccggcgccaacauggagaagguggugaagauggacagagacaugaccaagggcggcugcugcgaggugaucaccgaggaggccgccgccgcccugagaaaggccaccaagugggcccagagcggccugaucgugagcaucggcccccccguggagagcaucaaccccgagaccgugagcggccugagcaccggcgacaagaagaagaccgcccagaccagcaucugcagagagagaaacagcgagcuggccagaaccgaccccgugagacccuucaucagcggccacguggccaacagcauggccgccgaggugaucgcccugcugcacagccugcugauggcccccgagagcaacgccgcccagaucuggaccaccaccgccgagaaggugcugagcagagcccugauguacaucccccagcugggcaaguacgccgagagcauccuggagaacggcagcagcagcggcagaaagcuggccaagcugcagagaaucgccagacaggccguggccgcccugugcgcccugggcggcuucaaggagaccaucaagaucggcagcgaggugcaggugcugggcagaggcaucagcggcagcaucggcgugguggccagcaucaacgagcaggagggcaucgccaccgugagauucccccccaucgacugcagaaagaccagccaggccagcgacacccugaccaucccccugagcagacugugcgugcccagaagcgaggcccugccccugcacaagcugagcaucaccgagaagguggugcaggccgugcagagcaugcugcugccccaggagggcagccugagcauccacaccagccugcccgccaccggcgacggcagcgcccccgugauggccguggugagacugcuggccgagaucagaaccagagccugccuggugauggcccagcugcuggaggacagccuguucugcgaggaguucauccagcagugccccgccgccguggaggugcugaaccugguggcccaggagugcagcgccggcgagagacuggccgugguggaggugcagugcgagagacugagaaugcuguacagagacugcgccagaccccccccccccccccugcaggccgacagaagacagcccaaggagaucaccuggagccccagcagaguguucccccccgugagagccugcauguucagcagccaccugaccagcgugaccuuccuggccgaccccagcgccggcggcggccugcccagaggcaccuucaucuacgccaccagcccccugcccgugcaggcccccagcuucuacugggagaucgagaucgugagcuacggcgacaccgacgacgacaccggccccaucgugagcuucggcuucaccaccgaggccgagaagagagacggcgccuggaccaaccccgugggcaccugccuguuccacaacaacggcagagccgugcacuacaacggcagcagccugcugcaguggaagagcgugagacuggacgugacccugagccccggcgacguggccggcaucggcugggagagaaccgagggcaccccccccccccccggccagcccgccaagggcagaguguacuucaccuacugcggccagagacugagccccuaccuggaggacgugagcggcggcauguggcccguggugcacauccagaagaagaacaccaagaccagagccaacuucggcagcagacccuucgccuacgccgagggccaggcccacagaaacgccgccgaccugugcaccgaccuggccgaggagaucagcgccaacuucgaggcccugcccuucgccauggccagcgacagcgacaacgacgccggcaccagcaucgccagcgaccccggcacccacggcccccccugcagaaucgccgccguggccaccgcccagcagcaguacgacagcgacaccagcugccacuacaagguggagcugagcuacgagaacuucaucaccagcggccccgacccccaccccccccccaucgccgacgacgagagcgacgacgacgacgacgacgacaucccccaggaggaccacuacgcccugcuggugaaggccugggagaccaagguguuccccaccaucagaagaagauucagaaacgaggccgagagaaagagcggccuggaccagaucaagggcgcccugcagcugggcaugguggacaucgccagacagaccguggaguuccuguacgaggagaacggcggcauccccagagaccuguaccugcccaccaucgaggacaucaaggacgaggccaacaaguucaccaucgacaaggugagaaagggccugaccguggugaccagaagccccgacagcaacaacguggccagcagcgccgugggcaccgcccugcccaaguucgccaucagaggcaugcugaagaccuucggccugcacggcguggugcuggacguggacagcgugaacgagcuggugcagguggagaccuaccugagaagcgagggcgugcuggugagauacugguaccccaucgacaugcuggagagaccccccgccggcuacagaagaaccgccaccaacggccuggugacccuggacaacaccaaccugcagauccacagagagcugcugagaugcgaggccgcccuggccagacuguacugcagaauggcccugcugaacaucuucgcccccaagcugccccaccuguucaccagacuguuccacauccccgccaucagagacaucacccuggagcaccugcagcugcugagcaaccagcugcuggcccccccccugcccgacggcaccaucagcagcagcagcauccugcuggcccagagccugcagcacugcauccacagccagaacugcagcgccaccgaccuguucuaccagggcaacagccagaccgugagagaguggcugaacguggccaucaccagaacccugcaccagggcgaggagagccugcuggagcugaccaagcagaucugcagcuuccugcagaccgcccccgagcaguuccccagcgaggaguuccccaucagcgagagcaaggugaacauggacgugaacuuccccggcgccgccuucgugguggugagcugcaaggagagccagagcggcuucagaaaggacagcagccuguacaaggcccccugggccagagugcugguguacggccugggccacaaggugaagagaaacggccagcugaaccugaucgaggccgccugcuaccccagagacgccagccccgccaacaccggccuggcccccccccccaccgccgaccaguaccccagcguggugcugagcaccgacagagugcacaucaagcugggcgugagccccccccccggcgccgugcuggugcugcacagccugccccuggaguucccccuggccauggccuucgccgagcagcugcugagcuggaagagcgaggacagcgagggcaagagcgaggacgagcccgacaccauccccaccagcgugcugcugcaggugguggagcugcugggcaacuuccuguggaccaccgacauggccgccugcgugaaggagcugguguuccaccugcuggccgagcugcugagaaccgugcacacccuggagcagagaagacaccccgccggccugagcagcagcaucgcccugcagcugaaccccugccuggccaugcugauggcccugcagagcgagcugcacaagcuguacgacgaggagacccagaacugggugagcggcggcgccugcggcggcagcggcggcgccgccgccggcgaccagggcagauucagcaccuacuuccacgcccugauggagggcugccuggccguggccgaggugacccugcccaccaacaugagcgugaccgccagcggcgugaccagcgccaccgcccccaaccugagcgacagcagcagcagcagcagcagcagccccggccagaccccccagagccccagccugcugagcaagagaaagaaggugaagaugaagagagagaaggccagcagcagcggcaagagacagagcagcagaaccguggacagcgaccccaccgugcugagcaucggcggcagcaagcccgaggacaugcugugguuccacagagcccugacccugcugaucauccugagacaccugaccagaaaggacccccagggccugggcgugaccagcgacgccaucgccgacgccugccaggcccuggugggccccaccgcccacagcagacugcuggugaucagcggcauccccacccaccuggacgagggcguggugagaggcgccaucagaaaggccugcaacgcccacggcggcguguucaaggacgagaucuacaucccccugcaggaggaggacaccaagaagcccaaggacaaggccgagggcggcgacggcaagguggagcccgagaagacccuggccuuccccggcaccgacagcauggaggugagcaccagcagcagccugacccccgccaugagcaucagcgccagcgccagcaccagccaggccagcaucugcagcagccagggcaucagccagaccgugagcgaccugagcguggacccccugcccgccggccuggagcugcccaucccccccggccugcuggagccccacgccgugagcagccaggagagccuggacaucagccugugcagcaccggcagccugggcagccugggcagccugggcgagccccuggacaacgccgagaccgccagcgugagcgacaugggcagcauguacaccgugaccagccuggacaaccagccccuggccgccagacccaucaagggcuucgccgugguggagaucagaagcagagccaagaucgagaagaucagagccagccuguucaacaacaacgaccugaucggccugagcagccuggacggcgaggacgagcugauggagaugagcaccgaggagauccugaccgugagcguggugaaccagagccuguucgacacccagggcagccccggccuggaggacuacuucaacgacaagagcaucaagggcgagaagcuggugcccggcgccagagaggugcugaccgagaucuucaagagcugcgcccacagcgagcagacccugagccugacccccgccaagcccaucagagugagcgacaucuaccugagcaaggagcagaucaacagccagacccccggcaaccugcugcaccuguucuucaccaacgugagaccccccaagaaggugcuggaggaccagcugacccagauccugagaaaguacggcgugcccaagcccaaguucgacaagagcaaguacagcaaggccggcaaggagcagcaccccgugaagguggugagcaccaagagacccaucaccaagccccccgccaaggacaaggccgugcugaacagcgugagcagaaccgcccugagcgagaagaagcccaccgugaagcccaagagccccgagaagagcaagcccgacgagaaggaccccgagaagagccccaccaagaagcaggaggugcccgaggagaaguaccugacccuggagggcuuccacaaguucgugaucgacagagccagacaggacaucagaagcguguggagagccauccugagcugcggcuacgaccugcacuucgagagaugcgccugcaucgacgugagacacgcccagaaggccagcagaaaguggacccuggagauggacguggcccuggugcaguacaucaaccagcugugcagacaccuggccaucacccccgccagacugcacccccacgagguguaccuggaccccgccgacgccgccgaccccagaguggccugccugcugaacgugcccaucgagagccugagacugagauucgcccugcugcagagccugaacaccacccuggagaccuucuuccugccccugguggagcugagacagacccccauguacacccacagcaucgccgcccugcugaaggaggccaagggccugaucuucuacgacaccaaggugaccgugaugaacagagugcugaacgccaccgugcagagaaccgccgaccacgccgcccccgagaucacccuggacccccuggagaucgugggcggcgagaucagagccagcgagaacagcuacuucugccaggccgccagacagcuggccagcgugcccagcagccagcugugcgugaagcuggccagcggcggcgaccccaccuacgccuucaacaucagauucaccggcgaggaggugcacggcaccagcggcagcuucagacacuuccuguggcaggugugcaaggagcugcagagcagcagccugagccugcugcugcugugccccagcagcgccgugaacaagaacaagggcaaguacauccugacccccagccccaucaccuacggcgaggagcagcugcugcacuuccugggccagcugcugggcaucgccaucagagccgacgugccccugccccuggaccugcugcccagcuucuggaagacccuggugggcgagccccuggaccccgagcaggaccugcaggaggccgacauccugaccuacaacuacgugaagaaguucgagagcaucaacgacgagaccgagcuggaggcccugugcgccgagaucgccagccagcaccuggccaccgagagccccgacagccccaacaagcccugcugcagauucaccuaccugaccaugaccggcgaggagguggagcugugcagcagaggcagacacauccugguggccugggagaacaaggacaucuacgccgccgccaucagaagccugagacugagagagcugcagaacguggagugcgugaccgccgugagagccggccugggcagcaucaucccccugcagcugcugaccaugcugagcccccuggagauggagcugagaaccugcggccugcccuacaucaaccuggaguuccugaaggcccacaccauguaccaggugggccugauggagaccgaccagcacaucgaguucuucuggggcgcccuggagauguucacccaggaggagcugugcaaguucaucaaguucgccugcaaccaggagagaauccccuucaccugccccugcaaggacggcggccccgacaccgcccacgugccccccuaccccaugaagaucgccccccccgacggcaccgccggcagccccgacagcagauacaucagaguggagaccugcauguucaugaucaagcugccccaguacagcagccuggagaucaugcuggagaagcugagaugcgccauccacuacagagaggacccccugagcggcuaa

SEQ ID NO: 17985 - RNA, 4719 nt, Artificial Sequence
  HECW1__Homo_sapiens__NP_001273988
augcugcugcaccugugcagcgugaagaaccuguaccagaacagauuccugggccuggccgccauggccagccccagcagaaacagccagagcagaagaagaugcaaggagccccugagauacagcuacaaccccgaccaguuccacaacauggaccugagaggcggcccccacgacggcgugaccauccccagaagcaccagcgacaccgaccuggugaccagcgacagcagaagcacccugauggugagcagcagcuacuacagcaucggccacagccaggaccuggugauccacugggacaucaaggaggagguggacgccggcgacuggaucggcauguaccugaucgacgaggugcugagcgagaacuuccuggacuacaagaacagaggcgugaacggcagccacagaggccagaucaucuggaagaucgacgccagcagcuacuucguggagcccgagaccaagaucugcuucaaguacuaccacggcgugagcggcgcccugagagccaccacccccagcgugaccgugaagaacagcgccgcccccaucuucaagagcaucggcgccgacgagaccgugcagggccagggcagcagaagacugaucagcuucagccugagcgacuuccaggccaugggccugaagaagggcauguucuucaaccccgaccccuaccugaagaucagcauccagcccggcaagcacagcaucuuccccgcccugccccaccacggccaggagagaagaagcaagaucaucggcaacaccgugaaccccaucuggcaggccgagcaguucagcuucgugagccugcccaccgacgugcuggagaucgaggugaaggacaaguucgccaagagcagacccaucaucaagagauuccugggcaagcugagcaugcccgugcagagacugcuggagagacacgccaucggcgacagaguggugagcuacacccugggcagaagacugcccaccgaccacgugagcggccagcugcaguucagauucgagaucaccagcagcauccaccccgacgacgaggagaucagccugagcaccgagcccgagagcgcccagauccaggacagccccaugaacaaccugauggagagcggcagcggcgagcccagaagcgaggcccccgagagcagcgagagcuggaagcccgagcagcugggcgagggcagcgugcccgacggccccggcaaccagagcaucgagcugagcagacccgccgaggaggccgccgugaucaccgaggccggcgaccagggcauggugagcgugggccccgagggcgccggcgagcugcuggcccaggugcagaaggacauccagcccgcccccagcgccgaggagcuggccgagcagcuggaccugggcgaggaggccagcgcccugcugcuggaggacggcgaggcccccgccagcaccaaggaggagccccuggaggaggaggccaccacccagagcagagccggcagagaggaggaggagaaggagcaggaggaggagggcgacgugagcacccuggagcagggcgagggcagacugcagcugagagccagcgugaagagaaagagcagacccugcagccugcccgugagcgagcuggagaccgugaucgccagcgccugcggcgaccccgagacccccagaacccacuacaucagaauccacacccugcugcacagcaugcccagcgcccagggcggcagcgccgccgaggaggaggacggcgccgaggaggagagcacccugaaggacagcagcgagaaggacggccugagcgagguggacaccguggccgccgaccccagcgcccuggaggaggacagagaggagcccgagggcgccacccccggcaccgcccaccccggccacagcggcggccacuuccccagccuggccaacggcgccgcccaggacggcgacacccaccccagcaccggcagcgagagcgacagcagccccagacagggcggcgaccacagcugcgagggcugcgacgccagcugcugcagccccagcugcuacagcagcagcugcuacagcaccagcugcuacagcagcagcugcuacagcgccagcugcuacagccccagcugcuacaacggcaacagauucgccagccacaccagauucagcagcguggacagcgccaagaucagcgagagcaccguguucagcagccaggacgacgaggaggaggagaacagcgccuucgagagcgugcccgacagcaugcagagccccgagcuggaccccgagagcaccaacggcgccggccccuggcaggacgagcuggccgcccccagcggccacguggagagaagccccgagggccuggagagccccguggccggccccagcaacagaagagaggacugggaggccagaaucgacagccacggcagaguguucuacguggaccacgugaacagaaccaccaccuggcagagacccaccgccgccgccacccccgacggcaugagaagaagcggcagcauccagcagauggagcagcugaacagaagauaccagaacauccagagaaccaucgccaccgagagaagcgaggaggacagcggcagccagagcugcgagcaggcccccgccggcggcggcggcggcggcggcagcgacagcgaggccgagagcagccagagcagccuggaccugagaagagagggcagccugagccccgugaacagccagaagaucacccugcugcugcagagccccgccgugaaguucaucaccaaccccgaguucuucaccgugcugcacgccaacuacagcgccuacagaguguucaccagcagcaccugccugaagcacaugauccugaaggugagaagagacgccagaaacuucgagagauaccagcacaacagagaccuggugaacuucaucaacauguucgccgacaccagacuggagcugcccagaggcugggagaucaagaccgaccagcagggcaagagcuucuucguggaccacaacagcagagccaccaccuucaucgaccccagaaucccccugcagaacggcagacugcccaaccaccugacccacagacagcaccugcagagacugagaagcuacagcgccggcgaggccagcgaggugagcagaaacagaggcgccagccugcuggccagacccggccacagccugguggccgccaucagaagccagcaccagcacgagagccugccccuggccuacaacgacaagaucguggccuuccugagacagcccaacaucuucgagaugcugcaggagagacagcccagccuggccagaaaccacacccugagagagaagauccacuacaucagaaccgagggcaaccacggccuggagaagcugagcugcgacgccgaccuggugauccugcugagccuguucgaggaggagaucaugagcuacgugccccugcaggccgccuuccaccccggcuacagcuucagccccagaugcagccccugcagcagcccccagaacagccccggccugcagagagccagcgccagagcccccagccccuacagaagagacuucgaggccaagcugagaaacuucuacagaaagcuggaggccaagggcuucggccagggccccggcaagaucaagcugaucaucagaagagaccaccugcuggagggcaccuucaaccaggugauggccuacagcagaaaggagcugcagagaaacaagcuguacgugaccuucgugggcgaggagggccuggacuacagcggccccagcagagaguucuucuuccugcugagccaggagcuguucaaccccuacuacggccuguucgaguacagcgccaacgacaccuacaccgugcagaucagccccaugagcgccuucguggagaaccaccuggagugguucagauucagcggcagaauccugggccuggcccugauccaccaguaccugcuggacgccuucuucaccagacccuucuacaaggcccugcugagacugcccugcgaccugagcgaccuggaguaccuggacgaggaguuccaccagagccugcaguggaugaaggacaacaacaucaccgacauccuggaccugaccuucaccgugaacgaggagguguucggccaggugaccgagagagagcugaagagcggcggcgccaacacccaggugaccgagaagaacaagaaggaguacaucgagagaauggugaaguggagaguggagagaggcguggugcagcagaccgaggcccuggugagaggcuucuacgaggugguggacagcagacuggugagcguguucgacgccagagagcuggagcuggugaucgccggcaccgccgagaucgaccugaacgacuggagaaacaacaccgaguacagaggcggcuaccacgacggccaccuggugaucagaugguucugggccgccguggagagauucaacaacgagcagagacugagacugcugcaguucgugaccggcaccagcagcgugcccuacgagggcuucgccgcccugagaggcagcaacggccugagaagauucugcaucgagaaguggggcaagaucaccagccugcccagagcccacaccugcuucaacagacuggaccugccccccuaccccagcuacagcaugcuguacgagaagcugcugaccgccguggaggagaccagcaccuucggccuggaguaa

SEQ ID NO: 17986 - RNA, 4719 nt, Artificial Sequence
  HECW2__Homo_sapiens__NP_065811
auggccagcagcgccagagagcaccugcuguucgugagaagaagaaacccccagaugagauacacccugagccccgagaaccugcagagccuggccgcccagagcagcaugcccgagaacaugacccugcagagagccaacagcgacaccgaccuggugaccagcgagagcagaagcagccugaccgccagcauguacgaguacacccugggccaggcccagaaccugaucaucuucugggacaucaaggaggagguggaccccagcgacuggaucggccuguaccacaucgacgagaacagccccgccaacuucugggacagcaagaacagaggcgugaccggcacccagaagggccagaucguguggagaaucgagcccggccccuacuucauggagcccgagaucaagaucugcuucaaguacuaccacggcaucagcggcgcccugagagccaccacccccugcaucaccgugaagaaccccgccgugaugaugggcgccgagggcauggagggcggcgccagcggcaaccugcacagcagaaagcuggugagcuucacccugagcgaccugagagccgugggccugaagaagggcauguucuucaaccccgaccccuaccugaagaugagcauccagcccggcaagaagagcagcuuccccaccugcgcccaccacggccaggagagaagaagcaccaucaucagcaacaccaccaaccccaucuggcacagagagaaguacagcuucuucgcccugcugaccgacgugcuggagaucgagaucaaggacaaguucgccaagagcagacccaucaucaagagauuccugggcaagcugaccauccccgugcagagacugcuggagagacaggccaucggcgaccagaugcugagcuacaaccugggcagaagacugcccgccgaccacgugagcggcuaccugcaguucaagguggaggugaccagcagcgugcacgaggacgccagccccgaggccgugggcaccauccugggcgugaacagcgugaacggcgaccugggcagccccagcgacgacgaggacaugcccggcagccaccacgacagccaggugugcagcaacggccccgugagcgaggacagcgccgccgacggcacccccaagcacagcuucagaaccagcagcacccuggagaucgacaccgaggagcugaccagcaccagcagcagaaccagcccccccagaggcagacaggacagccugaacgacuaccuggacgccaucgagcacaacggccacagcagacccggcaccgccaccugcagcgagagaagcaugggcgccagccccaagcugagaagcagcuuccccaccgacaccagacugaacgccaugcugcacaucgacagcgacgaggaggaccacgaguuccagcaggaccugggcuaccccagcagccuggaggaggagggcggccugaucauguucagcagagccagcagagccgacgacggcagccugaccagccagaccaagcuggaggacaaccccguggagaacgaggaggccagcacccacgaggccgccagcuucgaggacaagcccgagaaccugcccgagcuggccgagagcagccugcccgccggccccgcccccgaggagggcgagggcggccccgagccccagcccagcgccgaccagggcagcgccgagcugugcggcagccaggagguggaccagcccaccagcggcgccgacaccggcaccagcgacgccagcggcggcagcagaagagccgugagcgagaccgagagccuggaccagggcagcgagcccagccaggugagcagcgagaccgagcccagcgaccccgccagaaccgagagcgugagcgaggccagcaccagacccgagggcgagagcgaccuggagugcgccgacagcagcugcaacgagagcgugaccacccagcugagcagcguggacaccagaugcagcagccuggagagcgccagauuccccgagacccccgccuucagcagccaggaggaggaggacggcgccugcgccgccgagcccaccagcagcggccccgccgagggcagccaggagagcgugugcaccgccggcagccugcccguggugcaggugcccagcggcgaggacgagggccccggcgccgagagcgccaccgugcccgaccaggaggagcugggcgagguguggcagagaagaggcagccuggagggcgccgccgccgccgccgagagccccccccaggaggagggcagcgccggcgaggcccagggcaccugcgagggcgccaccgcccaggaggagggcgccaccggcggcagccaggccaacggccaccagccccugagaagccugcccagcgugagacaggacgugagcagauaccagagaguggacgaggcccugccccccaacugggaggccagaaucgacagccacggcagaaucuucuacguggaccacgugaacagaaccaccaccuggcagagacccaccgccccccccgccccccaggugcugcagagaagcaacagcauccagcagauggagcagcugaacagaagauaccagagcaucagaagaaccaugaccaacgagagacccgaggagaacaccaacgccaucgacggcgccggcgaggaggccgacuuccaccaggccagcgccgacuucagaagagagaacauccugccccacagcaccagcagaagcagaaucacccugcugcugcagagcccccccgugaaguuccugaucagccccgaguucuucaccgugcugcacagcaaccccagcgccuacagaauguucaccaacaacaccugccugaagcacaugaucaccaaggugagaagagacacccaccacuucgagagauaccagcacaacagagaccuggugggcuuccugaacauguucgccaacaagcagcuggagcugcccagaggcugggagaugaagcacgaccaccagggcaaggccuucuucguggaccacaacagcagaaccaccaccuucaucgaccccagacugccccugcagagcagcagacccaccagcgcccuggugcacagacagcaccugaccagacagagaagccacagcgccggcgaggugggcgaggacagcagacacgccggcccccccgugcugcccagacccagcagcaccuucaacaccgugagcagaccccaguaccaggacauggugcccguggccuacaacgacaagaucguggccuuccugagacagcccaacaucuucgagauccugcaggagagacagcccgaccugaccagaaaccacagccugagagagaagauccaguucaucagaaccgagggcacccccggccuggugagacugagcagcgacgccgaccuggugaugcugcugagccuguucgaggaggagaucaugagcuacgugcccccccacgcccugcugcaccccagcuacugccagagccccagaggcagccccgugagcagcccccagaacagccccggcacccagagagccaacgccagagcccccgcccccuacaagagagacuucgaggccaagcugagaaacuucuacagaaagcuggagaccaagggcuacggccagggccccggcaagcugaagcugaucaucagaagagaccaccugcuggaggacgccuucaaccagaucaugggcuacagcagaaaggaccugcagagaaacaagcuguacgugaccuucgugggcgaggagggccuggacuacagcggccccagcagagaguucuucuuccuggugagcagagagcuguucaaccccuacuacggccuguucgaguacagcgccaacgacaccuacaccgugcagaucagccccaugagcgccuucguggacaaccaccacgagugguucagauucagcggcagaauccugggccuggcccugauccaccaguaccugcuggacgccuucuucaccagacccuucuacaaggcccugcugagaauccugugcgaccugagcgaccuggaguaccuggacgaggaguuccaccagagccugcaguggaugaaggacaacgacauccacgacauccuggaccugaccuucaccgugaacgaggagguguucggccagaucaccgagagagagcugaagcccggcggcgccaacauccccgugaccgagaagaacaagaaggaguacaucgagagaauggugaaguggagaaucgagagaggcguggugcagcagaccgagagccuggugagaggcuucuacgaggugguggacgccagacuggugagcguguucgacgccagagagcuggagcuggugaucgccggcaccgccgagaucgaccugagcgacuggagaaacaacaccgaguacagaggcggcuaccacgacaaccacaucgugaucagaugguucugggccgccguggagagauucaacaacgagcagagacugagacugcugcaguucgugaccggcaccagcagcauccccuacgagggcuucgccagccugagaggcagcaacggccccagaagauucugcguggagaaguggggcaagaucaccgcccugcccagagcccacaccugcuucaacagacuggaccugccccccuaccccagcuucagcaugcuguacgagaagcugcugaccgccguggaggagaccagcaccuucggccuggaguaa

SEQ ID NO: 17987 - RNA, 4146 nt, Artificial Sequence
  HEG1__Homo_sapiens__NP_065784
auggccagccccagagccagcagauggccccccccccugcugcugcugcugcugccccugcugcugcugccccccgccgcccccggcaccagagaccccccccccagccccgccagaagagcccugagccuggccccccuggccggcgccggccuggagcugcagcuggagagaagacccgagagagagcccccccccaccccccccagagagagaagaggccccgccacccccggccccagcuacagagcccccgagcccggcgccgccacccagagaggccccagcggcagagcccccagaggcggcagcgccgacgccgccuggaagcacuggcccgagagcaacaccgaggcccacguggagaacaucaccuucuaccagaaccaggaggacuucagcaccgugagcagcaaggagggcgugauggugcagaccagcggcaagagccacgccgccagcgacgcccccgagaaccugacccugcuggccgagaccgccgacgccagaggcagaagcggcagcagcagcagaaccaacuucaccauccugcccgugggcuacagccuggagaucgccaccgcccugaccagccagagcggcaaccuggccagcgagagccugcaccugcccagcagcagcagcgaguucgacgagagaaucgccgccuuccagaccaagagcggcaccgccagcgagaugggcaccgagagagccaugggccugagcgaggaguggaccgugcacagccaggaggccaccaccagcgccuggagccccagcuuccugcccgcccuggagaugggcgagcugaccacccccagcagaaagagaaacagcagcggccccgaccugagcuggcugcacuucuacagaaccgccgccagcagcccccugcuggaccugagcagcagcagcgagagcaccgagaagcugaacaacagcaccggccugcagagcagcagcgugagccagaccaagaccaugcacguggccaccguguucaccgacggcggccccagaacccugagaagccugaccgugagccugggccccgugagcaagaccgagggcuuccccaaggacagcagaaucgccaccaccagcagcagcgugcugcugagccccagcgccguggagagcagaagaaacagcagagugaccggcaaccccggcgacgaggaguucaucgagcccagcaccgagaacgaguucggccugaccagccugagauggcagaacgacagccccaccuucggcgagcaccagcuggccagcagcagcgaggugcagaacggcagccccaugagccagaccgagaccgugagcagaagcguggcccccaugagaggcggcgagaucaccgcccacuggcugcugaccaacagcaccaccagcgccgacgugaccggcagcagcgccagcuaccccgagggcgugaacgccagcgugcugacccaguucagcgacagcaccgugcagagcggcggcagccacaccgcccugggcgacagaagcuacagcgagagcagcagcaccagcagcagcgagagccugaacagcagcgcccccagaggcgagagaagcaucgccggcaucagcuacggccaggugagaggcaccgccaucgagcagagaaccagcagcgaccacaccgaccacaccuaccugagcagcaccuucaccaagggcgagagagcccugcugagcaucaccgacaacagcagcagcagcgacaucguggagagcagcaccagcuacaucaagaucagcaacagcagccacagcgaguacagcagcuucuuccacgcccagaccgagagaagcaacaucagcagcuacgacggcgaguacgcccagcccagcaccgagagccccgugcugcacaccagcaaccugcccagcuacacccccaccaucaacaugcccaacaccagcguggugcuggacaccgacgccgaguucgugagcgacagcagcagcagcagcagcagcagcagcagcagcagcagcagcggccccccccugccccugcccagcgugagccagagccaccaccuguucagcagcauccugcccagcaccagagccagcgugcaccugcugaagagcaccagcgacgccagcacccccuggagcagcagccccagcccccugcccgugagccugaccaccagcaccagcgccccccugagcgugagccagaccacccugccccagagcagcagcacccccgugcugcccagagccagagagacccccgugaccagcuuccagaccagcaccaugaccagcuucaugaccaugcugcacagcagccagaccgccgaccugaagagccagagcaccccccaccaggagaaggugaucaccgagagcaagagccccagccuggugagccugcccaccgagagcaccaaggccgugaccaccaacagcccccugccccccagccugaccgagagcagcaccgagcagacccugcccgccaccagcaccaaccuggcccagaugagccccaccuucaccaccaccauccugaagaccagccagccccugaugaccacccccggcacccugagcagcaccgccagccuggugaccggccccaucgccgugcagaccaccgccggcaagcagcugagccugacccaccccgagauccuggugccccagaucagcaccgagggcggcaucagcaccgagagaaacagagugaucguggacgccaccaccggccugaucccccugaccagcgugcccaccagcgccaaggagaugaccaccaagcugggcgugaccgccgaguacagccccgccagcagaagccugggcaccagccccagcccccagaccaccguggugagcaccgccgaggaccuggcccccaagagcgccaccuucgccgugcagagcagcacccagagccccaccaccgugagcagcagcgccagcgugaacagcugcgccgugaaccccugccugcacaacggcgagugcguggccgacaacaccagcagaggcuaccacugcagaugcccccccagcuggcagggcgacgacugcagcguggacgugaacgagugccugagcaaccccugccccagcaccgccaugugcaacaacacccagggcagcuucaucugcaagugccccgugggcuaccagcuggagaagggcaucugcaaccuggugagaaccuucgugaccgaguucaagcugaagagaaccuuccugaacaccaccguggagaagcacagcgaccugcaggagguggagaacgagaucaccaagacccugaacaugugcuucagcgcccugcccagcuacaucagaagcaccgugcacgccagcagagagagcaacgccguggugaucagccugcagaccaccuucagccuggccagcaacgugacccuguucgaccuggccgacagaaugcagaagugcgugaacagcugcaagagcagcgccgaggugugccagcugcugggcagccagagaagaaucuucagagccggcagccugugcaagagaaagagccccgagugcgacaaggacaccagcaucugcaccgaccuggacggcguggcccugugccagugcaagagcggcuacuuccaguucaacaagauggaccacagcugcagagccugcgaggacggcuacagacuggagaacgagaccugcaugagcugccccuucggccugggcggccugaacugcggcaaccccuaccagcugaucaccguggugaucgccgccgccggcggcggccugcugcugauccugggcaucgcccugaucgugaccugcugcagaaagaacaagaacgacaucagcaagcugaucuucaagagcggcgacuuccagaugagccccuacgccgaguaccccaagaaccccagaagccaggaguggggcagagaggccaucgagaugcacgagaacggcagcaccaagaaccugcugcagaugaccgacguguacuacagccccaccagcgugagaaaccccgagcuggagagaaacggccuguaccccgccuacaccggccugcccggcagcagacacagcugcaucuuccccggccaguacaaccccagcuucaucagcgacgagagcagaagaagagacuacuucuaa

SEQ ID NO: 17988 - RNA, 2655 nt, Artificial Sequence
  HELLS__Homo_sapiens__NP_001275996
augcccgccgagagacccgccggcagcggcggcagcgaggcccccgccaugguggagcagcuggacaccgccgugaucacccccgccaugcuggaggaggaggagcagcuggaggccgccggccuggagagagagagaaagaugcuggagaaggccagaaugagcugggacagagagagcaccgagaucagauacagaagacugcagcaccugcuggagaagagcaacaucuacagcaaguuccugcugaccaagauggagcagcagcagcuggaggagcagaagaagaaggagaagcuggagagaaagaaggagagccugaaggugaagaagggcaagaacagcaucgacgccagcgaggagaagcccgugaugagaaagaagagaggcagagaggacgagagcuacaacaucagcgaggugaugagcaaggaggagauccugagcguggccaagaagaacaagaaggagaacgaggacgagaacagcagcagcaccaaccugugcguggaggaccugcagaagaacaaggacagcaacagcaucaucaaggacagacugagcgagaccgugagacagaacaccaaguucuucuucgaccccgugagaaagugcaacggccagcccgugcccuuccagcagcccaagcacuucaccggcggcgugaugagaugguaccagguggagggcauggaguggcugagaaugcugugggagaacggcaucaacggcauccuggccgacgagaugggccugggcaagaccgugcagugcaucgccaccaucgcccugaugauccagagaggcgugcccggccccuuccuggugugcggcccccugagcacccugcccaacuggauggccgaguucaagagauucacccccgacauccccaccaugcuguaccacggcacccaggaggagagacagaagcuggugagaaacaucuacaagagaaagggcacccugcagauccaccccguggugaucaccagcuucgagaucgccaugagagacagaaacgcccugcagcacugcuacuggaaguaccugaucguggacgagggccacagaaucaagaacaugaagugcagacugaucagagagcugaagagauucaacgccgacaacaagcugcugcugaccggcaccccccugcagaacaaccugagcgagcuguggagccugcugaacuuccugcugcccgacguguucgacgaccugaagagcuucgagagcugguucgacaucaccagccugagcgagaccgccgaggacaucaucgccaaggagagagagcagaacgugcugcacaugcugcaccaggagagaauccccagaauguacgugagcgaguucaccgacgagggcuucuucgagggcaagcugcccagcagaaaggaccuguacgacaucagacccuacgagaacaccuaccugcugaagcugcacaccaacuucgagauccugacccccuuccugcugagaagacugaagagcgacguggcccuggaggugccccccaagagagagguggugguguacgccccccugagcaagaagcaggagaucuucuacaccgccaucgugaacagaaccaucgccaacauguucggcagcagcgagaaggagaccaucgagcugagccccaccggcagacccaagagaagaaccagaaagagcaucaacuacagcaagaucgacgacuuccccaacgagcuggagaagcugaucagccagauccagcccgagguggacagagagagagccgugguggaggugaacauccccguggagagcgaggugaaccugaagcugcagaacaucaugaugcugcugagaaagugcugcaaccaccccuaccugaucgaguaccccaucgaccccgugacccaggaguucaagaucgacgaggagcuggugaccaacagcggcaaguuccugauccuggacagaaugcugcccgagcugaagaagagaggccacaaggugcugcuguucagccagaugaccagcaugcuggacauccugauggacuacugccaccugagagacuucaacuucagcagacuggacggcagcaugagcuacagcgagagagagaagaacaugcacagcuucaacaccgaccccgagguguucaucuuccuggugagcaccagagccggcggccugggcaucaaccugaccgccgccgacaccgugaucaucuacgacagcgacuggaacccccagagcgaccugcaggcccaggacagaugccacagaaucggccagaccaagcccguggugguguacagacuggugaccgccaacaccaucgaccagaagaucguggagagagccgccgccaagagaaagcuggagaagcugaucauccacaagaaccacuucaagggcggccagagcggccugaaccugagcaagaacuuccuggaccccaaggagcugauggagcugcugaagagcagagacuacgagagagagaucaagggcagcagagagaaggugaucagcgacaaggaccuggagcugcugcuggacagaagcgaccugaucgaccagaugaacgccagcggccccaucaaggagaagaugggcaucuucaagauccuggagaacagcgaggacagcagccccgagugccuguucuaa

SEQ ID NO: 17989 - RNA, 3306 nt, Artificial Sequence
  HELQ__Homo_sapiens__NP_598375
auggacgagugcggcagcagaaucagaagaagagugagccugcccaagagaaacagacccagccugggcugcaucuucggcgcccccaccgccgccgagcuggagcccggcgacgagggcaaggaggaggaggagaugguggccgagaacagaagaagaaagaccgccggcgugcugcccguggaggugcagccccugcugcugagcgacagccccgagugccuggugcugggcggcggcgacaccaaccccgaccugcugagacacaugcccaccgacagaggcgugggcgaccagcccaacgacagcgagguggacauguucggcgacuacgacagcuucaccgagaacagcuucaucgcccagguggacgaccuggagcagaaguacaugcagcugcccgagcacaagaagcacgccaccgacuucgccaccgagaaccugugcagcgagagcaucaagaacaagcugagcaucaccaccaucggcaaccugaccgagcugcagaccgacaagcacaccgagaaccagagcggcuacgagggcgugaccaucgagcccggcgccgaccugcuguacgacgugcccagcagccaggccaucuacuucgagaaccugcagaacagcagcaacgaccugggcgaccacagcaugaaggagagagacuggaagagcagcagccacaacaccgugaacgaggagcugccccacaacugcaucgagcagccccagcagaacgacgagagcagcagcaaggugagaaccagcagcgacaugaacagaagaaagagcaucaaggaccaccugaagaacgccaugaccggcaacgccaaggcccagacccccaucuucagcagaagcaagcagcugaaggacacccugcugagcgaggagaucaacguggccaagaagaccguggagagcagcagcaacgaccugggccccuucuacagccugcccagcaaggugagagaccuguacgcccaguucaagggcaucgagaagcuguacgaguggcagcacaccugccugacccugaacagcgugcaggagagaaagaaccugaucuacagccugcccaccagcggcggcaagacccugguggccgagauccugaugcugcaggagcugcugugcugcagaaaggacgugcugaugauccugcccuacguggccaucgugcaggagaagaucagcggccugagcagcuucggcaucgagcugggcuucuucguggaggaguacgccggcagcaagggcagauucccccccaccaagagaagagagaagaagagccuguacaucgccaccaucgagaagggccacagccuggugaacagccugaucgagaccggcagaaucgacagccugggccugguggugguggacgagcugcacaugaucggcgagggcagcagaggcgccacccuggagaugacccuggccaagauccuguacaccagcaagaccacccagaucaucggcaugagcgccacccugaacaacguggaggaccugcagaaguuccugcaggccgaguacuacaccagccaguucagacccguggagcugaaggaguaccugaagaucaacgacaccaucuacgagguggacagcaaggccgagaacggcaugaccuucagcagacugcugaacuacaaguacagcgacacccugaagaagauggaccccgaccaccugguggcccuggugaccgaggugauccccaacuacagcugccugguguucugccccagcaagaagaacugcgagaacguggccgagaugaucugcaaguuccugagcaaggaguaccugaagcacaaggagaaggagaagugcgaggugaucaagaaccugaagaacaucggcaacggcaaccugugccccgugcugaagagaaccauccccuucggcguggccuaccaccacagcggccugaccagcgacgagagaaagcugcuggaggaggccuacagcaccggcgugcugugccuguucaccugcaccagcacccuggccgccggcgugaaccugcccgccagaagagugauccugagagcccccuacguggccaaggaguuccugaagagaaaccaguacaagcagaugaucggcagagccggcagagccggcaucgacaccaucggcgagagcauccugauccugcaggagaaggacaagcagcaggugcuggagcugaucaccaagccccuggagaacugcuacagccaccuggugcaggaguucaccaagggcauccagacccuguuccugagccugaucggccugaagaucgccaccaaccuggacgacaucuaccacuucaugaacggcaccuucuucggcgugcagcagaaggugcugcugaaggagaagagccugugggagaucaccguggagagccugagauaccugaccgagaagggccugcugcagaaggacaccaucuacaagagcgaggaggaggugcaguacaacuuccacaucaccaagcugggcagagccagcuucaagggcaccaucgaccuggccuacugcgacauccuguacagagaccugaagaagggccuggagggccuggugcuggagagccugcugcaccugaucuaccugaccacccccuacgaccuggugagccagugcaaccccgacuggaugaucuacuucagacaguucagccagcugagccccgccgagcagaacguggccgccauccugggcgugagcgagagcuucaucggcaagaaggccagcggccaggccaucggcaagaagguggacaagaacguggugaacagacuguaccugagcuucgugcuguacacccugcugaaggagaccaacaucuggaccgugagcgagaaguucaacaugcccagaggcuacauccagaaccugcugaccggcaccgccagcuucagcagcugcgugcugcacuucugcgaggagcuggaggaguucuggguguacagagcccugcugguggagcugaccaagaagcugaccuacugcgugaaggccgagcugaucccccugauggaggugaccggcgugcuggagggcagagccaagcagcuguacagcgccggcuacaagagccugaugcaccuggccaacgccaaccccgaggugcuggugagaaccaucgaccaccugagcagaagacaggccaagcagaucgugagcagcgccaagaugcugcugcacgagaaggccgaggcccugcaggaggagguggaggagcugcugagacugcccagcgacuuccccggcgccguggccagcagcaccgacaaggccuaa

SEQ ID NO: 17990 - RNA, 729 nt, Artificial Sequence
  HELT__Homo_sapiens__NP_001287710
augagcgacaagcugaaggagagaaagagaacccccgugagccacaaggugaucgagaagagaagaagagacagaaucaacagaugccugaacgagcugggcaagaccgugcccauggcccuggccaagcagagcagcggcaagcuggagaaggccgagauccuggagaugaccgugcaguaccugagagcccugcacagcgccgacuuccccagaggcagagagaaggccgagcugcuggccgaguucgccaacuacuuccacuacggcuaccacgagugcaugaagaaccuggugcacuaccugaccaccguggagagaauggagaccaaggacaccaaguacgccagaauccuggccuuccugcagagcaaggccagacugggcgccgagcccgccuuccccccccugggcagccugcccgagcccgacuucagcuaccagcugcaccccgccggccccgaguucgccggccacagccccggcgaggccgccguguucccccagggcagcggcgccggccccuuccccuggccccccggcgccgccagaagccccgcccugcccuaccugcccagcgcccccgugccccuggccagccccgcccagcagcacagccccuuccugacccccgugcagggccuggacagacacuaccugaaccugaucggccacgcccaccccaacgcccugaaccugcacaccccccagcacccccccgugcuguaa

SEQ ID NO: 17991 - RNA, 7950 nt, Artificial Sequence
  HELZ2__Homo_sapiens__NP_001032412
auggccgugugggaggccgagcagcugggcggccugcagagaggcgaccugcugaccccccccgcccccgacggcgacggcagaaccgccccccugggccagccccccggcgcccagcuguacugccccgccugccuggugaccugccacagccaggaggccuucgagaaccacugcgccagcagcgagcacgcccagaugguggccuucgaccaggcccugcccugggagcacagaagccccccccccggccugagcaaguucgagcugugccccaagcccgaccugugcgaguacggcgacgccugcaccaaggcccacagcgcccaggagcugcaggagugggugagaagaacccaggccguggagcugagaggccaggccgccuggcaggacggccuggugcccuaccaggagagacugcuggccgaguaccagagaagcagcagcgaggugcuggugcuggccgagacccuggacggcgugagagugaccugcaaccagccccugauguaccaggcccaggagagaaagacccaguacagcuggaccuucgccgugcacagcgaggagccccugcugcacguggcccugcugaagcaggagcccggcgccgacuucagccugguggcccccggccugccccccggcagacuguacgccagaggcgagagauucagagugcccagcagcaccgccgacuuccaggugggcgugagagugcaggccgccagcuucggcaccuucgagcagugggugguguucgacuucggcagaagacccgugcugcugcagaagcugggccugcagcugggccagggcagaagacccggccccugcagaaaccuggcccugggccaccccgaggagauggagagauggcacaccggcaacagacacguggugcccggcguggagagaaccgccgagcagaccgcccugauggccaaguacaagggccccgcccuggcccuggaguucaacagaagcagcguggccagcggccccaucagccccaccaacuacagacagagaaugcaccaguuccuguacgaggaggaggccgcccagcagcagcugguggccaagcugacccugagaggccagguguuccugaagaccgcccugcagacccccgcccugaacaugcuguucgccccccccggcgcccuguacgccgaggugcccgugcccagcagccugaugcccgacaccgaccagggcuuccugcugggcagagccgugagcaccgcccugguggcccccgugcccgcccccgacaacaccguguucgaggugagacuggagagaagagccagcagcgagcaggcccuguggcugcugcugcccgccagaugcugccuggcccugggccugcagcccgaggccagacuggugcuggaggugcaguuccagaucgaccccaugaccuucagacuguggcaccaggccguggacacccugcccgaggagcagcugguggugcccgaccugcccaccugcgcccugcccagacccuggagcgugcccccccugagaagaggcaacagaaagcaggagcuggccguggcccugaucgccggcuggggccccggcgacggcagaagagugcccccccugcugaucuacggccccuucggcaccggcaagaccuacacccuggccauggccagccuggaggugaucagaagacccgagaccaaggugcugaucugcacccacaccaacagcgccgccgacaucuacaucagagaguacuuccacagccacgugagcggcggccaccccgaggccaccccccugagagugauguacaccgacagaccccugagccagaccgaccccgugacccugcaguacugcugccugaccgacgacagacaggccuucagaccccccaccagagccgagcuggccagacacagagugguggugaccaccaccagccaggccagagagcugagagugcccgugggcuucuucagccacauccugaucgacgaggccgcccagaugcuggagugcgaggcccugaccccccuggccuacgccagccacggcaccagacuggugcuggccggcgaccacaugcaggugacccccagacuguucagcguggccagagccagagccgccgagcacacccugcugcacagacuguuccugugcuaccagcaggagacccacgagguggccagacagagcagacugguguuccacgagaacuacagaugcaccgacgccaucgugagcuucaucagcagacacuucuacguggccaagggcaaccccauccacgccagaggcaaggugcccccccaccccagacacuacccccugauguucugccacguggccggcagccccgacagagacaugagcauggccagcuggcugaaccuggccgagaucgcccaggugguggagaaggugcaggaggccuacaacaccuggcccagcugcuggggcggcagagagcagagaugcaucugcguggugagccacggcgcccaggugagcgcccugagacaggagcugagaagaagagaccugggccaggugagcgugggcagcuucgagauccugcccggcagacaguucagagugguggugcugagcaccgugcacaccugccagagccugcugagccccggcgcccuggcccccgaguucuucaccgacgccagagugcugaacaccgugcugaccagagcccagagccagcuggugguggugggcgacgccguggcccugugcagcuucggcgccugcggcaagcugugggagagcuucaucagagagugcguggagagacacagcgugugccccgagggccugagcauggagcagguggagcagggcguggcccagagaagaagauggccccccagaggcacccaggccggcgccgccggcaacugggaggccgcccccgagcccgugggcgaccuggccgaggagcaggccgccguggugaccgccauggugaaggccgagcccggcgacgaggcccugagccccgccagcagagacaucaccgccaccaccgcccagaccgaggccgccgccgcccccgccggcgacgccgugaaggaggacguggugcccggcgccugcgccgccggcgccgccgccgccgccggcguggagagcaccgaggccgaggacgccgaggccgacuucuggcccugggacggcgagcugaacgccgacgacgccauccugagagagcugcuggacgagagccagaaggugauggugaccgugggcgaggacggccugcuggacaccguggccagacccgagagccugcagcaggccagacuguacgagaaccugccccccgccgcccugagaaagcugcugcacgccgagcccgagagauacagacacugcagcuucgugcccgagaccuucgagagagccagcgccaucccccuggacgacgccagcagcggccccauccaggugagaggcagacuggacugcggcauggccuucgccggcgacgaggugcuggugcagcugcugagcggcgacaaggcccccgagggcagacugagaggcagagugcugggcgugcugaagagaaagagacacgagcuggccuucgugugcagaauggacaccugggaccccagaaucauggugcccaucaacggcagcgugaccaagaucuucguggccgagcugaaggaccccagccaggugcccaucuacagccugagaaagggcagacugcagagagugggccuggagagacugaccgccgaggccagacacagcagacuguucugggugcagaucgugcuguggagacagggcuucuacuacccccugggcaucgugagagaggugcugcccgaggccagcaccugggagcagggccugagaauccugggccuggaguacagccugagagugccccccagcgaccaggccaccaucaccaaggugcugcagaaguaccacaccgagcugggcagaguggccggcagaagagaggacugcagagccuuccugaccuucaccguggacccccagggcgccugcaaccuggacgacgcccugagcgugagagaccugggccccagaugcgagguggccgugcacaucaccgacguggccagcuucgugcccagagacggcgugcuggacguggaggccagaagacagggcgccgccuucuacgcccccggcagagagcccgugcccaugcugcccgccagccugugccaggacgugcugagccugcugcccggcagagacagacuggccaucagccuguuccugaccauggagaaggccagcggccagcugaagagccugagauucgcccccagcguggugcagagcgacagacagcugagcuacgaggaggccgaggaggugaucagacagcaccccggcgccggcagagagcugcccgccagacuggacagcguggacgccugcgugguggccgccugcuacuucagcagacugcugagaagacacagacugagaagcgacugcuucuacgagcagcccgacgaggacggcacccugggcuucagagccgcccacaucauggugaaggaguacaugauccaguucaacagacugguggccgaguuccuggugggcagcgagugcaccagaaccgugaccccccugagauggcagcccgcccccagaagccagcagcugaaggcccugugcgagaagcacggcgacagagugccccugagccugcaccugggccaccaccugcacggcggcggcggcagcccccccgacaccagacugcaccugcuggccagccuguggaagcaggugcaguucgccgccagaacccaggacuacgagcagaugguggaccuggugaccaccgacgacaugcaccccuuccuggcccccgccggcagagaccugagaaaggcccuggagagaagcgccuucggcagaugcgccagaggccaccagcagcagggcggccacuacagccugcagguggacugguacaccugggccaccagccccaucagaagauaccuggacguggugcugcagagacagauccugcuggcccugggccacggcggcagcgccuacagcgccagagacaucgacggccugugccaggccuucagccugcagcacgcccuggcccagagcuaccagagaagagccagaagccugcaccuggccgugcagcugaaggcccagccccuggacaagcugggcuucgugguggacguggaggccggcagcagaugcuucagacugcuguuccccagcaacagagagacccugcccgaccccugccccgugcccuacggcagccugcagcuggccgagcacccccacgcccuggccggcagacccggccugagacugcuguggagaagaagaguguacagcgcccagggcagcagccccccccugccccugcccggcaccgugcccgacccccacacccuggccguggagaccgcccuguggaagcagcugcuggagcugguggagcugcagagauggcccgaggccgccgcccugauccaggagaagggcgaggccagccagagaagagagcuggugcaggugcagagaagccacugcggccacuuccuggagguggccagagagcugggcagcggcgacacccugcaggugcagcugggcaccagccugcagcacggcuuccuggugcccagcccccagcuguggaccguggcccccggcuucagccugugccuggagcacguggagagacccggcgacugcuucagcggcagaguguacagagcccccagagacagauacagagacguggacgaguacgccugcgugugggagcccuucugcgcccuggagagcgccaccggcgccguggccgagaacgacagcgugacccugcagcaccugagcgugagcugggaggccagcagaaccccccagggccagcugcagggcgccuucagacuggaggccgccuuccuggaggagaacugcgccgacaucaacuucagcugcugcuaccugugcaucagacuggagggccugcccgcccccaccgccagccccagacccggccccagcagccugggccccggccugaacguggaccccggcaccuacaccuggguggcccacggccagacccaggacugggaccaggagagaagagccgacagacaggaggcccccagaagagugcaccuguucgugcaccacaugggcauggagaaggugcccgaggaggugcugagacccggcacccuguucaccguggagcugcugcccaagcagcugcccgaccugagaaaggaggaggccgugagaggccuggaggaggccagcccccuggugaccagcaucgcccugggcagacccgugccccagccccugugcagagugauccccagcagauuccuggagagacagaccuacaacauccccggcggcagacacaagcugaaccccagccagaacguggccgugagagaggcccuggagaagcccuucaccgugauccagggcccccccggcaccggcaagaccaucgugggccugcacaucguguucugguuccacaagagcaaccaggagcaggugcagcccggcggcccccccagaggcgagaagagacugggcggccccugcauccuguacugcggccccagcaacaagagcguggacgugcuggccggccugcugcugagaagaauggagcugaagccccugagaguguacagcgagcaggccgaggccagcgaguuccccgugcccagagugggcagcagaaagcugcugagaaagagccccagagagggcagacccaaccagagccugagaagcaucacccugcaccacagaaucagacaggcccccaaccccuacagcagcgagaucaaggccuucgacaccagacugcagagaggcgagcuguucagcagagaggaccuggugugguacaagaaggugcugugggaggccagaaaguucgagcuggacagacacgaggugauccugugcaccugcagcugcgccgccagcgccagccugaagauccuggacgugagacagauccugguggacgaggccggcauggccaccgagcccgagacccugaucccccuggugcaguucccccaggccgagaagguggugcugcugggcgaccacaagcagcugagacccguggugaagaacgagagacugcagaaccugggccuggacagaagccuguucgagagauaccacgaggacgcccacaugcuggacacccaguacagaaugcacgagggcaucugcgccuuccccagcguggccuucuacaagagcaagcugaagaccuggcagggccugagaagaccccccagcgugcugggccacgccggcaaggagagcugccccgugaucuucggccacgugcagggccacgagagaagccugcuggugagcaccgacgagggcaacgagaacagcaaggccaaccuggaggagguggccgagguggugagaaucaccaagcagcugacccugggcagaaccguggagccccaggacaucgccgugcugacccccuacaacgcccaggccagcgagaucagcaaggcccugagaagagagggcaucgccggcguggccgugagcagcaucaccaagagccagggcagcgaguggagauacgugcuggugagcaccgugagaaccugcgccaagagcgaccuggaccagagacccaccaagagcuggcugaagaaguuccugggcuucgugguggaccccaaccaggugaacguggccgugaccagagcccaggagggccugugccugaucggcgaccaccugcugcugagaugcugcccccuguggagaagccugcuggacuucugcgaggcccagcagacccuggugcccgccggccaggugagagugugcagaagacccaccaugcccagcuaa

SEQ ID NO: 17992 - RNA, 5829 nt, Artificial Sequence
  HELZ__Homo_sapiens__NP_055692
auggaggacagaagagccgagaagagcugcgagcaggccugcgagagccugaagagacaggacuacgagauggcccugaagcacugcaccgaggcccugcugagccugggccaguacagcauggccgacuucaccggccccugcccccuggagaucgagagaaucaagaucgagagccugcuguacagaaucgccagcuuccugcagcugaagaacuacgugcaggccgacgaggacugcagacacgugcugggcgagggccuggccaagggcgaggacgccuucagagccgugcugugcugcaugcagcugaagggcaagcugcagcccgugagcaccauccuggccaagagccugaccggcgagagccugaacggcauggugaccaaggaccugaccagacugaagacccugcugagcgagaccgagaccgccaccagcaacgcccugagcggcuaccacguggaggaccuggacgagggcagcugcaacggcuggcacuucagacccccccccagaggcaucaccagcagcgaggaguacacccugugcaagagauuccuggagcagggcaucugcagauacggcgcccagugcaccagcgcccacagccaggaggagcuggccgaguggcagaagagauacgccagcagacugaucaagcugaagcagcagaacgagaacaagcagcugagcggcagcuacauggagacccugaucgagaaguggaugaacagccugagccccgagaaggugcugagcgagugcaucgagggcgugaagguggagcacaaccccgaccugagcgugaccgugagcaccaagaagagccaccagaccuggaccuucgcccugaccugcaagcccgccagaaugcuguacagaguggcccugcuguacgacgcccacagaccccacuucagcaucaucgccaucagcgccggcgacagcaccacccaggugagccaggaggugcccgagaacugccaggaguggaucggcggcaagauggcccagaacggccuggaccacuacguguacaaggugggcaucgccuucaacaccgagaucuucggcaccuucagacagaccaucguguucgacuucggccuggagcccgugcugaugcagagagugaugaucgacgccgccagcaccgaggaccuggaguaccugaugcacgccaagcagcagcuggugaccaccgccaagagaugggacagcagcagcaagaccaucaucgacuucgagcccaacgagaccaccgaccuggagaagagccugcugaucagauaccagaucccccugagcgccgaccagcuguucacccagagcgugcuggacaagagccugaccaagagcaacuaccagagcagacugcacgaccugcuguacaucgaggagaucgcccaguacaaggagaucagcaaguucaaccugaaggugcagcugcagauccuggccagcuucaugcugaccggcgugagcggcggcgccaaguacgcccagaacggccagcuguucggcagauucaagcugaccgagacccugagcgaggacacccuggccggcagacuggugaugaccaaggugaacgccguguaccugcugcccgugcccaagcagaagcuggugcagacccagggcaccaaggagaagguguacgaggccaccaucgaggagaagaccaaggaguacaucuuccugagacugagcagagagugcugcgaggagcugaaccugagacccgacugcgacacccagguggagcugcaguuccagcugaacagacugccccugugcgagaugcacuacgcccuggacagaaucaaggacaacggcgugcuguuccccgacaucagcaugacccccaccauccccuggagccccaacagacagugggacgagcagcuggaccccagacugaacgccaagcagaaggaggccgugcuggccaucaccaccccccuggccauccagcugccccccgugcugaucaucggccccuacggcaccggcaagaccuucacccuggcccaggccgugaagcacauccugcagcagcaggagaccagaauccugaucugcacccacagcaacagcgccgccgaccuguacaucaaggacuaccugcaccccuacguggaggccggcaacccccaggccagaccccugagaguguacuucagaaacagaugggugaagaccgugcaccccguggugcaccaguacugccugaucagcagcgcccacagcaccuuccagaugccccagaaggaggacauccugaagcacagaguggugguggugacccugaacaccagccaguaccugugccagcuggaccuggagcccggcuucuucacccacauccugcuggacgaggccgcccaggccauggagugcgagaccaucaugccccuggcccuggccacccagaacaccagaaucgugcuggccggcgaccacaugcagcugagccccuucguguacagcgaguucgccagagagagaaaccugcacgugagccugcuggacagacuguacgagcacuaccccgccgaguuccccugcagaauccugcugugcgagaacuacagaagccacgaggccaucaucaacuacaccagcgagcuguucuacgagggcaagcugauggccagcggcaagcagcccgcccacaaggacuucuacccccugaccuucuucaccgccagaggcgaggacgugcaggagaagaacagcaccgccuucuacaacaacgccgagguguucgaggugguggagagaguggaggagcugagaagaaaguggcccguggccuggggcaagcuggacgacggcagcaucggcguggugacccccuacgccgaccagguguucagaaucagagccgagcugagaaagaagagacugagcgacgugaacguggagagagugcugaacgugcagggcaagcaguucagagugcuguuccugagcaccgugagaaccagacacaccugcaagcacaagcagacccccaucaagaagaaggagcagcugcuggaggacagcaccgaggaccuggacuacggcuuccugagcaacuacaagcugcugaacaccgccaucaccagagcccagagccugguggccguggugggcgaccccaucgcccugugcagcaucggcagaugcagaaaguucugggagagauucaucgcccugugccacgagaacagcagccugcacggcaucaccuucgagcagaucaaggcccagcuggaggcccuggagcugaagaagaccuacgugcugaacccccuggcccccgaguucauccccagagcccugagacugcagcacagcggcagcaccaacaagcagcagcagagcccccccaagggcaagagccugcaccacacccagaacgaccacuuccagaacgacggcaucgugcagcccaaccccagcgugcugaucggcaaccccaucagagccuacacccccccccccccccugggcccccaccccaaccugggcaagagccccagccccgugcagagaaucgacccccacaccggcaccagcauccuguacgugcccgccguguacggcggcaacguggugaugagcgugccccugcccgugcccuggaccggcuaccagggcagauucgccguggaccccagaaucaucacccaccaggccgccauggccuacaacaugaaccugcugcagacccacggcagaggcagccccauccccuacggccugggccaccacccccccgugaccaucggccagccccagaaccagcaccaggagaaggaccagcacgagcagaacagaaacggcaagagcgacaccaacaacagcggccccgagaucaacaagaucagaacccccgagaagaagcccaccgagcccaagcagguggaccuggagagcaacccccagaacagaagccccgagagcagacccagcgugguguaccccagcaccaaguuccccagaaaggacaaccugaaccccagacacaucaaccugccccugcccgccccccacgcccaguacgccauccccaacagacacuuccacccccugccccagcugcccagaccccccuuccccaucccccagcagcacacccugcugaaccagcagcagaacaaccugcccgagcagcccaaccagauccccccccagcccaaccagguggugcagcagcagagccagcugaaccagcagccccagcagccccccccccagcugagccccgccuaccaggccggccccaacaacgccuucuucaacagcgccguggcccacagaccccagagcccccccgccgaggccgugauccccgagcagcagcccccccccaugcugcaggagggccacagcccccugagagccaucgcccagcccggccccauccugcccagccaccugaacagcuucaucgacgagaaccccagcggccugcccaucggcgaggcccuggacagaauccacggcagcguggcccuggagacccugagacagcagcaggccagauuccagcaguggagcgagcaccacgccuuccugagccagggcagcgugcccuacccccaccaccaccacccccaccugcagcaccugccccagcccccccugggccugcaccagccccccgugagagccgacuggaagcugaccagcagcgccgaggacgagguggagaccaccuacagcagauuccaggaccugaucagagagcugagccacagagaccagagcgagaccagagagcuggccgagaugccccccccccagagcagacugcugcaguacagacaggugcagagcagaagcccccccgccgugcccagcccccccagcagcaccgaccacagcagccacuucagcaacuucaacgacaacagcagagacaucgagguggccagcaaccccgccuucccccagagacugcccccccagaucuucaacagccccuucagccugcccagcgagcaccuggccccccccccccugaaguaccuggcccccgacggcgccuggaccuucgccaaccugcagcagaaccaccugaugggccccggcuuccccuacggccugcccccccugccccacagacccccccagaaccccuucgugcagauccagaaccaccagcacgccaucggccaggagcccuuccacccccugagcagcagaaccgugagcagcagcagccugcccagccuggaggaguacgagcccagaggccccggcagaccccuguaccagagaagaaucagcagcagcagcgugcagcccugcagcgaggaggugagcaccccccaggacagccuggcccagugcaaggagcugcaggaccacagcaaccagagcagcuucaacuucagcagccccgagagcugggugaacaccaccagcagcacccccuaccagaacauccccugcaacggcagcagcagaaccgcccagcccagagagcugaucgccccccccaagaccgugaagccccccgaggaccagcugaagagcgagaaccuggaggugagcagcagcuucaacuacagcgugcugcagcaccugggccaguuccccccccugaugcccaacaagcagaucgccgagagcgccaacagcagcagcccccagagcagcgccggcggcaagcccgccaugagcuacgccagcgcccugagagccccccccaagcccagacccccccccgagcaggccaagaagagcagcgacccccugagccuguuccaggagcugagccugggcagcagcagcggcagcaacggcuucuacagcuacuucaaguaa

SEQ ID NO: 17993 - RNA, 1455 nt, Artificial Sequence
  HEMGN__Homo_sapiens__XP_011517148
auggaccugggcaaggaccagagccaccugaagcaccaccagacccccgacccccaccaggaggagaaccacagccccgaggugaucggcaccuggagccugagaaacagagagcugcugagaaagagaaaggccgaggugcacgagaaggagaccagccaguggcuguucggcgagcagaagaagagaaagcagcagagaaccggcaagggcaacagaagaggcagaaagagacagcagaacaccgagcugaagguggagccccagccccagaucgagaaggagaucguggagaaggcccuggcccccaucgagaagaagaccgagccccccggcagcaucaccaagguguuccccagcguggccagcccccagaagguggugcccgaggagcacuucagcgagaucugccaggagagcaacaucuaccaggagaacuucagcgaguaccaggagaucgccgugcagaaccacagcagcgagaccugccagcacgugagcgagcccgaggaccugagccccaagauguaccaggagaucagcgugcugcaggacaacagcagcaagaucugccaggacaugaaggagcccgaggacaacagccccaacaccugccaggugaucagcgugauccaggaccaccccuucaagauguaccaggacauggccaagagagaggaccuggcccccaagaugugccaggaggccgccgugcccaagauccugcccugccccaccagcgaggacaccgccgaccuggccggcugcagccugcaggccuaccccaagcccgacgugcccaagggcuacauccuggacaccgaccagaaccccgccgagcccgaggaguacaacgagaccgaccagggcaucgccgagaccgagggccuguuccccaagauccaggagaucgccgagcccaaggaccugagcaccaagacccaccaggagagcgccgagcccaaguaccugccccacaagaccugcaacgagaucaucgugcccaaggcccccagccacaagaccauccaggagaccccccacagcgaggacuacagcaucgagaucaaccaggagacccccggcagcgagaaguacagccccgagaccuaccaggagauccccggccuggaggaguacagccccgagaucuaccaggagaccagccagcuggaggaguacagccccgagaucuaccaggagacccccggccccgaggaccugagcaccgagaccuacaagaacaaggacgugcccaaggagugcuuccccgagccccaccaggagaccggcggcccccagggccaggaccccaaggcccaccaggaggacgccaaggacgccuacaccuucccccaggagaugaaggagaagcccaaggaggagcccggcauccccgccauccugaacgagagccaccccgagaacgacguguacagcuacgugcuguucuaa

SEQ ID NO: 17994 - RNA, 1251 nt, Artificial Sequence
  HEPACAM__Homo_sapiens__NP_689935
augaagagagagagaggcgcccugagcagagccagcagagcccugagacuggcccccuucguguaccugcugcugauccagaccgacccccuggagggcgugaacaucaccagccccgugagacugauccacggcaccgugggcaagagcgcccugcugagcgugcaguacagcagcaccagcagcgacagacccguggugaaguggcagcugaagagagacaagcccgugaccguggugcagagcaucggcaccgaggugaucggcacccugagacccgacuacagagacagaaucagacuguucgagaacggcagccugcugcugagcgaccugcagcuggccgacgagggcaccuacgagguggagaucagcaucaccgacgacaccuucaccggcgagaagaccaucaaccugaccguggacgugcccaucagcagaccccaggugcugguggccagcaccaccgugcuggagcugagcgaggccuucacccugaacugcagccacgagaacggcaccaagcccagcuacaccuggcugaaggacggcaagccccugcugaacgacagcagaaugcugcugagccccgaccagaaggugcugaccaucaccagagugcugauggaggacgacgaccuguacagcugcaugguggagaaccccaucagccagggcagaagccugcccgugaagaucaccguguacagaagaagcagccuguacaucauccugagcaccggcggcaucuuccugcuggugacccuggugaccgugugcgccugcuggaagcccagcaagagaaagcagaagaagcuggagaagcagaacagccuggaguacauggaccagaacgacgacagacugaagcccgaggccgacacccugcccagaagcggcgagcaggagagaaagaaccccauggcccuguacauccugaaggacaaggacagccccgagaccgaggagaaccccgcccccgagcccagaagcgccaccgagcccggcccccccggcuacagcgugagccccgccgugcccggcagaagccccggccugcccaucagaagcgccagaagauaccccagaagccccgccagaagccccgccaccggcagaacccacagcagcccccccagagcccccagcagccccggcagaagcagaagcgccagcagaacccugagaaccgccggcgugcacaucaucagagagcaggacgaggccggccccguggagaucagcgccuaa

SEQ ID NO: 17995 - RNA, 3483 nt, Artificial Sequence
  HEPH__Homo_sapiens__NP_001124332
augugggccauggagagcggccaccugcugugggcccugcuguucaugcagagccuguggccccagcugaccgacggcgccaccagaguguacuaccugggcaucagagacgugcaguggaacuacgcccccaagggcagaaacgugaucaccaaccagccccuggacagcgacaucguggccagcagcuuccugaagagcgacaagaacagaaucggcggcaccuacaagaagaccaucuacaaggaguacaaggacgacagcuacaccgacgagguggcccagcccgccuggcugggcuuccugggccccgugcugcaggccgaggugggcgacgugauccugauccaccugaagaacuucgccaccagacccuacaccauccacccccacggcguguucuacgagaaggacagcgagggcagccuguaccccgacggcagcagcggcccccugaaggccgacgacagcgugccccccggcggcagccacaucuacaacuggaccauccccgagggccacgcccccaccgacgccgaccccgccugccugaccuggaucuaccacagccacguggacgcccccagagacaucgccaccggccugaucggcccccugaucaccugcaagagaggcgcccuggacggcaacagccccccccagagacaggacguggaccacgacuucuuccugcuguucagcgugguggacgagaaccugagcuggcaccugaacgagaacaucgccaccuacugcagcgaccccgccagcguggacaaggaggacgagaccuuccaggagagcaacagaaugcacgccaucaacggcuucguguucggcaaccugcccgagcugaacaugugcgcccagaagagaguggccuggcaccuguucggcaugggcaacgagaucgacgugcacaccgccuucuuccacggccagaugcugaccaccagaggccaccacaccgacguggccaacaucuuccccgccaccuucgugaccgccgagauggugcccugggagcccggcaccuggcugaucagcugccaggugaacagccacuucagagacggcaugcaggcccuguacaaggugaagagcugcagcauggccccccccguggaccugcugaccggcaaggugagacaguacuucaucgaggcccacgagauccagugggacuacggccccaugggccacgacggcagcaccggcaagaaccugagagagcccggcagcaucagcgacaaguucuuccagaagagcagcagcagaaucggcggcaccuacuggaaggugagauacgaggccuuccaggacgagaccuuccaggagaagaugcaccuggaggaggacagacaccugggcauccugggccccgugaucagagccgaggugggcgacaccauccaggugguguucuacaacagagccagccagcccuucagcaugcagccccacggcguguucuacgagaaggacuacgagggcaccguguacaacgacggcagcagcuaccccggccugguggccaagcccuucgagaaggugaccuacagauggaccgugcccccccacgccggccccaccgcccaggaccccgccugccugaccuggauguacuucagcgccgccgaccccaucagagacaccaacagcggccuggugggcccccugcuggugugcagagccggcgcccugggcgccgacggcaagcagaagggcguggacaaggaguucuuccugcuguucaccgugcuggacgagaacaagagcugguacagcaacgccaaccaggccgccgccaugcuggacuucagacugcugagcgaggacaucgagggcuuccaggacagcaacagaaugcacgccaucaacggcuuccuguucagcaaccugcccagacuggacaugugcaagggcgacaccguggccuggcaccugcugggccugggcaccgagaccgacgugcacggcgugauguuccagggcaacaccgugcagcugcagggcaugagaaagggcgccgccaugcuguucccccacaccuucgugauggccaucaugcagcccgacaaccugggcaccuucgagaucuacugccaggccggcagccacagagaggccggcaugagagccaucuacaacgugagccagugccccggccaccaggccacccccagacagagauaccaggccgccagaaucuacuacaucauggccgaggagguggagugggacuacugccccgacagaagcugggagagagaguggcacaaccagagcgagaaggacagcuacggcuacaucuuccugagcaacaaggacggccugcugggcagcagauacaagaaggccguguucagagaguacaccgacggcaccuucagaauccccagacccagaaccggccccgaggagcaccugggcauccugggcccccugaucaagggcgaggugggcgacauccugaccgugguguucaagaacaacgccagcagacccuacagcgugcacgcccacggcgugcuggagagcaccaccguguggccccuggccgccgagcccggcgagguggugaccuaccaguggaacauccccgagagaagcggccccggccccaacgacagcgccugcgugagcuggaucuacuacagcgccguggaccccaucaaggacauguacagcggccuggugggcccccuggccaucugccagaagggcauccuggagccccacggcggcagaagcgacauggacagagaguucgcccugcuguuccugaucuucgacgagaacaagagcugguaccuggaggagaacguggccacccacggcagccaggaccccggcagcaucaaccugcaggacgagaccuuccuggagagcaacaagaugcacgccaucaacggcaagcuguacgccaaccugagaggccugaccauguaccagggcgagagaguggccugguacaugcuggccaugggccaggacguggaccugcacaccauccacuuccacgccgagagcuuccuguacagaaacggcgagaacuacagagccgacgugguggaccuguuccccggcaccuucgaggugguggagaugguggccagcaaccccggcaccuggcugaugcacugccacgugaccgaccacgugcacgccggcauggagacccuguucaccguguucagcagaaccgagcaccugagcccccugaccgugaucaccaaggagaccgagaaggugccccccagagacaucgaggagggcaacgugaagaugcugggcaugcagauccccaucaagaacguggagaugcuggccagcgugcugguggccaucagcgugacccugcugcugguggugcuggcccugggcggcguggugugguaccagcacagacagagaaagcugagaagaaacagaagaagcauccuggacgacagcuucaagcugcugagcuucaagcaguaa

SEQ ID NO: 17996 - RNA, 267 nt, Artificial Sequence
  HEPN1__Homo_sapiens__NP_001032647
augggcaacuggggccugggcaucgcccccuggguggacggcgagagcgagcuggaguucagaagacugggcaugcagggcccccuggaggcccugagaagaagagaguggaacacccagagagccagcuucagcuucagcuuccugaucgcccugagcccccacaccguggacuacugccacagcuacgagcuguucaacagaagauggcacggccacgugcuggccacccagagacccagccuguucauccugaugcugguguaa

SEQ ID NO: 17997 - RNA, 14586 nt, Artificial Sequence
  HERC1__Homo_sapiens__NP_003913
auggccaccaugaucccccccgugaagcugaaguggcuggagcaccugaacagcagcuggaucaccgaggacagcgagagcaucgccaccagagagggcguggccgugcuguacagcaagcuggugagcaacaaggagguggugccccugccccagcaggugcugugccugaagggcccccagcugcccgacuucgagagagagagccugagcagcgacgagcaggaccacuaccuggacgcccugcugagcagccagcuggcccuggccaagauggugugcagcgacagccccuucgccggcgcccugagaaagagacugcuggugcugcagagaguguucuacgcccugagcaacaaguaccacgacaagggcaaggugaagcagcagcagcacagccccgagagcagcagcggcagcgccgacgugcacagcgugagcgagagacccagaagcagcaccgacgcccugaucgagaugggcgugagaaccggccugagccugcuguucgcccugcugagacagagcuggaugaugcccgugagcggccccggccugagccugugcaacgacgugauccacaccgccaucgagguggugagcagccugcccccccugagccuggccaacgagagcaagaucccccccaugggccuggacugccugagccaggugaccaccuuccugaagggcgugaccauccccaacagcggcgccgacacccugggcagaagacuggccagcgagcugcugcugggccuggccgcccagagaggcagccugagauaccugcuggaguggaucgagauggcccugggcgccagcgccguggugcacaccauggagaagggcaagcugcugagcagccaggagggcaugaucagcuucgacugcuucaugaccauccugaugcagaugagaagaagccugggcagcagcgccgacagaagccaguggagagagcccaccagaaccagcgacggccugugcagccuguacgaggccgcccugugccuguucgaggaggugugcagaauggccagcgacuacagcagaaccugcgccagccccgacagcauccagaccggcgacgcccccaucgugagcgagaccugcgagguguacguguggggcagcaacagcagccaccagcugguggagggcacccaggagaagauccugcagcccaagcuggcccccagcuucagcgacgcccagaccaucgaggccggccaguacugcaccuucgugaucagcaccgacggcagcgugagagccugcggcaagggcagcuacggcagacugggccugggcgacagcaacaaccagagcacccugaagaagcugaccuucgagccccacagaagcaucaagaaggugagcagcagcaagggcagcgacggccacacccuggccuucaccaccgagggcgagguguucagcuggggcgacggcgacuacggcaagcugggccacggcaacagcagcacccagaaguaccccaagcugauccagggcccccugcagggcaaggugguggugugcgugagcgccggcuacagacacagcgccgccgugaccgaggacggcgagcuguacaccuggggcgagggcgacuucggcagacugggccacggcgacagcaacagcagaaacauccccacccuggugaaggacaucagcaacgugggcgaggugagcugcggcagcagccacaccaucgcccugagcaaggacggcagaaccguguggagcuucggcggcggcgacaacggcaagcugggccacggcgacaccaacagaguguacaagcccaaggugaucgaggcccugcagggcauguucaucagaaaggugugcgccggcagccagagcagccuggcccugaccagcaccggccagguguacgccuggggcugcggcgccugccugggcugcggcagcagcgaggccaccgcccugagacccaagcugaucgaggagcuggccgccaccagaaucguggacgugagcaucggcgacagccacugccuggcccugagccacgacaacgagguguacgccuggggcaacaacagcaugggccagugcggccagggcaacagcaccggccccaucaccaagcccaagaaggugagcggccuggacggcaucgccauccagcagaucagcgccggcaccagccacagccuggccuggaccgcccugcccagagacagacaggugguggccuggcacagacccuacugcguggaccuggaggagagcaccuucagccaccugagaagcuuccuggagagauacugcgacaagaucaacagcgagauccccccccugcccuuccccagcagcagagagcaccacagcuuccugaagcugugccugaagcugcugagcaaccaccuggcccuggcccuggccggcggcguggccaccagcauccugggcagacaggccggcccccugagaaaccugcuguucagacugauggacagcaccgugcccgacgagauccaggagguggugaucgagacccugagcgugggcgccaccaugcugcugcccccccugagagagagaauggagcugcugcacagccugcugccccagggccccgacagaugggagagccugagcaagggccagagaaugcagcuggacaucauccugaccagccugcaggaccacacccacguggccagccugcugggcuacagcagccccagcgacgccgccgaccugagcagcgugugcaccggcuacggcaaccugagcgaccagcccuacggcacccagagcugccaccccgacacccaccuggccgagauccugaugaagacccugcugagaaaccugggcuucuacaccgaccaggccuucggcgagcuggagaagaacagcgacaaguuccugcugggcaccagcagcagcgagaacagccagcccgcccaccugcacgagcugcugugcagccugcagaagcagcugcuggccuucugccacaucaacaacaucagcgagaacagcagcagcguggcccugcugcacaagcaccugcagcugcugcugccccacgccaccgacaucuacagcagaagcgccaaccugcugaaggagagccccuggaacggcagcgugggcgagaagcugagagacgugaucuacgugagcgccgccggcagcaugcugugccagaucgugaacagccugcugcugcugcccgugagcguggccagaccccugcugagcuaccugcuggaccugcugcccccccuggacugccugaacagacugcugcccgccgccgaccugcuggaggaccaggagcugcaguggccccugcacggcggccccgagcugaucgaccccgccggccugccccugccccagcccgcccagagcuggguguggcugguggaccuggagagaaccaucgcccugcugaucggcagaugccugggcggcaugcugcagggcagccccgugagccccgaggagcaggacaccgccuacuggaugaagaccccccuguucagcgacggcguggagauggacaccccccagcuggacaagugcaugagcugccugcuggagguggcccugagcggcaacgaggagcagaagcccuucgacuacaagcugagacccgagaucgccguguacguggaccuggcccugggcugcagcaaggagcccgccagaagccuguggaucagcaugcaggacuacgccgugagcaaggacugggacagcgccacccugagcaacgagagccugcuggacaccgugagcagauucgugcuggccgcccugcugaagcacaccaaccugcugagccaggccugcggcgagagcagauaccagcccggcaagcaccugagcgagguguacagaugcguguacaaggugagaagcagacugcuggccugcaagaaccuggagcugauccagaccagaagcagcagcagagacagauggaucagcgagaaccaggacagcgccgacguggacccccaggagcacagcuucaccagaaccaucgacgaggaggccgagauggaggagcaggccgagagagacagagaggagggccaccccgagcccgaggacgaggaggaggagagagagcacgaggugaugaccgccggcaagaucuuccagugcuuccugagcgccagagagguggccagaagcagagacagagacagaaugaacagcggcgccggcagcggcgccagagccgacgacccccccccccagagccagcaggagagaagagugagcaccgaccugcccgagggccaggacguguacaccgccgccugcaacagcgugauccacagaugcgcccugcugauccugggcgugagccccgugaucgacgagcugcagaagagaagagaggagggccagcugcagcagcccagcaccagcgccagcgagggcggcggccugaugaccagaagcgagagccugaccgccgagagcagacuggugcacaccagccccaacuacagacugaucaagagcagaagcgagagcgaccugagccagcccgagagcgacgaggagggcuacgcccugagcggcagaagaaacguggaccuggaccuggccgccagccacagaaagagaggccccaugcacagccagcuggagagccugagcgacagcugggccagacugaagcacagcagagacuggcugugcaacagcagcuacagcuucgagagcgacuucgaccugaccaagagccugggcgugcacacccugaucgagaacguggugagcuucgugagcggcgacgugggcaacgcccccggcuucaaggagcccgaggagagcaugagcaccagcccccaggccagcaucaucgccauggagcagcagcagcugagagccgagcugagacuggaggcccugcaccagauccuggugcugcugagcggcauggaggagaagggcagcaucagccuggccggcagcagacugagcagcggcuuccagagcagcacccugcugaccagcgugagacugcaguuccuggccggcugcuucggccugggcaccgugggccacaccggcggcaagggcgagagcggcagacugcaccacuaccaggacggcaucagagccgccaagagaaacauccagaucgagauccagguggccgugcacaagaucuaccagcagcugagcgccacccuggagagagcccugcaggccaacaagcaccacaucgaggcccagcagagacugcugcuggugaccguguucgcccugagcgugcacuaccagcccguggacgugagccuggccaucagcaccggccugcugaacgugcugagccagcugugcggcaccgacaccaugcugggccagccccugcagcugcugcccaagaccggcgugagccagcugagcaccgcccugaagguggccagcaccagacugcugcagauccuggccaucaccaccggcaccuacgccgacaagcugagccccaagguggugcagagccugcuggaccugcugugcagccagcugaagaaccugcugagccagaccggcgugcugcacauggccagcuucggcgagggcgagcaggaggacggcgaggaggaggagaagaagguggacagcagcggcgagaccgagaagaaggacuucagagccgcccugagaaagcagcacgccgccgagcugcaccugggcgacuuccugguguuccugagaagaguggugagcagcaaggccauccagagcaagauggccagccccaaguggaccgaggugcugcugaacaucgccagccagaagugcagcagcggcaucccccuggugggcaaccugagaaccagacugcuggcccugcacgugcuggaggccgugcugcccgccugcgagagcggcguggaggacgaccagauggcccagaucguggagagacuguucagccugcugagcgacugcaugugggagacccccaucgcccaggccaagcacgccauccagaucaaggagaaggagcaggagaucaagcugcagaagcagggcgagcuggaggaggaggacgagaaccugcccauccaggaggugagcuucgaccccgagaaggcccagugcugccugguggagaacggccagauccugacccacggcagcggcggcaagggcuacggccuggccagcaccggcgugaccagcggcugcuaccaguggaaguucuacaucgugaaggagaacagaggcaacgagggcaccugcgugggcgugagcagauggcccgugcacgacuucaaccacagaaccaccagcgacauguggcuguacagagccuacagcggcaaccuguaccacaacggcgagcagacccugacccugagcagcuucacccagggcgacuucaucaccugcgugcuggacauggaggccagaaccaucagcuucggcaagaacggcgaggagcccaagcuggccuucgaggacguggacgccgccgagcuguaccccugcgugauguucuacagcagcaaccccggcgagaaggugaagaucugcgacaugcagaugagaggcacccccagagaccugcugcccggcgaccccaucugcagccccguggccgccgugcuggccgaggccaccauccagcugaucagaauccugcacagaaccgacagauggaccuacugcaucaacaagaagaugauggagagacugcacaagaucaagaucugcaucaaggagagcggccagaagcugaagaagagcagaagcgugcagagcagagaggagaacgagaugagagaggagaaggagagcaaggaggaggagaagggcaagcacaccagacacggccuggccgaccugagcgagcugcagcugagaacccugugcaucgagguguggcccgugcuggccgugaucggcggcguggacgccggccugagagugggcggcagaugcgugcacaagcagaccggcagacacgccacccugcugggcguggugaaggagggcagcaccagcgccaaggugcagugggacgaggccgagaucaccaucagcuuccccaccuucuggagccccagcgacaccccccuguacaaccuggagcccugcgagccccugcccuucgacguggccagauucagaggccugaccgccagcgugcugcuggaccugaccuaccugaccggcgugcacgaggacaugggcaagcagagcaccaagagacacgagaagaagcacagacacgagagcgaggagaagggcgacguggagcagaagcccgagagcgagagcgcccuggacaugagaaccggccugaccagcgacgacgugaagagccagagcaccaccagcagcaagagcgagaacgagaucgccagcuucagccuggaccccacccugcccagcguggagagccagcaccagaucaccgagggcaagagaaagaaccacgagcacaugagcaagaaccacgacguggcccagagcgagaucagagccgugcagcugagcuaccuguaccugggcgccaugaagagccugagcgcccugcugggcugcagcaaguacgccgagcugcugcugauccccaaggugcuggccgagaacggccacaacagcgacugcgccagcagccccguggugcacgaggacguggagaugagagccgcccugcaguuccugaugagacacauggugaagagagccgugaugagaagccccaucaagagagcccugggccuggccgaccuggagagagcccaggccaugaucuacaagcugguggugcacggccugcuggaggaccaguucggcggcaagaucaagcaggagaucgaccagcaggccgaggagagcgaccccgcccagcaggcccagacccccgugaccaccagccccagcgccagcagcaccaccagcuucaugagcagcagccuggaggacaccaccaccgccaccacccccgugaccgacaccgagaccgugcccgccagcgagagccccggcgugaugccccugagccugcugagacagauguucagcagcuaccccaccaccaccgugcugcccaccagaagagcccagaccccccccaucagcagccugcccaccagccccagcgacgaggugggcagaagacagagccugaccagccccgacagccagagcgccagacccgccaacagaaccgcccugagcgaccccagcagcagacugagcaccagcccccccccccccgccaucgccgugccccugcuggagaugggcuucagccugagacagaucgccaaggccauggaggccaccggcgccagaggcgaggccgacgcccagaacaucaccgugcuggccauguggaugaucgagcaccccggccacgaggacgaggaggagccccagagcggcagcaccgccgacagcagacccggcgccgccgugcugggcagcggcggcaagagcaacgaccccugcuaccugcagagccccggcgacauccccagcgccgacgccgccgagauggaggagggcuucagcgagagccccgacaaccuggaccacaccgagaacgccgccagcggcagcggccccagcgccagaggcagaagcgccgugaccagaagacacaaguucgaccuggccgccagaacccugcuggccagagccgccggccuguacagaagcgugcaggcccacagaaaccagagcagaagagagggcaucagccugcagcaggaccccggcgcccuguacgacuucaaccuggacgaggagcuggagaucgaccuggacgacgaggccauggaggccauguucggccaggaccugaccagcgacaacgacauccugggcauguggauccccgaggugcuggacuggcccaccuggcacgugugcgagagcgaggacagagaggaggugguggugugcgagcugugcgagugcagcguggugagcuucaaccagcacaugaagagaaaccaccccggcugcggcagaagcgccaacagacagggcuacagaagcaacggcagcuacguggacggcugguucggcggcgagugcggcagcggcaaccccuacuaccugcugugcggcaccugcagagagaaguaccuggccaugaagaccaagagcaagagcaccagcagcgagagauacaagggccaggcccccgaccugaucggcaagcaggacagcguguacgaggaggacugggacaugcuggacguggacgaggacgagaagcugaccggcgaggaggaguucgagcugcuggccggcccccugggccugaacgacagaagaaucgugcccgagcccgugcaguuccccgacagcgacccccugggcgccagcguggccauggugaccgccaccaacagcauggaggagacccugaugcagaucggcugccacggcagcguggagaagagcagcagcggcagaaucacccugggcgagcaggccgccgcccuggccaacccccacgacagagugguggcccugagaagagugaccgccgccgcccaggugcugcuggccagaaccauggugaugagagcccugagccugcugagcgugagcggcagcagcugcagccuggccgccggccuggagagccugggccugaccgacaucagaacccuggugagacugaugugccuggccgccgccggcagagccggccugagcaccagccccagcgccauggccagcaccagcgagagaagcagaggcggccacagcaaggccaacaagcccaucagcugccuggccuaccugagcaccgccgugggcugccuggccagcaacgcccccagcgccgccaagcugcuggugcagcugugcacccagaaccugaucagcgccgccaccggcgugaaccugaccaccguggacgacagcauccagagaaaguuccugcccagcuuccugagaggcaucgccgaggagaacaagcuggugaccagccccaacuucguggugacccaggcccugguggcccugcuggccgacaagggcgccaagcugagacccaacuacgacaagagcgagguggagaagaagggcccccuggagcuggccaacgcccuggccgccugcugccugagcagcagacugagcagccagcacagacagugggccgcccagcagcuggugagaacccuggccgcccacgacagagacaaccagaccacccugcagacccuggccgacaugggcggcgaccugagaaagugcagcuucaucaagcuggaggcccaccagaacagagugaugaccugcguguggugcaacaagaagggccugcuggccaccagcggcaacgacggcaccaucagaguguggaacgugaccaagaagcaguacagccugcagcagaccugcguguucaacagacuggagggcgacgccgaggagagccugggcagccccagcgaccccagcuucagccccgugagcuggagcaucagcggcaaguaccuggccggcgcccuggagaagauggugaacaucuggcaggugaacggcggcaagggccugguggacauccagccccacugggugagcgcccuggccuggcccgaggagggccccgccaccgccuggagcggcgagagccccgagcugcugcuggugggcagaauggacggcagccugggccugaucgaggugguggacgugagcaccaugcacagaagagagcuggagcacugcuacagaaaggacgugagcgugaccugcaucgccugguucagcgaggacagacccuucgccgugggcuacuucgacggcaagcugcugcugggcaccaaggagccccuggagaagggcggcaucgugcugaucgacgcccacaaggacacccugaucagcaugaagugggaccccaccggccacauccugaugaccugcgccaaggaggacagcgugaagcuguggggcagcaucagcggcugcuggugcugccugcacagccugugccaccccagcaucgugaacggcaucgccuggugcagacugcccggcaagggcagcaagcugcagcugcugauggccaccggcugccagagcggccuggugugcguguggagaaucccccaggacaccacccagaccaacgugaccagcgccgagggcuggugggagcaggagagcaacugccaggacggcuacagaaagagcagcggcgccaagugcguguaccagcugagaggccacaucacccccgugagaaccguggccuucagcagcgacggccuggcccuggugagcggcggccugggcggccugaugaacaucuggagccugagagacggcagcgugcugcagaccguggugaucggcagcggcgccauccagaccaccguguggauccccgaggugggcguggccgccugcagcaacagaagcaaggacgugcugguggugaacugcaccgccgagugggccgccgccaaccacgugcuggccaccugcagaaccgcccugaagcagcagggcgugcugggccugaacauggcccccugcaugagagccuuccuggagagacugcccaugaugcugcaggagcaguacgccuacgagaagccccacguggugugcggcgaccagcuggugcacagccccuacaugcagugccuggccagccuggccgugggccugcaccuggaccagcugcugugcaacccccccgugcccccccaccaccagaacugccugcccgaccccgccagcuggaaccccaacgagugggccuggcuggagugcuucagcaccaccaucaaggccgccgaggcccugaccaacggcgcccaguuccccgagagcuucaccgugcccgaccuggagcccgugcccgaggacgagcugguguuccugauggacaacagcaaguggaucaacggcauggacgagcagaucaugagcugggccaccagcagacccgaggacuggcaccugggcggcaagugcgacguguaccuguggggcgccggcagacacggccagcuggccgaggccggcagaaacgugauggugcccgccgccgcccccagcuucagccaggcccagcaggugaucugcggccagaacugcaccuucgugauccaggccaacggcaccgugcuggccugcggcgagggcagcuacggcagacugggccagggcaacagcgacgaccugcacgugcugaccgugaucagcgcccugcagggcuucguggugacccagcuggugaccagcugcggcagcgacggccacagcauggcccugaccgagagcggcgagguguucagcuggggcgacggcgacuacggcaagcugggccacggcaacagcgacagacagagaagacccagacagaucgaggcccugcagggcgaggagguggugcagaugagcugcggcuucaagcacagcgccguggugaccagcgacggcaagcuguucaccuucggcaacggcgacuacggcagacugggccugggcaacaccagcaacaagaagcugcccgagagagugaccgcccuggagggcuaccagaucggccagguggccugcggccugaaccacacccuggccgugagcgccgacggcagcauggugugggccuucggcgacggcgacuacggcaagcugggccugggcaacagcaccgccaagagcagcccccagaagaucgacgugcugugcggcaucggcaucaagaagguggccugcggcacccaguucagcguggcccugaccaaggacggccacguguacaccuucggccaggacagacugaucggccugcccgagggcagagccagaaaccacaacagaccccagcagauccccgugcuggccggcgugaucaucgaggacguggccgugggcgccgagcacacccuggcccuggccagcaacggcgacguguacgccuggggcagcaacagcgagggccagcugggccugggccacaccaaccacgugagagagcccacccuggugaccggccugcagggcaagaacgugagacagaucagcgccggcagaugccacagcgccgccuggaccgccccccccgugccccccagagcccccggcgugagcgugccccugcagcugggccugcccgacaccgugcccccccaguacggcgcccugagagaggugagcauccacaccgugagagccagacugagacugcuguaccacuucagcgaccugauguacagcagcuggagacugcugaaccugagccccaacaaccagaacagcaccagccacuacaacgccggcaccuggggcaucgugcagggccagcugagaccccugcuggcccccagaguguacacccugcccauggugagaagcaucggcaagaccauggugcagggcaagaacuacggcccccagaucaccgugaagagaaucagcaccagaggcagaaagugcaagcccaucuucgugcagaucgccagacagguggugaagcugaacgccagcgaccugagacugcccagcagagccuggaaggugaagcuggugggcgagggcgccgacgacgccggcggcguguucgacgacaccaucaccgagaugugccaggagcuggagaccggcaucguggaccugcugauccccagccccaacgccaccgccgaggugggcuacaacagagacagauuccuguucaaccccagcgccugccuggacgagcaccugaugcaguucaaguuccugggcauccugaugggcguggccaucagaaccaagaagccccuggaccugcaccuggccccccugguguggaagcagcugugcugcgugccccugacccuggaggaccuggaggagguggaccugcuguacgugcagacccugaacagcauccugcacaucgaggacagcggcaucaccgaggagagcuuccacgagaugaucccccuggacagcuucgugggccagagcgccgacggcaagauggugcccaucauccccggcggcaacagcaucccccugaccuucagcaacagaaaggaguacguggagagagccaucgaguacagacugcacgagauggacagacagguggccgccgugagagagggcaugagcuggaucgugcccgugccccugcugagccugcugaccgccaagcagcuggagcagauggugugcggcaugcccgagaucagcguggaggugcugaagaagguggugagauacagagagguggacgagcagcaccagcuggugcagugguucuggcacacccuggaggaguucagcaacgaggagagagugcuguucaugagauucgugagcggcagaagcagacugcccgccaacaccgccgacaucagccagagauuccagaucaugaagguggacagacccuacgacagccugcccaccagccagaccugcuucuuccagcugagacugccccccuacagcagccagcuggugauggccgagagacugagauacgccaucaacaacugcagaagcaucgacauggacaacuacaugcugagcagaaacguggacaacgccgagggcagcgacaccgacuacuaa

SEQ ID NO: 17998 - RNA, 14505 nt, Artificial Sequence
  HERC2__Homo_sapiens__NP_004658
augcccagcgagagcuucugccuggccgcccaggccagacuggacagcaaguggcugaagaccgacauccagcuggccuucaccagagacggccugugcggccuguggaacgagauggugaaggacggcgagaucguguacaccggcaccgagagcacccagaacggcgagcugccccccagaaaggacgacagcguggagcccagcggcaccaagaaggaggaccugaacgacaaggagaagaaggacgaggaggagacccccgcccccaucuacagagccaagagcauccuggacagcuggguguggggcaagcagcccgacgugaacgagcugaaggagugccugagcgugcuggugaaggagcagcaggcccuggccgugcagagcgccaccaccacccugagcgcccugagacugaagcagagacuggugauccuggagagauacuucaucgcccugaacagaaccguguuccaggagaacgugaaggugaaguggaagagcagcggcaucagccugccccccguggacaagaagagcagcagacccgccggcaagggcguggagggccuggccagagugggcagcagagccgcccugagcuucgccuucgccuuccugagaagagccuggagaagcggcgaggacgccgaccugugcagcgagcugcugcaggagagccuggacgcccugagagcccugcccgaggccagccuguucgacgagagcaccgugagcagcguguggcuggaggugguggagagagccaccagauuccugagaagcguggugaccggcgacgugcacggcacccccgccaccaagggccccggcagcaucccccugcaggaccagcaccuggcccuggccauccugcuggagcuggccgugcagagaggcacccugagccagaugcugagcgccauccugcugcugcugcagcugugggacagcggcgcccaggagaccgacaacgagagaagcgcccagggcaccagcgccccccugcugccccugcugcagagauuccagagcaucaucugcagaaaggacgccccccacagcgagggcgacaugcaccugcugagcggcccccugagccccaacgagagcuuccugagauaccugacccugccccaggacaacgagcuggccaucgaccugagacagaccgccgugguggugauggcccaccuggacagacuggccacccccugcaugcccccccugugcagcagccccaccagccacaagggcagccugcaggaggugaucggcuggggccugaucggcuggaaguacuacgccaacgugaucggccccauccagugcgagggccuggccaaccugggcgugacccagaucgccugcgccgagaagagauuccugauccugagcagaaacggcagaguguacacccaggccuacaacagcgacacccuggccccccagcuggugcagggccuggccagcagaaacaucgugaagaucgccgcccacagcgacggccaccacuaccuggcccuggccgccaccggcgagguguacagcuggggcugcggcgacggcggcagacugggccacggcgacaccgugccccuggaggagcccaaggugaucagcgccuucagcggcaagcaggccggcaagcacguggugcacaucgccugcggcagcaccuacagcgccgccaucaccgccgagggcgagcuguacaccuggggcagaggcaacuacggcagacugggccacggcagcagcgaggacgaggccauccccaugcugguggccggccugaagggccugaaggugaucgacguggccugcggcagcggcgacgcccagacccuggccgugaccgagaacggccagguguggagcuggggcgacggcgacuacggcaagcugggcagaggcggcagcgacggcugcaagacccccaagcugaucgagaagcugcaggaccuggacguggugaaggugagaugcggcagccaguucagcaucgcccugaccaaggacggccagguguacagcuggggcaagggcgacaaccagagacugggccacggcaccgaggagcacgugagauaccccaagcugcuggagggccugcagggcaagaaggugaucgacguggccgccggcagcacccacugccuggcccugaccgaggacagcgaggugcacagcuggggcagcaacgaccagugccagcacuucgacacccugagagugaccaagcccgagcccgccgcccugcccggccuggacaccaagcacaucgugggcaucgccugcggccccgcccagagcuucgccuggagcagcugcagcgaguggagcaucggccugagagugcccuucgugguggacaucugcagcaugaccuucgagcagcuggaccugcugcugagacaggugagcgagggcauggacggcagcgccgacuggccccccccccaggagaaggagugcguggccguggccacccugaaccugcugagacugcagcugcacgccgccaucagccaccagguggaccccgaguuccugggccugggccugggcagcauccugcugaacagccugaagcagaccguggugacccuggccagcagcgccggcgugcugagcaccgugcagagcgccgcccaggccgugcugcagagcggcuggagcgugcugcugcccaccgccgaggagagagccagagcccugagcgcccugcugcccugcgccgugagcggcaacgaggugaacaucagccccggcagaagauucaugaucgaccugcuggugggcagccugauggccgacggcggccuggagagcgcccugcacgccgccaucaccgccgagauccaggacaucgaggccaagaaggaggcccagaaggagaaggagaucgacgagcaggaggccaacgccagcaccuuccacagaagcagaaccccccuggacaaggaccugaucaacaccggcaucugcgagagcagcggcaagcagugccugccccuggugcagcugauccagcagcugcugagaaacaucgccagccagaccguggccagacugaaggacguggccagaagaaucagcagcugccuggacuucgagcagcacagcagagagagaagcgccagccuggaccugcugcugagauuccagagacugcugaucagcaagcuguaccccggcgagagcaucggccagaccagcgacaucagcagccccgagcugaugggcgugggcagccugcugaagaaguacaccgcccugcugugcacccacaucggcgacauccugcccguggccgccagcaucgccagcaccagcuggagacacuucgccgagguggccuacaucguggagggcgacuucaccggcgugcugcugcccgagcugguggugagcaucgugcugcugcugagcaagaacgccggccugaugcaggaggccggcgccgugccccugcugggcggccugcuggagcaccuggacagauucaaccaccuggcccccggcaaggagagagacgaccacgaggagcuggccuggcccggcaucauggagagcuucuucaccggccagaacugcagaaacaacgaggaggugacccugaucagaaaggccgaccuggagaaccacaacaaggacggcggcuucuggaccgugaucgacggcaagguguacgacaucaaggacuuccagacccagagccugaccggcaacagcauccuggcccaguucgccggcgaggaccccgugguggcccuggaggccgcccugcaguucgaggacaccagagagagcaugcacgccuucugcgugggccaguaccuggagcccgaccaggagaucgugaccauccccgaccugggcagccugagcagcccccugaucgacaccgagagaaaccugggccugcugcugggccugcacgccagcuaccuggccaugagcaccccccugagccccguggagaucgagugcgccaaguggcugcagagcagcaucuucagcggcggccugcagaccagccagauccacuacagcuacaacgaggagaaggacgaggaccacugcagcagccccggcggcacccccgccagcaagagcagacugugcagccacagaagagcccugggcgaccacagccaggccuuccugcaggccaucgccgacaacaacauccaggaccacaacgugaaggacuuccugugccagaucgagagauacugcagacagugccaccugaccacccccaucauguucccccccgagcaccccguggaggaggugggcagacugcugcugugcugccugcugaagcacgaggaccugggccacguggcccugagccuggugcacgccggcgcccugggcaucgagcaggugaagcacagaacccugcccaagagcgugguggacgugugcagagugguguaccaggccaagugcagccugaucaagacccaccaggagcagggcagaagcuacaaggaggugugcgcccccgugaucgagagacugagauuccuguucaacgagcugagacccgccgugugcaacgaccugagcaucaugagcaaguucaagcugcugagcagccugcccagauggagaagaaucgcccagaagaucaucagagagagaagaaagaagagagugcccaagaagcccgagagcaccgacgacgaggagaagaucggcaacgaggagagcgaccuggaggaggccugcauccugccccacagccccaucaacguggacaagagacccaucgccaucaagagccccaaggacaaguggcagccccugcugagcaccgugaccggcgugcacaaguacaaguggcugaagcagaacgugcagggccuguacccccagagcccccugcugagcaccaucgccgaguucgcccugaaggaggagcccguggacguggagaagaugagaaagugccugcugaagcagcuggagagagccgaggugagacuggagggcaucgacaccauccugaagcuggccagcaagaacuuccugcugcccagcgugcaguacgccauguucugcggcuggcagagacugauccccgagggcaucgacaucggcgagccccugaccgacugccugaaggacguggaccugaucccccccuucaacagaaugcugcuggaggugaccuucggcaagcuguacgccugggccgugcagaacaucagaaacgugcugauggacgccagcgccaaguucaaggagcugggcauccagcccgugccccugcagaccaucaccaacgagaaccccagcggccccagccugggcaccaucccccaggccagauuccugcuggugaugcugagcaugcugacccugcagcacggcgccaacaaccuggaccugcugcugaacagcggcaugcuggcccugacccagaccgcccugagacugaucggccccagcugcgacaacguggaggaggacaugaacgccagcgcccagggcgccagcgccaccgugcuggaggagaccagaaaggagaccgcccccgugcagcugcccgugagcggccccgagcuggccgccaugaugaagaucggcaccagagugaugagaggcguggacuggaaguggggcgaccaggacggccccccccccggccugggcagagugaucggcgagcugggcgaggacggcuggaucagagugcagugggacaccggcagcaccaacagcuacagaaugggcaaggagggcaaguacgaccugaagcuggccgagcugcccgccgccgcccagcccagcgccgaggacagcgacaccgaggacgacagcgaggccgagcagaccgagagaaacauccaccccaccgccaugauguucaccagcaccaucaaccugcugcagacccugugccugagcgccggcgugcacgccgagaucaugcagagcgaggccaccaagacccugugcggccugcugagaaugcugguggagagcggcaccaccgacaagaccagcagccccaacagacugguguacagagagcagcacagaagcuggugcacccugggcuucgugagaagcaucgcccugaccccccaggugugcggcgcccugagcagcccccaguggaucacccugcugaugaaggugguggagggccacgcccccuucaccgccaccagccugcagagacagauccuggccgugcaccugcugcaggccgugcugcccagcugggacaagaccgagagagccagagacaugaagugccugguggagaagcuguucgacuuccugggcagccugcugaccaccugcagcagcgacgugccccugcugagagagagcacccugagaagaagaagagugagaccccaggccagccugaccgccacccacagcagcacccuggccgaggaggugguggcccugcugagaacccugcacagccugacccaguggaacggccugaucaacaaguacaucaacagccagcugagaagcaucacccacagcuucgugggcagacccagcgagggcgcccagcuggaggacuacuuccccgacagcgagaaccccgaggugggcggccugauggccgugcuggccgugaucggcggcaucgacggcagacugagacugggcggccaggugaugcacgacgaguucggcgagggcaccgugaccagaaucacccccaagggcaagaucaccgugcaguucagcgacaugagaaccugcagagugugcccccugaaccagcugaagccccugcccgccguggccuucaacgugaacaaccugcccuucaccgagcccaugcugagcgugugggcccagcuggugaaccuggccggcagcaagcuggagaagcacaagaucaagaagagcaccaagcaggccuucgccggccagguggaccuggaccugcugagaugccagcagcugaagcuguacauccugaaggccggcagagcccugcugagccaccaggacaagcugagacagauccugagccagcccgccgugcaggagaccggcaccgugcacaccgacgacggcgccguggugagccccgaccugggcgacaugagccccgagggcccccagccccccaugauccugcugcagcagcugcuggccagcgccacccagcccagccccgugaaggccaucuucgacaagcaggagcuggaggccgccgcccuggccgugugccagugccuggccguggagagcacccaccccagcagccccggcuucgaggacugcagcagcagcgaggccaccacccccguggccgugcagcacaucagacccgccagagugaagagaagaaagcagagccccgugcccgcccugcccaucguggugcagcugauggagaugggcuucagcagaagaaacaucgaguucgcccugaagagccugaccggcgccagcggcaacgccagcagccugcccggcguggaggcccuggugggcuggcugcuggaccacagcgacauccaggugaccgagcugagcgacgccgacaccgugagcgacgaguacagcgacgaggaggugguggaggacguggacgacgccgccuacagcaugagcaccggcgccguggugaccgagagccagaccuacaagaagagagccgacuuccugagcaacgacgacuacgccguguacgugagagagaacauccaggugggcaugauggugagaugcugcagagccuacgaggaggugugcgagggcgacgugggcaaggugaucaagcuggacagagacggccugcacgaccugaacgugcagugcgacuggcagcagaagggcggcaccuacugggugagauacauccacguggagcugaucggcuaccccccccccagcagcagcagccacaucaagaucggcgacaaggugagagugaaggccagcgugaccacccccaaguacaaguggggcagcgugacccaccagagcgugggcguggugaaggccuucagcgccaacggcaaggacaucaucguggacuucccccagcagagccacuggaccggccugcugagcgagauggagcuggugcccagcauccaccccggcgugaccugcgacggcugccagauguuccccaucaacggcagcagauucaagugcagaaacugcgacgacuucgacuucugcgagaccugcuucaagaccaagaagcacaacaccagacacaccuucggcagaaucaacgagcccggccagagcgccguguucugcggcagaagcggcaagcagcugaagagaugccacagcagccagcccggcaugcugcuggacagcuggagcagaauggugaagagccugaacgugagcagcagcgugaaccaggccagcagacugaucgacggcagcgagcccugcuggcagagcagcggcagccagggcaagcacuggaucagacuggagaucuuccccgacgugcuggugcacagacugaagaugaucguggaccccgccgacagcagcuacaugcccagccuggugguggugagcggcggcaacagccugaacaaccugaucgagcugaagaccaucaacaucaaccccagcgacaccaccgugccccugcugaacgacugcaccgaguaccacagauacaucgagaucgccaucaagcagugcagaagcagcggcaucgacugcaagauccacggccugauccugcugggcagaaucagagccgaggaggaggaccuggccgccgugcccuuccuggccagcgacaacgaggaggaggaggacgagaagggcaacagcggcagccugaucagaaagaaggccgccggccuggagagcgccgccaccaucagaaccaagguguucguguggggccugaacgacaaggaccagcugggcggccugaagggcagcaagaucaaggugcccagcuucagcgagacccugagcgcccugaacguggugcagguggccggcggcagcaagagccuguucgccgugaccguggagggcaagguguacgccugcggcgaggccaccaacggcagacugggccugggcaucagcagcggcaccgugcccauccccagacagaucaccgcccugagcagcuacguggugaagaagguggccgugcacagcggcggcagacacgccaccgcccugaccguggacggcaagguguucagcuggggcgagggcgacgacggcaagcugggccacuucagcagaaugaacugcgacaagcccagacugaucgaggcccugaagaccaagagaaucagagacaucgccugcggcagcagccacagcgccgcccugaccagcagcggcgagcuguacaccuggggccugggcgaguacggcagacugggccacggcgacaacaccacccagcugaagcccaagauggugaaggugcugcugggccacagagugauccagguggccugcggcagcagagacgcccagacccuggcccugaccgacgagggccugguguucagcuggggcgacggcgacuucggcaagcugggcagaggcggcagcgagggcugcaacaucccccagaacaucgagagacugaacggccagggcgugugccagaucgagugcggcgcccaguucagccuggcccugaccaagagcggcgugguguggaccuggggcaagggcgacuacuucagacugggccacggcagcgacgugcacgugagaaagccccaggugguggagggccugagaggcaagaagaucgugcacguggccgugggcgcccugcacugccuggccgugaccgacagcggccagguguacgccuggggcgacaacgaccacggccagcagggcaacggcaccaccaccgugaacagaaagcccacccuggugcagggccuggagggccagaagaucaccagaguggccugcggcagcagccacagcguggccuggaccaccguggacguggccacccccagcgugcacgagcccgugcuguuccagaccgccagagacccccugggcgccagcuaccugggcgugcccagcgacgccgacagcagcgccgccagcaacaagaucagcggcgccagcaacagcaagcccaacagacccagccuggccaagauccugcugagccuggacggcaaccuggccaagcagcaggcccugagccacauccugaccgcccugcagaucauguacgccagagacgccguggugggcgcccugaugcccgccgccaugaucgcccccguggagugccccagcuucagcagcgccgcccccagcgacgccagcgccauggccagccccaugaacggcgaggagugcaugcuggccguggacaucgaggacagacugagccccaaccccuggcaggagaagagagagaucgugagcagcgaggacgccgugacccccagcgccgugacccccagcgcccccagcgccagcgccagacccuucauccccgugaccgacgaccugggcgccgccagcaucaucgccgagaccaugaccaagaccaaggaggacguggagagccagaacaaggccgccggccccgagccccaggcccuggacgaguucaccagccugcugaucgccgacgacaccagaguggugguggaccugcugaagcugagcgugugcagcagagccggcgacagaggcagagacgugcugagcgccgugcugagcggcaugggcaccgccuacccccagguggccgacaugcugcuggagcugugcgugaccgagcuggaggacguggccaccgacagccagagcggcagacugagcagccagcccguggugguggagagcagccaccccuacaccgacgacaccagcaccagcggcaccgugaagauccccggcgccgagggccugagaguggaguucgacagacagugcagcaccgagagaagacacgacccccugaccgugauggacggcgugaacagaaucgugagcgugagaagcggcagagaguggagcgacuggagcagcgagcugagaauccccggcgacgagcugaaguggaaguucaucagcgacggcagcgugaacggcuggggcuggagauucaccguguaccccaucaugcccgccgccggccccaaggagcugcugagcgacagaugcgugcugagcugccccagcauggaccuggugaccugccugcuggacuucagacugaaccuggccagcaacagaagcaucgugcccagacuggccgccagccuggccgccugcgcccagcugagcgcccuggccgccagccacagaaugugggcccugcagagacugagaaagcugcugaccaccgaguucggccagagcaucaacaucaacagacugcugggcgagaacgacggcgagaccagagcccugagcuucaccggcagcgcccuggccgcccuggugaagggccugcccgaggcccugcagagacaguucgaguacgaggaccccaucgugagaggcggcaagcagcugcugcacagccccuucuucaaggugcugguggcccuggccugcgaccuggagcuggacacccugcccugcugcgccgagacccacaagugggccugguucagaagauacugcauggccagcagaguggccguggcccuggacaagagaaccccccugcccagacuguuccuggacgagguggccaagaagaucagagagcugauggccgacagcgagaacauggacgugcugcacgagagccacgacaucuucaagagagagcaggacgagcagcuggugcaguggaugaacagaagacccgacgacuggacccugagcgccggcggcagcggcaccaucuacggcuggggccacaaccacagaggccagcugggcggcaucgagggcgccaaggugaaggugcccacccccugcgaggcccuggccacccugagacccgugcagcugaucggcggcgagcagacccuguucgccgugaccgccgacggcaagcuguacgccaccggcuacggcgccggcggcagacugggcaucggcggcaccgagagcgugagcacccccacccugcuggagagcauccagcacguguucaucaagaagguggccgugaacagcggcggcaagcacugccuggcccugagcagcgagggcgagguguacagcuggggcgaggccgaggacggcaagcugggccacggcaacagaagccccugcgacagacccagagugaucgagagccugagaggcaucgaggugguggacguggccgccggcggcgcccacagcgccugcgugaccgccgccggcgaccuguacaccuggggcaagggcagauacggcagacugggccacagcgacagcgaggaccagcugaagcccaagcugguggaggcccugcagggccacagagugguggacaucgccugcggcagcggcgacgcccagacccugugccugaccgacgacgacaccguguggagcuggggcgacggcgacuacggcaagcugggcagaggcggcagcgacggcugcaaggugcccaugaagaucgacagccugaccggccugggcguggugaagguggagugcggcagccaguucagcguggcccugaccaagagcggcgccguguacaccuggggcaagggcgacuaccacagacugggccacggcagcgacgaccacgugagaagacccagacaggugcagggccugcagggcaagaaggugaucgccaucgccaccggcagccugcacugcgugugcugcaccgaggacggcgagguguacaccuggggcgacaacgacgagggccagcugggcgacggcaccaccaacgccauccagagacccagacugguggccgcccugcagggcaagaaggugaacagaguggccugcggcagcgcccacacccuggccuggagcaccagcaagcccgccagcgccggcaagcugcccgcccaggugcccauggaguacaaccaccugcaggagauccccaucaucgcccugagaaacagacugcugcugcugcaccaccugagcgagcuguucugccccugcauccccauguucgaccuggagggcagccuggacgagaccggccugggccccagcgugggcuucgacacccugagaggcauccugaucagccagggcaaggaggccgccuucagaaagguggugcaggccaccauggugagagacagacagcacggccccgugguggagcugaacagaauccaggugaagagaagcagaagcaagggcggccuggccggccccgacggcaccaagagcguguucggccagaugugcgccaagaugagcagcuucggccccgacagccugcugcugccccacagaguguggaaggugaaguucgugggcgagagcguggacgacugcggcggcggcuacagcgagagcaucgccgagaucugcgaggagcugcagaacggccugaccccccugcugaucgugacccccaacggcagagacgagagcggcgccaacagagacugcuaccugcugagccccgccgccagagcccccgugcacagcagcauguucagauuccugggcgugcugcugggcaucgccaucagaaccggcagcccccugagccugaaccuggccgagcccguguggaagcagcuggccggcaugagccugaccaucgccgaccugagcgagguggacaaggacuucauccccggccugauguacaucagagacaacgaggccaccagcgaggaguucgaggccaugagccugcccuucaccgugcccagcgccagcggccaggacauccagcugagcagcaagcacacccacaucacccuggacaacagagccgaguacgugagacuggccaucaacuacagacugcacgaguucgacgagcagguggccgccgugagagagggcauggccagaguggugcccgugccccugcugagccuguucaccggcuacgagcuggagaccauggugugcggcagccccgacaucccccugcaccugcugaagagcguggccaccuacaagggcaucgagcccagcgccagccugauccagugguucugggaggugauggagagcuucagcaacaccgagagaagccuguuccugagauucguguggggcagaaccagacugcccagaaccaucgccgacuucagaggcagagacuucgugauccaggugcuggacaaguacaacccccccgaccacuuccugcccgagagcuacaccugcuucuuccugcugaagcugcccagauacagcugcaagcaggugcuggaggagaagcugaaguacgccauccacuucugcaagagcaucgacaccgacgacuacgccagaaucgcccugaccggcgagcccgccgccgacgacagcagcgacgacagcgacaacgaggacguggacagcuucgccagcgacagcacccaggacuaccugaccggccacuaa

SEQ ID NO: 17999 - RNA, 2799 nt, Artificial Sequence
  HERC3__Homo_sapiens__NP_001258531
augaccaccgaggacagcguggccgugcccagacugauccagaagcugaaccagcagaccauccugcaggugagcugcggcaacuggcacugccuggcccuggccgccgacggccaguucuucaccuggggcaagaacagccacggccagcugggccugggcaaggaguuccccagccaggccagcccccagagagugagaagccuggagggcaucccccuggcccagguggccgccggcggcgcccacagcuucgcccugagccugagcggcgccguguucggcuggggcaugaacaacgccggccagcugggccugagcgacgagaaggacagagagagccccugccacgugaagcugcugagaacccagaaggugguguacaucagcugcggcgaggagcacaccgccgugcugaccaagagcggcggcguguucaccuucggcgccggcagcugcggccagcugggccacgacagcaugaacgacgaggugaaccccagaagagugcuggagcugaugggcagcgaggugacccagaucgccugcggcagacagcacacccuggccuucgugcccagcagcggccugaucuacgccuucggcugcggcgccagaggccagcugggcaccggccacaccugcaacgugaagugccccagccccgugaagggcuacugggccgcccacagcggccagcugagcgccagagccgacagauucaaguaccacaucgugaagcagaucuucagcggcggcgaccagaccuucgugcugugcagcaaguacgagaacuacagccccgccguggacuucagaaccaugaaccaggcccacuacaccagccugaucaacgacgagaccaucgccguguggagacagaagcugagcgagcacaacaacgccaacaccaucaacggcguggugcagauccugagcagcgccgccugcuggaacggcagcuuccuggagaagaagaucgacgagcacuucaagaccagccccaagauccccggcaucgaccugaacagcaccagagugcuguucgagaagcugaugaacagccagcacagcaugauccuggagcagauccugaacagcuucgagagcugccugaucccccagcugagcagcagcccccccgacguggaggccaugagaaucuaccugauccugcccgaguucccccugcugcaggacagcaaguacuacaucacccugaccaucccccuggccauggccauccugagacuggacaccaaccccagcaaggugcuggacaacugguggagccaggugugccccaaguacuucaugaagcuggugaaccuguacaagggcgccgugcuguaccugcugagaggcagaaagaccuuccugauccccgugcuguucaacaacuacaucaccgccgcccugaagcugcuggagaagcuguacaaggugaaccugaaggugaagcacguggaguacgacaccuucuacauccccgagaucagcaaccugguggacauccaggaggacuaccugaugugguuccugcaccaggccggcaugaaggccagacccagcaucauccaggacaccgugacccugugcagcuaccccuucaucuucgacgcccaggccaagaccaagaugcugcagaccgacgccgagcugcagaugcagguggccgugaacggcgccaaccugcagaacguguucaugcugcugacccuggagccccugcuggccagaagccccuuccuggugcugcacgugagaagaaacaaccuggugggcgacgcccugagagagcugagcauccacagcgacaucgaccugaagaagccccugaaggugaucuucgacggcgaggaggccguggacgccggcggcgugaccaaggaguucuuccugcugcugcugaaggagcugcugaaccccaucuacggcauguucaccuacuaccaggacagcaaccugcugugguucagcgacaccugcuucguggagcacaacugguuccaccugaucggcaucaccugcggccuggccaucuacaacagcaccgugguggaccugcacuucccccuggcccuguacaagaagcugcugaacgugaagcccggccuggaggaccugaaggagcugagccccaccgagggcagaagccugcaggagcugcuggacuaccccggcgaggacguggaggagaccuucugccugaacuucaccaucugcagagagagcuacggcgugaucgagcagaagaagcugauccccggcggcgacaacgugaccgugugcaaggacaacagacaggaguucguggacgccuacgugaacuacguguuccagaucagcgugcacgagugguacaccgccuucagcagcggcuuccugaaggugugcggcggcaaggugcuggagcuguuccagcccagcgagcugagagccaugauggugggcaacagcaacuacaacugggaggagcuggaggagaccgccaucuacaagggcgacuacagcgccacccaccccaccgugaagcuguucugggagaccuuccacgaguucccccuggagaagaagaagaaguuccugcuguuccugaccggcagcgacagaauccccaucuacggcauggccagccugcagaucgugauccagagcaccgccagcggcgaggaguaccugcccguggcccacaccugcuacaaccugcuggaccugcccaaguacagcagcaaggagauccugagcgccagacugacccaggcccuggacaacuacgagggcuucagccuggccuaa

SEQ ID NO: 18000 - RNA, 3075 nt, Artificial Sequence
  HERC5__Homo_sapiens__NP_057407
auggagagaagaagcagaagaaagagcagaagaaacggcagaagcaccgccggcaaggccgccgccacccagcccgccaagagccccggcgcccagcuguggcuguuccccagcgccgccggccugcacagagcccugcugagaagaguggaggugaccagacagcugugcugcagccccggcagacuggccgugcuggagagaggcggcgccggcgugcaggugcaccagcugcuggccggcagcggcggcgccagaacccccaagugcaucaagcugggcaagaacaugaagauccacagcguggaccagggcgccgagcacaugcugauccugagcagcgacggcaagcccuucgaguacgacaacuacagcaugaagcaccugagauucgagagcauccugcaggagaagaagaucauccagaucaccugcggcgacuaccacagccuggcccugagcaagggcggcgagcuguucgccuggggccagaaccugcacggccagcugggcgugggcagaaaguuccccagcaccaccaccccccagaucguggagcaccuggccggcgugccccuggcccagaucagcgccggcgaggcccacagcauggcccugagcaugagcggcaacaucuacagcuggggcaagaacgagugcggccagcugggccugggccacaccgagagcaaggacgaccccagccugaucgagggccuggacaaccagaagguggaguucguggccugcggcggcagccacagcgcccugcugacccaggacggccugcuguucaccuucggcgccggcaagcacggccagcugggccacaacagcacccagaacgagcugagacccugccugguggccgagcuggugggcuacagagugacccagaucgccugcggcagauggcacacccuggccuacgugagcgaccugggcaagguguucagcuucggcagcggcaaggacggccagcugggcaacggcggcaccagagaccagcugaugccccugcccgugaaggugagcagcagcgaggagcugaagcuggagagccacaccagcgagaaggagcugaucaugaucgccggcggcaaccagagcauccugcuguggaucaagaaggagaacagcuacgugaaccugaagagaaccauccccacccugaacgagggcaccgugaagagauggaucgccgacguggagaccaagagauggcagagcaccaagagagagauccaggagaucuucagcagccccgccugccugaccggcagcuuccugagaaagagaagaaccaccgagaugaugcccguguaccuggaccugaacaaggccagaaacaucuucaaggagcugacccagaaggacuggaucaccaacaugaucaccaccugccugaaggacaaccugcugaagagacugcccuuccacagccccccccaggaggcccuggagaucuucuuccugcugcccgagugccccaugaugcacaucagcaacaacugggagagccugguggugcccuucgccaagguggugugcaagaugagcgaccagagcagccuggugcuggaggaguacugggccacccugcaggagagcaccuucagcaagcuggugcagauguucaagaccgccgugaucugccagcuggacuacugggacgagagcgccgaggagaacggcaacgugcaggcccugcuggagaugcugaagaagcugcacagagugaaccaggugaagugccagcugcccgagagcaucuuccagguggacgagcugcugcacagacugaacuucuucguggaggugugcagaagauaccuguggaagaugaccguggacgccagcgagaacgugcagugcugcgugaucuucagccacuuccccuucaucuucaacaaccugagcaagaucaagcugcugcacaccgacacccugcugaagaucgagagcaagaagcacaaggccuaccugagaagcgccgccaucgaggaggagagagagagcgaguucgcccugagacccaccuucgaccugaccgugagaagaaaccaccugaucgaggacgugcugaaccagcugagccaguucgagaacgaggaccugagaaaggagcugugggugagcuucagcggcgagaucggcuacgaccugggcggcgugaagaaggaguucuucuacugccuguucgccgagaugauccagcccgaguacggcauguucauguaccccgagggcgccagcugcaugugguuccccgugaagcccaaguucgagaagaagagauacuucuucuucggcgugcugugcggccugagccuguucaacugcaacguggccaaccugcccuucccccuggcccuguucaagaagcugcuggaccagaugcccagccuggaggaccugaaggagcugagccccgaccugggcaagaaccugcagacccugcuggacgacgagggcgacaacuucgaggagguguucuacauccacuucaacgugcacugggacagaaacgacaccaaccugauccccaacggcagcagcaucaccgugaaccagaccaacaagagagacuacgugagcaaguacaucaacuacaucuucaacgacagcgugaaggccguguacgaggaguucagaagaggcuucuacaagaugugcgacgaggacaucaucaagcuguuccaccccgaggagcugaaggacgugaucgugggcaacaccgacuacgacuggaagaccuucgagaagaacgccagauacgagcccggcuacaacagcagccaccccaccaucgugauguucuggaaggccuuccacaagcugacccuggaggagaagaagaaguuccugguguuccugaccggcaccgacagacugcagaugaaggaccugaacaacaugaagaucaccuucugcugccccgagagcuggaacgagagagaccccaucagagcccugaccugcuucagcgugcuguuccugcccaaguacagcaccauggagaccguggaggaggcccugcaggaggccaucaacaacaacagaggcuucggcuaa

SEQ ID NO: 18001 - RNA, 2961 nt, Artificial Sequence
  HERC6__Homo_sapiens__NP_001158608
auguacuucugcuggggcgccgacagcagagagcugcagagaagaagaaccgccggcagccccggcgccgagcugcugcaggccgccagcggcgagagacacagccugcugcugcugaccaaccacagagugcugagcugcggcgacaacagcagaggccagcugggcagaagaggcgcccagagaggcgagcugcccgagcccauccaggcccuggagacccugaucguggaccuggugagcugcggcaaggagcacagccuggccgugugccacaagggcagaguguucgccuggggcgccggcagcgagggccagcugggcaucggcgaguucaaggagaucagcuucacccccaagaagaucaugacccugaacgacaucaagaucauccaggugagcugcggccacuaccacagccuggcccugagcaaggacagccagguguucagcuggggcaagaacagccacggccagcugggccugggcaaggaguuccccagccaggccagcccccagagagugagaagccuggagggcaucccccuggcccagguggccgccggcggcgcccacagcuucgcccugagccugugcggcaccagcuucggcuggggcagcaacagcgccggccagcuggcccugagcggcagaaacgugcccgugcagagcaacaagccccugagcgugggcgcccugaagaaccugggcgugguguacaucagcugcggcgacgcccacaccgccgugcugacccaggacggcaagguguucaccuucggcgacaacagaagcggccagcugggcuacagccccacccccgagaagagaggcccccagcugguggagagaaucgacggccuggugagccagaucgacugcggcagcuaccacacccuggccuacgugcacaccaccggccagguggugagcuucggccacggccccagcgacaccagcaagcccacccaccccgaggcccugaccgagaacuucgacaucagcugccugaucagcgccgaggacuucguggacgugcaggugaagcacaucuucgccggcaccuacgccaacuucgugaccacccaccaggacaccagcagcaccagagcccccggcaagacccugcccgagaucagcagaaucagccagagcauggccgagaaguggaucgccgugaagagaagaagcaccgagcacgagauggccaagagcgagaucagaaugaucuucagcagccccgccugccugaccgccagcuuccugaagaagagaggcaccggcgagaccaccagcaucgacguggaccuggagauggccagagacaccuucaagaagcugaccaagaaggaguggaucagcagcaugaucaccaccugccuggaggacgaccugcugagagcccugcccugccacagcccccaccaggaggcccugagcguguuccugcugcugcccgagugccccgugaugcacgacagcaagaacuggaagaaccugguggugcccuucgccaaggccgugugcgagaugagcaagcagagccugcaggugcugaagaagugcugggccuuccugcaggagagcagccugaacccccugauccagaugcugaaggccgccaucaucagccagcugcugcaccagaccaagaccgagcaggaccacugcaacgugaaggcccugcugggcaugaugaaggagcugcacaaggugaacaaggccaacugcagacugcccgagaacaccuucaacaucaacgagcugagcaaccugcugaacuucuacaucgacagaggcagacagcuguucagagacaaccaccugaugagcgagaagaaggccuacaugcugaugcacgagaccauccugcagaagaaggacgaguucccccccagccccagauucauccugagagugagaagaagcagacuggugaaggacgcccugagacagcugagccaggccgaggccaccgacuucugcaaggugcuggugguggaguucaucaacgagaucugccccgagagcggcggcgugagcagcgaguucuuccacugcauguucgaggagaugaccaagcccgaguacggcauguucauguaccccgagaugggcagcugcaugugguuccccgccaagcccaagcccgagaagaagagauacuuccuguucggcaugcugugcggccugagccuguucaaccugaacguggccaaccugcccuucccccuggcccuguacaagaagcugcuggaccagaagcccagccuggaggaccugaaggagcugagccccagacugggcaagagccugcaggaggugcuggacgacgccgccgacgacaucggcgacgcccugugcaucagauucagcauccacugggaccagaacgacguggaccugauccccaacggcaucagcauccccguggaccagaccaacaagagagacuacgugagcaaguacaucgacuacaucuucaacgugagcgugaaggccguguacgaggaguuccagagaggcuucuacagagugugcgagaaggagauccugagacacuucuaccccgaggagcugaugaccgccaucaucggcaacaccgacuacgacuggaagcaguucgagcagaacagcaaguacgagcagggcuaccagaagagccaccccaccauccagcuguucuggaaggccuuccacaagcugacccuggacgagaagaagaaguuccuguucuuccugaccggcagagacagacugcacgccagaggcauccagaagauggagaucguguucagaugccccgagaccuucagcgagagagaccaccccaccagcaucaccugccacaacauccugagccugcccaaguacagcaccauggagagaauggaggaggcccugcagguggccaucaacaacaacagaggcuucgugagccccaugcugacccagagcuaa

SEQ ID NO: 18002 - RNA, 1173 nt, Artificial Sequence
  HERPUD1__Homo_sapiens__NP_001010989
auggagagcgagaccgagcccgagcccgugacccugcuggugaagagccccaaccagagacacagagaccuggagcugagcggcgacagaggcuggagcgugggccaccugaaggcccaccugagcagaguguaccccgagagacccagacccgaggaccagagacugaucuacagcggcaagcugcugcuggaccaccagugccugagagaccugcugcccaaggagaagagacacgugcugcaccuggugugcaacgugaagagccccagcaagaugcccgagaucaacgccaagguggccgagagcaccgaggagcccgccggcagcaacagaggccaguaccccgaggacagcagcagcgacggccugagacagagagaggugcugagaaaccugagcagccccggcugggagaacaucagcagacccgaggccgcccagcaggccuuccagggccugggccccggcuucagcggcuacacccccuacggcuggcugcagcugagcugguuccagcagaucuacgccagacaguacuacaugcaguaccuggccgccaccgccgccagcggcgccuucgugcccccccccagcgcccaggagauccccguggugagcgcccccgcccccgcccccauccacaaccaguuccccgccgagaaccagcccgccaaccagaacgccgccccccaggugguggugaaccccggcgccaaccagaaccugagaaugaacgcccagggcggccccaucguggaggaggacgacgagaucaacagagacuggcuggacuggaccuacagcgccgccaccuucagcguguuccugagcauccuguacuucuacagcagccugagcagauuccugauggugaugggcgccaccguggugauguaccugcaccacgugggcugguuccccuucagacccagacccgugcagaacuuccccaacgacggccccccccccgacguggugaaccaggaccccaacaacaaccugcaggagggcaccgaccccgagaccgaggaccccaaccaccugccccccgacagagacgugcuggacggcgagcagaccagccccagcuucaugagcaccgccuggcugguguucaagaccuucuucgccagccugcugcccgagggcccccccgccaucgccaacuaa

SEQ ID NO: 18003 - RNA, 843 nt, Artificial Sequence
  HES1__Homo_sapiens__NP_005515
augcccgccgacaucauggagaagaacagcagcagccccguggccgccacccccgccagcgugaacaccacccccgacaagcccaagaccgccagcgagcacagaaagagcagcaagcccaucauggagaagagaagaagagccagaaucaacgagagccugagccagcugaagacccugauccuggacgcccugaagaaggacagcagcagacacagcaagcuggagaaggccgacauccuggagaugaccgugaagcaccugagaaaccugcagagagcccagaugaccgccgcccugagcaccgaccccagcgugcugggcaaguacagagccggcuucagcgagugcaugaacgaggugaccagauuccugagcaccugcgagggcgugaacaccgaggugagaaccagacugcugggccaccuggccaacugcaugacccagaucaacgccaugaccuaccccggccagccccaccccgcccugcaggccccccccccccccccccccggccccggcggcccccagcacgcccccuucgcccccccccccccccuggugcccauccccggcggcgccgcccccccccccggcggcgcccccugcaagcugggcagccaggccggcgaggccgccaagguguucggcggcuuccagguggugcccgcccccgacggccaguucgccuuccugauccccaacggcgccuucgcccacagcggccccgugauccccguguacaccagcaacagcggcaccagcgugggccccaacgccgugagccccagcagcggccccagccugaccgccgacagcauguggagacccuggagaaacuaa

SEQ ID NO: 18004 - RNA, 522 nt, Artificial Sequence
  HES2__Homo_sapiens__XP_011539915
augggccugcccagaagagccggcgacgccgccgagcugagaaagagccugaagccccugcuggagaagagaagaagagccagaaucaaccagagccugagccagcugaagggccugauccugccccugcugggcagagagaacagcaacugcagcaagcuggagaaggccgacgugcuggagaugaccgugagauuccugcaggagcugcccgccagcagcuggcccaccgccgccccccugcccugcgacagcuacagagagggcuacagcgccugcguggccagacuggccagagugcugcccgccugcagagugcuggagcccgccgugagcgccagacugcuggagcaccuguggagaagagccgccagcgccacccuggacggcggcagagccggcgacagcagcggccccagcgcccccgcccccgcccccgccagcgcccccgagcccgccagcgcccccgugcccagcccccccagcccccccugcggccccggccuguggagacccugguaa

SEQ ID NO: 18005 - RNA, 669 nt, Artificial Sequence
  HES6__Homo_sapiens__NP_001136325
auggccccccccgccgcccccggcagagacagagugggcagagaggacgaggacggcugggagaccagaggcgacagaaaggccagaaagccccugguggagaagaagagaagagccagaaucaacgagagccugcaggagcugagacugcugcuggccggcgccgaggccaagcuggagaacgccgaggugcuggagcugaccgugagaagagugcagggcgugcugagaggcagagccagagagagagagcagcugcaggccgaggccagcgagagauucgccgccggcuacauccagugcaugcacgaggugcacaccuucgugagcaccugccaggccaucgacgccaccguggccgccgagcugcugaaccaccugcuggagagcaugccccugagagagggcagcagcuuccaggaccugcugggcgacgcccuggccggcccccccagagcccccggcagaagcggcuggcccgccggcggcgcccccggcagccccauccccagcccccccggccccggcgacgaccugugcagcgaccuggaggaggcccccgaggccgagcugagccaggcccccgccgagggccccgaccuggugcccgccgcccugggcagccugaccaccgcccagaucgccagaagcguguggagacccugguaa

SEQ ID NO: 18006 - RNA, 693 nt, Artificial Sequence
  HES7__Homo_sapiens__NP_001159439
auggugaccagagacagagccgagaacagagacggccccaagaugcugaagccccugguggagaagagaagaagagacagaaucaacagaagccuggaggagcugagacugcugcugcuggagagaaccagagaccagaaccugagaaaccccaagcuggagaaggccgagauccuggaguucgccgugggcuaccugagagagagaagcagaguggagccccccgccgccgccgcccccggcgugcccagaagccccgugcaggacgccgaggcccuggccagcugcuaccugagcggcuucagagagugccugcugagacuggccgccuucgcccacgacgccagccccgccgccagagcccagcuguucagcgcccugcacggcuaccugagacccaagccccccagacccaagcccguggaccccagaccccccgcccccagacccagccuggaccccgccgcccccgcccugggccccgcccugcaccagagaccccccgugcaccagggccaccccagccccagaugcgccuggagccccagccugugcagccccagagccggcgacagcggcgcccccgccccccugaccggccugcugcccccccccccccccccccacagacaggacggcgcccccaaggccccccugccccccccccccgccuucuggagacccuggcccuaa

SEQ ID NO: 18007 - RNA, 558 nt, Artificial Sequence
  HESX1__Homo_sapiens__NP_003856
augagccccagccugcaggagggcgcccagcugggcgagaacaagcccagcaccugcagcuucagcaucgagagaauccugggccuggaccagaagaaggacugcgugccccugaugaagccccacagacccugggccgacaccugcagcagcagcggcaaggacggcaaccugugccugcacgugcccaacccccccagcggcaucagcuuccccagcgugguggaccaccccaugcccgaggagagagccagcaaguacgagaacuacuucagcgccagcgagagacugagccugaagagagagcugagcugguacagaggcagaagacccagaaccgccuucacccagaaccagaucgaggugcuggagaacguguucagagugaacugcuaccccggcaucgacaucagagaggaccuggcccagaagcugaaccuggaggaggacagaauccagaucugguuccagaacagaagagccaagcugaagagaagccacagagagagccaguuccugauggccaagaagaacuucaacaccaaccugcuggaguaa

SEQ ID NO: 18008 - RNA, 1590 nt, Artificial Sequence
  HEXA__Homo_sapiens__NP_000511
augaccagcagcagacugugguucagccugcugcuggccgccgccuucgccggcagagccaccgcccuguggcccuggccccagaacuuccagaccagcgaccagagauacgugcuguaccccaacaacuuccaguuccaguacgacgugagcagcgccgcccagcccggcugcagcgugcuggacgaggccuuccagagauacagagaccugcuguucggcagcggcagcuggcccagacccuaccugaccggcaagagacacacccuggagaagaacgugcugguggugagcguggugacccccggcugcaaccagcugcccacccuggagagcguggagaacuacacccugaccaucaacgacgaccagugccugcugcugagcgagaccguguggggcgcccugagaggccuggagaccuucagccagcugguguggaagagcgccgagggcaccuucuucaucaacaagaccgagaucgaggacuuccccagauucccccacagaggccugcugcuggacaccagcagacacuaccugccccugagcagcauccuggacacccuggacgugauggccuacaacaagcugaacguguuccacuggcaccugguggacgaccccagcuuccccuacgagagcuucaccuuccccgagcugaugagaaagggcagcuacaaccccgugacccacaucuacaccgcccaggacgugaaggaggugaucgaguacgccagacugagaggcaucagagugcuggccgaguucgacacccccggccacacccugagcuggggccccggcauccccggccugcugacccccugcuacagcggcagcgagcccagcggcaccuucggccccgugaaccccagccugaacaacaccuacgaguucaugagcaccuucuuccuggaggugagcagcguguuccccgacuucuaccugcaccugggcggcgacgagguggacuucaccugcuggaagagcaaccccgagauccaggacuucaugagaaagaagggcuucggcgaggacuucaagcagcuggagagcuucuacauccagacccugcuggacaucgugagcagcuacggcaagggcuacgugguguggcaggagguguucgacaacaaggugaagauccagcccgacaccaucauccagguguggagagaggacauccccgugaacuacaugaaggagcuggagcuggugaccaaggccggcuucagagcccugcugagcgcccccugguaccugaacagaaucagcuacggccccgacuggaaggacuucuacaucguggagccccuggccuucgagggcacccccgagcagaaggcccuggugaucggcggcgaggccugcauguggggcgaguacguggacaacaccaaccuggugcccagacuguggcccagagccggcgccguggccgagagacuguggagcaacaagcugaccagcgaccugaccuucgccuacgagagacugagccacuucagaugcgagcugcugagaagaggcgugcaggcccagccccugaacgugggcuucugcgagcaggaguucgagcagaccuaa

SEQ ID NO: 18009 - RNA, 1671 nt, Artificial Sequence
  HEXB__Homo_sapiens__NP_000512
auggagcugugcggccugggccugcccagaccccccaugcugcuggcccugcugcuggccacccugcuggccgccaugcuggcccugcugacccagguggcccugguggugcagguggccgaggccgccagagcccccagcgugagcgccaagcccggccccgcccuguggccccugccccugagcgugaagaugacccccaaccugcugcaccuggcccccgagaacuucuacaucagccacagccccaacagcaccgccggccccagcugcacccugcuggaggaggccuucagaagauaccacggcuacaucuucggcuucuacaaguggcaccacgagcccgccgaguuccaggccaagacccaggugcagcagcugcuggugagcaucacccugcagagcgagugcgacgccuuccccaacaucagcagcgacgagagcuacacccugcuggugaaggagcccguggccgugcugaaggccaacagaguguggggcgcccugagaggccuggagaccuucagccagcugguguaccaggacagcuacggcaccuucaccaucaacgagagcaccaucaucgacagccccagauucagccacagaggcauccugaucgacaccagcagacacuaccugcccgugaagaucauccugaagacccuggacgccauggccuucaacaaguucaacgugcugcacuggcacaucguggacgaccagagcuuccccuaccagagcaucaccuuccccgagcugagcaacaagggcagcuacagccugagccacguguacacccccaacgacgugagaauggugaucgaguacgccagacugagaggcaucagagugcugcccgaguucgacacccccggccacacccugagcuggggcaagggccagaaggaccugcugacccccugcuacagcagacagaacaagcuggacagcuucggccccaucaaccccacccugaacaccaccuacagcuuccugaccaccuucuucaaggagaucagcgagguguuccccgaccaguucauccaccugggcggcgacgagguggaguucaagugcugggagagcaaccccaagauccaggacuucaugagacagaagggcuucggcaccgacuucaagaagcuggagagcuucuacauccagaaggugcuggacaucaucgccaccaucaacaagggcagcaucguguggcaggagguguucgacgacaaggccaagcuggcccccggcaccaucguggagguguggaaggacagcgccuaccccgaggagcugagcagagugaccgccagcggcuuccccgugauccugagcgcccccugguaccuggaccugaucagcuacggccaggacuggagaaaguacuacaagguggagccccuggacuucggcggcacccagaagcagaagcagcuguucaucggcggcgaggccugccuguggggcgaguacguggacgccaccaaccugacccccagacuguggcccagagccagcgccgugggcgagagacuguggagcagcaaggacgugagagacauggacgacgccuacgacagacugaccagacacagaugcagaaugguggagagaggcaucgccgcccagccccuguacgccggcuacugcaaccacgagaacauguaa

SEQ ID NO: 18010 - RNA, 1758 nt, Artificial Sequence
  HEXDC__Homo_sapiens__NP_775891
augagcggcagcacccccuuccagaugagacuggugcaccuggaccugaagggcgccccccccaaggugagcuaccugagcgagaucuucccccuguucagagcccugggcgccaacggccugcugaucgaguacgaggacauguuccccuacgagggcccccugagacugcugagagccaaguacgccuacagccccagcgagaucaaggagauccugcaccuggccggccugaacgagcuggaggugaucccccuggugcagaccuucggccacauggaguucgugcugaagcacaccgccuucgcccaccugagagaggugggcagcuuccccugcacccugaacccccacgaggccgagagccuggcccuggugggcgccaugaucgaccaggugcuggagcugcaccccggcgcccagagacugcacaucggcugcgacgagguguacuaccugggcgagggcgaggccagcagaagauggcugcagcaggagcagaacagcaccggcaagcugugccugagccacaugagagccguggccagcggcgugaaggccagaagacccagcgugaccccccuggugugggacgacaugcugagagaccugcccgaggaccagcuggccgccagcggcgugccccagcugguggagcccgugcugugggacuacaccgccgaccuggacgugcacggcaaggugcugcugaugcagaaguacagaagaugcggcuucccccagcugugggccgccagcgccuucaagggcgccaccggccccagccaggccgugccccccguggagcaccaccugagaaaccacgugcaguggcugcagguggccggcagcggccccaccgacagccugcagggcaucauccugaccggcuggcagagauacgaccacuacagcgugcugugcgagcugcugcccgccggcgugcccagccuggccgccugccugcagcugcugcugagaggcggcuucgacgaggacgugaaggccaagguggagaaccugcugggcaucagcagccuggagaagaccgaccccgugagacaggcccccugcagcccccccugcccccugcugccccugcccuuccccagacccuggagacagcuguucagcgccggccugagcgccggcagaggccccgcccccagccuggccgccaccagccugccccugagccacaagagcgccagcaucugcgccgcccuguggaugagaugcuggagagccaccggcaugagccuggccggcagcgcccccaccaccgccagcggcagcagcagcaccagaagcugguucagcaccagcagcccccagagaagcgccagcuggcacagcggcgcccccagcugcagaagcuggagacugcccugcagcuggcugagcaccagaaugcccuggagaagcggcuggagaaagaccugcacccccgccugcagcggcugcaagcugugcugcagaaccagcgccagaugccugccccccagaugccacccccccgcccuggccggcacccugcugagaacccccgagggcagagcccacgccagaggccugcugcuggaggccggcggcgcccugcacugccagauggccugggccaucagagcccacgugggcguggugcccagcggccccgccgugagcugcccccacagcgugcccgagggccccggccagccccugggcgagagacuggagaacaccgagggcagcagcaccggcagacccgcccuguaa

SEQ ID NO: 18011 - RNA, 1080 nt, Artificial Sequence
  HEXIM1__Homo_sapiens__NP_006451
auggccgagcccuuccugagcgaguaccagcaccagccccagaccagcaacugcaccggcgccgccgccgugcaggaggagcugaaccccgagagaccccccggcgccgaggagagagugcccgaggaggacagcagauggcagagcagagccuucccccagcugggcggcagacccggccccgagggcgagggcagccuggagagccagccccccccccugcagacccaggccugccccgagagcagcugccugagagagggcgagaagggccagaacggcgacgacagcagcgccggcggcgacuuccccccccccgccgagguggagcccacccccgaggccgagcugcuggcccagcccugccacgacagcgaggccagcaagcugggcgcccccgccgccggcggcgaggaggaguggggccagcagcagagacagcugggcaagaagaagcacagaagaagacccagcaagaagaagagacacuggaagcccuacuacaagcugaccugggaggagaagaagaaguucgacgagaagcagagccugagagccagcagaaucagagccgagauguucgccaagggccagcccguggcccccuacaacaccacccaguuccugauggacgaccacgaccaggaggagcccgaccugaagaccggccuguacagcaagagagccgccgccaagagcgacgacaccagcgacgacgacuucauggaggagggcggcgaggaggacggcggcagcgacggcaugggcggcgacggcagcgaguuccugcagagagacuucagcgagaccuacgagagauaccacaccgagagccugcagaacaugagcaagcaggagcugaucaaggaguaccuggagcuggagaagugccugagcagaauggaggacgagaacaacagacugagacuggagagcaagagacugggcggcgacgacgccagagugagagagcuggagcuggagcuggacagacugagagccgagaaccugcagcugcugaccgagaacgagcugcacagacagcaggagagagccccccugagcaaguucggcgacuaa

SEQ ID NO: 18012 - RNA, 927 nt, Artificial Sequence
  HEY1__Homo_sapiens__NP_001035798
augaagagagcccaccccgaguacagcagcagcgacagcgagcuggacgagaccaucgagguggagaaggagagcgccgacgagaacggcaaccugagcagcgcccugggcagcaugagccccaccaccagcagccagauccuggccagaaagagaagaagaggcaucaucgagaagagaagaagagacagaaucaacaacagccugagcgagcugagaagacuggugcccagcgccuucgagaagcaggugauggagcagggcagcgccaagcuggagaaggccgagauccugcagaugaccguggaccaccugaagaugcugcacaccgccggcggcaagggcuacuucgacgcccacgcccuggccauggacuacagaagccugggcuucagagagugccuggccgagguggccagauaccugagcaucaucgagggccuggacgccagcgacccccugagagugagacuggugagccaccugaacaacuacgccagccagagagaggccgccagcggcgcccacgccggccugggccacauccccuggggcaccguguucggccaccacccccacaucgcccacccccugcugcugccccagaacggccacggcaacgccggcaccaccgccagccccaccgagccccaccaccagggcagacugggcagcgcccaccccgaggcccccgcccugagagccccccccagcggcagccugggccccgugcugcccguggugaccagcgccagcaagcugagccccccccugcugagcagcguggccagccugagcgccuuccccuucagcuucggcagcuuccaccugcugagccccaacgcccugagccccagcgcccccacccaggccgccaaccugggcaagcccuacagacccuggggcaccgagaucggcgccuucuaa

SEQ ID NO: 18013 - RNA, 1014 nt, Artificial Sequence
  HEY2__Homo_sapiens__NP_036391
augaagagacccugcgaggagaccaccagcgagagcgacauggacgagaccaucgacgugggcagcgagaacaacuacagcggccagagcaccagcagcgugaucagacugaacagccccaccaccaccagccagaucauggccagaaagaagagaagaggcaucaucgagaagagaagaagagacagaaucaacaacagccugagcgagcugagaagacuggugcccaccgccuucgagaagcagggcagcgccaagcuggagaaggccgagauccugcagaugaccguggaccaccugaagaugcugcaggccaccggcggcaagggcuacuucgacgcccacgcccuggccauggacuucaugagcaucggcuucagagagugccugaccgagguggccagauaccugagcagcguggagggccuggacagcagcgacccccugagagugagacuggugagccaccugagcaccugcgccacccagagagaggccgccgccaugaccagcagcauggcccaccaccaccacccccugcacccccaccacugggccgccgccuuccaccaccugcccgccgcccugcugcagcccaacggccugcacgccagcgagagcacccccugcagacugagcaccaccagcgaggugccccccgcccacggcagcgcccugcugaccgccaccuucgcccacgccgacagcgcccugagaaugcccagcaccggcagcguggcccccugcgugcccccccugagcaccagccugcugagccugagcgccaccgugcacgccgccgccgccgccgccaccgccgccgcccacagcuucccccugagcuucgccggcgccuuccccaugcugccccccaacgccgccgccgccguggccgccgccaccgccaucagccccccccugagcgugagcgccaccagcagcccccagcagaccagcagcggcaccaacaacaagcccuacagacccuggggcaccgaggugggcgccuucuaa

SEQ ID NO: 18014 - RNA, 1047 nt, Artificial Sequence
  HFE__Homo_sapiens__NP_000401
augggccccagagccagacccgcccugcugcugcugaugcugcugcagaccgccgugcugcagggcagacugcugagaagccacagccugcacuaccuguucaugggcgccagcgagcaggaccugggccugagccuguucgaggcccugggcuacguggacgaccagcuguucguguucuacgaccacgagagcagaagaguggagcccagaacccccugggugagcagcagaaucagcagccagauguggcugcagcugagccagagccugaagggcugggaccacauguucaccguggacuucuggaccaucauggagaaccacaaccacagcaaggagagccacacccugcaggugauccugggcugcgagaugcaggaggacaacagcaccgagggcuacuggaaguacggcuacgacggccaggaccaccuggaguucugccccgacacccuggacuggagagccgccgagcccagagccuggcccaccaagcuggagugggagagacacaagaucagagccagacagaacagagccuaccuggagagagacugccccgcccagcugcagcagcugcuggagcugggcagaggcgugcuggaccagcaggugcccccccuggugaaggugacccaccacgugaccagcagcgugaccacccugagaugcagagcccugaacuacuacccccagaacaucaccaugaaguggcugaaggacaagcagcccauggacgccaaggaguucgagcccaaggacgugcugcccaacggcgacggcaccuaccagggcuggaucacccuggccgugccccccggcgaggagcagagauacaccugccagguggagcaccccggccuggaccagccccugaucgugaucugggagcccagccccagcggcacccuggugaucggcgugaucagcggcaucgccguguucguggugauccuguucaucggcauccuguucaucauccugagaaagagacagggcagcagaggcgccaugggccacuacgugcuggccgagagagaguaa

SEQ ID NO: 18015 - RNA, 4308 nt, Artificial Sequence
  HFM1__Homo_sapiens__XP_011539154
augcugaagagcaacgacugccuguucagccuggagaaccuguucuucgagaagcccgacgagguggagaaccaccccgacaacgagaagagccuggacugguuccugccccccgccccccugaucagcgagauccccgacacccaggagcuggaggaggagcuggagagccacaagcugcugggccaggagaagagacccaagaugcugaccagcaaccugaagaucaccaacgaggacaccaacuacaucagccugacccagaaguuccaguucgccuuccccagcgacaaguacgagcaggacgaccugaaccuggagggcgugggcaacaacgaccugagccacaucgccggcaagcugaccuacgccagccagaaguacaagaaccacaucggcaccgagaucgcccccgagaagagcgugcccgacgacaccaagcuggugaacuucgccgaggacaagggcgagagcaccagcguguucagaaagagacuguucaagaucagcgacaacauccacggcagcgccuacagcaacgacaacgagcuggacagccacaucggcagcgugaagaucgugcagaccgagaugaacaagggcaagagcagaaacuacagcaacagcaagcagaaguuccaguacagcgccaacguguucaccgccaacaacgccuucagcgccagcgagaucggcgagggcauguucaaggcccccagcuucagcguggccuuccagccccacgacauccaggaggugaccgagaacggccugggcagccugaaggccgugaccgagauccccgccaaguucagaagcaucuucaaggaguuccccuacuucaacuacauccagagcaaggccuucgacgaccugcuguacaccgacagaaacuucgugaucugcgcccccaccggcagcggcaagaccgugguguucgagcuggccaucaccagacugcugauggaggugccccugcccuggcugaacaucaagaucguguacauggcccccaucaaggcccugugcagccagagauucgacgacuggaaggagaaguucggccccaucggccugaacugcaaggagcugaccggcgacaccgugauggacgaccuguucgagauccagcacgcccacaucaucaugaccacccccgagaagugggacagcaugaccagaaaguggagagacaacagccuggugcagcuggugagacuguuccugaucgacgaggugcacaucgugaaggacgagaacagaggccccacccuggaggugguggugagcagaaugaagaccgugcagagcgugagccagacccugaagaacaccagcaccgccauccccaugagauucguggccgugagcgccaccauccccaacgccgaggacaucgccgaguggcugagcgacggcgagagacccgccgugugccugaagauggacgagagccacagacccgugaagcugcagaagguggugcugggcuuccccugcagcagcaaccagaccgaguucaaguucgaccugacccugaacuacaagaucgccagcgugauccagauguacagcgaccagaagcccacccugguguucugcgccaccagaaagggcgugcagcaggccgccagcgugcuggugaaggacgccaaguucaucaugaccguggagcagaagcagagacugcagaaguacgccuacagcgugagagacagcaagcugagagacauccugaaggacggcgccgccuaccaccacgccggcauggagcugagcgacagaaaggugguggagggcgccuucaccgugggcgaccugcccgugcuguucaccaccagcacccuggccaugggcgugaaccugcccgcccaccugguggugaucaagagcaccaugcacuacgccggcggccuguucgaggaguacagcgagaccgacauccugcagaugaucggcagagccggcagaccccaguucgacaccaccgccaccgccgugaucaugaccagacugagcaccagagacaaguacauccagaugcuggccugcagagacaccguggagagcagccugcacagacaccugaucgagcaccugaacgccgagaucgugcugcacaccaucaccgacgugaacaucgccguggaguggaucagaagcacccugcuguacaucagagcccugaagaaccccagccacuacggcuucgccagcggccugaacaaggacggcaucgaggccaagcugcaggagcugugccugaagaaccugaacgaccugagcagccuggaccugaucaagauggacgagggcgugaacuucaagcccaccgaggccggcagacugauggccugguacuacaucaccuucgagaccgugaagaaguucuacaccaucagcggcaaggagacccugagcgaccuggugacccugaucgccggcugcaaggaguuccuggacauccagcugagaaucaacgagaagaagacccugaacacccugaacaaggaccccaacagaaucaccaucagauuccccauggagggcagaaucaagaccagagagaugaaggugaacugccugauccaggcccagcugggcugcauccccauccaggacuucgcccugacccaggacaccgccaagaucuucagacacggcagcagaaucaccagauggcugagcgacuucguggccgcccaggagaagaaguucgccgugcugcugaacagccugauccuggccaagugcuucagaugcaagcugugggagaacagccugcacgugagcaagcagcuggagaagaucggcaucacccugagcaacgccaucgugaacgccggccugaccagcuucaagaagaucgaggagaccgacgccagagagcuggagcugauccugaacagacacccccccuucggcacccagaucaaggagaccgugauguaccugcccaaguacgagcugaagguggagcagaucaccagauacagcgacaccaccgccgagauccuggugaccgugauccugagaaacuucgagcagcugcagaccaagagaaccgccagcgacagccacuacgugacccugaucaucggcgacgccgacaaccaggugguguaccugcacaagaucaccgacagcgugcugcugaaggccggcagcugggccaagaagaucgccgugaagagagcccugaagagcgaggaccugagcaucaaccugaucagcagcgaguucgugggccuggacauccagcagaagcugaccguguucuaccuggagcccaagagauucggcaaccagaucaccaugcagagaaagagcgagacccagaucagccacagcaagcacagcgacaucagcaccaucgccggccccaacaagggcaccaccgccagcaagaagcccggcaacagagagugcaaccaccugugcaagagcaagcacaccugcggccacgacugcugcaagaucggcguggcccagaagagcgagaucaaggagagcaccaucagcagcuaccugagcgaccugagaaacagaaacgccgugagcagcgugccccccgugaagagacugaagauccagaugaacaagagccagagcguggaccugaaggaguucggcuucacccccaagcccagccugcccagcaucagcagaagcgaguaccugaacaucagcgagcugcccaucauggagcagugggaccagcccgagaucuacggcaaggugagacaggagcccagcgaguaccaggacaaggaggugcugaacgugaacuucgagcugggcaacgaggugugggacgacuucgacgacgagaaccuggaggugaccagcuucagcaccgacaccgagaagaccaagaucagcggcuucggcaacacccugagcagcagcaccagaggcagcaagcugccccugcaggagagcaagagcaaguuccagagagagaugagcaacagcuucgugagcagccacgagaugagcgacaucagccugagcaacagcgccaugcccaaguucagcgccagcagcaugaccaagcugccccagcaggccggcaacgccgugaucgugcacuuccaggagagaaagccccagaaccugagccccgagaucgagaagcagugcuucaccuucagcgagaagaaccccaacagcagcaacuacaagaagguggacuucuucaucagaaacagcgagugcaagaaggagguggacuucagcauguaccaccccgacgacgaggccgacgagaugaagagccugcugggcaucuucgacggcaucuucuaa

SEQ ID NO: 18016 - RNA, 1338 nt, Artificial Sequence
  HGD__Homo_sapiens__NP_000178
auggccgagcugaaguacaucagcggcuucggcaacgagugcagcagcgaggaccccagaugccccggcagccugcccgagggccagaacaacccccaggugugccccuacaaccuguacgccgagcagcugagcggcagcgccuucaccugccccagaagcaccaacaagagaagcuggcuguacagaauccugcccagcgugagccacaagcccuucgagagcaucgacgagggccaggugacccacaacugggacgagguggaccccgaccccaaccagcugagauggaagcccuucgagauccccaaggccagccagaagaagguggacuucgugagcggccugcacacccugugcggcgccggcgacaucaagagcaacaacggccuggccauccacaucuuccugugcaacaccagcauggagaacagaugcuucuacaacagcgacggcgacuuccugaucgugccccagaagggcaaccugcugaucuacaccgaguucggcaagaugcuggugcagcccaacgagaucugcgugauccagagaggcaugagauucagcaucgacguguucgaggagaccagaggcuacauccuggagguguacggcgugcacuucgagcugcccgaccugggccccaucggcgccaacggccuggccaaccccagagacuuccugauccccaucgccugguacgaggacagacaggugcccggcggcuacaccgugaucaacaaguaccagggcaagcuguucgccgccaagcaggacgugagccccuucaacgugguggccuggcacggcaacuacacccccuacaaguacaaccugaagaacuucauggugaucaacagcguggccuucgaccacgccgaccccagcaucuucaccgugcugaccgccaagagcgugagacccggcguggccaucgccgacuucgugaucuucccccccagauggggcguggccgacaagaccuucagaccccccuacuaccacagaaacugcaugagcgaguucaugggccugaucagaggccacuacgaggccaagcagggcggcuuccugcccggcggcggcagccugcacagcaccaugaccccccacggccccgacgccgacugcuucgagaaggccagcaaggugaagcuggcccccgagagaaucgccgacggcaccauggccuucauguucgagagcagccugagccuggccgugaccaaguggggccugaaggccagcagaugccuggacgagaacuaccacaagugcugggagccccugaagagccacuucacccccaacagcagaaaccccgccgagcccaacuaa

SEQ ID NO: 18017 - RNA, 1968 nt, Artificial Sequence
  HGFAC__Homo_sapiens__NP_001519
augggcagaugggccugggugcccagccccuggcccccccccggccugggccccuuccugcugcugcugcugcugcugcugcugcugcccagaggcuuccagccccagcccggcggcaacagaaccgagagccccgagcccaacgccaccgccacccccgccauccccaccauccuggugaccagcgugaccagcgagacccccgccaccagcgcccccgaggccgagggcccccagagcggcggccugccccccccccccagagccgugcccagcagcagcagcccccaggcccaggcccugaccgaggacggcagacccugcagauuccccuucagauacggcggcagaaugcugcacgccugcaccagcgagggcagcgcccacagaaaguggugcgccaccacccacaacuacgacagagacagagccuggggcuacugcguggaggccacccccccccccggcggccccgccgcccuggaccccugcgccagcggccccugccugaacggcggcagcugcagcaacacccaggacccccagagcuaccacugcagcugccccagagccuucaccggcaaggacugcggcaccgagaagugcuucgacgagaccagauacgaguaccuggagggcggcgacagaugggccagagugagacagggccacguggagcagugcgagugcuucggcggcagaaccuggugcgagggcaccagacacaccgccugccugagcagccccugccugaacggcggcaccugccaccugaucguggccaccggcaccaccgugugcgccugcccccccggcuucgccggcagacugugcaacaucgagcccgacgagagaugcuuccugggcaacggcaccggcuacagaggcguggccagcaccagcgccagcggccugagcugccuggccuggaacagcgaccugcuguaccaggagcugcacguggacagcgugggcgccgccgcccugcugggccugggcccccacgccuacugcagaaaccccgacaacgacgagagacccuggugcuacguggugaaggacagcgcccugagcugggaguacugcagacuggaggccugcgagagccugaccagagugcagcugagccccgaccugcuggccacccugcccgagcccgccagccccggcagacaggccugcggcagaagacacaagaagagaaccuuccugagacccagaaucaucggcggcagcagcagccugcccggcagccaccccuggcuggccgccaucuacaucggcgacagcuucugcgccggcagccuggugcacaccugcuggguggugagcgccgcccacugcuucagccacagcccccccagagacagcgugagcguggugcugggccagcacuucuucaacagaaccaccgacgugacccagaccuucggcaucgagaaguacauccccuacacccuguacagcguguucaaccccagcgaccacgaccuggugcugaucagacugaagaagaagggcgacagaugcgccaccagaagccaguucgugcagcccaucugccugcccgagcccggcagcaccuuccccgccggccacaagugccagaucgccggcuggggccaccuggacgagaacgugagcggcuacagcagcagccugagagaggcccuggugccccugguggccgaccacaagugcagcagccccgagguguacggcgccgacaucagccccaacaugcugugcgccggcuacuucgacugcaagagcgacgccugccagggcgacagcggcggcccccuggccugcgagaagaacggcguggccuaccuguacggcaucaucagcuggggcgacggcugcggcagacugcacaagcccggcguguacaccagaguggccaacuacguggacuggaucaacgacagaaucagaccccccagaagacugguggcccccagcuaa

SEQ ID NO: 18018 - RNA, 2187 nt, Artificial Sequence
  HGF__Homo_sapiens__NP_000592
augugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcuaa

SEQ ID NO: 18019 - RNA, 1173 nt, Artificial Sequence
  HGH1__Homo_sapiens__NP_057542
augggcgaggccggcgccggcgccggcgccagcggcggccccgaggccagccccgaggccgagguggugaagcugcugcccuuccuggcccccggcgccagagccgaccugcaggccgccgccgugagacacgugcuggcccugaccggcugcggccccggcagagcccugcuggccggccaggccgcccugcugcaggcccugauggagcuggcccccgccagcgcccccgccagagacgccgccagagcccuggugaaccuggccgccgaccccggccugcacgagacccugcuggccgccgaccccggccugcccgccagacugaugggcagagcccuggacccccaguggcccugggccgaggaggccgccgccgcccuggccaaccugagcagagagcccgcccccugcgccgcccugauggccgcccuggccgccgccgagcccgccgacagcggccuggagagacuggugagagcccugugcacccccggcuacaacgccagagccccccugcacuaccuggccccccugcugagcaaccugagccagagacccgccgccagagccuuccugcuggaccccgacagaugcguggugcagagacugcugccccugacccaguaccccgacagcagcgugagaagaggcggcguggugggcacccugagaaacugcugcuucgagcacagacaccacgaguggcugcugggccccgagguggacauccugcccuuccugcugcugccccuggccggccccgaggacuucagcgaggaggagauggagagacugcccguggaccugcaguaccugccccccgacaagcagagagagcccgacgccgacaucagaaagaugcugguggaggccaucaugcugcugaccgccaccgcccccggcagacagcaggugagagaccagggcgccuaccugauccugagagagcugcacagcugggagcccgagcccgacgugagaaccgccugcgagaagcugauccaggugcugaucggcgacgagcccgagagaggcauggagaaccugcuggaggugcaggugcccgaggacguggagcagcagcugcagcagcuggacugcagagagcaggagcagcuggagagagagcuggcccccgagcccuggguggagagagccacccccaccuaa

SEQ ID NO: 18020 - RNA, 2334 nt, Artificial Sequence
  HGS__Homo_sapiens__NP_004703
augggcagaggcagcggcaccuucgagagacugcuggacaaggccaccagccagcugcugcuggagaccgacugggagagcauccugcagaucugcgaccugaucagacagggcgacacccaggccaaguacgccgugaacagcaucaagaagaaggugaacgacaagaacccccacguggcccuguacgcccuggaggugauggagagcguggugaagaacugcggccagaccgugcacgacgagguggccaacaagcagaccauggaggagcugaaggaccugcugaagagacagguggaggugaacgugagaaacaagauccuguaccugauccaggccugggcccacgccuucagaaacgagcccaaguacaagguggugcaggacaccuaccagaucaugaagguggagggccacguguuccccgaguucaaggagagcgacgccauguucgccgccgagagagcccccgacuggguggacgccgaggagugccacagaugcagagugcaguucggcgugaugaccagaaagcaccacugcagagccugcggccagaucuucugcggcaagugcagcagcaaguacagcaccauccccaaguucggcaucgagaaggaggugagagugugcgagcccugcuacgagcagcugaacagaaaggccgagggcaaggccaccagcaccaccgagcugccccccgaguaccugaccagcccccugagccagcagagccagcugccccccaagagagacgagaccgcccugcaggaggaggaggagcugcagcuggcccuggcccugagccagagcgaggccgaggagaaggagagacugagacagaagagcaccuacaccagcuaccccaaggccgagcccaugcccagcgccagcagcgccccccccgccagcagccuguacagcagccccgugaacagcagcgccccccuggccgaggacaucgaccccgagcuggccagauaccugaacagaaacuacugggagaagaagcaggaggaggccagaaagagccccacccccagcgcccccgugccccugaccgagcccgccgcccagcccggcgagggccacgccgcccccaccaacgugguggagaacccccugcccgagaccgacagccagcccaucccccccagcggcggccccuucagcgagccccaguuccacaacggcgagagcgaggagagccacgagcaguuccugaaggcccugcagaacgccgugaccaccuucgugaacagaaugaagagcaaccacaugagaggcagaagcaucaccaacgacagcgccgugcugagccuguuccagagcaucaacggcaugcacccccagcugcuggagcugcugaaccagcuggacgagagaagacuguacuacgagggccugcaggacaagcuggcccagaucagagacgccagaggcgcccugagcgcccugagagaggagcacagagagaagcugagaagagccgccgaggaggccgagagacagagacagauccagcuggcccagaagcuggagaucaugagacagaagaagcaggaguaccuggaggugcagagacagcuggccauccagagacugcaggagcaggagaaggagagacagaugagacuggagcagcagaagcagaccgugcagaugagagcccagaugcccgccuucccccugcccuacgcccagcugcaggccaugcccgccgccggcggcgugcuguaccagcccagcggccccgccagcuuccccagcaccuucagccccgccggcagcguggagggcagccccaugcacggcguguacaugagccagcccgcccccgccgccggccccuaccccagcaugcccagcaccgccgccgaccccagcauggugagcgccuacauguaccccgccggcgccaccggcgcccaggccgccccccaggcccaggccggccccaccgccagccccgccuacagcagcuaccagcccacccccaccgccggcuaccagaacguggccagccaggccccccagagccugcccgccaucagccagcccccccagagcagcaccaugggcuacaugggcagccagagcgugagcaugggcuaccagcccuacaacaugcagaaccugaugaccacccugcccagccaggacgccagccugcccccccagcagcccuacaucgccggccagcagcccauguaccagcagauggcccccagcggcggccccccccagcagcagccccccguggcccagcagccccaggcccagggcccccccgcccagggcagcgaggcccagcugaucagcuucgacuaa

SEQ ID NO: 18021 - RNA, 1908 nt, Artificial Sequence
  HGSNAT__Homo_sapiens__NP_689632
augagcggcgccggcagagcccuggccgcccugcugcuggccgccagcgugcugagcgccgcccugcuggcccccggcggcagcagcggcagagacgcccaggccgccccccccagagaccuggacaagaagagacacgccgagcugaagauggaccaggcccugcugcugauccacaacgagcugcuguggaccaaccugaccguguacuggaagagcgagugcugcuaccacugccuguuccaggugcuggugaacgugccccagagccccaaggccggcaagcccagcgccgccgccgccagcgugagcacccagcacggcagcauccugcagcugaacgacacccuggaggagaaggaggugugcagacuggaguacagauucggcgaguucggcaacuacagccugcuggugaagaacauccacaacggcgugagcgagaucgccugcgaccuggccgugaacgaggaccccguggacagcaaccugcccgugagcaucgccuuccugaucggccuggccgugaucaucgugaucagcuuccugagacugcugcugagccuggacgacuucaacaacuggaucagcaaggccaucagcagcagagagaccgacagacugaucaacagcgagcugggcagccccagcagaaccgacccccuggacggcgacgugcagcccgccaccuggagacugagcgcccugccccccagacugagaagcguggacaccuucagaggcaucgcccugauccugaugguguucgugaacuacggcggcggcaaguacugguacuucaagcacgccagcuggaacggccugaccguggccgaccugguguuccccugguucguguucaucaugggcagcagcaucuuccugagcaugaccagcauccugcagagaggcugcagcaaguucagacugcugggcaagaucgccuggagaagcuuccugcugaucugcaucggcaucaucaucgugaaccccaacuacugccugggcccccugagcugggacaaggugagaauccccggcgugcugcagagacugggcgugaccuacuucgugguggccgugcuggagcugcuguucgccaagcccgugcccgagcacugcgccagcgagagaagcugccugagccugagagacaucaccagcagcuggccccaguggcugcugauccuggugcuggagggccuguggcugggccugaccuuccugcugcccgugcccggcugccccaccggcuaccugggccccggcggcaucggcgacuucggcaaguaccccaacugcaccggcggcgccgccggcuacaucgacagacugcugcugggcgacgaccaccuguaccagcaccccagcagcgccgugcuguaccacaccgagguggccuacgaccccgagggcauccugggcaccaucaacagcaucgugauggccuuccugggcgugcaggccggcaagauccugcuguacuacaaggccagaaccaaggacauccugaucagauucaccgccuggugcugcauccugggccugaucagcguggcccugaccaaggugagcgagaacgagggcuucauccccgugaacaagaaccuguggagccugagcuacgugaccacccugagcagcuucgccuucuucauccugcuggugcuguaccccgugguggacgugaagggccuguggaccggcacccccuucuucuaccccggcaugaacagcauccugguguacgugggccacgagguguucgagaacuacuuccccuuccaguggaagcugaaggacaaccagagccacaaggagcaccugacccagaacaucguggccaccgcccugugggugcugaucgccuacauccuguacagaaagaagaucuucuggaagaucuaa

SEQ ID NO: 18022 - RNA, 1071 nt, Artificial Sequence
  HHAT__Homo_sapiens__NP_001164035
augcugcccagaugggagcuggcccuguaccugcuggccagccugggcuuccacuucuacagcuucuacgagguguacaaggugagcagagagcacgaggaggagcuggaccaggaguucgagcuggagaccgacacccuguucggcggccugaagaaggacgccaccgacuucgaguggagcuucuggauggaguggggcaagcaguggcugguguggcugcugcugggccacaugguggugagccagauggccacccugcuggccagaaagaugcagcagcaggagcacgacagccugaaggccagccugugcgugcuggcccugggccugggcagacugcugugcuggugguggcuggccgagcugauggcccaccugauguacaugcacgccaucuacagcagcaucccccugcuggagaccgugagcugcuggacccugggcggccuggcccuggcccaggugcuguucuucuacgugaaguaccuggugcuguucggcgugcccgcccugcugaugagacuggacggccugaccccccccgcccugcccagaugcgugagcaccauguucagcuucaccggcauguggagauacuucgacgugggccugcacaacuuccugaucagauacguguacauccccgugggcggcagccagcacggccugcugggcacccuguucagcaccgccaugaccuucgccuucgugagcuacuggcacggcggcuacgacuaccuguggugcugggccgcccugaacuggcugggcgugaccguggagaacggcgugagaagacugguggagacccccugcauccaggacagccuggccagauacuucagcccccaggccagaagaagauuccacgccgcccuggccagcugcagcaccagcaugcugauccugagcaaccugguguuccugggcggcaacgaggugggcaagaccuacuggaacagaaucuucauccagggcuggcccugggugacccugagcgugcugggcuuccuguacugcuacagccacgugggcaucgccugggcccagaccuacgccaccgacuaa

SEQ ID NO: 18023 - RNA, 1515 nt, Artificial Sequence
  HHATL__Homo_sapiens__NP_065758
augggcaucaagaccgcccugcccgccgccgagcugggccuguacagccuggugcugagcggcgcccuggccuacgccggcagaggccugcuggaggccagccaggacggcgcccacagaaaggccuucagagagagcgugagacccggcugggaguacaucggcagaaagauggacguggccgacuucgagugggugaugugguucaccagcuucagaaacgugaucaucuucgcccugagcggccacgugcuguucgccaagcugugcaccaugguggcccccaagcugagaagcuggauguacgccguguacggcgcccuggccgugaugggcaccaugggccccugguaccugcugcugcugcugggccacugcgugggccuguacguggccagccugcugggccagcccuggcugugccugggccugggccuggccagccuggccagcuucaagauggacccccugaucagcuggcagagcggcuucgugaccggcaccuucgaccugcaggaggugcuguuccacggcggcagcagcuucaccgugcugagaugcaccagcuucgcccuggagagcugcgcccaccccgacagacacuacagccuggccgaccugcugaaguacaacuucuaccugcccuucuucuucuucggccccaucaugaccuucgacagauuccacgcccaggugagccagguggagcccgugagaagagagggcgagcuguggcacaucagagcccaggccggccugagcgugguggccaucauggccguggacaucuucuuccacuucuucuacauccugaccauccccagcgaccugaaguucgccaacagacugcccgacagcgcccuggccggccuggccuacagcaaccugguguacgacugggugaaggccgccgugcuguucggcguggugaacaccguggccugccuggaccaccuggaccccccccagccccccaagugcaucaccgcccuguacguguucgccgagacccacuucgacagaggcaucaacgacuggcugugcaaguacguguacaaccacaucggcggcgagcacagcgccgugauccccgagcuggccgccaccguggccaccuucgccaucaccacccuguggcugggccccugcgacaucguguaccuguggagcuuccugaacugcuucggccugaacuucgagcuguggaugcagaagcuggccgaguggggcccccuggccagaaucgaggccagccugagcgugcagaugagcagaagagugagagcccuguucggcgccaugaacuucugggccaucaucauguacaaccuggugagccugaacagccugaaguucaccgagcugguggccagaagacugcugcugaccggcuucccccagaccacccugagcauccuguucgugaccuacugcggcgugcagcuggugaaggagagagagagaacccuggcccuggaggaggagcagaagcaggacaaggagaagcccgaguaa

SEQ ID NO: 18024 - RNA, 813 nt, Artificial Sequence
  HHEX__Homo_sapiens__NP_002720
augcaguacccccaccccggccccgccgccggcgccgugggcgugccccuguacgcccccaccccccugcugcagcccgcccaccccacccccuucuacaucgaggacauccugggcagaggccccgccgcccccacccccgcccccacccugcccagccccaacagcagcuucaccagccuggugagccccuacagaacccccguguacgagcccacccccauccaccccgccuucagccaccacagcgccgccgcccuggccgccgccuacggccccggcggcuucggcggcccccuguaccccuuccccagaaccgugaacgacuacacccacgcccugcugagacacgacccccugggcaagccccugcuguggagccccuuccugcagagaccccugcacaagagaaagggcggccaggugagauucagcaacgaccagaccaucgagcuggagaagaaguucgagacccagaaguaccugagcccccccgagagaaagagacuggccaagaugcugcagcugagcgagagacaggugaagaccugguuccagaacagaagagccaaguggagaagacugaagcaggagaacccccagagcaacaagaaggaggagcuggagagccuggacagcagcugcgaccagagacaggaccugcccagcgagcagaacaagggcgccagccuggacagcagccagugcagccccagccccgccagccaggaggaccuggagagcgagaucagcgaggacagcgaccaggagguggacaucgagggcgacaagagcuacuucaacgccggcuaa

SEQ ID NO: 18025 - RNA, 2103 nt, Artificial Sequence
  HHIP__Homo_sapiens__NP_071920
augcugaagaugcugagcuucaagcugcugcugcuggccguggcccugggcuucuucgagggcgacgccaaguucggcgagagaaacgagggcagcggcgccagaagaagaagaugccugaacggcaacccccccaagagacugaagagaagagacagaagaaugaugagccagcuggagcugcugagcggcggcgagaugcugugcggcggcuucuaccccagacugagcugcugccugagaagcgacagccccggccugggcagacuggagaacaagaucuucagcgugaccaacaacaccgagugcggcaagcugcuggaggagaucaagugcgcccugugcagcccccacagccagagccuguuccacagccccgagagagaggugcuggagagagaccuggugcugccccugcugugcaaggacuacugcaaggaguucuucuacaccugcagaggccacauccccggcuuccugcagaccaccgccgacgaguucugcuucuacuacgccagaaaggacggcggccugugcuuccccgacuuccccagaaagcaggugagaggccccgccagcaacuaccuggaccagauggaggaguacgacaagguggaggagaucagcagaaagcacaagcacaacugcuucugcauccaggagguggugagcggccugagacagcccgugggcgcccugcacagcggcgacggcagccagagacuguucauccuggagaaggagggcuacgugaagauccugacccccgagggcgagaucuucaaggagcccuaccuggacauccacaagcuggugcagagcggcaucaagggcggcgacgagagaggccugcugagccuggccuuccaccccaacuacaagaagaacggcaagcuguacgugagcuacaccaccaaccaggagagaugggccaucggcccccacgaccacauccugagagugguggaguacaccgugagcagaaagaacccccaccagguggaccugagaaccgccagaguguuccuggagguggccgagcugcacagaaagcaccugggcggccagcugcuguucggccccgacggcuuccuguacaucauccugggcgacggcaugaucacccuggacgacauggaggagauggacggccugagcgacuucaccggcagcgugcugagacuggacguggacaccgacaugugcaacgugcccuacagcauccccagaagcaacccccacuucaacagcaccaaccagccccccgagguguucgcccacggccugcacgaccccggcagaugcgccguggacagacaccccaccgacaucaacaucaaccugaccauccugugcagcgacagcaacggcaagaacagaagcagcgccagaauccugcagaucaucaagggcaaggacuacgagagcgagcccagccugcuggaguucaagcccuucagcaacggcccccuggugggcggcuucguguacagaggcugccagagcgagagacuguacggcagcuacguguucggcgacagaaacggcaacuuccugacccugcagcagagccccgugaccaagcaguggcaggagaagccccugugccugggcaccagcggcagcugcagaggcuacuucagcggccacauccugggcuucggcgaggacgagcugggcgagguguacauccugagcagcagcaagagcaugacccagacccacaacggcaagcuguacaagaucguggaccccaagagaccccugaugcccgaggagugcagagccaccgugcagcccgcccagacccugaccagcgagugcagcagacugugcagaaacggcuacugcacccccaccggcaagugcugcugcagccccggcugggagggcgacuucugcagaaccgccaagugcgagcccgccugcagacacggcggcgugugcgugagacccaacaagugccugugcaagaagggcuaccugggcccccagugcgagcagguggacagaaacaucagaagagugaccagagccggcauccuggaccagaucaucgacaugaccagcuaccugcuggaccugaccagcuacaucguguaa

SEQ ID NO: 18026 - RNA, 2349 nt, Artificial Sequence
  HHIPL1__Homo_sapiens__NP_001120730
auggccagagccagagccggcgcccugcuggcccugugggugcugggcgccgccgcccacccccagugccuggacuucagaccccccuucagacccacccagccccugagacugugcgcccaguacagcgacuucggcugcugcgacgagggcagagacgccgagcugaccagaagauucugggcccuggccagcagaguggacgccgccgagugggccgccugcgccggcuacgccagagaccugcugugccaggagugcagccccuacgccgcccaccuguacgacgccgaggaccccuucaccccccugagaaccgugcccggccugugccaggacuacugccuggacauguggcacaagugcagaggccuguucagacaccugagcaccgaccaggagcugugggcccuggagggcaaccuggccagauucugcagauaccugagccuggacgacaccgacuacugcuuccccuaccugcuggugaacaagaaccugaacagcaaccugggccacgugguggccgacgccaagggcugccugcagcugugccuggaggagguggccaacggccugagaaaccccguggccauggugcacgccagagacggcacccacagauucuucguggccgagcaggugggccuggugugggccuaccugcccgacagaagcagacugggcaagcccuuccugaacaucagcagaguggugcugaccagccccugggagggcgacgagagaggcuuccugggcaucgccuuccaccccagcuuccagcacaacagaagacuguacguguacuacagcgugggcaucagaagcagcgaguggaucagaaucagcgaguucagagugagcgaggacgacgagaacgccguggaccacagcagcgagagaaucauccuggaggugaaggagcccgccagcaaccacaacggcggccagcugcuguucggcgacgacggcuaccuguacaucuucaccggcgacggcggcauggccggcgaccccuucggcaccuucggcaacgcccagaacaagagcgcccugcugggcaaggugcugagaaucgacguggacagaaaggagagaggccugcccuacggcaucccccccgacaaccccuucgugggcgaccccgccgcccagcccgagguguacgcccugggcgugagaaacauguggagaugcagcuucgacagaggcgaccccagcagcggcaccggcagaggcagacuguucugcggcgacgugggccagaacaaguucgaggagguggacgugguggagagaggcggcaacuacggcuggagagccagagagggcuucgagugcuacgacagaagccugugcgccaacaccagccugaacgaccugcugcccaucuucgccuacccccacaccgugggcaagagcgugaccggcggcuacguguacagaggcugcgaguaccccaaccugaacggccuguacaucuucggcgacuucaugagcggcagacugaugagccugcaggagaaccccggcaccggccaguggcaguacagcgagaucugcaugggccacggccagaccugcgaguuccccggccugaucaacaacuacuaccccuacaucaucagcuucggcgaggacgaggccggcgagcuguacuucaugagcaccggcgagcccagcgccaccgcccccagaggcgugguguacaagaucaucgacgccagcagaagagccccccccggcaagugccagauccagcccgcccaggugaagaucagaagcagacugauccccuucgugcccaaggagaaguucauccccaagaccagaagcacccccagacccaccgccagagcccccaccagagcccccagaagaggcagacccaccgccgccccccccgcccccacccccagacccgccagacccacccagcagcccggcagcagaagaggcggcggcagaagaagaggcagacugaacagcgccagcagagccuucagagacggcgaggugagacuggugagacccgccggccugagcagcggcagcggcagaguggagguguucgugggcggcagauggggcaccgugugcgacgacagcuggaacaucagcggcgccgccguggugugcagacagcugggcuucgccuacgccgugagagccgugaagagagccgaguucggccagggcggcagccugcccauccugcuggacgacgugagaugcgccggcugggagagaaaccugcuggagugccagcacaacggcgugggcacccacaacugcgagcacgacgaggacgccggcguggugugcagccaccagaaccccgaccuguaa

SEQ ID NO: 18027 - RNA, 1596 nt, Artificial Sequence
  HHLA1__Homo_sapiens__NP_001138567
augcugggcuuccugagcagaggccccagcaugaagcugugcaugggccuggccugcgugcugagccuguggaacaccgugagcggcaucaagggcgaggccaagaaggagaagggcaugaccuuccugcccaccaccgugagcggccugagagaggaggagagaaaggagaagggcguggccuuccuggccaccaccgagcugcccgccagaagcaucgaccugagcgcccugaaccugaccgagcuggugaacggcaugcugagcagagcccugaaggacagcaagaaguucuucagccugcugagcgugaccagcuacagcagcuucgccuuccacaaguucagcguggccguguacaacaucagcaaccugaagaccguggaccccgccaaguuccccaccagauacugcuacugccugaacaacagaaccaacgaccugagcgacuucaccgcccugcugguggacaucaucggcaacagcaccagcuaccugaccgagaucuucaagagcaccagcauccugagcgugaaccagagcaacgagagcgacugcaucuucaucugcgugaugaccggcaagagcggcagaaaccugagcgacuucugggagaucgaggagaaguaccccaucaucaacuacaccuucaccagcggccugagcggcgugcugggcgccgccaccagaggcaccgccagaaccagcaagcccaccaccaagagccagaagacccugcccagcaccagccccggccacuggacccagagcacccccugggccagcgcccugagaagcagccccuggaccgagaccgccgcccccagcgagaccgaggagacccugaacaccggcagaccccccgagcugcccgccagagccaccgccaccugguucagcgccagccacacccugcccgcccuggccaccagaagaguggccagaacccaguggcugaccgccgacagacagaccugggccagcaucagcagcgugcccugggcccagaccaucagcgagaagaagcccggcggcagccugugggagaccagaagcagcccccccaccaccgccggcaccgaggaggccaugaacaccaccagccugcuggcccccgccgccgagaucauggccacccccggcagccccagccaggccagccccacccugggcgccuucacccacggcacccagacccccagccccaccaaggccaccgcccccagauacccccagaccggcgaccugagcgccgaguggcccuucaccgccggcgaggagcccgugcuggugcccagaccccaccaggugagcagaugcccccagccccuguucaaggugggcgccauggccgccgccccccugacccuggccauccagagacugaaccccugccugauggagcugugccaguucuuccagcagugccugugcaugagccagagaagccccagaaccgaggacaugagauacugccuggaguacuacagcugguuccugaagaacgccaccuacaucugccagagagugaagagagugagccacagccacacccugaagcagaagugccuggagaacaucugcaagagcguguaa

SEQ ID NO: 18028 - RNA, 1194 nt, Artificial Sequence
  HHLA2__Homo_sapiens__NP_001269487
augaaggcccagaccgcccugagcuucuuccugauccugaucaccagccugagcggcagccagggcaucuucccccuggccuucuucaucuacgugcccaugaacgagcagaucgugaucggcagacuggacgaggacaucauccugcccagcagcuucgagagaggcagcgagguggugauccacuggaaguaccaggacagcuacaaggugcacagcuacuacaagggcagcgaccaccuggagagccaggaccccagauacgccaacagaaccagccuguucuacaacgagauccagaacggcaacgccagccuguucuucagaagagugagccugcuggacgagggcaucuacaccugcuacgugggcaccgccauccaggugaucaccaacaagguggugcugaaggugggcguguuccugacccccgugaugaaguacgagaagagaaacaccaacagcuuccugaucugcagcgugcugagcguguaccccagacccaucaucaccuggaagauggacaacacccccaucagcgagaacaacauggaggagaccggcagccuggacagcuucagcaucaacagcccccugaacaucaccggcagcaacagcagcuacgagugcaccaucgagaacagccugcugaagcagaccuggaccggcagauggaccaugaaggacggccugcacaagaugcagagcgagcacgugagccugagcugccagcccgugaacgacuacuucagccccaaccaggacuucaaggugaccuggagcagaaugaagagcggcaccuucagcgugcuggccuacuaccugagcagcagccagaacaccaucaucaacgagagcagauucagcuggaacaaggagcugaucaaccagagcgacuucagcaugaaccugauggaccugaaccugagcgacagcggcgaguaccugugcaacaucagcagcgacgaguacacccugcugaccauccacaccgugcacguggagcccagccaggagaccgccagccacaacaagggccuguggauccuggugcccagcgccauccuggccgccuuccugcugaucuggagcgugaagugcugcagagagagaugcugcgugccccccggcgagagaugccccagcgcccccgacaacggcgaggagaacgugccccugagcggcaagguguaa

SEQ ID NO: 18029 - RNA, 1359 nt, Artificial Sequence
  HIAT1__Homo_sapiens__XP_011540259
augacccagggcaagaagaagaagagagccgccaacagaagcaucaugcuggccaagaagaucaucaucaaggacggcggcaccccccagggcaucggcagccccagcguguaccacgccgugaucgugaucuuccuggaguucuucgccuggggccugcugaccgcccccacccugguggugcugcacgagaccuuccccaagcacaccuuccugaugaacggccugauccagggcgugaagggccugcugagcuuccugagcgccccccugaucggcgcccugagcgacguguggggcagaaagagcuuccugcugcugaccguguucuucaccugcgcccccaucccccugaugaagaucagccccuggugguacuucgccgugaucagcgugagcggcguguucgccgugaccuucagcgugguguucgccuacguggccgacaucacccaggagcacgagagaagcauggccuacggccuggugagcgccaccuucgccgccagccuggugaccagccccgccaucggcgccuaccugggcagaguguacggcgacagccuggugguggugcuggccaccgccaucgcccugcuggacaucugcuucauccugguggccgugcccgagagccugcccgagaagaugagacccgccagcuggggcgcccccaucagcugggagcaggccgaccccuucgccaucaugaaguucagccccgagagcguggccgccuucaucgccgugcugggcauccugagcaucaucgcccagaccaucgugcugagccugcugaugagaagcaucggcaacaagaacaccauccugcugggccugggcuuccagauccugcagcuggccugguacggcuucggcagcgagcccuggaugaugugggccgccggcgccguggccgccaugagcagcaucaccuuccccgccgugagcgcccuggugagcagaaccgccgacgccgaccagcagggcguggugcagggcaugaucaccggcaucagaggccugugcaacggccugggccccgcccuguacggcuucaucuucuacaucuuccacguggagcugaaggagcugcccaucaccggcaccgaccugggcaccaacaccagcccccagcaccacuucgagcagaacagcaucauccccggcccccccuuccuguucggcgccugcagcgugcugcuggcccugcugguggcccuguucauccccgagcacaccaaccugagccugagaagcagcagcuggagaaagcacugcggcagccacagccacccccacaacacccaggcccccggcgaggccaaggagccccugcugcaggacaccaacguguaa

SEQ ID NO: 18030 - RNA, 1011 nt, Artificial Sequence
  HIBADH__Homo_sapiens__NP_689953
auggccgccagccugagacugcugggcgccgccagcggccugagauacuggagcagaagacugagacccgccgccggcagcuucgccgccgugugcagcagaagcguggccagcaagacccccgugggcuucaucggccugggcaacaugggcaaccccauggccaagaaccugaugaagcacggcuacccccugaucaucuacgacguguuccccgacgccugcaaggaguuccaggacgccggcgagcagguggugagcagccccgccgacguggccgagaaggccgacagaaucaucaccaugcugcccaccagcaucaacgccaucgaggccuacagcggcgccaacggcauccugaagaaggugaagaagggcagccugcugaucgacagcagcaccaucgaccccgccgugagcaaggagcuggccaaggagguggagaagaugggcgccguguucauggacgcccccgugagcggcggcgugggcgccgccagaagcggcaaccugaccuucauggugggcggcguggaggacgaguucgccgccgcccaggagcugcugggcugcaugggcagcaacgugguguacugcggcgccgugggcaccggccaggccgccaagaucugcaacaacaugcugcuggccaucagcaugaucggcaccgccgaggccaugaaccugggcaucagacugggccuggaccccaagcugcuggccaagauccugaacaugagcagcggcagaugcuggagcagcgacaccuacaaccccgugcccggcgugauggacggcgugcccagcgccaacaacuaccagggcggcuucggcaccacccugauggccaaggaccugggccuggcccaggacagcgccaccagcaccaagagccccauccugcugggcagccuggcccaccagaucuacagaaugaugugcgccaagggcuacagcaagaaggacuucagcagcguguuccaguuccugagagaggaggagaccuucuaa

SEQ ID NO: 18031 - RNA, 1161 nt, Artificial Sequence
  HIBCH__Homo_sapiens__NP_055177
augggccagagagagauguggagacugaugagcagauucaacgccuucaagagaaccaacaccauccugcaccaccugagaaugagcaagcacaccgacgccgccgaggaggugcugcuggagaagaagggcugcaccggcgugaucacccugaacagacccaaguuccugaacgcccugacccugaacaugaucagacagaucuacccccagcugaagaagugggagcaggaccccgagaccuuccugaucaucaucaagggcgccggcggcaaggccuucugcgccggcggcgacaucagagugaucagcgaggccgagaaggccaagcagaagaucgcccccguguucuucagagaggaguacaugcugaacaacgccgugggcagcugccagaagcccuacguggcccugauccacggcaucaccaugggcggcggcgugggccugagcgugcacggccaguucagaguggccaccgagaagugccuguucgccaugcccgagaccgccaucggccuguuccccgacgugggcggcggcuacuuccugcccagacugcagggcaagcugggcuacuuccuggcccugaccggcuucagacugaagggcagagacguguacagagccggcaucgccacccacuucguggacagcgagaagcuggccaugcuggaggaggaccugcuggcccugaagagccccagcaaggagaacaucgccagcgugcuggagaacuaccacaccgagagcaagaucgacagagacaagagcuucauccuggaggagcacauggacaagaucaacagcugcuucagcgccaacaccguggaggagaucaucgagaaccugcagcaggacggcagcagcuucgcccuggagcagcugaaggugaucaacaagaugagccccaccagccugaagaucacccugagacagcugauggagggcagcagcaagacccugcaggaggugcugaccauggaguacagacugagccaggccugcaugagaggccacgacuuccacgagggcgugagagccgugcugaucgacaaggaccagagccccaaguggaagcccgccgaccugaaggaggugaccgaggaggaccugaacaaccacuucaagagccugggcagcagcgaccugaaguucuaa

SEQ ID NO: 18032 - RNA, 2202 nt, Artificial Sequence
  HIC1__Homo_sapiens__NP_001091672
augaccuuccccgaggccgacauccugcugaagagcggcgagugcgccggccagaccaugcuggacaccauggaggcccccggccacagcagacagcugcugcugcagcugaacaaccagagaaccaagggcuuccugugcgacgugaucaucguggugcagaacgcccuguucagagcccacaagaacgugcuggccgccagcagcgccuaccugaagagccugguggugcacgacaaccugcugaaccuggaccacgacauggugagccccgccguguucagacuggugcuggacuucaucuacaccggcagacuggccgacggcgccgaggccgccgccgccgccgccguggcccccggcgccgagcccagccugggcgccgugcuggccgccgccagcuaccugcagauccccgaccugguggcccugugcaagaagagacugaagagacacggcaaguacugccaccugagaggcggcggcggcggcggcggcggcuacgcccccuacggcagacccggcagaggccugagagccgccacccccgugauccaggccugcuaccccagccccgugggccccccccccccccccgccgccgagccccccagcggccccgaggccgccgugaacacccacugcgccgagcuguacgccagcggccccggccccgccgccgcccugugcgccagcgagagaagaugcagcccccugugcggccuggaccugagcaagaagagcccccccggcagcgccgcccccgagagaccccuggccgagagagagcugccccccagacccgacagcccccccagcgccggccccgccgccuacaaggagcccccccuggcccugcccagccugcccccccugcccuuccagaagcuggaggaggccgccccccccagcgaccccuucagaggcggcagcggcagccccggccccgagccccccggcagacccgacggccccagccugcuguacagauggaugaagcacgagcccggccugggcagcuacggcgacgagcugggcagagagagaggcagccccagcgagagaugcgaggagagaggcggcgacgccgccgugagccccggcggccccccccugggccuggcccccccccccagauaccccggcagccuggacggccccggcgccggcggcgacggcgacgacuacaagagcagcagcgaggagaccggcagcagcgaggaccccagcccccccggcggccaccuggagggcuaccccugcccccaccuggccuacggcgagcccgagagcuucggcgacaaccuguacgugugcauccccugcggcaagggcuuccccagcagcgagcagcugaacgcccacguggaggcccacguggaggaggaggaggcccuguacggcagagccgaggccgccgagguggccgccggcgccgccggccugggcccccccuucggcggcggcggcgacaagguggccggcgcccccggcggccugggcgagcugcugagacccuacagaugcgccagcugcgacaagagcuacaaggaccccgccacccugagacagcacgagaagacccacuggcugaccagacccuaccccugcaccaucugcggcaagaaguucacccagagaggcaccaugaccagacacaugagaagccaccugggccugaagcccuucgccugcgacgccugcggcaugagauucaccagacaguacagacugaccgagcacaugagaauccacagcggcgagaagcccuacgagugccaggugugcggcggcaaguucgcccagcagagaaaccugaucagccacaugaagaugcacgccgugggcggcgccgccggcgccgccggcgcccuggccggccugggcggccugcccggcgugcccggccccgacggcaagggcaagcuggacuuccccgagggcguguucgccguggccagacugaccgccgagcagcugagccugaagcagcaggacaaggccgccgccgccgagcugcuggcccagaccacccacuuccugcacgaccccaagguggcccuggagagccuguacccccuggccaaguucaccgccgagcugggccugagccccgacaaggccgccgaggugcugagccagggcgcccaccuggccgccggccccgacggcagaaccaucgacagauucagccccaccuaa

SEQ ID NO: 18033 - RNA, 1848 nt, Artificial Sequence
  HIC2__Homo_sapiens__NP_055909
auggugagcggcccccuggcccugagauggugcgccugggccggcagaggcgacaugggccccgacauggagcugcccagccacagcaagcagcugcugcugcagcugaaccagcagagaaccaagggcuuccugugcgacgugaucaucaugguggagaacagcaucuucagagcccacaagaacgugcuggccgccagcagcaucuacuucaagagccuggugcugcacgacaaccugaucaaccuggacaccgacauggugagcagcaccguguuccagcagauccuggacuucaucuacaccggcaagcugcugcccagcgaccagcccgccgagcccaacuucagcacccugcugaccgccgccagcuaccugcagcugcccgagcuggccgcccugugcagaagaaagcugaagagagccggcaagcccuucggcagcggcagagccggcagcaccggcaugggcagaccccccagaagccagagacugagcaccgccagcgugauccaggccagauaccagggccugguggacggcagaaagggcgcccacgccccccaggagcugccccaggccaagggcagcgacgacgagcuguuccugggcggcagcaaccaggacagcgugcagggccugggcagagccgugugccccgccggcggcgaggccggccugggcggcugcagcagcagcaccaacggcagcagcggcggcugcgagcaggagcugggccuggaccugagcaagaagagccccccccugccccccgccacccccggcccccaccugacccccgacgacgccgcccagcugagcgacagccagcacggcagcccccccgccgccagcgccccccccguggccaacagcgccagcuacagcgagcugggcggcacccccgacgagcccauggaccuggagggcgccgaggacaaccaccugagccugcuggaggcccccggcggccagcccagaaagagccugagacacagcaccagaaagaaggaguggggcaagaaggagcccguggccggcagccccuucgagagaagagaggccggccccaagggccccugccccggcgaggagggcgagggcgugggcgacagagugcccaacggcauccuggccagcggcgccggccccagcggccccuacggcgagccccccuaccccugcaaggaggaggaggagaacggcaaggacgccagcgaggacagcgcccagagcggcagcgagggcggcagcggccacgccagcgcccacuacauguacagacaggagggcuacgagaccgugagcuacggcgacaaccuguacgugugcauccccugcgccaagggcuuccccagcagcgagcagcugaacgcccacguggagacccacaccgaggaggagcuguucaucaaggaggagggcgccuacgagaccggcagcggcggcgccgaggaggaggccgaggaccugagcgcccccagcgccgccuacaccgccgagcccagacccuucaagugcagcgugugcgagaagaccuacaaggaccccgccacccugagacagcacgagaagacccacuggcugaccagacccuuccccugcaacaucugcggcaagauguucacccagagaggcaccaugaccagacacaugagaagccaccugggccugaagcccuucgccugcgacgagugcggcaugagauucaccagacaguacagacugaccgagcacaugagagugcacagcggcgagaagcccuacgagugccagcugugcggcggcaaguucacccagcagagaaaccugaucagccaccugagaaugcacaccagccccagcuaa

SEQ ID NO: 18034 - RNA, 2367 nt, Artificial Sequence
  HID1__Homo_sapiens__NP_085133
augggcagcaccgacagcaagcugaacuucagaaaggccgugauccagcugaccaccaagacccagcccguggaggccaccgacgacgccuucugggaccaguucugggccgacaccgccaccagcgugcaggacguguucgcccuggugcccgccgccgagaucagagccgugagagaggagagccccagcaaccuggccacccugugcuacaaggccguggagaagcuggugcagggcgccgagagcggcugccacagcgagaaggagaagcagaucgugcugaacugcagcagacugcugaccagagugcugcccuacaucuucgaggaccccgacuggagaggcuucuucuggagcaccgugcccggcgccggcagaggcggccagggcgaggaggacgacgagcacgccagaccccuggccgagagccugcugcuggccaucgccgaccugcuguucugccccgacuucaccgugcagagccacagaagaagcaccguggacagcgccgaggacgugcacagccuggacagcugcgaguacaucugggaggccggcgugggcuucgcccacagcccccagcccaacuacauccacgacaugaacagaauggagcugcugaagcugcugcugaccugcuucagcgaggccauguaccugccccccgcccccgagagcggcagcaccaaccccugggugcaguucuucugcagcaccgagaacagacacgcccugccccuguucaccagccugcugaacaccgugugcgccuacgaccccgugggcuacggcauccccuacaaccaccugcuguucagcgacuacagagagccccugguggaggaggccgcccaggugcugaucgugacccuggaccacgacagcgccagcagcgccagccccaccguggacggcaccaccaccggcaccgccauggacgacgccgacccccccggccccgagaaccuguucgugaacuaccugagcagaauccacagagaggaggacuuccaguucauccugaagggcaucgccagacugcugagcaacccccugcugcagaccuaccugcccaacagcaccaagaagauccaguuccaccaggagcugcuggugcuguucuggaagcugugcgacuucaacaagaaguuccuguucuucgugcugaagagcagcgacgugcuggacauccuggugcccauccuguucuuccugaacgacgccagagccgaccagagcagagugggccugaugcacaucggcguguucauccugcugcugcugagcggcgagagaaacuucggcgugagacugaacaagcccuacagcaucagagugcccauggacauccccguguucaccggcacccacgccgaccugcugaucgugguguuccacaagaucaucaccagcggccaccagagacugcagccccuguucgacugccugcugaccaucguggugaacgugagccccuaccugaagagccugagcauggugaccgccaacaagcugcugcaccugcuggaggccuucagcaccaccugguuccuguucagcgccgcccagaaccaccaccugguguucuuccugcuggagguguucaacaacaucauccaguaccaguucgacggcaacagcaaccugguguacgccaucaucagaaagagaagcaucuuccaccagcuggccaaccugcccaccgacccccccaccauccacaaggcccugcagagaagaagaagaacccccgagccccugagcagaaccggcagccaggagggcaccagcauggagggcagcagacccgccgcccccgccgagcccggcacccugaagaccagccugguggccacccccggcaucgacaagcugaccgagaagagccaggugagcgaggacggcacccugagaagccuggagcccgagccccagcagagccuggaggacggcagccccgccaagggcgagcccagccaggccuggagagagcagagaagacccagcaccagcagcgccagcggccaguggagccccacccccgagugggugcugagcuggaagagcaagcugccccugcagaccaucaugagacugcugcaggugcuggugccccagguggagaagaucugcaucgacaagggccugaccgacgagagcgagauccugagauuccugcagcacggcacccuggugggccugcugcccgugccccaccccauccugaucagaaaguaccaggccaacagcggcaccgccaugugguucagaaccuacauguggggcgugaucuaccugagaaacguggacccccccgugugguacgacaccgacgugaagcuguucgagauccagagaguguaa

SEQ ID NO: 18035 - RNA, 2553 nt, Artificial Sequence
  HIF1A__Homo_sapiens__NP_001230013
augagcagccagugcagaagccuggagaacaaguucguguuccugaaggagggccugggcaacagcaagcccgaggagcuggaggagaucagaaucgagaacggcagaaucagcagcgagagaagaaaggagaagagcagagacgccgccagaagcagaagaagcaaggagagcgagguguucuacgagcuggcccaccagcugccccugccccacaacgugagcagccaccuggacaaggccagcgugaugagacugaccaucagcuaccugagagugagaaagcugcuggacgccggcgaccuggacaucgaggacgacaugaaggcccagaugaacugcuucuaccugaaggcccuggacggcuucgugauggugcugaccgacgacggcgacaugaucuacaucagcgacaacgugaacaaguacaugggccugacccaguucgagcugaccggccacagcguguucgacuucacccaccccugcgaccacgaggagaugagagagaugcugacccacagaaacggccuggugaagaagggcaaggagcagaacacccagagaagcuucuuccugagaaugaagugcacccugaccagcagaggcagaaccaugaacaucaagagcgccaccuggaaggugcugcacugcaccggccacauccacguguacgacaccaacagcaaccagccccagugcggcuacaagaagccccccaugaccugccuggugcugaucugcgagcccaucccccaccccagcaacaucgagaucccccuggacagcaagaccuuccugagcagacacagccuggacaugaaguucagcuacugcgacgagagaaucaccgagcugaugggcuacgagcccgaggagcugcugggcagaagcaucuacgaguacuaccacgcccuggacagcgaccaccugaccaagacccaccacgacauguucaccaagggccaggugaccaccggccaguacagaaugcuggccaagagaggcggcuacguguggguggagacccaggccaccgugaucuacaacaccaagaacagccagccccagugcaucgugugcgugaacuacguggugagcggcaucauccagcacgaccugaucuucagccugcagcagaccgagugcgugcugaagcccguggagagcagcgacaugaagaugacccagcuguucaccaagguggagagcgaggacaccagcagccuguucgacaagcugaagaaggagcccgacgcccugacccugcuggcccccgccgccggcgacaccaucaucagccuggacuucggcagcaacgacaccgagaccgacgaccagcagcuggaggaggugccccuguacaacgacgugaugcugcccagccccaacgagaagcugcagaacaucaaccuggccaugagcccccugcccaccgccgagacccccaagccccugagaagcagcgccgaccccgcccugaaccaggagguggcccugaagcuggagcccaaccccgagagccuggagcugagcuucaccaugccccagauccaggaccagacccccagccccagcgacggcagcaccagacagagcagccccgagcccaacagccccagcgaguacugcuucuacguggacagcgacauggugaacgaguucaagcuggagcugguggagaagcuguucgccgaggacaccgaggccaagaaccccuucagcacccaggacaccgaccuggaccuggagaugcuggcccccuacauccccauggacgacgacuuccagcugagaagcuucgaccagcugagcccccuggagagcagcagcgccagccccgagagcgccagcccccagagcaccgugaccguguuccagcagacccagauccaggagcccaccgccaacgccaccaccaccaccgccaccaccgacgagcugaagaccgugaccaaggacagaauggaggacaucaagauccugaucgccagccccagccccacccacauccacaaggagaccaccagcgccaccagcagccccuacagagacacccagagcagaaccgccagccccaacagagccggcaagggcgugaucgagcagaccgagaagagccaccccagaagccccaacgugcugagcguggcccugagccagagaaccaccgugcccgaggaggagcugaaccccaagauccuggcccugcagaacgcccagagaaagagaaagauggagcacgacggcagccuguuccaggccgugggcaucggcacccugcugcagcagcccgacgaccacgccgccaccaccagccugagcuggaagagagugaagggcugcaagagcagcgagcagaacggcauggagcagaagaccaucauccugauccccagcgaccuggccugcagacugcugggccagagcauggacgagagcggccugccccagcugaccagcuacgacugcgaggugaacgcccccauccagggcagcagaaaccugcugcagggcgaggagcugcugagagcccuggaccaggugaacuaa

SEQ ID NO: 18036 - RNA, 1050 nt, Artificial Sequence
  HIF1AN__Homo_sapiens__NP_060372
auggccgccaccgccgccgaggccguggccagcggcagcggcgagcccagagaggaggccggcgcccugggccccgccugggacgagagccagcugagaagcuacagcuuccccaccagacccauccccagacugagccagagcgaccccagagccgaggagcugaucgagaacgaggagcccguggugcugaccgacaccaaccugguguaccccgcccugaagugggaccuggaguaccugcaggagaacaucggcaacggcgacuucagcguguacagcgccagcacccacaaguuccuguacuacgacgagaagaagauggccaacuuccagaacuucaagcccagaagcaacagagaggagaugaaguuccacgaguucguggagaagcugcaggacauccagcagagaggcggcgaggagagacuguaccugcagcagacccugaacgacaccgugggcagaaagaucgugauggacuuccugggcuucaacuggaacuggaucaacaagcagcagggcaagagaggcuggggccagcugaccagcaaccugcugcugaucggcauggagggcaacgugacccccgcccacuacgacgagcagcagaacuucuucgcccagaucaagggcuacaagagaugcauccuguucccccccgaccaguucgagugccuguaccccuaccccgugcaccaccccugcgacagacagagccagguggacuucgacaaccccgacuacgagagauuccccaacuuccagaacguggugggcuacgagaccguggugggccccggcgacgugcuguacauccccauguacugguggcaccacaucgagagccugcugaacggcggcaucaccaucaccgugaacuucugguacaagggcgcccccacccccaagagaaucgaguacccccugaaggcccaccagaagguggccaucaugagaaacaucgagaagaugcugggcgaggcccugggcaacccccaggaggugggcccccugcugaacaccaugaucaagggcagauacaacuaa

SEQ ID NO: 18037 - RNA, 2004 nt, Artificial Sequence
  HIF3A__Homo_sapiens__NP_690007
auggacuggcaggaccacagaagcaccaccgagcugagaaaggagaagagcagagacgccgccagaagcagaagaagccaggagaccgaggugcuguaccagcuggcccacacccugcccuucgccagaggcgugagcgcccaccuggacaaggccagcaucaugagacugaccaucagcuaccugagaaugcacagacugugcgccgccggcgaguggaaccaggugggcgccggcggcgagccccuggacgccugcuaccugaaggcccuggagggcuucgugauggugcugaccgccgagggcgacauggccuaccugagcgagaacgugagcaagcaccugggccugagccagcuggagcugaucggccacagcaucuucgacuucauccaccccugcgaccaggaggagcugcaggacgcccugaccccccagcagacccugagcagaagaaagguggaggcccccaccgagagaugcuucagccugagaaugaagagcacccugaccagcagaggcagaacccugaaccugaaggccgccaccuggaaggugcugaacugcagcggccacaugagagccuacaagccccccgcccagaccagccccgccggcagccccgacagcgagcccccccugcagugccuggugcugaucugcgaggccaucccccaccccggcagccuggagcccccccugggcagaggcgccuuccugagcagacacagccuggacaugaaguucaccuacugcgacgacagaaucgccgagguggccggcuacagccccgacgaccugaucggcugcagcgccuacgaguacauccacgcccuggacagcgacgccgugagcaagagcauccacacccugcugagcaagggccaggccgugaccggccaguacagauuccuggccagaagcggcggcuaccuguggacccagacccaggccaccguggugagcggcggcagaggcccccagagcgagagcaucgugugcgugcacuuccugaucagccagguggaggagaccggcguggugcugagccuggagcagaccgagcagcacagcagaagacccauccagagaggcgcccccagccagaaggacacccccaaccccggcgacagccuggacacccccggccccagaauccuggccuuccugcacccccccagccugagcgaggccgcccuggccgccgaccccagaagauucugcagccccgaccugagaagacugcugggccccauccuggacggcgccagcguggccgccacccccagcaccccccuggccaccagacacccccagagcccccugagcgccgaccugcccgacgagcugcccgugggcaccgagaacgugcacagacuguucaccagcggcaaggacaccgaggccguggagaccgaccuggacaucgcccaggacgccgacgcccuggaccuggagaugcuggcccccuacaucagcauggacgacgacuuccagcugaacgccagcgagcagcugcccagagccuaccacagaccccugggcgccgugcccagacccagagccagaagcuuccacggccugagcccccccgcccuggagcccagccugcugcccagauggggcagcgaccccagacugagcugcagcagccccagcagaggcgaccccagcgccagcagccccauggccggcgccagaaagagaacccuggcccagagcagcgaggacgaggacgagggcguggagcugcugggcgugagaccccccaagagaagccccagccccgagcacgagaacuuccugcuguucccccugagccugagcuuccugcugaccggcggccccgcccccggcagccugcaggaccccagcaccccccugcugaaccugaacgagccccugggccugggccccagccugcugagccccuacagcgacgaggacaccacccagcccggcggccccuuccagcccagagccggcagcgcccaggccgacuaa

SEQ ID NO: 18038 - RNA, 324 nt, Artificial Sequence
  HIGD1A__Homo_sapiens__NP_001093138
auggagcagaagcugguggaggagauccugcaggccaucaccaugagcaccgacaccggcgugagccugcccagcuacgaggaggaccagggcagcaagcugaucagaaaggccaaggaggcccccuucgugcccgugggcaucgccggcuucgccgccaucguggccuacggccuguacaagcugaagagcagaggcaacaccaagaugagcauccaccugauccacaugagaguggccgcccagggcuucguggugggcgccaugaccgugggcaugggcuacagcauguacagagaguucugggccaagcccaagcccuaa
